United States Patent 9,487,797 (GENOMIC PLANT SEQUENCES AND USES THEREOF) - sequence listing, part 10

SEQ ID NO: 20411 - DNA, 1501 bp, Oryza sativa
tgcgcctaaaatccgagtaaaatcagccccattttttgtggtgacagttttttttaaaaaaaatttggggaaatctgaagtaataacttagttcatggaattattacacattataagcatattatacatgagagtggtagcaatttgtaaagaaatctcgtatattgactaacttgtagagagagagagagagagtagaaaaccgtaaaacgactttacatttatacatttagaatcggaagaaagtatcccatagcaataacacgaaatatagtacaaagtgcacacaaatgttctttttaagaaaaaaagaaaaaaaaacattgaacatgcacgatacgcacgtggtggcatgtactcgattctgtctgcagggtacatgcatgccaatgcatgatgtccatgttcttttatgcgagtaattagctacaacaaaggttaattagaatgtgattcgatctgtactgtagaatccatatattggtaacacctaatatacttgcgagcggaaggaacggaacttcagcgttttcgactctgctctcacttcggtctcaatagttttagagtacatcctcactgaggatcatctatggtcgttagctggcgttgcttcttttgggatttccttgggaaggtagtgtagctctgctctccttcccgctaattggagttgtgtttagccgtcgtagtagtctcttcatttttccttttttttttccgtttttgtcttttctctcctcctttggcataagccggtctggctgattgcgttgtgtaaataaacactattgtcttctaatatattgacctgtaatttttttgcgtattcacgaaaaacatctaatatacacacacacacaatatttcagaggatgtactcctacatgtttagcaattggtgaacaaaggtaaacggtgcggatgaccaccagtgagcagctagcagtgcttcgaagttcgtaggagatatatattcttcgctccacaccacacagtatggtgtctatggaaccatggtgagttatcagttggtgagttcatgcgtgtagctgatcaaattaagatatagagaatacatagatcgaactagcttggaagttgaaacaaacaaacacaccgatcgatcgaaagtggcgtacgtcagccacgtgcgccagggcctcgacgcacgcacgcacgcgaaaacgacgcgacgcgcgctgcgtgcgcgtcgatctcctaaccacgcgcgcacacgtgacacgctccactccacggtagtggattatctcatgagagctaattaaccagcatcgttcgtcgtctcagctcgtaattaacgcgcgccgcgatctatataaacgcccgccatggcctcctcagtcctcactaccccaacccaaccacaccagtacaccacggctaattaactcgatcatctcatcagcctcgcggtcttcgcgtcgaacacctaggctacaactcgagctgcacgtacacagcgtcgcacgagcgtacg

SEQ ID NO: 20412 - DNA, 1501 bp, Oryza sativa
agtactcagcaagccacgggaaataagtgtttaatgcaggcttcaaggaaaggctgttgttttcgtaattgattttgtttgaactcttttctaaaaagtctaagtgagtgcttcccaaacgacacggatgagacagtgcgtctcgtccggtcggagtatgtgcaatgtgtcagtctttaggattgcaacaaggttggcacccggccaacagcttttcaaacggccacccgggccaacaacttttcaaacggccacccgggcctagctgatcccatcagctgcagatttttcaaacatcgaaccccttttcacaacagcaatttcacaagcagtagtcaaacaaaactacgctaggaatcacctcacatacgcccatgaccgtgggcacggctgttcgagcagtttgttaacctctgcagagggggtacactttacccacacgacattactaacccggatcacccagcccgtggggatcagccacgtcgggagacctccaagctttcatgacaaggcatttcgaaagccgatacaggtttaccaaatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgtttggatgaaattccaaggaatcggtccttaagtgcgagagcgggaaaccgtacacccggtacgttccccggtccgcggttttggaaattcatttagttcgcaagcaccgacccaggtgtcgggttttccaagtcttttgtaaaactccagttttacccaagttgtttctcagattttaagtttgaaggcgaccgtcgatactcgcacagagtgcacgaatatcgaggtgcaactgggtggttacaaggggacatggtataacaattaacaaaggaaggatcaaatgcaacaaattaggtaggtctgccaatctgccttgcagacgggacaacagattaagtgtgatcctatcaatgcataatatttcgcaagcaatataattaaatttcaaatataggctcaagatgttcaaaggtggcttgccttgctcgagatctggagcttgatcctcgaaatcctcgcactgcgggtcttcgggctccgaaactacacgcgaaacgggacaactcaacaaacggcaaaaataaagccctattaaagacctctaagcgtgccactagatagatctcgagatttgagaaattttagaagttgaacggagtcaaacggaattacggttgggaagatattgaatttctaagattattggatttttggtctaaaggaaaaaggatttatttaaatccttttgggaaaagaaaaagaaaagaagggagggagggaatatagacttttctaggacggctagggcgcggcccaagagaaa

SEQ ID NO: 20413 - DNA, 1501 bp, Oryza sativa
tagaaattacagtgatttgaaattaaaattaaaattagaaattacagttgtaaaaacaatttatattgcgtgtaacttcactgtaatttttgtgaataagctatgtaaataaatatgtaatacttaacattctagtaagatggtttcagtggacatgtatactaatttattccatgaattttgcaggaatgaaatttactgaaccagtcaaggttggatccatggagaaaaaaggtattgcaacactacactacttattcaagtacaaaacatctcacaatttcaaaaacttcaactacatagccaaatataataatcacatatataccactcctttcacttgccactcaataccaaacacacagaaatacaatcacatatgtgcctaaatacagaaattttaaaaatatatgcaaaaccattctaggctaacaatcataatttgacctaaatattatggccaaaaattacagtgctttatatctaaaattacatttgtaagttcagttgatacaacatgtaataaatccaaaaagtataaaacttacagtgatttataactaaaattacaattgtaaaaacagtttatatgacaagtaagtgcactacaaatgtggttcagtttataactaaaattacaacaatttatgactaaaattacatttgtaaattcagtttatttgtcatgtaagtacactataattttggtataattgaagtgtaacatgtatgtgtattgtaattttggtgcaaccacaatgtatttgaaaaatatattcatgtttgacataaaacatgcaaatgccacactgaacatatactgctaaagctcaatacatgctaaaaaatacaaatgattctcaaaagacatacctatttaacaaatcagtacctcatatacttcatttctcccatggcacaggtcgtgaagcaatacaagaaggagaaacaattagacaacaatcagaggagagcaaaaatgatgcaatgcatattgaaggaagcaaaagaaacatcaacatggctccaggtcagaaaatatatttgaataaattttgctctaagaataaataaaggtaactacaattatgtttgttgattctaacatatgctctaatgatttatataaattttacagggaggctggcatatgcaggaagtcctaatatctacaatttgcaggagggtgaaggaagcagcagcaaaatgccccatttaggtactaactaagtttctaaactaccaggtcgacaagctccaacaaaacaattgcaacatacactgatctaatattctgatctttatctttttcaaaatgcaggatgcaggaaaatacaacacgtaggaaaaaacttcaattcaccagaattaagcaataccataggaacaattgcatcagaagttgtcaattatggaggacaaatgctatatgatcaattcacattgctaaactcagacccaagacaggtacactaatcaaaaagcatagatgtagcatata

SEQ ID NO: 20414 - DNA, 1501 bp, Oryza sativa
tttatttactaggggattgagggagtatgatacagagaaagtagtacgtataacgtagtacctagtactagtactagtacatctgtacatgtgtcatgttcatgcagccggtggtccattcatccagaaatacatcgatgtagcaacatgaaacaccgcagtaatgcagtatggtgggagcgtcgccggtacgttcggaatatgaccatctaacttatttttctttggcttcgagacacttgatatgtggattcgttcgagaacggatcatatgtcagcgagacaaataagttagaagaaattaacaagggagtggattcagactctcatgagcacgttcccttgttatttgtatatcatttaaatgattatgaaaaataattcaacaagatagattaatatgtgataaatcactttacaaacaagcaagttaaaatttaacttctacaagttacaacaaaaaacaaatggaactatgactagttaacgtgtattcacggtcaaatttgtttttctcgttgtaatttgtagagtgatttatcacatattaatccatcttgttaatttttttaaaaaaatttcataatcatttggataacatgtaaaggataaaggaatattccctcaagagtttaaaatactttcccggatatgtgaacagttcctggtacaagtagtatactgaagttttttttagataatggaaatgggttacatctctaacctctgcccacaggcacacagccaaaaagtccagaagtgaatataaaagaggttaaaaaaggcgagatgggacaaacccccaacttctaccgataatatgatctactaaaatcatgttttttaaaatcacgtagagtctatcacaaaattctgtaggtactacgccatccaaactggagtaaaagttccttggctaccaattccaagcgtgtagcaccactgcgcatagtatcttgttgttcctgtgaaagcatcatacatcaagagtggagccaattggaacacatgaagataatctgcatgatgttaggcatttttttatggttaaaaaccatatcattatggcaacgccaaattgaccaacatagagcactagctccaaataaaatctttttttttgtctaggcactccccttagctagttaccaaaaatatcttttgcattgtggagagggggaatattgaaggcaaagaatacacatcgccaagcaaaacgtgcaacatgacagtcaaagaaaagatgttggatggtctcttgtgtattaaaaaacaacattgcttgtttcccctccattttctctttatgaggttatctttcgtcaagattaattttttgtgaagaaaccacataaatactttgatttttagtggtacgtttacctcccataagatcctcttgtggattctgttaacagtgaaatttggtaagcccaaagttaccatcggtttagagtcagtatcggcttcaaagttctagaatcagccgatgggagtcaag

SEQ ID NO: 20415 - DNA, 1501 bp, Oryza sativa
ctgattgttagcatagtcagttgtaaatcagaatatggctaaatgatctacttcaaggatcagtaagtttaaatcaatatttcctattcctagctatattcctcgtttgattgctacaagcattgacagattcctagaagcacagtgcattagataagtaactttcataaattcaaagcagttacaatgctcatcgcaagatgtaggttttatacaggatatcatacagcacgcaggggcgagtttcatatatagtaagtcgtactaatggcttggatttgcaaaaaacaaaataggaccacactgtcttgttgttgcttcattggttctgttcgaaaagggataaaatgcttcaccaatcaattgacctatagggaagtaaaaacagtagtgttaattaattgggaaagtggtttgcatacatgcgtacccaattaggcatgctgaagagcttgcacaatgggagttcctcatcataccgtccatgaaagagggaagacggtaatgcccacaaataaaacatcctgcatataccatcaaatcacacagcacaggttcaggataattcagttcacaactggccattctggccaatgtaatttctcttgctactaaaagaaaaataaatggctgttctctatatgttgaatagggagagacacggtgccttacaatattgccaagatgaggagcctaattggtcgaaagcctgtcctaacaatcaacatattcttttacaactgaaacaataatgctaatagccggattcttaacacgaaaatcacagaaaagaaatcaggtaaggttaattgcaagcataaacaccactatcttcaagctttcaaacgaacaaattccatcaaaacttagcaatgatataaaaatcatggacaaggttgggaggtgatatattgaagattttttttactatttccattagctaagctgcaagacttatttgcacagaaatcacactacacagagtcatcaagctttctaaagggatattgaattgatacatagaaaatataatagttgcataagttttgaatgggagtcgccaacctgataaatcatcacctatacggctccagataggatctcattcattgccgataagccacaacttgtggtactctgtaaaacaaacagatcgagaaagaatccatgtaaaatatcagaacctggtaagccaagtaaatcattagtaagaattaattgacgtgaagttgcatatcactgtccattaagtattctctattgattagcaagttgttaatcttattaactattattttaatctaagccaatgtaatttaatctttatgatgtttatcaaaaaaatagtccgtgcgacgcacgggttgatggctagtgaatataatgacagtctgaaaactaaaccgagggcaacaccctaatcacttgcctgtaaaaatgtgcaccctaaatccaggtataaagtgatgttggattgcaagctctatgagggactctgaac

SEQ ID NO: 20416 - DNA, 1501 bp, Oryza sativa
gctctggtttggatgatatatttgcctacctatttatcatatgtctatattaatctagttttagcatatcaatttagctctatcggctgcttctcgttttaggatttctgccggtatcggctaaatcgcgttgctagattagattagcttagatatctaccaccctgaaaactcagtcaacggcttgattgtctagatattatgtttcttttcatacttagtgctgcatcagttaagtttgatctactaagtcgtgcttagaaccataatctctagcttgctttttgactgccaataaggttttcatcggggtttcagccggtgagttatctggacgttgcatcggctcataaggattgcatatacatataagttggatttagccgatgacgacaaaggtttcactgtttaatctaatcttgtggatttcatgacatcggacctccagctgatgtatgctttaacattcggatcagtgcttattatattttgtttctagctgattggtttctactggattatattgttattttattacatcatcatcagccgattgccttcatatcattatttacattggacatatagctgattgcttaaaccctatcgctatcggctggtatcggcatcggctattatcggctatcagctggaactactccatcggcttaacagccgattggctgttttgatctactatttgcatatcttatcagttgcaggatcaaactgactggcacgcccgtatctcatcaacctttggacctgcactggagctaagcagatcttccaggccggtatgttcgattttttcgtcaacagattcttacattggaattgatgatcacattatacatggatttgacccaaaaatggccatttttatgtagcgaccaaataaagcaatccttttcatttgacagggttatgttagctagtcgagaaatcaaatcattccactcaactaactttggtcctacaattgatcgtcggaatgaaacatttaatggtgttgtgctcataacctctgccaaagtagaatgtctctttcgaatcacattgtacagagaaggatattgatatttgagtggttgcaagcccaaccatgtgtcttcccaaaatcttatttctattccattaccaggtttaaaagatccatactgaaaaaattgatcttttactttcattaggctagcccaaaattgggatgttcctggtttgtgtgacacgtgggagaggggaatagtacactggagtggctggtctctgttgagcatcagtgtggccactgaaaaatgtacacccacaccatagagcactctggttaacacgtttctcacggcgcgcgcgggctacaccgagcggagagacacttgcaatttccaaacccgagctaattatcgccatcgcccgccgcgatctatataaactccgcggcaccgagagccgagacatcccatccatccaagcacacgcgcgcacacgcacgcacgcacgtaca

SEQ ID NO: 20417 - DNA, 1501 bp, Oryza sativa; identical to SEQ ID NO: 20178

SEQ ID NO: 20418 - DNA, 1501 bp, Oryza sativa
acttaagcacatctgttaaagcagtgtgcgcatggcgtatgcccaatactttggaaattcctttattcacaatatacaagcttctttatagctattttgctatatcactcatcatattttacaaagcagttggtatatcactcggatcatgttatttggaggattcacaccgcatatgctatatattgatatcaagtcacttggttgattacgattatcaaaaccactcggttggttggattatttattccttgactatatgcttggtttgttcaattaaccacattgtcgggggctacacctattaggtgcatctagtcggtgcacctgactttattttccagccctccacagtcttcagatttggtaaaagtactcgggagaccatgacaaagatgattgaagcactcggctttggagtaatatggttcgagagaagattatcttttcgactgcgaaggtctcaggggctactgtggatattatgggtaccccatacccatacggcatggttatccgactagtcataggggataacttatatctatgggatatgtaatagatcatgactcgggtattacgtttccttatatattacggaacagcctaaagtcctggtttgataatattgtaaagtagatttaggaaaccgataccgtattggttaaggtttctatcttgtaatcctgccccccaccctatataaggtgggcaggaggccctctagggggcatgagacaacctgatcgtcagatcaatacacactcggcggattcaaatccccaaacaggagtagggtattacctctcattgagagggcctgaacctgtctaaatcctttgtcttcgcatccatccacttttaggtctcgtgcgctacccccttttattattgccgaattcatgtttcgacaccccttctcgctgacgccgagggcagcctccggatgccgtcgtccccgatatgagataggaacaaggtggaatcgatagattgtaactggcatgagttagtcgtggggtaagaaattgcttgtctccgtgctctgatttgtaaccttggtttgtcgtttattttcattgccgactactgcgaatgagttagagattgttgtaacaatcgttcgaatttttttgataatatgtactgtccagatttaccttctctaaaaatatgtgtgatgtgattatgcaccgtctaaaactactatgtaattcttgaaattgggacagtttgatatccattccagattgacattgcacaatattgtaaattggaaacagaaccgccggaacgggaatctaccgatatcagtcggaagtcgaaaagtcatgtcgtaaacagcgaactgtgacatcatcccacatttaactatgcatgaagatgaccttataatttcacccttgcatcatcacgctgccacataacactgttatatgatgattaatgagttgacaataaggtcaacaaacaatataaacaaagttcaacgatacttcaa

SEQ ID NO: 20419 - DNA, 1501 bp, Oryza sativa
gccacggctcaccgaataggcaatgccatgtcgacccacgtgctgagactggagcctaagcatggcggccatggcccaatgagatgttgggccatatcgtgttaggctagtacgtattggggtacatgtgttgtgccggaggtctgtagcccaaattcgacatataccaagaaaaaaatgcgaatagtccgttgcatcctgccacacaaacttgggaagatctggcgaggtcctccgctcaccgatagcacattcctcttcctcctcgtcaagcactgtcatggcacttcgtttcctacttccttcgtctcgaatcaatgagctgccaatgatcgacacgctcagtggttgtgctcacgactgggccggccgcaccactatgatgttgtctctttttcatgtacccttttagtgtaatctgttggcaacacctggggatccaatggaatccaaatctggaattttatcagatggtagtattggcaagaattcagttcgcgcataagggctttttggaaatcttcttcttggctgcttggcatatctagaagcaaaggaatggtttcatcttccaaaataatcaccccaccttccaatcgtggagattacttttcaaaaatgaagttcttctgcatatgtgcagaatgaaggatcctctcaaatagctggttttagactggttacaaactatataggaatcttgttttcgtttccttttttctctttgtaactttgtatatattcttttcatttataaaattacactgctgggcaaagccctggcagtttccccggtcaaaaaaaaatgcctacgttgatgagcatccaccatcgctttcctctaccctgagccttggcttcctcaattcttccgttcttctttgctccttgctcttgctcggatgtcagttgctcaactgggggttgttcaccggtcgtcgatcgtcactgtgtcgcatgggccagggcatgccgtgccattcgggggccatgtcatgctagcttcccacatacaacttgtcgtgcggggttggggtggcggcccaagcatggtatggttagatgggtcgtgccatcatgacccatagctaaacagggtgtaccattcctgggtcgggaactatacatacatgcccgggctaatacggaaaggcctagcccattttatatcctataggaagattcggcaaactcatagaagatgattagtaagctagatgttccacctctttatcttatatggacaaaatttatggccccatctttttgcttatgctgatgcttatcaacaaaaaattgaattttcaaccttaaatttaaagctgattttgagtttttttcatcgaagtttatttttcagccttcgcttttaggtcgctaaaaacacgtatgtaaaatttttattcacaaattacttattgtggaataagccaaacaatgaggccgttagatgtctggtactaatcacccttcctttaaaacttacactaaggctacacca

SEQ ID NO: 20420 - DNA, 1501 bp, Oryza sativa
ctcaaatacaagtattatatcttcaatttggacttgctccggatacatgcaacatgaattcatgatcatgggtctattttatatgctcaaagactggactatttattattccccgtaagggttatcaactgaatacttgcgccagtcgggattcaattgttacatctattttggagtatcccataagggataaccactcagatcagaagctattcatatgagctacgcttggtctatattacccggaagatttattactcgggagcatgttatatgcgtcatcctttaaagggtgtcgaaggcatatgttttggcctaggcctaatatgtctgcagcccatattttcaggtgtggcctgtcacgttcttttagggacttaggcactttttgcttaggccaaagtgcgcgtgatcaagtgcccaataccttaaaatccttttataccgcagttacttaactttttaggagttggtacaatgcatcttaaaaggtgtcaaatagtaaagctttatatagctgtcccgctgacttttttatatataagtcaaggtgctgtttgggtttttaagcaattgattggatacaatatcattgcttttcgccacgtaagtgtgcatttttattgaccaatattatggcttaggctgattatatattgtggtcattttctaggcggttggtaaatcctttatgagtttatttactcggattttacaccacatatgccatatatttctaggtgtggtgaaaccatgtgtcttctagggacttaagcacatctgttaaagcagtgtgcgcatggcgtatgcccaatactttggaaattcctttattcacaatatacaagcttctttatagctattttgctatatcactcatcatattttacaaagcagttggtatatcactcggatcatgttatttggaggattcacaccgcatatgctatatattgatatcaagtcacttggttgattacgattatcaaaaccactcggttggttggattatttattccttgactatatgcttggtttgttcaattaaccacattgtcgggggctacacctattaggtgcatctagtcggtgcacctgactttattttccagccctccacagtcttcagatttggtaaaagtactcgggagaccatgacaaagatgattgaagcactcggctttggagtaatatggttcgagagaagattatcttttcgactgcgaaggtctcaggggctactgtggatattatgggtaccccatacccatacggcatggttatccgactagtcataggggataacttatatctatgggatatgtaatagatcatgactcgggtattacgtttccttatatattacggaacagcctaaagtcctggtttgataatattgtaaagtagatttaggaaaccgataccgtattggttaaggtttctatcttgtaatcctgccccccaccctatataaggtgggcaggaggccctctagggggca

SEQ ID NO: 20421 - DNA, 176 bp, Oryza sativa
actcgattatttgttaaagatagcaccttttgagatcatagctgttttgtgcgcctggatcataggcttgtagtttgtccttttcagtctcttatgttaatgttgtacttagtctaaaactgcatagacattctgcagaaaaggcatctttcctgattttgttagtttaatgcaga

SEQ ID NO: 20422 - DNA, 158 bp, Oryza sativa
ctaatcccgccggcgccattgatggagcccgagagcgccgcgccggttttcttcccctccggccgccctctcccccttccaacccaatataaaccctccccgcacctcctccgttcgtttccgcctctcgccgcccttcctcctcgccggaatcgagc

SEQ ID NO: 20423 - DNA, 1501 bp, Oryza sativa
taattttccctccctctctcccttggattcgtttggaaaccctcccctaatcccgccggcgccattgatggagcccgagagcgccgcgccggtttccttcccctccggccgccctctcccccttccaaccctatataaaccctccccgtgcctccctcgcccgtttccgcccttaccgcaccgtctccccgccggaatcgagctcgcgccgtcgccctctctctcctctgtcgctgacgacctccggccggtcttctctgctcgccgggaccgtctcccgccccggcgtcgcctcctccggcttcgccgcaccgccgtcgaccccgtccaccccctcgccgagcccgcggaccgccggaacgccgtcgaccccgtcgacccgagccgcgccgccgccttcctccgctccggccgcctttttcgtcgtcgccgtcgacctagggtgagccaaggatcgccgcctcttttcccccttcccttcccctctctcggccgccgctccgccgtgcctatggccgccgccggcgaccataggggcgcgggcgccgcctctcgtcggccgcgccgagtggccgccgcgtggggcccggccatcagccgcccgcgccctcgagtgcggctgacgcgtggggcccacggcgcaggccggtgcgagcccgggtgcgcccggtccaccgtggaccgtgaggctgccgtgtgggccccactcctgtggacccggttcgcgcgccccctcccctcggctgacgcaataaaccctttttaaattaaaatttaaataaagaaattcacaaatattcatttaaagagcatataaacttcaaatggccataacttggccatttgaactcagaattggaccgttcaagtctctaatttttccttaagaagtcaagaacccatttttatactttgttcctgcttgtgatatggagtttattagagtaaaagcccttttattttccattggtcgtgtagacgttgcagcttcggaagatccgctcttcgtggaggttgaagccgacgtttgggaaagtgagcaaggcaagtcacatcattcttgagcatattgaatcccagtttataaaatttttttgatttaaattaatgcattatcgctttatttaaattcctgcgttatcactgttttatttagccatgcctatttacctttgttatgaccttattattattgctaatgttattattaccttgttcaccctaggataatcaaaaccccaactagtgggtactctattcatggttccactagtatgaatttaggtagatgcttcgctgattaattaggcaacattaggtggttttataactttagactttgggaattctcatatcatttggacactatggaatagttggcttacgttggaattggacacacacctccccctctattcaaaaccaccaaaatggttttaggctgggctcgaggtgcgtggttgggttttgttagtcgtacctcgggtactataaggattaa

SEQ ID NO: 20424 - DNA, 846 bp, Oryza sativa
gatctagcacgtatcggctaatactccgatatcactctatattaagatattaaggcaagtagaatatactaaacaaaagcctaatatacttaaatgcaataagatctcgacataaagggcggatttaacatgtcaatgaggcatataggacaaatatagctaaatcagataagatcggctgaaaccccgatactaccctaatcggcaaccaaagacaggctagagattgagattctaatcacgatgcataagatcaaactcaactgatgcagctataagtatgaaaagaaggacaatatctagacaatcaagccgttggatgtgtcatagagtggtagatatcatatatgatctaagtcaacactggtatttaggctaatcggctgccttctattgacagatgttagccaattgtaggtttgataccgatattgccggagattatgtaagatataagataactcgacgaattacataaacaagattagagtgtcataaagatagaagcactaatcccgagagcgcaagccgccataacaagttttacctcttgttgaagatcgaaactgatacagctcaacccgaaagcaagaactcttcgaaataaaactaaagcaaaaagggtggcgatgcgccgaaattgtattgaacatgtgttgttttattacatggggttcggggtctatttatacccaaaaattacaaacaatgtccatattggacacgactcttatctctaacaaactctaagataccataagtctttacggcagacttttgcccaaacatatctctaagcaaattacttaaaatatcctaattaatagatacaattgccttctcagg

SEQ ID NO: 20425 - DNA, 1501 bp, Oryza sativa
ggaagactcttgagtgtttctcgccaacgcacgtctctatcgcatgagtttctccccattctaatacggataatttcaaatttctattccatcacttccgtcttagtgtccggatttctcattgcctaacgcctctgctgcatcttgtgctgccgcctgcgtcaggtactacgaactactcaccacggcatagattaaaggagatagagagggacagaacaaaataatggtttggtgagatgatagtattaatcagtatataaaccagcttatgacattcctgcgcgtggagaacgtgtgattacgaactcttgtcgtcaaagacccactccacaggaccacagccttgtctgtgtattttttttttagaatgaagaaaaaatgaattttagaatgaagccttgtctgtgtattggaaaagaataaagatatttttatttgcctcgtattctcgtgtaatggcatactacacctactctatacaattaaatggtactgtgttaaggaatgaggtaaacatggcatgctgattgagtttatgttcaggtaagctatgagaaaatgactcactgatttgtttagatgatcgattaattgcattacttgtttatttagtttatttaggctgagttcttttctgcatctccaaataacaacttcatttccgttatcatactttacgaactactacacaatatatttcgtgcaacaaatttctatatatttttctaaagtgaaataaaatctatttttaattttatagtagttaataattaattaattatgctctaatgaactttatcgttttacgcatggctgaatattctatgaaaaacatgcagaaataaacaggcccttagccatgctacagtgtgtttttcttttaaaaaaagacgtggacataaacccgtttataccctcatcatgtacttgtttgtttactaaaattgtaaacgagaatctcgggaatcagttgaataaggcaactgaatctcaaagctttcgttgtatcgagcgtacatgtagcaaaaaaggaaaatattccttttcccaagttgttttctcctcctctttcttctttttaatttaactcggctatctttataccatggtaaaaagtgaaaccctccacgtggatcgctataagattctcctccccctcgctctcctcctcgcctccccccacagcggaagaggattccaacgagaaggcgagcgagagagaggagaagaaaccaagagagcgagggcggaggaagcagtcgagctctcccagcctcggcggctaaactccccccccccctcgctttcttcccctccttcctcaatctccaagcctcgatatccgtgttcttctctgaccgaatccgaatcccgcgtttctttgttgcgcgcgcgaccgcccgcgggaatcttggtggttcttgggcgatcgtgatggcattggatggcggcggcgaggttggcaggaggaggaggaggaggggatggggaggcgggt

SEQ ID NO: 20426 - DNA, 1501 bp, Oryza sativa
ctcgttggtcccttatgacattggttacgtataatgtcaatctattgaattatatttatgccgttctattaagcacatttgattatacggtttggtgtttcatgtgttgtgtttagacttttagcatttagactttgttcatcaatatatgtttttatgcatgaggatgcactgctacatagtagtgggatgtgcagttctgaccttctcatccaccttcattatagttaagttcattgtacactttaatttgtttattcttctcagtccacggcgaagctggggatttaactggcattcgtagatttcttggatttgggattggtttgcagcctgattcagactatatggacattggagggtgaagcttggtgagatgctatttatctgtattaggacgtgtgtatttcctgtgtgtttgttactttatataggatttagaataaaaagcgggcagttttatgtgcaggggtgcttttggaggcagatacggtcttcatccacccgacggtagatccgagcatgtgcatttgtggcggtgcgaggcagcaggcagcggccagtagcccgagaaccccgacctcgatgccctaatgggcgtcacgccatatgtgacggagatacgcgacgaattgggggtgagccagggagactgcgcgaaccatgatcttgcgagttgcgagcgctgggcctggccaccgttttcaggccgttgggcaagctaggaggcaagaccttggagacgggaagctgatctacttctccagtctccagttatgtcttgcaattcgtaactcccttcttggctgcggcctacagccctacagcgagtggtatgactttattctttctagatttctagcatctgatctatttgtcgattaaggggatttaacatatgttaattgatttactagcagttcaagtgacacccccaccccaaaataactagagcacgaatcaatcaaagagccttcgattattactttatcctaaagagatatttgctgatcaaacataacaaatacaatttgagaactatgcaattatgcttctaaaattagagatgaagtgaggagggcatatttgttgaatgaaccaaataaaacagctgagtaattattttttccatttcatcatgtgcacatcacattcgacatgtgtaagggcatatgcttcatttttgttttactgatttgaacttagggttcgagcccatcctccattctcaacctggatttgccactcatcaagcctcaaggaaattggtggaggttggccaacgtttaccttctactgcagaagcttggtcatcgactgcgtgccttggtgctgtcttgccatagctgcggctgcttgccttgatctgttcacttcttagtttgctaatttcaaacgcgaaattggttattagtggttccgttctaatagctaaatattagagattgatttcaccgagtctacagcttgccatattcatctattatattattaaaacagc

SEQ ID NO: 20427 - DNA, 1501 bp, Oryza sativa
caatttctataaagaatactcgacagggtagagctactgtgtaattactcggggtttaatgagtaatgaccccggtgaagtttcctaaatcccatggtaaatcatgttagtcaccatatataaataagaacagagtgactccatggtgcaatatgagtgaccccgtgaattttctgtctggatagatccacccctgatactcgatattgttgagttttgtcggggtttaaacatcttttccttctctgctactagtctgagagaggcgggcgatcgagtgcgagatcgtcccgtgattctggggagtttcgcgcgagcgatatattgattgctagtagctacttgctgttgatttatagctaaaaatatttatatttaaggatgaagggagtaggtggttacattgctggcattgctgcgcgatacaataatggatcgatcgatcgagttgcgccaatgcaacttgcgattattcagacatgtacattcagtgcagtgtgcaagtggccggccgtgtgatcagctagcaatatgtactgtttcgtgtcacgatctctgatgatatgtgatgatcagctgccatgcatttgttgcaatgacgctgcaggctagatacgcgcgtagagtctctctctctctctctctctccctccctccctctcgtgatctcgtgtctgacgattagctctcgcagcttcacactgcatatgaatagctgaatatgtagcgcgtaatctggcgaaaaagttccagggggagaaacacagtacagtacttggagggtgcatgtcatctgatcagacgtgcatagttagtgatttgacctcatgcgtccttcttgaacaacgtgtatttggatctaagcaggggcggatatagaacaagatttaagagaggactcatcttcttctttcttcttcagtctttctactctttattttctccctgtttttctcctttcatcttcaattctatcaatggtaatccagcgaggtaaggaggactcgagtcccctcagcattcacgcttgattcgcccttggacctaagtatgctcatggtgatggctagctgctaatagcttaactaattaagctgctcaatgacgagaaatgaaccatcgtttaaacatcccccaactcttcttcaaatgagtaaaggtatccatgatggagagatcgatcagaccatacactgtagatgacgattttttgccgtgaaatttgggagatatttatggctacaaaacgagggaaggcgatggttcctcgaaatccagacatacagtcatcattcagcatgaccatacagtatacacactatacatgagaccggcaacccatccagggttccagcgaatgcggcatcgaggcatggatcgttggctgctaattggctgcatcccatgccgcccccgggtcccgcccctgccggtactttggttccatatttattagggtgcagctatacaacggaatcctgttttcaaaccgaatgatccc

SEQ ID NO: 20428 - DNA, 1501 bp, Oryza sativa
attgtgcaagctcttcagcatgcctaattgggtacgcatgtatgcaaaccactttcccaattaattaacactactgtttttacttccctataggtcaattgattggtgaagcattttatcccttttcgaacagaaccaatgaagcaacaacaagacagtgtggtcctattttgttttttgcaaatccaagccattagtacgacttactatatatgaaactcgcccctgcgtgctgtatgatatcctgtataaaacctacatcttgcgatgagcattgtaactgctttgaatttatgaaagttacttatctaatgcactgtgcttctaggaatctgtcaatgcttgtagcaatcaaacgaggaatatagctaggaataggaaatattgatttaaacttactgatccttgaagtagatcatttagccatattctgatttacaactgactatgctaacaatcagcatattctgatttatgactggaacaataattctaatagatcaacttctattaccatgttaatcccaaaatacgttaattgttagcatagatcagcttcaaatatgctaataatgcaggcaaaaattgatgtcctgtgaagagtactatatcaatgctatatgctatacccatccttttcctgtcaacaaactgcagtatccatccccatggaaatcaaccatttacaagttatggtactactgtttgctaattagcttttcatcttagatggtcatcgtgcacactgcacttctttgtaaatataacatacctcctacgtatctagcagttattagagactgctaactaacaagatgcttatgtgtagtgaacaatccagtatgttatcgttgtcttatattttgtttctgatatgtttatttacctttcctaattttcagctctttctgcaaatctactcaacatattatcacactcttcgcaccaaccacgcataggccttcatgaaacaagacagagtggttagctcttccgtttgctttaaattcttttatgccttcagccaacagctgacacccagttttcattacagtacttttcgacgaaatactccatagatcacatagcgccactcatggacagcgcaacagtggatatacaagttcaagcattggaaggcccttcaatcacaatggttctccacacatcaacggatcatcgttgcaacttaaaagatggatggacagactttgcagtaaacaacagcatgaggttgctcactatgcattttcatttctacaagaaaagcatttgcaagcaaccatagatatcttctgaagaccgtactggccctgccatacagtccttttggtgccatcagggttcgctctccatgaaacgtgatgctaatatcttatgatatcaatatggtgttaattagccttgtgccttataaggccatcgtgcagactgcacttgtaaatctactatgccacccacatatttagccactgttataaggaccaaataggcaacatcc

SEQ ID NO: 20429 - DNA, 1501 bp, Oryza sativa
cagtgcaacttaaggactgatccaaaccaaattcttcacggcgtatggtctcaataactagagttgcttcctcaggattcacttctcccaaggtgggagatttgttagtaatgaattctgcagtatcaagctttgctgtgacgatatttaatacattttggtttttacttacagcaacaatttgattatccttgccaggcaatgacttgctcctcttcattatatcaacatcagtagcattaagcaagttagagttttcgcatatagcaactccagatgcagttgatggatgcctagaagaagcatgcatttctatatttgcatgaatttcgtcagttaaacataatctgcgacaatcttcagcccattctgctactccaagtgataacccaatatcatgaagcatgcacagctgcccggtttcagtggcttcaagcaagatggctgaatagcaattcttcgtgatagttcgaagtcctgccaataaaacatctgctgcaagactccggaattcggaaggtagatgaccaagacagtcaagtacaaatttggcaaccagatgaactatgtcgtcaatgtcttttgacatatcagaccaaatgttccttgcactaaaggatttgccttcagatttagtgttcagcaaatcattaccgttgtccattatgatgcctattgctcgttgtgcataacacttcaacaaggaaattggagtgttggtagaaccattataaacatgtagcaaggaaagcagcttcactgccacttggaatggtgaacattgaataatgccttctaaaaattggtcaacagtagcagatggatcaactctaataaacctaccatctgtggtcacgatgcaagctagatcttgaactgggcctgtattcagcaaccagtgcatgaaggaacccagagagggagcaaacaacaaatcccaatgcgaccaagtaagtagatctgacagcattggagccttaagcaaacatttaattgcttcttgtgaggagactgttacagaacaagattgttgaatatcattcattagcccatcaacggtatcatggttacctggaacaataccagaccaccgtttctccaacaaagacatagaaaacatgatattatttatttctatgtttttcctttgtctctcaatagaatcaagaagtccttctccagatttatcttgcacaatatcaaagctaatagttggaaattgccttttgagaagcttagagaaactatcctccgaaaactcaccatcttcaagccaattacccccagcttggcagagtaaaacctcaatctgttgctgcagtacagaaacttccactgaagaatgtgttaactttccgactttcaagaaactgctcaacttagggggtaaatgttgctcatgtttccccaagaactcgaggaaagtaccatggccaagagcgctaaattggttggctgaaaatttagcagttatgcatgtttcacaatcgagaagtgttct

SEQ ID NO: 20430 - DNA, 1501 bp, Oryza sativa
ccacaacaactgctgccacacccaattccacccgtcaccacacctcggcagctggatcgtcgccgtcggcgctcctctcccgcgaggcagaggcggatcccagcgacgactgtccgcgcgcctaggtcgtcatgcaccgcgacggcgagtgccgccgcctaccccttgtgccaccaccaccccgctcttgccaccgccgctgccgcctcccccctcgtgccaccgtcaccgcctccccccttgtgctgccgccgccgcctccccctccgccggatccagtggaggagagggctctgccaccgcctatcggtcccggctacgatcggagaggaggtgtaggagatcggagagaggaggaaaaggagagatagaaagagagaaagagaaagggttagtggatgagggggagaaagaaataaggacgacgacgcgcgctgctctctccctccccatgtggctcgactgtttttttaatttttcgtcctggttggtttagacaaccgggactaaagatagtgggaggcttgacaatttttgaaccgggacataaaaaatgatctctagtcctgtttgatgttaccaactggaactaaatatcaaaaaattctgttgggcttttgaaccgggactaaacatattctttagtctcggttcctattcgaatcggggctaatgtgatttttgtcatccggacaaatatcaattctccggtagtgtatattgatgtattaaaatggaaggggttggatattggctaccagaaattatttttctagctaggagaaaaagagctgcgatatctaatccattttttcgaccactaaagcatctagaaaccctgcttcactataccgaacaattcttatcaatgggaaagtctgtaatagttatccaagagttctgtgtagaagggctatcatgcaacggatcaaacgtgtggatagcacaccatggcaccacggagatcgatatccacttctgtcattccatgtaaacgacagctccttctcccctttctagagttggttcgatttggagaaggggattgaaaaaaaaaagagtaaattgcatcgccgtacatgaacttgttaggtggtagcaatctagtgtacgaacttataaaacgcttgttctagtgcatgaacttgtcaggtgcgtgtggaggaaggcgaaaagaacactacatggataatcttattgattttgtgattgtagaaaaagattaaaaaaaagagcaatgatataagggtgggaaagatatgaaatatcatcacttccttgatgaaggataaagtagtgatcaaatttataaataattgcagtcttatgcaaacgcactatacatatgcacgtcacaccctaatcaatatcagcttcgtaagattaatattgccaagctattttggctctcgtttgcacgaaactatacaagttcgtgtaccgaaacgagcattttacaagtgatgaggcatcactagattgtctgtacgcatggtttggt

SEQ ID NO: 20431 - DNA, 1501 bp, Oryza sativa
tggaacaaagtttcacggatcggagtttactactcgggtacttttgcaattattaagagcagaaaataaatttatctcatctctatgcttttgatttattccgaatagtacttagcaccttgcgttactcggtccatccaacgagcccccgggtgctaggaatcggcccaaaggcaaccatccattggcaaaccaaacggaaagcataggaagatagaactccataactcgataggtacttttgtactcagattatgtcgcaagcaatcaagataaatattatgaaaaatatgatataacatctgtagcccccgactcactactcaatggaagaccaattggtgtagtgaggcagaggaaaaggaaaaaatatcatataaagaataaaataaatgatgacttagctttgtaatattccccttggtgatggcagaagtggccaatgtgggaacaaagtcgtccatcaataacaatgaagacaccagttggcggcgacgaaggcggtcgacggtgaaagcgaagatgcccactaatggcggcatgataggtcagccgtgtaagcggaaacaccagtcgacggcaacgaaggtgagccaacggtgaggatgtagacatccaacaacggcggcataataggccagccgtgtaggcggaggcaccactcggcggcgacggaggcaggccggcggtgaagtcgtagacgcccaacagcggcggcataataggccagccgtgtagacggaggcaccaatcggcggcgacggaggcaggccggcggtgaagatgtagacgcccaacaacggcggcataataggccagccgtgtagacggaggcaccaatcggcggcgacggaggcaggccggcggtgaagatgtagacgcccaacaacggaggcataataggccagccgtgtaggcggaggcaccaatcggcggcgacggaggcaggccggcggtgaagatgtagacgcccaacaacggtggtgtgaccaaccaaccatataggcgaagacaccagtcggcggcgacggaggcaggccggcggtgaagatgtagacgcccaacaacggcggcataataggccagccgtgtagacggaggcaccaatcggcggcgacggaggcaggccggcggtgaagatgtagacgcccaacaacggtggcataataggccagccgtgcaggcggaggcaccactcggcggcaacggaggcaggccggcggtgaagtcgtagacacccaacagcggcggcataataggccagccgtgtaggcggaggcaccaatcggcggcgacggaggcaggccggtggtgaagtcatagacgcccaacagcggcggcataataggccagccgtgtaggcggaggcaccactcggcggcgacggaggcaagccggcggtgaagtcgtagacgcccaacagcggcggcataataggccagccgtgtaggcggaggcaccactcggcggcgacggaggcaggccggcggtgaagtcgtag

SEQ ID NO: 20432 - DNA, 1501 bp, Oryza sativa; identical to SEQ ID NO: 20178

SEQ ID NO: 20433 - DNA, 1501 bp, Oryza sativa
gaaccaaaggtgggttattctgaatgtgccaagttagttttctgttattttcacttatttgctcatttcaatgtactgagtaatctgtttactttcaggattatattcacagagttggacgtactgcacgtggtgaaaaaggcaaaggagaagcactgttgtttttactgccacaagaactgaagtttcttatctacctgaaggtagtactttacaaagtaatatgttttctattttctgaagttaagagaaattataacatattatattggtgcctgcaggctgctaagatttcgctgacagaattagtgttcaatgaaaacaaagtgccaaatttgcaatcgcaccttgtaagtgttttttcacagttagtgagttgttttaacactgtttgtcaaatgtgtctagtagtaataactcaagttgttggacaggagaatatcgttggcgagaattatttcctgaatcagtcagctaaagaggcatacagatcctacatcttggcatacgactcacactccatgaaagacatttttgatgttcataatctcaatctgaaggtacactgcttattgaatttctttctgaaggatttttggttcccctgtgcatgaccaattgttacccattatatgctttgttgtattggacattcaattcacaacaaatgctcttcattttggcatgttccaaatcttttaagtgtcaagtggagtgtctgttgttttttcttcaattttagtagtatttagctctcttgagagaaaatggtatgtgctaggtaagtgatgataatttatcatctttaacttttatataaagtatgtgctaggtaagtgatggtaatttatcatctttaacttttatataaactaactgaatttcttctgcacttttttactgagctagattaaagtttatttttctagtatataatttgttttatgtgcttatggtagtgaatctttgttgtatttttatctttctgttttacaaacccaccattaataaatcttgattcagacagatgggtctaaatcctttctatctggcaggatgtggcagcgtctttctgttttaagaacccaccaaaggtaaacatcgatttggagagctctgcatccaaacatcggaggaagatgaggaaagtggacggtggaaggaggcatggcatcagcgctgcaaatccctacggaagaaaaggcggtgatgacaaaaggcagtttgcaagattctagagatgttcaatacatggagtctcaaaagacccttggccctatgaaattttgatagataacttatattatcgcatcatgctataacacaattattctgtccaatgtatccacttagtctagcactcgagattgttgagaaatgagaatgaaatcgtgtgccaaattcattgctggtatcctgaatcctgatgtttgcaattgacagcgttctacaaaatgtataaagacgggtgggctatttatgtcagactaccactccattg

SEQ ID NO: 20434 - DNA, 1501 bp, Oryza sativa
aattcaataaatcatttctttaatccagaaaattcaataaatcctttttccgttgttccacaaatattttccttcctcccagaaaattcaaacaaccttcgtaaataatttctcttattcccatcggataagtacatatcctcccttgtccacaaaatttccacaaattgttttccccgctccaaagaatcaaataaatcatttccttgtccagacattcatttaaagcctccaaaaattcatatctcccgatccgtgactccgattgacctcgttccacttccagtaattccgtaaaattgtgatctatctaatggcactattattttagtctaaataggatccttttctatttggtccttgtttagatttttgattgtatgcgcctagttgcggttaccggatatttttcgtcaagcggatttctcgaagattcgtgaagaccctgagcaaggcaagccacctttgaacatcttgagcctatatttgaacttaattatattgattgtaaaatattattcattgataggattgcacttaatatgtttgccccgcctgcgaggcagattggtgggcctacctaacttgttgcatttgatccttccattgttaattgctatatcatgctcccttgtaaccacctggttgcgcctcggtattcatacactctgtgcgagtatcgacggtcgcctttaaaacttaaaatctgagaaacatcttgggtaaaacttggtttacgaaaggattggaaaacccgacgcctgggtcggtgccttgtgaaagaaaatgagttttaaaaataaaactcgcgacacaaggccattcctgggcggaatgcttgtgcggtcacatttaaggaccgattcctttggaattacatccgagcatataacaagtgcgaccacatgggtggaatgggacacccctggctgagtaacaagctaggccagggaagccttgatgccaagagacaagtggattcgccggggtggtgtcggggaggacccctgggcttcatggcacagtatggtctgggacctaacctgttgttggtccgggacccctctcgttggcatatggcaaccctgtgttggctttggaaatgccttgtcgtgaaagccccaagtcaccagacgtgtttgatccgcacgggctaggtgaccaaggctagtaacgtcatgtaggtaaagtgtaccccctctgcagaggttaacaaactgttcgaacagccatgcccacggtcatgggcggatgtgaggtgattccttagcgtagtttttgttttacccagctttgtgaaaagatgttgaggtttgggaaacctgatgtttggataaagcaagcggatgtcagggagacagcgggacagggagtccctgagaatgactggttgtttggagacaaccaaaactctgaaagattggaaaattggtttggtttgggaaaccaactttgaggccaactctgggagttgtgtaaatcttgcaaatcaaatttggtt

SEQ ID NO: 20435 - DNA, 1501 bp, Oryza sativa
cgtcgtcgtcgttggcggtggcggcggtggaggtggcgggggtgggggggctaggctggggcacgtggagacggtcgacgggtccaaaaaacaagggagaaaaaatttcatgtcatcgtccacgtggcgtgccacgtaggcaagaccacggtcaaacgcggttttggactgggatgatacaataaaccaagtttaggaacctcgaagtgtactttgcaagttcgtggacctaagtgaaacctcctgacaagtttaaggaccgatggtgcattttactttattaaaaaaatacaatctatgctacaaggaaagacaaaacaaagcaacaaagttttttttttcacaaacatgcaaagcatgtcgatatcaaatactcctctaagagtgatgtaccaattttggtctcgaggactgtaaaatttctcaatatttaaaggtacttatggtgtaacttttttgcaaatgtgcaaaagcttttaacgtcgatatcaaatatacaagtgtccttaggtgtgttctttagtactccctccgtactcgtaaataaagtcgtttaggacaatgtttaagttaaaccttgggaatataaatcatgaataactctcgagttgttgagtttaaaaatgtaaaaattatatgaatagatttgtcttgaaaaatactttcataaaaatatacatatatcacatttcaataaatatttttatagaaataagaagtcaaagttgtgttttggagaccgtgtcgctgtcttaaacgacttcctttacgagtacggagggagtactaaatatctaaggatacttttggtgtgtcaaaaaaaataaacaaaaagaaattaactagttatatcaattagtgcaatgctatatatctagctatggcccatggatgactggatctcccggccttttcttctttccaccatcaattggtcgctgtcagcaaagtgtccctttctccttcagaaagcgatccactcctcttcagttcaggagcttggccgccatggcgccaccactcgattaaatacactcgagccgtcgagaattgctttaagttttctacgaaagatgatggccttacagctcagatataaaaacgacaacggacagctaatcagatgatgtttcagtctccaatttcgtcagtgatgacaagaacgcttttgtgcgcacacatctttttcctacgaacacgacatgatccgatcgcatcagtgcgatcaacggttacgattttccctgtctcttacctctggaaaggtaagatcgatggtgcactgccaaaaagcttgacgaacataaatgcgaaagtttggcactaacaaaaacgatgcttttatgagtttttggtagagtttttgccctctgaaagtctgaaaatctgaaatgcacgtgaacccattatgcaccaaagtgctcacaatttggtctccaattcagcaactttacgcgtgtacctcactactttgtgagtgatcgatatcactgatattttt

SEQ ID NO: 20436 - DNA, 1102 bp, Oryza sativa
ccatctcaccaaccgggactaaagatcgatttttagtcctggttatttgaaccggaactaaagatagcgatctttagtcccggattcgtagtcccggttagaaaaccgggactacagggggttacgaaccgggactaaaaagcacttctccaccagtgtcccctgtcgtcagttgcgtccgccttgtccaccacggccgtctcctgcgcccgccgtcttctacgtccgccgcggcgaccagcctcgtccatcgtcgcactcgtcgcctgtatccctggcaggcttggctgtaaccttcatcgctgcatactttgcatatgcaggcaaaagaaacgaagagaagtaaagaaaggaagagaagctgagagaaagaaagagaagagacaggataagactgtgggacccacgaaaataataaaatatttatgttgagtaaacataaaatttcttcatggtacatatggactataatgtctactccctccgtcccagaaaggaggacgttctgctcctaaccatttgtcccataattcttgacgctggcagcctggcagcctggcaggcactagcaaactcctagacaagcacacataaaaaaaagggtaaataaaaaaaagaagtggggccatctaaaacagtactagcgaactctttcttctccaaacgatttttgctctgaagcgctaccttatcctctcctctcgtattctcttcttccccatcgctcgtctctcgttttcttctccttccacgccgcgtcttccacaccagcaccccgcttctccctcccatcagcacaccgcaccaatccccatccatcccccctcccccacccccagacgagcaagccatatccggtgtgcgacaacatgctcaacggccgcggcaacactgagagcgccatcagcagcaatggcggaaaccctaggggttgcagtggcggcgaacctaggggctatggcggtggaggccgtagggatggctacggcgctggctttggcgagagatcgggttgtggaggtgatgatggaggcggaaactgtaggggccgcgatgttggaggccctaagggctacaacagcagcagccctaggggtgcagc

SEQ ID NO: 20437 - DNA, 1501 bp, Oryza sativa
gacgacgtaatgacgaagacatgccgtccaagaagatcgagatcgatcatctcatgacgacgacgcagatgcgaatgacgaacggaaaaaaaaacgggtggccgccctcgttagaaacaatttttaaatcaacttttaaattttctaatatttaattactctcaaataactgttacgaactcagtttgtgctatcatccatcaaagggatcgggctgagttctttctccaattttcctaactcatctccctcatttttcacgcgcacgttttttaaattgctaaacggtatgttttttataaaaattttctatatgaaagttgctttaaaaaaatcatattaatcgatttttcaaaaaaatgctaatatttaattaatcatgtactagactgctccattttacgtgcgtggaacgaacacagcctagtccatagattttgggcaaatgagttactgacaagctggtacgtgcgtactttcacctctcctgaaggaatcgtaatctagcgtgcagtagtgctggtaaactatcacacatcatgcatcttaatgacgcccctaaaaccaattaattttctaacagaatctagctttgtggtaccatactagtttcttaatacagtagtatgcgtaatcgtgcacgaatttcacaggaacggtgagaattttcccgtgtttcatcaaaccaaacgtttgcattgtatatttccatgcatagcgttcatgctgaagaaagagatgcgtccttgaatctacgctcgattgcttacatgttttgttttcttaccgtgttaccgtttcactaaatgagtatctcgcgtaacgcttgtcatgtagtactaatgtgcaagatagtaactccactacttgaaatcaacaaactcactcgtacgttcggcaatggcttgcacaccaatttcaactttttcacggcacaactcttcacataggacaataaacttttcgcattgcaagctaatacaaaaaacacaagaactaaacagaagcagagtatgctagaagaaaagcaggggaacaaaatcagtgagagagttctgtacctgctaggatggaggcaaaaactgcaagtagcaacgccatgtcgagcatggaagcagctgaagacgccattctcaagctcgactcaacctgtgacatctgacctgttgttgcttcttgcagagcctaacggccacgagcagaagcgctactactcccggcttatataggaaggtgagaacaacgccaaaatgtgtttggctcatactggccaataggattgaattcttagtctgaattaactttgccatgttcaaccaattcatggatggatggacaacgatgacttcgacaagaaaaaataggcaggagatagtcgaaggtcacactctgttcggtacaggtaggcagtggcgaagacaggacaaaagtagagcaaagaccattagccaaaggtaacatgagattagtgagtcaaacacatctctaacactccgagagt

SEQ ID NO: 20438 - DNA, 1501 bp, Oryza sativa
gagttggacctaggacctcaggtgctactgagactcttgtaaccactaggttacaggccctttcacttttatttactgaattatgtcttataccaccacttaactaccggttgtagattttttttattaatgacagaagttaaaaataaatagttgtggtcaataaaatagggagcatataatgtacacacaattttttttgtacacaccgtgcacacgaactaacaaattttactaaaaattttagaaaaaaattgtatacgtacttccaataatactagccacgtagtcacgctttgtgcgacttttgattttgtttaagaacttttctatatggtctattagtttaggtaaacttataagaaggttttaacataataagttattattttacaaagtatggacttccctagccaactattgatttagctaagttgtactatatgtttataagagaaatcactagaaacctcatgtttcttctctctttatcccctctcttttttatcatgtgtctaggggaggtaccagaaacctccggaaatttccatttatttagctcatctgtggtttgtttatacatgtacccttttcatccaatgaccattgtttatccaaatccttcatccgatggctaatatatttataatgatgtggcacgttctcgtgtaagaaagcctgctgctttcattatataagataagataagattacacttacgtgttaaatattaacctcgaattaattatattttggccataacaaaaatattctttttacaatttaagagtataaatctatcagaatttttttctccccatatataagtaatgaatttgaattgtgactttagacatagatataacactactaagggtagatgtacattttttagagtttttttttcatattttttagttggtgtatatggtgtgcacacaagaaaatttgtatgtataggatacgttttccaataaaaaatgctcgatttattgaccaaagttataatatgaatagtcatcggtgatatagatgtattatttatttattttttttcaattttgtatggaataagctgagcgcgatttctctaggtgtgtgatcgacagcgaaaccttgaaactgtcgatgattcctctttgttccaccgtgcaacacaccaccggaccgcagcagattgcaagttgcaactgcagcatccttaatcaactcaataaaaaaaaagcgtgcgcatgttatcctagcgtactaaagtactaaccttaaacaaggctgcgtttgaatgtaccatgacctttgaattatctctcatttttcgttagcatgttaaatggcacatttcgtgaaatgatctatataaaaattgagatcatctatttttaacattatattaattaatatttaattaattatatgactcattggaacggccccgttaacatccgtgcatgacgtgcatggagtcatgtctgctgctgtgctgcaccctaaaatgcacagg

SEQ ID NO: 20439 - DNA, 1501 bp, Oryza sativa
agactgatccggtgcgatgagtctcatccgtgtaatattttggaattcctcttccaactcgtcccggaatgggcgttatggcaaagaacaagaagaaaaagaaagaaggaacttgtccaatagtaacaaatggtgcctccacaggttgacatctgatccaacctagtagtaagcaatccgccaaaagcaaccaaaatattccttggtgaatcggtcgaaaacttgaactacgcacatacatttctttaaaaaaaggtaaagccaagagatataaaaactggtgctattgcggctacacctggagtgagcccacaagagcttttactgtaccagttccgaatataagaaggggctcgcggattttaacaggttaggcttaatctacccaattggaaatctcttgcagtagcttttactagaaatccatttctcccacaaagctcctgtgacctaaccatctagatagaagcctcgcaaagagtatatgccgaaaatcctatgtttggagtgaccatgaacactgcttgagacccttctttcgtgagagttgtgattccgctttcatgttttggattgagctttaagtggattggaggcgggcattttcatttcaacgtagcagtagggaaagtgatttcggggggttagtacacatgggcagttgggacagttacaggtagttaagttcggtcttattcttatgggcaagtggtcctagaatctctctttccttctctaaagtatagctttatgaaactagaatatgagtaaatatagaaatagaataataagaatatcatatagccgtgtattggttttgatcccagttttatcctacatggcggctgagtcagcgtgggacccacgtggacccacatgtcagcatgccacgttatctcttctttcttcccttttcttctcttttctcttttattttcttctcttctcttgtgagggtaggcggaggcggaggcggaggcggtggcgcacgccgttcagaatgaccgcctccccgtgcgctccgtgctgcagatgctcttttccgagcacggcaagctcaaccgcctcgccgagctcagcggcggtgcctccttcggcgcgcccagcctggtattcgacctccccggcgcccgctgccctccaagcgcgaggtgctcgcccagcaccacgagctccgccgcctccgcgaggacttcgcccgcctccaggtacggtttcatcacggccatctccgccgccaccgttcatcaattcaaagctttgaggtgttcgtcattgtcttcgtcgcgacgtgcaggtccagtgcagcgcgctgcaggctcaggtggacaggctaagcatggagaggaggtggcacggtggcggtggcgggttcttcaagtggagcacgttctggttcggcggcatgagctccgacgtcgcgagggtggaggactccgagagcggcattgagcggcggacgccggcgagcgggaagaagggcaggggaggcgcacttgac

SEQ ID NO: 20440 - DNA, 1501 bp, Oryza sativa
tttttacttcatctaatctttctcaatgcataaaatgggttctttctcagtgcatgttgattgcattagtaaatctggctctaaaaaactatggtgttgtatgacatgcaacagcagattataccccctcatcagcacacatgctctctctctctctctctctctctctctctctctcacacacacacacacacacacacgatctgaaaagaacaaaaggttgctactgtgacagttttgcagagtttagttcttctagttccattatcatgtatcagaagacactttagaaactagataacaggtgtagtaatcatagagagtaaaactcaagacatgtcactatggtttcaaacagattaaagcattggcaaacaaatagattagatttcagagcctagtatgaaattttagttcacatctgaccatttcttttcagaatcctagagcatctggactttacagaagatagagaaaacaaatgaactgtaaatagcacattgttacctaacatcgaattagggaggaagtaactttggtcatggccagagcatgttggaagaattaacaggcacaacctattggtgagcagaacgatgtcaagatttactaactaattttgttaattgctagtacaaagaaccaatttattgccaagaacccacacgtcttgccaaatttaagtatttaatattcatcaacaaatcacgtgtttatgatgcgaaatattgaatcatgcttagatggtcacatacttgtgaaatttgaattgtgaaacatccttaactccagctcccagtcccagacacaatattcctgttgacctgctactgaaaataagcaagaactgaattaagtacctgaaaaaaattacttgtacaacactagaacttaaatagagctagaggtagaattaaatacataactgaattagcatgacaacaaatcaatgctaccttacgaacagatgtatgaataagtcatggatcttgatatggaaatatggaagagttagtactattgtaaactacagttatgagtcatgacattgcaaatcctaaacatattcaatattctttgtgcggcactgaccagcaagtagttttttttagacaattatcagcaagacatggagcatgacctggatatgcatgcaaatggaaatgaggaacaagaaattcaactgggtaaaagttcattactctttgatcagttacaaacatgtttacattcttgattttaggactgaataaatctacacaatctgattaacacacattaacttaccatgtaaatttttttgtagacaatgacaatgaattgcaacatgagctggaagccttggaggatgatcttcgggactatggcgtgtatacagatactgtcaatgttgtctttgatagagaggagttgtcagactcagaagaagaagaagatgcaaatgcaaatccaaatccagatgcaaatggaaatgaggaaaacagttctagagaattgacaa

SEQ ID NO: 20441 - DNA, 1171 bp, Oryza sativa
agcccccccccccccccccccctcgccgcgcgccaacctggctgctctgcctctgttcgcgtcgctctctctctctccgcgagcgccgccgccgaaaggagtggagagagtagagaaaaaaatatctgagggggcgcggggggaaggagctggatgtggggggatttggtcggcgccagcaaaggccccgcgaacccgcaacgtggtggtgaggcgattcccatttgcttgcctccccccggggcccagacgcctcctcctcctcctcctcctcgcactgtttccctttcccctcctcctcctcctcctcgattgattgccctcctcttctccctcctcgctgctgcttgagccgtgatcccatttgctagcttagcttagctcagctcggctcgggggcggcggaggcggatcggatgccggggctccacgtggtctccttcctcgttgtgctactgctgcagctgaggtacgttcttgcttgcttggattggcgcggtgatctggaaggccgcttgcgctgtaaccaggagtcgttctgggtagcttgatctgtcttgttgatgcgagctcgagatgatgctcttctgggagcagcgtttatccggtttgcttgaacagtacaagaggatatttagttttctctatttgctttttgtcactttgagctgggctagtgtgattgcaaagtttgcaactgctttcagttgtacgtggtaacggaaatctgctttgctgaaggcattagagttgttatgtctgcgatgtatttcgatgtatctgggagattaaacctgttttcggtcagaattggttatgctcgaatactggatcatagtttttgctgccttgtttcagatcttctggaatgcatcttgtggcttctgagctattctggtaaaatcttgacatggcccgagcagagacaagcaaggggagcatccagaggtgtgataattctcgtgtctatctctgcgtattcttcatttttttttcttggtaggaattacaagtgcttcatcgtgttcttcccacatattgaaaagcacattaaaatcagcgcaaagtttgcaatcatccactgcccccactctccagctgtccagcactaattgcgttgctttacgattgggcaatttagttttgcaagcaccacacaatgtaatttgaa

SEQ ID NO: 20442 - DNA, 1501 bp, Oryza sativa
aaaatttactgtgagaattcgcttggatgtttctttttagaaaatcatgagctgcaattaggagtctgattttcatctcaagttagcacgtgagtttttttaaagagatttcatatacgtcatacgtctccttttgtatttccaaaaacaaacaagtttaaaatccaacttaaacacgtatatgtattttcaaaaacgaacgaacttaaaaacagattcaaacacggatgacatattaaaataccgataaaaacatatttaatttttataacagtagagattaaaactcaattaattatacgttaatggctttctcgttttgtatacgctgatttttttttcgtttcatatatctcaaacactgtctctgctactcaaccaacaaaaatgctacagtgagcacgaaggtaaaaacggcaacgttgccccttagccggaaacacccgtcttactggcgaaccgccggcaacggcgacagcgcacctcgctcctacaccctctccgctgctcgcaccgcacaccaccacccatcacgaccagtcgaccacctccccccgccgatgccataccgctcagccggccgtgaggtgtgtgggccgtgtggcccccgtgggccacaccgaacgcaggcagtcaaaagcaaagcgctagctgtagcgtggagacaaacgcgagggggagagaaaagaaagaccaggggggacgcacccggcacccgcaccggcagcagcagcaagcaaagccacgctagttgtagtatactaggctactatagcaagcacccgccgtgcggttggatttttttttctcctcctccgcttttgccttttccgggtggtggactggtggtggcggacttgacggctccccactggctgcctccctgccgtgccgcctgcctctgcgcatctggctggctatcttacctcccttttctgcgccgcgtcctcctctctctcctttcccctagggctctagctccaccgcctctcggccaccgccgctccccgccgccgccgccgacgacgcgcgaggtacgctacggatgctcgtgcttctcttctttcgtttgctggactattcagatctgggatttaggtttcccgtcttctccgagtttgttggaccgatcgggaggctagagcggtggtcgagatggggggagtgatttcggatgtgtgctatgctgctgtgggatgagagggttgcaaccttggctttagatggtgggaatgggggttgagggtggattggaaatgggaatcggagtgatgatcgcttcatcttagctgatctgcagggtctagtagtatgccaaatgtgttcatcgtcatgcggctacagtttcctaattattagatgctttctgtttcttttaaaacgagctgcagcatgaactttcagtgatatgtttgattgggtcggacaggacagctcatatgtatgtttgtacttctgtagggagtgtggtgaggactgatgaacttctaaacattgggta

SEQ ID NO: 20443 - DNA, 990 bp, Oryza sativa
  unsure (1)..(990): unsure at all n locations
aaggagtgaaaaatgggggtaggtggacccctaaaccaagaacagccaagaatttcttctgtgagtttgtaagcttccatcgagtttagatactttgggactgctctaaaaaaaacgctccgccacagaagcctcgaaatgcaaatttaaaaggtgaagaagaagaagcttctccagacgtaaagttaaaggggacgtgagtcccgggcaaagtgaaactcattctcatagaatacacgaagagacctttctcttacatatattagagaaggtcacagcagttgtacacatatatacacttgataatgccctcgtgcatatccctatccaaataccgttggctcatcccgtcggattaattgttaaaagttttgaacagactttggcgcgccaaacaagtaaggtaaggacgccattctttggttggaccccggcaaccatgtaagancaggaccnggaaagngggannnnnnnnnncatcaacgccacataggatcctgaaggggttgtgacgatttgggacctagatgacacattatgacaagttctgggacttacatatgcattttaagagtttagggaactagatgacacacatctacaagtttaaggaccgcctgtacacttcactctagttttaaagaccgtaccaattttgatcgtactttatattatggaatagagggagtaattaattatgcgcttatcagttgggaaatggttccaacccttccaaactaacaaagccaagctcaaaaatttcttgattgggatttataatattttttaccatttgaattaaccggtagaggcgtgtcattctgacgcggacggccacttcagtttgatcttcttttcggaaatgtgaaagagagctggctagctagataggaagaacgaaacttgaaagctcaagctataaatatgtgtatatccaagctatagctaccaccatacacaccactgaccagtcgctacacatcaaagcac

SEQ ID NO: 20444 - DNA, 1501 bp, Oryza sativa
ttcgatttcaggttcagataattgcattatctatctatttgtgcgattcaatggaaatgttcataaatcaagactgtttgattcatgctctgcatgttgatttatatattactaccctttagttgagcttaattaccgaaaaaccatgatgccaattatatatccatatgcataacaactgatgtcaagggtttatgattttttctccatgtcctccagatcgacgacgccaccactggaaccctctccagtctcaacctctccgcgaacacggtaatcattgcacgatcactttccttcaaccattacagttcaaattcaaattacgatatgtaatgcacaagccattaaaataaagttctatgggcttatatgtacactgctgccttattttcatttactcatcaaaatttgtcattactgttggaaactggaaagcgcctttggctatattttgaatttcatgcattatacacatcaattgaccggaaatttgtgtaaaatataacctgactaataatctttagagtggtgtactgctatattaattttcatttttttaattctcaggtttgacctctggattacatcttcaactggtaataatcttcaactgtttgcttccctttttcaccaactatgagcatgtttggaatgtctaaaaataacaaaaaataaatataagcttcacagaaaaaaaatcacattcagcggtataattttaaaataaatccaattatatccacgttgcaaaaaaaatactttggaagtaaggctaacctgttggacgtcgcctccattgtcccctctgccggtgaccgacgtccttgactcgccgtgaatcccagtcaatgccgcccaggtactttagtttttttaaagatcaactgtatcagactcaagcagtgagccaaagctgatcgattttattcccttattttctgaggatcttaaagaatagtacatagagattagttgctgaaattaatttgctcatgctcgaaagcaattggtaaccatgtgctttcctgctctatttacgtacagatggcgaacaattgagtcaatattggtacaaggattattttcgagataatttcaataattatgcatacgattggaaatgtagtgtttaatccttctattctgagcataattttgacccatcgtgttctacactttttgtaaaaatgatagaccaggatcttaagtaggggtgggcagaaaaaaccgagaccgaagaccgaacccaaacaaaccaaaaccgaacccgaactacccgaagtttcggtcatcggtcggtagttcggtcatgcactcgagaagaccgaagtttttttgggtagttcggtcattcttctcgggtactcgatgtaaccgatctgtataaaaacagagttaaacataggcaaacataggcatgtgttggtgttgggctcatgggttgggtggctggcaagcccattagtgattagtgtatttctccacgagacaaacaagt

SEQ ID NO: 20445 - DNA, 227 bp, Oryza sativa
tagtataatgtggcatgtttttatcactgtagtctgcactctgcaaccacttgatctttaggaactgaatggttacagtttcttgtgtatgtccttatattagagcaaataattttcaacgtagatttaataaatcttctgatagaattagtaccaacttgttgtagactcaaggcatgctgcatttttcataggttgttgtgacggtatgtaattcatagttttca

SEQ ID NO: 20446 - DNA, 1501 bp, Oryza sativa
ggctaaagaagataccaaatcaagtcgttatgctacccaactctagcaacgactagcaaacaactaaaccttatactacctaaacctaccgccagcaaatactagcccaataatccctataccctataaaggaaatagaatataccctaaaccatagcccttttaaccatttatcgttctctttctattttatggcttttattgaatttggctcttccttcaagtagagtctattatcttttggatggcaacctatggtatttcaagaatcgataatcaggctgctatattggatttatttacgttggagcaaggcaagttattatccctctcctttgagcataattgtcccatattccatgcctctattattctatgcattagtcatacatgatttcaaatgcataacctgaacatagtaaaccaaatatgctagcttttgcttagccttgcctagttagattgcataaaaatataataaacttagattgggacagtacgtaggaattggttgatttccgggtggctagtgctgtctcagtcgatataattgttcaccaaatacttatgtcaaacgaacaggtatgaccgcagcttctagaatggggatatacctagttattatgtcaattaataatgtggtatctctgtgtagtggttcttatttaagttctcgcgcaggaggcaaacttacgccgagcagggcgattgtaatatttaccgaggcgcaggtaaatatcttgattatctcgcgagctgtatgtgtgaattgtgaaaacctgattgagatgacggggggtctctcaactagttctctcgaaaaacctcgagaacgccagaactactctcgctgctgataacgttacgttcagagcgcatgaggactagagttcacggaacaggtaccactattgttagtaacctaatactgggccatgactaagctaatgattattggcaagttatggactgcgggtaaagcgtacatctactgcagtatgaatattcttaaaactattcgaatagccgtgctcatggacttgagtatcgggactcatatggtatttggttagaaacctaattgaagattttattaaatattgatgcatttcaaacatcataggctttgtccctctttattctcagctttctgcaagtaaatctagctctactaagatattatcatttcatgcattcaatattgaatataatagcttgctgagtacattgtactcacccttgcttcaaccccacctttttagagtcattttggagattttgccaaagccgggagtttaatcatataagttagtttcattccaacttaacttccaagtctagcgtagttagatggtttaagtctatagcaaaacattagagttgagtcattctatagcttctgttgtaataatagttagccacaaacttgtaaataccctattatgttataataaaatctcctttagagacattcaaatgtatgtaatgaaaattcagattg

SEQ ID NO: 20447 - DNA, 1237 bp, Oryza sativa
aataaacgatccaggcgctgctgctatgctgctgcctgctgctcaatggccagggccagcctgatcctgcagatgatgagtgtggtagagagacagagagaaagccagctaggctatgcatggcagaaagtagtataggagtatgtgcctctaggcacaagtacgtactgtactcctacaggtacagtagagtaactggacggatagatggacgggatcgtcactgtcctcaccctcgtagattgcaccccaaggcacaaaactagggctttgcgtcaaaatggccagagacccgtgccgcggtggtccacgaaagaatctgagagcgcatgtacgtatgagtatcatcttaaggatatgaatgtgttcaaagattatacgttatgttttttaaaagtgtgtttaggcccattattagaattagattttttttataggacggagggagtaattggtaactaagctaggcctaagttactaatactctccctaaataactcaaaccctagcttcccaaggagttttcaaggaaaaaacaaaatagcacaatacccttaattaatgtgaattagttgggtgcccgcgcaattgcacggctagcaccctataaaattatctattttttacatatgattttatttaaaaatatcattattatgtttctaattttatagtttttaaaagtcatgtcaatcgctacacctcactcctttgtcacccctttatttgcttactcgatctaccactacttctattcattctctttacaactttaaaaattagaccttgtagattttagagttcattgtccggtcaaacgtcgtcaatgtactcatttaccacccgttcgctgcctcatctctttattgttattgggattttaaaaaccgaacataattattgtgtgtgttcttttttactttctaagagtcccaccaaaccgtcagcagcttcgtcactacagtcctctacggctctaccgctgcctcccatccttattatcattgagattttttaaaaccgaacatgtttatcattggctttttttttttactttctttaagtcccgccaaccgccataactatgttgtttaacgggctcgtcatttctcctcttaatcatcattgggattctatttttcaatagcctttattttttatgatgaaattttatttatttataaaatgtattcctaattgaaatattatttttctttttctaatttcaggatttagt

SEQ ID NO: 20448 - DNA, 1501 bp, Oryza sativa
tcgcgccatgacctcgccggaatcgcctacgaccgccactgccgcgcagcatcgtcgccgccgcccacgtcaagcgcacaacgacaacgacgatggccggcctcacttcctcctcctcaacatcgaccggtcacatccctaaaccctctcacttcctctttgttagttcatctattgttgttcatccatccaaagtgttctaccgactagatctaaacctaggtaatccaatagacaaacctaacagttagtactcaagtgaggcatacatagctttgcagagttctttctgcaactagtcaagtgcgcctcccctgcccttcttcccgctcgccggcgtccgccgctcaatgccgctctcggagtcctccaccctcgcgacgtcggagctcatgccgccgaaccagaacgtgctccacttgaagaacccgccaccgccaccgtgccacctcctctccatgcttagcctgtccacctgagcctgcagcgcgctgcactggacctgcacgtcgcgacgaagacaatgacgaacacctcaaagctttgaattgatgaacggtggcggcggagatggccgtgatgaaaccgtacctggaggcgggcgaagtcctcgcggaggcggcggagctcgtggtgctgggcgagcacctcgcgcttggagggcagcgggcgccggggaggtcgaataccaggctgggcgcgccgaaggaggcaccgccgctgagctcggcgaggcggttgagcttgccgtgctcggaaaagagcatctgcagcacggagcgcacggggaggcggtcattctgaacggcgtgcgccaccgcctccgcctccgcctccgcctaccctcacaagagaagagaagaaaataaaagagaaaagagaagaaaagggaagaaagaagagataacgtggcatgctgacatgtgggtccacgtgggtcccacgctgactcagccgccatgtaggataaaactgggatcaaaaccaatacacggctatatgatattcttattattctatttctatatttactcatattctagtttcataaagctatactttagagaaggaaagagagattctaggaccacttgcccataagaataagaccgaacttaactacctgtaactgtcccaactgcccatgtgtactaaccccccgaaatcactttccctactgctacgttgaaatgaaaatgcccgcctccaatccacttaaagctcaatccaaaacatgaaagcggaatcacaactctcacgaaagaagggtctcaagcagtgttcatggtcactccaaacataggattttcggcatatactctttgcgaggcttctatctagatggttaggtcacaggagctttgtgggagaaatggatttctagtaaaagctactgcaagagatttccaattgggtagattaagcctaacctgttaaaatccgcgagccccttcttatattcggaactggtacagtaaaagctcttgtgggctcactccag

SEQ ID NO: 20449 - DNA, 1501 bp, Oryza sativa
aaatggcaatcatatctatcaaaatccaatttggatacacttattatcaagtttctttgcaaagaagggacataaaaacgtctggaagtaaaagtgtgaagccattcgcgagttctaggcgaagatctccaacagcctcaacttttgcttcaactctattggcaactctaatggatctttcacttctttgcgtagtcctcattgaacggaatccctttaaacaattacacacatgaatagttgctccagaatcaatccaccatgtggatctagaataaccaatcataatgagattctttacaaatgtaataatgttctcacctttctttgccatgatcactgtcaggaagtcaggatgatctttcttggaatgtcttgtcttcttgcaatgtagacactgatcttgtctcaactgtaaactgttgcttctgaggcagatgctgaggctgtttttcttttgaggagggtgacctgtggctcttttccttgttatctttgacaaggttaatggagtcaccattggtctctttgtgtctttcctcctcttgcacacaattagagatgagctcttcaatattccaattctctgtacttattttgtagttgacaacaaggttgtcaaagttctttggcaatgaggacaaaaccagatggaccagaaagtcatctgagatgcccaaatctttttgcttcaatttggaagccatgttgctcatcctaagaatgtggtcttttacaccacctccatggtacctctctgtaacaagctgctttatcagctgtgtcgcataaaactttgaagaaccagtaaaccggctctttatactttcgaggtacttagagacagtgtcatactctgggattgagcccaatatggttggctcaatcgtgttctttaccgcagccaaacaattcttgttggctgaagaccatttcgcatgctcaatgtcatacgacatgatgagggaagcattgtccctctctctcttttgccattcagcatctgactctttttcacctctgaaaatttcagcaggttctataggacatggggtagtcaacacccagtccacctctcccaagataaaagcaaggtcgagttctcttttccattcttcgtagttatctcctttcagggtcggaatatctttaatgtaacccatcaaggagtagccatctgagataatcatgtattgtgagaacaaaattaacattaaaattattatgtattaagtctacatcaccgttgggcagaaaatagacataacacataaagccataactataacattgcaattatcaacgttggtcagaaaaattacaacatcatagcacataattaatgttcctaaaattaaaatctcccgttggttcgaaatttaattttagaaacactaattttcatcaatttcatctgtttgcagcggaagatctatatacaattcatataaacaataacaaaactctgttgtttactctctgtaaaaattctcccgttggt

SEQ ID NO: 20450 - DNA, 1501 bp, Oryza sativa
ttgatgacttacaactgatgatatgtaaatatgttatatatgttatttaaagttattcgtttaagcttttaaaatatgcaaaaccaccatccaaaaccaccttagggggtaatataaacggttttgcaaagtttagggggttgaatgtccggttttaatgtttagggtgctagatggacttccatccaaagtttaggggggtatttggactttttcctttgtttaactatagggtagaagatgaaagggctataataacgtatcacataggttcgtttatagtttatgagttacgctacacaatgcatacatttgattgcagaaagtatagtgcatacagaactcatttccaaagaatataactgtttcaacgttcaccaatgaccagacgatcatagcatgagacttcatgcatgaccatcaagtttgagcactgtcaaggtatatatcctttagttttgccacgttggacacagtctcgcatctcctacaagtttcaaccacaggatgtcagtcatacaccgccattgatatattgttgaactagcaagtacataactgtcgggtcccgaaactaatgattcgaaaaccgatatatttaactgtatcaagccctgaatcagtagattgatacaggttcaacaatctgaattttcattacatacatttgaatgtctctaaaggagattttattataacataatagggtatttacaagtttgtggctaactattattacaacagaagctatagaatgactcaactctaatgttttgctatagacttaaaccatctaactacgctagacttggaagttaagttggaatgaaactaacttatatgattaaactcccggctttggcaaaatctccaaaatgactctaaaaaggtggggttgaagcaagggtgagtacaatgtactcagcaagctattatattcaatattgaatgcatgaaatgataatatcttagtagagctagatttacttgcagaaagctgagaataaagagggacaaagcctatgatgtttgaaatgcatcaatatttaataaaatcttcaattaggtttctaaccaaataccatatgagtcccgatactcaagtccatgagcacggctattcgaatagttttaagaatattcatactgcagtagatgtacgctttacccgcagtccataacttgccaataatcattagcttagtcatggcccagtattaggttactaacaatagtggtacctgttccgtgaactctagtcctcatgcgctctgaacgtaacgttatcagcagcgagagtagttctggcgttctcgaggtttttcgagagaactagttgagagaccccccgtcatctcaatcaggttttcacaattcacacatacagctcgcgagataatcaagatatttacctgcgcctcggtaaatattacaatcgccctgctcggcgtaagtttgcctcctgcgcgagaacttaaataagaaccactacacagagata

SEQ ID NO: 20451 - DNA, 1501 bp, Oryza sativa
atattcctacatgaataatcacacgacacatctgtaagagaaacaaaaagatcgagctaaaccaacctcttgtgatttggtttgtgcattagtacagtacataacatatggtgaaagcttcgtgcagtaacatacttgtaataagaactatcggtgtggggctaacttctgtgagggacctgataggctggtattaaccagacaccatcactagagacactgaataaatgtatttccgcttagcattaaacaatttgctcactagagcattacactactcacgatcaaaatcacttctcgaattctggaattgtggcaggaaagggaaacacatttccatcggaaaacaaccagaaaagcaagcaatgaaacttacaattgcacgaacccaaagcctctgctcgtctctgaccctgcattagaaacaaacacaaccaaattactccctgctaaacagccattgaactcactgtcactgaattctcatacctttcggcgcgaccatgaagcatcgcctcaccggcccgacctcgctgaacaccgcctcgagctaaaaaaaaacagcaatacacaccgcgtatcacagcctcgcagaccgaaacagcaaaaaaatgctagccgcatagcttcgcaggggataaggctttgggattggggctcggcttgcgcttacatcggaggacttgaaggtgtacggcaggttggagacgaacacggtggaggggctgtggcctccggcgccgccgccggtggccgcgccgccttccgtggctgctcccccgccaccgccgccgccgccgcgctgcttccgcttacccatcgccggcgtcgtaggggaggaggcgtgtgaacaagctcccgtactcgacgaggcgagaggttttgttgggctaggccgctagggtttatagcttagaatgggccattgtttttgtcggaccggatgtcctagcggtgtatgcttggtttgggcctgtttgcgttaagtgcaaaaaggtccactttacgtccctcaactaatggtcgagtgctcgagtttcatttacatacaactatatactccatataaaaaactacgatggtgatgggagtaaatctgttattctacttgtgcttcttcggtttttataaattgccgcttgatattttctgatactgtagaatattctaatatttgattcaagtaaataccatatatgcaaataagcaaacaattacatgcttgataaaataatattatgctatgatattataatatattttttatctataacaaaacatagacattttctagtcaactataaaattaagtatagattgtcctaacttctaaaactagtgttaatcgagccatcaatattaagagtagtttcaactgacatgatgcttatcaaacttctaggcaccatttaaaaaaaaaatgaaacttcatcaacatttcttaataataccttttcattaaatcttcaactttctaatatcttatccatcatctctactt

SEQ ID NO: 20452 - DNA, 730 bp, Oryza sativa
cgtatatcattcgtccagttctctatcatgtcctaaaatcgcctgcacaaaatattcattgtaaatgtccacttttggtccttcaactattactggagcctaatttagttgttttcaccatgtttttcaataacttttagtttttcccttaaatgttaaaactggagcaaattgcatccaaagctgtttatgtttctttttttttatttgggttttgtgcataggattatgtggtttctgcaccatcattttattttgacgcatggtatccactcgtcctctggaaaatggtccaactaatttccttttctaaattatgaagccacattacctcactagcacacgggcacacaccatgtaggatccatataaacctccttcaaaactatcaccaggatgtgatgtgcatggttttttatttgttgaatgacatcttttagaaattactgaaggttagggtgtaaagtactgagggacaaaaactggacctttttcatgttaatcactgatgtactgcataatgctcatatatgctgatgtaaataggatgcaccatatgtactatacctcaaccttatctatgtatattcaacgcactatatttttactgcaattaagatgcaccattgaaactatacctcaactttatctatgtctattcaacatattatactttttactcgactaattgtttgctaagcagttttcgtttccaattatctgtccgttc

SEQ ID NO: 20453 - DNA, 1501 bp, Oryza sativa
gggacgtggctgagggctctgcctccatcctttggacgcatgcgcacaggagtaggggcggaaggatgacgccggcggtgatagcgtggatggtgcggcgtggagcggcgacaaggtggcagcacgcgatgcaggtgttggtattttttaacgatattactagaaatataatttctaacaatgacgcagaaatattcatggtatattatggttacagagtttatccgtaagctcacgcatataccattgtagtatttcacccaagggtatcgtatttattttatcccatgagaatatcatgtagagagaacttgactaataatttatatattacttgtgataatcatatcctgagcaggggttaagataatccaagggtagagtgacacacaagcaatagctactcattctcataatatattatctaagctaagtggaaagaaatgagaaagaaaatatattcctatacttctagtatacatacattctagttatctgatatactagctaatactctctatccgatgccctcctggtacttcgagaagccacccctaactgtcgagttccttatgacagcccgtcatgaccatacaatcggggctaaatacggaggaatatcctccccagggaattaacttaggatcatatacacgcgcggaggaatacccgtactgagctgtcaccatcagcggcccacctctcatccgcagcatataaccccaaataatgatatcacgtaatctagacaccacgtctaaacttccagatactactctaatatcatcatcatgacatagagtaaatgcataagtaaacattatacccgcaccaaagcatctcccagataagctagcagcatattcagtataacatgaacataatgtaaaattggcattcatactctcggaaagtattccaataccataaatgtataaagaagaatatttaataatactacaaagcttacaaaagaagataggaaagctactaaagccatacccgaactctttcgaagacttccggactcctaatttctactctattcctattccactagcttgatactactaaactaaacttgagagaatatgagagaactttacttgaggtgtgtgagtgaagtgggaatggcaactccttttatagccttccaatgacgttgtgaatgttggaatggtcggaaataccctctaaccgtcattgggggctaatccacaccttccaggcgaagccctggatcggatggcactgaggagggttcagccgaacctggggcctgcccaatctagcccaatttcggctggcggcctcctccgttgttcttctccacagacttgtgaattttggcccagtttgtcgtgtcaattccgagtcttggtccattcatatataagtctggttctcgacatcatccgattgatttatcgtctgtgttgatgtcgattctcctccactttatgattattctccgcacaaggttagtgaacctaatactagt

SEQ ID NO: 20454 - DNA, 1501 bp, Oryza sativa
ggcttaattgccaatgtgtttgttatatgagcaattttatatttcttgaggaggtactattttttaatttagtaactcttggtacataggttaggaggtaccaaaactcagccatgtgctcctattcagcggaatataaggcaagttcagtgaaatatttctcaggctatgaggtcccaataagaagataaccacaagctcgtcgtgatccaatcaaaactaaacacgttgcaccccatgccatgaatgcccagccttgtaagcttaattttgtctgaccacccgtttcttcgacaattaagttgggtcacggatactgcagatcaagttaaccagctcagatatataaacacagcaagccatctagcttgccagcttggcataaaacttgcatatgcggaattgtttcaacatagagatttgacaagacgacattcccctagacagtgttctctaatgctcatcttgacacgcaatttatatgcattcatatttatatgtcagattatcatcgaagactgtgggaaagcaagagggagagaccaaccacaccgcaagctagctacactaaaataatattagttccctctacttattcgttgatgtcgatggttaatattaatattggaaatatatctaatattgaatactcagagaaatgcattcacggtgtcgctgttggtgatcttcagatagccacgcgaagaacttgtcgcgggcaagcaaaaccgagcatgcctctcgtcactactcgtcagtcgtcagtagcaaagaacgcacatgcatgtatatttgacctgatcatcagtataggtacgagtcatgacggccagctcatcttatcttaaaacaaaacgaggcggcttgacattgtgtttgaacttacgtggccacgatgaggccacaacactatcattcgtcaagcttaatgatgaacggagaatcaaccgttagattaattaacctaatactgcaagccacatgtgtaagaaatagtttagttattatccaaacaaatgtgcaagaaatagtaatgagcaagcttaatctgaactgtgaggtttgcgcgcaaatcctcggcaaatacaattacaacttttcgagagataaatataattaaacctatctaactactaagtactaaccgttcgaagtgccacctggttgtttatagatcatctgatacgaaaagccgcaccatctcacagtatataaggaggcccattctttccctagcgacgatcacaagcgagcattgaagcatacatattcagatttgagcatctccgacaactgagtaatttgagcaaatgggaggtacattaattcagttttcatttttcttttgatcctcttatcttgcatgctgcgttaatctattgctaatcaactagtaattgtgttcgctaatcaacaagcaattaattcctctcaagcaattcaatctctctgtattttttcttcatcgattaattttagatttttaatcatgcaggtgccc

SEQ ID NO: 20455 - DNA, 516 bp, Oryza sativa
ccacatcaacgccacataggatcctgaaggggttgtgacgatttgggacctagatgacacattatgacaagttctgggacttacatatgcattttaagagtttagggaactagatgacacacatctacaagtttaaggaccgcctgtacacttcactctagttttaaagaccgtaccaattttgatcgtactttatattatggaatagagggagtaattaattatgcgcttatcagttgggaaatggttccaacccttccaaactaacaaagccaagctcaaaaatttcttgattgggatttataatattttttaccatttgaattaaccggtagaggcgtgtcattctgacgcggacggccacttcagtttgatcttcttttcggaaatgtgaaagagagctggctagctagataggaagaacgaaacttgaaagctcaagctataaatatgtgtatatccaagctatagctaccaccatacacaccactgaccagtcgctacacatcaaagcac

SEQ ID NO: 20456 - DNA, 1501 bp, Oryza sativa
  unsure (1)..(1501): unsure at all n locations
gtcatacattaaaatacagatggagtactctgtagtatatgaatatagcactatggaacgctgtctgctgactttggtcggtggattaatagtagtgttagtattagtagactgtatatatattcagcagtagttgttcagtacacaagaactagccttgaaggcacctccagccatagagaactaaaacgatggcagtacacaagagcttgctctacctaaaccatggacttgccttgtgcttcaagtgcatcatatacaagaaaaaacgagagaaaaatggttcaacctctaatgcaatcagacacacgagttgaaaatgttcgtcagtaatgagctctgaaacattttgggctccctgtcaaatgcttctagaacaacccgaatcaccagccttttttttttctttcggagtttcagactgtcaacgtctcaccgataattcgcgtgtctgattctgtcttggtttttataatgcgcatctgattcattaatcccattgttgtagcaggttgttactgttcagagtgcttcatgatgctggattgctggatactgcatcaacatcattaagcctgtttaaacatggacaagtgtccgaataaggggagaagaaacagaaagtgttatgcttagtgcgctcatgtgacctctaatttcttgctttactgcctattgtgcttgtatggttctgattatatgatgcgtattttccatcatggtagcatgtgcaatcagttggtcggcgttaattttgttttgataatgtaaagtcccgcaaatttttccatggattcaccgcttaatatattgaattggagaaaagatggcagattcaaaattatcaccgtgtagtttacagcaagaaaaacactgaaatcagcaaacttgtgcgaaatgaaggcaaacgctcgaaacgatcagacctactcacctaaccgtaataaacaaacgaaatctgtttccgttttgacgaatagaaaacgtaaaaccgtagtgacaaagcagcccgcgcctagtagccgttgaaccgcccctgcctcatgggccccacctgccattaactttttcgttttctcgaaagagggggggggggggggggggggggggnnnaanannnnnncngnncgcgctagctcggtcgagtcgtcgtcgtcgcctcaaaccacccgcctcggcctctctgtcccggacgaacacctcgcagcctctgctattctcgccaccacctccgcgtccgctcgcctcaagaaagcatccccgcacgcggccatggcaatgccattgcgggatccaacagaccgcgctgctatgtccgcgccgttgctcccgcgttccgccttcgtctcctccgcatcgttctcctccttttcgtccgtcgcctcgttctcctccacctcgtcgtcgttctccgacccggccgtcccgtcggatgtcgtcgaggcgttgccgatgtcgagggactcgttcaaggcgctcgccgtgctgagggaccaccagg

SEQ ID NO: 20457 - DNA, 1501 bp, Oryza sativa
gaagtacttcaatcgggtgcatactggatatgagtggaacaaatacaaccagactcactatgaccacgacaaccccccaccgaaaatcgtccagggctacaagttcaatatattttaccctgacctggtggataaatcaaaggcgccaacatacacgatagagaaagacgggagcaccggtgagacatgcctcataagattccatgcgggccctccatatgaggatatagtaagcctctattcccatatcttcaaatttaatcctgtagagtttcatgggcacttcacttaattactctgttttcttcaccaggctttccgtattgtcaacaaggagtgggaatactcacataagaagggcttcaagtgcacattcgaacgtgggattctccacctctatttcaacttcaagcgctaccgctacaggcgataaaatgccacgcaaggaagacgttttgatctccattgtgctgttagaagttggtcttgcttttcttacctgagagccctatgcaaataggtttgctcggataccaactctggagtcgactacacatgctcatccgagatcatatgtactaagtgagaacagggtagcatactagcatcccgtacttatgctgattaggctctttgttagcggtttgaaaatagcaacgaagtctcctgtgtacattgtaacttccttttttctgctttggaaattgagttcagatgtcaaaaatcaacacatctttttggtggcaatcaaactaatagtgcgtatatcattaaacttcttgtttctggaactagcgaaagtgtggagtacttagcacaacatcagaaggcatgaccaattgacttatagctaaaaatgtaatagctgttttttttttgttttttttgttttgctcctacacaactttgtgctattaacaggatcagagatgcaaagtggcagttggtccgaggctcctagctccgaaccactatcagtttgcagctattggcctctacatccatcttctacacaagattataaggacaagagatgattttaaaaatggaaggcaagtattcactcaaagtttagatgccattggatggtagaatctaaactgcttctaaataagttaccgcatacaaaaaataaattaacagagtcccctttttcacaagtgaggtttgctcacttagttcccttcgcactggcaaactacgacagtgtgtaaatttcagaagggatattaaaacaattaccaatgcagcaaaggtaaatagtgcaatgggcaaaattgaattgattctgaggacaggatatctccaaaaccactagccactttggacttggtggctaatggtcgggtttctccgtccaatttccagaacaaaacaggtcaactcctatgaagtcagagactcaggagttgcttttaaaaaacaaggaagaaagaaaaaaaatattttgagttgagaaaatggcaaggcaaatatgatatactagtagagcacaggagca

SEQ ID NO: 20458 - DNA, 1501 bp, Oryza sativa
ctatcatcatttcccaaaattcccaaagttgccatgccattcaacaagggaaaaaaaaggcacattcatgacctttgctagatatttggttctcagactgttaaatttcatatacatttcattactccatgaatttcgagctttgctttagcatgcgtccattatcgtcaggggatgcgattagtactagctactactaaatatgtatacataaaatacaaaataaactggatatcagaattaaaagatttcatttcatttattttgggggattaacatagattttccccaaccaaatgtcaaatacttcgcttgaagattcataaaccttactagttgtaccgaaacacatcctatttggagttccatttatgttccaagatcagcaggcaacacatattctgtgattgtgaattgggcaccacaggttgcattgtaaattgctttgtagttaatctctgactttagtccaccctctgtgatgttccaattctcaatcggaagatgtctgctaaacataacaaacaccacaaaaggttgaaagatcaacagtcttgatgtgcttactttgagacctgcaattgcatcttctcaacagttcatatgggttctgaattcctttctccatgccatggtgactaaaccccaactctgcatcagcatctcacctgtagaactcatagaatttattttgatcatatgcattacatcactaatttcttttgtcaagtctttgcagcaatcctttcacactagaatttcatgtagtcattatgctagaagtatccgcataaaggtttgatggttataatctgccaataccaaactatctggtggcatccaagcagttattgaatcaaatatccttgaacatttgcaggtcatgaactcaataggaccatcttcccatgcagacagatgcctaatgcctttgtagcaatgcaactcccatcacatccatcagtaatcaatttgattgattatgaagtgcaaaagtgttgaatactcttcaaatgaataaattcaataagatgaaatggatcacaaacaaaactccacacaaacttatcagcggttatcatcactagggttttccctttcaaaaagtaaggtaattttggtgggcaatgaaattccgaaatttcggatatttcaaacgaaattttagcacatatttactaaatttgaagaaattatgatcaaattcacaaatatttgaaaaaaaaaactgaaaatttcacttaaaataattgcttgccggatgggggacgaaattcccgaaatttcggttcaaatttccaaaattgtgaaccgaaatttccatccctaattcatcactaaacaacaccttgtaaaacttctctcttccctcttccctattcttagcactatccaaccgcgctgcttcctcatcgtcgtcctcctcctttatctcaatctcacctctcctcctttctccttttctcctccaaattctctgcatgccgccgctgattatact

SEQ ID NO: 20459 - DNA, 1501 bp, Oryza sativa
tcaattttaaactcaacgaaatagggtacatgactgactcatggctatgcagtgttcaagtacaacaaggagtaccacgacgtggcggtggtcggcggcaaggggtaccggcggtgcaaggtgccgaggaacaaggacacggcggtgctgcggaccgggtacgaccaggtgacgctccggcgagggaacaactacttcatctgcggcatgccgggccactgcgacgccggcatgaagctcgccgtcaaggctctctgcttcttgtactgtactggctctctgatgatctgatcagctctgtgtgtgtgtgtcccctgcacgtcccaggttgaaatggttgatatcgtggttttccgcgggaatcctttgctctgttctgttcctgcgttttccaaacagggttttgaccagtggtgatgtggtgtgtggtgtgtggtttgcttttggttatgagtagagtagcagctgctactacgtccgttttagattataagtcgttttgactttaatcaaaatcaaactactttaaatttaactaagtttgtagacaaatatagtaatatttataaaaccaaattagttttattagatcaataattaagtatattttcttaatatatttattttgggttaaaaatattacagttttttttctacaaacttaattaaatttaaaatagtttgattttgatcaaagtcaaaacgacttataatctgaaacggtgaaacagagagagtactagcttgtgtgatgagatgtcatgtcatgagtaaacctcaggtggattcatgtgaaaaaactgagtgaaaaaaaaaaatccttttactttagtcctgtttggttcccaagaaggtttgggtgtttagctgcagcccaaaaatggtggagtattgttaattctacctaacggagactataacagattctactagacgttgacttttacttgggcaatttgtggtttttaagctaaactttgtcagtgcatcttccatactactattaattgggattacatcaggtgctttgtgcggtgatcatcctactcactttgaatttggacgtaaagaagattgacgaacaattttgcccctttcatcaaagggtatatatcacgagacaacatctttgtgaaggttttgttccagacttttccaatgtgaaaacacaggctgtcaggaaaggtgaacactgaacagcttccatttttcacatccacccaatatatatgatagacaagaaatcaaagactaacaagccatggaaggtccaaatgctgccagatgctgatcgagcatagtgttctcagatagaacgattcaaagcagaacatgccaattgaacgttggattctcagaaataccagttcaaagacacatacaaacacaacactaagcgtacatcaccccgtgtgataggaaagcgaaaaccagcaaaataacataaactgctggctctgaatttgacatgttctacatcaaggcactgcaatgccacagc

SEQ ID NO: 20460 - DNA, 1101 bp, Oryza sativa
  unsure (1)..(1101): unsure at all n locations
agcgtgttgatggatacacctcatgcttgcacgcctgcangncttctctagaggatccgcggcgcccacatgttagtgggccccacaattgtgtgtgaatgacaaatgagtcccacgtataactttttaattgaaatgccggggtggcgccacatcaacgccacgtgtaaagaagacctggtcaataccgccacgtcagcgaaaccgccctccaaaaccgctgagggagtcaaattgcaccggttttcatagtttgggggtcaagatatccggttttgtgttttagggtcacggattagatttcaatcacttttgagggtcacaaagtgaacttattcccagcttgcacgattcctacgaggaataagttcacctaccgtccctcaactttatgtcgagtctgtaaaacatcccttatgtccaataccagaaatctccccccctaaactatacgaaatcatgtagaataggtcctatggcagtataatagatggttttactaacgtggcatcctaatccgcaaagagggaataaaaaaattgtgggggtccatatgtaagtgatagaagaaaaatgtggggtccgcatgtcagccaatcgtctttcttttcttccagcccgggacagctggcaggagaggggggcgtcggcgggagaggcagccggccgcatcagcgggagaaaggggagaggtcgccggccgtgccggcgggagaaggaatagaggaggccggccgcgctgnccgcgcctgtgagaataggaggagaggcggccggccgcatcgactggagaaatgggagaggccgccggccgcgccggcaggagaagggggataggaggccgactgtaacgccccgattttcgttcgggattaaaaatcatttgataatgcatttcctagaaattaaataaaaagttaagcaatttattcaagtgaattaatagaggaaattaaaatttcctttaaaaattattggccgggaatattttgtaatattctttgtgccctaatgtactctccataattttccgtgaattttcggagctcgagaaatagtttaaagtcacgaagatcatttaatcaattaaataaaaagaaa

SEQ ID NO: 20461 - DNA, 1501 bp, Oryza sativa
cactcatcatctgcaggatcaggctggccctggccattgagcagcaggcagcagcatagcagcagcgcctggatcgtttattactcgaggggaaggaccagactagtggtagacggtagtaggcccccggttcagaattcatcgcatcatcatctagagtgtgtttagtttcaaccaaagtttaaaatttaattaaaattagagacgatgtgactgaaaaattactatatatataaaagatttgatgtgatggaaagttgaaagttttaaaaaaaactttgaaactaaacatacccctaataactgcagcttgcagttcttgcatgtagctggtggcctaagggtgtgtttgagcagaaggggattaaggagattgggagtatacacaaaacgaggtaagccattagctcatgattaattgagtattaactattttaaattttaaaaatggattaatatgattttttaaatcaactttcatatagaattttattttaaaaaaaatacaccgtttaatagtttgaaaaatgtgcgcttggaagacgggacacaatctcctctgtcccccagaacgaacagagcctaactcctcgtcccctgcgttgcaagcggggaggaggctccaaaccggtcggcacggtggacgttagcgccacctcgcatcgccgtgcctgatgttgccatcgtgttgggaaacttcaaacttgcacttggttcgtacagtacgtactacctctttccataagagcaagtttaggggctgtttgggagagagggactatctctctcccaccaaaactttaatccctatcaaaagggactaaactctcccgaacacccccttaatactacaagtcaactataacctaaaaaaataggaaaaatatatataaacatggagtaactttttctaactaagggtctcaacttttcacttatatttatacttatcagccaaaatttaaattttcaaccataaatttggagttgaatttaaggtttttttcattgaagtttaattttcagcatttgcttttagatcgttaagaacacatatataaaagttttattcacaaattacttttcatttgcgaatataccgttttgcttatttcgcgaataagagaaacgatggttacgtaaattcttagtactaacactgacatgtcatgctatgaatgcatctaaattttttataacttccatctaccaaattaaacggttgagataattattagtactagtacaaatttataactttcatctaccaaatcaaatctatgctgctagaggacctaatttaacccgggatgcaagttgggagtcatgatttctggtattgcggttcagggcgtgatttaaactcgacgtcaagaagaggaatctaaagtgaacctattccaattgccaacaaacaggcccattaaagaaatatgcaaggcccatttttacaatcctacagcccattatcgcaagccaatctcagccgtccaacactccg

SEQ ID NO: 20462 - DNA, 1501 bp, Oryza sativa
aattaatttcatctgcacttactcgttgatgtcgatggctaatattaattcgaaatatctaatatatgaagtactccacttgacaagatcagagaaatgcatgcacgatgtcgctgttcttgtcactgtcagatagccacgaagaacttgtcgcgggcaagcaaacaagcatggctctcgtcagtcgtcactactccctatatttcgtattataaagagtcaagtaccataaataaattaaaaactacatattcaatatttaacatgatgtacggtaaaaatacatatttaaaacttaatttatcgcagaacgataaatttaaagtataataatatcacaaaactatgatttagtaacagatttatcataaaattatagatttagtgtcaatttaatcataaaacttggatatttataatcaaacataacattgatgtcaaatatttaaatcataacattagtgttaattatttaaaccataaatatgtagtatttttttgcgaggataaatatgtagtattgtgataattttattgttaaatatgtagttatacgatacatcaccttaaatctgtaattttatgataatttagtcaaagtatatgtagttttgtaaaatttattctattataaatcgtttgattttttttctcaatcaaaattatttagatttgtccaaatttatagaaaaaattagcaacatttataacaccaaattagtttcattgaatttaccatcgaatatattttgataatatatttgttttgcattgaaaacattactatttattttttttgtaagctttagtttgactaagaaaaaaaattcaagtgagatatagtataaaacgaaaggagtagccagcacggtatatacttgatctggtacgagtcattatggccagctcatatattatcttaaaacaaaacgaggcggcttgacattgtgtttgaacttacgtgcccaagatgaggccacagcactatctactcgatccaaacacaagaagttccatgcatgttaatcgatcagtcgtcattcgtcaagcttaatgatgacaggaaaatcaactatatattgggttatccaaacaaaatgtgcaagaaaccttactggttaaccgattgaagtgtctcattgacaagaggaagaagtcacgccatcttgcagtatataaggggggacattctttcctagctacgatcacgagctagcgagcgcgagcatcgaggcgccattcataattccatctccagatactgatcaagcagatcagagctcgagttatcatagctatttgatcaaatgggaggtatattgagagcttatatttccgtttccttttctctttcatgctgagctgatctattgctaatcaattaactaaccctctcatatgcaattcgatctctctctctctttctctctctcttgctattttatttccttacacatcaattaaatcgtctgatttggtatcaacatgcactcctatgttt

SEQ ID NO: 20463 - DNA, 345 bp, Oryza sativa
  unsure (1)..(345): unsure at all n locations
aaaaaaggacgttgtcttcttctccaaccggtgagcttgtgggtaaagcccccgccgggtttaacggggtcgccgaggcagggaagttcggccggtaacgtcggcggcgcggggggccnacggggaggtggcggaacaccatctcgtcgaccctggcggggtcgccggaaagaagggcctccacggttccgtcgcggcggttgcggacccagccggcgaggcccagcgcgcgcgccgtctccaccgtccagtcgcggaaaaagaccccctgcacccggcccttcaccacaacccgcaccgccttggggctgggcgggcttggctacggggtggcggcgtagacca

SEQ ID NO: 20464 - DNA, 1501 bp, Oryza sativa
gaaccgtaggagtacagagtacagacactaccattaaaaagtcaaaacgggccttggcaacgagatagatgggctcaaagaaattgggccctcttctctagcgtaggcccaccagagaattttcagccgggccggaagcctggaattcccctgaatttgggcccagagttgaaacagacaattcacaggggtcctactgcaaatatgttactacttcgtatcatatcatttgcaagagagaggaaaagaaaaaactcttaaaacaagggaaaggagaaatccaagccaatttgcgacgaaccctaaccgcccaccaaatcctctcctccttccccaacggcgagcgtccccggcgaatccgccttgacggaggcaccccggcgagctcaccttcccggaggaatcccagctcagcctcatcgtcttcggtgaggtacgcatccctttgtcccatcacttttcacccgtcaattgcagtccccgacctggtagaggaggggagcacacagccgacgccatagcagcagcaaatctgacgtgccgtccgcctccgctctgctgcgggcgtcgattctggtgaccgtgccatgtcgcgctcgatgtgctggccttccggacggccggcgccgccatctcatcccgtagattccgaatcagcgagaaacgtgtgttactcgtgtagggaggggaacgtgaggaggacgaacccctacacctacaccttaggagttttgtgcctcctcccgatgtgaggggaataggggatcgtgtttcctgggcggagaaagctcttattgttttctgattatacacaattctgagtagtaacacgtgtctactgtgtctgtgtcccttccgcattttccgcttagtgcttacagcccagttgaacccaaatcagattttgtactgagcaaaatccttgaaccaaacatcccctggaaaaacttgctccttatcttagtgagaaatgaaacatttatcataattacattggattatttttttcttacatgtgcattttctgtatggccacgtgccattgaacatgggaagtagatctatttttctttcaccatttagtttacattgcatagcaggattttatttatgcagacatagtatttatgttgcatcctggatagtaaagtaatactagttctacgagtatgaatatgaatttaattttcttaccaaaccatataaaccatcataccctagtgtgcttacttgacttcatgcgcaagaaacttataagtgtggattctcttcatatatctgtagggaaatatcttggtgattcttgggaaccttcagaaagaccacttaatagttttccttggcccagaaaggcttgaggcttgagagctgaaaagttctgctggagctagtgctataatggccacaaaacttgtggtaagtggacaatctttctctttttaggattctataaacgaatgtgtcctttcatagtttaatcattcatgaagaatgatgacat

SEQ ID NO: 20465 - DNA, 1501 bp, Oryza sativa
cactcacgtcggcggtgacggacattccctacctgttgagccccgacaacgacgccggcggcaacgcggttgctcaagctttctacaccactttccaccggagatacggcagcggcctgggagggatcctctgcttgggagtcgtcgctgtcgccgtcttcctctgcggcctcgcctgcatcactagcaactcgaggtcagatcgatcgatcagctgacgtgttcaggaatttagcttagcttaattagctacgtacatgttgataatttcctaggttaattagccactgcatgcaggatggcgtatgcgttctccagggacggagcaatgccgttctcgaaagtctggcaccgagtgaacaagcaagaggtgcctataaacgccgtatggctctctgtggtggtggcgttcatcatggctctgacagtgagttaattcgtaccactgctgattaattttcatgcttgattctcagttcagaataaccagaattatgctttatttttatgacagtcgctgggaagccaggtggcattccaagcaatggtgtccatcgcgacgatagggctctgcatctcctacgcgctgccgatcttcttccgggtgacgacggcgaggggatccttcgttccggggccgtttcaccttggcaagtacgggatcgtcgtcggctgggccgccgtgctctgggtggccgccgtcaccgtgctcttctcgctgccggtggcgtacccggtggcggaggagacgttcaactacacgccggtggccgtcggcggcgtgctgctgctcaccgtcggcgcgtgggctctccgtgcccgcttctggttccaagggcccattactaacactaatgacggcccgctgtgacggcccataactgtatgggccgatgcatgtgtgctacggcccatggagttctacggctgacaaggaagcccacgtacatgtagccttgttgggcggcccagtaagaggccgttctttattttgattcgtattcccatgtccttggatggaaattcaacggtctacgattcggctgattatgttagaaaaagacaggcatgaggtacagaactatactaaaaaagcagcatgcgtgcaataattcaagcatagtttaaacatgaaccaaaagtcctaaggtatacagttttttttttggaacgcataaggtatacagcgatatattgcatcttatccttcagttagtcaacggtagttggcaatactacaggaaaatcgtgacataagcgtatcaatcaatcatcagtggtatacaaaatttccaaccatttcgttgattatgaattatatataagagagaggtacgtacttggacatttcttttttgggaagttgactagtacagcgagcatgtaaactatactctgcaggattagtgagctatggaggtgatagcgtcaaaaatagctagcctcccaggaaacagcctacaggagatagagaactgatccacggccatgtctcgctccg

SEQ ID NO: 20466 - DNA, 1501 bp, Oryza sativa
tcctcaagcacactaggcacttatatatgacagctcggtaccatgtttgtagatgtggccgagggtcaacacaaacctcgttcatgccaaggggtttgaggcttatggactccaagtcttgttcattttatttctatctttaatccaatctcattggcatgggccttatagactttgaggcttgtttattttattgttgcctttaatcctatcaatttttggtaagataatgaatttaagatagtcttactaatgctatcataccagaatttggtagctctaggaatttcctctcataaaaacaacaccagcataacaaaggtattaaactagacacatccaacgctgccaaattttagtgacacaaaaacgtgctaaaatttggctgaattttggtaatgttgattttagcaataaaatgaataagccattagtaccaaatagtccttggttgcagagtgaacacttgaagggttcggtcttcgttgccaaattctttagttgtaggcttctacgcttcattgccaaggaagcaaaccctctgacttaactgcacatgcagttgagtcactgacatgtggatcctactttgctatagctcacatgccagtaaatccctttcatctcgccaattatgtattgacaacttggtacgaggtccaacatgaactcttgtatctcaaagccaaatgctatggcaatacatatcatttcacatattttagctttagatctgtagcactattatttatttaaagttacaaaagttgtaatttattaataaaattgatgttcaatatatagttttgtgatacaattccttagatctatcgttttgtaaaaataattgacactaaatctatagtttgtaatacacattcttataagtttgtagttttacgacagtttccttagatctatcgttttgtaaaaaaaattgacactaaatctatagtttgtaatacacatccttataagtttgtagttttacgacagtttgttttaaatatcaatagttttgtaaaatttattttatttttattttctttttactagcggatgtctggttgatagattgcaatgaaaatgagaaagctgagggagcatatatttacataggtttttcaaattgttttattacgagttcagtgaggggtctattagagcaggtacaatagcgggctattagccagctataagcatattttaatgagataaaagatgagagaggagtagcgggctacagatctgtagccagctgcagcacggactccagaatacaatatgtgtatggtaggtgggaccatgtgttaatagtatagtaagcaactattatacgaattggctattagatcggttattatagataaattggagttagtagtgggctatactatttaacttgctcttaaattgacgaaaacacacagaaatctacacgggcacacacattgcgtgtagtgtgaagcatgcatgaaccgtccgatccaaatccaatggt

SEQ ID NO: 20467 - DNA, 1501 bp, Oryza sativa
cagaagcccggggaagccacggagcaaaactttggagccttctaccctaacaagacagcagtctaccctatcaatttccagtgaaatcgttcatcatcagcgccagttgtcaaattcacgcgattgcttgcgctgtaatagcgtattgtattcggatgggaaactgtatttatatctcgagaggatgctctctcctttgtttaaaaaatatataaatagttataaagaaattctaaaaaaatgggatatattcatataacatacatgtatcagtacacaaaattttagacccaaactcaatttatacattaagatataaaaaatacaacttcaacatataaatagtagtgtggtggtgtgttattattcgggatattaactatttgtcattctcagttgtggcaactaacaatttaccacctggacctatatgtcatatacacatgaggtctcatatgtcattggcacatgtgtgacaaatagttaaacaacaaatctaagagtggcaaatagttaaatactctgtactattcatagctgaatttatctctttttttctcatcgtgtaggtcgaatttgaacttgctttttggtgcagtgatagatgtactgtacctacaattgttagtttttttaagatttttttatgactatttatattaaattcggaagaaaaaggtatacgagataatattctgtggagggattagaacccgtttctatattaggatacaaatgatttaatgatttcctatatataataatatttttttcttttcaggtatttcccatatctgatctcaaaaacttaattagtgccaggtcatacagattccagataattccataggtttaattcgtggtacgtccatgctgaagaaattctatgagatgcgtgtgtatagtaactgatgtggatcaggtattcaggtgagttctcaaccgatggaaaggtagtgttgtgctgctaacctgacaaaagaacaatgaacacacgtcaggaagtcactccggtacaagccaccattccattcagttagcaccccaaacctgaaattccacgtactggtcaagaatatacgtaagaattcaatgcaaaatcggatatacggttggaaaaacaaactagtgtggtattagtagtgatcttccgcgactctgtgtactgctgatgagggaagaattccatgaagcggaagaatacatgctgtgtctaagtacgccaagaaaacagaggcgagtttccacgtttcgtggaattttttagctccaacaagccgctgtttctgtggaaaaaatgggaggaagatggctagttaggctgcaaatgcaacgtagcagctagctgtaagcacgcacttgggccgtggatgtgaggaaattaatgtgcctaactggctagacactgaaacttgtatataaaggggtgtgcattggcacatagcatgcataacattcaggttcaggagcagcagttgggagtagctagctgggacaacaa

SEQ ID NO: 20468 - DNA, 1501 bp, Oryza sativa
caattaaattcgttgcaattaaatcttcaaaacaaaaccacacatggatatattccaacggatttttttatcttattattgaattattttcaaattgtcgacagtgggtacccgtagaccggatatagagggtattggggtacgctggtacgaggatctacgtagtacgacatcaagcaaacagaaaacaagaattatactggtttagaccccttagcaggtaatagccctaatccaattggtatgggattatataatggaaaccacagattacagaaggaatagcggaactcgataataccgacgagatcgtagtcgagttggttcgactagatcacacggcgacttggctcctgtaggctccggcttcgtaggctgtggtggatgtgttggcggtgtgattcgatgccttacgtcctgccgaggggtcccttttatatcgcgggtcagttgatctccaagtaggactcggagatatcagacccctcacgatatggcaaatacccaatcttgtctgagtaggactccttccatctgtggattccgcttctatctcgtgatagatttctttaacgcatacaaggactatccgtatacgcgcgggtatgccatatcaatatacaacgcatatctaaggatagagggtataccttatccgtaaccctgacagtagcccccaacttctgcttaaatgaactcatgtaaccaatcgtgacttctgatgtcggaatcgttgtcgttctcatctgatcgatctcggtgtgagaaccgtagagacgaagagttatcgacaatgccgtatgaagttcaatggtcatgaatgaatttaaattgaagtctaaaaactaccacacgtaacggacccagaattttccggcggcaatctctctcctttccttggaatacgcaccgtcggtagtgcggttatttaaagggattttggggatccattttgaagtccgtttgccaaagaactctcaagtcttcaagcgcccttcgtcatctccgctcctgcagagaaaaccctagcctgcttctttcgctttactctccggcgatcctccggcagcgatggatctcgacaagtccacctccaccaccgcgtccctgaagaagttgcaagatgacggcgccttcctggtcgcgggaccatgcagagggagttaggaggtattgaacccgaacccatcttgggccgtatggttgcggtcgaagattacatttcttgcggttttcttcctccgccttccaaatttcttcttcttgtcttgaacttttatggcctttctttgcttcacctgaaccccaactccatcgcattccttagtattttctcctatctttgcgaggcctatattggggtagagcccttccttgatcttttccgtttttactatgagttgcgctggatggaatccaatagggtatccggatgtgttggattccgactttgggatcgcctgaagtcgcgttacatccccttccagtgcccctcttctcg

SEQ ID NO: 20469 - DNA, 1501 bp, Oryza sativa
gttcccatgtgaaaatatatttttttagataatggaataaaatagcatcccggcctttactcaaaagagttacagccaattattatagcaaccatttttggtgcttgtttactctttatagctttcaggagtttcaacttgaaagaggtgccttctttcatgaggatttttatggtacattctactactagtatatactaccagtatatttaatctaacggtcgaaaattcatccgatcccccttctaattattctgcagtataaattgaaaagggtatatttgtctttttatctaattgtgtgggggtaattttatgatttcacgtttcctcactagtcaaatctgatccatggccgcccatgcgtcgccgatgtcttcctcttgcgagcgccgccgcgccgccgccatcgggaatcgaatcaatttccctcatcctttcctctcatgtcttttccagcgacccaaaaccctagttcttgagtgaggcgatgggcaggcggagctgcagaaggagcagcgacgcgagatgtatccagaagaagcggtatcacgcggatgatgatatccaaacaaccgaaggaaaattaatcccggtgaaaatacttctctaatttaaatgaccaaaaagcccttttcagatttttccctaataccaaaactacccttcatatactggtagtatatactagcagtagaatgtaccataaaagtactctctttcatctaccttttctttttctgattgagtttaccttttttttttgtcttgaaacaaacattagacttcgctcttccatggtaacgaagactggaaacagcactggaagttccaattcatctatttgcttgacgaaatgctgacaatgatagcagcaactcgaaccatgtatcaaaatatattttgtgacctcttgttctgaattttagtggtgtggtacaaaattactgatatgctttttgtgatgatgttccatgtgttctatatcgttcgaggttacatactttggtgtcagtcagagatggggatgcatttggataaaacctaagtttagtaggtaatgttctatgcagttgtccgcctccattttgccgattatcgtatgacatctatcaacaatgagcatgtccttcttgaattttgttcaaattgattcaaatccagtcaaacattgtttgcaatttaaatctctagctagatttcaccgagagcggcatccctgagaaaaggatccctgctcaaggtatccgccggctgacccatgctaattcatttggtttacagtttatcaatctgaaatgagaataagtagaaggcaagtgcatttataatctaatggcatggattatttttgtaccacaagtgggcaaacttatgcccctaacgaggtgtgattgctgtttgtgtcaaacttgatgatgacatacccgtcgatgacgagagctgcccctccgatgaggccaccggcggtgcatatgttgccacgggcatcttggctggt

SEQ ID NO: 20470 - DNA, 1385 bp, Oryza sativa
caggtttagcttaaggaacccaagtgaaatggtttcttttggtcctctgttcggggaccctcattttaaaaatcaatatttgaagaatgtgattttgtcatcagactgcatttaattttggaactttttttacataaaagccaatatgacctccatattgtacccaaaactcccaaagccttatcttcatcaacttaggtaagaagagcttcagtgcggaagcagaaggcctcgagccaaaagagaagtctgtcaacaagcattttgcacaaggaaagttctcctaagcaatgacacgccaaacgttgtcgccactctatgtttctcatactgatctacatttgttttattttttctgcaaggaaatcaatttcatactatctatgtcaatgctataagcaagaagaaaaattcttcttgagattgaattatatcatcaaataaaggaagctatttaatcagttgaggactagacacgatttatttccgcctttgttccactaatggcaacttggagaactaatttgttattgcaacaattttcattctatatatgtagctgcacaagaattggcaattaatttaattatgaactatttcgttattacttcaacagtttatctaaggtatgattcacaccccctcaaacccctctattctaagaaaataaaaatcaagaaaatatttgtttttcgatctatgtgttggaaaattattgggattttatgtgttggaagaaaattattgtacatattatcttttaattaatgagtagatgatagggttaaaattagagctagtagtcacatttactataaaacttgctctaaggcaagtagcacattccaacgaagttcaatcaaaagaagccaaaccatcgcgccaccgctagtgatgactagaatgacccgtcacaacatgtgcacaatctccgtggtacaatctcaactccagtagtactccagtgctctctggaacctcctagcttgcccgagacagagaaaaaaaagcctcttctctggcccctcttcctccttgattccggtggctcgccgccggtgacgggagggagaggggtcaggctcaatcgcgtctccttcgtatagtagtttagtcgggttagtctcgtagtcgagttagtctcattctgtgtccttcctattcttcgtctttggtcctctatgaagagtccagtgttcccttcttcagatctgaaatcttgtgggtggatcagccagggaggtcagtcttcgcggtgccagacctcgatttcgtcggccctagcgacgcctgattgtggaaaattcagctacagtgccggtggccgaaagtcttcaagctttgactctttgaggtcgctagccatagtttgcggtggatctgga

SEQ ID NO: 20471 - DNA, 1501 bp, Oryza sativa
gacaagtagactatggtaaaatatggcataacctatttgtggcttaaatcaaacacaaaactttagtcttagtagatcaaacttagtgtctataaggttggcaactaaatttgctacgctttaacttaggtaagccacaattttagtaggtagtgtttggttcatgccacaaatctactttgcctaacccttaggacctgtttggtacagcttcaactcctgaatttagctccatgagttgagtctggagtggagttgtggagctgcctaaacctagctccacaactctagtacattttgagagagctccacccaactccactcccagttttggtggagctgaaactgtttggctgagctccagctccaggagctggagctgtgccaaacaggcccttagtcacctgggccacatgttgtacactatattttcttgtctaactttgtctaaacttagtttgtcattttatttgccacaaaaatgtggcaagactcaatttagtaaccttagtcaaaaaatgtgtgacataattagtcctcaaccaaacaaacccttaattaccaaaaaaaatgcttaagtttgacactcaaccaaatagtcccttaggccttattcggtgcagcagtttggagatagatttttattacacgtaaaacgagaaatcttattagcacatgattaattaagtattaactattatgaaagctttttctgtcaaaaacacactatttaatagtttgaaaaacgtgctaactaaaaacgagcttgaagtttggagttgaggaaatggaaacaaacttcattccatcagtgctaactcttctgagccatacacgagccacatatcatatcagctggacgatatcgctaacgttatccttacatccacgagggaaatgccgcacgtacccagaagcgtactaaagagaatcagaccaacaaaaaggttggcagaagaaaaaaaaaaaaagccattgcagcccacagcccagagcccactggctcggcatggcccacaactcccggaatccgcctcacgtggacggccagaatccccgcgcggtcgcggtccaagattctgaccccccccccccaaaccctccacaatacccacgcgtctccactctaccctctcccactgcaatcgggacccacgtcgcactctaccccacatgtcacccgcactagacaaccacccccaccctttcggcgcgagccggattagacagccgccctcgtgccgcgtgcgccaccgatgacgcagtcactcggctaacacgcgaatccgacggccgggacgcgattagcggctcgcaaagccctaattagatcccctctcctccctcctaaacccatccgtgacgcgaggcagtgcggtgcggattccattctcctcttggcatcacgaggcggcgccgcttggtctagctagtagccacagggagaggtggtagccgcagccgccgccgacgagacctcgccgccggggggagggcacca

SEQ ID NO: 20472 - DNA, 1501 bp, Oryza sativa
cgggaaggaggagaagttcgagttccagccaaggacggaacaatgctccatgttccgaataaagtacgggccagccccgtagaacattcagacggtcgaagtggagccacccaaaatggatagcctcatcgtgtttatgaagaaatctctagaaattcaaccatccaggatgaggtcccgttattggaaaacgccggtaaaacccaagacaccggccaagaaggaagaaaagctggctcagaagaagccgccgcccataccaagaacaaagaaggtatggcgtgcgaagcagaaaacgcccactccatcacctccggagacgggtgaaaaatccgtgaaatgaacgtcggaggtacggtcttgcacgtcggacttgaagcgacgccgccctcgccaataggtaaattggtatgtatcctcatatttgttttcatcaatttgatttctgcaacaaagcatgtttgaatttttttaaagaaattgcatttaggtttgaattttgtggcaattattcaaattgaatttttcagagcaaaatggaatcaaattttaaatcaaaattttcagtgtcacgaccacactgatcgatcttgtagattgttgaactctggagcaccatcatcctcccgtttgagtccttcagctttgacttccttaagtttatcatcattagcagagcttgactcaggcttctcatcaaccggtggcaaatccaccttgtgtctttgaattactgtacccgaacgagtcagaacaaatgaatgtaagtaccgattttgcagttgatttatcatcccttcaaacccttgcttctgttctgatgttagcatgtccatggttattggaatcacattgtctggatccacctcggtagacttgatgtccaccatgatggaagcttgtcacactcgtgtcccaccgggcgtgccaaaagcatgttgatgcgaaaaacacacactggcctgagagatctgcttaactctagtgcaggtccaaatcttggtttcgagttcaaaggcatgctagttggtttgatcctgcaaccaacaagaaacaaagaaagaaacacagttaaattcataaacgatagccgatcggccatgtgccgatgacgtatcgtttgtaatctagccgatgtaacgtgaattagatcggtaatgatatgtaaagaaaaaaggacggttagatctagtcgatcggctgtagatattaacaacatataatcagtatatcaaaatatgttgaaaccatgtgactgggatagatcggacaacttgtcgagacagtataaatcacttatgtctaaaagtacttcaatataaagattatatatgtttatagcatagccgatgttgcagatctgacatgtatcggctaatactccgataccactttatactgagatatcaatatagacaaaatatattaaacagagatcaatcaagtattaagatgacttaacagattaataacgtgcttaatatatttaattagagtgaga

SEQ ID NO: 20473 - DNA, 1501 bp, Oryza sativa
ggaccggtagatcgagcaaatcatgtcactaccgttgtcactagtcacaatgttgtgtctgccgtgacccgcggtgcgtcgacgaggtggaggaaaaccttggcttgccatctgcgggaggctatgtaggcttgccgctgcgaagtcggaggccgccgatggatggattaaccacaccacatggccggccggcgtggagcttgacgaccgctagctaggtttagttggttgttgatttcccctgttgctggttctggaaggagatgaactgtaacatatataatacgatcaaaacactagattagcagcagattagttagctggtttgatcaaggctgctgatatatgttgaattgatagcctagcttgactccacgtctccacctcactgtcaaaataggtaaatgaaacaactgaacaaatcatgtcgcttgacgacctcgcaggcagtcaggtgactatcttattggcgcccaggcagcgacttcagcgagcgtgggcctcaacgcggccttcagcggtagcgacgcgagaggaggtcgatgtgtgcgacgggttttttccctgacgaaagtggtggtagggaatgggattggggaagccgtggctctcggcgctgtcggtggctggtggcggcgcatacacaggcgatggcgaacaccattgtagccaggtgcgtatgctgccactaggtggttccattaagcgtcatgccatgcgagccgtgagccatcggatgacttggacggtggatgaggactgactgcacgcctgtgctgtgaaggcagacgatcctaatccgttcatatggtggtggatgatggtgacaatgtggatgcagtgacaagagaggggagcaagatttccacgcgaaaggctaaccctattcaaggccggtcgtggcgacgcttaagagcacccgtaatagtaaagtaaggtgctatctataaaacatgtacatctcagcaatagactagattaatagtaaaccaacttaatagtatgtctacatgggtatctatagctctttaatacattgcctcgtttttctctatagactatctccaggttagtagatagctttgctctctatcttcatttaatctcttccaagtaggaaaatatgctgacatggatctcttatagagagcctatagataaccattgtgggtgccctaagagcaccattaaccccctaggggcgtagttgtggtatctctcctcatgtctttggtggagttcttcagttgaaaaccacatcttgattttccaggatgggcatggcaaagtccttggcatctcaagcatcttggatgagtggttgaaggcctattttgtgatatcccgacccagagcttaataggattaatagaatactcataccacaagttacagctttttatctggatactgatctccaaagaactctgaggttaagcgtgcttggcctggagcaattttgggatgggtgaaccgattggtaaattcttcccgaatgagg

SEQ ID NO: 20474 - DNA, 1501 bp, Oryza sativa
agatgggctgaaaatatcaatttcagaagacccaaaatgcccaaaattcataagtctgcggagagatgaagtcagggaggccgcaggataaaaggtgggctggttgggccggcctgaggtaaccctcctcatcgccgttggatgcagcgctttgggggaacaacttagattagcccccaatgatggttggagggtatttccgaccattccaaccatcacaatcgtcattgggaggctatataaacccctcaccctctcactttctccacacacttcaagcaacaaagctctcatattctctcaagttagtttagtgctctcaagctagtggagtcggaataaaattgtagtcaaagtccggaagtcttcggaagagttcgggtatggctctagtagctttactttcttcttttgtaagactagtatttaatttagaatatacttttgtatacgactctggtattgtaatactctccaattatatgaatacaagctttacaatgtctgagatattatgattatactgctagcttatctgggagatgcattggtacgggtataatgtttgcatatgaaattactctatgtcatgacgatgatactagagtagtatctggtagtttaggcatggtatctagattactcggtatcattatttggggttatatgctgcggatgagaggtgggccgctgatggcgacagctcagtatgggtattcctccgcgcgtgtatatagtcctaagttaattccctggggagggtactcctccgtatttagccctggttgaatggttatgacgggctgtcgtaaggaactcagctgtcaggggtggcttctcaaagtaccaggagggcatcggaaagggggtattagctagttaatcatatacctaggatgtatgtataatatgtatactagaagtatagaaatagattcttttctatactctttccacttagcttaggagatttaatataagaatgagtagcttatgcttgtgtgtcattctaccctgcaattatatttacccctgcttagacatgattaatacaagtaacatataaatattagtttggttctctctattataatcttcccatgggataaacaaatatgatacccttggaatactctcgggtgaaatgctacaatggtatatccatgcgcttgtggataaactctgtaaccataatataccatgactatttttggcgccattgctgggaattatatttctagtaatgtcgttaagaaataccaacaagcatttctagcgccgttcccggggaagatttgtaaaaagagattactaaaactaatatcttatatttacctctatataatcactgtgctttgcaggctaaccatgttgttttcaccttttgttgtgaaaacagggtagtgcatgacaggtttcgacttgccggaaaattttcaagaaaatccagaagtcttcttccgaagcgtaaagccgcgggttgttcccccgcagaagactc

SEQ ID NO: 20475 - DNA, 1501 bp, Oryza sativa
gatggcataatagggtttcatttgcaaaagcagcatttagcaaacatttgagaatttaataaaacagttaagtaattaaacaatattaatccaacgctatacaacataccctgttgtataggcccaaccattctgaacaaccatcccggctgcacagttctatctccaaaccaggaatgtaccattccaaaccaggagctaatcaaattattaccaattatagcatcatttactatggtgagaagtgtgagactaatcatgaaagacattgttagacccgcccataaccgcgggcacggctattcgaatagttttactctgatcagaggtgtaccactgtacccacaagacacaaccccacatcatgtcaccatgtgcctcaataccaccacgatacctcggaaaggagttgtgacaatacccctcgcataacacaatccactgcagtgcaccttcctggatcataatcacccccttataaacaaggcatggactccccagcgacccccgtgggcttatctccgccacttctcagtctggtgccccgcaacgaaccatgctatacaaaagataaagccgttgcccatgctggcttgtggttggcacgattaatgtttcacaaccgaaactcgtgaaccggtccttaattgtcatgagcacgaccatcaaaaccatgtgctcacaacccaccattatcaggttttagttggcacattaattaattaactaatcacgattgaccatcgtgaactatcaataaaccatcatgaaataatagtgaatcataagttatcccataaatgtgctaaggtttctaagcagggctaagcaattatatctaatatttagttgaaccaatataaataaagctcaactagtcaaattatatcccaaggtatcaaggaataaagtaatcaagaacaaaagggctataacaaacaataggttaattccacccaatgacattcgaaaataaatgcaatagttgaaaagaaacaacagctttaaataggatcaacatgctcaaagggttgtttgggatctgtgtgacttgccttgctggccttggaactcttcaaactcttctccggcgaaaacggactcttcggaaacgacggaatctaagcagaaaagagcaaaatcaccaaaacagcacataaacaagcatgaacagtacatgtggatatttttaatgtgtagatctcaattttagaaaaatttagagacttgaaccaactaaatcggagctaagatgaattagttatgaatttttgaagattaaatcggattaaaacacttaaatcggttaaaattgaattatgacgcaataatgaattatttttgaaaaggaaaagagggattattgcgtcagcggctagggtttcggtggaccgggcgcatgggcggcggttcacgcgaacggacggccgagatcgatccaatccaaaacggacggccgagatcgaacggtccacgaccggctcacggcggacgaccccga

SEQ ID NO: 20476 - DNA, 1501 bp, Oryza sativa
ttcctacttggaagagattaaatgaagatagagagcaaagctatctactaacctggagatagtctatagagaaaaacgaggcaatgtattaaagagctatagatacccatgtagacatactattaagttggtttactattaatctagtctattgctgagatgtacatgttttatagatagcaccttactttactattacgggtgctcttaagcgtcgccacgaccggccttgaatagggttagcctttcgcgtggaaatcttgctcccctctcttgtcactgcatccacattgtcaccatcatccaccaccatatgaacggattaggatcgtctgccttcacagcacaggcgtgcagtcagtcctcatccaccgtccaagtcatccgatggctcacggctcgcatggcatgacgcttaatggaaccacctagtggcagcatacgcacctggctacaatggtgttcgccatcgcctgtgtatgcgccgccaccagccaccgacagcgccgagagccacggcttccccaatcccattccctaccaccactttcgtcagggaaaaaacccgtcgcacacatcgacctcctctcgcgtcgctaccgctgaaggccgcgttgaggcccacgctcgctgaagtcgctgcctgggcgccaataagatagtcacctgactgcctgcgaggtcgtcaagcgacatgatttgttcagttgtttcatttacctattttgacagtgaggtggagacgtggagtcaagctaggctatcaattcaacatatatcagcagccttgatcaaaccagctaactaatctgctgctaatctagtgttttgatcgtattatatatgttacagttcatctccttccagaaccagcaacaggggaaatcaacaaccaactaaacctagctagcggtcgtcaagctccacgccggccggccatgtggtgtggttaatccatccatcggcggcctccgacttcgcagcggcaagcctacatagcctcccgcagatggcaagccaaggttttcctccacctcgtcgacgcaccgcgggtcacggcagacacaacattgtgactagtgacaacggtagtgacatgatttgctcgatctaccggtccctgtgggagatgacgccggtgacaaggcaaggaaagattgttggctgggctagacgtcggtgacagaaaggcaaggaagatgatggtttggctgggctagctctcttcaacgcatacaccacgcaaaacgttagatggcatggacagtggatgatggtcaactgcacgcccgtgccttcatcccgtgaaggcagacgatctgaatcccatatgaacaccatcagcacgcggccatcgcaccagtgccccaccactagctggccatcaggaaggaggccctttcctaagaaggaaatggtgtcccatgcgccgcagaactccaacatgccattggcaaagcggccgctagcatcttcatgtaccacccgcgtcgttgctcca

SEQ ID NO: 20477 - DNA, 1501 bp, Oryza sativa; identical to SEQ ID NO: 20377

SEQ ID NO: 20478 - DNA, 1501 bp, Oryza sativa
cagccattcgatctattcatccaacggctagaaacggatgtagatatctttgtgataacaatgcgacagtgaaatcaccgattccccatccagccgagcggatgtgcgccgcgctatccccacgcaccgagcaataacaccggaccatgatgcgcctcacatcctcccctaagtagtggccaggtcatctcttccaccgtcgtgtgaaggcatggtctcagggaaggccactcgtggccatgagcatggagacaacagagtgctgtgacatggctgcggcctgcgggagaggagcctagggtttcacgagagcgtgtgctggtgtggtggagtcgaccggtggccgctctgtcgctctgttacattgcctgttggccgtcgtttcactcgtcattcgctaaattggaaggttgtggctgctattgatttgaaccgtgacaatggaggaagcctcggggcagttggcgaggtaaatatttgacgccgttgatttattaaaatatatttgaccgttcgtttctgttactacttaaaaaatttatgatgtttttgtcgtccgtctaacttaaaaaaaagagcgatcctgaaaagaaaaacgcggcaacagaaaaacaaaagcgaatcggaggtggaaaaaaatctcctccccatctcccgatctcttttttttctttttatttctagaaaagtaaataaacaatctaaattcctaatcacaaaagggaacagatctaatctctaatccctaattttacttaaaaagttaaaaaagtttccgtcgtccgtatataataaaaaaccattatatggtacaaggggcggaaaaatccaattttctaattgtggtaactacaacgatccatataaacattatcattaatatggttatgcatgaaaagtgtatattgtcattggattctttttacccgttgcaacgcacgggcatttttgctagttatttaaaaaattgaagtaattcttaattatttttctatcatttgattcattgttaaatatacttttatgtatacatatagttttacatatttcacaaaagttattgaataagacgaacggtcaaacatgtgctaaaaaaatcaacggtgtcaaatatttagggacggagagagtatttgttacttccatctctagatttggcgtggttgtccacagtgtttcacgttgccacggcctccaccattcgccgagatttctgaccttggcctcaagtctcaacatctgctcctccagccagatgattttcatcttcctttatcatggctttgcctcctctccatcttaggagattgaagcttctagggtctaactctgcagctttattcctcagccgacaacttcatttgtattcattcgtcatttatttattcctgtacaaggtcaaggtgcttgatgaaaccccgttgtgaataagtttgttctgcgtgggacgatacataaaataaactcaactcttttgttttttttttctcttttggaaagg

SEQ ID NO: 20479 - DNA, 667 bp, Oryza sativa
ttggatttacggtatgttgaagttgaacttgctattcaatacagttctcttgaaaatccccaccccatagaagaattgtaagataaagttcagcaaggctaagagaccgaaactataggcttattatggtaggttgaagctcaaaaatcttatcttattaatgtaattccaaactaagagaccgaaactataggctagatgtagaacaggattcatattggatagctatctagatgtttcaattatagactccattccttttcaaggggaaacaaatgtatacagcttccttcgctcagtgcaatataaacacagatatgctgcttgctgcaataatgaaataatcaaaaaaacttgatttttcaccattcaatcagcatgtcactgcagattctgtatccctacaatttttgggggtattatgaggaatcattggcaggatgaatacactaccagaatcacaatacgtagcaaaggcaactcaaaatatatatctactgctgtataattgtattcgatcatcaatatgccatctagatccatcagcacaccactgtttattacaactctagagtttcacaactcatgaagctagtccacatcaaggactgatgtgaatctctctatactgaacctaactggcctaactggctctaccgtgaatgga

SEQ ID NO: 20480 - DNA, 489 bp, Oryza sativa
ttttctttgaaaaagaaagattatagtattttattgtacagcatatgcaacatgtgaccatgtgagacattgccaaataacacgtgcaggactgcgcacattcccaacttttggggaaaatattcacatgggtagctagtttgggaaaaatactcaccagtcaaaatttatgcagcacatgtttagaaatttcaacacaacagataaaacattccttaataggggcatgaagaaacacaagcagaaaacactatatgatgcatataatcaccttgaattccgtacagtttagtggtgtttcaacagtgatcaagttttttgttttcactattaggcatacatatagaaagatgtagcatgtttgaggttggtaaatgcttgagttttagcaaatgaaactgcaggcctgtaggaacataatttcaaaatgtgcatgctgttggtcgttcattctaaaagcagcataattttcatgatacaaactgtagg

SEQ ID NO: 20481 - DNA, 1501 bp, Oryza sativa
tatggatctggaatcgcagattaggtttcatttagagcaagtttaatagtgtagccaactgctgactctaaatcatctatagtcaacttaatagtcaattcatacaatagttacctataaacatatactacacaattaatatctagtcccacctgtcatacacacatgcattttggagtccgtgctgcagctggctacaaatctgtagcccgctactcttctctcttatcttttatctcctcgaaatgtgtttatagttagcttataggctgctattgtacctgctcttatacatctatagtcaaattcatctacacacacaaaaaaaccgaccgtaaaaattatgattgaattcccagttagatttgctatatactcctacctatccatatagattttttttagagaaaaggtcacaaggacccggcctatattgaaagccaacctcgagcagagtttttgctggggttaccagctttacaaaaaggagcacagaaagcactcggagatgattacgtaccaacagacaagtgatatattaaacctctgaaacagaccgaacgccaaaaacattgcatggggctagcaagatcaaccaactcctattctattttgtcttagagcaggtcctccctccttcaacctctttaccggccagcttctctagatcactcttattcatctccagccgatgcaaagtgttgaatagtctttatattgattgtggaaggacaaatgacataagatataagtggaagagcccctcacctcaaggctagcttttgtgatgggaaagactatttacgatcctacgcaaagaactccacggcaataagaaagagacaatttggaaaggtagatacgatgttgtttctcgttgttcatatatagagtccagcaaatggttaaattcagctctaatgtcagcaaggataaagaagtcatcaaaagctctaatgtcagcacggataaagaagtcatcaaagttaagaggaacataatcccagttgagcacatctctacataaacaccaaacaaccagttcagcacatctctacataaacaccgaacaaaatacgccaaagggcagctaaagattatgtacatctctacagaaacaccaaacaaaatgcgccaaagggcagctaaaaattatgtacatctccacagaaacaccaaacaaaatgcgccaaaggacagctaaagaatatgtggtttgtagtttctagatggacagtggagaaaaaaattctaattttaaaatcagtaacaccaaacaaaatgcgcctaaggtcagctaaagattatgttgtttgtagtttctagatggacagtggagaaaaaaaatctaattttaaaatcagtaactagagggtgagcgtgtacggtacggtgttaacacgggccacggccggcggggagcacaaaagttacagtctctatatttattttagtgctagagaagacacatatagtaaggccctgtttagattctaacttt

SEQ ID NO: 20482 - DNA, 1501 bp, Oryza sativa
tgtgcataagcctaagtgtaggattatggatgtcatttgtcctaggttttctgcaagttggagcaccagaaatgtcttcccaaaatctgtttttctcgaacccggaaattcctttccgaagatcgattttacagttatcgtgaaaaccaagaagtgtgcttaatcctttccatgaaagtgtatactccttatggaaaaaacaaaaggatatgctatcttctgtttctttcaaagtgcacagaaattgtatagtaagcaaacgagaacctggctcatctactactacaaatctctgctaacagcgtgaaaatcaacatccatacctgtttttcttagaagttctggatcatacgccctggtgtggccgaactcccggtccttcagcatgtggtaggcttgtagctcccgatcaccaacaatgtcgaggtcggtgtcggtgttaaggaccaaatttggtaaatcatggatcggagatagagattaaaaccgaagcggaatcgaaggaggttgatggtttcggaaacagagtgcgcatcggctggagatcgaatcggctaaggtatgcatcggcagagttcgagtcggacaaggtagccgatgaagtcgattccgacaagatggcattgcaatcattgtcggatcgggttgatatgcttcatgaggattgccacgtgcgtattgagtctgaaaaaagcaattgtatctattaattagatattttatgtaatttacttacagtttgagttggtaagagtctgccttagggacttgttcgtatcctaagttgtaatagagttaggagtcgtgtctgacaagggcatattatgtactttgggttgggtataaaagtagcccaacccgtgttgggctgcttcgccaacctttcactttcgtttactttcgacgagttcttgctttcgagttgggctgcatcggttcgatctccgatgataaggtaaaacttgttatggcggcttgtgttctcgggattagtgctttcatctcaatgatactttaatcttgtttatgtaagttgtcaatttatcatatttcctatataatctagatcaatattgctatctaacctagaattggcaaacatctcttgttggaaggcaaccgatagggttaaataccaacgttgacttagattatatagtatatccaccatcctaggaatcaatcaatgacttgattatctagatattgttcttcttttcatactcattgctgcattagttaagtttgagcttataagttgtgattagaatagtaatctctagcctgtttattgattgccgattagggtttcatcggagtttcaaccgatcttacctgatttggttattttgtctactttatgtttacttaatatgctaagtctgccctttatattaagatctcactctaattaaatatattaagcacgttattaatctgttaagtcatcttaatacttgattgatctctgtttaatatattttgtctatattgatatctc

SEQ ID NO: 20483 - DNA, 1501 bp, Oryza sativa
gacgatcaatcaatcgaacaatgtcgagaatcagacttatcaatgaatggaccaacaatgtagaaatgacatgaccaattgggccaaaattcacaagtctgcgtatgggagcaaaagaggaggccacctgccgaaattgagccaagccagcccagcccatggttcggccgaacccaccgcggcttcgttcgatgcagggttttgatggacggctgggattgatccacagtgacggttggagagtattaccgaccttttccaaccgtcataaccgtcatactcaagctataaaaggctctcactccctccatttcaacacacacttcaagcaagagctttctcatttctctcaagtttagtttagtattctcaagctagtgagtaggaatagaatagaaatcgaagtctggaagtcttcggaagagttcaggtatggctctagtagctctccttttctcttttgtaagatttgtactttatttagaatattcttccttatacaattctggtattaaaatactttccgagtatatgaataccaactttactttatgttaatgttatactgattatactgctagcttatttaggagatgcataggtacgggtataatgtttgctattgtaattactctatgtcataacgatgatattagagtagtatctggtagtttaggcgtggtgtctaaattatcgggaatcattatttggggttatatgctgcggatgagaggtgggccgttgtcggaaggtgaactcctccaccagggaaccgtgaggccccccttttttggttcggccgggggtagcgggtgagattcgagggcttggagagcgaaactgtgtgatcttgagggggttaggcccctccaagacgatgagacaaaaggggtttatacaggttccgcccgctgagaagcgtaataccctactcctgtgctatgctgattgtgggagaaattataagatctccttgttggagtagaaggtgttgatcatgaggggcagaagctgctctagagtctaaaatggctcatcctcccctcaatctgtccatccccctccttaagtaggcctagacctccttttataccttaaggggttaccacatgggcccaacaacctaacttagtggagaagtattacaatctttgcattaaatccatgtcttgtatcttgatttgggaagccaagcgcacgtcgtcttgatgatgtggcccgtcaaatcttgccgcctgacacagggggtgcccctgtcagttgccatttaagagatgaagacttctgggctcctgtttgaccagagcggataaaccgactctggctatgatgagagactaaaaagcctctcattatgatgtgacgggacagagcacgccgcatgccgcctggcacactgacagggtgggggtacacagccgccgtcccatcggtcattcgaccggtcatagactagccacaaatcggtcacagacctgtcagatgtgcaacatgccgcatt

SEQ ID NO: 20484 - DNA, 838 bp, Oryza sativa
atatatatatatatatatatatatatatgttacttcgcatttatcctaatacatcttttttatcttgcagaaaagacgtgttgtcggagtcgtccgtcaagcctgagtggaagagctagccctagaaggaattggagcaggcaagtgacgtaataatataaatgattgttatatttgtaatgcaattaattaagattattagacctgtaattggacttatcatataagattgtgtagtgttctaatattatttgagttttaatataagattactttatttataattagacttagtatgtataattattgactacggaattggtgcgacaagtagcaattgactattgtagtcttaattagacttagcatatacgcacgaaacacttagcatatacatgactattttagtcttagcatgtaatattatttgagttttaatataagattactttatttgtaattagacttagtatgtaattattgactacggaattggtgcgacaagtagcaattgactattgtagtcttaattagacttagcatatacgcacgaaacacttagcatatacatgactattgtagtcttagcatgtaatattatttgagttttaatataagattattttatttgtaattagacttagtatataattatttactagctagggttgtataatatacgtcacctagacttagcttatatcacgatttgtaattagacttagcacgtaaggttgtgtagggttctaatgtacgacatttacacttagcatacatgacttagattgttaaaacataaatgtctcgtgacttagcagatgtttcttgtatcaacaga

SEQ ID NO: 20485 - DNA, 340 bp, Oryza sativa
taattcatttgtatcaaatattttgatagaaatctgggtaattaaacaatacatttattgtagatttatttcctcctgttttggctggatatagcctcacgataagtacttccttcttgagatatgaatcacatgggcattagctggcaagctattaattatttatatcaaatctttttagataactatgaccaattaagaagtacattaattttagattttcactgctatgtttgcatgctacacagtaaatggtatccttttccccaatatgaacatatatattcaacaacttctcttattaaggactcatttttactgaccgcgcatattttccagc

SEQ ID NO: 20486 - DNA, 1501 bp, Oryza sativa
caaaatatttggatttgttcaaaacttttttattcttatttgatgagtgagaagcacaaataatagatagatgagaaaaattaaattaaattttagacagtggttttgcgataataaaactacagaatttagctttggtttttaagtggatcattttatgtttattttgggtgacattgagattttaagtatctgaaattttttttattgctatttgaggagagagaagcatacatcatagatagatgtaaataaacaaataaacaaataagaattaggcagttattttgctacaatacaatccttaattcatcatgagaattatgattatccatgtatgttttttctttgccaagtagtattggcaaacatgaacaatccagtaaaacacgtataaaactataaattctatatactgagtataattgatggacgaatgttatacacctctgaacccaattttgtcaattctttacctcaaatcaactcaaaacttaaaaataatactgtttttgccacctcttcctttctgtatatatctgtccttcaatgttgggtgtattacttgctatgccatcataaatattgtagagacatgtaaatggttgagttaaggtggtgtcctaaaaggccaccataaccaatgtaactaaaatgacatacttaccaatgcaatcatttgtgagtgtgccaatagtgaattgagtgttaaaattgtactttaagatggtctttaagggcacagttacatcgatgcgaaacccgtgtttcaaggcattatgtaagaaagccttagttggctgctacggtcgacttcatctgttagaaaatcattcatgaatatttttaacggtgttatcgtattatctggtagatatgatatttttagacaatttatacatagatgtgaaaataagttatgcacactgggttatgcagtgtagatgatatttttagcgtataaataatgtatcatttattttagtggtacaaatacagtttcttttattaaaagtgcacctaactttcaaaaacaatgatagtaagtagtggtgacaaaagacgagtttatatatgaccaggacaaagggatttttacttaaatctaataaacattctatcacatttagtaatctataccatctattttacggcaaatatatttgttttttttatttagggtaatctatattcccttacaggatatatgtattaatgtatatactaagatatgatttattttagcattctttttcttgaacaacaaataagatgcccgtgtatatgtgggggtttcttttccgatttatattctgaaaatatcctccattttatattttgtccttacattggttgaaacatagcctatgatacatgcatgcgcgcgcgaatgcgcgggctaccttcctagttagtataataattagtgctaatctaaatggtgcatgtatggagctcatggttagtttctaatgtatggatacatacggtggagcccgga

SEQ ID NO: 20487 - DNA, 1501 bp, Oryza sativa
gttggatccgcgccctcgccggctcccgtgcctccaaccctctgccaggccattgctcctcgccggagtaccgcccggcctcgccgccactcccgtttgcggttgcatgttcctccttggctgccacctcccgagcccttttgggcgccggaacactgtcgacgccaagttcgtccatccttcaccgtgtcagctgtcctagtagcctaccaaagatccctgatgcgtccataatggactctagcatgatacttggcccaacgggcctaaagatggtgacataacacccggacagattctggatgcccattgtttcgatgattttcattgacttcaaaggggttttaatatgagactagattcattagaaaggcggtctagttagctttccatacttgtacagaacgtcgaaaatagagttcagatgagataagggtgatgattttagtgcgggctgctccagtatttttgagatggacttgaatttgatatgagatagacctccatcttgacttgaacgcccatcttgaccttctccatctcctagtctctagttctctccatagttcctaatcatatttaaatcattatgtaataattagtcctcaaaatcatataaaagaaatacctaggaacgagctcacatgtaatttcaattgttgggcatgagctctagtgattagatcttgcatagcaacttgaggaatattgtgtgtatccaaattgttgatgtctccatcatcatccccctcatgaagtagagtcgtcctcgacccaagcttatcttcttctctcaaatatagctccaaatcgaaaatgttaaatgtgggactaacctcaaactttagaggcaattcaagtttatatgtattatcatttatcttttccgatattctaaaaggcccactggctctagacgccaagtacaggaccgctggttagataactctacattgaaatgtcatttttgggagttaaattgctaatagtgttgaatgatgaatatattaatttgaaagcacgtaaagtttttatgagagcttcggaagttagagaagcatgttgattgaaacaatacaagcaatatgattttacatgccaatttgacctccctttatagtatgtctgattgtggcaacatttatttaactgtaaaattattgtagtgaaccagcgccgctacggctgggaaggaaaccagaggtgcatcgctgtcagcactggcgtcctgtccctgcatcatttgtccgcatcgcgtgcctgcagcctgttagagatagaggtttgttacatagagttgttacgtgagataacaacgcatgagatgataagataggaagagattttgttttctgttttgtaaccaatcttcaccattgtatgcgccactttgggggcttttcccaaacatatattaacacgtacagcggcctctaacgaggttagaacgcttctgccaacttatatggtatcagagccaatcatgcacgcgtgagatcgc

SEQ ID NO: 20488 - DNA, 1501 bp, Oryza sativa
atttggcatttaagtacatatattttggtagtgtagtttcacaaaaccacactatcaataaatagattcacccgtgagatgacttggttgttccacataggacaatgacatgcatcctattaccagccatctcatgaaattaataggatgccacgtcgacttggttgttccacataggacaatgacatgcatcctattaccagccatctcatgaaattaataggatgccacgtcctcatcctaggtaaaataaccacgtcatctcacaggtgaatccattcattgatattgtggttttgtgaaaaaaaaaactaccaaaaaaatatatgtacttaattactattccctccgtcatacaatataagagattttaagtttttgtttgccacgtttaaccactcgtcttattcaattttttttacaaatataaaaaacgaaaagttgtgctcaaagtactgtagataataaagtaagtcacaaataaaataaataataatttcaaaattttatgaataagacgagtggtcaaacgttgcaagcaaaaaacttaaaatcccttatattatgggacggagggagtaagtgttaaaatatgtgtgtttttctgtaacttcaaccataaaacataaaacatttagttttctgaaatttactaatgatagtatgaatcgagaaaaaaaaagtatgtgaattgggtggcaaatttctccaatttcaccgtcaccgcctcattctttccgatcctccgcgccgcgctgctcggtgctccgccgccgccgccgccgccgccgctcaccgcaacgagcatactaccgcctctcttcctcgtcgtgccctagtgggaactgggaacccccgccgcgcccagctggtaagcgtcgcgctcctaatctgttcatcaaattggtcgagaatttggtcgcaatcacggagtcctcttggagctggagagagatcgtggtgctcgggggagttgtgaggctttcctctcctcgcctgctcgatccgccgccgccaccgccgccgccttcctcctcacgccacatcctcccgccgtcctcgggcagggggcctttccttgtcgcccccttcctctttgctgctcttccgcctcgcctcccatctccgcctcgcctcctcctccatgacttggtcggcctggaggtgttcgtgaatcgtgagagacgctaacctgccccgctgccgtagaggtctcagttggtacctgttgtgcttcggtttctatttcctagccaggaacttttaaattttgcatttcagtttagggtttccgattaaaattacctatgacgtttcaacagataaataggtgttgggatcaaatctcggctaagttaaatccatgttgaattttacttggcaatctaaggttttagtgttacctatatgcgttacttcaatgaggactggagaatgtgaaacattgttattgcaatttgcaactttcaatttcaggaggtagaaaatctctcttggaaga

SEQ ID NO: 20489 - DNA, 1501 bp, Oryza sativa
tgtttgttatagcccttttgttcttgattactttattccttgataccttgggatataatttgactagttgagctttatttatattggttcaactaaatattagatataattgcttagccctgcttagaaaccttagcacatttatgggataacttatgattcactattatttcatgatggtttattgatagttcacgatggtcaatcgtgattagttaattaattaatgtgccaactaaaacctgataatggtgggttgtgagcacatggttttgatggtcgtgctcatgacaattaaggaccggttcacgagtttcggttgtgaaacattaatcgtgccaaccacaagccagcatgggcaacggctttatcttttgtatagcatggttcgttgcggggcaccagactgagaagtggcggagataagcccacgggggtcgctggggagtccatgccttgtttataagggggtgattatgatccaggaaggtgcactgcagtggattgtgttatgcgaggggtattgtcacaactcctttccgaggtatcgtggtggtattgaggcacatggtgacatgatgtggggttgtgtcttgtgggtacagtggtacacctctgatcagagtaaaactattcgaatagccgtgcccgcggttatgggcgggtctaacaatgtctttcatgattagtctcacacttctcaccatagtaaatgatgctataattggtaataatttgattagctcctggtttggaatggtacattcctggtttggagatagaactgtgcagccgggatggttgttcagaatggttgggcctatacaacagggtatgttgtatagcgttggattaatattgtttaattacttaactgttttattaaattctcaaatgtttgctaaatgctgcttttgcaaatgaaaccctattatgccatcctttgttatcctgtgcacttgcatatttgctgcgtggcttgctgagtatgtcatatactcaccttgcaatcattcatcagaggaagagttctacaatgaggctgatggtgtggaggattaggtgtagccttggtcaagctgcctgtggagtggagccgtctgcgccgtttattttattttccgctgcttagatctctattgattgagaggaactatctacctctgtaatgacattttattcgcttattaattagagtaataattgtactctattatcaatttgttattgtgtgcctcggctgattcctggacgagggttcacacacatgtaagcgtttggaattttggatagaaattccgggcgtgacaaagacagtgacggcgctccgcaagctctcctctagttccctccgtgtcacgcccagaaattcacgaaccagaatttctaagctgaatgtgtattaaacccctgtccaggaccagccagggtacacaaatgacaattgttgacatacatatccacgttttacaaaaatataagagattacaaatgcagcgga

SEQ ID NO: 20490 - DNA, 1501 bp, Oryza sativa
taggccaattctggatcatcttctggaatcgtataactgtcaaaagtgagtgactgttcatcggaactgttatagtccgaatactcataaggttgggtcgacgcctgccgtccttacattctatttaggattaggaataggtgtaatcagacctgcttttgacatatctatcctatccttatttgggtaccatatgcactcgaaagcgttagcacgcgcatccgttttcttgctccttggcttcaaacaatcgattgaatctggattcctttgcttatccttcctggctatagtctctcttgtgccttcggcagttcagttaaagatttctgtatcagtagtttgtttccccatttgctaaacaattatttggttatgccattttgggcgtagtaccggtattagagatcaggaaagtagttgggagagctcatgagactctttttgtgaaattcataagtctcaattccccaaaaactcgagttccttttggatttccttcttgattaatgacaaccgtcatcatatcgtattatcataccgttgtcacgtttgagttctttacatgtacgtacaattactgctcaactatatactaataaagaataaatatatagttggtattacgcttgtctgaaaactttgcaatcattggtattatgagaaccaaaattatgccacttgcaatatctcctcttgcctagttcctcagctgatggaattacatgaccagcagcgaagttgaatttgtttttcccgaagcaacaaatcgaaaatcttatcaaccttggtgatatcaaaatcaaaattttcctctttcccagaacttctcacccattgacatggcacaaccttcttgctcctgacccactcggctgctgctactccggattcatcctcttcatcggaaccatacatgtaagtgtatatgtggttgatctttttgaaatttttcttcgcctctgcaaacctttgttcgtgtagggttaccttctgtgcaagatgagataagctttcaaactattattactatgagatattattactatgaaggataaccaaagatcaaaacgctgattcaaaattctattgcatcatccgcccacgaggaattgccgcttcaggctcgcgattcgactttgatcgttatggattggtaccaaaccaagatcaagtcctaggcaagcgggaaacctgaaaaccaaaatcatgcgatcattccttcaagagcataaatgggtaacaactagaaatacatgaagaatcacttctttcgagaatgtgcctgagcacgtgtttcattaagaagatacatgaagaatcacataccagcaaaaatgtcttcacttaaatttataccacaggaagccttgctaatgcctcctcttgtaatgttaaaaatcctgtcgaacacatcaggatgtccatagtgaaatcgtaccctgcacagagaatgaagtatgtcagatacacagcatttagactacaagtctgatgcctt

SEQ ID NO: 20491 - DNA, 1501 bp, Oryza sativa
aggcaatggttaattttcagtcacaattttgagaagtttgggcgcaccataaaaaaaataaaatacaccagcagttcttaaactagttaggaggtttcactcaggtttacgaacttgctaagtgcacatcgagatctctaaacttggtttactgtatcatctcggttcaaagccgcgtttgaccgtggtcttgcctatgtgacacgccacatggacgatgacatggaattcttttctcctttttcttttttttttctcctgcgcaaccgaatcgttaaccatgttcccttatacagtttcgcatactcgttcgtccagttgttagttattcacaggctgtcgcacgtgtggaacgaagaaggaaaaggaagtatccatgtgctttcctgatgggccacccttacctttcttctaaaattcatcatcatgtctccacactactgccactgcaaacagtatacgcattgactctattaatcagcgggggagggaacacggtggcgatcgatggccggcgtcttgccggcaaccaccacgacgaacaatattgtcgggctcatcttcttctgtcagatcgtcatctgacagtgctgaggaagatactgaagaagaactgagcttggaagcagagcaggacgatgatgagaagatgcaagctgaagctgaagatgcagagcagggaggagttatggaccatcaacccgcgttgcggcgcacttcaaggactgtcaagcccaacccactgtaccatgggccacagtgggccgtgtaactgaattcgttgtaacagctgtctaacagctagcgtgtcgcgtatgctgtacgttgagagcgagagagagaactatatatatgaattggggatgaactagagaggaggacttttggcaatctggtggcgaaggcggcggaaggctcaatcctgttggattggtgcataatacatcagtaatcgattgccatatatcttgttgctgttctgtgattgttctagttagattagatcctaacaatctggtatcagagcctcaatttgtctcgaaatcctcttgattttgctgtaaaattccttgcaagggattggaaccgacttcggttggattccgcgaaaaggaaacttgcccttctaggttagcgaaattcggagagtagacaagttcaggcctcggatccaggagtagcgccatggatacggatgggaagcttgatgtgttgctcaagttggtggaggggaacgagaagaagcgggtggaagcggatgagtgtacgagggcggagtaccaagagctcaagaagacggtggaatccagaattcctgtggttgagaagaaggtggaggtgttgagcgaggcgttgctcgagctgaatctcaaggtgaaccgcttggagggatagatgcagaggacagttaaggaagaagttcctcaaggcaaggttgctgatccgaaaccgaccacaccatctggtatgcgagatcttcacctgttttcctctgcttcta

SEQ ID NO: 20492 - DNA, 1501 bp, Oryza sativa
attccaaaagcacattgtgatgccgaaagaatcttcggaaccggtggggttctgattgaaggctagacaaataacatgactgaaatatgtaaatcaaaccagtgaaatagctttataatattatatagatatagaataccaaaagcctgataatgggttaaaaaaatccaaaataagctttttgctttctttttattttgtgtgcgctttcctcctgccttcccgaccacggataggctatggggctttgcacttcttccgcgatataggacgattcgctcgctatctgaggcgttaatttacctactaaaatatcgcctgtttctacccaggaccccaacttcacaactccatttctttccaaattgcggagtaaatgttcttctagatgtggtatttctttagtgattttttcagcggagccttggcttgtcgtatccgtctgaatttcatattttcggatgtgaaaagaagtataaatatcctcatataccaaacgttcgctaatctcattcccaccccgtcgtcgagagcagccagcccgacgtttttatgcgagtgccccatgaagagattttcaatctcgaatctccgtctggttcccaggtggggtattcatccattgatcgaccaactgataaaataagcaattcttccactttctctctgttgcctatcggattgtcgcctgttgatggtaggtttgttctagaggtagacgaggcattactttggctaggtggagtgtttgcgagtactgaagtcaatcttttccaaaaaaggtttagtaaatgcacatcctcgccgctcggctcctccctcattgcccatagtccctaaagtctgtatgtctcttgtctctttgagaccggggatttcccaactgttccttcccttacaccctaatcttaatacccctgttacccgcctgtaggcggatcctaccaaccaaaataaagtgaccgaaagacacaattgcatcggtccaatgagacatggaagcaccagtagatattgaaagaaaaactattgttcggtattattgttgtagttctttgttcctttcgtcgatgaaagtacaaccacccattttccacactttttcatattgacttaagtcagcgaattacccgcggcgaggaggagagattagaactcctggattgaaaaactttttcttctccttgctaattgccgttcctgcccttcgcttcaggccatagtgcttctgaattatttctatacccctttgatgatgcagcctctgactttcgtgggtaaactcaagtctacctcgtaagccacttaaagatctttgagcagctcgagagagaaatccgtcttcattggtacaaaataaccttcgacatttggtactggtcaataacttacggcgagacgagcatccctataccacgtgtatccacactcgtttgtccttttctacttagttgtacagatcacttcagaaaatcgtataaaaatcaagcaagaaaacgta

SEQ ID NO: 20493 - DNA, 1501 bp, Oryza sativa
tggtaggtttgttctagaggtagacgaggcattactttggctaggtggagtgtttgcgagtactgaagtcaatcttttccaaaaaaggtttagtaaatgcacatcctcgccgctcggctcctccctcattgcccatagtccctaaagtctgtatgtctcttgtctctttgagaccggggatttcccaactgttccttcccttacaccctaatcttaatacccctgttacccgcctgtaggcggatcctaccaaccaaaataaagtgaccgaaagacacaattgcatcggtccaatgagacatggaagcaccagtagatattgaaagaaaaactattgttcggtattattgttgtagttctttgttcctttcgtcgatgaaagtacaaccacccattttccacactttttcatattgacttaagtcagcgaattacccgcggcgaggaggagagattagaactcctggattgaaaaactttttcttctccttgctaattgccgttcctgcccttcgcttcaggccatagtgcttctgaattatttctatacccctttgatgatgcagcctctgactttcgtgggtaaactcaagtctacctcgtaagccacttaaagatctttgagcagctcgagagagaaatccgtcttcattggtacaaaataaccttcgacatttggtactggtcaataacttacggcgagacgagcatccctataccacgtgtatccacactcgtttgtccttttctacttagttgtacagatcacttcagaaaatcgtataaaaatcaagcaagaaaacgtatgcgctttagcaacaaagcgctcatcccttcttctttcgcttggaatcccctcgcttcttctttcgcttctacgctcgtgctttcagcaagttcgtaccagtcgtcaggagctccaacctccgcgcctagccgcaaggaacctaaatgctggttctatcccggccaagcaagcaaggtgaaccccggtgggaaagaaagaccagggggaagaagctgtcaacacttctacaatccagtctcttaacactagctttacttgggaaagtagtgaaagtcctgctgctggataaagatactggaaaaagtctcaagttccactaggcgagatgaaaaagttcagaactgggatgccaaaaagagccgatttacaagcaaaatgaaaaaactaccactttcccactatgtcggaactagttttttcggctaaccctatctatctccttaccctgtaagaaaagcaaggcgccctccagtctcgttcgctgggtggtcagagtacagcttcgccttctcctcaggcggcaacttgaaaaactccattccaatccccaacaaagcgggattcaaaatgattgacaggtaccaaagcaaacatcccttttccccttgcccccatgaggaatcctttgtctacctggatcttcaaagagcctcatagccaaaaattctcaagcagagaagccatttctttctc

SEQ ID NO: 20494 - DNA, 1501 bp, Oryza sativa
tacaaacatataggcaaagggataaatatgctgttctaaatttgtaaattagagtatcatcaacaaaaaaagcaatgcaatgatctccagggctaacaaacttcatcagacagaggacaaagaaggaaatttaacacaaatcaattatctcaggtcaaagaaggcgatttcaacattagacaagacaaaaggaaagcaatactactgtaaccaacaaccactaaggctatgtacatcctttgggtgcagagtaaggctgggaacatgatcctctgacgtagagcaatctaatctacgtcagaggaacctattacgccaggccacggacatactttaagtgcacaggccggaacaatcctttatttatgaaaaaccagacaaccactaccagctttcacattgattaccgacgtaaaggaatgcaaagcacgtgaccttaggagaggccgctccggtaggacgaatcggcggcgatgcacgaccgcagccttgccgccgccaccgcgctgtgcagcggcatcaaagaatccacgctcgccagcgccgctgccaccgccacgaaggacctgaaacagtcaggatctaggtactttgggcgtgacctgcggaggcggggaggagagaccggatgcttcgccgcctggaacgagctcgtaaccggagatctcgactggcgcgcggcggcgcggtagaaagacgccatcttgtttcgtcgtttgctgcggccttcggttgaggaagggaagaacaaaagctcaaaactgggcctgcgtttattgggccataaagggatcgcggtggcgtacatgagacccatttaagttggcccttcttgtggcccatatatacaatgggccagagatacctcgccgccacgggtaaccggaactaactgcggcggcggccgcgggggagcagcagaaactctgaaccagcagcaagctagcttcatgcttcaggcttcaagctttagttgctagcctgctacattgctcctcgttgcaaattgcaaacaggcgatggctgatctgatgcatctgatggcaacgggattagatcactgtagatgatccaaaaaccaatcgtttctctttgtggatttcagattcactagcatcaacttttgccctaatttcctccctccttttgacttgaactgtctccttaatttatcggagacgtttggttctcagctggatgagagtgaaactgatgaaatcatataaaacctattgcttttgcctacaacttttgcccccaggtactgtattactgttctactgttctctcaacagttgatcgatgccatctgcaccgtccaatctagcgtgtgtcaaggatccaaatatccaatatctcttccgcttctaccctcccgtgaccgtgagcagctcgagattagtttcttctcgaccatcgaaccctttcccgctgcttctgttcgccgccgccgtgctccagcgcctagggttttcttcgccgccggcgagtgctccagctc

SEQ ID NO: 20495 - DNA, 1501 bp, Oryza sativa
tcaccgatttgttatctttctcttttctactgttgcaaatccaacaaagaattgtgaaagcaattataattattttttttttaaaaaaaagatggcgtagagttttctcaaatttttacaagctttacttcacaaagcacatgacttatcagctatagccagaagatcgcatgattgaaactgatttattctagagagtaataggcaatcatagaaccatccatgacatgcaatcggcaaccaacagatgatggtctatcactcctccatatgttcatctccagcatattcgtgtacagcttgtaatgtacagtcaatagtggcaccttttatagcatgtgtacatgccaacctacaaacagaaagatgaaaaggaacattcagcaacgcgcaaaaaaagatccattttttattcatacagtttgaaaacttttgaatttttacctagcataagaatctttttatatgggtcaagctttaaaccaccagtgttatagtactacctatagctaagatataggtatacttcaatagtcctaattaaacttaattcggtaaaaatctacatagaaaaggttgtgtgctaccatctacggaatgtggaaaatcatttagatttcgatacaatggagttctcaagctgctaaataaatgaataaatttgttcaacatatttttcctaaaaaaatgatgcatagagatgaagtgctgattaaattaccaaaaagttggattgtggtcatcactttaaatccaaaattcataatgacttgcttaaatatagttaaaaatcgaatgtcagtatataattaattgattttgttggaagcctttcatgttcctaggaataacgttaaacattatttagtagagtgtgaaaatcatcatttcagctctaatctgattcttgggagtagcatgtgcgtgagtccaaatttcttagtggcaagcacatggcatgttcatttgtatacatatccgcaccagaaaatacatataattgcccacaaattcaaactgtatgtaccatcgctagctgatgagctcacctcgttaacatgtcaatctgcatatcaggcaaataatctacgtcgttataagaaacaagaataaatttatattataagtgacagtaatgagtgcagcttggaaggaggacaggcaggccatagagctggacgcatacttcatcaaacatgtattaattgggcgtttagattttgtttaaagtccaaagctgaattcaccacgcacagcaaaatataaagatcccaaatgttagttctgttgagggtgttcaattcttcggttccacattgcagaagcttagagataataaaagtgaagattcaatcttagacatgatcaaccaaggataacacaatgaatatcaataaaaaatgtattattgtacaaatatgcatgtacaggctccggcctagagatgacaaccagggtttcatttaccgccggggccgcggttatcgcgccccggcggtaa

SEQ ID NO: 20496 - DNA, 1501 bp, Oryza sativa
ttggatgataatttaacatgtttgtatttgaaaagctcttaaattataaaaatacaaagatatagcatgtttgcatgatgtttaaatgtgatgattgttagtggatgatgatgtggcatatttgcatgttaagcttaaagagttagtggaggataactttatactaagataggataggtgacaaacaccatcaaacctcattcagttaatccttatcagggagagattggaggggatttattctacttctattgtggtgtagaattattcccccacaatcccctcgaaaccgaagaatgcctcgacgatattagtaatagcagggtttctagttgacagttgactcgttagtagctgacagcgggcccaccccgtgtgggacccaccgggcaggcacatctgatccaatcctaccagcttcttcggctcttcccataaactgcagagtactacgccgcgtcaaaacgcttagaaataggcagcagaaaaaaaaaaagaaaagaggaaaccgaactccgctataaaaccgcgcctccgccgcgacgaagccgaccaagtgaagcagcgccgccgccgccgacgacgacgacgacgacgacgaaaccgccggaggcagagaggagcagaggttacgcacacggtttcaggttcccccccctccctccctcccatgaaatccaacaccgttttcgagcttgatcgtctccgatttcgtttctgggcggcggcggagtactagtggagacgacgcggtttgtgtgggggatgggattcgtcggctcggcgctgcgctggggtgagtggatgtgggtgtaggctagtggggtgcgcgtgcgtgctagtttgattggtgttaggtgacgatttttttttttttttggatgcggcggtttgttaggcgcgtgggtttgtgttgtgcgaccatggtttggatctcggagctacgcatgcgtactgtttttgtgtttaggtttattggcaattatggctgcctcgtgagtactggctgtgttcgtgatgagataagttgattgaccagtttttcatgttgaatgaatgaaattgttttgagactttgtctttgagggtttatttgtttattgactatgtggtttatgttaccgacaccgtaaattctgtgtacagaaatctcatgtatgtgatgtatggaggtcaccatttttagccgagagagcaatttcatttttagacgatctggaattctctccttctgaatagcatcagcatcatagacgcccattgtggcagtacatatcctgaattcctgacgctgtatgtctctgctgacaatgtcttaataaggagcgaacggagaggattgcccactgaaatttattaagaatggggaacaatttaggctggaacattttacaaccggtctaaggacattgtctctgctgacaatctgatatatttcttggtaaaatttatgtgctgtacagactacaaggggtaaagtagtgagaagagatggtaaggt

SEQ ID NO: 20497 - DNA, 1501 bp, Oryza sativa
ttaggggggcaaagatgcaaacagatgattcgaacctaggtctctaggatagaatatgcacaaccgaaccaactgagctaatcacatttcttattaaatgatttctttagttgtttatattataacaactaaaatacgatctgtgcactttagcaggcaaccttaatctcccaccttctctcctctcctctcgtgtctctcacctcacccaacacgcacgagagcgccgccccatcctgttcccacactgcatctcattttcttctcacgctctcgcacatcactgccacggcgcacaccgacggcggcggcggcagcgcgcatcggcggccagcggcgcgttctcagcagcggcggcggcgagcccgcgaggggatcggccgcggcaggccggcgacgggccgaggccgacgacagcgggtcaacggcaagcacggtccttttcttagccacttctcataggttgattccccatttggccccaaatccaggtcagtgtcagatccaggtcaatgtcagcttttttttttattattcaggtttgttgcatcatgagtctatctgattgagtttaataacacctgcagatttttcttgttcatccgaacggatatttggaacataggttttaaacacatgtgcttctggagtcatcatctgtagattaactagaggtaatttatagtaaggaatttaacttggagatgacagctttgacattagattgctggatgttttttctgtaaattgatttagctcttctctatttttgcagagtaaaagcttttgtttcagtgtataaaggaggtctattaggttgtgacaaaattagctgacactgattttatactggtacttttctaattgccctatttttgctacatcatgatcataagagacaattccttgtcattgttattatctacaagaacctgaaatatcaattttttttatataggtcgaaatggatttagaaaccatcaagattcttttgcgctaccctagaggttctgttgagtacttagctggagtagatggatttcttgaatttgtatataaagataagttagaggatacaaagatttattgatttaagttagaggatacaaagatttattgatttattgtccatgtgaaacatgcgtacatactatgctactttcaaaaaatgatgtctatgatcatttggtgtgcaatggaatgcttcagagttatgaccaatgggattttcatggtgagtcttcagaggagcaaattaggaaccaacaaccacagcctcacaatgaagacatgcgtgctaacatgcacgaattaattaatgatgcacttaggactgtgtatgacgacatgcctatgagtgattctgcagattcgccatgtacacacactgatggaccaaatttagaagctcaagcattttataagttggtgaaagattcagagaagcctttatgggatggaagtgaactatcacacttatctctgctagtgcttttgttca

SEQ ID NO: 20498 - DNA, 1501 bp, Oryza sativa
agtagtagcggtggcgccgtccccgacgccagatccaacggaaggggagacggtgggttccccacccagaggtggtggtagcagcgtgctccctgacattggcaacggtgagcggcaggcttactattgttgtgttcttagtgttcttgtgttcttagtgtggcttcatcaactctttctatgtgttgttgtgtgttgattttgttcttttatgttagatcgaacttgattgaatcgagccgattaaaatgtttattctatgattgaactcgattgatcaagttgttaaaatgttcattctattattctttggaatctggtcggtgtgaactggagctgctcgaatgagccgatgcatcaagccgactttgtttttttcattcttgcaacactacaacaagaacccccctctagcaatacatgcttggcaacgcattaagcatgcgttgccaaaatgcgaccctagcaacgcttagtagtgggtgagcccaatttgcaatagataatatgtgttgcagaacatgcgttgcagagattgagtatcttgcaacggccgaatccactttacaacagatatcatgcgttgcaatggtcttgatgccctataaaaacttttagaataagcgaacttattgtattttttaaaataatcgagcgagatatttatttttacatttcggacctctagcgaactgttttttaaaagaaattatgaagtgagttgcttttttttttcctgttaaaacttttggactaagcatgctttttaaaaaataataataattgagcgagctgtttttttacattgtgtactgggcgtgctgtttttgttttctaaaaaatttatcaagcgagtttttttaaaaaaaaatgccacaagcgaagtggctgctgataggggaaaaaaataggctgctgatacctgataggaataaattaggggggcaaagatgcaaacagatgattcgaacctaggtctctaggatagaatatgcacaaccgaaccaactgagctaatcacatttcttattaaatgatttctttagttgtttatattataacaactaaaatacgatctgtgcactttagcaggcaaccttaatctcccaccttctctcctctcctctcgtgtctctcacctcacccaacacgcacgagagcgccgccccatcctgttcccacactgcatctcattttcttctcacgctctcgcacatcactgccacggcgcacaccgacggcggcggcggcagcgcgcatcggcggccagcggcgcgttctcagcagcggcggcggcgagcccgcgaggggatcggccgcggcaggccggcgacgggccgaggccgacgacagcgggtcaacggcaagcacggtccttttcttagccacttctcataggttgattccccatttggccccaaatccaggtcagtgtcagatccaggtcaatgtcagcttttttttttattattcaggtttgttgcatcatgagtctatctga

SEQ ID NO: 20499 - DNA, 1501 bp, Oryza sativa
actgctccggccagatatattcacaggcaacggtgattactgaagtaattaataagcacaatgcagtgttaaattttactaaataaagagcgaaccaaatagagttggcggatccagcatgggggcggcggggtctcgagccctccattactggcgtgaagactatgagagaccccacaaagaccccactaaaattttttaccatgggagggggactgtaactctatctagtttgcttagaccccactactatttatttctagatccgccactcttcatatttttgctcagcaatgtgcacggcaacatatatggaatggcgtttctgtgctcccgaaggaaccccattctcttccaaactgttcagattcttacccagaagataaattttgctacggaacacctcaaattttagataatttgctgatagatatggtaaaaacgtgttatggctgaaagacaccataaaaaactgataatttgctagagaatactttcgattcaattgaagagagaattcttttcaaagacgagaatgcccctagggccaaaagcttctgagttgaggctggagtgaaaatggaatatgatgtacgcttgcgatgtacttaaggtgatcacaaatttaaagttgcataatttctaaactttcactctaacatcatgtgttaaagcatgtggtcctaagggtattcttgtttttcttaagaatttatctccagcaaagtgttctacaagaatttatgtgcagcaaattgttctccaacaaattactattttttgggtttttttttcagctatcacatatttttgtgatgtctacaagcatattatagaaatttcgggcatcatgtaacaaaatttgcctacccaaaatataagaaaaggaaatatcctggggaaatgagctatgtgttgaaaactcatgaaaaccatactttaatattttgtaaattcatgaaaaaatattagagataggtgtaaataagaaataaattctcactaaatgttaagtccaaactcaacttcatttgagagaaagaaatgacaaacttcatatgaatataactcacaaaataaattagaagctagaaattaagaaacctaacttccccaaactttatatgagtagaactcacaaaataaactagaagctagaaattaagaaacctaacttccccagatttttatgagctgtttatcataatcgcaacttctcaaacaagatcttaagctcaactaagatagattttttaagagtgaattcagaaaactattgatacatcgaccaaactatatatcatgaaactatagttttaagaggtatatcacaaaactatagatttaataatcaatttgttacaaatttacaatttattttaaggtgatgttctaaggtagatttatgtgctataatatcggtgcagaaaaactgaaaacgaggagagagcgagagaagagctgggggcagctataaaaaaaatgtatatttaacttgtac

SEQ ID NO: 20500 - DNA, 1501 bp, Oryza sativa
catacaagatgcctgttgatgacttcaattgctttctcataattccttggtagtttgaccctctcccataatttatttggatgatgagctctttcagctgttttcatgtataggtagaaaatacctgcaaggccagaaaaaaaaaaggataaatacaaaatacaaacagaataatgtaacaaaaaagatcagatgataggcataatttctatatgggaaagaattgggagcatatatcacaagtatgcatgattcaattgaagattagactgcaatatatctgcatccttggacagttagacgaagagcaattttacggtccttgagaaggtaccataaagtcctattttttctattattaaattggtacctcattgtacctaggtactatgaggtaccaaaatttacactaaaattttggtatctcatgatacctcctcaaggacagtagaattgctcttggactaaaggattctgaaagcctataagcaattcactcatggaaagaaaaaaaaacactttctgcagtactatggagtatattcactttaaaattaactaaatgaatggacttttaggcaaaaaaaacattaactaattaataagcttccatgctggctagaccaaactaaaaaaaaacagtcatttgttgtgtttaactttgaggttttatatatccaatctactcacaaatcaaaatatcatcgatcttataagggaattaataacaattatcagtcacaattaaatgatttccttcaaatcaaaagcaacgcatctcctaattgcaactgcgaatgtcagtcaacaagggggagataatcccttatatgccactgaaaattggtctgatcccttatataccactgaaaattggctcttcccttatatgccattggtccaaatttgcgcactctctcatgccactacggtcagttgatcgtgtgttgaccgttaacttttaagtaaaaaagacatatttgccctctctgagttattaggcatgccctatactcagaagggtaaatacgtcttttttccttgagaattaacggtcaacacacggtcaactgacgggagtggcatgagagggtgtgcaaatttggatcaatggcatataaggaaagagccaattttcaatggcatataagggatcagactaattttcagtagcatataagggattctctctgtatatattcaccgtcatggtcgcggatggtggcgtagcggctgttggcaagagggcaggagctccggttgcatattccggtggcgttgtacgggttccggcagaatatccccgtcgtgatcctgccgcaaaaccaaaaccatttatcgtcagaaatcaaagaacaccaccacagcgaacgaaagaaagaagatgattgctgctctgctcgcatatatacttggccatgaagctgcagtggttgtgccggatgcagtgccatatcacgtcgtcgctcatccttggatgccttcctctttgcctgctagg

SEQ ID NO: 20501 - DNA, 1501 bp, Oryza sativa
ggttgaaaatgtaagtgcaatcacatttttttttaaacttggatgacattaggcagacctttttatattcatctcaagagaaaaaaaaaggaggttttacattaagataaaaatttcagcccgacccacgtatgatgactttggacctggaaaagcccatccagaagacaaaaatggcctcaagcccaatgacccaaaacctgacaacgaggatgatagtttagaaagacaaaaagaaaagcatgactaatcattatttttaacttttaaatttaaattaaaaataaacctttccaaaacttatttttcaaaatttcaacattttaaccctatcatcccggcaaacgtgacaaaacagtaaaacaatattataacatcacccgcagcgagcgtgacagtcctgtcatggcttcagggcagcgtaacaaaacaaagcttctataccatccggaccgtatagccaaataacattgttttatcacttgacctcaaaatgtttagctcttgaaaataactttttaaaatgtttattttaaaattaaaaaatcaaaaaggtttataaaaaataaaaataaaaaaaattcttacggtggtaaaggccgatcagcccgccgcaggcgcaggtgccgcttaagccgctaatggcgttccgcttccgctctccatcccaattccaccgacggacgcgaagcccatctcctctcccctcctctgctctgctcgatcgcggccgtttcgcttcgatcgtcgtcgtcgataccctagcaggtagccgaccgacgatcaatccagtccagctgcttttcttccatccagcgtactgatgatcatgatctgatccaatatgtgctcgtgctgtcattttcttttctcttctcttgatcgtggggagagagaatctgggctgagctgggcagtgcgctgcttcttgaattcgaatgccctgaagatcaaattatttttctgtttcgttccattttttcctatttgctggttttgatagaatcacatatagaggagatgtcgacgcaattgtcttttgtttataaaacggtaaaaaagaaggggaaaaaacgaaggaagacgcatgtagaagataacaaatgcgatccattctcatcaatggccgatggggattacgggattagtttgtgtaggtttataaatgcacggttttatcagcattgtgatttgtcagaacaatgcgaggtactcgatcgacagagcttagcggcaggattctaagattaaggacaatgatttctccgtattattttttatttacttgcatccgtcatgcatccatttcgatttgtgaagctccattgagaaggctggaatttgacaataacctgcaggagccggaaactgttgattttccaaactcattatcattggcctctcacgtttccatggaaatattttgctggctgccatcttaatttattagtagtctccttggatcaggtggagcttgcttgttttgtttacgtccatcctt

SEQ ID NO: 20502 - DNA, 1501 bp, Oryza sativa
gccacgactgatgattgcaattaaaccacccagcagatttctaaggtttaccggcttatctgccttcaagggtgcagatccccaaccatcgtccgcacaatcatagccataaaaattggttttgccaccaaaatcaaattgcttgtgctcagccaattttgactcaaaggaattgatgatgtttccagctgttcccagtgctccttctacatgctgtgggaatgactttggatcaaatgagttcatcacatcccctatcgtgcccaaaaccttggattggatctcatccttaaaactgttttccactcccggtgtaggcaaagggtgatacttgaaaacctctcgcgaggtcgccatggtcataaattactaccacacaaaagttactgaaagagtaaaacacgaaaagagaaaataatcaaaatatgctggaatacaatttatctaaataacaaccaaatggtaataactactcatattcagaacaaaacaatctcagctgtacacaaaatttccacgtattctgcgaacagggttgaacctaacgtgggcatggggatacctctggttgaacccacagttttttttttatatatatatatacttctatatattaagaaaaagagaaaaacctaggttccagatctacatgttattacaggctaaggcgaaatcgaaagaaagaggatgcgcgtcggcacgggagctcaccggagacgtacggcacctaccgctgctcccctccccccgaggaaatcggcggaggcgggcgaaattagcgaggaggagagcgacctcctggagttggaggcggagaagagattggagttgggcgcagggaggatgcgggcgggagtagcagcagggacgccttgcggttgcggggctcgcacccagccgccggtgatcggagatcggcggcgcgcgcgccgcgaaaatagcggcgacgtggatgggtgggtccctccgtccgtccacggggagatcgatcggccaacgaaggcgtgcgaaggctcgcttgttgtttaagcccaaccgagactccgtaacgtaacgctaaatgatttatttatcaatttaacttaaactgagacaatttttaagcgaactgcgaggagaggataaccaatttgttaacataggatatccgaatatagtcttttgttacacacgctatctgtgaaaattacccattgcacgctacacgctcgtttttatgtagtaattactaatatctttcctagctactgtataattattatggactgaaattattaaaatttattaccagttaaattagaacttcaactccggacggaccaaagctctagcacgttagcagatccagggttcaagataggggtgaaaacagagcggattcggacggataatagctataccatatcctaaaccattttttttaaacggatgcggatgacgtgcggatacggatgcggagcggattttttcggacgtcggattcggtgcggactcagttcaa

SEQ ID NO: 20503 - DNA, 1501 bp, Oryza sativa
cttgttgtatggattgaatacaaacttgacatccgacaactttttatccgtttttgaactgagtccgcaccgaatccgacgtccgaaaaaatccgctccgcatccgtatccgcacgtcatccgcatccgtttaaaaaaaatggtttaggatatggtatagctattatccgtccgaatccgctctgttttcacccctatcttgaaccctggatctgctaacgtgctagagctttggtccgtccggagttgaagttctaatttaactggtaataaattttaataatttcagtccataataattatacagtagctaggaaagatattagtaattactacataaaaacgagcgtgtagcgtgcaatgggtaattttcacagatagcgtgtgtaacaaaagactatattcggatatcctatgttaacaaattggttatcctctcctcgcagttcgcttaaaaattgtctcagtttaagttaaattgataaataaatcatttagcgttacgttacggagtctcggttgggcttaaacaacaagcgagccttcgcacgccttcgttggccgatcgatctccccgtggacggacggagggacccacccatccacgtcgccgctattttcgcggcgcgcgcgccgccgatctccgatcaccggcggctgggtgcgagccccgcaaccgcaaggcgtccctgctgctactcccgcccgcatcctccctgcgcccaactccaatctcttctccgcctccaactccaggaggtcgctctcctcctcgctaatttcgcccgcctccgccgatttcctcggggggaggggagcagcggtaggtgccgtacgtctccggtgagctcccgtgccgacgcgcatcctctttctttcgatttcgccttagcctgtaataacatgtagatctggaacctaggtttttctctttttcttaatatatagaagtatatatatatataaaaaaaaaactgtgggttcaaccagaggtatccccatgcccacgttaggttcaaccctgttcgcagaatacgtggaaattttgtgtacagctgagattgttttgttctgaatatgagtagttattaccatttggttgttatttagataaattgtattccagcatattttgattattttctcttttcgtgttttactctttcagtaacttttgtgtggtagtaatttatgaccatggcgacctcgcgagaggttttcaagtatcaccctttgcctacaccgggagtggaaaacagttttaaggatgagatccaatccaaggttttgggcacgataggggatgtgatgaactcatttgatccaaagtcattcccacagcatgtagaaggagcactgggaacagctggaaacatcatcaattcctttgagtcaaaattggctgagcacaagcaatttgattttggtggcaaaaccaatttttatggctatgattgtgcggacgatggttggggatctgcacccttgaaggcagataagc

SEQ ID NO: 20504 - DNA, 234 bp, Oryza sativa
agcagttttcttctctttctcaacatcttcttattcatttagatgaacaaaggcttcttaatttcttgagagctttggggaagttgatcaagctgaattcacagtgcaaggaaatggtgttcccatgctgttggcttgaggttcttttgtcagcacacagtgatcacatatctcttgatgaacttgtgctattgaactgtgtcatttctaagggcagacaactttggcgcctca

SEQ ID NO: 20505 - DNA, 257 bp, Oryza sativa
ctaattacgctgtaatgtggtgctacagtaaacatttgctaatgacgaataattaggcttaatagattcgtctcgtagtttggcggtatctataatttattttcttattagtctatccgtatacgtcacaattttttttggctaaacaactaaacacagcctaagttcagctacctggccacctcactgccatgcagaccacaaagaagtttgcgccagctgctcatattcatataaatgtcatacatatgttagaa

SEQ ID NO: 20506 - DNA, 199 bp, Oryza sativa
cggcgaagggttggtgcccaatgctaggggctcagttctgcctgcctgtcccgggtatcccggccgtaggcaggattgggtcggtactcttgtttatggctaggatgggttggaaactatgtcacgtcttccgtctgtataccgtggtggtatgtggcgcgtggtaacacgtgaggaagatgtgtcttgtgggtaaaga

SEQ ID NO: 20507 - DNA, 166 bp, Oryza sativa
tactccctgggatattttgacagtaagaaactcacataaaccaaatcaagtttgcaagcactttaaactaaatcactcatcttaataataatatcccttataaattggttatatggctgtttaaatgactttttaaatcatagtgcaaagtaaagatgtcgtagtg

SEQ ID NO: 20508 - DNA, 1501 bp, Oryza sativa
tctctaggatcagactcacatttcatcagtatcaaagcctaaaggcaagataaacacgcatgtcgctctggtatctgacggtttcaaccagctgcagtatgcacattctcaatcagcagacaaccaaatagaccccatctcggcgatcacccactctgactgcggctacaccaacactggtacaccacctgtgaacgaaagctcatgcccacgaggagaacctgatgggcgacggctccagccgaaacccaaaacaccacacatccctccactccacctggtgctttgcagagagcacacgcgcacaagctcctattccacggggcaccgcgcccgcgccgccgccatgggtggatccaggttacattaggtctcagcgccagccgaaatatgcgaggggaggacagcgcggctcgctctacggagacctcgatgccatctaccggagaggaggtaactgaccttgaggttgtcggtgaaggccggcagcgccacaaccatgttgatctcccgcggtggacttgtggccggagacgagaggggaagaggcggcaacggcgggggaaaggagaagacgatggagtcgtgggagcgactcttttgtctccttagtgcttagtgggccccacaggcccacctcattatatgggctcaatttgggcccaagtttggccttcttcagattgggctcctttcgtttccaacgagtttgagcctttttttttttacctccctttcttcttcttttttctttttctgaacgcgcacaatccttgcgcatcgatatattagaagggaaaaatatattttacaactaatacctgttagtcatcagggtaacaggaaataggtggaacactgaaagacaatcgggcgcctgtaaacaaggaaaaggagaaagagcttgtagatttgcatacattctttcaaaatttgcataaatttcacttgcattttaacaaattcaagtttatcctcccaaataaacaaaaaaaaatcttttaaatcctcccttgccgctcacatcggcaaagcaatagtagcttgcagatgattttctgcaccctccatggaagcaaacgaagcccagaaatgacatggcaagcagctttcacgtagctttgtgctaagtgcaaacttcaccaccaaaccaagccatctgcaactctgcagcaaggccgccaagatagatcatcgacgttaaccccgatgcgatgtttaagctaataatccaagtcaaaatcataccttgccatgctctccaagctactccaattttctgcgattgatgcggtaatggacagtacaactaccagtacaagatccgggtgacaagccaagaaaacgcggccgcgcgggaggaggaggatggaggagaagaggcagcggctggtgatctctctctcggcgctctgcctcgccgtcgccgtgatgtccggcgcgctgctgccgccgcgggcgtcggcggcgggaggggtcgggaggaagcggcggtgggccg

SEQ ID NO: 20509 - DNA, 1501 bp, Oryza sativa
tatcttatatagatcaaggttatcaataatggccactcatgtattagagtggctgatcagctttcgttttcgatgtgtcaatagctttggcacatgatgctccggttgcatggctttttgctttagcatgcaacggctggctactatttgctatggataaatttatggtcggctatgcttattttgagaaaggggtgtcaccactcaccactattaggtgttctcttgtatctttgacagagtgcacattattaaaacacaggttgattaattatagaacatttgaaacttaaatctgaaagaaagaaaatctttttatttactactaagtgaaaccttcttttaatataatttgaaaattacacacaactagatcctttctattaagaaaaaccatttttgtttatgcacaaaattaactctgtttttcccagacaaaaatgaattttgtttgctattagggggcactacaagtaaatgcaaactcatttctatgagatagccttctgtaaaactaaaattcaatacaaattttacaagtattgtaaatttaccgctaatatccgacttccaagggctcctttgaatcgcatgtgaaaaaacggaattatatgaaaacataggattttgacatgaaagcaaatgcaaaatacaagattacacctaggaatcagatgattgaaacttacggctccatcatttcgcttattattgaatatttgcaaacgaaaaataatttgtgaatagaacttttatatatgtgttcttagcgacctaaagcaaaggatgaaaataaacttcactgaaaaactccaaaaacaactccaaatttaagcttgataatttaaatttcgactgataagcataattataagcgaaaatataagaccgttagaaggaaatttttcaagatgttacaactctgactaacttcctttcaaaatctctacatgaatgttccttctataagaattccagagaaaatgagagtgctgtagaattaaaatcctcctatagtataaataaagctactttatgtgcttatatttttttttctaaaagtaaatattaaagaaaatgtcttttgtggccctccaaccccaatgatgcccattgcgagggttttttttttttatatataaataagcgacccaaccattccccgggagtcaaggtggaagagacggacagaggccactacccgtgcaccacgccccctctcccacaatctcgcaaaaaagttgattttctttttcagcttcctcctcccctcctccgcttctcatcaatccactagcatatcagatcagattcctgtacacttccctttcctcgcatccaatcccgactatcaaatcatcaccatccttttgcaaaaccaaaaaaaaaaaagtagataaaagaagaaggttcttgcatccaagagaggaggacactgtccgtcgtgcagcgtttcttgcttggttgaatcgggtggttttgggggggatggcggggaagg

SEQ ID NO: 20510 - DNA, 1501 bp, Oryza sativa
gaatcaaatgataggaaaagaattaataattacttaatttttttaataatacgaatggtcaagcatgttttaaaaagtcaacagcgtcaaatatttagaaacggagggagtacattcttggacggagctaatagctcgtactccctccgtactcataaagtaagtcatttagaataatgtttaagtcaaatcttaggaatataaatcatgaataactcttaagctgttgagtttgaaaatataaaaactatatacatagatttgtcttgaaaaatactttcataaaattcaataaatattttttataaaaacaggaagtcaaaattgtgttttggagaccgtgtcactatcccaaacgactttatttatgtctcaattgttaatctcaagacaaatttatctttagcaattgtatcagagtttgtaaaaaattgcattgggatttgggagtagataaagataggaataattgcattaggatttaataaagttcgggtattgtagtctttttttttaattttatattggtatgtgtgatggataaaactaaacttatttcgtaacgaagagagtactccctatgtttcttagttcttcgagctgaaaaatgctctttgcttttaaatttttttggacgtgtcgtttgatgatttgtcttatttaaaagcttattgcaaaaataaaaaaaatacgtcatgatttaaaaaatctttaataacaaaaacaagttacaaatgatatttgtttagtatttcaatttggatgaatggtgaacagtatgtgtaaacatcaatatcgtcatatattaaaagacgaaggtggtatttcgttctatccttttcttctcctgtatgatcccacactctggtgatgtgtatctttcttctccatgcaacgaaggcaacaaggctggcctggctactttgtgctcttgtgagcatgagaatcaggcgtattattggtgccagaagctacgacgactttatcgtattcagatctcgaatttgttagaagataagtaaactgttttgtcttttttcaccagtttaatctttctggttaaacatttaagttgatgtttacatccaaatttggcacatatggatgaaatagaggaaaattaccaaagtttagaaagtgtcgggtttccttcacaggacaggtcagaccacaggtatgtgggcggtctgaccgtggcctgaactccggtcttaccgcaggtatgcggccggtctgaccgtcagggtccgaacccgaatctgttttcgtcgggtctctctaaatcagctccgctagccggtttagccgttttctacaaaaacccatcttgatttggccctttggctaggtcgaggtggttggtaactccatatcactgcaagacgtttaggtactgcgattgtgattgtcaacttgtgaaaggaagatccacaggaggagttaagcaatagtgcaacagaaaagcaattagaacctgaagaagcattaatctccatgtttg

SEQ ID NO: 20511 - DNA, 1501 bp, Oryza sativa
tctttcccctcttcagtaagagaagcgttggagaagatgtcttaggtggagtcctggcttataccccagttgagcgcctgtgaagatggagccgtaggcccgctagtccgttgctgtttatttttgattgtcaggccttaagtgcctttgtaataatgtaaatattatcgatataataaaaatgtgtcttttatatcatgtttgtgtggtgtaccccggcttttcctgggacggggattaatacactagcgttcgggaaaaggcaattttcccggtcgcgacaagcgtggtgtaacatcccggtctagggcttaataggattaatagaatattcatatcaacaagttgcaacttcttttccggaagccaatctccaaagaactccaaggttaagcatgcttggcctggagcaatttgggatgggtgaccgaccgggaaattcttcccggtgcacacgagtgaggacaaagtgtgcagaaaagacatgtgttggtctgtgagggcagtctatgacctgtgaaagctatcagatgtaagcgggcccggcctgggggaaggcgggacgttacaaaatggtatcagagccgactctcgcggtttcacgggcgcatgtgtcgcagttgcgcaggcatggtgcgcatggctggtgtagaccgggagtggttacacagcatggcacatgcgctggcactggacacatggacgtggccaagagaggacgttcctggcctagggttgatcgacgggggcgtcgatctctcttaagggggtgagggtgtaacatcccggtctagggcttaataggattaatagaatattcatatcaacaagttgcaacttcttttccggaagccaatctccaaagaactccaaggttaagcatgcttggcctggagcaatttgggatgggtgaccgaccgggaaattcttcccggtgcacacgagtgaggacaaagtgtgcagaaaagacatgtgttggtctgtgagggcagtctatgacctgtgaaagctatcagatgtaagcgggcccggcctgggggaaggcgggacgttacacgcagccagaagatcaccgcccgcaagagcacctccaggcccgagcttgttcgtcagtccctggcgtggacttgcttcgtcgagacccctcgtgccgagcctgcgcccgtggttccccaggagggggaagccttccggcgttggtagcacggagggtgcgctgttgctcaccttccgtcctggcccgtcgcagcagtagacgagcagttagtaggcttgcgcgtgtgtttttctcgtttgtcttcttgttgagtcgtgtgggacatggttatgccggtgtgtggcataactatgtcggagcctgtcttattttattcgcctaagcaacttgaacattaatgaaccaatttaatagcagtaataaatgtaagaataatggtagtcgtgggtggttagttttaattgttagctccttctctgtttgctggttctgtgtggggttttc

SEQ ID NO: 20512 - DNA, 837 bp, Oryza sativa
agtaaccaaccatcgaccattttcaaggtcacagtcacccaccaggaaggcatagaggcaagacagaaagtcaagacagcaggaatcgaacctagtcatagtaaaatgatcattcaaagtagacttttgtcatagggcaaagaagcttagaagggtgatgtagggaagtagtaagggatgaaatcacttatatgttgtatgacgcaacgaccgggatgaatcaaaggcatgcaaagggaatggatagctcaacctgtcagtagttcaagtgaattgtcgtagtgtaaggaagattgattggttttctgattgctacttggctggcataagaaagaaggcgccccggcaggaattctataagcttgacttgcgtgcagcgtttgggaatcaaagataaaaaataactctatgggacttacggaactagaaagaaggtagcacctaggcgtaagaaagaaagtaaatagagacagcacctactacgctatctattgaagcttactatataatatataaaagaaaaaaaaggccatataggcctattgggtgccgatccactcgatcctatgctatgcatttgtgaccaaggcgaggtaagatcatgaatacaagatggcgatgagtcatgccaagtttggggagtgttgctcataccctcattgcatgttttaaaatagggcatactgcctgtgatttactattgatttccaagtcgacacgagattctatttctttccctctacactatgtacttacttttccggctatgcgagagagactttatccttggtctataggcacaaatccagtagaaaataccaatccaacttcctccta

SEQ ID NO: 20513 - DNA, 1501 bp, Oryza sativa
ggattcgtccggattcaatcccgtaatcgtcgccggcgcatcaatggcggccgagatctccgcggccgtttccttctcctccggccgctctctcccactcccgacgctatataattgttccccgtgcctctctcctccgtttccgccgctcgccgctcgctctccccgtcggaatcaagcccgcaccgtcgcaccttctctccgccgtcgccgccgagctccggttcgccgccgccgtcgctccggacctcctcccgactcggcgccacctccgtcggcttcgccgcgtccccgtcgaccccgtccacccctccgcttcgctcgccgaccgccggaacgccgccgtcctcgtcaccccgagccgcgccgccgtcttcctccgctccggtcgtcgtttccgccatcctcgtcgacctggggtgagccgtggaccgctccgttcacttcccccttccctcctctctctcgggtgctgctccgccgcgccgttggtcgccggcggcgaccatcggtgcgcgggtgcgccgcctcccgtcggccgtgccggcgaggccgccttcgggcgcgccccgcggctgccaggtggggcccggccgtcagccgcccgcgcccgcgggtgcggctgacgcgcgggacccacggcgccggtcagcgccagccgcgtgcacccggtccaccgtggaccgagaggctgacgcgtgggccccactcccgtggacccggtccgcgcgccctctctcccggctgacgcaataaatccgtttttttaattaaaatttaaatgaagaaattcgtaaatatccatttaaagagcatataaacttcaaatggccatatcttggccatttgaactcggaattggaccgttcaagtctctaatttttccttaagaagccaagaacccatttttgtgctttgtttctgcttgttatatggagtttagtagagtaaaagccttttcttttccgttggtcgtgtagacgctgcagcttcggaagatccgctcttcgtggaagttgaagccggcgtttgggaaagcgagcaaggcaagtcacatcatccttgaacatattgaatcccagtttataaaattattttgacttaaattattgcattatcgctttatttaaattcccgcgttatcactgttttatttagccatgcctatttacctttgttatgacattattattgctattgttattattaccttgttcaccctaggataaacaaaaccctaaatagtggacactctactcatggtaccactagtatgattttaggtagatgcttcgcaatttaataggacaacattaggtggtttttataactttagactttgggaattctcatatcatttggacactatggaatggttggcttatgttggaattggacacacacctccccctctattcaaaacccccaaaatggttttaggctgggctcgaggtgcgtggttgggttttgttagtcgtacctcgggtactataaggattaa

SEQ ID NO: 20514 - DNA, 1063 bp, Oryza sativa
cccccctgcacccatattggatccgcccctggcagacacaacacactgtgtgttgactgcacaagagtgaaattaagtagaacagcgccaatacaaatgtatatatgtatagaaacataatctaggataattgtgtccagtgcaaaattgcatgtatcaaattcaaaaaaaaagaatatctcggtgtaaaaatagatgggaaaattccgctagtaatgtactgtgggataatattaaccagaacaaaatgcctcgagaagctttgactgggctgttccaaggaaaaaaaaatctcaaacacgtgttttctagtacagttacatgagagcgacaaatactaaatactagtattcactatcttcggaagcctccatatctcctttaggttctaggtcctatgtcatactccctccgtttcaaaatatttgacaccgttaactttttagcacatgtttgaccattcgtcttattcaaaaaaaaattatgaaatatgtaaaactatatgtgtacatgaaagtatatttaacgataaatcaaatgatatgaaaagaataaataattacttaaaatttttgaataaggcgaatggtcaaacacgaattaaaaagtcaacggtgtcaaacattttgaaacggagggagtacataacttaatactaaaaccttaatcgtcaatatttttctctacacgagcgtcacataaatattacaagaagtcaaaatactaaaaccttagtggttcatgataagcatgttcggtatgaaattcctgattccgtgagataattatttagcgcctagctagtttgcttctctttaggtagcgtcatcttccaagaatatatcctatactcctacttgctagtaatatttggcctagacaaacttgaagagtcaattagttgccatttttctaagtaaagaaaagtgaaaagtatacttttaatcctattaacctactactaaaacttaaaatttactgaaaaaccagcggtaacaacaactagatgatacttttttttattttactagaaaaaatgcccatgtgttgcaacagatgaagg

SEQ ID NO: 20515 - DNA, 464 bp, Oryza sativa
cgtgaaattttttagggtgattttgatttactgtatgcaagattaatgtcatgccatcgattattctccacaataaaagaatgagattgtggtctctttttccctttgcataatatgcgatagtgggtagttctgtagttctatcgtataaattgtttatacatatacgttagtttggactattattttttgtcataattatatgtttattgaatcatgtttgatatttacattatataatgagagaggggcattgtataatttaacaactaattatagagtgtatgtaattcaatgtgtgagatatggccttatagtatttaattaacttcttataaaatgctgcatataagagataaggtattgttttatagccccaccgtgcgccccgtgttcaaacgaacgtggggcccagcagaaaagggtatctatccctctcgagtgtcctgtgactcctgtccagc

SEQ ID NO: 20516 - DNA, 367 bp, Oryza sativa
aaaaacattattaatgaacatacatgagagggtataaatgccattttgtcaattacttaacactattaacttcaccatccaaagtaggggcaaaacaagcattcagttcaaaaaagtgagggtaaaaatgaaaatcctaaaaagtaggggtaaaatcaatattagacatcaaatagggttagaaacaaaattgcccctttaaaaaaggtcccgaggcagtatacccgctgccgctcccccaaaaaacgaaacagaagagaaaaagggagaaaaaggagattgctgattaggattgtcgaccccatatttttttcacttacgtgtgggtcccacatatttatttatttttatttttttgttaactagg

SEQ ID NO: 20517 - DNA, 1501 bp, Oryza sativa
ggaatttgcttgtgttcgttcgttaaccctagcttctcttctagatctggaagaagctcttcccttaatttcagtgccttaaccttaatacaagtaacagtttgtttgttccccgaaaagtttgggtgtcccaagttggatccgcccctgtcctggcgatgattttgtgaaatagaaccgacgaaatgttgatttctggtttacttgtttctgttcctcttcttctgaatcttcgcaggaagatccgtggctgtgcacatctgtttgcttttgaattcatatttctcctgtatgtagatagtgtagtgtacttctatgatgatcgtgcctacctgtagtttaaaccgttcatttcgtaacaaaagatatgtttatttttaggctatgcttcaatattatcctttggcaagatttagaggatctggtaacaagtttatcaagttttgttgctgactaactaatgtcaggtttagaataacagtgacgcagagattgattttcctgatccgagagcgaacattcactagttgtcttgcattacatcacttcatgtaaccgcatattctggattggcctatcaaagacctagaaaacctggttatgcatttacgtgggctagccatcatatttggtagtatatagattactttataacgcatttgaaatgtcgacgaagagtattaattgacccatgcaattttgcatttgtcgtctagcacactacaacgcttccgatcctgcgtaacttcaatttagcatatattttaatgtatggttttattgttttcgactcctatgctttgattcgaaaatgtgttccaggataagatgtgaagattagggattactccctctgtggctctgtcccgaaaaaaacgaatctaggactggatgtgacatattctagtacgatgaatctggatagaggtatgtccagattcgtagtactaggatgacatccagtactaggttggtttttttatgggacagagagagtagtttggaatcagggtccaccaaatcgagcagaggatattactatttttatgatatagtaaagcatttctaattttcttgtcagcattatcacgtgccattgagtatcatctaatacatataataaaggcacaaaaacatataactcacccaatacgcttgattttataatttcgatggatttagttatgatcaactttcaaaccctgcttactggttctagggggtaatgtaaaaattactcccttaacatgcaagtcggacagatcaacatgttgtcagaaatatttggtagcaggcatcagttagctggtgatggcaccattgtgctttgcatcttgagtaacattttttttcctgaatagatgaaagtttctgtatgaatttactggcatcatgaatgtcatttccttgggattctgtccaaatacactgcatatttctttcctttcttcaaacaagttcttttatgatatcttctgatattatttgctgatgatgaaac

SEQ ID NO: 20518 - DNA, 199 bp, Oryza sativa
agggtgggtgcggcccccgatcgcggcgttgctttcagctcggatctagctgatgtgcgtcctgcgcgcgcgggcgcatgcgtttttgtggtggcgttgtggataagtcggggttttgtccgcatttgctatggctggctggtatcaattgggcttgcgtttgtggattgcagggggaggaggggaggggaggacgcga

SEQ ID NO: 20519 - DNA, 1501 bp, Oryza sativa
gtactacaccctcatatgtcccgatatataacaatctaggatagattctaggactataaatctgaacatatgaattagactcgtcttaaaactacgaatctgaacatagtcacataggatatatccaaattcgtagtcctaatatgtgcttgctacatatggggatggagggagtagcctactagctagctaagcagtgacatatgcacaacgtgcagtccgcgtttatcagacggtaatcctacaatcttatccgttggtagcgctgtttgacttacgcaggtcgcgatctgatcgctgtttcggcgtgattcgtctcggagaatgcagccatttggatgcatcaacgtagcaggcggcgcgtgccgattctccgctctgttccttcatttgtgccaagtgttctgctcatgcggtcattcccagaatagaaatgctagggaacacattaactttatctctagttttcgagctaatctgaccaagctcgcagcttgttagaaatgtaggaattcaattttaggcagcaagcctatgagagcgttcgcgaaaaaaaaaatccgtccgaccaaacaggcctcaaagagtcaaaggttgcaactcaatcccatccttggccatttaagacgattgagatcaaaatatacaaatgtcaagaatgggattgaaccgtctccccattcgcaaactttcatgaatggggttaaccaagcaaactgtcaagaagttttcagaggttcagctgaaagaacagtggatttcacatgacattatatttcataaatgcaatttaatgacgatggtcctcgccagataatcaattttggggagaattgaaacccaatattcagcgatattttacatggtttcatatgcctgcatttgcagacttaatagttcagcggttttccaatcactatccttctttcagcatcatgtgcttctctaatatatacttgccttctttgtacttctggtcctcactataagctttctcctgcatattgttcaatgagcacagttacatgatgatgactgatccagaaaaaataaccaacattcatgagagaaatggcatgaacattaaagagcatattcgttcgttcacgcttatggactcatacttgctgacatttggatcaaatgcccaagtgtgtatgacccaggattggtcttatagtccatctggcagtagcaagtgtttagaggtataattagtcatgcatgaaggaacatccagccaatgctcctggaggaaatcatcactacaaatgcaaccaaacaataaaaatctcatattaagttaacaatttgcaagattcctgtggaaagggcagcctgaccatggaactaagggagaaatggaggaacaaattgatcatatgctccttagctgaaaagacccactatggactagatgttcccaaccacataacataggcaacatattgttttttccccaaaaaaaaattcaccaggaaaaaataactataaactacac

SEQ ID NO: 20520 - DNA, 307 bp, Oryza sativa
cgcgggtgcgacatgcgaggctgctctgctctgtggaagttcctcgcatggctcaaatccagcactttgctttgcttctttcggtagcttggcgattcttctaggcatatcgttgttcatctacgcattcgtgagcgtgtttagcgacgcatgcagcggcttagtccccgttgaatcgtggtttggttgaagccgtgaagttaatcaccgagagagacggaccgcgtcatagcagcgcacgagtggtagctgagcaaggtagatcttgaagcttttgaccgctgacttggagtgaatttttttaagg

SEQ ID NO: 20521 - DNA, 1501 bp, Oryza sativa
tgaactggggtatttccttccaatatagtagtataacataaacttattattacatataaacgatacatatataatcaaaaggcaccactggttcaacgaaccacttacacttatatctctacgggtttctaaccagaaagcacactagttgctgttgttatttttcatagttgcacactagttggctataataataataataaatatagttgctgtttttttacatagttgcagactagttggctataatagtaatatagccaacacgcccctataataataatataccgagctaacactgcctgcttcttttgccacaaaacttgttcgagacttcctccacagtgagatccgcaaatttgtttgtacctagtgtgcatttgcagcaaccatattttttcacctgttcagcattgaacttttcgacatactggacagtagacttgaatacctcaaagcgataagccttctctgcctcgtctttgtaattacggttgaacttgttcatccactcttggaatctcaccttcagggcctgctcctcgtcttcagacaccttcttggagccctccatcctctcatcactgtcgcttgtcttcagatacttgaaagcttctgtaattatgaggtatagtagacatttcttgttaattatgaggaaacaaaaagagatttcacttcaggcaaagctgtccgtacctggttcccctgcagtgtttgtggttgccatagacacttccattgtgttaccaggccttaataatttgagttcacgttcccctgaaggcaccctgcaaaaggtaacgaaaatggaacatagttaaaacatgtagggtaatgagtgatgaaatgctagatttttttcttttgctctaacttttctgttcgtaaagttgattgcacagatcagaaaataatagacagagatatagtaacttcttttttcatatttttgctctagcttactgaatccttaatcgcttgggtctttaacgacgtgttggcttgttaagggcgttcgtaatggtaccggtagcaaataagggacagtttttgggtccgcttggcacaacttttcttaaaagctgcaattgatatttaaatttagaatttggttttaaaaattatttcttgaggttttcctttgccacttccattgcctagctctcttttcatgattgatatacatatgagtaaaacctacctaaaattagtcttaaaaaacacatcaaaatttgtcttttttaagaaaatgtgcttctaaaagttttccctccacaatatatatcttttgcctatataattaagttactctcctggttcagtgaagatctaaccatcatggcaataacttgtgggttgaagatggcgtgtgtgtatcacatcataacttagttgataatcattatatgacaataataggaacgccgaccaatgcttttagactcatggttattgcagggtcctcgaaagaaagaaagaaacatggtgtaatgaatgg

SEQ ID NO: 20522 - DNA, 1501 bp, Oryza sativa
  unsure (1)..(1501): unsure at all n locations
gtcatcgtctagcacactgcatacctccactagtagtcaacgtgctcctgccagctcatcctcctcgacatcatagaatttcagccccccgaggtgggccgcctccttggaaaccttccacggtcaagctcctgcgctcatgttgaccaccagtgtctccctgtcgctcgccgccccccctcctggcttgaagaggattggggaagagaggggagaggagggagagagaagaaacaagagtgggttgttgacatgtgagacccactcgccacgtgagttaagattgggcactatattaccctaggacctcaggtacacctattttgcaagtttagagacacgctatatgtatctagtatcacggtgtagtgatgtaattcaaacttgacgtatggagatctaaactgaacttattccctcgtagaatgtagaattggatgggctaatgactttggcagtcaaaaactcgttgaattgatcacctaccgtgcatttgcatttggtttaagggatgggatggttggcttggatcgagtatatttcttagcgtgtctggtttaaattgttaaatacacagttttgccataaataaattgctaaatatattatagnnnnnnnnnnnnnnnnnnnnnnnnnnnnnnnnnnnnnnnnnnnnnnnnnnnnnnnnnnnnnngaagtggtgtttttagttgcggacgtgtgagtaaacttccttgggagaggaacaacaactcaaaatggttgctagtttcgctaagggaaaattttcatcaatagtctgataacaaatttagcgacgtatctatagtttcgcaacagtttggtttaaaacaaaatctacttaaaaaaaactcaaatagcaaaatgtttgcccccctaggattcagaaaccagcactcgtagcccagtggatggatgatggactgtgagcagcagcagcaacaacgaccaaggagctagcaaagcaaacagcggtgaaaacgaccgggggcaacgaggcgtcgaacatgtggcgcggccgcgcggggcaagcgacgcgccggggtcccacgcgcgcggggaagaaaccgaagaatccacgagcaccaatccgcgcaatccccgcctccgcgatcaccaaatccgccgtcgcaccgtctccactcgtcccggatcaacaaaccgcctcttccacacaacacgccacgccacgcctcgccgcgccgcgccgcgacgacacgcgccaaccaaacgggtggcaggcaggcagcagcgagctgctgatgccgctgccgctgccgctgacaccccgcccgcccgccgccatgctgctccccgtctgctccgccgcgcccacctgctccccgctctgcccggtacggaacaaaccaccaccgcgcgccgcctccgccgccgccgccgttgtcgttctggtagtcgctaatgcttctgtttggttggctttggcaggtgacgtcgtcggtggcccatgtcgtcggcgcgccggcgctacgagggaggg

SEQ ID NO: 20523 - DNA, 1501 bp, Oryza sativa
cggatcgagcacggcactcgtcaacgtttatctcgagtccacatcgatatttctgacacaccaagcatagagcttactaatttaattactggtctctaggtgcagagacacagatcgatggagattaatccgtctgacctccgcggatcgatcggccttcgcgtacgacgcagcgaggagagaatcacacgggaaacttctgcggatgacggcatttcttccgtgagctaggctccggcaacagcaagtcggcaacagtgttaaactactcgttatacagtacacaacgggagtgagccaagtgaaggctgtgcctatccaccgccttgcagatcgatcgatcgatcgatcgaacgcggttaatttgtactcaagcctccaggtttacctgcagtctactactacgagaccgcatctgacaaagactagtactgtacgagcttactttactcatctcgaggctgcaaacttaacctctgagggacagaaagatagcagcgattagtttagtactagtactactccatagcaaagctaatactgcaacagtaatagtataatcaactagtgctaataatgcaccgtgctgatgatgtcacccagattagcctagctgaataattttccgtcatattatctgaacgccacgcaacgtgtcccgtcgacgcctgcgtagtacacacacaagacaagacagctctctcaggtcgccatggcgatcaccggccatggccatcatcggtctcttgactctcgagcagccgacatggctatgcacagcacagcacacagtgtcactgatctgtttgaaatttgtacgtacgtgcagtgccattgggtgtgtacgttgctgcaattaacggtcgggagtcaaaggcgagaagaagaagaagaagaagaagaagcgagaaaagccatctgacaaagacgatgatactgctgctttaggtgagtaaacccacatcattaagcagcttaatgaatgctctatctaacatgattattatctcatctcgtggcctgataaagtgagagacgaaagtcacatatactactagcagtattatgtgtgcgtgtcagtgtcaagagttatcatgctttagccggtaagagtggctatcttcgctagctacatgtatgcaagtatcatcaagctaatagagtttatatatattgctctagctagctggtccgtcaggtaggtcaagtgtcccaagcgtacgtacgccatagatgtgctcgtgcggcgaggtcgacgcacggccgtgtcgcgctccatcgttattatagatgcaccatcatatctctcgtctatttctccggcgatatgatgcgaccaccatcatcgagccccatatttccatcagattaagcagaccaaggcagcctgatgaacttgattagaggcaattacaaatttatcactgctttgaatcgttattgtaagactgccactagaaaattataaaagtactactagaactgtcattcaaatgacatc

SEQ ID NO: 20524 - DNA, 1501 bp, Oryza sativa
ccatgtctgggaggtctccactttgtcgtctctatcggcgattctctcagcaagtctcgtccatggtggtgaccggtgaacaagcagaaagggccgtggcaattgtcagtttagacctttgcattcctgcttatttgatttttttatgctggatgggtcgaacaaactctccttccgaaaaaggatcgcattaatattttttttaaaaaaaatcaatttacagatttgtatttcgacccagctaatgaattttatgctgtaatgcatatatggtaatgcactatagtataacacattcgtacaatattgtctgtttggtaattgcttggtgcccacattagaaaaacgtaaattatatatttccaacattccatgaggatatactaattatccaccttatagaaagatgatatgcctaatggtgtaatcatggcgaatatggtgtagcatcaaaatcctcttcaccacttagtgctttttaaatttcatccttttcagcttaagatatttttttttattatcatggctacttcctaagctcctacgggtatatttggacaatgggaaataaggggtgagattgagatagggaaatgaatgaaatgttaggattaaatggaagagtaagaataaatggttaggatttaaagatgctttttggtgggtgaaaaaacatttccctaacccattattcaaacaaggcctaaaagtttattatctctttgacaactttcttcataaccatttcttcaaaactttacaaaacaaactcttaactctctaacatctaattcattcatttataacatccaacaattgacataaactgaatttcatccatcatccaccagcactcgacaaaacaagaccttacaacagctaatactcatctattagcactagccattaaacattccctctaaaccgaaagtctctactgacacttggatatcacacatatcctgggttttgattccatcccaaatcagcaaaaacctcacccaaaaaaaaggagaaaaaaaaatgctacgaggaccattttgaaaatcagtaaaattcaagggtccattttagaaacacacgaacctcacataaaagtcccttcccctttcgttctcgtgggatattcctccgaataattatttattttatatttacataattttttttcccactcctctccctctccgggcctccgctccccgtgtctccccccacctcgccgactcgcgccttctagaatcttcgaatcgcgatcgcctcctcccacctcggcccagcaacgagctccctcccatggtggcctccagaggataggttctctcgcctcgcctccctttccccccaccctagttcgtcccggccagggcgggttctgattttattttattttgttttgttttttttctcgatttttttggtgaattttgctgatgtttttgggtgatttgtagcgggagagatcggaatcgtagggttttgggggaggcggcggtggggg

SEQ ID NO: 20525 - DNA, 1501 bp, Oryza sativa
tgacagtgacttcatagtacacatacatatacaggctacatgactgcatcaattgatcgatcgatcgatcgatctctcactctctgcatgatttctctcagcctcacacttactgaagcacacatacgtgtgtgatcaacagcgacagtttaattaatacaaatactgaagaagatatgcattcgagttcttcagatttgtgaagcacacacatctctgaagaacagctgcatgcatagcaaatatccatcacgcatttgatctcgtgcagtaaaaaggctagtggtcaaggaaattcaggtgccattttttgccgacaaatcttccaagtttgaaattggtagctagctagcttgatagcgtttgcaactttttatttggtcttgtggttaaattgctataaatttattgtgaacaccaagacatgcacaagtcgacgtcacattatatatattgtaatgtagttcgtcgaatcaaaaacaaaaggttgaattcaccgaacaaactttatttgactatatagctagtgatatagtggtggtccagtggagaatcttttggagatagaaaaaaagagggtagtgacccgtttggcttaaagttttttggtttaaaattgggattaacttttggccacaagaaaaggggttttgtggggccgaatcctcacttgccggtttatgcgtggctgaaattaatcgatttctggattattattattacaagattaattgcagctggttttttgatatcgatggtgacttcccactttaccagtatgcatggcactatcgatggatggatggatcatatcgttttatttcgtcatgaaaagtgaaaaaaaactacgggtgaatcatatcgttttacttcgtcatgaaaagtgaacaaaaaaactacggctatgtttcttatgtagcaagttctatgcaagtggatggtaagtttgtcagtagaaaatggatttatctttgggaaacatcagcgatatggtggtatatggtggtggtgtcgtaggcacgtgactctacccaagagaatttaaatcctgatattcacaaatattacgtacatacaggttggttttcaacgtatttttaattttagtaaggtcaaagttgtaccgttgattttcatcacttagagtgtgtgttagggtattcacgggagtatgaatgtggtgttacgtgtgcagtgatgtgacgcaatgagtctttgttgtgaactaattaaaaaaaacagatttatgtttatgagtttatccatgcgattgattcatgtatttatcctgcttggcagctgatcaactaaattgtccaatagcagcgaggttgacgtggatctaagagagttggctacggattggtcgaacccacgcagggcggcacgtcagaggaagattctgccgttcgagtggggcccacacgcgccacgtggatgcatgcattgctgtgtcgtcgtcgtcgccgccgacgccgacacccgccgtgtgcgaggggtc

SEQ ID NO: 20526 - DNA, 1486 bp, Oryza sativa
cgcgggtgcgacatgcgaggctgctctgctctgtggaagttcctcgcatggctcaaatccagcactttgctttgcttctttcggtagcttggcgattcttctaggcatatcgttgttcatctacgcattcgtgagcgtgtttagcgacgcatgcagcggcttagtccccgttgaatcgtggtttggttgaagccgtgaagttaatcaccgagagagacggaccgcgtcatagcagcgcacgagtggtagctgagcaaggtagatcttgaagcttttgaccgctgacttggagtgaatttttttaaggtgggtgttcgtaataatcttgtgccgggacccgggggtagttgcgctaaacgggtcaaagtgtcaaactttgccctctgttttggtgtcggaaaattatgggagagggggatactttacgacttgatctacagccctctgttttgttggcacacggattggtcgaaccttcttgtacgatgggtgtacggtacccatccattcatgacgttgttctacggtcagcgttacggcatgctgcttgattttgttcacttgtcggtaggactaggatgccaaaatagttggtggtattgcacaacctaatttcttagttgtttcttttttgtttcgtcttttattagcggaattaacatgttttcacatcataatgatgcttgtttagaagagctaaggtttctgctcgtcttagttttatttggcagaaaagaatgcatgtatgacatttgatcccaagttaagttgccacagtccaacatgtactttggcatgcccgctttcttcagttctgatcagatactcagtattgttgtaggatagattctatgtagttttctggcgatcttctttcgttagatacagtagattatctcaggtatctgagatttgagatattgtggttttctcaacattaaatgtttgagaattcatagtgggtggtttcttcaatgaaacaacgtcagaaaatccatttcaattaccgatattgccttgtttggttctgatactacttaaaataattgcttccagtagttcagtgccagatttacttgagttggtagctcagtttgtttatgttctgacttctgatatctactggttcattgcagattttgttcctgctggatttctgaaattttactggaggactagagatatcaagacaccaacaacaaactagtacaaagttttccttccagttaatctgttcctggatctccttgccatacgcgaagcagtggatactatgcagtaattggttaggaggtctttactgaaccataatggctgatactccaacttcccgaatgattcatcccttcagcaatataccgagccaaaacctgaagcagttccagtattctgataatccacagcacccttgccacccttatagggcaccttcagacacccacgttgtgccacatcattatggcctaaagtcacattcaccggatgc

SEQ ID NO: 20527 - DNA, 1501 bp, Oryza sativa
tgttttttatgggctgtagatagtactctctccggtttcattttaattgacgctttggacaatgacacgctttacaagatatacctttgatcttatttttctattataatatatacaataaataaatgcatgtttacttttattatagtgttttgaaagacatatctatatatgtttttctaatttctttaaactaaatatttttaaagttattgatggttaaagttataaaagtttaacatcaatctttttctaaatgtcaattaatatagaaacagagggagtacatgattacctactctgtccagtaaaaaaacctcaacctagatctggacatcccatactaactaggttggattttttttttgacttaggaaaaaatatcagaaaacctgctctaaaccggcaatataccaggaaaatccgcagcgtcttgccgaatggaattaaattgttcattcattttttttctcaggaatattcgggatacaaaattttctacagaaatataccgtcggtctcgcatacgcgttacgcgaaaataacgtggaataacgtcgcaggcggtatcgcgccatgaaagtgcgaagagaccgttcggtatcgctgaagcaaggagcgatactggtgccatgatgatttaattagccattaattaacgaattaattaaatcactgatcaagataatttatcattaattattattagttaattgttaattgagtgattaattactggagatattggtcagtgtatctgtttgatttcgtgagagcgttcagtctcacattccgcgagacattttcaccgcgcgatatcgtccacgacgtcacgccttcacagaacggttatgggatatcgatgttatatttttaagaaaaattgtatcacgaatatttttgagaaaaaaattaaataaacagtatattttcaaatttgactatcgccgaacggcgatggtatcgatcgattcaattcccaatctttggtttgatttccgcatgtggctttgcccactgatcctccagacctccaccaaccaaccccaaaacaaccggcgacgacgaaatgacaaaataaagaaaaaagaaaagtgccgtcgcgtacgaaggcaagctatctacggtcaccccctataaattcggaaagaggcgagcgaaagacgaaaaaaacagcccgaaaacagaagcaatcgcgacagagaagaagagggccattcccttcgtcctcctcgtcgcctccgctttcccaatccaccatctccccccacctaaatccatcgaatcatccgcccccgaattccgccgccgacgcggtcgatccctccccggccggcgcatggggatcgggcccaatcgccgcctctcccgcccctcatttggggttcccgggatttgacggctttttgcttgcttgagcgcttgcttgctgattcgatcgggtgggaagatttccgtgcctgcctccggtggtggttcgatcgggcttgggggggattga

SEQ ID NO: 20528 - DNA, 1501 bp, Oryza sativa
aagcaggccatgtgtctctcatacatgtttgtaaaatgagattccttcagtccaaatgtgcacaagtaatcgattagtggtaaccatttatcatcaaagtcatattcttcttgaagtttctgaaacaagcttctagagatactttcatttttcaactgcgaaaataaatcaatcatttatcctgcatacgttaaatattgaacataaacaagaacatggacacactgaatcaaccttagtagtctacctctacttcattatctatgtccacaagaccagttgatctgctagctttactcttggcatgcagagcatcgactttttttgaagtgtcacatctgtctcgtgttttaggttgtcttccttcccagttttgtttcagcgctggtttttcccggcctggagaataaagtattaatacaaagtaaccactggatatcagggattttcacagcctttcatacctggtttcttgattggagcacgaggattgtttgaataaagtacaccaggatactccaaacctgatagatcatcctgaaaagagtaagagaatatattagaatgctggaaatgtagaatattgccaatggtaagtttctcatatttcattctatgagaaatgaatgaaagttagcatcacaaaactttatccttttgaatccaataatctgcaattctgcctggtttggcatgtggactaaacacccagtgatgcagtatactatatattgaaaactcaatgcagaacagatcatatagtcagggtggcagaagaaacataactgattctctctccctctctcttttaagtcttcactaatcagcagaaaagcgagtttcgctgtttctattggtccccgtatgttggatatggtttacccaaggcagaaatcaaattagtctctcaccctaatgcccacctctacctactgttacccagctagcctaagtttaagagcataccattgagtatttaagcacataaatatgcatggaacaaataaaccatataaataagaattgtttaactgtggcagccaggcagaaaacttttaaaacagtttatcatatgagcggttaaggtgttataccattaaatacaggaacgatgatttaccactagtgcgctcttcacaaacttatgcctcttttaactcaatgtgcatacaacattacatcctacaatgtttgttgattcctttgacaaacttatgcctctttaactcaatgtgcatacaacattacatcctacaacctaatgagatgttggttagttcaatttctgaaactctctagcctgacgcaataaaatggtatcacatctctaatgtactccaaaacaaaaggaataccggagctctagttacataatgagcagcagttgaatgatattccttccggagctctaattacataatgagcagcaattggatgatgatatcatgtgatagcacagccttgcacttatcccatggcacgagcttgagtacgcaagcaa

SEQ ID NO: 20529 - DNA, 1501 bp, Oryza sativa
gacactgacacatcaatttggagattttgattcacctctaacacataacctctctgagaagaaaacagaatctccagaaggtattcatgtggaatttccctactccatattcatccttgtttttcattaaactgttatagtttttatattagtaagtcttagggcctgtttggcacagctccagctccaactccacccctcctggagctggagctcagccaaacagttttagctccaccaaaactaggagtggagttgggtggagctctctcacaaaatgtaatagagttgtggagctgggtttaggcagctccacaactccactccagactcaacttctggagttatatttaggagttggagctgtgccaaacaggcccttacttgattctgtgatgttttagatgatcatgcgacaaaagagtctaatgtggatgaatcttcagaattctcagctatgtgagtaatgagtactcctgtttctatttgcagattaaacagtcttatttcaacctgtacgatgcattattgcttctgagaacattattctttaagcaacacggaaacaaattaatgaaattaagagttaatacttttcataatttattcatgagaaagatcaagatatgttggaaaattggagcacttctgatgctgctgcacagttgtacatctgtaacgttgaagtggcatttttcattctttatgcagcatagaaacttttttgagtaaagttcacagccggtccttaaagttgtagcgaggtgtcacttaggtctatgatctaggaaaattgtcaatacggtccgcgatcttgtttaagtgaatcatttaggtccaaagcgcctctgaccgggttgactggcttacgtggccgtccacggtggcagcatttttgcattttagccccgccgcatcttgcctcccctatttccgatccaggcagtctcccccaaatcctcctccttctacacgcgaccaaaattgacccccattctctcgttctggccgagctaggagcactccgaggaggggcggcgattagggcggagtcggcgatcggggtcagggtggccggagacgcgttctgggtggcgcgtttggccgccaaccgattgggcgccgtcatcggaggcgtcggaggcgcgagatggacctgaccttgcgagatgaaggcgcacctgcgcctgtttatagtgagtgtcgtcgtcatcttttaatccctttcatttggtaagtttaatctgtgattgagaggtttggaagtttgtttcttcaagaaatttgggacttttggtcggtggcaattttttctagggtttcatctagaatgcaattagttgattttgtgttggtaaatgtgtgtttttttagctattgtgatgtaatgtagggtttagtatgttgtctcatcccgaatgtgtgcactatataggtcctggatcaaagtacttttcaattgagtttcatcatggggggtttttctgtggtatgggagtga

SEQ ID NO: 20530 - DNA, 1501 bp, Oryza sativa
gacggtgccttttactcttgtgattctttgcgggttcagctgttctaggggttcgtggattatcaggtacaatcttggcggttttagttgcactctggatactgattcttggccagaacgatgttttgtactcttgtgattctttgcggggtgagctcttctaggggttcgtggagtatctagtacaatctgagtggtattggtttaattccgagattatgttcttggctggaatagttcttgtttgtagatatacaacttctcttttcttcttttggtgtgttcttgtggaggcaggtctatggattacaggaggagtagcgttcggctagttttggttggattctgagaagggttattggaaagaacagttcttgctcattgggttcgttctcttactatggatattttggctgggttggtgggtatagagtttctgttttgcatccaacagataactttgcactttgttcttcagatttggaaccaggaaaacataattttgggtcaatgtggaaaaacacgagttggtgcaaatgtttcctcttttgtgggtgcaaacagagatagatgcaaggtttccggttttgcttgcactaattttctctactgccaaattttggtttaattgttatccttgtaatcttttagaaataactgctgatttttccaatcagaaatattggcttgcagtgggtttttatattttgtcccttgtgttgcaggaacggggggcatatgctccaatgtcaactggttttgcggcacaagccaagttggatcagttggagccatcatgtgcaaatgctattgttcagtacgccaacatatcaaagccaagttggatcagttggtatgcattttcagcccgggatgaggcaatacaagccttgattaatgaggcgaagtcatactacatgaggttccccccaatacaacacctccagcagctacccttactgcagtcaccttcaacgcggtatgattatgaatccccatcgctctatttggagcctcagtttcaggtaggtagttgttatcatggagttaagtttccatgcctccccgttggtcaaagtggaggttttgacatcccattttctgcgcatttgcagtctttgaacattccaggtgatggcttgccaagggattatctaaatgcacaagttaatgttctcgggtctgatgtccatgagatgcacaatcagaggcaatctcatcctcgtggccgacatagggatttctttggtgaaggttccgattttacgatttatattaccatcaactttgatggcggcagattaactaaggaaaatatttgggactacttcaagtattttcttctaacctttgtattatgtttactagtttggaggacaatactaggtgtaatatgatttaaagtttcaaattataccactacattcaattcaataattttacgatggtatttcttccaggaagttcgggcctgtgatcaatgtctaccttagctgtaagc

SEQ ID NO: 20531 - DNA, 1501 bp, Oryza sativa
aaaaaaatggtagtagatccgaaaagaaaaaagcttgtgaaacagcaaaatcacccacctacggagacgccgatatccgtatccgcgacctgattcttccgcagcttccgctccaaatgcgccgcgatccatatggtcccgaggggccccttcttggccaagatgaactgcgagtagaacattttccaccccccacctcccttcctcagcacctcaccaccaaaccctagctcagctcagcaccacccaaacacacacacaccccaagcaaagctcccaccctcccaacaccctccttatcccatctctccacgccccccaaattccaaaccctaggcggaacaaggaacaacaccccccgaagctcccccgaaaccctaaattcgtgccgggaaaccctagaaccgccttcgaattgggccgcgcgagctggggaggaggtgggatctggggaatccgcggcggcgcgagcaactggggcgttcgaattggaggccgcgaggaggaggaaggcacgaagatttcgaacccaagggcgaaaaaattttggatctttttttttttctcgagaggggggagttcacagtgttgtgtggactcgcactcgcagcgacttgaggagaggcagctagcgaagcaaaagtgctgcacgcttcgcaatttagcccctggagaattgacaaattacgcgcggggctctccgcgtgcgtaccgttggtacgagggcgagggtgtggatgtgtttttcacttttttaggatgggtggagggggtttaatgtaaaattagcggatttttgaagaggggcttccgctcgcgagaaaaccgggagaatatcaggatatcgtgttgggggtggggggaggagcgccgttggatgggggatgggtaatgggtttgaggcggtgtggtgtgtggttaccgttggatcgtctcgcgagatgttggcgccgtctcccaactgctgcggttggcttcgtgctcgcttgactagctgagacctgtcacgtgtgcgtgactcttctttccccgtagtatatacgtggagtacgtgtagtattttgaattttgagagaggggcggaacattccgggctcggccatgcaagttaattacgtacccctccgttaaaaaaaaaaaactcaatcataactacgaatctggacataaatatgattagcttcgtggctaaggttgtatcttttttaacggagtaatacaagttaacgattattagagactaaaagaataatttattgataataatttttagaataaatttcacataactacgcgtatttgatctgtctatcgtaaaactatatattcaagtggtttatcttagcgtgctagccgctgcttcatttcgtatagcgataacgcttttctctttcttagcgctccaccccgcggagaactctggttgtgctttggttggctttctctttttttctattttctctgacttgactcagcttgaccaacttgactcaactgttag

SEQ ID NO: 20532 - DNA, 1501 bp, Oryza sativa
catagctacagtatgttgctactataggtgctggctgtggtagcactcaacagagtagctgaatgtgtctatattttaagacggagagagtagtataagtacttgagggagtagtatggtagtagtaacatcgaagtccttttgtaaatacttttactctatacaaagaaattagagtaaatttcacaaaactacacgtgtaagtccaagttgtagaaaaccacacacactttaacacttggcacttaagtaaatatattttagtagtgtagtttcacaaaacacactatcaatgaatggattcaccgcgagatgatgtgactattaccagccatcgcacgaaattaataggatgccatgtctttatcctagatggagcgaccacatcatctcgcgggtgaatccattcatcgatagtgtgtttttgtgaaattaaactaccaagatatatgtacttaagtgttaagtgtcaaaatgtgtgtgattttctgtaacttaaaaaatatagtttcgtgaaatttacctttttttaatgtcctacagccaattttgtctaagaaaaaaaaaggaaaacttcacgagggcacgcgcgtaatttcagggtcgcctcgctgccggcagcggcaggccggccggccagccagccgcatcgtgtaccgtgcctacctgtcagaaaagttcagaggaggaggaaggaacaaacaaggcgcccgcctttttttccgaaaagccccctcgtaaatcccctttttccgcaacatgcccacgcatcgatggagaaagaaaaccgcgacgcatcgggtgcccatatgaaatgaatgaatattccgccgccgctccagcttccgctgcagccgcagcttgctgccaaatttaccgtgaggtgaccgttgccttccaccgcccccacctccgccgcggcctcaccctcacctgcggcgaggatcggtgctctactctagtagtagtactctagagtctagtctagtctactctagttgctgccttcgctagcattcggaggcgatctgaggaggaggagtggggagcagcgaaggttttgatcttttgggaaggagttggattcggctttctgggttctgtctgtcgcttgattccaattcggatttcttgctgttgttgttggggtgttcgcggccgatttgaccccggggaatcgctgcttttttatttttttgaaaagataattctacgcggattagatttggtcaagaagtcgtagtacgaacgcgaggtttgatcttggtttcgatccgaagggtctcggttggctgcgtgggaagggggaggaggaagaaggcgacctgctatctaatcctctaccccctctgctgcgaaaattctctgctgtttgctcaagcatcttgctgcttggagccttggatcgaagagagttttagttcttggagttctgagaattgtgttgcttgagccgaattcgatcccaaaaaggctcttttttgggaggctttgaggagga

SEQ ID NO: 20533 - DNA, 1501 bp, Oryza sativa
tgagccaaagacatctttttgtttagtcatgcccgatgtatagtagttacgttgtaactataatacaatgtagttaggttcgaaagttttttactcaaaaaacatggttcgaaagttttttactcaaaaaacatgctaaagacttttagacagacccataaatacaaatatttatactctaacagttgagtcaagttggtcaagctgagtcaagtcagagaaaatagaaaaaaagagaaagccaaccaaagcacaaccagagttctccgcggggtggagcgctaagaaagagaaaagcgttatcgctatacgaaatgaagcagcggctagcacgctaagataaaccacttgaatatatagttttacgatagacagatcaaatacgcgtagttatgtgaaatttattctaaaaattattatcaataaattattcttttagtctctaataatcgttaacttgtattactccgttaaaaaagatacaaccttagccacgaagctaatcatatttatgtccagattcgtagttatgattgagttttttttttttaacggaggggtacgtaattaacttgcatggccgagcccggaatgttccgcccctctctcaaaattcaaaatactacacgtactccacgtatatactacggggaaagaagagtcacgcacacgtgacaggtctcagctagtcaagcgagcacgaagccaaccgcagcagttgggagacggcgccaacatctcgcgagacgatccaacggtaaccacacaccacaccgcctcaaacccattacccatcccccatccaacggcgctcctccccccacccccaacacgatatcctgatattctcccggttttctcgcgagcggaagcccctcttcaaaaatccgctaattttacattaaaccccctccacccatcctaaaaaagtgaaaaacacatccacaccctcgccctcgtaccaacggtacgcacgcggagagccccgcgcgtaatttgtcaattctccaggggctaaattgcgaagcgtgcagcacttttgcttcgctagctgcctctcctcaagtcgctgcgagtgcgagtccacacaacactgtgaactcccccctctcgagaaaaaaaaaaagatccaaaattttttcgcccttgggttcgaaatcttcgtgccttcctcctcctcgcggcctccaattcgaacgccccagttgctcgcgccgccgcggattccccagatcccacctcctccccagctcgcgcggcccaattcgaaggcggttctagggtttcccggcacgaatttagggtttcgggggagcttcggggggtgttgttccttgttccgcctagggtttggaatttggggggcgtggagagatgggataaggagggtgttgggagggtgggagctttgcttggggtgtgtgtgtgtttgggtggtgctgagctgagctagggtttggtggtgaggtgctgaggaagggaggtggggggtggaaaatgt

SEQ ID NO: 20534 - DNA, 940 bp, Oryza sativa
tgggaagaactccatccactttttctgcaatggcaatgaaccaatcaatcagcaaggaggcatacgtgtatatgaacgaattcattcatgggcaagatggaaaatgcttgtggcgtcgaacagcttggagaagatgctgtcgtaggttgagggtctcgcgggcgtcgccgccggacacgccaccgctggggctcttggaccagatgtgttcgcctgcctgcgcgaggcggatcagctcgtctccccgacgagccgccgctgaggaggtcaaggtctagcgcggccagcacagccgggctcgtctccccttctcccgtcgacgcgggtgacgacctctcccctttctcccgccaatgcggtcggccgcctctcccgccgacgcccccacctctcgcgtcggcgcgcctcctctcctcctctcccgccgcctcgtcacgccgaccgcctccgcttgccgctgcagccgcactcgccgacgcccgccctagcagccgcgcttcccgccgcaagccgcgctcgcccgccgcttgccctcgcagccgctccgcctgcctccgcccacgcccggagaagaaaaaagaacaacagaaaaatgtgggtcacttatatgtgggccccacatatttatttttattatttgtgctaaccagatgtcacgtcagcgaaaccgtttttgtatagtttaggggtggagatttctggttttgtggttaagcaaccttaaaaaatctcgctgttaagttgagggacctccggtgaacttattccttagcgccgaatatgtcgggccggatagcccaggagtctcgtcctcttcccctacccccatcgacgcaggcggcgctgtacagcggttaggagttcgacagagtggggagaaagccggcgagggaagccgaagcatcgccgccttccgccagcgccccaccggcggccggca

SEQ ID NO: 20535 - DNA, 1501 bp, Oryza sativa
aattctagaaatactttagtaaactttataattttgtttaatatcattcgatgtttactgtcattgttctaaaatttttcgtgcaaacgacagtcaagcggggtcggagtttaattccccgacccccttgtaccatctttgaactggaaacttgagttcacgtgtcccactaacgtgggcctacagcccatccaacatcgtccgctaccaaacaggcccattccaccttactacaggctacagcccatgaattggccacccacctcaaggctagggtttttttttcagcgccgcgagatcgtgaccccggaaggaggcagatcggcggcgcgcgtcactccaatctccggtaagaagaaaccactcattgcaatcttctcgtagcatggcttgttctgtaacttctgttggcgttagcctgttatgcgttcgtttcgctgcatgaattgatcagtttagactccatttttgcgattttagctttgccctctccatccatccagtgctggtggtttacttgaattagatcattcgacgttcgtagctacgctcgctttgttactgcccaaatgcttagagtcgcttgagacgtgctggtgtggggacatttaacttttggccactttcaagatgtgacaattaattatttaccactcgctgtctataatatgtgggtcttcatgtgtctatggtatgtgggtccagtgataaatcatttatcaccatccgctaatgggatattcactggtctgttcggaaattggaattcaggtctacgatttgtgtgttcgattcttatcatcatatatatgctcgtttaggccatgttcttttcagcttttgggttactagcttattgccggcacgtttttgaaattgctaaatgatatttttgaaaaatatatatatatatcttaaaaaaattcaaacgaatccatttgctaagtttataataattaatactaaattaatcatatgctaaatggatgtcttcttcggtaagttaaggagctaattgctccaacctctgaatagaacgccattggtgctacaagaataagcaagctctaggttacggtgaaatgatacaaattacatcagggggaagaggttctgagggaggaagagatggtttccttccaggcggaaaccacaatacgatcgcttacatttagcctttcggcccataaggaggcctcatctaaacatttggctaccaaaggggaagagacttttgcatacccctaaaaattacatcatggcggtgattccatagcccccaaaaacagagaagaaagaaaactctgaaatgcttggttgggatggagggggggctctgaagagtcgccaaatcagacatggcggcgatatctgtctgaattcccatctgccagaaggacacagctcttatattaggagtcttatatttgttcctgttttgttccatttcggttttggatttcatccgggtgttgatgtggattctttaggttaggataaa

SEQ ID NO: 20536 - DNA, 311 bp, Oryza sativa
tccctcgacagggagccatggcagaaggagagggaggcaccggaggagaagccgagcgccgtcgcgagttcaacttccgccttgccgcactccgccgcaaccacgacctccagtcgggaatgaaggagaggacgatggggctgaccggagagaggggaaagggagagttgtgtgactgacgagtgggtcccacggcgatttttgcactacgctgccatgttggcataccacataggcaaaagtggcaaatagttaaaagggcacaaccttagaagggcaagaaaataagggcaaatataagaagggaattt

SEQ ID NO: 20537 - DNA, 1501 bp, Oryza sativa
gttaggatacaatactaccctttggagggtggaatattatttccctatcctatttgcaaacaaagccttactagttacatgtgtatgcattaaagtgggatctagagataaaaatcagacactgctcgccaaagaagcacgaatgcacgatataaataaaccctctaatcaccggatcaactaacacgaaaaatgatatatataaatcctctaatcaccagatcaactaacacgaaaaaacacggccctcactggcgtcgccgcgaattggggagatgacgaaatggtgtgaatgcgaagtggggtggtcgaaaccggtccgcctttatttgggttcatggagagagacccaagcaagcggcgagctcctctcgtgcttcccgtgtgctatctggctggctgcacagtggttcgtccgagcggtgagccggtgacgcgcttcggtgcttgcttctgagcttttgtgaatcgtgactttgtggctgatagataatgccataatggcacgccatggtagctttattgccattgctaacttcttgctttggctgctatgtaggcaaggcgtaaacaatttctgtaatgaagaatagtcaaaataatcaattgtgataaaatatcccgatgtaatttattatatgaaacattgtgaaaccctaacgattaaattgctattattatttacattcattttcgtggtgatttttggtgagggagattgaatgtgactatgttgaccatagggagagacgtaagcaagcttaaagcaaccagggcttttgcctacataatcacaattaggtccttttaaatcactattgaaagtttttttttgaaaaaaaagaacttaaaatctagtagttgagccctatgtgagttctaggttttggtaatttctgactccctctctgagcagcaataggttcttagtccgataacatgttttttagggtttgcatgggttagttaaaaatatatgtagactgatggatatactgccaagaaaggggagacaataaatgtaccttttttttattgttttcacaaatggcattagctttgttggatacttttattctctcgccggctcccgcgtcatgtaattgagtggtagaatccatcgttgtagtggtaagtagtcaggcataatctacttttggcatgaaatgtggttgtgagtattttacttactccatttcaaaatgactaaagttttaatattaggagaaaaagggaaataatctaaatacccctcattaaatgagaggtggttgggggtaaagcatgaagaaatttaaacgagggtggttggagaggaagatattactttcaaattacacttatttaagacaatttcaatgataaatttctaggccagaataatataatagccattaggttttgtgaggtgctatgtgtttctttttctaagtgaaaatataatattgcataaaaaggtagatcaaaggggaaaaaaggccaacgaaccaaactagcatgg

SEQ ID NO: 20538 - DNA, 1501 bp, Oryza sativa
aagatagaaagaactcccaggattggacctccttagttcattgccataatcccacaacaagttgtattgggctatttcatcaccatatatctcttttagggccagcctcctagctcttgcaagcttgcttcttgaaggagtcaagttccactctttttgtactgtctttgcaaagctaggaatggtcatcttcccatcagccctaaatgactcagtgtacttttcagctaaccattttgcagtacacctttttagaatccactccttcttgcatttgtgatggggctcatatgtcttaacaatgaaggcctttgccctgctgtccattgaagcataaaagttccaggggcatccttctgcacaatgtgccttgatcctagttctatcattcctgggcatctttatgtccaccctgttcttcatgctatattcagagatagcctttctaactaattcaactgaagagaataccatgcctactttgaagattgggttgttaatgtcttcaggattaaaagacttaaacttcaagttgaactcatcatcatcatcatcacttggcaagtgcagttgttcatcatcacttgtgtcaccttctgacaaatctgccacaactttcttgcccttcaacacactacctgcagccttcttatggttgaatttcttcctatccccctcttccacatcaccatccacattttcctcaaagaggtcatcatcatcatcctcccactcataatcactatcaacaaaatcagaatcagactcactgtcatctgagtttatatgaaagctcaactatttcttcaccaacatccaattcttcatgcactacatgtccatcaggtgcattcctagggtttctatcctcgctttctgcctcctctgtctgctggcactgtctactagggttgaacacctctggcaactcagcttctgggctcagaacaatgtcatctatatttcttcctgagacatgattagtatgatcaaaatagatgacaaaattcttgattttatttgacactgatttcatgacattgatctcaacttcactgtctatgatcctcaatccatcagacatgttctttccaggcaataaccaataagttttcaactttccatcagagtcatatccaagcatggcaacaaagtctgctaaatgtagacatctaccccaatctcgagaatcaatattgtcaaaccagtctactttgccatccatatatgtgcggttcactcccataccacagaaaaaccccccatgatgaaactcaattgaaaagtactttgatccaggacctatatagtgcacacattcgggatgagacaacatactaaaccctacattacatcacaatagctaaaaaaacacacatttaccaacacaaaatcaactaattgcattctagatgaaaccctagaaaaaattgccaccgaccaaaagtcccaaatttcttgaagaaacaaacttccaaacctctcaatcacagattaaact

SEQ ID NO: 20539 - DNA, 1501 bp, Oryza sativa
ggaattgctattctttctacttctcgaggtataatgacagatcgagaagctcgactaaacaaaattggaggagaagtcttatgttatatatggtaatcgccccacctatagttatagtacccaaattctatcttgaacttcctatttttcaaacaaaaatacaacatttttttatttgaaaataaaaaaagaaaaataggagaaaaaaatatgacagaaaagaaaaataggagagaaaaaaaaaccccgagagaagcaaaaattactttcgagggtttagttatggaagccctacccaacggaatgttccgcgttcgcctagagaatgacaccatcatcctgggctatatttcaggaaagatccggtctagttctatgcgaatactgatgggggatagagtcaaaattgaagtaagtcgttatgattcaagcaaggggcgtataatttatagacttccccataaggattcgaagcgtaccgaagactcgaaggataccgaagatttgaaggataccaaagatttaaatggttaggtttttcttttttttttcagggtaaaaaattcaaagttctaaaattcaaacaaagagacttattttttccaaaagagtaaattcatagtttaagaaaggaatactccctatacatttgtcgacaaattttctttttgacaaattttctttttgacagatgtaattataatacaaccgtagtgtagttatactgtaactcatatgtaattacactgtaacttgcatgtaactacagtgtaacttatatgtaagtttcacgtaattttgaatcgttagatctattataagatttgttctggtgaggaagaaaaaaaatcacatcatacacatatgtgaaagaatttgttctcacaacctccattttaccgaaataaatgttatggagagatttttaaaagttacatacatgttacattataattacagtgtaattacatgcaagttacagtgtaattacactacgattgtactataattacatctgttaaatttttggtggaaaatttgtcgacaaatatatagcaaattcagttgcgaattgtagccccaagaacgaagcagatgcaattggcaaccgtttcatgccagcgcgcagacatatatgatctactgggaaaccataacaggttgagagatgcccagttcctagtcaacactaatgttgacaatttaaggtacatctacatagcaagcttctttacactccatggatgtacacgaaactaaatctaggaaaaattcatcgcatgtagcgtgccctccaaaattcacttaggcaaaatttgcagttcaaatgctccttcgttcaggaaattgttcactctgaccgttgcagccatccaagctgtgtagaaatgaatcttgttaaacatttgacaacaaaactggctgaatattgaaggagcagacaacatttgacatgaggaaataccttccaagcatacatcacaaagaatgcaaccgtatc

SEQ ID NO: 20540 - DNA, 1501 bp, Oryza sativa
cgcaaagttgaaaccaagaaatatctattactttcctgatgtttccgaacactttcaataaaaccctctcgtagaagtattttaacaatgttttcggtaatatttgtagatactacccgaatagttccttttttattcatgtctgtgtttcttatagaggttagtaaatcaacaatagtgtccttgcccataagactctaattctaggttcctcctaatttttctataatcaacatgttctcttttttcttttcgttttggattctaaagcatatacgtgaaacacaatctactaattttttatttgatctatatcttgtctactagtatttataatacttcaggagctaatgaaactagtttagtaaaattcaattctctcaattcctcgacgatcgtgccaaaaacgcgagttccttttggatttcctttttgatcaatgataaccgctgcattgtcgtcatagcgtattattataccgtcttcgcatttgaactctttacatgtacgtacaattacagctcgaattacttgagatctttctagaggcatttggggcactgcgtctttgattacagcaacaataacatcaccaatacgagcatattgctgattactagcagctcctatgactcgaatacacatcaattttcgagctccactgttatctgctacatttaaaagggtctgaggttgaatcatattattttgatttcaatttgttatttcaatgcaaaaggatgaaagaaatattgtctttccagaaagaagaacctggtttttttattttcaatactactttttttggggggttatatttctaaccgaagaaattgacttcgtatgggcattttgctggcagctatggaaatagctgctctagctatagtttcggatactctgcccatttcataaagtattcgacttggtttaacaacggctacccaatattcgggggatccctttcccgaacccatacgtgtttccgtcggtcttattgtaaccggtttgtcgggaaatatacgtaccagatttttccaacacgacgtgcatatcgtgtcattgctcttcgtcctgcttctatctgcctcgccgtaatccaagtaggttcaagtgcttgaagagcatatctaccaaaacaaatacaattgcctcggtaggattttccctttattcttcctctatgttgtttacgaaatctggttcttttggggttatagtcgatggttctctcttagttccatctctactgcaaaactggacatgagagtttcttctcatccagctcctcgcgaatcaaatgagaaagtgtgcaaatttctctaattccacaatattctaaaatattacggatagatacacattaataggaaaggttagggtttttaatattaaatttattaaaatactaaaatatatagtcaagaaaagaggatctagaatatatctagatgtgtatgtttatttatctatattctatatttaatgtaattcttttttt

SEQ ID NO: 20541 - DNA, 1501 bp, Oryza sativa
atgatgttaacagtttttttaaaaaaatccaatccattttcttaaatttaataaagtattgatgaagcaacttaagatgcatctaaacaatgctatcaatgctcttaatggaggagcagcaacctgaagggtacaatcacacccatatattctggtatttttttataatggaaatgtgttaaggggtaaatcaacgtgtaccagacctttagataattctatatcatttggttgtacaatgcaaatcatgaaaattttgctgtaatttttgtcatttgccttccaggaatttaggatgagttcagcaagtcataagattgatcagaattactacctcttatgccattaggctttaagtttactagttggcaccccgcgccttgctgcgggatttgctagttttatcatcgaataaaatcaatgttttaaatgattagatgcaactctttgtatatacaaaataaatgataatgcggcttcatatatagcttctgttattacaatataattcatgttttattttttgaaacatcattgtgtattgttatgatatgtgaaagttgttttcatgcacaatctggatatcgttacaattaggtagtgtagcacttatctgcttcatctcaagcatgtttcaaaaatgagtttggattaatgatacctagttattgtatgttatccaattgtttataacaaaacaaagctcacatcttatgtaataattggagttgtatttagaaaaaaaaaagattagtattgtctttgaggatttggatgtgcagaatgtataacaatgtcacgcgcgattatgagctaaagggaggtgaatggatgagtaatcaatgattaaattagatggatgagtagctaacttcttgatccaacgggtgataactctatactaatgcgatccgatggcttaaaattattgatgatgtaacttcttgcatgtcttgttttataggagtaaatgattcttagtgggtaacaactatataggaagatatgatatggaaggggtgtggattggcagcatgccttgaataattcctcttaaggtcacaaaacaattgaccttcctagtttgattgattggtggtctgaggatgaaatcaattataattttgtgtatgaagttttttctgcaacttttcagtatttaccatttttcgtcattgatgagtgaatgatagtatcagatattagtaatagtgagactcagaaaccgcgctactatctcaacatgtgttcctcggtcgaggagcgacctcgatcattatctgtgttgtgttttcatagtcttattgacttggcaatggaaacaatgtataaaaagtactttgtatgatagatatttttattagtcattataggttatgaactaccagaacttacagataccatattctagacaaggatgatatttacacaatgcatgctgataaaaagatttatgcgcctataatatgctcatcatccatcaaaaaatggagttagcaga

SEQ ID NO: 20542 - DNA, 1501 bp, Oryza sativa
gcgctgagctgctagcatatactccctccgtcccaaaatatagccacttttgtttatgaatctaaaagtggctatattttgggacggaggtagtatactcttgtttcaaccgtggcgatgggttgcggcgattcggtcgatctcccctgatatttcccatgcgagattcggctgctgacaaatcgatccacctcatggaagaaacatacatggcggcacgacatcgtgtacgtcatcgtgttcggcatgcttcactagacgatgtgctttgttcgctcaccgtgacttcctcgttaacaggcggcggcggttggaatatgtcaacaccagcatctagcctttctacgcgtacgtgatgcatctgctaactccattttttgatggatgatgagcatattataggcgcataaatctttttatcagcatgcattgtgtaaatatcatccttgtctagaatatggtatctgtaagttctggtagttcataacctataatgactaataaaaatatctatcatacaaagtactttttatacattgtttccattgccaagtcaataagactatgaaaacacaacacagataatgatcgaggtcgctcctcgaccgaggaacacatgttgagatagtagcgcggtttctgagtctcactattactaatatctgatactatcattcactcatcaatgacgaaaaatggtaaatactgaaaagttgcagaaaaaacttcatacacaaaattataattgatttcatcctcagaccaccaatcaatcaaactaggaaggtcaattgttttgtgaccttaagaggaattattcaaggcatgctgccaatccacaccccttccatatcatatcttcctatatagttgttacccactaagaatcatttactcctataaaacaagacatgcaagaagttacatcatcaataattttaagccatcggatcgcattagtatagagttatcacccgttggatcaagaagttagctactcatccatctaatttaatcattgattactcatccattcacctccctttagctcataatcgcgcgtgacattgttatacattctgcacatccaaatcctcaaagacaatactaatcttttttttttctaaatacaactccaattattacataagatgtgagctttgttttgttataaacaattggataacatacaataactaggtatcattaatccaaactcatttttgaaacatgcttgagatgaagcagataagtgctacactacctaattgtaacgatatccagattgtgcatgaaaacaactttcacatatcataacaatacacaatgatgtttcaaaaaataaaacatgaattatattgtaataacagaagctatatatgaagccgcattatcatttattttgtatatacaaagagttgcatctaatcatttaaaacattgattttattcgatgataaaactagcaaatcccgcagcaaggcgcggggtgccaactagt

SEQ ID NO: 20543 - DNA, 1501 bp, Oryza sativa
cacaagtcctcagattccgagtttccgaccacagcccgagatgtggggattcgggcccgtgagtgatttgtccgcgcattcagcccacgaaagcggtgagtttgctctagacagctggctttgttcagtcactcgctgtgcacgagcaatatcaagcaccatctccagttccaagttccaattttacaactctcctttaccccatattgacacaatccccaagcccaaatccccaatcccacgacactctcccctccttcgcggctgcctaggtttcattctctcggatcaatgacaaggacggcgatagcgcggccgcctccgatggacatcgaggacggctggcgccggctagcggccgggttccagaaactgttgcgcattctcgacggggaggaaaggctatccttctcgggtgccgagtacagtgagcttctccagtatggaacgctgttcttctcgacttccttttgcttttttctgttctctttggggtttaatctaacacacattgacatggggcgtcttccgcggcgtaggatcacatataaactgtgttacgagagtcctgccggtcacgccgcggagatgtatgatcggtgggataagacaatcaggcatcacatcgtttatcaggtatgtgccgccttttccggttccccctgcccccgcgattatcatcaatttttattctgcgcacctaatcaatgtgtgaagtattctcagttgcatcgatcgatatctgttaatctgttcccaacctgcttagcttgtgtttgatgcatcctgcagttgcccttagctaatacctgtgtgagagaacgctcgctgttgatatctttatgttcgtgtctttgttacctgatcatgcaggtgctaccgtccctccaggatatgcagggagagccccttttaaagaacttcgttcatcactgggaaaaccacaaggtgttgatgaaatggctcaaatccgtctgcatgtacttgcgattggcattcactaatcagaggtcacttccacctataatggatattgctctgaatttgttcaagaacgtggtaagaagcatattctgaagtttacacgtgtattctgctgtgcaaaagatttcagctaaacccatgctgcctactgcccttggttgtaggttttcgaagagttaaataagaaaatgacaaatcatcatcgaaatggtaatatcttcctcctgcttgtttcgttttctgaccgattgtccaagatgcataaaaggatgttacaatggtgctggtgcattgatttaccagattgaggaggacagggcagggaaggttatggattgcaatttgatcaagatgactctcagtgtctaagctgaacttggtagaggtggtaatggaatggatgtttatgaaggtttcgaagaagtgttcctcaaaaacacagcagaacattactgaagaaaggcccaagcttgggtgtcccgtggttcttgttctaaatatttggtcaaggtatcta

SEQ ID NO: 20544 - DNA, 289 bp, Oryza sativa
tctccaaagctcatagcattgagcaggggctatgggccatcgccgatgtctccgtcaacctgtagcgcgcccgcgggagaggggggggggggagccggccgaccgcaccggcgggagaagtgggagaggaggccggcgggagatggggagaggaggaggcgagtcgtcgtcatcgccgcccagtccgcgcccgcctgcctccggcaggaggtggagatgtgcggggagtagggggcaaagccggaggagggcggccgcccacacccaacagtcgtcgcgcccctggtga

SEQ ID NO: 20545 - DNA, 737 bp, Oryza sativa
taagaaaatttaaatataggtactatttacatcattccataacatccataacaaacttgaagatctttaaaaggagtatatattttaggcatctagctacattaaaaatgcaaaaatatagaaaatatatctatgcctatccaatctctatgaattcccatgcttcttgattagatcttgagtaggccactgaatcatgatcatttaaccattgatcttttgaatctgcaaaaaattaaagtaggatgtcatgatagcacagacataatatgatatcaatgattcatcaaagtgtggaaatatatgtgtatgcatgcatgcttacacaaattgaaggccaagcaattgacattccttcagcatgaacatcaccaatgtcttgcaatgcttcattggccttactagctcctcgttttcttgaagaggatgattaacaaccacttttgtgaattgattacctatctcaacaccacccactttctctcttggattactactcataaaagtagcatatgccacatgttctttgttaggatattttgcagtcatcaaaattactgtggtacctgcctacaatatgattgaataagaatcactagttagttgcataaacaagaatcgaactgtactatttgaccttcatcacagaagaatgcatcctgtttgaaaccatgggatgtgtagtcctgttcagaccatcctttttctctctactcttcatagtcttttgttataga

SEQ ID NO: 20546 - DNA, 1501 bp, Oryza sativa
aaggtcgggccgtggggaggcaccgccgggagcccgtgggacgacggcgcgcaccgcggcgtccggagcatcgccctgacgtacgggcggttcctcgagtcgatgagggtggagtacgacaggaacggccaccctgtccacggcgagaagcacggcggcggcggcgacggcagaacaagccgcactgccgaggtgcgtgcgtgcgtgcgtgctccggtgcaagtcagctcatctaccaaaaaaaatgtgcatctctctgaatctctccctctctctctgatcgatgcaggtgaagctggactacccgtacgagttcctgaccggcgtcggcggccggtgcggcccggtggcgcacggcggatcgacggtggttcggtcgctgacgttccggacgagcacgggggcggtgcacgggccgttcggggacgcgtcgggggacggggtgccgttcgagtacccgatggagggcggcgtggtggtcgggttcagcgggaggagcgggtggtggcacctcgacgccgtcggcctgcacgtcgcggcgctgcgcccggagacgctctgcgacgtggtccaggagcgcggcgccatggcgtaccggtctttcgtctacgggaacggcggcagcagctcgggagcgcatcagctgcagcagaagaggaagccgttcgagtggtgctacaaataagcagacaaaacgattcctttttctgcggaataaacagtgattgattcgtaactaataaatcgaactactgcgcggtagtcaccagcaagcagcaaattacacactaacaaaaaccttaatcttgtcatcacgagaagattagcgttggaagaaacatttcacgtcgaacacattatccgaaccagcgatcaaccagacatacgtcgtgacccaaatcggcacgacggcgaaagccatcacccgtggcccagtgtcagccgcaggggtaattcgtagctcgcgctcttttgtcgaaacgtgaacctgttgtccctcgtggcagctacccacgcctcgttcggtgctctcgcgtcacgtggaccgttggctcgtgggcccacctgtcaaaatactctacgggtggaaagcccaggactcctaggcggctaggcgcacctgctggccgctcagccaccacagctttcaaaatcgctattacctcccgatttaatcctcgttttcctcccaaatcgccagtttaactacgcccacaggcatcggtggcaacagctaacaataggttaattaagtgctaatcaaaatagtaagtctaattaattactatacttacaatagaaactgctcttcctaccctcgcgtcctttggcctcgtctcactccattctcatttcccaaagaccgcaaaaaaattttccttccatcgctcgccgcatttccctttccccctatgcggatccgctcccttgcatccaccgccattccccgcgtctgatccgtcgtcgttgtggaggatgagggaagggggagcgggcgagg

SEQ ID NO: 20547 - DNA, 1501 bp, Oryza sativa
agttaacttaggctattttggcttcaatccaaacataacttgccttccaaaattaattatgccaaaatgtgccaaaattggtaaggtcgatttagatcacaaaccaaaccagcccatactactcgtacttcgtccaatgcacagatattagtgctattgataaaaatataaaaaaaatttattatttaatattttttaaaagttataattaactggtgccgatcgagctgtatttggtctggagtattattttgtagcctatttttgtctggacaagtctgaaatttaaaataaataaagactataggttgtatttagtttagaatctcaattcccatctcgtgtaaaataaataggtttggagcgttacctacgatgataatttcggatatacggtatgatttatcgaatcaatggagataccatatctttttattaacaatataggaattattagaaagtgctttggcaataaaaatttgctttgacaagtagtaacctagagccaaggcaagccattacttagagcaagtttaatagtatagccagctgccggctctaaatcatatatagtcaacttaatagcccattaatacaatcagtgttctaaaaatcggccctaggtgccgcctaggcgcccattaggcgctaggcgccgggtagccgccgcgattaggcattcaatggtgcattaggcggttaaattacttaggtagtattttattgctattttagtgttatatagtctaatttctatgcaatatgcctactaatttcttgaatttaactatttgacccgacctaggcgccgcctaggcggggcctaggcgccaattaggcgctaggcgccccctatccgcccaactagcgcctagcgccttcttgaaccatgaatacaatagttatccataaatatatactccatccgttttaggttataagacgtttcgactttggttaaagttaaactgttttaagttgactaagtttattgataaatactccatccgttttaaaatgtttaacaccgttgactttttagcatatgtttgaccgttcgacttattcaaaaaaaaaattgtgaaatatgtaaaactatatgtatacataaaagtatatttaactatgaatcaaatgatatgaaaagaataaataattacttaattttttgaataagacgaatagtcaaacacgtactaaacagtcaacggtgtcaaacattttgaaacggagggagtataataatatttataatactaaattagtttcatcaaatcaataattaaatatattttcgtaataaatttgttactatttttttacaaacttggtcaaacttaaagcgttttgactttgaggaaagtccaaacgtcttaaaacctgaaacatagggagtattacataattaatatctggtctcacctgtcatatacatatgtaacttggagtctgtgctgcagctggctacaaatatgtagcccattgttcttctctcttcttt

SEQ ID NO: 20548 - DNA, 1501 bp, Oryza sativa
ctatctacctctgtaatgacatattattcgcttattaattagagtaatatttgtactctattatcaatttgttattgtgtgcctcggctgattcctggacgagggttcacacacatgtaagcgtttggaattttggatagaaattccgggcgtgacaatagtgtatttgaagcaacttcggattccttatcatatgtaactaaaacaagttaagcatgcatttctcctatcaattcttagttttgctcagttttgactacactcccttgctgatttttaataacttttggattttattttagtaaatttaggagctttttcgtcactttgttaatagggtctttcatgatttataaggccgtgtactttttggatgactgaacatattacgacaattgcttatagcgatagattaagtattacatcttatatatctttatctatactacttaaaaaattaaaaatgtttccgtcgtccgtaataacgaaaaaagggcgaaaaaattaaaaaaaatcccattcaatttactttcatcgtccgtgaaaatctgatattgtcttaatcataatctttccgagggaacaagcggcaccctctgtccctacctgcgcgatgaaacgctagccaaagcaagagagagagagagagatcagagatcaaatcaaataagaaaataagagatagaattctatctgaattgcccccgagccccacaagttacaaacaaaatggtgaaaaggcgttgagaagaggtgacgaaccaaaagcaaaaccagacatcggcttcaatggcttccctgaaattgagcaaagggataaattagattgaagtttccaaaattaaaagaggggataaacgatactgaaactccccaaactcgaaaagagggaataaaaaatattgaaattttctgataaaattccccaaattcaaagaaccctaatttcgtataagaaccctaagagtcaaaatccaaatcaattaagctaagggatcgggttacttaccgaacttgaagcccctaagctcgccggagctttccgggaaacggcaccgccgcaccttcacctcctcgcagtcgcgtcaggttccccgtgcgcgcgctgtcctggagcacccctccaccatcccttgccagagacgggaagcgtcggcttggcgtcgcccctcccgccgacgaggtccgggccactcggtgctcgtcaccatttgcacgcccgcctggccggaccatcgatgccgtggcatggcttggtgctgccctcgggtgcgccccccagccggcaaagttcgctcgccagaccactgtcgttccgctcgctcgttgccgaatagaaagaggatcgggagagaaggatttgggagctaggggtttttcccctctctcccggtcggcgcttcatccgacgcagggacgatcggagccatctatcagattggacggctcaaattcgcccaacgtcgggccaccgtcaccgctgattatgctgcccaatggg

SEQ ID NO: 20549 - DNA, 1501 bp, Oryza sativa
ttagaatcctatttttttaaagaaaaaattgcagttgctacacgtatatgatagatttacttatttatgatagatgtatttattcatatagtgactgtttcttagttaggatctcgacaatacgaagcaataggttggttattagttcattttctataattacatagtagggttcattctatttttttaatcccctttttgaaccctaaaaaaaactaacgagtcacacactaaacatagcaattttattaaaagatttctcaattttcattaaatcttatagaaagaggtagaatttcttctttttttcagggattttagggaaaataaggctcttgtcattttttattctattacttaacagaatgggaagacagggttggttattcttcatctacgaatatccaaattttaactcctaatactccatagatagttcgaattggatagcagcaataatcaattttagatcgaattgtttggaggggaagtctaccttttttgatgcattcggcacgcgcaatttcttttcccgcgagacggcctgcaatttttacttttactccctttatatatgttttttagttaattcaatgacccctgtacatttgtcgataaattttctcttaaaaatttgacagatgtaattatagtacaatcgtagtgtagttacactgtaactcatatgtaattacactgtaacttgcatgtaactacagtgtaacttatatgtaagtttcacgtaattttgaatcgttagatctattacaagatttgtactattacaagatttgtactagtgaggaagaaaacaaatcatagcacacacatatgtgaaaaaatttgttcccaaggtctccattttatcgaaataacaagttacggaaagatttttgaaaattacatacaacttacattatagttacagtgtaattacatgcaagttatagtgtaattacactacgattatactgtaattacatccgtcaaatttttgagggaaaatttatcgacaaatatatagcaaaattatatctcattcatatgatcaattgaccaccatatctggttctcttacccagtttcactttcatagcacgtatgagagcacgcttgtgctttgatgctttctcgcgttgacaactcgaaaacgtgtttatccatagttccatgcccgtatctccaaaacgtatttctgatttacgctttcaaggtgtgcagcgacatcaaaatatgtatatggttcagtgccttatttgaggcaaatatttttcatggaagaaagatcaaactgcaccacatctcattcacatgatcaaattaaccatgtctgaaaacacgcttgtgctttgatacttccccgctttgacagctggaaagcgtgtttctccatgaccgaaagggtccaatgtccgtatctcggaaacgtactttcgatttacgctttcaagaaatggaccaaataggagtccgggctcgagccactcgactcgaccgattc

SEQ ID NO: 20550 - DNA, 1501 bp, Oryza sativa
aaaagcagggagtaaaaaaaaacagccccactgatccaagatttgagactttccttgatatttttccatatactattaaaatataactcataccggactaaatacattgactatctcttacacagttatgtgtgctgcctacttgatccaactaggggataaaacaatcttgtctatggcaaacacaaagcagaaatttcagaattgaaagaaaaaaaaataatctggatacacaagtgttcagaagagttctacacttctaaagacagccccaccatgcccatatcatcacactccgcacttgactaacacaaacgcatcatatgatgtcaagggaaacaaataaggccaaaccaaaatgcatatgaatcatatcatttaaggtctcataacatttgtaacaaaattttccgacagcgtttgcattaactagtttgtcataaactcgtcgctgaacatgatctatagaaatgctattcacaatttataggaaaagcaattgcagcattagtttataatataacacaaacatttacttcacatcccaattcagaatgcgagtgggcaaatccatgatgcagaacttactacgtctaattctaagtattaattcgtgaactaattagatcctagatctagaggccaaagttttgattccaacagcaaggcatatagtaacgcaccgatctatctagattcaactatgtagcctacaaatcaaaccagctgctaatcagcgggacgcggatgaatctacgaccgatcacagaataaaaccattctcaatttctcatcaagcacaagaaatctaagatagaggtcaaccgaagcatcatcagatggggaggagggcacacgtacggacgaaggggaggacggcgagcacgagggcgagggtcggggaggaggagagcgtggcgttgagggtggggtggaggacggtgagcgcggagacggcggtggtgaggagcagctgcgcggcgaggatgccgtacaccttgcggacgaacccccaccggagggcgctctccccgcgcgagatccccgggtacagcgtctccccggtgccggcctccaggtccaccgcggaggcgtccaccttctccttcatctccggcgcccggcggtagcccgccggggccagcggctgcatctccgccgccgacgccatcgcttccgacgcgcttggtgggtgggtggggggaatcggggagagaggaggaaggaggtcaggaggggatttcggttgctggtggcctcgtgggaaggagacccgtatgtatcggggaggttgggatttgtgaatttgctaagcgtacacgtgggatctgaccgaacttttcttcccctggtcactgcgaggtggggccaaattgggcggatcggtgggcgcagcactcagtcagaagtcagaagaacgcgtgacacacacacactgacagttggacccacgtggataggctgttatgttaataaatctctatattttttttgcggggaa

SEQ ID NO: 20551 - DNA, 1501 bp, Oryza sativa
cttaagtatataataaaagtaatttacaaatataaatattttttcattgcagtataatcatgtaagatctagttttgaagatttaattgcaacgaacacatgtaatcggattatagatcgaataagtaatttgagagaaaactttgtaagaagaggaaaaaaaatacatgtatgtgtaatagaaaaaaaagacatgtatgtgcgctggcttctccacggcttctatggttggcgttgcgcgataagacaatatcgaaaggcctcgccgattagtttttgcgttaaataaattgcaaaccaaagtttatgatgacatgttttgcaaagcaaactttagattgaaacaatataaaaaaagtatacaagcgttaatttacatggtcctactcttagacaatgcacaggaaaaaaaaaagagggactagcgtaacaaagaatatgtttctgaggccaaataaaattaagctaataggatggactttcctctttatatgcaatctagattagtattgttgtagattagatcagaccgtaagttcagatattaacttaattaggtttatagcataaataaaaaaaaggtaaaagactgcgatgagtttgtaaactttgtatatggacttcggggccatgagcaactcttgcatgtattctcatcacgtatctgtttctgtgccgtctgtttggtccgcgtttgatcgtactaatttcttactatgatgttttccgattgctatggtgtttcaatgcacggatctatcatacttcctccgtattcgtaaagaaaatcattgatgacaatgtttaaatcaaaccttagaaatataaatcataaataactctcaagttattaagtttaaaaatgtaaaaattatatgaatagatttgtcttgaaaaatactttcataaaagtatacatatatcactttttaataaatatttttatagaaacaagaagttaaagttgtgttttggagaccgtgtcgctattctaaatgacttctttacgagtacggagggagtatttatgaatgaagatagtaggtagtactatcactaataatcagatgtagccataattgtttcttttattacccttgaccccgggaaaacaaaaattctttaggtaatgattgttccgaagagctgtggctttattatacctcatgagagatataaagagattttaatgaacactaccagattgggaccataagttgatatgaaggcccacatataatcctcatttttcaatattctccattcatagtatgatgatagtacaatcttgccgatagtcactacagggggccaagatttctctgctcaattaacgcattctttcaacagtctgatatgtctggaccgtaccccatatggccatatactgccatacacagccaatcgcataaaagtcacacctctgggtctgaggttctcttgtgaaactaaaaccgttacatctgcccatcttattagggcatggccaacgcagagtata

SEQ ID NO: 20552 - DNA, 1501 bp, Oryza sativa
agcgtatgctgccgttggtgccaaatcgtgccaaaggaccgttgtagtagatttcgtgcgggctgtagaaattgctgtgcatgagaacacgcagaaatctatctatctatatatttatatttactagtaaaatacccatgatttattgtgggcaaaataaaatacacaataatatataacataaacaagttctttaaaaaatatgctagtgttatttatttgcttattagagtgtccttgatattatgcatcagcatctttagtgtcttttatactactatagatatgtatatacgaacacttcttacgagttgacacattaaccaatcaatattgtaattagatagatcatattattgtgatcgaatatttatatttaatagtgtgctatatcaaaaagtcatttgttctagatggtgttgccacgtcaaaattcacctaaattttgataattagatatacattaattattaatttaggaattaataaatctctactattatacaaattgaagatgtcactactagaaaaacgatttttcatggcgtttggaaaatagtttttatggcggctaagtggaaaaaccgccagcacaaaaaatcgtgggggtcacgggctgccagcggaaacacatcttcgctagcggtcatcttaagccggccgccagcgaagataggatatcttctctggcggccctcttaagttgacgacagcgaagataccatatcttcgctggtggtgtggtgacgtggaccgccagtgtcggagaatgaactcctccaccaaggaaccgtgaggcccccctttgtgagttcggccgggagcagcgggtgagattcgagggcttggtgagcggagctgtgtgatctaagggcgttaggccccaccaagacgatgagacaaaagaggtttatacaggttcgggccgctgagaagcgtaataccctactcctgtgtatgattgattgaatgtagaacacaagtgcttggggttgcgagacccaagcgccagttcgctccgaagtcccccctccaccactaggcctagaccttcttttatacctcaaggggttaccacatgggcccaacaacctaacctagctctggtggagaagtattataatctttgcattaaattcatgtcttgtctcttgacttgggaagccaagcacacgtcatcttgatgatggggcctgtcaaatcttgccgcttgacacggggggtgcccctgtcagtcaccatttaatgggtgaagacttctgggctcctattacaccgggaaacgggagccttgctttgaccagagcgggaggacctactccggttgggataaaaggatgagaacctctcaccatcactatttgatgggacatgtcaggctgcacgccgcctgacacacgagcagcgcacaggcgcactagccagtcccatcggtcattcgaccggtcacagaccggttgagtgtactgcacgccgcatagcgtggcgcgaccgctcggga

SEQ ID NO: 20553 - DNA, 734 bp, Oryza sativa
cctgccctgccaggccaggccaggccaggcgagcgagtgtgttccccctcttctctccaccacacatgcttcaagtggctaggagggcatcctcccttttaaggagatccccctcttctagaataagcaaggtggtactaaactccacatgcatgccatcccatgaggtgcgcttttgtgattttccaaagaattaatcttcgaatgggccttagcccatctatcaattccaacaatcccccaccaaatctcaaaatcccactgagatttgccttttccaatgtacttttatataccaacggttcgatggagactgatcaaggttgaacatccacctagaactccaagctacacttactcacaacttgaacaatggactacgccttgaattgcatgtcttgtgcaagcaagtttcactcaaagtcttatctggtactagaccgtctgtagactacccctcgggtggagcatataagtcatactcctaggtctttagtaagcttcctagaagattcacccaaaatcttcatagactgcgaccaacagtcaagcttacaaaggtgagttctttcatgaatgctttgcaggacagcatcttcgctaattaaagccaacagaactcattaaggcatagccaacctgccttgcagctcacgagagtacatgcatcttcacttagagagggtatagattggtactctcctctagtttactaatggtttgttcttcccagg

SEQ ID NO: 20554 - DNA, 1501 bp, Oryza sativa
catggcttcagcttggttgggcaacaccatcctcgtcgtagagcgagtggcctccagacctatggtcgcgtgctccactgctctagcttgacagcaaggttagaggagagcctgcaacggagctcaaacttcattggggaggtgttggcggcggagtcaagctctttgtgggaaggatagctgagctcaagctctctaggcattatctcctggagctcgattgggtggaaaaggccgcaggcggcggcggagtcgagctctttgtgcgaagggcagctgagctcgagctctctaggcattatctcctagagctcgatttggtggaaaaggccacaggcggtggcgagcatcagtgcacgtggtggcgaagatgttcgaagagtattttggttgcggagcttggcgagatgtgcagctgcgtccgtgtgagtggtggtggagatgatgcgaccgtcggggtccatatatgagacttgtgcttttatccggatgtgcggcatcttcgttgtctccctcgctatcactgtcatattcccatcctcctcttcctcccccgtgtatcctccctctcccatggagaccagtggccaaacgtggcgtggacgcagcaagcgacggtgcgacgtatggtggtggtcgccaccggggacgagttcctagtgaggacgggattctcgaccccaagttggtttcgagctctacatccatgtgcctccactctgcctcgggttgctgcctcctcgatccgccttgcccaagcggtctccgcctttgccctccttctctagccataggtgtagagagagaagaggggaaactagggatagattggcttaggggcgggtgggtctagagattttttttatttgttaattggattgtcacgtttggcgtcacgtgtgtaagctcgagcaaaaaccacccaaaacaatgctcaaggagtttatttgtccaatattaatagtttatggtgtaaattatctagtattccagaccatgaagtaattcaatcgagcgcaatcgttaacagtaattcttttttgctacgaacaaattcttcacgcaggtgcagtaaagatgagttaagcacacgtaattatagagatttccccgcaaaaaaaatatagagatttattaacataacagcctatccacgtgggtccaactgtcagtgtgtgtgtgtcacgcgttcttctgacttctgactgagtgctgcgcccaccgatccgcccaatttggccccacctcgcagtgaccaggggaagaaaagttcggtcagatcccacgtgtacgcttagcaaattcacaaatcccaacctccccgatacatacgggtctccttcccacgaggccaccagcaaccgaaatcccctcctgacctccttcctcctctctccccgattccccccacccacccaccaagcgcgtcggaagcgatggcgtcggcggcggagatgcagccgctggccccggcgggctaccgccgggcgccggagatgaa

SEQ ID NO: 20555 - DNA, 171 bp, Oryza sativa
tccaccccgttttctctttccacccccgcagcaccattcccaccgcgaggccgagcttccaccgccgttcgccgccccagccgcccgctactgccgccctaggggccgcagcgccgcgccgtttgtgtcgtcggcattgcggtgccgagctctaccccggcctccactccg

SEQ ID NO: 20556 - DNA, 1501 bp, Oryza sativa
attctcacttttttttataagactagcaatagtgcacgtgcgttgcaacgggaaaaactaccgtttgatagtatgacatctcgagaacctcaaattggtaaaaatcaagtctaatttgatatattaccaaaattggtagaaccgagtctaatttgatgaattagcataggatttaggatttagtcttagatttatttttcaagcctacttaggagtttatctgatggactttaattttaaaaaaatctgagccatttgatcaaatttgctttcgggccaggtcttcccaagtcagcccaaacttgggccggcccgtcttcgggcttgtcggtgacatgggaccgggggaatcatgactagaggcttgggcaggagcaatcacccacgaggcctgaccccctctgggggggtcgggcccgagggtgatatggtcgcccccctctttgtctccccgaggggtcggaccgctcccgtttcggccccgagggctgaggcgccccgaccccttgtagattttgcgccgcgtgtatgggttaggtgagcgcagcggggctcacctaaccgcatttattgcgttttggacgagcgcgtcacgccgcatgtaacgcagtgcagcgcgctcgtttatccggtctgagaccagtcacagaccgatcagatcgtgggttaggtggcgacaggcggtctgacgcacgcctcgccccatcccgtcaggacgagagcctctaaacactcgtccctagccggagccggcgtgttacctcctggagatggcacgttggtcccggtcagatatatgccaggcttcatcctaaccattacaagcaagacattgtatgaagaagggcgaacatgcagattgataaactgacgcgtggtggacaagaatgaccgatttgtgaccggtctgacactggtcatgtcgtcagcagacaaccatgttcccacgtcgcgcctgcctccggcggaagtggaggtaggtatgggccgtcccatcagaaggtcattcggacggcaaccatacaagtctccgtctatttatgaaaagataggataagtccccacacaaaagagagaaatggtgcatgtggtatccccttgaggtataaaaggaggaccttgcccacttagaaaggggattggggatcgagaacgatcagagagggagagagttagagttctctggctctccagctctttgtagcttcttcatacacaaatccactaaaacacaggagtagggtattacgcttctcagcggcccgaacctgtatacatcgcccgtgtcttgtgtgtttccactctcgcgaaccttccacacaccgagagcttagaacctcacccagggcccccggccgaaccagcaaaggggggcctgcgcggtctcccagtgaggagccccaagctccgtcatctggcgcgccaggtagggggctctgcgtgtgttcttctaagctctcgcactctttcgtgtgcgccaagcttttcctgttcagcccaa

SEQ ID NO: 20557 - DNA, 1501 bp, Oryza sativa
ttctttcagatgaaatgcatcggccggagcagcagtgtgatcgatgcaggacttcagggtgcgcggcgccgacagcaccgtacacgtgcaagagaaggttgagaactcgttgagaagcgcacgcggagtgccggagacgacgacatactccagcataataacgagcggccggcgtttgcctcacgtgccagcggaggcccgggaggaccaagaaattaaccttctggcgccgcgcgcacacgtcgttcgtccgtcgcctcctgtcacctgcggcattttacacatcctcgtcagcctcacgcacgcccagtcgcccacgcgtgcggtcgatcgttccgagcagagggcggaacaagtgaacgaacgaacggcgcccgagcattttcgtcggcgtttctggaacggcttctgtttctctccactgtcgcagcggtggagatctttcgtcaactgagtttggagctgtctgctctctctctctctctctctctctcccgttcgcgtgcagagctggagatcaaactcaactttttctttcggtacagcgactctccagtctcctcggtcgatcgtttctcctgttcccttctgatgcgtgtgatcataaacctggtatcatttgattgagattgataataacctgctgtaacttagcgaattaccagagttactccgttttgcttgtacagtttccggtttctttgccatttcgtttacagatagcactcattattatctcaacaaaatatacacaatttcatttagtaactaagggcctgttgggctgcccaggctgcgactgccggcatgaacagtgccacattcactgtgcacagccgcggcgcttgctgaataggccctaaattatcgtggaactgtacgtcagtgtaataattgtttaatcacaacctacaactaaagttgtgtttagatccaaacttcaattcttttccatcacatcacatgtcatacacacacaacttttcagtcacatcatctccaatttcaaccaaaatttaaactttgcgctgaactaaacacagcctagtactccctccgttatatttcatattataagttatttaatttttttcttaatcaaatacttacaacaaattttacccttgttttttttaaaacgatgctcgatcgatcgagaatttccatcaccgttttcataatcatcagtaaccacacctacaactggtacaacacggtgatattttcaacacgaaaagtagttctgtcagtaccagttccacgtcaaagaaaccacggcgattttctaccggtcggagaattccgtccttccgggacaaaatccacgccaaccacaagctcaccacaaagagagatcagagatgccatcggaatattctccgtttccatctcgttctgcattttcgtgggctttgattattattcgtcgaaacttcccaaactcgcgaatttaccacgcgtgtcccgtatgatccctctcctctccatcgtacgttatcag

SEQ ID NO: 20558 - DNA, 1501 bp, Oryza sativa
gcatgtcattcaaatatttatgaaaaaaaactaagaatatgcattaacatgtgatatatcactttacaaacatacaacttaaaagtcaacttttatcacaacgataaaaaaaacaatttgagacatgtagaagttgaattttaagttgcatgtttgtggagtgatatatcacgtattaatacatctttttaaaaattttcgtaagtattggagtgacatacaaataatgataggacatcccttttcgagagattagaaccccctccagagcaagtactcttggtatatttcataggttctaattaaatgccaagttaccagagttgacgcgaattacaaacaaaacaatgactatttggttcggtcgtgactcataaaattttcatttgacatcgaggtaagaggacttgctctggtcggtcggtgtagctaacaaataaccatgcaatcaaacaatgtcaaacaggcacatcagatctggtcagtagcttcatccgagggagctagtaattaataataactactccaagaatcatcacggtcaaaaaaaaaaaagtactactccactacaagaatcaaaccaagcagcgtagtaggaggctagaagcccagtccaaaaacaaagcaggttggagacatagcgtgaagtttcgtttgtgttcccgaacaaagcgttttctcggtggacttctgaacaataccagacaggagcgttttctgtgttcgggataagtgcgcaaagacttgaatataatgggccctaatttcgtcccgtccttataaatgggccgagaatttgggctaaatcaccgatccacctccatctttttaaaggaaaatggaaaaggttcatttttaatccctgaactataggcgaagctttattccctcaaccatgaaaccgggtataggcatccctcaccaatcaaaaccagtgaaagttgagtctctcggcggtttgaataatgattttttcctatgtggcaatttgatttggtcttcaatcctatacggcgcttgcgtggcattattatcaaggaaaaaaaatttaaaaaaagaaatattgagacccatatgtcagtcacaagaaaaatatataatcctcccctaccttcttcctctctgcctctctctcctccccgacgaagccccctccttggacgagaatcaattctacgtgaataccaccagtccaccatcgtcattagcagcaatactagaataatcaagcaccagctgactcagtagcgcagcagcgggcctcaccttgggaagccgtggtgccgctggggtgcaacaggaaggccaggtcctcgtcgaagcctcaccagaagagacgatagaacataggatctcatcctctcctcagcagcgctgtaagccctcgccacacaccacgccatatcactgccgtccatctgtccagggccagttctagagggcacaaacttcctcaagactaaatatacttttacttatatatatatatatatatatagga

SEQ ID NO: 20559 - DNA, 907 bp, Oryza sativa
agcttgcggaggtgggggaatggggggagaggaggcggcttggggtgggcggaaaagaggaagagggacttcatcatttggcgagaggaggaagagaggcgaggagaggggggtttggggcgatgagacgatgggagctcggcccgctcggggcctcggggtagagacggcgcaggtggccggccgagtagtcgatggagggggatatcttcctctgaatatcgattcccctggttttctttataataaacagttattaatccgtttagtatagttattactaatattttaaaaaaaaattgaggaaaaaaaagactctagccattacctgaaatattttttctagaaaacaaccattttgtagaaaaagatttaaatctcgaaaaaaatgccccacgttccaattgaagggtattcagtagtcactttgttattctgacaactttctaaaatccgaaaagggagttgtcagggttacgggtcaggcataccccctacccttcgatatacgttacgtgtcgacatggcatacccacgcgcacgcggatatttcctttatgatctaaggaaacctttcacgaaatcaatagacgggaaaagtccttctcggataagaaccgggttacctacgtatcgtgctaggtctggtatattcgagtcctactcgaagagcactagacctgcgatataaaagggaccccccgaggagggcataggggatcgaatctcagagccaacacaacccacacagcctacgaagccggagcctgtgaggagccaagtcgtcgagagctagtcgaatcaactcgactacaatctcgccggatctgacaagttccatcttttcctttgtaacctgtgttttccaccatataatcccatatcaactggattagggctattacct

SEQ ID NO: 20560 - DNA, 1501 bp, Oryza sativa
cctccatccacaaggcggtcaccgacgcgttcgcggccgagacgtccatgatcccgcgagtgccggccgtggctccgttcaagctgtgctacgacgggagcaaggtggcgggcacacgcgtggggccggccgtgccgacggtcgagctggtgttccagagcgaggccacgtcgtgggtggtgttcggggcgaactcgatggtggccaccaagggcggcgctctctgcctcggtgtggtggacggcggcgtggcgtcggaaacgtcggtggtgatcggcggtcacatgatggaggacaacctgctggagtttgacctggtgggatcgcggctggggttcagctcctccctcctgttccggcaaacgacctgcaacaactttcgcctcggctagatgtgcaacgcatggcagtcgccactgcagcttagcttactatctcaaaaaaaaaaaagatgctttgcatttctttgtgcaatcgtgtgaagttgttggaataaattgttcatccattacaactagtcaaccagcgtaggcatttgacttggatctacttgttctttaccatatccttgatagtgagaggtggcgtttgactgaaacaacaatttggaatcaattttgctatatattatcgataaattttcttctaaaatattgactgatgtaattatagtacaatcgtaatgtaatttaattttgctatatatttatcgataaattttcttctaaaaatttaatatatataattacagtataattgtaatgtaattacactgtaacttgcatgcaactataatgtaagcatgtaactttcacataattttaaatcgttagatctattcaaatgaagaaaaaaagtcgctgtgtgcacatatgtgtgagggttcgttccacgacctccgtttgacggaaatagcatgttacggagagacttttgaaagttacatacaagctgtatgtaagttacagtgtaattacattataattgtattataattatatctatcaaacttttaagagaaaatttatcgtaaaatgtataggtaatctcaagcacttgaccttactttgtcagcaaatgtaatcaaccgtcgctgcttgtgcagtcttctcccatttcagctcccctcgctccagctgatcagcactggtccagtttagattagttggatgagttggataccatcatctcatcacccatacaacaatggccacccctgcaaaaggctgtgcagatggtttgcctgcctgcatggtggcccgcaattggtcgagaacaaaggtcgcaattcgcacatgcccagaccgtcaaatactaccagcattttccttgctataacagcagagttccgtttccacttcggcgtctcgtacagtcgtactctcgctcggcccgcgactatacagtctgccctaccaggctaccaccgccatccatcgccgttgtattctgggatggtgattggtgcgagagccgaaataccaaaccgcgcgcgagggtg

SEQ ID NO: 20561 - DNA, 1501 bp, Oryza sativa
ggggaggggagagctcagatcgggattcgatgcgaatctgctaggaaggggggttgcacttgcagttgcaggtgttgggatttgggtggggttttactggctcggctcgggtcggcggagtcggatcggccgcgtttgccggacggcggccgcggcgcgacgggtcgtctccttttttcttcttccgccgcggctgcttcgctgctcgtccgtcctcttcttcctcggcggccgttatttacgtttcgttacggtgcggaacgtgacggcgatctgaatcccagtaactttttcttttatcttcaattcacgttcttttcgattttataaaggcgtgtaaagctaaagtatttgtcgagattaacaaccataatacggagtactggacaagatcgtgaagaagatggagtctaggagacgcttgttttcccatgaaaaaaatactggagtactgtatagtgcttacaatgattatggccaattgatattttgtgcatatgtgctcttttaatcttattaatacaaagcttgttcattcacatcgaacatcaaaattctatggttcactttaacagctcagaaagttctatagcatcaaagtctctcgtggggctctgagtctatctaattttcatggttagcgtgtgagcctgtagccaatacaaattaaattgtaccatgtattctagtaatcgttattgttacaagtacgagccaaacaacatgtattgtgttgaacaatggtggtgttgtgcaaaatgctagctattcatatcgttacccttcgtgcacttctgcggttgtcctacctccaatcctctctcaccaagattgaatatcatcctcctcgctatcatcgaatgtgctttgccgttgatgtcgtcctccctaccatatcattgatcacgcttcgcagccatgcttgagctcgtcggccaccgctactattgagtttgccaatagcaattgacgtcaagcttactagctgcagctacccttgagctcacctagaccctaaatgcccctatgttggcgctctcgagcttgccccgatattgttgtcctcgagctagtatgttgcaccaccctcgagcccgccaaatgcgccaccctccacttcactcaccatcgtccatcaaccttgtttggatgtactgccaccctccagctcgcttatcattgttctatctagcatactttgttgcggtagttggtgagtgttgttgcaaaggaggggtgatgtaggatcgagatgtcgactagagggggtgaataggcgatttaaaactaaatgacacgtaatcaaaactaacctaagttgctaggcttggtgagggtcaactctaactaagcaactaagttatgttttgcaagcctagggtgatagtggctcaattatatctctaggaaaataaatcacactcctatgtcaatgtttagcaatcctagggtgatatgatctcaagtatgtctctagaaatataaattgcacaaatgtaaa

SEQ ID NO: 20562 - DNA, 1353 bp, Oryza sativa
aatccgatggaaaaaaaaatcctatgaaggtctttgaaacaaaggattgaatcctatccaatcctttaaaattcctatggaatgggtaatcctatgtatattttggaggaaagttagcaagaggtctaacctcttggaaaatttcctctgagtctatctctctcatgttcagaatcctatgtttttcctattcctttgttttttcgttcctatgattcaaaggtagaacctcatggaaagaatactttgagtctttatctctcctcaaatttatgtgattttcctgcggcccaatcaaacattcattcctatatttttcttgtattttgcaatcctctgttttacactagaattcctgtcagaatcctatgttttttctattcttccatttttttcattcctgtgattcaaatgggccctaagtgtaaaacagatgattgcaaaatacaggaaaaaatacagaaataaccatttgattgaaccgtaataaaaacataggaattggatgagagagactcaaaggaaagttaccaagaggttcaggttgaacctcttgctaaatttcctccataatttctataggattgtcaatttcataggaatttcaaagcattagataggattcaatcatatgtttcaaagggcttcatacaaaattttcctataggattaaaatcctccaaaatttctatatttttttctccaaatcaaaggggccctaaacaaggccttaacgtggttaggatcaaagtccagacctactacctctttgttgggccagtttaaccaatgttagttaggaaaaatggattttaatatccccttgagatatattacttaaatagtacccctccatcctaaaatataagtattttttgatcctgatacagtctccgagatgctactttgacaaacaatatctataaaagtaagatgttttaaataaaaatagttgcatattatgttagtttgtttaatgataaatctagtaacatcaattttacatgattatattttttatttctttgctattaatagttaaagttaaaaatgtttgactcgttactatgctaaaaatgcttattttttaggacggagggagtaataaaaaaatttaaagagaaaaaagacgagatagattaatatgtgatatataactccagaaacatgcaaatttatatttgatagccgcaagttgtaacaaaagtaatagatttaactgtaacttgtacacatatgctcaaagtcatatttattttttttcaacttgtagaagttaatattaaactagaattttgtgaagtgatatattgtatactaatctatcttattattttattgttctttttaaga

SEQ ID NO: 20563 - DNA, 203 bp, Oryza sativa
aagcttcatcatctttttttttccatattgtgtaaaagagttaatgaatcttttttatccatttaaacaattggctgcttatgtatattaagatatctgagattgtggacaaaatgataaattaagtaccggtgtcacattgtttttcacatagcactcttcagtcttgcaccaggataatgcttagcttttgcaatttgtag

SEQ ID NO: 20564 - DNA, 1501 bp, Oryza sativa
agtggattcagcagaagccaaaactgcaggctacttggacgacgactgggaaatcagaagatgcggggctatggctgcaagacttcttaaggatgtcaaacttgcatgaaatttgatccatactagtattgcccagttgatgttgtactccaccttttcttcttatgagtagtattccctccacattcatccttagaattggacttttttgggacagggggagtactgtacaagctaatttgtactatgcttcactgtcattgttcatgtgaaggtgaagatatacacagagtgctagtacattttttgagatgttgagtgcatatgatcgccggcggcttgcaagaggagtgagccgccgccgtgccatcaccggggagctcattgacttctcgtcggtggattgtaggactattttactctggaaaatctgctcgatcggcaacaatggtagtgaccatagtctcaacctggaggggctcgccatcccctctgctccgcttccgtcgtccccgtcgtccccgtcgtcccctacgcctcgttcgcgcatttcgtcgaacaccgtgacggcgccgaattcgcactgtccgcacatctcctcctcctcccccgtcctctccaaaccccaaaccctatctcccgtcctctccaaaccccaaaccctatctccacccccgaggcaggcgcccccatgcacttgtaagtcgattggatgtcctgtcccagaagacatatcgagcgaggaggcggaggaggacgaagggaagcggatcctagggcttcaaccatggatcggcatcccccatttcaaggtactatactactccattatagtagtagtgcttttgcatcttagaaaaaaaaatctgttcattagccattgagagcttctgaacttgttgattccgttccaactccaactgtgagtttctgttcaggtcatcccctgattttcactatgccaattctctgaaacaactttaccactgtcaaatgaacacactgaaacagtttgcaattattggccattactagttatgcaaggtagaagtgttctgaggtactgtatcatttttatgtactaattaattaagtttaataaaaactttcattatctaaaaataaatgactattactagctcagtattcccttcattttatattataagacgttttgatttttttcacatacaactttatttaagtttgattatacttattaaaaaattagcaaacatatataattttcatatatatattttttacactaatagtgcaaagtgagcacgtttaaatgcattgtacttcataaaaaaacatctaacttttacagacgaatctggataaatgcatatctaaattcatcctcaataattgattcttttgggaggagtgagtacaatgggttggtgcgctttgtccttggaccctacaataatgatgattgtttctttaacacatgggctatgtttatcccttcctgagcactgactaccgaggc

SEQ ID NO: 20565 - DNA, 1501 bp, Oryza sativa
aagttttctgcgctggcagcttgagtttggtgcctcaaatagcttatcctacttactgatatgctaaatttcatgcgtcatgatatttcagttgttctttaagaacagagtctggagagactttagtgtagctagcaatcgacattgcacatggtcacttgctgtaataataagttgccaatttttacatgaggaatctctcagatattaacctaaatgaagttttcctcaaagtcactaaacttttcttcttggttatgttacaaacgtgcgggagcacttgcttctctagattttgtaagttataggcatgccttacggattgaaatttaagtgcagaggatagccttttagcagaaatgcagaatagccaaaaataattgataacagcactggtagtccagagacaatgcaatggcttactgctcttttgtctgtgtgtttttgaaggtttattcagaacatctgttgcaacctctaatggagacaatcattgcattatctggtcctaaaacaaaaataatggtaattgctttcaccaccattcaaacagttctgtttttgttattgacaatatatgaggtaaatattgttgctttctacccagctaggatacgagatccgttctaccactgtccatgaacagatgatgcaaatgtggaaaagcaattttaatgtgaaaaccgtctcgaaatcgaaggtacacacacttcagagttcatcttatcagaactcccttcccttgtcatttatctgtttctgcatcagtgcaaaaggtattctctaccatcacgctgttcttgaattctaacacagatggatgtgaaataccaacatcctagtattcatctttacataatggaccccaaagcgacattgatccctgaggtcagcgataacggcaacaacgaggaggaggaggttgtctccaatccaggagatgatgaagatcctggagctgagagtggtggaccttgtactggctcagtggattcagcagaagccaaaactgcaggctacttggacgacgactgggaaatcagaagatgcggggctatggctgcaagacttcttaaggatgtcaaacttgcatgaaatttgatccatactagtattgcccagttgatgttgtactccaccttttcttcttatgagtagtattccctccacattcatccttagaattggacttttttgggacagggggagtactgtacaagctaatttgtactatgcttcactgtcattgttcatgtgaaggtgaagatatacacagagtgctagtacattttttgagatgttgagtgcatatgatcgccggcggcttgcaagaggagtgagccgccgccgtgccatcaccggggagctcattgacttctcgtcggtggattgtaggactattttactctggaaaatctgctcgatcggcaacaatggtagtgaccatagtctcaacctggaggggctcgccatcccctctgctccgcttccgtcgtccccg

SEQ ID NO: 20566 - DNA, 1501 bp, Oryza sativa
ggaccccaaagcgacattgatccctgaggtcagcgataacggcaacaacgaggaggaggaggttgtctccaatccaggagatgatgaagatcctggagctgagagtggtggaccttgtactggctcagtggattcagcagaagccaaaactgcaggctacttggacgacgactgggaaatcagaagatgcggggctatggctgcaagacttcttaaggatgtcaaacttgcatgaaatttgatccatactagtattgcccagttgatgttgtactccaccttttcttcttatgagtagtattccctccacattcatccttagaattggacttttttgggacagggggagtactgtacaagctaatttgtactatgcttcactgtcattgttcatgtgaaggtgaagatatacacagagtgctagtacattttttgagatgttgagtgcatatgatcgccggcggcttgcaagaggagtgagccgccgccgtgccatcaccggggagctcattgacttctcgtcggtggattgtaggactattttactctggaaaatctgctcgatcggcaacaatggtagtgaccatagtctcaacctggaggggctcgccatcccctctgctccgcttccgtcgtccccgtcgtccccgtcgtcccctacgcctcgttcgcgcatttcgtcgaacaccgtgacggcgccgaattcgcactgtccgcacatctcctcctcctcccccgtcctctccaaaccccaaaccctatctcccgtcctctccaaaccccaaaccctatctccacccccgaggcaggcgcccccatgcacttgtaagtcgattggatgtcctgtcccagaagacatatcgagcgaggaggcggaggaggacgaagggaagcggatcctagggcttcaaccatggatcggcatcccccatttcaaggtactatactactccattatagtagtagtgcttttgcatcttagaaaaaaaaatctgttcattagccattgagagcttctgaacttgttgattccgttccaactccaactgtgagtttctgttcaggtcatcccctgattttcactatgccaattctctgaaacaactttaccactgtcaaatgaacacactgaaacagtttgcaattattggccattactagttatgcaaggtagaagtgttctgaggtactgtatcatttttatgtactaattaattaagtttaataaaaactttcattatctaaaaataaatgactattactagctcagtattcccttcattttatattataagacgttttgatttttttcacatacaactttatttaagtttgattatacttattaaaaaattagcaaacatatataattttcatatatatattttttacactaatagtgcaaagtgagcacgtttaaatgcattgtacttcataaaaaaacatctaacttttacagacgaatctggataaatgcatatctaaattcatcctcaataat

SEQ ID NO: 20567 - DNA, 1501 bp, Oryza sativa
tataattttaatttagctgcattgattgattggttcatgcctcactcttgactggatctcctctactgaaaatgtagtttctctgcaaacaaaatgtacggattgagatcaaatgcagtcactgctagaactgcaagtcagtgacggcacattatctcatccattcattttttagatcaagggtgtagatcaactgctatagtaccatcgctacagtagctgtgaaatattttttacgcgtgaacagtgctctaaggatctcagcccttagatgcaacttggatggtcctagtgtgactaattaagttgcagtcacactagggactgcacctgaaccaaatccaaaatgtattgctccctctcaggctccctgtgggtttcggtatataacatttaaccgtccatcttatttaaaaaaattaaaaatataaattacgcataaagtactattcattttttatctaataacaataaaatactattcataaaataaattaaataaaacgaatagtcaaacgtataacatagaaacccacaactaaactacgggcctgttcactttgatgccattttcaatcttatcaaatttaggtaaagtcgcaaaaaaagtggctacatttagtttgctgtcaaattttggtaactatataagaaatcctgctatgccaaaattttggtaatgcaaaaatttgataaggtttttttttgacatcaaagtgaacaggctctacaattataacagaacaaagggagtaagttttttatttccttctcattcttgtactggacaaatccaacagtactactgaaaaattatcaaggttcagtataagtattccacggcaattaatctagctagctagtatcctttctgagggcatatataggatatgttcattctagtgattatctttcacctgcaaattaaacttcaatgttcatgaagatgttggtggtaagcaaagtgtagaaattaaactggaccgtttctgcatattttcaatgaagatcagattatattactagtacatacgtaccaatattatttatatatatagtcattatctgctccatgacaactgatcaattaaggaagactatacaaatcacatggccatgttgtacactaatatttctttcttttttctgaaggtgatatatatacagtagtagaattgattagtttaagctgcaggttaattagcaagtgagtcgtagtaaggcagaggacgttggccttcttattcaacgcagcattaacacgtttgctcccctcgaaccagacaccctaccctacctgtcctcctctcttcttcctcctctcctctccttcctcctcttataaatccacctcctccatctcaagttgcaccgctactagcagctaacctacctacactacactacaccacacactacacttggagagaagcacacgtagctagagtgatcgattcattttcttgctcgatcttgatcggtatggctggtgctacggctg

SEQ ID NO: 20568 - DNA, 1501 bp, Oryza sativa
ttccaagcattagtttaaattgatcacaattctgtttattttagaattagaaaaacaataactagctttttcgtcggttggtgaggattaggaaagcaaagaagttgcctggctcaccaaacaactaccccaactataataactgcgttttggtgtgcccctttgtccaaaaactcactggagtatacataccgctttaaggttgatatgactagcttcattttttttctcaaaaaaagtgcgcatggtatggcccctatggttctgcttattcgtggaataaaccaaacgatatatctacaaacaaaaaataatttgtgaataaaacttatatatatatatattcttagcgatttaaaagtaaaaactgaaaataaactttgatgaaaaaaaccccaaaatcaacttcaaatataacgttgaaaatttaaattttggctgataagcataagcatgtctcctggcttagaaaaaaaagagaacatgtaaatttcatgatattttcatagaaggaaatttagttcctgtataaacgagcaaactgcatttcaaagagtgctcagtagtaaaaattacagatatttgctactgataaaagaaaaaaagacactcgtgtggatataagaaaaagggaaagcaaaaggggtagagaagaatttaatgggagggagttacgtggcaggtcaggtggttaagaccaatgatgtgttatgcaagagctcacaggcttaacacactttatgttagtatcgtcattttgtagtcacatgcaagataagaccagtatgatgatttcctagataactcttgaacgaacttaatctcctggatcagtgagcatgtgagtgtgacagtgagcatttaactaacctgacactgcatttgcatccatcataggcggttattgtatacttttccgttaaagctgtgtttagttcacgttaaaattagaagtttaattaaaattggaacgatgtgatagaagagttgaaagtttgtgtgtgtagaaaagttttgacgtgatagaaaagttaaaagtttgaagaaaaagttggtaactaaatcaggcctaagaaaaaaacaagaagaaacgaatgacgaggagtaaaatattactggctgtgttgatccgagacattaattcaagagatcaagatgatcaaagcatccatgtgttggtgaagagatgataattgtatatgatcttgttgaatcatgacagatgttggagacttggagtgtaccccactatccgtaatctctgcagtaccttcgcatcatgctgtttctgtaattctgttagcactaattaaactagagattcagagcgcagttgcttatgattgatttaggtcatgttctttttatattatctatcaaattattgtcgtagattatttgttaattccatgcttttaaaaatatatcttcttgaaaaatatttttttatttgtttggtttattatgcataacattgaaccgattcctataatcaactaga

SEQ ID NO: 20569 - DNA, 1501 bp, Oryza sativa
aatgaagaagcaggaaatgcggaccatcaatcctcagactacattgccaccaatatcccttggtaaaaacagtttctgaccacctgcagactatcaaccatggcgctctactccaccgacagcaagaaggttccacgagcaagacaagagaagcttcagttctctagtactggagagacgtagtgccctcaagctctcctgcttcccattcttggagctgcaaatgtcgtgttgcaagagtactactctagtgatgatgaactggaagacagcaacgtccgaacaacagcaagagcaacaggtggaccactactgcacaagcatattgtaccttcagctgaatcagaaccaaaatctcccggccacgcatcctacaaatctgtaaatcagcgatcgcgatgtgcaccggaactcgcagtctgaaaacaacatctcagtttatatcatcgaagcctgaattcctgcatcatctgttcgtccgtttcctgatgcaaacaaagttcaggcatcagagggtgtagtacatatttggcagcatcttgttgattactagtgcttgttggacttgtgtctggttcatttatgcataattagaccttatctgggtcttaacctaaatggagacatggagtacacaccataattgaagtattgagtcacacataattgaacgaaggtggcctgaaatgtacagattcttatgtaaagcagcagcagacaggggatgttaagtcagtccttcagtcagtcagtcaccgtgccccagacgaaaaggaatgcacgtactgacaagaccaaaagcaagcaagcgtcagattagttgactagcaagctactcctagtacaggttagacaagaaacagaccaagaaagaaattaccactactaaagcctaacagtacaaggaagcagcaagcgtaggccggccgggaacaccggcggcgtgcggcatccgtcgcactcgcacatgaaaaaaaagggggaagcaaaagctcacctccaaagccgcgttcctgtcactcggccacacttcaatcgcatccaaaacatcaagccgccatcaccaccagtgccgtgatcatcatacacagcatctccatctctgcagggagtgtgtgcaaacctgcaagctgctgcaaattaaggatagctgtgtgctgacagttcattttccttgtgttgtgctgttgtgcaagcaactattgctcctactgctgctgtcctgctcttgctcttgctctgcaggttgggtttctttccttcctcaatttctttcacaactccactgcattttccaacctgatcgggtgctgccttttcattcttccctcctacctcgttggccactacattgagcatcaccatttggtctcaccattcatacctgaaaaccagtatatatgttgcatcagcagcatcatcaaacctggtctatctagctcagtagctcacctgcttgtgtgcttaagctcgtgtttgcagcaaaccatggatgcagaca

SEQ ID NO: 20570 - DNA, 1501 bp, Oryza sativa
caaggaggaagccgccatccaccacccaaaattctattggattctacctatgcatattgtgcgccatgatcagtaagcacctacttgttgttgaaagcaccaagagattaggtaaatcaaaagtgtccaaagacaacatcaggaagcatggaaacccaaagcttgcatcactgaaagagtgatttggttcactcatcactgggttagcgacatagtaacaaatgtcactacttactaggattggataagtgcaaatgtgagctaatttaatcactgtgttcactgtggtaggtagaaaacaacagttgattcacagtttagcagtattataatgctagctcgcctactagtttaaggaaagatcctataatttgacactctataaagtgagcttcgattatttgttggtacatgttgtatttatttgactctagttttttttcttaatcgccacacgttgtcttgtggaaacaaattttgtactatgcgcgtattttctcgatgaatatccaggagcgtagaaataagttcatttgttggtacatgttgtatttatcttttgaagataaacatgttgtttttatgatcttcaacaattagtacggtagaaaacacacagtcatgaattttgtaccaatccgtgtgaagctcacgccattattacggttacaatcaccatttttgatatgacaaatgcagtgaaaggaagtaagaaaaagtctccccaactcataaatacttccaatgctatttttttctacaactacaaatatcagcattgcacttactctgccctttggccatcttccatccatccaaaaacatccacacttttcatacaaacaaacaaaattcagagtgcataaaaacaacaacaaaaaagagtcagatgtacaagggagaaaatgaaaggaaagagaaatagaagtaaccccacaaaaatgttcctaaaatctccaaccaaggagcaaggacccatacatagtatgtctaatactcagggggtttgatacaaaaaaagcttatgcttttattccaaagtccaatacaagtctttggggaattggcacaggcaggagagagaaagagagagagacccataccaatgccaagaacaagaaatcagagagcccaagcaaaaaatccaatccgaatcccctccaaaaacccaccaaacaatctcctccatctccaagaacaagaacaagagagcatcctagaacattaggggataaaggaggaggagaagaagaccaagaaaaggtactacctttcatctctccctcccccccaaatacacactggtcgcaaaacgagaggccgcctcagccttctccaatcccctcttacggagagcaaagcaagcaagatttttcttcgatctctgctcgagtttcttgctgtgaagtctgttcttttttcttaactgttactgctcgtgcgtttttgagaagtttcgagaggagagggaggagagttcaagaacttggagagaagggga

SEQ ID NO: 20571 - DNA, 1501 bp, Oryza sativa
atcctcccagtagacaacaagagaaatctctggactaatttattcgtagcactagtcatagagaatgacaaccatttctgtttttcctctaccagtcatagaaagctccaccttgactacttaagctcatgctgtcttttctgttttaagcgtgctgaagctgccaaatagaaaaatttttgggagcccaaactgaaactttttgagatctcacatatttacgtaagccatctcatttgattatgaccgaatatcaaggtgtcaacctgataaagactaaatatcaaataaagcttccaattgtaagtatgaaaggagcattgttgtctaagtaatctccacaatattgttatacttgagctttcattatcagcattgctctgtcttttgcctggcgtaatgacacaagagaatgtaaagcaatgcatggccgacattactgcctactactccagttctgaagctaaagaaaaatactatcgctggagccatgtagtgctacaggtcacatcgaggaggatgagatctatactactcatcctccctgactgctcacctgtgcttaattttcaaagtttaggtgaaaatgcggagatgtcaccatcgcgaatcgaaccgatgctctatcatgtgtagccaaaattctcatgtaattggtatactacttactcatccgtgcaggtggaatactaacggtactagtgtctacaggatctaggagctcatcaaagagacaataataaatgtgaaaaagagaaggatctgatcctaatcccaactcaccaaacctacgtacagtactacgcatcagcagttggagtactagaataccagcattaaacatattcgctttcgattttaaacgagctctcgttctgggcggtggaaacatcggcaagtgctcatcaattggtacacatgaaatccgtgaaccgccatcaattcaaattcaatccgcgcgtatcgcccaaccaaattgaaattgctatgggttttggaagatgagatccagttggggggaaggaaggaaggatagggataagggatcagtgaccttgtggcgcgagaagaggttgtactcaggctgttcgacgatgggtccgacgaggtcgaggcggttggcgacgctccacgcctcggtgatctgctgggcggaccactcggaggtgccccagtagaaggccatgccgtggtcgatgacccagttcatggcgcgcacggtctcctcgacgggggtggtggcgtcggggcggtggcagtagacgacgtcgacgtagtccatgtcgaggcgcttgagcgagccgcggaggccctcgacgatgtgcttccgggagaggcccttgtcgttggggccctgccctccccagaagagcttggtggagacgacgacgtcggagcggcgccacccgaggtcccgcatcgcctgccccatgatctcctcggcgcgcccgttcgcgtacacctcggcgttgtcgaagaagttcacgccggcgtcgcggca

SEQ ID NO: 20572 - DNA, 1501 bp, Oryza sativa
tccaccttgaagataacataaaattgcctctctatttccgctccatttattagtaggaagaatgcaaagttggagccttgtgaaaactacttttcttctggctgcattcgatgacttggatgatggaaatggacgtgtcaatgtcttccttcgaaaacttgcaaagagttgcattggaatcatctcttcagagagcccccatgctcttgtacagtttgtactagaagaggctgcacttggattcatctcatctgaatgttcaattggagctgcagctgataggatatggagactgtttcctgtgttatacctaccaggtacatgatcttcctttgatcatctcaaaatgaaaaaaattaaaatgcgaacctcttatgattgttttacacgttgccatcactgttatgctacagcgtgttccaattttatactctggcaacaacatccaactccaggacaaatgctgtttgcacttgaaggtataaaaatgccaataccatccaattcacggtatcttgaagccccaactgccgccacacgaaaacctgcactttctgtcggtatatcaaatttaccatgattagtctgcagttatctctatattctgatttcccattcttcactgcagtcttttggtagtgcaattttcaaagaaaatcttgctcctagttactgctcagtcagtcccaaaatataagtggtttttggtaaatattacatatcctaccttgtctagattcatttttcttaacttgtatagatttatagttcaaggatatgccacatttatctaaaatcttctactcccttcgtttcaggttataagacgttttgactttggtcaaagtcaaactgcttcaagtttaactaagtttgtagaaaaaaataaatatattcaattattgatttgataaatttaatttagtactataaatattattatatttatctataaacttagttaaacttaaaacaatatgattttgaccaaagttaaaacgttttataacctaaaacggatagagtatattttaggatggatgaagtataagatataacttctattccatgtagtactccctctatccctaaatatttgatgccgttgatttttttttaaacatgtttgaccgttcgtcttattcaaaagttaattcttttcctatcatttgattcgttcttaaatatactattactactcaagtttttgaataatatttataaaaaaatttgaataagataaacagtcaaatatgtttaaaaaaatcaccagtgttaaatatctagagacggagggagtatgttttatcagttgagactgatcctagctgccaattcaattgtagcaacggagaagaagaggaggatgctgcaaagattccgttacacactccagtagcatctctggaggaaggcttggttgtcttgtctgtctggttggccggccgggagtcgcgcgcgcgcgggaaaggcagctcaacaaacggaggagcaggcccca

SEQ ID NO: 20573 - DNA, 1501 bp, Oryza sativa
gtggcagcgacgagtctcgacgacggcgtggcagcttgccagatccagtggcgacggctcgtccgggcgcggcgcgaggatggttgcggccgtagtttcgttgccgccaccatggtcgtcgccgcgctgccctcctccccaggccggcaacgcagatctggcggtacagggcgacctcggagcggccggcgagctccgggcgacgcggcggtgacacgcccttcctgtcccccacgaccgttggcgcctctcactccaatgccactcgcaaccggaggctcgagcgcctcccctcctcctcctcttccggccctgcaaggccggcgcggccggcgacctcggctcccacggcggcgacccctctcctctggctctcctccgaccggcgtgaatcgagcgacggagtggccggcgagcttcgggttgagcggatcgggggcggtgtggccggcgagctccgatggcagggacgagaacgagctcgatggctgcggacagcgacggtgggctaggcggctggctggagggcgacggctggcatgggaaggagggcgatgccactcactccacaacgcggaagcagcgtcgtctcccagcttcattcgtcctctttttcgccaagaaccagtggccatctttggacactcgaacctcattctggtgggcctagaagcagacgtggcgtgtgccctcctgctttgccgacgtggaatggcgagggagaatgacacatcactgcattgtaaatggcctaactgagctcccttagagttactttgcggtgctctataccatcgcactccctccgtttctaaatatttgacgccgttgaattttttaaatatgtttgaccacttatcttattcaaaaaatttaaataattattaattcttttccaatcatttgattcattgttaaatatacttatatgtatacatatagttttatatatttcacaaaagttttttttgaataagacgaacggtcaaacatgtgctaaaaagtcaacggtgttaaaagatttagaaacggagggagtatattatagtggattgtactatcgatccaacaattcagattaactctatactaatgaacttatagcatgggtagtatacataggtagtatagtactcactccgtttcataatgtaagactttctagcattgcccatatgtatatagatgttaatgaatctaaacaaatatgtctagattcattaacatctaaataaatatgggcaatgctagaaagttttacattgtgaaacggaggaagtatagtataagggtattcattttgcaagttagccgttatctgctgctgcgacgtgctggagtagtgttgttgttggtggtgttgatgacctaaaatgcttgcttgtttctatcaagttctccagaatgtagtatgtactgcatcttccttgttgatttttgtccataagcggattgcattatttgtatatgacccaatcaacaataaacggtgttgcatttt

SEQ ID NO: 20574 - DNA, 577 bp, Oryza sativa
aaaaaaagtggggttgatagtgggccccaccatttttcttttatccttgccactgacaggtgggtcccacctgctgactcagcaagtcaacagggtcaaagatgccacgtagagcaaaaccgcctccaaaaccacccggggagttgatttgcaacggttttcggagttgggggacgggttatacctggttttgtggttgagggatggtattcatacacggccatgttgagggagggatagtggacttattcctttgtgtgtgtgtgtgttggtgttggggggggggggggggcaaaagggccttaggttgctggaggtggaggtgggccgccgggaacggagtggtcatcgatgcaggcgacgctttctgtatgctacagcctataggtggaaaacgaaggtcatctgaaaggatcaaaggaagcaacaccaagtccttttctttactctgactccctcactctcgtcatttattttctttcttaaaagtagttgctttagcttcagccacgcaaattctcgataattcttttttattttaaaacttgttgcttttgatgctttagcaacagaacaa

SEQ ID NO: 20575 - DNA, 1501 bp, Oryza sativa
acgtggcttaatgggagcacgatggccatgggatccatagtccaacctcttctgcaacaccatgtcttgtccttgactttaggaaatgtgttcagtgacagcaaggggaagtaaataaaacatgcgccatatttttctgcgtcgaataagcaagatttagcgaacattgatccaataccgaaagacatcctaatacagctcacaactaaaagaaaatgctgaattctatgcttctgaaatggaaagaattcatcattggtgagccccatcaaaaccgataatatctggcaagatgacattcgctgaaaccacagtctacttgtagtagtatatctttgctcttaaaaaggacaaattggggttgatggtgtgctctacaccccaccccgacatctgagatgatgttgtctggctagatctgtgtatacacaaaccgaatcaaacatgtttcggctcggcaattattcggttcacacctagagcataaaccccatcccgaaatgcaatcgagcatctcgcgtaactgacgagagggaagaatccgcattacccgtcgacgccgacgaagaggagggcctcgccgccagcgttgagatcgccgcagctcggctagggttttgcagctgcgtgttccgacagccgaccaaccggagcgggaggcgcagatcggggagcaccggagcacggcggaggggagcagatggcgcgcgccgccgcagcgctcgtcgcctaggattggttgacgacgacgacgacgatgcccatctgctgcttctgctgtgcatacaagaaacgaattttgcatataagtttccatttttttctccttttcttgaaaacatacaggagataatcagagcaggaaataaaatgaaataatcaggcaggttgtccgatcaagaagggtaaccttgtgggggatgggggaaggttccagaaggttcgagaagagcgggcggggaggaggaatcgctgcaagtggaaggcgcagggaggaggaggaggaggagagggagaggggaaaggattggaggagaaaaaccccgtggaagagaagaagcgaggattttccttgtgtttcttgctgttttttcttttcttttttttcttttttttttgatgatgggaagaaatggttttggggcagagtggttggttggaggtgggcttgcgcatgatgcatcacggcccattggatgatggatcggttgggcttaatttttgtttttggagcaaagcaatatgggccggcctggttatggcctggttatattcgaagatgggctgctctataactggaggcccaacctgtattatgggatgagatcccaaatgcaaaaatcacacaagtttgtcatgattttgtcgtaagatctgtccttttacgagtggaaatgaatagattcacgggccatggacttttctaacaatagattaacgccagcgcacacttcctgggctcctaaacaagtgcatttttttgcaaaaagaaaaagaaaaa

SEQ ID NO: 20576 - DNA, 1501 bp, Oryza sativa
gcggcgtcgcttcctggtacctccaatttcttctctggcccttacctcatctctgttgccaaagatttccttccaatcggcaacccttctttcgcagtgctaacaaggacgcccccatgtggttccccgcttgcagttgggcctttcctccatttaataaagcctaggatacctttcaaatgtatgcaatgattctctttgcttgccaaggtaaagttcctttttagactgctttgagattaatatttgtgcttcttcttttttgccagcataagatgtacacttagaaacacaaatagtgtggatccatctcaaagcctttaggatcataatataaatgccctactgtttttttattactgcttattaagcttctggtatccctccactgcatatgaagtgtgacatgtctatgtgagttctgtttttccaacatataaaattataaagtcatcatgacctatttaaaactgaaattttagctatcattgacctatgctgaagccatgtgactttttttggtttacaccaccttacatgaggtgcatattaaagtctgtgtaccttaatttggttcttcctcttagctagaggtatactaagacatactagctaggagggcctacaatccattgataatgtctcactgaatgcaaattaaaagagtcttaagtatctatacagatgtctccagattttaactatattgtgcaaagatagaattaactaatagaacaacaaattgatgtggagaaaatctctgtaataatcaatgtctgctgcaattgcttattataattcatgctctgtacttgcgcgtgatgatttaaatttcagaataagtgtacagaaaataagttgcggtgaactgtgatttaaccatgaccagtgcccgaagaacagcatggagattggagagatgactggtcagacaagagcctttataggaacaaaatgcaacaccgtttattgttgattgggtcatatacaaataatgcaatccgcttatggacaaaaatcaacaaggaagatgcagtacatactacattctggagaacttgatagaaacaagcaagcattttaggtcatcaacaccaccaacaacaacactactccagcacgtcgcagcagcagataacggctaacttgcaaaatgaatacccttatactatacttcctccgtttcacaatgtaaaactttctagcattgcccatatttatttagatgttaatgaatctagacatatttgtttagattcattaacatctatatacatatgggcaatgctagaaagtcttacattatgaaacggagtgagtactatactacctatgtatactacccatgctataagttcattagtatagagttaatctgaattgttggatcgatagtacaatccactataatatactccctccgtttctaaatcttttaacaccgttgactttttagcacatgtttgaccgttcgtcttattcaaaaaaaacttttgtgaaa

SEQ ID NO: 20577 - DNA, 1501 bp, Oryza sativa
gcaccttgaggcttccaaaagcagttccagtctgtggaggcttgaaatgaaattcttcaccctgaaacggtgaaatcactagaatttccagcttcggtagtttcccaaggaattccatagcaacatcgtgctccaatagcctagcgcccactagttttagcttcacgagatgctggagctccttgatccattccggcaacgttttcagattgccgtatagcttgaggctctgcaggttttccggaggcgaggatatatcatccaagcaaccacacaaacccgacatccctgctgaactcacagacagtgattccagcttgccgaggttggaaatggccaacctaaacgctcgtccattcttcttgttgatgccagccactcctaacttgtgtaatcctgtgagcattccgatgtctcgtaggatggcatttccccttccgatattcacgtcccttagtgtgtacaagtctttcagatttctgatcccctttggcaccatagtgccattttcttcatatactcccctcatgagagatgggaatttcacgcagcaagcgaaagtgcatgcatcacgcctggtaagggccttatggagagggccatcaatgtcccgaagaagaggaaggcaacatgttgcacatagataccccactttacaacgcctctccattaaatcatcctttatccccgttacagtctcttttgagcccaacatggatgtactgtagcttctgcagcttgatgatagtttttggcaaagcctctacatatgtacctctgatgtctagcatctggagttgcctcaggttgcccaaaaaatctggcagtagatcaataccagcgcatcctcggagagaaaggaattttaggtgaataagcttccaaatctgatcaaggtgatgatagtttaggcctctagtcccttcaaagtcgagcactcgtataaacctcatcttgctagaaaccaaaaatggctcccaatacccaaacagagatagcgatcgtattcgggacaggtccactatgcccttgaattaatccttatctcccttccagttgctacttatagcaagatgacgaattgcgccatggatgtacgagctgcagccttcctccatcctaaaaacaaggtttccctccattgactttgagatggcgatgtcacggatgagatcatggactttgcaagagtcaattgatttcctgctgcgagctgattgctggaatggtaaaatcatgcttctattcttgagttccatgaagtagtcgtcagctatttctgttagatttaattgggtaattaatccatttaaatcaattaaatcaaataaattccaaggctcattatgctaggaattcatgtgaattcattcttctatgggatatcaatgggatgaagagttttgagaattaatccatttgattaaggaattggtaacttatatcaattagtcctaattgatggatggttgatggttgtgtagtggaggatggttcatgg

SEQ ID NO: 20578 - DNA, 293 bp, Oryza sativa
acaaataatcttgctatgtctatcaaaagttgggccaaattcttttttttttctcaaaagaacgaaatttccactagtgtcacgatcgaaagacgaaataagattgctcatttgagcatccggtccatttcctgatgtgcgtacataaatgctcattcacaattcagtccaatcaatttgtgacctgacaaaattactgaacaataaattcaaacacacaaccacaaaactttgcactacatgataattcatcctggtctataaaatgacacgaagaaagatatattagacga

SEQ ID NO: 20579 - DNA, 1501 bp, Oryza sativa
atttcttttacttactttattatctaaaatactttaaacataactttttattttttatatttgcataaattttttgaataaaatgagtggtcaaatattgtaagaaaaacttaaaatcccttatattatgggacggagggagtccagtacactaccactgcattcactctcacacagtacatatatacttcctcactaagcatacacacacagtacatatcgctggttaattacataaccccagccagccccaacctgaagatgaaaactagttaaagcttgagatgtctacagatgaattaatttattcaattaaaagatgatgaggacagacaaggacaaattccacagtaaaccatttggtgacatcaccctcacgtacccatccatcccccctccttttaaaagcccccctcacacccacaaactcctatccctctctccttaatttacttctccctcctccatttctccttctcgatcctcctccttcggccagccaccaccacgcgcatgcagtgcatggcgcaggagggctccgaggcctccgtcgccagctcgccaccggcgccgccgcccccttcctcctcctcctcctccgccgccgccgcggcctcctggtggcgcgacatgcaccacccgtacggcgccgcgtcggcgccaagctggctgccaccgccatcggccacggcgccgcggtggcctccgacgatggcggcggcgcaccaacaccaccaccaccggacgtcgtcgtctggcgccgaggacgacctgtcggcgtccaacgccaccatcacctccttcaccaacacctccaccaccaaccactccggcctcagcatggactcctccggcgaggccgccgccgccgccgccgcagccgccgccgagagccacctcatctggaaccaagtactcatgtgagtagagtacacgtatatagatgtttatttgcatatatatcatataaaacaattaattacatgtaagtatataaatttgcatattcgaagagggcgtgaaaagaaggcatgcgtccactaccctttgtcccaatgcgtccaaagcgccctcactttgcctagattctaattaatttaaagaataaatttgtgcatgcatctctctctagctaagctagctagctactgacatcaatccctaataaccctgcttaattcccagctagctaggctaataaaaaatgaattaaaaatggaacaagaatatgtgcaagtatattagaagtgaatatatagtatagccaaccaagcaagatagctagtttctagtactagagagatagagagagagagagagagagagagctaaagcaaagcaaagcaaagccaagccaaagaaaggagcttttcaaatagtgtgtgatataggggaggcttacatgtgtgtctaggcatctattatgattctttggctataaggttctctaattatctctctctttctctgatagattttttcctagctagatagataggtt

SEQ ID NO: 20580 - DNA, 581 bp, Oryza sativa
cagaggttgacttgagaagtagagggctgtgcttggtgcctgtctcctgcacccctcaagtgtacagagataacaatggcccggactactggacgccaccctatagaagctgcttataccgatgaatttattatatattattggtgttcattgtttattattattaattactgaataatgtgtggtggatataagattaattattagaagaaaaaggatattcatagccaagtaagtttaattaattagagctctatttgtgtacggccacaaattagttgaactttctcaatgtatcttcagctggtttgttgttgatttgtaggtatatatggttcgtgtgatcagcatcgagctattaatcgattgctttcctgtactgatttaaccttttttttttacttcggagttatttgatcaatttaattgagtgatagttaagtgtatatattgtttctttatttgtgcatacgatacagcacaggtggatactagtatgccacacatgattcatggcttcatgcagcgtgatgatatcagtttatttggggcgccctaaaatatgcttcgccactttcaga

SEQ ID NO: 20581 - DNA, 418 bp, Oryza sativa
ctcgatgtaaggagttcaagatgggcataacttaagataagccatctgtaccagctggtgcccgccgatgcaccaacaagatgtagatcttgtaggtctggactctctttttgacaccttgaagatctaaatctcttgtaggtctcgacactcttcgtgagaccttgaatatgtagatcgccctcgggggataggcccggaggagcccatagcgccccgagcactcctagggtagttcttgtggtctcgacactgttcttaagaccttgaagatgcagatattgtatggcttggtggggcctgtagtgccctaagcacccaagggggagggaaacccctgttcccatttctccaacaactatcaagaactgtaggcgcacgaaactgctggtagtaccaaggggtgttcctgccatca

SEQ ID NO: 20582 - DNA, 1329 bp, Oryza sativa
agttgtacattggattttgtaccgctttaataggaataatatcaaactttggatttggggagaagtctagtgttatgacactatcaccaagcccagtgtagaacttacccccaactacagtgagaagggccatatatccaatgacgctaccacgatgacgatgaaacctcctagactgatactcatgcttaaaccattgggttcctccgggataacaataccaaattaccgtgtcattaaggcttaggacgagcacgacacagtttatatcggtgggcttacacgatagcaagcaccttgtataattcgttctgaggaatctgtcttgatcgaagggcaagctaattctctgagatgtgaatgggttccacaagaatgtctcatgcgagtctcggtgtaccatgagcagccaaccttgtggtgttatccagtaaaagtgatctttcaaataatccagcttgctattagctagcaattgtttgctagatatgctatagaggagcaaagtgtcatttacctccttaccctcatcattagcagtatcatcatcattatcattactacttgcatcggtttcatcatcatcagtttcctccatagactcttcatcgtcacttgcctcagtaaactcatcttcgtcgctcacatcctcgtcatcaccactttcttcattgtcctggtcgtcgtcgctttcctctagagacatatcatagttgtaatgaaacaataacatcggagctaatttatgatccaacgaagttgaattttcactttcgtttatcccgatctgcatcgtgatttagccaatacgtcgtacgtactccagctacataaaaaaataaaagaattactcaaatgatgatgctgcacaaagaggcggctcgataatttctaaactcttagaactatatgtggagatagtaattaaaagggaccctatacatatcatgcgaagcataacttggatagcaaaagcttataaatatatattcgaaaaagaatagttcgtgtatgggggcttatatatctgaaaataaccagcaaaacatacaagtctccttaaaaaagagagagaaaaaaattaaggaaaaaaaatctaaagtagcttgatataccgtcatcacataataatataataataattgctagtatagtaattaaattaattattctgttgcaaaaagaacataataacatttgctagatacgaacctctttgcgtgcgttcctttaaattgccgattaaacgggcgcaggcacttaaccaggcaggcgctgttcgccgcgtttctgtaaattgcacggctcgaccgctcaatccctcgatgt

SEQ ID NO: 20583 - DNA, 315 bp, Oryza sativa
tacacctctgatcagagtaaaactattcgaatagccgtgcccgcggttatgggcggtcaaccagattcaccgtgattagtctcaccctagtgtaatctgttgaacttggatagttcaggtggatggctgggcctgtcgcaacgtgggttagcgttggacagcggatgtttaatactgcttaattattacaactgttttcgcattaaattcctgtttataaatgccagtatttatgcaaatgaaccactctagctcttctttgttaattccctgcatcatacccccattccggtatgacttgctgagtacagtggg

SEQ ID NO: 20584 - DNA, 1501 bp, Oryza sativa
gtggacatcaatgatcagcaagacatcaagtatactttgagttttatttcatatagtttattgctatatagtcatctattgcaatatgagttgacttcattgtttctatattaatgtaaatatccattatggttgctgattagaatacaaatgaatcaacaaagtgtaattttaccttgttaaagtaatacagagtgaatttcaattggcattgttccaaaattattagtggtactcattaggatgcttgcccggttatcttactgcatgagtttttctcaagcatggaaatcatcaaaagtaataagattattaaatgcttagatagttatcaaactttgataaataccacattgatttacaaacacttacttttctagaaagttaattgtttgctttcagaaagaaggttgtgatgaccattttcctgtaaatctaagagttagtacatgcatgtttgctactattcgcctttccttgactaacatttacactttgcatgaattagttacagcttcccttttcgaatcctgtaaggagagggaatcgcactaaccaatacatgcagaggtgctaggtgaactgttcttgagatgcttactctgattctatatcatggagtttgtttgtggtggggaggatctgcactgccatcttcgtgagaacaactttagctaccatcaaatttaacaaatttatagacgaaaagaagaatatatctcatcaacaaaatagttatgaggcaaaatacgaaatcccaaataagcacagatacatgttaacatgtaattgttgctggacattgcaaaagattatgctcataagatgatatgcaagaatagaatattcgatgaaaattgaactaacttttaataaatcctataaaatttgaagttttaaacacaccctaaataataatataggttatatacagtggagcgccaaatggcgcgctacatttctagttagacattatagcccaactctacggtcaatccatctatcaataatattataaagatagctaaaaatgcgaattgagtgtcaaaatattttaatagtgtttcatttttcatctttttttttacgttttgaaacccgtatgcatcaaagatgaaaatatgaaacactatcaaaatatccactgcaacattcgatccaaccacaaagaaacatcacgagtacactaactaactgaaacataaaaaaaaaacacgagaatatacctggtatggactgcattttcttcccctccaacgaacacagggttaccaaggtccgccggcttggtgctctcctccagtcttcgctagagatccacgccgtgatactacaacaccctttttgtaccctgaggtgagcagctgtcgcttcctcaggccctcaccaccctgttgccgctactactgggagctcactacgtcatcgtcatcgcttgagcaaaatggaagcatctgcatgggggtcatcgtcttcctcccagcttctagtcccaagctat

SEQ ID NO: 20585 - DNA, 191 bp, Oryza sativa
atcgggaataaagcgtacgcaccagcccacgcacaagcgcatgcgtagcccatccttatctctttttcttctccttccttatcttcatcctctccccttcctcttctctcaccccctctcctcctccccgacggcggcggcgggatgggggatgggcgcgggctggcggcggccggccggcgggggcggga

SEQ ID NO: 20586 - DNA, 811 bp, Oryza sativa
tatttggatgtgatacttttggtattttaggacatatcacatacggtgaaaataacttatattttagaacggatatagtagttttaaattagtggagatgatctatagaaataatattttctcagcgcctaaacagtaaatgcaaaacctttgaatgaatggttttagttgttagcgagctggtttcgtaaggttggttgtggtagtattgcatccactaatatttttttcagcgcctaaacagtgaatgcaatacctttgaatgaatggttttagttgttagcgagctggtttcgtaaggtttggttgtggtagtattgcatccactcagctgttgtttgtggtgtttttgcgaggtttttcttgtgatattttttcttgtaatttgttcaagattttacgtctgtttattgaaatatacttaaaataaaacatcaaacatcagtatcgctatacattataattgaaaaagcgttgcctcctacatcccttcactctgtctacctctcttaacttccggaagacatacctccattcactctgcctgcctcttaacttacggaagatagttccgtgcctatacattgccaatccctatcaaatcaagttgaatctttcttgatcttccaaaattgattgagaacttttgatccacttgatctcttctctcaatttttcctaaaattggagcgaatccacaaaacccggaataaaaacagctggggaagttcactaccggaagggcatcattcactactgttaaattgatattaaatctagtgaattaaagccaaattaaaagaggaaatca

SEQ ID NO: 20587 - DNA, 533 bp, Oryza sativa
ttgtgtagcgccacctctcaccactactcgctatgtcatgggtttgatgctcggtcgcaagcatgagttttgaatttggcttaggacacccctagcgaaatgacctcactactacaaaaaccctcatagggaccgggcttgggaccgcgcttataggtgctggttcatttaaaaccgacaactataggcctttcccacattcgcacgccaaaaaaaaataaagaaccggcacctttaaggaagcataagtgccagttcattagctaaaaccggcaccttttctaaaagaactggaacctataatatattatatgtaccagttaattaaaaaccaacacccataatatattagaggtgccggttcttttaaaaaaccagcacatataccataccgagccgagcttacgagccgatcgtgcgccggcttatccatataatagcgcgtcgcctcgatctctcctgtcccttctcgatttctctatctctctctctcgcctctttgtctctctctcgcctctctcacttctctcagt

SEQ ID NO: 20588 - DNA, 1501 bp, Oryza sativa
taaacaatatgcaatcggagaagatactgcaaaatagcgtgtacatgcatcctatatatccccattaagtgtagttaatgctaattctctcctctcataaaaccacgtcacctcaattgtttttagtatttggatgattcatcaagtatgtaaattgcatctcttgacatgacctcaactgtttttagccgttggatgattcattcagggtataaattgcatcccttcccccaaaaggcacaccatacaactagtcatttataacctttggataattgataaaagtataaaaatagataaacatataaaaaaaatcgtatagtaggtaagaaagaaaattttagaactcatatatagtatattatcacacaattctcccgtagcaacacgctgggtatccatctagtttaatagaaagcacacctcaaaggcatatgccccaattcctctcatgtttttcctattcccttgcccttcttccgtcccctctgtcccccttcttactgttttattacattctgtacacctgaaatcattattccaacatagtagatgatttgttcagactttttagcattacctcaaaaaagtatgcacataatataccgtggtatatagtccaactgacctttttctacctacatagctacataggtgttagcgtgcgcggcgtggcaccgcgctcacatttctagttacaattcaagatgtggttccagcttcatgttaagatgagggaacagaggtgaacttattaaataaaatctccaacgtcgggaaattatgtggacacacgagcgcacgacaacgaattggtcgctggaacaaacattatgcgctgcaatcctcgttttccaaacgcatctgggatcattttctacgtggatttcccctaggaaatttccacctccaattttaccaaaataaccctcagagaaattggagcccacgggggtattctccccaaatttaccctcacagaaatttgggcatattagtaaattaacaagagacggcccgacccgaccgaggagctaaccacagctcggctctggcccatataccggcccattaaacagtaacccctcgtttccatctgatcacgttctcccaccagccgccgccgccgccgccgacgaccgcctccaacacctcaaagccgccgccgacgatggctcgttcgaagcgggcctggagagccccgaaggtgccgaggagggagatggcagagaagtccttcttctgcccctactgcgtgaaacagatcaaggctgacctgatcaggggaagcgaacactccaagaggtgcaaagcgatacgagacaagcaggtcgcggagagggcgagggaggaggcggcgctccgccaagccgccgaagagctgcgcaccgccggcaagaccagcaccggcagcggcggatcgaccccggccggcccatccagccccaacatcaaaaagtgagcagaggtaataataagctactactgctggagatgatta

SEQ ID NO: 20589 - DNA, 1501 bp, Oryza sativa
gggtacacaaacgacaatgttgacatacagatcctcgtcttacaaacattataaaggtcttacagaaatgcagcggaaaacaaaagaaactggagcttaagccttgactaaaccgcagcgggaacaccactccacaggcatcctcgacggcacggacgaagcctactcctcggggaaaccttcatctgacacatacccgtcctctggggttgggaaaaatagagcaagactgagtactacccactgtactcagcaagtcataccggaatgggggtatgatgcagggaattaacaaagaagagctagagtggttcatttgcataaatactggcatttataaacaggaatttaatgcgaaaacagttgtaataattaagcagtattaaacatccgctgtccaacgctaacccacgttgcgacaggcccagccatccacctgaactatccaagttcaacagattacactagggtgagactaatcacggtgaatctggttgaccgcccataaccgcgggcacggctattcgaatagttttactctgatcagaggtgtacaactgtacccacaagacacagccccacgacacgtttccgtgcgccgacatgtcaccacgacataccggaaagaggccgtgacaggacccttcgcataaccccctctagccaagcacaccacacctcaggtttcacccccgtccccagcgggcgacgggcagtcccctctcgtgcctaggtgaatccggaagcgacagaggccgtcgcagggcccgccccgctccatcacgcccacccttgcctggatgcgtcgactagaggaaagctacactacaagcccagccgttgcccacgctggcttgtggtaagtacgataaattcttccagggcatcccgcgaaccggtccttaactgccatgggtgcgactagcaaaaccatgcacccacagcccaccatgtggttcattttatttacccaacaccagagcggtggtattaaaccaacattatcatataaacctatagtctaggttttaaatgagatccccaatgtgtgctagttgaactaagcatggctaagcaattcctagtccaaaatctaatcatgttataacccaagctaacaaaggagcatggtatcaaaaggcatagctgtaacaataggtaaccatcccatagtataattgcaaaacaaatgcgatatttgaaagaaaacattaggacatttgcaatataggatcaatatgatcaagtgacaagcatgacttgccttgctctgctgctggagggacctcggcgactatctcgaagtacaccggagcgtcggagagatcggaatctagcgacatacaaagcaaacattgcaaacaggctataagactactgaaacagagaacaaaaccatttttaatggattctacacatttttcttgatttactgagacttgaatgggcttaaacggagctcggatgaattagttatgaattttagaagattcactgtgtt

SEQ ID NO: 20590 - DNA, 350 bp, Oryza sativa
aattcctgcagccctctggacagtagttagttggatcgaattatcatggccataggtaccattaaaaattaaataacaataccataattaataataggctattgtaattaataacagactactgaaaatactttggattcttcagtttatactatccacattgtaattgacatctgatttatcttttagttaaaccgatataattaaaaaataactaatgatttttctataattagaatctaaacattataatattaataataatagccgtggaacgcacgggttggcgactagtactagtaatgttgaatagtctcacattggttgtcgaagggcaaaggacttaaaga

SEQ ID NO: 20591 - DNA, 562 bp, Oryza sativa
tctatgtggacaaggggatatctacggtataaatacaaagcccctaggaggagaggggacacacaacatagagatacacgatacacaaggccaagacaaatcaatacacatcgccagatatcgatattagagttaagcctagaaaaacccaatatggtgtctgcggaggcagtaaaaagagatctagcgctatctctgatctcatcaagagcgtattcgaggtgggagactaccccaccgtcgactagtgttgatgatccagctgccaagtcgacgacggttagataggttatactatacattatatttgtgtgattatgatgaataaaagcaacaccggcttcggccagcaggagtagggctattacctgtaagataaggggctcgaacctgtataaaaattcttgtctccatctgtttaacctaaatctcgtatataccctagtaccaatgatacccatactgtctaaataccgtagtcacgatatcaaatgtcgacagtggcgcgccaagtagggggattttggtgcttcaagattccggttgagatgagttcaagaga

SEQ ID NO: 20592 - DNA, 1501 bp, Oryza sativa
taaaataacgtggtcccttatttggttctatgaaatgttgcttcgtatatatgctatggttatgtatatttattcctcttgaaccatatatgctgctgattgtatgtccagtggacagtggtgctctttatgtggtagatgagttttagtacgctcttttaaagtccccacattaagcatcaaaggcttcctttggagcaaattgtttcttggagatctttcaggtggctacttggatcctgtggaaacaaaagaaatgatcccatcttccaaaatgtgcaaccctctctctctctctctttggaaattcttcttgaaagaggaattaagtctacatttactcagacttaaaatagacaaatacaatacattgacctttctttcaatcatggattgacaacttgtaactcctctggttgttttttctatacttaactttgccacccctcttgtttttttttttgaaacttaacttgtaactcctcttgtaaagttgtgtttctgtattttaaattaaaatcactgtgggggcttccccactctttcctggtaaaaaaatggtccatatttcagctggaaattccaacattgatataaaatatctacaaattatcacgttaattaaaagataattgatatatcttacagatcaaatcatgtctataaaaaaatataagaattaaaatataaccatgtatatataaagtataaaataactgatattttgattccatttccacctagtacattgattgcttctcgactctatcagctagatgaatgtcagaccctttgttgtgtcagtatctctcttatatatcttgcctttctccatggatgtattaattggtctgtcccatatagtcgaatgcaaatgtaggccatcgctttctttctctacggtcagtcgttctgggtaagcacaatcaagctcgatcaaaccaaaacaattaaccaaaacaatttgcatggctagccaattaactaaattgtttatggtgctactaaattattgttttgtcgatcaaaccaaaacaatcaagctcaaaccaaaacaatatggtccatgtgtgtttatgtgacatagcaccttacgtgccacttaactaaatggctcctatcgcaacacccacctcttatttaacagcttaattttttagggacaattactcattggaccctattctagactctaactactaatttgaccctacttttttaactttgcttacttgactctgcttttcaaaataagaactgccatttgacgctgttttcactgtaccgttaaggtttatttaggaaacaaaaaataaatcattttatagtctaaattgactaaaatgtccctaactaccaaatcaatcctatccctaaaattctcacccggtggtccactcatcccaggccttctcaagtctcaacgacgcggctagggttcggtggaatcggcgcatggtgggggctgcggcgcaggtggcacggcgctcggtggggctgc

SEQ ID NO: 20593 - DNA, 1501 bp, Oryza sativa
cagcctgctgcatgcgactaagccagcagctccttctctcccatttgctactagtacatgcaagcattaactcttatagccaacctctacgccagttcactatctgcaatgaccttctcaaatgcttaaagtgacatggccaccctattgcgccagctgccgacgaaaccattaaccatgctcttataagttaaacattttaaaaaataataattaaatttataggaaaacatcattgtcggagcgagaatcctcacactccatcgatggctcggggcaccacgggagcaaagtgggagttgacggacaaaggtgacccgaggacaacagtagccttaagacaagctttcattacctcggaacccctacggccgctgcatatgggccatggccccaaggatagcgccaggaggtctctctgaacgaatttgcttcgttaaggagatttgatatccggtcctacgtgtactcccttagcctgtcattctgcattaattgtcgggtaatacagtttctatgaacatatcactggcgatgtgggggatatggccgtgcatgcttcgccttgcttgcccacgtcaccccggagtaaaagatgtgtgacgcgcatttgctccgtattcacctgatggacccctctttttaccaacgtcgtgggctgataggtggacccttcacatccggtcaccctgcttggagggacagcaataagaccaagcatatcaacccctatgggttggggcccttttttttatgcatgcatgggactacggactccccttgacgtataaaaggagcatccgtgccacatagaaagggatcggactcaagcaaagttagtttctagccacattacaatgaacaagggttcatcctctatcacttagacaacgaagaagagtcaatgctctctcacttaagacaaaccaaacatcctcttgtaaagttcattatccatagcaatatcacatgagtatgtgtattatgttttcgagcggcatctgtataaaccacttgtctccaacccacacgcaaaccgagtacgagctcggaacctgcacactaacagaattctcaagggagggtactttgccttcccactagaagagcttattgctttgacaatagcaatatttttaacagaaaacaaacatactatcaaaatgtattttatgctacatttaataaaaataatttgatgtcatagatagtgtttagtttttctataaatttgatcaagctaaaaaattaactaagaaaaaataagtcaaatatggaagggagggagtatgactaaggaggagaaagggaatgaaatcaaatccgattaatggtatgccggatagggccttccctggcccaatccacagcagaattcagcatggagcccaacctcccgtcccccattccccttctccatctcatctcactcccaacactctctctcctcgctgccgctgccgccgccgccgccgccgccgccgcacacacgcgccggaaa

SEQ ID NO: 20594 - DNA, 1501 bp, Oryza sativa
ctttttttttcttcgaactttttaacatttccatcacatcaaatatttgaagcctaattacgccatgatttaacaatgtggtgtaacagtaaacatatgctaatgacagattaattaggtttaatagatttgtttcgcagtttacaggtggaatctgtaatttgttttgttattagtctacgtttaatatttcaaatatgtgtccgtatacttaaaatttttttttgacacacgacctaaacacacagcctacattattaatgtcctttcccgtgttgcaaaccccattccatttcattcatcgactaattgatggaacttacttactctctccgtcttatattataacaacctataattagatagaatatttacatgttacaaagattttgattagaaaatttattcatattcattgtaccatctaatatcatatttgatcatagattattatattatgggacagccgaagtagtactccctccctccgtttcaaaatgtttgacaccgttgattttttagcatatgtttgaccgttcgtcttattcaaaaacttttgtgaaatatgtaaaattatatgcctacatcaaaatatatttaacaatgaatcaaatgataggaaaagaattaataattacttaaattttttgaataagacgaacggtcaaacatgtgctaaaaagtcaatggcgtcaaacattggagtacttatttttgttttgttttgcagcttagctgttgttttagtagagcatttgttggttggtcgttcccagcatttgtgcattgcaggtagcacaagtagtacaacctccgtctcaaaataagtgcagtcttgagtttccgcgctcaactttaataatccgtcttatttgaattttttttataattagcatttttgttactatgagataataaaatatgaatagtactgtactcatgacttatatttttaatttttttaaaaaattttcaaataagatgaacgattaaaattggacgcggaaaatcatggctgcacttatttttgttacggagggagcagtagagtacaggcagggcagggaagggcgttggtggttcatctcctctcctctgcttgtggcgcgctcattgaatattgatgctgctgcatgctacctgtatttctgtactactatctacgactacccccattaacaaactaaaatgacagctccgcactgccccaacatcattttcttgtactccatacgtctcataatataattttgagtttttactttgtaatgtttgaccactcgtcttattcaaatttttctttataaatataaaaaacgaaaagttgtgcttaaagtacgtagatgacaaattaagtcacaaataaaataaataataattttaaaattttttgaataagacgagtggtcaaatgttataagcaaaaactcaaaatctcttatattatggaacggagggagtagtattcaattcagatcagttgatttgagccgccgtcgac

SEQ ID NO: 20595 - DNA, 280 bp, Oryza sativa
gctataggaattgtatgtgtttgatgcctataaaatctatcctcagaatatttgtgttctcctttttgttagtttacacattggattgacctgtctgcaagcgtcaatatcaatatgtaactggttattaagccagactattcactattgtacatcctgcattccatgtactagttgataggagtttcttttgccccctagacagttgatatgagtataatatagccttttgtggtttatagtttccacctgacctgacaaaaagtttgctgcttgcagc

SEQ ID NO: 20596 - DNA, 886 bp, Oryza sativa
gctcttgttcgcaaaacttcaacctggaacaaatgttatgaacagcatggttgtattctgccacagttttaaagtcctgtaggcgtaaatgaacccactcataattagcctcaggccaaatgagttccttttgttgatcataacgctcttttagagctttccaaaggttgagagggctcgtctctaacatgtattcatgtttgagatccttgtgaatgtagagtgtcaaaagaaaaagggttgtattgagcttcctgggctcaactgccgggtccccatcattgggttcctcaattgtatttaaaatcccccaagaggcaaaattgattttgatatcagaagcccatgattttgatatcagaagcccagatgggatagttagtcccattgagggcgagttcgtcgaactcttttgttgccatgtccctataatcatggttaacattatcaatttacagaggtaaattaataaaaatatgatattaagattgtaatctcaatgcgtaatgtaaaacttcatattttgtaatgtttcgaaaaaaatgcaggtaatagacctggcaattttgagttagaattcgaaattaggtggcacaatgtggataatctccaagtaattaaacagtggagtagatctcttaatagtgggcaagttatacttgttgcctaaaacacagtctccaggcaaatatattctggtgaatataccgcagccaatgtttaggactccactaccttgtgttcaaccaaatttcaaataatctcatttttcaaaacatattgtcgaaaaataacacatgtgggtaatcatcgtgagatgtagacctctgtgagatgggcgaaatgctcgctgcctaggttatgaccagtgcggtcaatttgtagg

SEQ ID NO: 20597 - DNA, 1501 bp, Oryza sativa
actgacagtagtaacaagtaatgctatagcattactacttgtgaagagtcaaattctaaaaaagccaagatttgaagaacaatatctctcacgtgatgtactattttttaaaatagtttgcaccatgatgctagaaaaaaagcgcttatcaaaagtagatccatcatgactatattttaacattatttaagtgctgttactacacataaaacgtaatgttactgcacgttgactgtcgcgttactgcaccgttccgcgagacaaagcttaaaagaggtgggtggtgagaggagttaacaagtggtttgaccgcgtttgactgacgtgagatgcctttgaccgacctttgactgatgtgggagatgggtttagccctcgagagagggggtatagaatagctattctatgagtaaatcccttgtatacccatgaaaacttgcccaatctcctctatacccctcaattttactcgatcctctctgtacccctgaattttcgctttgatcccttccatgcccctcccgttaggttttcttcatttcccagttatgtgtaattgcaaatgtcgataatacccttgtagatggaggagcaacagcaggtactaggtagattgaaaaaaaattaaaaaatgttgactgcacagtatgtgtatttatgagactaataatgagtttagaacttttattgtggtattggaaaaaatgcaatacatgaaacttttcgttttgaaaaaaataatagggttggaaaatcaaaaaaattcctcagtacaaaattttggtacagtcaacaggaagcggaacttattgcggacaaaggagaaaatccattgcaaaaaatttggagcatctatacaaaaatattagcaccattaatagcaggaaggaaatgaaaagagtatccatatagaaatttgtgaaacaaaataatccggatcagtaagagcatcaagagcatacatcatcaatcaaaacagtagcaaccatacaaagcactttatcaattttattttcatcatccatacagagcacttcatatcaatctcatttccatcatccatacaggacagttcatatcatactcaatagtgtaggaaccaaaccaactttgcactccatacacaaatgttgcaaatgacaaatcaagttaactgggcagtacatcatgattataatgtcataagatccataacagtacatcactgcatcatgagaaggggatggtggcctcaactgtttcgcttaccgacaccaatgaacaacccactcctctgaacaagaaatcaatcactcatcaactgcaaatgttaaatacgcaagaagaaatttacattgctgctactcgtacgcggtgttgggtcgcgcaacgatgatagggtggtggactttggctgcacgacggcaggacgttggacagcggcgcccgcgacgggagggcggccggcggtggcctactgcgcgacgggacgggtggtggccggtggcgccccaccgcgcga

SEQ ID NO: 20598 - DNA, 1501 bp, Oryza sativa
taaatgcaactcaatctggaattagaaaaaaaaatatgttggcaagctaggctcatattagaacttcatgagctgacgtgcttgtccaggaaagtgttttcaagattactaaagctggtattagcatatccaaccgcagcatactgttttactgccctaagtacatcttgtttcagtgtctttctttgttgaaggtttccagaaatcatacaaagccacatgtgcatatagttctgcatatagttctcctgtcgtgtactaattgaaaatgagttactttcataggaaaaaaaactggggaatcgataataaagaactaaaactcctttcagcaaatatatgcaaaattgaattccaccaaaccaagtattaactgaagcatttgctggatctgcatatatgcaaacaaaacattaaggcttaaataggaactttgtttgctggaaacagaaagagatggtaaatcgaaaggaaagttagaatcattaacagagcataaaaaatatagtcaagccaaaacgaatcatgcctcctatctaagcccccatggactcaaccttaatttatgaacttctataattcagtcatagttttgcagtaaattcagtcatcttgctgtacttctttccaattcatccctataggtcaacatctcaattgacagttgcatattcattccaaattgttcagtcacagtgagtcaccatatccctataggtcaacatcttacttggacagttgcatattcattccaaattgttcagtcaccgtgagtcaattgagcaactttttactgtaacacattgaaggaggcagcactaaccttgcaatgaagtcatgtgcttatgacctcacagggtctctatctcatgagctgatggtaccgtaacgggcatgccattttgctatttgctcatttcaatctaaactggaaagaagcaattttttattggcatccacgattccaggggtgtctccctgccgctgccaccttctccactcccatacctgatgcgtgggagcaggcaaaagtgcagggatagggaggaagaagtggaagatggcggcgtcgcatcatcccactctgttgctcccagaggaaaattgttgagctgctcagccagtgaaagaggatgcatgtggtacctcagcctcgccgccacccatcttcaccgtcggtatggtttggatccagcgattcctgagcttgcggtggcttgcccccgagctcagtgcggggtgcttgaatctgatgaggaacgcggtgcggcctggatggagcggcggcctcgatttggccacggtggggatgaggagccaacttcggaggcggtgggggataggaggaagatgcggcagctgggatgacgagggggtttggagtggaggcggtggtgtggcgcagcacgcaaaggagaggaggggtcgtgctttggtagatggggagggaggagggggtaaatataaaagaatcgattctaagggtatggaaggatctagt

SEQ ID NO: 20599 - DNA, 1501 bp, Oryza sativa
tctctcttgccctttccctcttcccaacctctgtacgtgaggatgactgaaagctcgttaacaatcaactgtgtggagtcagtttttggcggggcgttttgcgacacccttgtaggcctgcgatcgacttggtggtagtgtcttttcctaggttgtgtgagaagctgcaaacttccagtgtggcgtgtttattttgtttttcctggttacaatcttctagggttgtaatcttgtaattttttttcatgctatatcaatacaaaccatcgcattgtttggtgtgttttgtttaaaaaaagcagaagatggggcaaactaggtggccagttgagccgacatggtaccggaggggttctcttcagtttctacagtggatctcgatttgtaccacaaccgcgtgcatcgaaggacgaagggtgacactgtctcgccggagttgaacaagctccagaccaaccaccagtgatcttttatcgtggtacccaaaacacaaatattcgattagatttataaccgaatctttagttccgattgatgttataccaaccggtattaaaaatacatctttagtcctggttgttaacaccaaccgagactaatgctggaggatctttagtcccggttgttattaatactggttggtaacaccaaccgggactaaagatatttttagtaccgattggtgttaccaagtggtatgaaagatgtctgcaggattagtttaaaaataaagtatctctatccaagttagatatgtgtactaggtgggatagtaatacgcgtgagggctgaggtgagagatcttgagtttgaatcccgcatcctacaaattttttttttactttatatgcatctttagtaccggttaaatggctggtactaaaatcgagattttagtcctgatttgctacaaccagttgctataaccggttccgaaccggtggtaaaaatcagttcttcactagtgagcggctcgccagtcgccactctgtagtctgtacttgaagaacaacagctttaatggcaccggcctcccccgtactcgccggagcgagcatagcattgctcgatggtccctaattaacgcagcagagaatacagaggtagcttagctaggtaaaggctcaaccgaagcaagaactgatgagataagattcggattcctcctaccaaaactgatcattctcttgctagctggccttcaagcctcgatccacccctcttactcggccgatccgttaaaaaaaacagataaatttgtagcacccctactactaattaatggctagctattaattgcagagaaaaacacactctactgctcacccttcaatcctcatatcccactcatattcatatatactccaccgacaacccctgttgttttattaatttcaagttgattgagtaattgttaattagcatgatagatgcttgtgtttactgataatacattactagaacgcaattagggagtttttttggccactgtgtctgacag

SEQ ID NO: 20600 - DNA, 1501 bp, Oryza sativa
ctcatggcatgtacaactctgttttcactggatgtctaggtttgaactgctgtgataaacgtcttacgtacttacgtgtgagagatgtccatttactcgcattgtgatcttctttaattttaaccttacgagtcattccatctataactgggactacctatacatttgtttaaaaaatttcttctaaaaatatcaaatataatatagtagaaatgtacaattatactgtaattatattgtaactcacatgtaactgtaatgtttttctagaaaaagaggggggcctctcccatttcattaataaaatgacagtagatttttatagagtcttgttacaaccatgtaactacaatgtaactcatacgtataacactggatagctctgcagttgatggtgcccttcagaagcagcaggaacaggaggaattgctcaagaacaagccaggcttcggctttctttgccaatatatatgaacagctggtcgatgaatggggcttcagggcccatgatcccaaccattttcttaccaaagcattctgatgctaccttcctcctaaaatttataacattgtttagttcatatttacactaaccaaaatcataaaaaagaaacaaagggagtctattctgccgaaaaaggaaagaacttgactcctctgttcctcctgcaaaaagaatgttagctcaagtggaatagtaccctaccttgcaatatgtttgaggaagaaatcatacagccaatgcctctacctgtcctgccaccagttctaccagaaaacccattcgaaagagaaactggaagtttgttcctgaaagtaatcctcctactttgatcaaggcaaagaagaagtattagagttagattagacttgtatagcctagatatttgttgtatccgtatatgtctcttatttaagagtttgttgtaatatctactgtattggatatataaatataaatcgccctccacattgggttggtgtggcgtctcataattctctacatggtatcagataccggtttccctctcctttcctaattcgccggcttctctccacgcgttgcccgtgatctcgcgacttctgctcctgccgcgatttgtttttccctcgacgagattttcgtcgccctcgacgcgtcccacccagcgtcgtgttttttcgttgtccccaccccacgccgcgccgtgccctatcaacgcgtttttgccgctcccacgccgcgcccagtccaccgcaccgtgccctgcccactctgctcgcgccgcgccttgccctctccacgccacgccgcgccgcgctctgctcgcgccgcacccctgcccgctccttgccgcgccgcatcctgctctacgcgtcgcgtcgtgactccctcttctctaagccatgtctaccgagtcttcttcctcctccacaacctcgggaacaatggcatctacgtcttccggttccttttcaacctctgccgctagcagtggggagtctgccagtgcaatctttg

SEQ ID NO: 20601 - DNA, 205 bp, Oryza sativa
gggaaaatcttaattgctgccatgataatttgagcttgtgttgttggtgaagcaattattaaccttggaagtgcttcaagtgtaatgtaagagaaatccactgatagcctaaaaacagccagccgcaaacaatgccgcgttgacctgcgaaatgataagcataataattagtggtgtctaaactttgcgctggtgtagtggtaaa

SEQ ID NO: 20602 - DNA, 1501 bp, Oryza sativa
ggctgcggtatattcaccagaatatatttgcctggagaccgtgttttaggcagcaagtataacttgcccactattaagagatctactccactgtttaattacttggagattatccacattgtgccatctaatttcgatctctaactcaaattgtcaggtctatagcctacatcttttcgaaacattacaaaatatgaagtcttacattacgcattgagattacaaccacaatatcatgtttttattaatttacctctgtaattaataatgataatcatgattatagggacatggcaactatagagttcgacgaactcgccctcgatgggagtaactacccaatttgggcttccgatatcaaaatatttttttctttcttcttgcgggatttcaaatgcaattgaggaacccaatgattgggatccaccagttgagaacagaaagctatatattgccttttttccttctgaggctctacatctataaagatctcaaacatgagtacatgttggagacgatccctctcaaccaatggaaagctctaatagagcgttatgatcagcaaaaggaacacatttggcatgaggctaattatggctggattcatttacgcctacaggattttaaactgtggcagaatacaatcatgctgttcacaacatttgctccaagttgatattttgcgataagagccaacgaaagcagaaagatagagaaaactctatcaactatgtttccggaggacaagatactaaaccaacagtatcgcacttaaaggattcaagggaaattcctcgaataaccctaagaatctgactggaaaacgcaacataacaacaaggtgcaaatccaatggtcgatagaaaggaaaagagaagggtaaggcaccacaacctcgttgcaatagcaacaggcattgcaacaggtgtggatctgactatcatgtcactaaagattgccacatcccaaaaacatcttgttctcctgtatcagaaatccctaaaggcgaaaaagtcttctgaggaactaagatttgaagctcacttcatcttacaaaagaaagaccggatgttgaaagttctcactaggctcctattgaaccagagaacaacctcgctcttctcccagaggataccgctgcattttctgcaatggatgacatgctcatcgaatactgctcaacggacccacttggagatttactgtaatctcagtgcgtcccacttagagataaagctgctttaatctcagtgtgtttgagacagtatattgatatcctatagtttgttaaaacaataatggttgtaataagtcgatgagtacaaactcccttatattataaggttataagacttgctagtcattagagtatgtactattaacatttgtaaacgtcatactatgtatctgatgttttaattattttatgtatgtatatatattggataaagaattcttaatcaagcaattcttctttcattatagatgtctaaggatatca

SEQ ID NO: 20603 - DNA, 601 bp, Oryza sativa
ccaccgctattgtgcggccggcccatcggcccgagggaaaagggcgcagggggcgagggggtgttacggttagaaccctaaccgttcccctcgcggtgtgcgccgccgccgccaccgattggccgcgcgtcctccacctcttctgccgccgccgccatttcgcggcctcctcctccaccactttggccgccgtttccaccgccgcctttctcatccaccgccgatcccatttccgccgccaccttctccccctgaaacgccgccaccgctgcctccatttccgccgccgcccaccaccgcctgcatccaccgccgtctctaccgcccgccgccgccatccaccgtccgccgccgccgcatcccccatgtcggccggcggtttgccggctagagttaggccgacggccccaactcctcatcggagtcggagaccggtcgagcccttacaccgttccccatcccgccatttgagagcgtgcgggagccatggggaacggcgagccatgtggagcggaggccgggacggcgagcagtggcttcaccggcatgacggcgagacgacgatgggttgaagtaggccggctcccccgtgcgcgctgcc

SEQ ID NO: 20604 - DNA, 1501 bp, Oryza sativa
attttgaaaggaaattatatttggatataatttccaaaagagatattttctagtttgagtgcaatattttgagagatagaatataacggaatttatttgatgcactcaaatgagagggagaggaaataaatggaggaagatagataggatttttagcctcaaaatatatggcatgggtttcaaagaattgtctgaggctaataggatatttggatagaatttgaatttaaagaagatttggatgacaaggatataatatattatcttagcacaagagcaattattcacaatgtttgtaataatattattcttgtgccgagaaggaaatcaagccacagaaattagatcaccggctagatcaaaaggaagaatttggatcaagaatcaaaggatatgtttaaggtcaaaggatgggctaacaaataatcccgataaaattagaattactttggtttaggttcaatggcaaaattgggaaggtttcttggatcataatccataaaaaatagtaagggttttgaaactaaatttgaataaaagaattttagtcgaaggaaggttttaaattaaaaccaaatcaagaaatacctcaatttaaccaaatatatttttaaatgaaaaacacaaaagaaattgaataccagagaaggattttatgcaagttagttttagaaggtccctctaattatattttcctaggtttaagaagttattaagaacataagactcagcatggtgcagagttagaaaatggttaattttcggtatgttacaacagtgccggtcccctgcaacaaatcaaccacatattttggaaactctctattaagtaaatttggtttatttttgttccacaaaaaatgtttcacctagtgcactcacaatgtttcactatgtatagatttaatgttgcagtgaactgaaatattccattgcaacaaaaaaaccaacatattttggaaaccctctattaagggaattcgttttattttttgttccaccgaaaaatgtttcactatgtgtggatcaaatgttgcagtgaactgaaacattctttcgctatttgccgaaacattgtttttatataaggtgaaacaacacctgatttaaacgagtgaaatattttcgatctacttagtgaaacaattccgatataactagtggaacatcgtacaacactaaaaaataattcaataataagctaatattttttttcatcggaatatatccatatatggtcttgttttgaagatttaattataacgaatttaatggtacaatcggattatgattttgataagtaatttaagagaaaaatcagtttaaaatagttttgcacgtaaatcggacgctaacgtcagcgcccgattttactccgaattgatcgggcgccccagcctaggctgccccgatttataattcgggcattcacgatactttagccataataagataataaagagacttcattcaagaatgagcctatacgtatagttggcca

SEQ ID NO: 20605 - DNA, 1132 bp, Oryza sativa
gaagtaataacatagattcatgccataaattgcctagcttgttgccatgccttcattcttcctgggaccattgcagggctggagataataatctatctactgtcgttgtttcttgaacattgcagaactggatgctttggaggctgatatggagtttgagtcaagtgcagtcccatcgtatcttcaaccagacaaggaatccgatttcgatgcagagcttaatttgccagctgcacctaccgctcctgcagcagtcccagtaagcaggcagcaggttagtttatattattgttatttttattcagatgcttgctttgtcatgatgattcgagaactatctagtcccatgtatgtactagaggaatgaatgatgaattttcctttccttttttcttaagaagttgttattcatgagttagcagtgtctgttgttcactatcccaagttcaaatattcttgcatagactaggtgcattgttgatcaacagctaaaacaaccatgttttgtatgaaccaattagattggtccgtagtttacctgttttaagcttgtactgaatgttgcctggtgctatctggtgcaggtggatgagctaggattgccagcagtccctcgagcatcaatccgcagttagaacagtaattcatgtacctttgcttgtgattggcattgacgtgagaacccattgctatgcaattgcagttgaacaattaatctgtgtatgtgtttctcttcatgagtcgccttgatttgttaaaccgagcttgcagtcttatatcttccactctgccttttagaaaaggggatttcgagttgtgatgggttgaggttgattagatgcatcatatgatgctttgtcggtggtggtggttctttcaatttggaatactgtcctagtgtcattggaagcgtgcttggttgcaagtacaacatcaataggttgcctgcttctgcttgcttgccacctaaaaattgtacaaagtattctttctagtggattgtgcaaagaaaagagaaggtgaacagggagggaagaagaaatatctcggaggtaggttgttttcttactgcaacatcaactgcatgctgtccttttttggctgtgcctgttttgcaattttgtaagaattg

SEQ ID NO: 20606 - DNA, 346 bp, Oryza sativa
  unsure (1)..(346): unsure at all n locations
tgggggcgtggtgctggtgttgaaggtgggggaggagtgtccgnacgaggacggcccggcctcctcgtcgcccatggcaatcgccccgtgtgtcgcggtggatatttgatgaggacgcggctgcggcggcgtagggttggttgcatgccttccgatttgcacgggatgtttttggttagtgatcaaacggccggagagcgagatacgccgtcgcaacgacgaaccctagctagctagagttcagtgttttgggcctttagcccgtaggctcttgaacgaaacagaggttggagatggcgtataggtatagttggccataaggcccgaggcccgaaggcccagccca

SEQ ID NO: 20607 - DNA, 641 bp, Oryza sativa
aaaatctatatagaaaatgactgatcagttcattcatcatactcctatatccctatatagagttcatatattactcccaaaaaggaatgcatcacatcacattattggaatgcaactgagagggtgatatataattgtaagttttctagtgaagtgcaattgaaaaataagaagaaatatattactagagtatacaaaaaagagatgatgggtgcatgtattattattgattgtcacatagctttagtttttccttcacctgatccgtgcttagcttatacagttctctcctcctaccaaacgaacaaaaaattacaaactccctgactgattgcctgcagtaccgtatcatatccatccatccatgccttcgccatggctgcttttacttgcttgcttagcttccaagatcatgagattatatcataaacacaagatgtttaaaaaggagaggagaaatatgagagagatttacccatttcaaaaaaggcatctttgcactagagtagtatagcaaaagcagtgatggcctgaccctagctaagagcaaggcaatggtggtggtggcaagtgtgatgcatggctagctgatgagaggaggaagaagaaatggctatggctaaagtagcttagcttagcta

SEQ ID NO: 20608 - DNA, 1501 bp, Oryza sativa
gcaccttccgccgctacgacgccgccttccgcgaccacgcccgcaggggcctcctcccggcgctctccgtcatcgagccacgctacttcgacctcaccggcacgcccgccgacgacgaccacccggcgcacgacgtcgccaacggccagaggctggtcaaggacgtctacgaggcgctgcgggcgggcccgcagtggaaccacacactgctcatcatcacctacgacgagcacggcggcttctacgaccacgtcccgccgcccaatgtcggcgtccccagccccgacgccatccgtggcccgctgcccttcttcttcaggttcgaccgcctcggcgtcagggtgcccaccatcatggtgtcgccgtggatcaggaaagggacggtggtggggaggccgccgggagggccaacgcccacgtccgagtacgagcactcctccatcccggccaccatcaagaagatattcaacctcagctccgacttcctcaccaggaggaatgcgtgggcgggcaccttcgagcacctcttcacggacctggacgagccaaggacggattgcccggagacattgccggagatcccgccgccatcttcctcgtcgtcgtcgaccagaaagaagacggaggatggctgtcgaacttccagcgcgagctggtgcagctggcggccttcctcaacggcgactacatgctgtcaagcttcgcacaggagtacgagtcgagaatgacgatgacggtgaagcaggcggatgcgtatgtgaggcgagccgtcaaaagtttcctggaggccagcaagcgggccaaacgcttaggtgcaaacgactccgccattgtaaccatgagaccatccctcactactgcaaccacctgctgcccttagttacctactgtagtacactaaactagtctctttattaatttaattaattacctaccttagctaatccaatcccctacccatatacttactactggagtactccattagtttaattactgtatatcgatgatcatatatatatcacacagattttcagcccagagagggaccgagggatgggtggcctttgctcatgtttcttttttatgaaagattacttaatgaatactacacatcccttatattttatgtctgggcctgctatctggtgccttggaggatacgaagctgtccttgagattgttgtccctataccatacgtacctaagttgcaattggatatgccgtccagcgccggcctcaacaatttcttactccacgatttagtactagcaggcgtacttgtcagggcaggccggccatttgattcatgcatctatcgatcgtccaggtccagcaataagcatatacttgtagatgatttgttcttcttgcacctgtacttgtagcagccagcacagcatatataccagagtgaagtgaagtgaaagtgcagtgcacactgctcagcaacagctagtagcctacaaggaattagtaagcctgagaagaagaagaaga

SEQ ID NO: 20609 - DNA, 1501 bp, Oryza sativa
tagcattgaattagcccatggatccaaacatgccattctagactaatgtttagcttaccaattcataactaaacattagctctgggctaatctttcaaatagggcctagtagtagctgggatggatgtatcagatgagcacatttgcttgcttaattaggtcgcattaaattcccatgcacagacaatccttgaacttccctaggttctctttctccccctcatcaggtcaattggaaactcatcattctatgatgtacttccacctcaagagaacaaaagagaaaaaggagtgtttatttaatgctccatctttcatgaacaaatgacaaagaaataaactactaattaattaaaaactgatagtactactgcagcaagatcagctgtgggtcttgcaaaaccaaagcaactctgaagatataatcccatggacaaataactggtccatgacaggataggatttctactatttttgaattacgaccatccatgatatgcatggggcccagggtgactcatcaaaagagagagagagagagagagagagagagagaggatgggaaaaaaataagaatgataaatcacacatggcaatgtacaaaaaaatatattggcatatgcatgaatgtgaattagcattatggttggtgtgtacatgtatgagtactattatatatcatatgtattgttgctatcatatacattgagtgcaggccctggaatttataaaacaaatgtgataaaattggaatctacctgtctagcttattgttccattgatgcatacttatctctggtgtaccaaccaagtaggtgtacaacaggttagataaataaaaagaaagaagaaatgcaagagttgatcatcagggacggacggtatctgcacttgtaaggagacaagggaaaagacagaaaagctcaacatcagtgtagcattgttaggagtgttgtgtgattttgtgattcaggcacaaacccaaacagttgctcctcatctctactctgtagtacacaattctactagctatagctagtgctggttcatctactaccagtacactgttcttgcctcatgcagatgcagcttccttgagaatgcataaaacagttcactcactgtgatattgtgatatgtacactagtcatgcattctcaagacttgattttttttaaaattgaaatatctattcaagattgatataaacaaccccttggcttactgatcaaaattaaccagtgagagcacatgtagtaaaaaagctattggcactgtggtaattactcaagtgaaaaaaaaaggggttcaatttttgtttcttctgcaagcaagaaaagtgaagaagctagtctgaagaaagtctgaactgctctacaaatctttttaatctttttagctggctcacacagggccctgaaagtaaagtataggatcagcaggcaggagcagataaagaggaggaagaagaaaagggatttggtttttggtgcccttctct

SEQ ID NO: 20610 - DNA, 979 bp, Oryza sativa
ccttaaaaatcatgctttgtgatctgatggtttgatcccctagactagagaacctccaaaagattcatggacatgcataagattgagactgaagcatttcgacagccccaagaagacatttgggaggcatcttaaagcttataggagcataaaaaagaatgatgtagggtctctggttaaaaaaaggatttggacatttgacagtccaatgcaaagcatgcacatgcaaccactggcttaaacatttttagggtctctggtgggggtcaccacatatcacaatgtgaagaatgagagggtggggcccacaatgtcagctatagttttcacctgaaagagataaaaaaaaaagttaccaagcctcttttttttatgcatgttgttgcatgctactgtttttagggtggtgccagttatgtgatgcaacatgctccattgaacagtgtagtaggagtatatttttgcgcacactttttttttagatatggtgcatttatgtgtagatggggaatcttgacagaagcaaatactaggctacatgggcctacagtacgtagtgcaccgagtggagaaatggagtgtatttttcacaaaaatattaggggtgtttagattagggttgtaaagttttagcgtgtcacatcgggtattatatagaatgttgtatggtatgttcgggcactaataaaaaaactaattacagaatccaactacgagacaaatttgttaagcctaattaatccatcattaataaatgtttactgtaacaccatattgtcaaatcatggagaaattaggcttaaaagattcgtctcgtaaattagtcgtgatctatataattagttattttttagcctatatttaatacttcatacaggtgttcaaacgttcgatgtgatatgctataaaattttagggtgggatctaaaatttagtagtcgtttttgcgtcaactcagatgttccttttttttcatagt

SEQ ID NO: 20611 - DNA, 1501 bp, Oryza sativa
gttgggtatgcttggacttgttgatgtcccctacgacaagctggttggatgttacaactttgctctccagttgacacttagcgtaggagccaggtgatctctacccattcaccatggggcccaccagtcggcccttgcgaggtggcaaggttgaatgtgctagagtgatgtgggcacgacacgtcatgccccttctattcctctagcagacgtgggcatgcgggaggctgcatgcagcgttacgtcactgagatgtaggtggatgagctgttctccaaacggctcccttctacaacagaaatcatgatgttggattggagttaagcccctaggtccatctagagaggcggagaaaaccccaaagtgagcttagggcagtggggtgtgcttggagcccagcttggagcccctaaaccctatactgcaccccagggtaaccctcgctcctcggggcagtcgtctatccggaacttatttccatgcccagggaacttagtttccttgggccctcggtgacctctctccatgtttcttcataggtttccattgtactttggatgagtttcttgaagatgtcggtgatgaatgagtttatagtgatcacctacgtcagagtggctcgaagcagttgtctgccgcctcagcacattgaaaatgtagatcttgacgttcttcttgagatcttggatgtgtagatcttatacacctcttgaagatgttgatcttgtacttcttgaatatgtagatcttgtacatctcatgttataacatatatctttgggtgccctgacgactccggaggacggggacccctattctcattcctccaatggttttaaactagactaagactaacttaatatattcacttaacactacaaagtcttgtggtgtatgcatactatcaatcttctcctttgcacgggtatatgtgccttggccaccaccactactgcccttgatggtatccatactagcccaagggtgccttcatcaacacctgtttctagggttagggtgaaacctgcatttcatggcacaatatgcgtgttgcttcttgatatttctctcgtcagagtgtcgagattagggggtggaattgtcaagttagaagtgatatcttcttgttattgtttcccttagttgtctgagatagccacaaggataatcatgaaataattgatcaggttttgtggcaatagatagttcgtatcaatctgcgaagcaccgcatggtaaagaactagtcattgtgagaagagagcagcttgtcgacatcctccctactccatactccctccgtttcaaaatgtttgacaccgttgactttttagcacatgtttgaccgctcatcttattaaaaaaattgtgaaatatgtaaaactatatgtgtacatgaaagtatatttaacaatgaatcaaatgatatgaagaggataaataattatttaaattttttaaataagacgaatggtcaaacacgcattaaaaagtcaacggtg

SEQ ID NO: 20612 - DNA, 1501 bp, Oryza sativa
gccacctcatcctcgtgatccatgggcataattgctaggtgcacacggcggggttctggttccggcctcgatgggtggctgacgggtggggccgtctcacaaaccgtgtgcggccaacgtgtcggctttgcggaattcttgctagtatttcttttttttttcaaaaaaagtttttattcaacacgcaaggaaaaaaacgatatagagatatgattgttgtaaacagctcaaacacgctggctacatgaaaccctagcggtctgagtttatacccgacagtcccataaacccttagttagcatacggactcgaacatgtgatctccccttcccgaattcaagtggttttaaccgctgggatgtcatttgacttgtgaatagtatctcatatgtcattttccccttgtaaattgagctttcgtacttaggtctcaggtagtaagtatttcccgaatatatttatcctatatcccaaaataactgatcactttattacttatgagtcaattatgagaaaaggtaaatgacctagatgccctatactaatagagatgtcactagtgggctgtagttgagggtataataaatatatataatttttaaattagaggttggaagaaattttggattggcaaacaatattcacttatttagggataatttttgaattttgaaatttgagatggattgacaaatagtactacttgttttcccgttgaaactggtagggtaaatactaacagtttgtgtcataaaactgctacaccttcacatgatgtcttgtcagaggttttgtttaaatctctcaccctttttgtggaacaataaaaaagcattactcctgaagcaatggaacactcccaaatcccaattcaccttttgatcagaagcacatgtacatgtacatttgtacacaagctgcctgtcttttttgctttggtccttttgggctaggctagaaaaagcactcatccaacacatgacttcctgatccatccaacacttttattttttttctgcagcaaatcatcattcagatggtttgcaaagctgccattctttagcatccaaagagatcagatgcaaaaaactttttcccagctactacaagacggccaaaaagaggaagcacacatgaacaccaatcattagcagataattggcacgggctttggctttttagtagtgccttcgctctgaatcgagtcaaacagcacaaccaaaataagagttgtttgcaaagtgtgagcatgccatcacacgagtgcaagaattgtgtatttagcaaccaatcaatcacaatcattctttcattcattcagacttaccaaaaatttcttcagaagatggtggttcttttcccctcttccttttccaacccatatcgacatcgatatcgatatgcttgaatttctattcatgtatgattttttttaaaaaatgcggtcaaggcgcgaattatgagccagaatataagcaaagtctgcatcaggacaaggaca

SEQ ID NO: 20613 - DNA, 1501 bp, Oryza sativa
tgtaattacactgcaacttgcatgtaacaatagtgtaacttgtatgtaaatttcatgtaattttgaatcgttagatctattaccagatttgttctggtgagaaagaaaaaaaatcacagcacacacatatgtgaaaggatttgttcccacgacctccattttacccaaataacatgttacggagagatttttgaaagttacatataagttacattgtagttacaatgtaattacactacgattatactgtaattatatttgtcaaatttttaggagaaaatttatcgacaaatatatagcaaaattgtttgggttaatcgcgctagtgtacgcatgtgtgctggccggattctgtttttagactttgctacaaaaagaaaggaaacattcctcacaaattgtatcccaacttgttccattcaatagaagacacacaaagtcacaaagataggtcacaaattaagttctttgttctttggcattgccgagcaactagagtccctgcccgcaaggtgttcgattgaggttctaggcaaccagtgatcgataacagagctatgagaactgcccccgtgtcgttccaggggcaggggcgacacgggtggcgaccaccgccgtctttctccccaccgccgccttgctccctcctccacctcgccgccgcccgagcagactgccggaaaccgcgcggctgcgaggaagtcggcggtggggccttccttctccctcgagggcgcgggtcggtgcccacgaccccgaccagttgggggcggcgacggtgcggtggcatcggcgtcggcgtcggggcgtcgggctaggcgcgcagaggcgaccgggtgcggaacagctgggcgaaggcggctgggtgcggaacgggggcggcggcgacgacgccagatttggcgtccctcgccaaatccggcggtccggcctcctcccgggacgacggcggcacccaaggaggcggggaagggagatgcaggcggcgggaaaggtggagcagcggcaacggcgctccctcgcgtcgcctctccaatccgggctgggggagagtggtcggcgccggggaggcgcggaaaccggcaggcaggggcggcgtcgcggtggacgggcgacggcagtggcggctcgctcccgtcatggtcgcggcgttgtcgtcggcgtctgtcaagcgtcggtgttggcttcggtaatgctgcggcggcgcgccctagctggtcatcccctgtacctggctggatctggccgtccgcggctagattcgtcgcctccacgccagatggcagctggtcggtgggacggctgcgtgtggacggcaagcgcggcggcggctcgctggcagccagcctcctactcggcagggggcttctgccggtggtgggtctcgttgttgttgatgggcagcgatgtgcggatgtggaaatggcgggacgacggcttgtgctggcgtgaagcaggaatggtgcttgatgtccgtgacggtgacttcctcattgtcggc

SEQ ID NO: 20614 - DNA, 1050 bp, Oryza sativa
tagccttgtaccatggggtcgcttggaaatttgctattcctaggtggtgatttgtgggcgttagccgctgacatgtgggtcccatgagtcccacattgactcagctttgacatgttagctaaaaccgggcataatactgccttagaacctcggacgatcctgttttgtatattgagggacccgttatatatgattttgctacacgtctatcgtgtgattttttcttaggcatttcacgtttttttagtcgcaccatatgtgggccaagatttatgcaagaattggtggggctgcatgcatggataaggccgtgtgttggatgcttaggcccggttcttttctaaataaaaattgatttctttaacggttaaaacattaagacatttgaaactaaaatataaaattacagtcctatataactaaaattacatatgtttattttatagtccgttggatgcaaatccaagggaagaaaaaatctctcaaaaatcacccgagtgatacacaggcggttcccgttatatatggtatttcggtttaaggataaatttggtaaacttaatccaacaacgaatagtgggcgtaggcttaggcctgggcctggtcctggtcctggtacggcccaacaacacgagaaacaagtccctttcccttgccctcttgttgagagatttgggatttgagaagctgctgctgctcacctcccctctcctccccacaatcgaatcgaatcgaatcctcctcctccaggctccaagccgaaaccaaaccctagccccgtcgatctccctctcctcgcatggcggctcccaagcccatctgggtgcgccaggccgaggaggccaagctcaagtccgaggccgagaccgccgccgccgccaaggccgccttcgacgccaccttcaaggccctctccgcatccgccgccgacgaccccgaccaggacgacgacctccaccgcccctcttccccggcccaagcctctcgggacgcctactccgacgcagacgacgacgacgacgaccggccccatgcccctcccggtccagt

SEQ ID NO: 20615 - DNA, 1501 bp, Oryza sativa
taactgaaactctgaactttctgaaatttcctccattcttcttacgagtctgacaaccgccgtcttcaacttgctggtctacccgctcgctgccatcggagtggccggatctgatggccatgacctcaaggccgccggatccgatgccatctcgtcttcctcctcgaaaacccaggcccccttctcttcgtctactcgctttcccaccgtctccaagtccaatctaatggcttcctctcttctctgcgcctcgccgctctccttcctctcccgcctaaagccgctcaaccctaggctgcccgcctcgcacctcctccgcctccttctgctctccaccaccacctccaccacgtaggcctcgtgctcaccgtctccgctccgaaccctagcggccaccaacaccgtgaccccgcggccgaggcgaagctcgagaggctgcagccgctgcagtggcctacgagggacgagctgtgtgacgagctcggcgccggtgatgccggccgctgcgtgcgcctctgcggctgggtcgctctccaccgcgcccacgccggcctcaccttcctcattctgcgaccactctggcatggtcttggtgagtggttgttattgttagtggtgttagtgatagactgatgctgataatttacgattgtgtttgttgcccatgtggtaactgcgagcctgtgattgcaattgttgcacgcaggtgtattgttgtttgatcgttctcgttagtgattagtcatactaatctacatgctaatgctctagatattactactttataacagttggtggttccacatttttactgcatgtttcattgctcagtatgtatcatcgagaatggtcagttgtattgtcaggttaatgacgtgatagtatttgtagcactgacattacctactgttttcctgttgtattgagtggttttggcaatgtttgcaggtacggattcccaataaactgatgttcggtgatctaataagtgaaggcaaaatgaagtaatataatcgcatcaatttgtaatgttgtggggagttgattttgtttttgtttttctgtactgatgaggtgtaggctagcagcgcccgccaaccggcactgaggtaaggagttccacaaccacagcactcagatgcaaataatgggcatgcctctgtctaagctgctaagtagagaagcacactgcaaataagagctgagtgagctaggacctgccaatctctgttttctcttgttcttggattgcaatttttgattttagattggatatttgagagaatgcataggaaagggaaaggaaaagggaaagggatgcctttacattatacttatctttccttacgttacccatctcagatgtggtcatagtaatatactttttcctttgtgccacttatctttcctttctatgctccactgatatatcagctggtccatgtgccatttggtgattgctgcttacatagttgtttttatttatctccgtacgctatgt

SEQ ID NO: 20616 - DNA, 1501 bp, Oryza sativa
gttacatgcagatgaaactgcagagcatgaaaacaaaaaatgaaaattaaatagcatatacaacatctgtaggaagttcaaaatatcatataacagcaaagaatcagctatagtacatgcagccaaagaagcaagctatagaaggggcatgatttaaaataatggtgttagtattagtacctaatggcacaacggttatcatgtaagtaaatcaatattcctgtcatgcttctgcttgcctctcacctgcaacctttctcaattgcttgtggaggattgaacttgtaacatgtactggtagccaagctgaataccagatcagagaacattttgtattaacaaatctgatgcatgaacattaactaatcaaaactgattgaatggctgaacatatatcgagaagggaatataacatcacatagcgtacggagataaataaaaacaactatgtaagcagcaatcaccaaatggcacatggaccagctgatatatcagtggagcatagaaaggaaagataagtggcacaaaggaaaaagtatattactatgaccacatctgagatgggtaacgtaaggaaagataagtataatgtaaaggcatccctttcccttttcctttccctttcctatgcattctctcaaatatccaatctaaaatcaaaaattgcaatccaagaacaagagaaaacagagattggcaggtcctagctcactcagctcttatttgcagtgtgcttctctacttagcagcttagacagaggcatgcccattatttgcatctgagtgctgtggttgtggaactccttacctcagtgccggttggcgggcgctgctagcctacacctcatcagtacagaaaaacaaaaacaaaatcaactccccacaacattacaaattgatgcgattatattacttcattttgccttcacttattagatcaccgaacatcagtttattgggaatccgtacctgcaaacattgccaaaaccactcaatacaacaggaaaacagtaggtaatgtcagtgctacaaatactatcacgtcattaacctgacaatacaactgaccattctcgatgatacatactgagcaatgaaacatgcagtaaaaatgtggaaccaccaactgttataaagtagtaatatctagagcattagcatgtagattagtatgactaatcactaacgagaacgatcaaacaacaatacacctgcgtgcaacaattgcaatcacaggctcgcagttaccacatgggcaacaaacacaatcgtaaattatcagcatcagtctatcactaacaccactaacaataacaaccactcaccaagaccatgccagagtggtcgcagaatgaggaaggtgaggccggcgtgggcgcggtggagagcgacccagccgcagaggcgcacgcagcggccggcatcaccggcgccgagctcgtcacacagctcgtccctcgtaggccactgcagcggctgcagcctctcgagcttcgcctcg

SEQ ID NO: 20617 - DNA, 366 bp, Oryza sativa
tgcaagtagctcatcaaaactccatatcagtatacaatttagaactaactaaactttggaattaaaaaaagaaaatataagtagaagtttgagtctatattgaaatacaatttataaccttaatttataaaaataaaaaataaaaaatattgaaataagagtttacaatctatataaaaatacaatttagaaaaaaaaatgaaaatttggaatagaaataaggaatattggtagctagccgcgcagtttgcgcgggccaccatactagttgttattgaatacaaatccagaataagcctgtattcacttcgattgactgaatgaatgttctttgtttctcaaacaattgaaatatactgattgtct

SEQ ID NO: 20618 - DNA, 1501 bp, Oryza sativa
gtaccaatgagacattacatagtacaacaaatctagacatgtcccatctgtacttaggttggcttttttttttgggacgaagagagtattttcgagcctgaaaaacaacgactagcatgcataatgtgcagctttcagaacaggtagtttgtgatgccatcccatcactagcactagcacaaactgagagcagacatcaacaaaaacaccaggcattacagctaaagttccaggaacaaaagtacaagtttaaagctctaatgttcagcaggcactttcagcgcttgaagtatgtttcttgttgatctccctcctgtattcttcagatgttgctcccttctcttccagctgatcattgctccaggctcctggaattcagccttcctctgtttcacttttcctccaatttctgcaaaggtaaccgggatttaataccatgtaaagtataatagacaaggttagttggattttaaggcatttttctgcttaaaacaggctgcatttcggttttccagatcagtgccattattcccatcatcctcttgtcaagtttgtcaatgtctctatgaatcaacagcttcaataggacatttgcaatggcatgtgaaactggtttctcagtttaaatatgagtaatctcatatctcatccagtaaccttgcaattctgcttacagcttcatgaactctcttcctccatgttatcttcactatctattaactgaagtggtaccttttcttttacgtaaaactgatgtggtaccaatcatgcaaaataagaatctgaagaatgcaaatgatagcgcaagaataagaggtgaaaactatgaacaatatagagtagcaggatcttataatatactcactaaaaacagataagatgtatatatactgctccaaacaaaatggcataggagaacaaggttcaggaatcgggagatgaattagcttaaaaacttggtagcttcaaccgcacattatttacttaaagttaaagaagtgatcatgaaaagaatcaggtagtaatccgtagtttttttgttttttttttggtctaccacaataaaaatcaactaattggaagcaacagttagcataacgtatatgcatcaaatttctaacatgaattcacaagaacttgtactaaattactagaacaacattatgttgagtgagtaggcaggaaagtttttcaatacaatagacagcaagaaaaagcgcaagaatcttgcaagaactgaaacccaacagcttcgcctcacagatcaatcattcaatccccaaatataacatccgagaacaatttcaaatcaaccgaatcgagggcacacaatcccacgagaagcatgcacagcagggcagggagagaaggagatcgaagagattgaggggagcgaccaactcacaagttgacgacgagcgacggggaaggtggcaccggtgaagggaggaggacacaggggaggtggcaccagcgactgatgggcggcgagcggaggaag

SEQ ID NO: 20619 - DNA, 1501 bp, Oryza sativa
acgttgatgtgtttgtgtatgtctcgatgatcaaagtgacctatcatagtgctaccttgagagaaatctaaactttaacctatcctttaagtgattttagatcttgtttttggttgagttgggtagtcctctgagtgagctttccatagagtctaagatcatcaaaatgggactcccgagcaaaaagttatggttattttactttgtgcttttcggaaattccgaaaaattatcggaagttccgaaaatggctgcgaaaccgagtttagcttctgtaaattttcggaagttccgaaaattccagtctttgcctccaatggctagtttttgagaggctcggtatataaactcctccacccctcccttgagtggctgttgttcttggggagtattagacacatccaaagccaaatagacatccacatttcctacctttgtggtgcctctttgtaagaggaatttgagaaggggagagagttggattgagagattgagaagttgagagctagtgagcttcactctatactttgagcactcgagttcatagcaagcaaatcttcgattgtgtttgttacttttggggactaaggtctcctagacggttaggcatcgccggtgagcatccaaggttgtggtgtgctacggaaagtttgtgaaggcttcaatttcgcctccgcaagagaaaaaatcaagagtgaaaccaaggagtacatttgtgctacctcgtgaggaaatggttgaaatagacccggcccttgtagctcctcaacggaaaacttcgggaaataaatcacgtgtctcttctcttggtttgcacattcttgcattctctcatattgtgcttgagcttatttttacccgatgtacttgcatgcttaattgatttagttggtgaccttatatcttacttagataccttatttgtcacattttgattcatacacattttgtttgtttgaggtacaagttcatagctagtgttttattccgttatccgcctaacttttctgttgagatcggaacttcgaatcacataccggaagttccgatttaaatataaaattctcatcattccaatatgctatgaagttgtgataatttttataaacgtctattcacccccctctaggcgatataaaggtcctttcagtgcttaaggacaggttgtacccgcacgctgtgagcgactatgttttttaagaaaaaagactattttattttcttagttttttttactgtgtttcttaatctaaagcgactattatttggcaccggagggagtactaatgtcatcccgataaatttaccgttttctttagaaaaaaaaaagtcacacagttaggccactgctattggctgggcttgttttcttatttgggcctagctagctaaagtgggctccactccacacagtcaattaggcccatttggcccgagaccagttcaccattagctcgagcagaaagtggggcggaaagctagggtttctcaggtcctcggc

SEQ ID NO: 20620 - DNA, 1501 bp, Oryza sativa
aactgatatttgaatactttcaattcaaatttgaaacgttttcaatccatatttgaaaactttcatctcaaatttaaaaactttccactcaaaatttgaaactttcaatctagatttgaaaattttcaacccagatttaaaaacttttaactcaaaatttaaattttttaaagtcaaattttggaactttcaacttttcatcttaaatttgaaaaattttcaacccagatttgaaaactttcaactctcgacttgaaaactttcaactctgatttgaaaactttcaactcagatttaaaagttttcaacttgagattaaaaactttcaactcagattcgaaaactttcaacttaagatttgataactttcaaatcaaaatttaaaattttcaagttaaagatttaaaaattttcaactcaaaacattttttgaaaaaatatgtgtgctaaagattaaaaaagtaataagacaaaagcgaaaaaaaagataaaagaaaaaggcaaaaaaatcgcaaaaaaatcttgcgaaaaaaaagaaaaaaagaagcctgatgggcttccgggccggggccaacaggcgggcgcgcgccaattagccacccccatgaaatccaagaaagtcattaaaagaataggtggttggattgaaatatgcctatcaaaagtaaattttttagatttggaatatgatggagagagtattataactcattttaattttttttcaaacctttttaagtttgattaagtttatgaaaaattttagcaacatttacaacaccaaattaatatcattaagattaacatttaatacattttgataatataatattttctttgtgctgaaaaagttactatatttttctataaattgaaagtttgactaggaaaaaaaatagaatgacttataatgagaaatagaggtaatataaatgaattcactcataaatccatttaaaacccgaaacaatttataatatgaaatagatgaagtaccgatatgtactcactccgttacacaatgtaagtcattctatcatttcccatattcatattgatgttaatgaatctagataggaaatgtatatatctagattcattaacattaatatgaatgtgagaaatgatagaatgacttacattattaaacggaggaagaaacaaaatataccctgacaaaacaatcatggaagatgagacggatgagggagccgcctatgccgcggtcctgtatgatagtgtggagattatgggtatcccatatctacacggcgatggtattcgaactgggtacaggatacctaatgtagatagaatatcttatctgtatctcgggtttgtttcttaacttgtgtatcaaggaaacacccagagacttagtcggttacgactgtattttatctgtatcttcatattccgttaggaatatagattatcttttgtaatccggactccttcccatatataaggggggtccgggcgcctctaggggcatatgctg

SEQ ID NO: 20621 - DNA, 1501 bp, Oryza sativa
gtttctgaataacaaaccagaattccatcaaactgcgcagacaaattcatatagcggtgtatgtttctgaaaatgggggcaataatttgtccgggtttatcatttctggcatctgaatgatccaaggttgtatctgaacatgaatttttttcatgaagtgacaggataagataatttagtcacatcaaactctcaagatacacgtgaggtatatccgtatatgtgaagactggttcaattgtctgtgctgctgcaagaagcaaaagaaagtgtacaagataggtcaaggggactccttgtgtaacacttcagattcaactaacatattttttactaaaatacttaagatataatctgcatggcatgtgttcacctttctttggtgcaacaacctctctctgataaacatgattagttgtgctggttgagtcaaaacacaggatgacatatctacaacaatatcagaaattaaacagaaaccaattagttttggtctcatgttgtcgagtcaataaagaaacgaaatgttcagctctgcaagttattagccagggaaaaatatcaagaaattagaggctaaatggttgctggttgaggccttgagggtaacctgttgactagcttaaattgtagcaacaactaaacagctccataaaaggaggagcactttttttcctctgcatatctcctctcttgtcttcttctcttctctcatctgctctcatcatctccattgcaacttctctctccatttgctgctcatatcaacttatcaaagggaggtaggtaagatatgcatatgccccacatgctcacatgcttgtgtttcttgtcttgtttcttttttacttttgtttttgttgtgttaccctgaaagtttagtggaatgaatgagtttttagctgggtcggttgaatgatgagtttgttagggtgttgtttgccatgagttaagggcatatgtgttgttcttggtcacctgattagattagaccatgttttttcttcatttgcaatagtttcggcacatttggttgggattcctccctcaaaatttcagtaactaggaagaaattggcctgagttatgaatcagtagaaaccatgttgcaaaaccatgtgtggtccatttttctctctctctctcttagtccaaacaacacgtgaactagtatgaattgaagaaatttctgggttttgtgtagtttttcagatgaaggagcttggcagtgctgaagttagcatgaactgcattacatggctgttctgaatatgatccaggcagttctaagaaataaagaaattaatcttaggcaataaaattgataactagatttgatagatggtgcgataggtcttggcgattgcaacaacaatatatcaagagtcaatacaaatatacaatcatctctttgattttgtgaatctgattctggtggattgcttacattttctccctttctacatgaactgttgtagtgcaagaggaagaacaaaacaaga

SEQ ID NO: 20622 - DNA, 1501 bp, Oryza sativa
acgtgggaatgcgaaaagtagcctatgccaaacagcattactactgtcaacctcaaagctagcttgcaaattaaaaggattggccacgttgacactttcaagtcctctccaacagtgaaagcacaacatgggcaaagtaccaataaaaagtgataatgttataatcttgttgctttgctatgcaaccttgcttatttctaattaataacagtgccttttgaattattggagagcaccatcacaccacaccacacatggtagcaagttcattaccatacttcaattgctgaaagtcttccatgtctttgacttaattagacactgttaagtgatagttgtattagtactagttacatccattgttggtgactgagaagccataaaagtaaagtcacattattcccaagagggacttctcatttaggcttccttcttttcagttgaacgaactcagctcattctaatagggtaatgaagataaccattaatgcataattacttaagtggagtacttactattataaagtattttttttaaaaaaatatttaatattaacaaaacttgtaagtagaaactttttatataaaatataaggtttgacaattcagaaaacatgctaacattaaacaaagggagtagtactagcatgtaggactatcactgactggtgcatggaccaagtccatccactgctgaacatggggaacaacactacacagtaagcacagaatcttccaaataatataaacaaaaagatcagaaatttttttaagaaaacaaaaaaaaataaaaaaaatagtgaagaaaaagagctagggagaggagagagaaagagagaaagctgaaagctgtgaaagaaaagcctctgctgctctctgctagcttcttctcctcctcctcctcccccttctccccgtagataaggaggacccggggaaaaaggggaggcaaaaagctgcgattttccgctaattaaccccggggattagctgcccaagaacaggaggaggtacgattcttgcattacttcaccccacgcgattccctccccggtttcccccaatttcctcccgcaatttctacttgttcttggctcctctctgctgttcttagcctcgccgcgatggcgtagtcttggagaagatcagatccatctcgagttcgattggggttttttttttctctcttgaggttgctggtgatgagcttcactttcttggattgattttttttttgttcttgttcgttgagtttttcactttgctctaatccaaatcttttttttctctctctctctctctaatatccataattaatctgcagatttccatgattggtggtggagttcatcggcaaggaattcagcagaagagatcagattctgtacacagttcgtcttcttgctcggtgactaagctgggttaggagaggaggaaaagaaaatctttttttttttttttgcggcgccatggatgggcagcagctacgtagctcggaatc

SEQ ID NO: 20623 - DNA, 1501 bp, Oryza sativa
cttatagaaaaatgcagcaacattttcagcacaaaacaaatatacttaaaagtatattcgatggtggatttaatgaaactagtttggtgttgtagatgttatgcttttctataaacttggtcaaacttgaagaaattgacttaggacaaactcaaaacgtcttataatatgaaaaggagggaataaaaaactgaaggaactaaaatttaacatgatcatgtttatgtagatgatataacacttcaaaatgaagtggttaatttggttcattgaacaagtgaatgctggcatcaaggcctttaatattattgttaataataataacactcgatccaagtggagagacgttccgaaagcattgctttaaggtcaagaaaaggcccagaaagccagctatcgctttagtgaatagtgacctgccacgaccatggggcatacacagcaaggggcctttctttgcgtgatcccaggtttgagccctggttggcagcctcatacctggaggtcttaccattgtgctatgagcatgttctcctcaaggccttcaataaagctatttatcgttggtcagggctcatgtaaatccttatagcatttattcttttcttgagttgtcccatatcataaaattggataatctcttgtgtgtctgttagaatgaactaatcaatcaattattactaacagaataaccctgctcacaaataaagctcaactcttgctccgcatcatagtactacaatggccttttgattaacaagtgaacaaagcagggaaatagtgggtttgggtgggataagctggtagggtctattcctagttggttagtcctaggatgggcctaggacaagattaagttgacctggactgcacttggttcaacaggtcaagttagttttggcttaggtcattgctcagatggacttgctttggttcctggctgtgtgattaaacatttatctctagatcgttacctagtggtagtaaatacacatttgtaatttaatcctttctagaaagcaattgatcttatacttttgtaatatcatattcttttaagcaaccatgttagatattggtacccattattcttggccttgaagtgttagcaaagttaagtctaatgtttttgtagctttaaaatctgcttcctccttcatatttcatttgaagaaaaaaatcatggcacgttaaccatattttcactatcttaaattcattgcaatgaacatgctaggttctagtaaactattaattagagaatctattcctcttcaagccagggctactccaagtaacactcctgggcaaggcatgttgctatggacttccaaacgcacataaatatattttgccttttctgtaaagttggcaatattatatcactatatgtttcgtggaaggaacagattcctatcattatttccttatttgtgtggattgtaggataacaccgcagttccttgagctgacattttaaattccttacatatcgtgccat

SEQ ID NO: 20624 - DNA, 1501 bp, Oryza sativa
cttggtagggagctttccagatgtttggtaattttccctggcttgtttttgggctgagccagcagccatgatgcttatgttcgcctagctggttgtttcccagccgattatcttatgttacttttgtattctgaactcttatagctttgaatgaaagatgggctttgcctttttctaaaaaaaaaatagctacgtacatcaaatggaagctatagctactagcggtacccatttaaaagaaggaaaagtttctacacgtactaatttcttatactaattaatcttttaacaactcatccctaacaatactctcaagaaacacccaggggttttccggctagctccacaaggtgatgggctaattggtctgggttcaaagccacacctcttctatttatttgatattaatttcttccctaatattcacttttttttatctaacaatactcttattctgaactgtttttagagggtaccaaaatggagacgggattatgggaataagaatggcaaccattgtaacaccctaggtaaccacgtacccagagtgccacaccaaaatacactcaaaactactaactcctaaaattattagaaatttcggcagagtctctcctatagatacggacatccatgataggcagttataagataaactaataataatattattcccacagtgctatctattcatataatccatagaaagaaactaatagatatccaaatgaatattacaagacaaaaccaggatatagtttaagtgtcattatggacctaagcaatataatttgatagtgtgtagatagatgtgtatataagggtgctactttccgcccatacatactgatctcaatgtgtacttaaaaccaaataaacacaagagtgagtacataaatacttagcaagtacaatatggaactagaaaacacatatacacatcattggcaataaagcctgaacataaaactttctttctttgaaaagaaacacggtttcaaacaccatgttaaagaaaattaatagttcccatcccgaacagacatgaattgaaatagtagttcccatcctggacaactgtgaatacatcctagcatttgccggcaaagccgagtaagcttgatcaacaattacctataggaacatgaatataaaaccagatagcatatccatgactcacatggaacatgaataattgaaactagaaacaaaaaagcaaattgaaactaaattgcacatccatggcaagcatggaaattgagttatttaaccagaaccagaatccagaatattgaaacaagaataacgtcattgtgaacataagataaacctgaaatataaatatcatgaacaataatctgaacatatgcaatcacatataacatagaaatatattgaaaataaataggtggagcaaacaatccaagaaacacataatttgttcgtcatacacttgcctttaacctcgacggcaacccgacgaaaccccctccacaccaga

SEQ ID NO: 20625 - DNA, 323 bp, Oryza sativa
atggaaggcaaataaaattgctaagaacaaccacaagttcttcaaagtagtataatctggtaacaacggcactaatgaagtactagtataaatgaagctactaattaagcgtggggcctggagccttggaggagacaggagagtcccggaccatgacactgagtgaagttgggctgtttggttattaactaacatttatacctcactttaggcaagtgtggcttgccacactttttgtggctaataaattatgagccacacttatggcaaagttagacaaagaattcagtctataacatgtggggtaagatggtaagaaagta

SEQ ID NO: 20626 - DNA, 1501 bp, Oryza sativa
catcggcgttgtcaggtaagctaacatagagtgatgatgttcatggtttcaaatgagaatatatatattcctcgcatggacaactttactatgctttgtcaaggagtatgtaaggcaaacagtaacagggatttttgccaaactaccaaactaggaaagagatagaccttaccgaaaatattatgtataaaggtttcttggaatattagaaaaatataatgacaccgtagcgttagcacgggcatattactagtagaacaaaagaaacacttatgcatttatacccaaaaaaaaccgtaattaatggaccgcatttcgtactgtgtagcggcccgtcgaagcataactcaaacttttaagccagagatgggcctgggccaacatcgacataaactggaataagtccacttgccttccctcaactttacatggagtgtgtatgatggccctaattcccaataccagatgtcgacccctcaagtcttcaaaaccatgcaaagtagttcctcgagggtatagaccatatttcccctggtttccattgatgtggcatatatcagggcccactacctgaaccatcgccacgtccagtcctttcggcctgttcgcgatgacgagctcggccaccacctcaacatcgtccatgctgcggcgatggcgaggagacagctgggacggtgaacctcatagctccgtctgttgcaacatcctctcgccatgctcacgccgccacgacacccttgtcctcctgctccgtagcagcctcgcaagctcacgccgcggcctcatcgaggtcccctgtccccgagccgcttctagcatcgatgagctgaggagctcccccactgccgaggcgatgacgatttggcagggagggctcgattcgcccactccaattcgcagcgtcacacctcccctcccccctcctattcatccaccaccaacgcggataggagaagggatagaggaaggtgtgcgtggacacttacatgttggttccatattttttttttactcggatgccacgtcagataaaacaaccgtcggtcaacatttttcgtagtggggattagggatgtcatacatgactcgacgcagagctgagggatggcaagtgaacttattcccataaacttccaaaagtttggaatgctcaacttaggcttctcttcggatgctgaagtgctaatgggccaaataaccaactagcccacagcccatcgaagtggaagccgacgagtccaccgtcaacgcggcagtagtaatccgagaaaacgcgggtcgcgcgaagcaatcgatcatcatcagacgattaatccacgacgaccaggagcgctgccccgagccacacgcccacacgcactggtgaatcttctcctttccacctagttttcactctgcagtctcctctcctagctactactctgccttcccatcctcgcttgttgcagccctcttgcacacgccattggccacagtccaaggactgctcctgttccga

SEQ ID NO: 20627 - DNA, 303 bp, Oryza sativa
ttttttaaaaaaaaacgtcgatagatacatggaaataatcaagaaattaacatgtttgcaatttatcgggtttggagcagagaagcacatgatagaaaacagaaattgaaacagaggaacacactcagaaaagttcaatgaacaatatcttcaaatatattttaccagcaattaaatccacaaaaagaactattaatactccagtcaaactggagagagcagggtaattgggaataggtagcttaagatctgaaaaaagaattacctccgagacatctaaatttcttctctctctggttcaga

SEQ ID NO: 20628 - DNA, 398 bp, Oryza sativa
aatattgcttatcgctttacttaaatgcccacgttatcactgttttatttagccatgcctatttacctttgttatgaccttattattattattattgttattgatattattaccttgttcaccctagattaaacaaaaccccaactagtggacactctactcatggtaccactagtatgattttaggtagatgcttcgctggttaattaggcaacattaggtggttttacaactctagactttgggaatattctcatcacctggacactatggaatggttggattattgtggaattggattcacacctccctctctattcaaaatcctcaaaatggttttaggctgggctcggggtgcatggttttgatagtagcacctcggccatataaggaccggt

SEQ ID NO: 20629 - DNA, 164 bp, Oryza sativa
actccatctgtgtgaagcatgcagcgctgtcagctatagctagtagtagtaccatactaccattatgttttacgttcgtttgcttgctcgtgcatgcgacttgtgcacaacgtacgtactccactgaactgatcaacacacacctcagccgttctgcgcgcagg

SEQ ID NO: 20630 - DNA, 1501 bp, Oryza sativa
tattttttatgattggcgtcagagagtcgtaaataaaaagagccaactgatacttgttggagcttttgccttgtgttgggctttatggttgagtaggaatgatagggttttgacaaatcacctacagttacttatatgtaggtcattttcaaggcaacatatttgcttcgtctatgggcacagttataaaaatgtgatgaagatggagatttcctaattgttgcatgtcgtaagcttgaaacgacggttatgcaactgtttaccaatcatggatggatatttaccaatatactgaaataatgttattttgtctagtttggtttccttttttacaaagtgctagtttgtaataattggctataactcttttgagtaaaggccgagatgttattttattccaatatctaaaaaaatatatcacaatgcttgttgcaacaaaatcataattataggaaaggacattcaaatgctaattcaatgatattattttcatcaaataaaatttaacttgtaataaaataattattggtcaaatatttaaagtgataaatattaaattgccgatgcgtcttattcagtgggacagtggacagaggaagtattactcatcatgatacagtatgcaaaaacaacaaaactgtgtgcttggaattcagggtgttcttccggtatctgggcatggggctctctagttgccgtgcaacttgtttgacccactgtgtcatcactgaatagaaacaaattgcatgcaggaatagaggagcatattatatactccctccttctctgaatgtttgacatcgttgacttttttaaacatgtttgaccgtacgttttattcaaaaacttttgtgatatgtgtaaaactatatgtatacataaaagtatatttaaagaaaaagaattaacaattacttaaattttttgaataagacgaacggtcaaacatttttaaaaaagtcaacggcgttaaacattttgggatggaggtagtatttgtgtacatgtggtcttggatttttctctgctatttatgtgtctatatatatatctagctgaatgttaacgtttttagatatttgcgtggccataagttaataaattaataccggttagttggcgtgtgtgtgtatatatatactagtctcttttgctcttacaacatgtcacagctcacatggctgctatatatcaatatatggtcaactatttttatttcttgtgagaactatttttgtgtttttgtaaatatttcttatggaatgttgtttttgcaaataatttgttttcattgatttttttttgttcaaacttatgatgatgagtgaatttcacataccccgttatatgcccgcttgtaaaaaaaaacatatatctctcaaaaatcctgcctttcacatacataatcaagttgtttctcgcctagctgagcacgccaacttgctattccaccataccaccatcgttggttgcctactccgctaggttttagtgtgcatga

SEQ ID NO: 20631 - DNA, 1501 bp, Oryza sativa
ttgtctattcgcaatctaattacccctataacatatctgaaacactgagctagcatatcttaaaattgacaaagtcacatgtgactgagccaacatatcttaatattaagaaagtcaccataaatgtctcgttgccaaggatacattggctacaatttaaatgatgattaaccataaatatgagcactatgccaattctaagacttgaacaggtcacaacaagaaacatatctaatcaattaactacactcactttgtatttttgccatatctaattttatacgtctagctctcatgataaaatgttataatctctttcattattttcctgttcatagacaaaagaaaaaaaaatacttatttattaattgagttccgcagagcattttggttgacaattttagttactactccatccgtcctaaaatataagcattttagcatagtgacaagtcaaacatttttaactttgaccattaataacaaaaaaaaaataaaaaaagatcaatcatgtaaaattgatgttactagatttattattaaataaactatcataatatgtaactctttttatttaaaacatcttacttttataaatattgttggttaaagtagcatctcgaagaccgtatcagaataaaaacatcttacttttatagatattttggaacggagggagtagtaggtgtgatgtttgaccggtggtctagcaagtacgcaacgtccacgatgaatttataacgcgtactccctccgtccaaaaaaagacaaaccctggattttcgtgtccaatgtttgactctccgtcttatataaaatttttttataattagtatttttattgttgttagataataaaatataattaatacttgacttgtctttttaatttttttttataattttttaaaataagaaacccaggggttgtcttttttttattattttttttacggagggagcacgtgtaagctctgtggcgtgaaagtacgtgcctgccctgcctacggacacgagctacatgtacgtacgtacgttaattcgtaccacactcgtgcactgttggatgcgtcgcgcggccggcatatatatcgctaattaataaagcgtgataaatatgttttgtcatatcgtacaacaggtcacacatgtaggagagggagagagctagccatttcagagaagttattcacaagccgcgcaagaaaaatcgaattaatttatactgtatatgtttttgaagagacaaatatgaatttggatttatgtgggaagtaacgtacatggcacatgcatgttaattatcagataacgatttgaaataaatcctccttaaatataattgattagagaaatgaaattaaatgacgtccaaaagtccgcctctaatattttacttatcagatatacgtttcaaaaagatatgtgccttagcatgcatggatgatttggttttaaaaggaaatggctaaacgtaccaaatttacagaactctattaca

SEQ ID NO: 20632 - DNA, 1258 bp, Oryza sativa
ccctagagcgccgggaccccccttatatatggaaggtgtcggattacaaaagatattctatattcctaccggaatatgaaatacagataaaatccagtcgtaaccgactaagtctctgggtgtttccttgatacacaagttaagaaacaaacccgagatacagataagatattctatctacattaggtatcctgtacccagttcgaataccatcgccgtgtagatatgggatacccataatctccacagtagcccccgagtcctttgcagtcgaccatcatagccttctcaaagatgataatccgagtacttcaaactcttcaagccaaaatctgccgagtggactgtaaagggcgaaaagataaagaatatggtgcatcgaatagatgcacctaattaggtgtagcccccaactatgtgattagttaacaaactaaacatatagttgaaagacaaaataataacacaattgtgcattatatgacaaaagcacacgcggcgcctaaataggcatgctagccgactgctttttagccacaataaaagaaatccgagtggtttacactctaaaaagttcacgaatgaacacacttgacaggcatccgaatataaaaactctaaagattacccatcaagtattataaagattatggtaataaataagtcaaatagcctaggccatgactatttaccatgaaaacaggcatataatacgccaaggaaatgactataataaaaacaagtcatccctagttaacccaaacagcttttgtagcctaaaaaagcttgcaaaaacagcataacgcctttctgtcgggcacctttttaatttgcattgcaataattccaaagaattatatgaccgcataaaaaggatttcatcagcattgggcaacactgttgtgcgcataatattgccaaagcaaaatatgcctaagtccctaaggaacacaatgggccacgctgttaaaagtattgggctgaagtactgttcaggcctaggcccattagcacctccgatacccttaactgaaaaatccgatatccaagcgacgcttcgtcttccccgccggaactctcgccattttccccactccctgctacagtgtaaagctgcgccggcgaactagggttcacagctccggccaaatccacctccgaaaagtgcatcaaaatccttcccgtgatccaccgcctcaatccctcacctctcccaagccatccctcgaatcaaatcagcacatttgagtgaaaccga

SEQ ID NO: 20633 - DNA, 1501 bp, Oryza sativa
gaccgaagacgttttattaatattacttatttataaaaatcattggcaccaagcttttttttttccagaatttaattatcatgtcctcgaagtggtgcggtcagagcaatatatcttaattattggaaaaagttttacctttagggcgggtttagtccccaactttttcttcaaacttttaatttttcatcacattaaaactttccatcatatcgttccaatttcaatgaaagttccaattttagcgttaactaaatacacccttaatctaaggtttggaatgtcaagctagctaggtccaatatattttaatttgctgcagagagcatgcattacgctatatatatgctcgttgtcatgtctttgtcacggcctaacatgcatatacattaattaggacgcctgtgtgaaggtctttgttttcgcgaaacaacagtataagcactgtggataaggaacaatgagttaatatagctcgtgcacgatcgtccctattaattggagaaggttaagtatacatcagttgatcctttttgttttgacgttctgtcgtacgttgacccaattggatatttggatcgatagagctactctatctgggttaataatactcgttttttaacaagagcacggtctatataaaaagtaactttgaccaatattttttattataatatgtataaaagtgttaataaatatatgattttattaaaatattttttaagactaatctatatatgtagtcaccatatttgaaagaaaaatattttaaaaataatttataatcaaatattctaaagtgtgataccatatttgtctaaaacgataagtattatcagctctgagggcggagggagaatatatattagtataaaaattagatctagtatatgcatgatcatccctttgtctttgcatatactagatcgcatctcttgactagtggtaaatttatttcccctgtactttggattatcaaggtactacctccattttaaaatgtaggcaaaatttgatacgagacacccaaaaatcgtgtaattggctgtgagacaccgcaaaatcgtgacgctgtttatggacactacgaaagttgtgaaattggttgtaggacactggaggcaatattttataatttccgagacaaaagaggtcagagaaatttctaaaagacctgattgcccctaggcgccgtagcttgtaaacccaactgggtctagtcgtcgtgtccatctcccccacccgatttccttattcctccccaatccctaaccctagttgatagtggcgacagcgccggcgccgacggcggcagatacgacgctggcaatggcggtgacggcggcgacctcaatggtgcaagcctggtcgaagcagatgcagcaaagctccatgtcgctcacctgtgcccaaatgatcaacacattttgcgaattcacaggagtttgctgttcttctcagacttgacctgtcattttgctgaattgcccatactctgcca

SEQ ID NO: 20634 - DNA, 722 bp, Oryza sativa
gtgacactatagaatactcaagcttaaggaagctcatgacaacctcctttccactactcaacatggagttctcattgatgttggcatatcttgtgatttgcttgatgatagtgctatttgccatattgctcatgttgtatcatctagcatttctacctcttgtgatgatcttgtggatatgcctagctctagctctagcacttgtgtttctatttgtgatgcctcacttgttgttgagaacaatgagcttaaggagcaagtggttaagctcaacaagagtttggagatgtgcttcaagggtaagaacactcttgacaagattttgagtgagcaacggtgcatccttaacaaggagtgacttggattcatttcaaagaagggtaagaaagcttctcaccgtgctactcgttttgtcaagagtaatggtaagtattgctccaagtgtcgtgaggttgggcatttggtaagccttccaagacttgcatgtttgattctcattatatgcttaggaaggctcatgatggtagcattattgctagatatgtgggttcccctatactccgtggtaaaaagaatgacatttgggtgcccaaagctttggtctctaacctccaaggacccaaacaagtttgggtatctaaaagagcttgatcttcttttttaggtgaactaccgcaccggtgggagccattgtgtgcttgatagtggatgcactcaacaca

SEQ ID NO: 20635 - DNA, 282 bp, Oryza sativa
tatgggtgctattaaagtgaaccggtaactttcggggctataaaaccaaaaacgtgaactttcgatgctatataaccaattttgccaaaaactaaatgacacctaatcaaaactaacctaagttgctaggcttggtgagggtcaactctaactaagcaactaagttatgttttgcaaacatagggtgatagtggctcaattatatctctaggaaagtaaatcacactcctatgtcaatgtttagcaatcctagggtgatatgatctcaagtttgtctctaga

SEQ ID NO: 20636 - DNA, 1501 bp, Oryza sativa
caaggaagagttggaggcggagatcgagttttggaacagagcaggaatcggctggagtcctgatcggctacggctaggatcggctgagattgagttgaactagataagctgatatagccggttccgacaatacgacccgtgtgcaacattgggttcgagttgatgtgcttcaagatgattgccacgcatggatagagtcctgagaaggtaattgtatctattaattaggatattttatgtaacttccttagagatatgtttaggcaaaagtctgccgcaaagacttgtgatattttagagtttgttagagataagagtcgtgtccaatatggacatatcttgtatttctcgggtataaatagaccccgagccctatgtaaaagaaagaagacacattcaatacaattcaggcgcatcgccaccttttgcttttatttcgacgaattcttactttcgggttgagctgcatcggtttcgattttcaacaacaggtaaaattcgttatgacggatcgtgctcttaggattagtgcttacatcttcatgacactctaatcttattgtataattcatcaagttatcatatatcttatataatcttcagcaatattgttatctaatacaccatcggccaacatctgtgtgcagaagacagccgattaggttagatctttacgttgatccagattatataagatatctaccattctatgaatcttctagtgtcttgattgtctagatattgttcttcttttcatacttaatgctgcatcaattgagtttgacctattaagtcgtgcttagaatattgatctctagcctgccacctagttgccgattagaatagcatcggagtttcagccggtcgtatctgatttaactataattatctctatttgcttcactgccctttatgccaagatattggtgtatttgaatgtgttaggcttttgcttgatattctatatctgttttaatgtcctgatatagcgtagtatcggagtattagccgatacatgctagatctatctgatcggttatgttgtaaacttatatagtcctattattaatatatatttcggtctaagtgatttatactgtctcggcatggcgaccgatatatcccaatcacttgatttaagtatatatcggtataaggagtatatatcgttaacatctacagccgatcgagtagatttagtttttcttccttatttattcacgattgccgatcgatgcacaaatgacatcggctcaaagataaatgatatgtcatcggcacctggccgatcggctatcatttataggtttaactacggttcttttgtctttatttcttgttgattacaggatcaaatcaactggcacgctcatacatccgaaggcgagttttggacctacactggagttaagcagatctcctaggcctcgtgttttctgtcaacacgcttttggcacgcccggtgggacctgattagaagtcaggcgtcagttcttcctca

SEQ ID NO: 20637 - DNA, 1501 bp, Oryza sativa
gctgctaaacacactagtctgaatgtgtgtccagttagtaagattgcttcaaggtgtgcataagttccagtgtaattagaggtactataagagatggggtcttcgtaatttttaaacaacttatgtacctattttagaaaggcatagcaagcctacttatatactgactagtagcatgcccgtactaacgctacggtaatatttatattaagcaaccaaaagacaatatataaaatgagattaattttaagaaataaaaaactgccagatcaagagaagtataacaccagcgttcaaatccaagttctctttgctactcttatatacataatgaaaattttcatctcgcagcggtcatgattccttggcgacgcggattgactaaataataagaaaatggatgcacaaagactaaatgaatcctttccaagatcaggttttggcttatccgtcaaagaaaaggtaggcaagtagtaattacagtcactttatgatattcaaatctacccagaaatctgtaatgacaaaactatttcctaaaaatgatcagtagtcaatctcaaattgtcctgagcatactacatgaaggtgcaggaggatctatcaattgaacaacatttcaaaattgttagacaaattggttcatgaggaattgaggcaccaagagcagatgaatcgcaaactcagcatagcaacagcagcagaggaggccaaacagttgtccatcccatgcagtggaatgaaatgcccacatgaacaacgtttccatgttaatctatttttgtatttcctagtatgatcgatcactgttgtcattctttcaactcctaaccaacaaaaaaatatatagaactgtagctaacataaaagatcaggtgatagagaaaataaaagacttccgctctctgcatatatgttacattgcagcatacaccaaagcacaaatcagaaaattcttactaaacagtaagattttcttgtatgcttcacttttctagagtaaaatattagaagtacgtcaacaaacatcactaatcccatgcagatttctgtttcaagtaacatggatattttgaatgaataagcagtcaaaatcatataggacacatacacagcttaacacagttctcttttgcctaaaagtccaaagtagaaagaaagtacacaaactaaatcaacttaactctcagatcagaaaagttccatctattacttaacagagtgataggtgcaccaaaattccatctattactacaatgcttatgcgcattttcacaagcatgtacagtgcaaagggctaatacagtaacctattcaggaggatatatagcagagcaatgtctgttctgggtctctgtgttgctacattaattcgactgcagcatgtccacatggacaatgtcgacgcgtaaatcattcgttacctggcaatataggtagtgtttggttgcaaggatgggatgaacccacttttaggggtgtttggttgagaggtgagtgg

SEQ ID NO: 20638 - DNA, 1501 bp, Oryza sativa
attaccgtaagtagcagcgcaggggcgttttgcacgatgagtgtgggggaggggggtgcgcccactgtgcaagttaaacagttggctcacacgcgcccattagagcaagtctaatcttaggctataaactaattataagcttatatagaagagagagaataaaaaataaaaagggttggctctcatgcataagctagctattcaagaaaaatacattaaatgcgcaggtgatagataaagagaggagaaaaaaataaagataacattatagctcatttatatacatgttaacttaaatataagttataatcttataattggatctagtattaaacttgacccaccaactcctcctcagcagcccatgtctggccggttcagcgtgctcgggtatactcaacatgggtgaggcacgacgacgggttcagcaatgcactcgagcagtcggagctgacacttttaggtcctggttggcacagctccaagcactagctctatctctcctggagctggagctcagccaaacagtttcagctccatctaaaattagagcggagctaggtggactctctcacaaaataaactagtaagttggagctgggtttagactgctccacaactccactacagaccgactccttaagctaaaattagcagttgtagctctattaaaaatgcgaatattaaggaatgatctaatatcaaataattagaaggggtgaggtttcgaacccagatcatctagcccaccatcttatagagctagttggaagacccctgaatgtgtttctgttgtagctctattaaacaagcccttagcagcatcttgtgattcatccgtgtgtttctccggcgcgtcgctttctgtttagagaaaaccgaatagctcgggttcggattcggttcgaggcgagggaaggcttaaaatcatttcatgcacacacagctgcccccttggcatttgcgtgcactgacacgatgccgtctgtcctacacgggttggtagtatgacgaaaggctgcggaaaccgatccagaaaattaaaccgtttggatcattggtttttttgactagtagccatgaaagtgaaattgtccgaaaaggataaaagagttaacgacgtcggtcgagctcaaagctctgcgctcaagaatccgagcacttcgggtccgggttcggttgttcagagtaacttcatgcccattgcccaatacgttgtcctccaccagagtgcatgtgagcagtgatgagcgtcattggagaatttggccattcgtacttcgtaggttgctggcgtcggcgagcgcggcgaaacccgaagcgctggttcggtttcggttaatccgtttcgcggtcgcacgcggacacggccatggtgccaggtcggtgtctcccctcgctgctgcgacgcttgacttgcttattactactattcatcttgtcgttgcagcagaacagcaacgtgcattcggttcggttttgggatctttttttcctgccc

SEQ ID NO: 20639 - DNA, 1501 bp, Oryza sativa
tctttgttgagatcgagtctctggggtacgcttttggtcgccaccattgagtggttgacgggcgtatgacatagatgactggtgtggctattccaatggttgtcttctatttcatatccgatggcttagagcctatgtagtgcactcttcaagacatgtcggggtctgcgatgaggttggatggttaccgtatttatttggactttatttgagaccccatccatccagatatttcgcgctgacatgccttggagcattgcaccacctagactttgggacgtcctcacacaccactaccatcctttagtagaaaacaccctctcaaaaggttttttttatgacgtgacacattcgttgatgtgttgtaacggtcgcacggaggaacgccggtcattttacaggcagccagggcaacaagagggctgcctataaaatagagacctataatattttgtaggcgcttcccttgtagctctataggagggcgataagggagctgcctataacaaaagccctagatattttgtaggcggcccccttcacctctttggaaagacggcaaaaggattgtccgcaaaatgacatgccaccttccatatggtcgttagcatatgtcaacggccgtgtgccacgtcataaaaaagtccgacggtagaggtgcatatttgtaaaactttaaaataaaaaagttgtaaatattttaataataaataaaattttaaaaaatccgagttttgcatggtatttcccgacagggcccatcttgttaccaggccatcccattcggaaggccggcagcggaggcctggtacgaggcccgctcgatgtcggagtgcctagcgggcgagatgggccaagtcctcgctctcgtctatccatctctccgcatcgacaagacgactagtcgccggaagcccggatcagagccagcctcaccgggacgggacctcccccgccaccgcccaccgccgaggatccaggcggcgatgcggcagcggtgcgagcgggatcctgccgaggcttcggaaggacaagccggagcatccgagcatctggttcaacagcctgccctcagtggaagtcgtgcgcatggggaaggcgaacctcaggtaatctgacaaggtttagacttctactagtaaatctgcgacgctgttcatcttcctgagatatcaagttcaccaaaaaaaacaaaaacttgtgcattgcggatatttctggcttagtacaacagaagtcatagtataggttcatagcgcagaattacagattaaaatacgaaacaccgtaacaatacatgattacaaaaaaaacaacattaggatggggttctaaggtgagacaatgctagtgcagagtttggcacgtgaaaaccaatatctgatacttctggcttctctgtaatgaaccacatgattggccttttcgccaggttaaccaaagccagctagctctgcgataattaatccacaggagaacacagggacgccaagaagttaga

SEQ ID NO: 20640 - DNA, 581 bp, Oryza sativa
cccttttttgatttgagattatttagggttcaaatattcaattgttgcatgtggttctacgtatgaaaaccgcctttaaaaatgagagtagtactagtactaaaatataaaagaaaatcataactttcaaatgaagtcggatgatgacatactttgtatgaaaactgtagcccttgatttgatctacaactttgtagatgaaagtttgtttatttcagatcgtttagggggttcgaatgtttgtttttctatctcatatttatttttatagttaaaatgttctattcgttttttattcccagatctattgttgaattgctttcttttaatttttttaaacgaccttgtatagagacatattctatattaaaattgtagagctcaacgacatctacgactttatgtttgatctttttttttcattggagatcgtttaggggagaaaatattcgttagaaactatatgatacctttacttattataaaaattaaagatgtttttgccagaattttggtacgtcatctgtgtttgattaggttttgagtttgtcctatttctctttcgtatgttttttgtcaga

SEQ ID NO: 20641 - DNA, 1501 bp, Oryza sativa
ttaaaatataagaaattcaaataattttttggtagtaaatgatttcaaatgaaaaaaaattatcaacaacaaagttgtaaaacgaaacaagatctacaacttttgttttggtcatttttctatatgactttgtttcaacagtttgaatttaaatttcaaattatgacaacttcaaacaatattttcaaatactaaatgatttcaactgaaaaaatcatcaacaacaaagtggtataactcatcaggatctataacttttattttggtcgtttcttcatccgataaagtggtttgtaacattgttcacaaaatgtacatatctcttatttagttttataacatataagagagatatgtaaattttgtgaaaatattactatcactttgtcggatgaagaaatgaccaaaatagaagttataaatcttggtaagttatacaattttattgttgatgactttttcagctgaaatcatttacttcttcaaaatattatttgaagttttgaaattcaaatttttagttgataaaatgaagtcacaagaaaaaaatagccaaaataactgcatgcagtaagaacacaataatatgatagagcatgattttagaaacatttaggaaaaagaatcatccaatttggaatttatatgagtgtgataaactagttttattttttttttcaaattttattttcccatacggctccttaaatggcccgtaatcaatttttccatacgggctcttaagtgatccacatgcagcggacttcttaagaggcctgcatgaaaaaatcgatttttccatgcgggccacttaaggagccgtatgggaaaatgcctctcgatttttccagacgcgactagttatggtccatttacaaaaatcatggggccttataaaaaaattgtttgtgtagtagtgctgtccagtcttctggagatactcatataggtatagtgagtgtgtgcttatagggatgagtgtgcgcgtattgtgagtgtctgtgttttgtaccgtgtttaaaaaaaagagaattaatccgttaaccttttgtgtatgacaaacagcaacactgaagctccttttcatttcatttcaagttaccaatactatggtggtttaatcttagttgcctgcagtattcagcaacatatgcatgctcttactttgccttactgtcaatgttgttctgaacgcagagaggcctctctagctttctgaactacttgcactggtacccttttttctaacgaactcatgaactttatttaataggaaaaagttcaaataatcccctaaaatttgatcaaaagtccatctatcaccttaaagtttaaaactggacattcaaccctttaaaccttacaataccattcgtacagcccttaaggtggttttacaaagtagtttttattttctttgcatataagttgcctaagatttgatcacatcacatactcattggacaaatatgaaaaattttcacttaaatatatcttttta

SEQ ID NO: 20642 - DNA, 1501 bp, Oryza sativa
ctaatatattaatagaagataggagtattttatcagtatatcgcattggcaattcctaatatttcagtgttatcggtgtttctaataatatcacaacaaaatattagaagcgaccaaccatacatttaaaaagaccgtgatgtctaagtactaacctgtatcctgtatgtatggccagaaatgaggataaaaatcaataggaaaagaacgttgcgtaaaacgaactaaaatgttgtcaatatataatgaagttatgcatagagaggaaatggaagaaaaagatcatataaagcaggaagagagttgggcagggtgttgctttcacggtccttaacttattttggacagttggacacacctaatttttcctctgatcgattgtggttttctgaagcatgcagcccaccggaaaaaaaatgatctttttcctgtgacgtactacttaatttgtgtagccacgactcctacttagctacagcacacacatgacatgcatcgatatctcgctctttttttccacttcaacactttttttttaacaataacactttggttgtttcactgaaaacgaaccatgcaggtgccgtagctagcgatatgctactagtcgcaaatggactagaatttctccccttttccctatctgatataccatcgttatattgacgtggtcttgactgaatatattaattaataaattatctagtaagacctgataaaaagcaaagacctgttaaaaaggggcattttttggggcaaaaactattttttttgtcccataatatactttttttagcacatgctcagatatataattaaaatttgatattttggacgaaggtagtatgtcttagtctaatcaggctagtaaagctaatatatactgagtatactaaataagaaaatggaagaaaataagaaggcagcaatatgtatatgttgaaagaaacaaaagggagaggaaaatgatggggcatcaaccggttgctggcctgcaaaacagcttctccatcatcatttttgttgtcgtaacgaggaaaattataggaaatttgactagaattttatgagaattgctagcttcacaagcgtgatccttttgcatctcatgcttccactactagggaatccatcgttattagtcccgatttacaacccctttaacaccaatcgagactaaagattgtagcgccatgtggcaaatgttttttctttttattttcattattttttactacttgtgtattgattttgagccatgccagttgctcccaacatccctaaatccccacatcaaattgacatccacaaattcacaaaaacatactcaacaacaaaatcatccacaaaatcgaatgaacatactcaacaacgaaatcatctacaaattcaaaaaacatctaaaaaaagtctacaaaccacaggtctacatgcaacggcatcacaacaaaatcatccattattcattcatagatcgaatgcagctcgatgccagcgctgt

SEQ ID NO: 20643 - DNA, 669 bp, Oryza sativa
ggccaggtagaactcaacacaaattttctttccacacaggcaccttttttttcaggcacataactcaagtcatcaaccaaactgaccctacacactaaacgataggtcctaggttcgaatcctattcgcgtgtgacttgtgacttaagagagatgtctgccaaaatacgagatattttttgagtatatatatatatatatatatatatatatatatatatatatatatatatatatatctcaaaaaactaaaaattcattttcaagggtgggtagagtagcctgtggaaattaattcccaaggatggtcggtattccgcccgcacaaatcatgcgatatctacaggccattatctacctgcgcgtctgaaaacacctatgtaaataggttattggcgaatttttttgaggattaatattatttttatggaaaatcgcaaaagtagtggccaaccggggaaaatcgcgaaagtaggtccctgtcgaacgggtgcaattcgatagggcacctatcgaacgacgggcagtcgacagagccctgtcgaacggctggcgttcgacacgctcgcccgtcgaacggagggagttcgacagggcccaccaccccgcgccgccaggcctgtcgaaccgggggcgttcgacaggtccctccaccgaccctgtcgaacaa

SEQ ID NO: 20644 - DNA, 256 bp, Oryza sativa
tacccctcacaagtacaagtgtaatgcatgtcaaagaggggttgaaatgtcatatcatgtgtgtggctggatcattaacgatcaagacggacagaaaaattgacggaagtgctaaaaatgggaacagggtgaactttggatgctattaaagtgaaccggtaactttcggtgctataaaaccaaaaacgtgaactttcgatgctatataaccaattttttcttagtttttaaatcgcctattcaccctccctctagt

SEQ ID NO: 20645 - DNA, 1501 bp, Oryza sativa
acatatgccagtacgtgcatggctcatgcatcccatgcaattgagcaagctatatacagagtcacatattaatgaatgcgacgatcatagctgctcttttgtttgcttgtcttgataatacaaataatccttggatttataagatcacaaaataccgtcaaacaaatgccccccagcaagtggagtttgcgcaagagaaacgcggtgtgaactcgacttggtgaaccctattttcctaaaattcggctcaattttgcactgctgcctcatcttgattatttaatatagaagggaataaaagaatttagtcccattgaatttagtcccactactaaaacaagcgtatatcaaaggccgcatatgcagcatcattgtgaatatgacaagccaatgtcatgcaaacacatcacttcatgcaactatgttgtttcaagcgacatcaaaacgggttttcaaaattttaaacattggtacattaacaagtttcatatatagatattaatttgaattgaaaatcatctagttgtccatcattcttgacaaaaggaagtgtataataaattcttgagttgagctctcgctcaatttgcatcatggaacaacaacgtaggcataattatttctgtacagaagcaaaacatgcagcggcaacaatgggggtgaaaaccgaaaagacagatttgtgatgttcttttggtttattctgtcactgtagagtgactataaagaaaatgcacccttcttccaaattcaaaattatgtgatgtcgtacttaaggaatgctccaagacattgaggttgttcttgctgacaaactctttgctttgagtagtttattctagcattgaaagtagatagtctcactgcaaacaaaatggataataaacctcatgtttcagcaaaattatattggtgatctctcgtaaatatctcgaatggtgattttaggcttcagcgctaacttaattcttcctacaatcaaatcttcactaccgcatcaacgaaacaataaaatgcacctgccgtactataattttgtcattcctgttgaaattttataattcaagatgcatgaggccgcgcgaccttaaagttcaacgtggcatgcagtagtgaaaaaatagcttagtaaacgtgataaacatccctagataaaagattcaatcctcacgaaacaaacgcataaggtgagcgatgagtcatatcgttatctttcttgcctgctaaccatcatgatggacagaaaagttactttcatgatgacaccaaagcggatttgttggggcacctaatagaacatacatccaaatgacatgactcacttagatcctaataggacatccaagcaaaactaacacactaaagcaaccgatgaggaatcgaaagaaaatccgtgccagcgcatctataaatggacaaactccatgaaaaccctcctcatcgctcgcacaattcaagcattatacaacaaaaatttaaaagaactagtgtcctgcaacaa

SEQ ID NO: 20646 - DNA, 1501 bp, Oryza sativa
gcaatgaaacaagcttattttctgcagaaatcaagaaaatcttccacgttctgtctctcactgtgtaattgggattctaatacccgtgatttgcttcttgtccaaatggtcatcaaaatgcgattgatcatttatatatatatatatgtaatcgtgtatgtttagcctcgtgtgcttacatgtagtcccctcgtgcctcgtgaggcgaatgtgaatttggggtgcacgtttgatctcaatgctatcgggcttacgctgaatttgtagtttgtagttcattttcaaaacaaaatcttttaccatttttaaaataatttttttgagaaggggtcaatttgtcaaaatttaggtactcaccgaaaccaagtacgcgctaaccgactattgcggtagccatggcggattggcgggcatgggcccgcgtgtcagcctctttgctcggaggtcttgacggtcaacggaggagtctccctcacaaactcatcaggaatttcctcgcaataaaataagcctaagaagcgccgagtcagcaaaaaacaggcccacctgtcagtgacaatagccgtagcttaccatcgaagacaatcagctgtttcgccataaaaaccaatctccttttcccctcgctttcttcatcagataataatagcaataaaacaaaaaaaaaagaagaagaagagtcgcttgaatttgcagcgtcgccgccgcccgcgcgagatggcccccgccgccgaagtctcctcgtcgtcggcggagaccaccggctcctccgccggtagcgcgccctcgaccgccgccgccgccgccacctccacctcccattcgtcgtaccggcgcacggctcccccgctcctgctcctagcctcgctcgccgcgctcctcatcatctccaccggcgatgacaccgcggccttcgattccgccgccgtggggcggtccatcaaaggtataatcgtgcccgctgtttggtgcaccatgggccggatttgggactgctgctgcgtttgcacggggatcgtagcgccgttctatctagggtttaggggcctttggggtggtttggggttttcgctgtaagatgcgtctggtagctgcttcatattttaggttttcatggggcttagttatagaatagggttttggagttggtttgtggaggggtgattggaaagttgcaactcttttgtcgcgaataaatctgcagtaacatgcctctccttttacttcagaaccaatgcatttttgataatgtctcaaaatttgttttgtattcagtggtttcggccttggctgaaggataagtattgtcattttgaagtatacagatggatgatttttacctgaataacatctcttaatagctagaccgtacccactttgttccgattcacctgtgtgtttggtatgagcttcttttcatgtatagcccttttacttacatgttccttttagcacaacacttggatttttgtatgataatccccttgtaggtttgcctata

SEQ ID NO: 20647 - DNA, 1501 bp, Oryza sativa
ctaaatcggctgaacgacctgcagtcgtaccggagtctgctggatcagctgaggtcgttgccttggcggtgtttgctggattggttggagatgctgctgcgttgatggtgcttgctgaactggctgcacgacctgttactggatcggctgtaccactggctgaattggtggtgtctgctgagctggctgcgcgacctgttattggatcggctgtacaaccggctaaattgatgacatctgttggatcggctgctgctgcactagatcaacaattggtggtggtggaaaaaacatagcagcaacctgatcttgagtcggctgattcgaggtttgtccagcaagctgtggatgttccctcattagcaatcgagggttgatcggctgagctgacgccgtggccgatgtagcaggtaagggcgttgatgctggcgctgttggttgagtcgtggatgcgacagatggagccgcctgcacaactggctgagcatcggtgatcaaagttcgataattcagaaaaacgccttcttgcaagtacaccgggcctgtagcctgatgctcagctatcgagccatcggctatcgttttcatcatgttcgacagtgtattgactaagacctcggattgattgatcaaagcatgatgcaccgcgtaatcaacccgatcttgaaagttgttgaaaaaatcttgtgctagctcaatattctgattaagatttcctccttgcggcccttgagcagaatcacctggagctccgtgcacttcttgagggttatcgccttgatttcctatagaaccaccgatagcacccttgttgctcggctgatcgagccatctggggcttgtttcacttctccatccttagaagaaccggttccagggctatcagcaaccagttttaacttgtacttctgaaccagcattcccttgcgggtttgcatgaacgagctcagatactgatcccgtgcttgctgcatcattgcttcaaactcctgcttctagtcaggcgtgaatttcttgggatcgatcggcaggacattgtcatcaatgatgtcagttaatcccggcttcggtaatttgcctttaactgagcctgggcttgatggtagtggtgcttgtttctcggccatgaggaagaactgacgcctgacttctaatcaggtcccaccgggcgtgccaaaagcgtgttgacagaaaacacgaggcctaggagatctgcttaactccagtgtaggtccaaaactcgccttcggatgtatgagcgtgccagttgatttgatcctgtaatcaacaagaaataaagacaaaagaaccgtagttaaacctataaatgatagccgatcggccaggtgccgatgacatatcatttatctttgagccgatgtcatttgtgcatcgatcggcaatcgtgaataaataaggaagaaaaactaaatctactcgatcggctgtagatgttaacgatatatactccttataccgatatatacttaaatcaagtgat

SEQ ID NO: 20648 - DNA, 1501 bp, Oryza sativa
gtcacggtttactgacggattctataattagtttttttttattagtatcggaatatcccatgcaacaccctatataatatttgatgtgacacgtcaaaacttcttaatgtaaacacccccaaagttatgagttctctgaaacaaatcaagttacctacgcttccacggaaacacacaaacatgtgagggcacaccgtgtactgtactcggtgttacaaggatttataagggtatgtatggtgcattcgtgctgctgaacaaaaacccatccaacgcgaactaacgcgtgcacgattaatcctagaaaaaagggaaaaataagcattaattccactatctcctacttaaaattttgttttattttacaatttagatcaaattttctgttatgccataatttgctatgatatattttttctcgtcgtgatacaagttttttttccacatagcatagactcggatgaaactagagctaccccgatcaaacggtagatggccactaggttttttatgtgttttatttatggatgagtgagagattgaatgacactgaatgaatattattgtcgaatgattggatctagctaaaccggttgagctacatgttgtattccagatcgccagacacgcatgcaattagaattaaaaaaactaattaaagatggatgaatgtgtcctgtacacggtgttataaggatttaattataagggtcaggcgtgcacatgcagcacccggtatcgtcctgttgaaccggaaactcatccaccgtggactgacgtgtgcacgattaatcccaaaagaaagggcaaaataatcattaattgcactatcttctacttaaaattatttttttatttctataatttatatcaaattttttgttatgctataattatatgttatgatatatttttctcgttgtgatacaagcttattttccctaagcatagactcagatgaagttagagctatggaagattgccgctggggtttttatttgttttattcgtggatgagtgagagattgaataaccactaaatgaatattctcgaatgagtggatctagctaaacccagttgagctgcaccagagcgccagaaagcaagacacgcatgcatgtaattagaattaaagaaaactaattaaagatggatggaccgaagtagatgaagttgggcaggagggcaatatcgatctctctcatcaatagtcccttataaaattagcatgcagctcgctataaaagggatggccaaacccaaatactgagcatccttgaagccagccagctcgctcgctctagactctacctttttcgctttttgctagagatctagccactttctttgatcgacatatatatccatcgagataaaaggagatagtgacaagtaattaacttagttttttccaataacgaaataaaatagtttctacgtcttttccacctctgccagcagaggcgcagccaagtaacttttaattatagttataaatta

SEQ ID NO: 20649 - DNA, 1501 bp, Oryza sativa
catttaacttttcacctttttcaccttttcagagatcagtcctctatgtcacagtgctacaataggtccacatatcgaactatccaatatgtaaaccagaaataaatctatcggtccttacaaattctgattcttcaaaggtcacaaaaacaccacaatatatatctagcgagttcgatctatgtcaccactcaccagtgctaggcatagaaaaagggaagcaatttgtagatctaattaacagatcattacaatgctaacaagaaaaagaaagtaattcattaaaacggtgcaagcgatcaatcaactttttcttcaggtccttccttttgcttcaaatacactgcactacgaaatgattaagaaggaaaattacttagcaaattacccgcagaagctcatgaaaggccgtgacatacctgaccactcccaacttgctttagttccaatgcttaagaagggggcatcaaaagaccaaaacaacgctacgaagctggttgatctctcatgacaagcagtttatcgacattaccatcttgcgaagaagacatggtgccatagcattgatacttgagctgcaaaagcttggttcccggtgcctcctacacctaacaggttacaggttcactaaaacagcctacttgattgacctctaggtgtttcttgctgtgtgagagacgtctgagtgtattaaggaaataggatgcctttggttgtaccctccatgttgtccatatatatagaagggtacactttaaggcggaaaagctacaaatatgttgacatttttttttctatatatatatatctttcgatttttggtccattggttttgtcctaagatttgcgctagttgtctagagaaacaaaacacagtgcttacactatagttacatttcaaagatttttttaaaaaacctatcgcctgatttttagatagtactcaatcaaggacctttaattgccttgaatcttcgctttaacatgtataggttgcttttctgggagcattttctcctatgtggccgtaaatgatgtggtttggtggctacactcttgtcattcatacccgttggattgtttaattatgtgaaggctcgatcttggaacaaatcttcattgtagtaccgggcttcattttatattgtcaggaatgcatgctgtggaacatcggcatcaatatatagaattatctgagatgcaaatcactgaaacaatatcagtccgacagcatcaatggttcgcgcgagggtttgacgacttagccaagcgttagcgaagcgtcattctcatagcgaggcgcttcgagttagcgaagcgagtgctaattgggcttcgaggttggctatacgccaaaaaaaactacttttcccggccctggcataaacctagcttctttgaaacaacataggttcacgtaactagctattaaatacgtatatcttttcagtctctaaacaccatcagtgccaacaagctacattcataactttattattaa

SEQ ID NO: 20650 - DNA, 901 bp, Oryza sativa
ccagcattttttccattgcagtaaataggaatccctgtaggggaagacatacagtctcgtgtactagtttactaactagtaatcgtgcacgtgcaatgcacgtttttcataaaatatatcgtaggagtacattgaaagtttggaaactatatctatcaaaaataatttattcaaccaaaatttataaaatatatctcctgtgtaattgtaaaaaaaagtataaccaacattatcggtacttgtaaacatgggtatgactgtcttttgtacgaattttgataggagggaataaaatagaacaaaagccagaggctatataaaattacaatctaacaaaaaaacaactgtaccagcccttttgctctgtagctggtccactgcttgatctcgtcaaaaagaatttgtcgacaattcgttgaattgaccatccctctttctcgaagtttctattattttgttccgtccaaattccccagcagaccagcaagaagagggtcctgagcctttttctttgaatcttttctgatgaagtcttgtgacaccaccattccaatactgaacaggccgaaggagggcttgctgaagaaacttcagttaagcacaggcttattcctatctggatggcttaaactaatctactcttcatgaacaaatgatgagatgtctcaaggtttgattcgtaggggacaaaagtaattgtatggccagcctctaagttataaacagcaacagtccatatgcgattctaagctaggagacaagcaaaagattaatttgcacctcaaagtcaaaggggcctgacttccaaacaggttgcatcaaatctgatcagatcaataccttgccatgtatgctggctttgccatgtagaattgtagatgcctaattctgaccatcgcca

SEQ ID NO: 20651 - DNA, 1501 bp, Oryza sativa
ttatttgtccttgtaacctagactagactagatcaatactccaatgccaatattacctccttaacaaaaattaatatttcctcctctttaatagacttttgttaacgaccaaatttggtaatatcagtatcggagacgaagattagatcgaagcggaatccaagacgaagatagttgcggaaacatagtaagaatcggctagagtctaaatcggctacgatcgggatcggctaagtctgagtcagactgggttagacgatacagccgattccgacaatatgacttggtgtacgtcatcgcgttgagttgatatgcttcaagatgattgctatgcatgaatagagtcctgagaaagcaattgtatctattaattatgatattttatgtagtttttgtagagatatgtttgagcaaaagttttccgcaaagacttatggtatcttagagtttgttagagataagagtcgtgtccgatatggacatgttgtgtaattcttgggtataaatagaccccgagccctatgtaatcgaattaacacacgttcaatacaatttcggcgcatcgccaccctttttgctttcgttttatttcgacgagttcttactttcgggttgagctgcatcggtttcgatattcaacaataggtaaaacttgttatgacagcttgcgttctcgggattagtgcttccatctttatgatactctaatcttgtctatgtaattcatcgagttatcatatatcttatataatctctggcaatatcgctatctaacttacaatcggctaacatctatcaatagagggcagccgattaggttaaatatcgacgttggcttagattatatatgatatccaccactctatgagacttccaatggcttgattgtctagatattgtccttcttttcatacttatagctgcatcacttgagtttgatcttatgagtcatgattagaatctcaatctctagcctgcttcttggttgccgattagggtagtatcgggatttcagccgatcttacttgatttaactatatttgttttatatgctttattgacatgttaaatccgtcctttatgttaagatcttgccgtatctaagtatattaggctctttgtttggtatatcctatttgctttgatatcttaatatagagtggtatcggaatattagccgatacatgctagatctatctgatcggctatgctatgaatatatataattttattcttagtatatacttcgatctaagtgatttatattgtctcggcatggcgaccgatctatcccaatcacttgacttaagtatatatcgacataaagattatatatcgttaatatctatagccgatcgagtagatttagttctttcttatctatttatgactgtcgattgatgcatatatgacatcggctcaaagacaaatgatacgtcatcggcacctagccgatcggctatcgtttatggatttaaccacggtttctttgtctttgttt

SEQ ID NO: 20652 - DNA, 224 bp, Oryza sativa
ataacaaataagatgcccgtgcatctgtgcaaaattcatttccgatttatattcccaaaatgttctccggtttatattatatcgttatagtgtttgaaacacaacctataatacatgcccgcacgaatgtgcgggcttcgtaccttcctagttaatcttaattagctaatcaagtcaactagcgatcgcattggcattagaaaagcttgtcttctcggcaatca

SEQ ID NO: 20653 - DNA, 1501 bp, Oryza sativa
cccaccagcagcaaaaacaaacaagaaacagaacaaggaggcgggtttgcaaagaggcaaagatgacaagaacatgaacagagctggaagcctcgacaagaaatgccaagaattcagagtcaagagaccaaggagcaggcacttacatgagcaataggaataggccatcttgtggcgaactcgtaaggcagctctggaggcttcgctttgcggtaggtgaggtccatgaggccggtcatcgcctgctccatcaccgcggacgccgcctcctcgtcgtcggcagcagcatcgtcgtcttggaacttggccaatgccatccgcatcatcgcggcgtagtcagacctcgtggggccatcatcggcgcccgcagctcttgctgggtcctcgttcttgggcgcagacccagccgtggcttcatcagcgccggcatttcttgctgggccatcgtcctcgggcgccgccgagcccgacgtgccggcaacatcagccgcccacgccggcgggaactggagcgggggcgggctcgatggtgtcctcaggggcgaggttggggcggaccgccaccctggcggcaatggcagcggatacaagccggcgtggtccaagccgaggctgctggagcgttgcaacccagacatgtccgccttggccttctttgccaactccatctcgaggcgaagctgcgcttcctccgcctccggatccatggccggcggtgtcctccttcccgaggaagaatcgctgcttcccggcggcggtgggtgggtggccgtggcctcgagccggcggtcgaggagttcttggtttcttgcgttgcggggtggagtggagcgggtcggtttcttggagggaaaaatgtgaagaggtgtttggatacaaagaagcctggggcctttctatttataagccttgagttgaggacttgatgaccaggagatttctggttttgctgcccctgtgcagatgtaggacgtgaagcttctgacgagatttctggtttgccttgagtgaaacatgtaactctgcatcatggtgtcacttgatcatcaactgatgaacactgatctgaggtcttgacaggaagacgcatagaatggatcgatggttcttgctatctgggaaattgatcttgctgccatcagatattgctactagaacaaccactctgatcaagatcaattcgtatgtcagcaagtatgagccgtgtagctgagcctgagcgcaaccccgcataggcgacatcgatcacacatctagatctcttcaatctccactgcccggttgtcatcgtgtcaagacatctgccccagtgacacatgaaagcagaaggtgcccaattgggagccatcatgtccatggcaacagtgctctgcctccgccacgccatcgcggcaacccggtcaaaccgagcatcctggcccagatcccactgtacgttcacggcggttgaccctgccgcgcgctcatccccgaaggccgcagctggaacagcgccttcccc

SEQ ID NO: 20654 - DNA, 1501 bp, Oryza sativa
agatgatgcattatcagtttttgaccatccaaaattctctttagtgattaggatgctccagaaatttggtcttctgttctatcgacaagataagtgtgtgggggcatgtttaagaagcttctattcagttcatcaaattggcttccaaaatattgggcacaccaattgatgataagaggagctcagatacaccaattgataataagaggagctcagattcttcattatttttgcagactaaggatgcaaaagaattgtgcccaacataattttgctttgtataaacccttctgaataagtaataataaatctgaaaacaaatgtgaaacagtgcatgagatttgactattttcttttttactcattttattggctacatggatttcacgtgcgccctactgactattttcttgatgcattaatgttgtgagtcgtaagttgtatgcactcagctatatcagtttcaaaccatgaattcgttgcttcattagcttaattgttctgtaaaaagatttttaagaaaaaaatggatctgaactttattggtgagataaatggctgtagctccatgagacatcaagttcttattttccttattgaattattttctttcgtttggaggggctgcaactgctaggatgatggacatgtgcagtgtgaaatcccttccagtgctcaactaatataatttggacatgttcacgggataccctgtaagtccataccacaaatacatagttgtcgtttcaatttttaaggtgtttccaacatgttcacactcgacatctccttcttttcacttaaggcaactacgccgagtactgttccgataacaatttactagagtactattacgagacaattaatgtcttgaaagtaactgagatataaacctctatggtttgcatatcatataaacttctactggtcacacgatagaagatatacacttactgttgaacatgtaaatgttatttactagagtactattttgagacaattttttatgcttttcgtactttgtatgcgctgtgtgatatacatatcattggaaaatcaatgcattaaactttgagtacacttatgtatatattgtgggaaacgtgcattgcacgtgcacgattactagttggagataatcaatcactcaattcatgcatgaataaccaaattaccatgatctaaactaaccgtagctatttgtgttgccgatgctttagcgtgttagataggaaaaaaacaaacatatatgcacacttgtccgtggagaaatgttagaagcctaccaaatacattatgtatcactcctaacagctgcaagtgagcgatagaaccttgtttctttactatcatcccacgacacatctagcacccactttcttctttttcttctcttctcccttattcacatagaattttgctagcgtggaataacctatagcctgctggctcgggcttattatacctatattatggctctgttacttgacccataggtagg

SEQ ID NO: 20655 - DNA, 1501 bp, Oryza sativa
tatctaattaagtggtatataccagtacataatttgtttatttacgatgctatttatctagggacataaacggtaaaaatcatgaaatcgaaaaacagacctaaaacattttgtacattcataaaaaaattattcgtgatatatacggtgaactctactaggcacaggatacattcacgccgaattttaacttcatacacaactttatttgtgagtaataaaaacaaaattttcttgcgaatagtgcactatgtaaacatactttggtgctagctggaactcccatataggtactggattcctcaaccagcaccacgaagcggcatgatttgggaacttcctcgatgcattggctcgaatcgagtcgctccccatcacctctataccaccatcgattaatccaataacatctccgaaagcacaattcatataaatatcaaccaaatatcggttaacagtttcatcaaatattcatcagaaaccaactccaaggagatgttgtgttgtcactcactgtagaggagaactaattacaaaagagaattctgcctaccaatgttgttcattgggatgtcgaggatatcgccgccactgccacctccatgcgagagagccatagccgccaccggatctacctgcaagagatgttgcctccactagatccacccacggaagccgctagatctgcccgcaggagctgcggttgttgtagttgatggatccgcttgagaaacgaagggggggagggcgttggagtcaggaggaagggttgccttggcatggaaaggggctggcaaagaggggagtgtggataaagatgagggggtgggagagaataggaagggcggagaggataaggatgaggggaggaaggagattgactaattggcggaccggtgggacggtgattttgttcttccacataagtgtcggtttaattaaaatccaccaacaatgacaatttaataggtgctagttcttattagaaatcaacacctatatctcctagctaggactcataggtggcagctcctttaaaaaccggcacctacatcaccacatttgtgctgattctcccccaaaggcatcccggtggcatgctcttgggtgaaaagtgcactataggtgtctaatctataattttcggcacctaaagtgccgtatttttgtgtttctgttgtagtggtaattaaccaacactattcatctaaaatttgtcattttataaccaaatttagtttcgacttgagatttggaatgaatatatttcatgctttatgccattctcaagtaatttctttcatgaatttggagaacattaaatatgtttttaatgggttttcacttatttgatttattcactggatatttcacggtaatgagtatccgagatctgtataccgtgcacggaatccttgtttgatttaattcactcaaaaattacagatttaactaaattaatacatgctaaaatttggagaaagagcgtgttctaattgga

SEQ ID NO: 20656 - DNA, 347 bp, Oryza sativa
attcctgcagcccggaaaatgtgtcacgatatgattcaagataaatggagggggcataagaaattcacttgaaaaaaaaatcaagttgaaatatgatattgactaagcagcattttgatgaacatctctgggagcatcactgatttcagttcttcctccttttataatgttgcaaatccaacaactattttccaacgcaattacaactttttaatgaaaaattagaaaaaaatagatggcatagggatttctcaaatctttacaagcattacctcacaaagcaaagttatctactccagccaaatgacatgtttgaaactgatttattttaatggtctgataacagt

SEQ ID NO: 20657 - DNA, 1501 bp, Oryza sativa
tcccagccgtccatcaaaaccctgcatccatcggtgccacgggaggttcggccgaaccatgggctaggcccacctggtccaaactcggcaggtggcctcctctgttgctcctttatacagacttgtgaattttggtctaattcatcgtgtcaattctgagttcttggcccattcatgcataagtctgattctcgacatcgtccgattgatttatcgtctgatttgatgtcgattctcctccacttaatgatcattctctgcaaaagtttagtgaaccaaaaactagtggaatattattattctaacatggatatgcattgcaagcatagctagttcttctctattttggtaatattgacggtcgaaactaatcgctaacgaccatcaacagcaaggtagaaaacgtgggaagaatcgtgtgattggggaggagtgtaaacccaacttttggatcttagctttaacagagccaggttcaccagccaaagatggcgatgctggtggtttctcgtacatgaggaaaaattgttgtgattctgacttctaatcgatcccactgggcgtgccaaaagcgtgttgatgtgaaaacacgaggcctgggagatctgcttaactccagtgcaggtccaaaactcgcctcgggtatgctagcgtgccagttgatttgatcctgcaatcaacaagaaacaaagacaaagaaaccgtggttaaatccataaacgatagccgatcggctaggtgccgatgacgtatcatttgtctttgagccgatgtcatatatgcatcaatcgacagtcataaatagataagaaagaactaaatctactcgatcggctatagatattaacgatatataatctttatgtcgatatatacttaagtcaagtgattgggatagatcggtcgccatgccgagacaatataaatcacttagatcgaagtatatactaagaataaaattatatatattcatagcatagccgatcagatagatctagcatgtatcggctaatattccgataccactctatattaagatatcaaagcaaataggatataccaaacaaagagcctaatatacttagatacggcaagatcttaacataaaggacggatttaacatgtcaataaagcatataaaacaaatatagttaaatcaagtaagatcggctgaaatcccgatactaccctaatcggcaaccaagaagcaggctagagattgagattctaatcatgactcataagatcaaactcaagtgatgcagctataagtatgaaaagaaggacaatatctagacaatcaagccattggaagtctcatagagtggtggatatcatatataatctaagccaacgtcgatatttaacctaatcggctgccctctattgatagatgttagccgattgtaagttagatagcgatattgccagagattatataagatatatgataactcgatgaattacatagacaagattagagtatcataaagatggaagc

SEQ ID NO: 20658 - DNA, 1501 bp, Oryza sativa
ccatataccgtcgtcgacacttcgccacacggagcggtcatgctgcgcgatgatgaaaacaacgttttttaggtaaatggtcactgtttaaaagttttcttagaacccgtagaggggttggggcaggatttagactgttgaattggtagattttaatgcttattttagagaccaacccaaaatagtttcgagtaagatgcgaaggaattttaataagaggtgattaatgagatgagtagaactctaaagtggtcacttatttttggcacaaatcgaaagtggtactaattttgggccggagggagtaattttgattaattaagttgtattgttttgagttattgtgattattgccaaacccatgatttgctatatcatgttccttcgtaacctaggcatagatttaattgtaaaacattgccatagaagtagatagtaccacaaaaccttatatcaacacacttgttttgtctgtcgtcactttggctttatcatgcaagtaatatgtttatcaatatgtatacgatcaaagtcttgaacgattgcgtgtgctttcgggataccatactaatcaaaccctgtatccccaaacatggctcaactagccaagctacgcccgcttggccactaataggtggagttgggcccacttgtcatccccaacgtcatgcaggccatctcagtctttggccaaaaccctagcacagctggccgcccgattcgcctaacaattaacatttttccataaattaattaaggggaatcgatccattgctcttgctcttcaattccaccacttttctcagcacatcaattgcacactatattgaagtgaagaagaggcgtggcatggatgcgccacaacttcttgtctgaaaagggggctatgttagctagatgagaaggcaagatgacaagcctatttggcatatgccactaatcaactgctaatttcccactctttaatgcaataagtaaagtacagaccgacatgtatttttggctggagcaataggatgatagaaaaccaaacatgtctgagatgggctgtccaattggcaggacaaacatacaagtacaatgagcttgttactttataggatgtaatttgattgagcacctgttaacgaccaaatttggtaagatgtgaaccaggttcaacattaggatcgaggcagattcgatgaagagatcgattcgaagaacagagtatgcatcggctgcgaatgtatcggctggagtgtacatcgactgggatggatcggatagaggatagccgatacagccgatggaggtaatgcagccgattacaatgaagacggtttcaaggctgtttctagaattgttcaaagtgcttcatagggattgccacgatggagaaaaagctctcggtttaggcaattgtatttattaattaggatatcttatataatttccttagagatatgtttgggcaaaagtctgccgcaaagacttatggtatcttagagtttgatagaga

SEQ ID NO: 20659 - DNA, 1501 bp, Oryza sativa
gaaatatctggatggatggggtctcaaataaagtccaaataaatacggtaaccatccaacctcatcgcagaccccgacatgtcttgaagagtgcactacataggctctaagccatcggatatgaaatagaagacaaccattggaatagccacaccagtcatctatgtcatacgcccgtcaaccactcaatggtggcgaccaaaagcgtaccccagagactcgatctcaacaaagacatattccccggttatctcaaccatttcaaacccatcctcatgtgggactagttgcccaggaatgcaacatattctcacataaatcatctcaagcatgatatccaaataataagtggttctaagcaataagcataaataatcttaataagtttctaagtagtacttggcgacaagccataaatattggttcatgcggtaagcgtgctacccaaaagcccataggcaaatcgactagggtaaatccctagttagaaccatcctggaaatctgcaacatcacaagctgcatcaaactccccatccaaacagtcattacctgcagcggggtctgagcataaacaagtaaaagaaagcaagaaatcagtacattaatcaaattaatgtactggcaagtcggaaaacaatcctagcatactacatgttggccatattcaaagataagctgtgtataggttaatttgcataaatgccaattttagttcacaacatgtttcgcaacgaaattttataacgatagtatagagtaagtaaaacttgtaatgtgaatgaataaataacacgcatctaccccttaaggtagatcatcaccactctccatcatctcatcaccatttaccgaactttacccaagtttacaaacaaaacattccaaccattttcaaaacattacaaataaggaattttgaattatattttttttacgaacgttattttgaattattcagattcgtagtaaaagtgatatctacctaacatctcttatattttattttagggcgaagaaacttgtatatagctcttctgcttgccttctccccgaaaacccccgatcctctctgtcttgtgcttaccgtcgcggcgtcggtcgccattatcgcccaagcgttgcgttgctccttttggacggttgggcctgacaaaggacaattctatgaggattatctgggcttgcccatcaccgacctaactggactagcccatcaaccagaagaggacgactcctccgtcaaagtcggtagccaccggggtcagctagcctagcgcgtcgtcgctgcgaaccgaatagctgatgaacattgctactagtctgctagctactcgcacagtaatctgtcctctccttgtacttaattcctcgcacagtaatctgtcttccacttcacctgctagtccgctttccccatcctcttgtcgtgctcacacggtcacgccatcggcgatcgccgatcgaggaactgcctctgttctgccggctgccgcgtctga

SEQ ID NO: 20660 - DNA, 546 bp, Oryza sativa
attgcattgaaaaaggagctcattcagcttaaatctaaagtgcaaatactggctggcacatgtaccatcatatgttctttatatgactgtcaacacaggaagcaacctgaaagtttcacatgtttgatgtagttggatggatgcttgtgtttcatgaatctaaaggttttgcaccttaaggctaacggtttgcttcattgtgaaagggggttttatacctccaaatgataaaaatcagtttatacagaattaacataaagaagcctaccaagtgatgaaattgccgatatcgcctgttcttctcacatcaaccctcctctaccccctccatcatggagggttagtagtgaggcatgttcccctgtctcagaacaatgatggtgaggtaagacaggacaattttaacattctgttgattccccacagaaacctaaccgcttggtctgtagctacacattggaagctgagatgtaggactgatcaaatttttcgctgggcaggcacaccaaagactctccgttaaaacacaatgacctcaaaggatgt

SEQ ID NO: 20661 - DNA, 1501 bp, Oryza sativa
gtttccccatggaggacggcaatcacatgaggcggataagatcggaggagttcctttcatctccttttaggaaatttaacttccaggggcgctaggctgtccctgtacaagccgtcctctgcttgctcagccagcaacttggcattcttcgtacagtaccatggtgcacgcatgggttatgaaaatgaaacgaaagtttttttaaaaaaaaacaaatattttgaagccaatattatagttataagaagtatttgttgccaagattgaagctatgtaaaactgtgatgatcaataggacaataggtgtgagtgcacctgtgatattggtataggcccatttgtcaatgtgtgttacaagattattcgacagtaatagttttcatgtatgggttgtcagttccatttccatgtccatgtcgaaatgaaatatctggtaattgaaacatcattatcaaatgtttatttttagagatcaaattgcagtaatttgccggaacggagctgatgatatatgatcacaggttttttttctttttggcatttcatctctcttctcatccacatgaacccagtgagtaactgttgctccacaatcagtgagcagtgaatgtcaatgccaagaacagtagtatatcaagattcagtgaacaacatcccgagagtacttacattttggatgtcgtttggtgccaattggcagcattcagaataatgtgcagagaatctcatgcccatcatcttacgtttcagaacagtagatgaaaattcgcaagccacagaatgatgacatggaaggccagtaggagcacagtaaattaaaatcagcacaatccattgctccccttctctgagcttggttaaaggattggagatcagtggtgctgatctatcggtcgaaatcagtgtagctgttactggaagcccttcaccctctgaaacacgctgtgagctttgtgaccaggtaggttcagccgttcaggggatccaaattccaatggcatcaatcaacatcgcgctctacgtcaatttcgagccggtgcttgccctttgcaggcagaaatatacagttgaacaaatactgtactacccctagcatgttcctttgcaaaccaccactttctgaagtcatacttgtatcatattcatatgcctaaccttggcgtatccctcttatgctgttatgcaaataggatggcataagcttcatggagatgtaaccaggcatgcaaattctaactcgaccaagatgacaggaggcggctgcagtatttgggcaataaaaatggcagtttcaagtttcaaccatgttctgcagctgagggctttggtggtgttttcttttcctttaagtatctttaaaagggatacaagtagtaaccaccagttaatgaaatcccagcaattatgtcaaaaaaaattgaaatcccagcaaaactaggctcttttggctctagttcctaccgggcatgctcccgtagaaaacaacattacgtcaaacttg

SEQ ID NO: 20662 - DNA, 694 bp, Oryza sativa
ctacttattgttgctgcagaaacctgattaatatactggcggaggtatcccagtctggaaaacaaaggcatcatattccttatcgagattcgaaattaacctttcttttgcaagaatcacttggtggtaatgctaagctcgcaatgatttgtgcggtttcaccatcacagaagtactgtttgagactgacatgctattttcttttgccattcttgcttcttcatgtgcttataatttgttttttcttctgcagctgtaagagtgaaacactaagcactctaagatttgctcaccgtgcaaaagatataaaaaacaatgctgttgtcaatgaacaaagagaggatgatgtcaatgttctccgtgagcaaatcaggcagctgaaggtattattttaatttctttttggtaatcatgattttcaattaattggctctatcgttattgcaggaggagcttcaacacgtgagatcaaatgggagcttgccaggaagcaatggcagcccttccactgggtggaattctcaaaatagctttcttttgaaaatgagcttgagtcgtccaactgcattccccaccatcaaagatgatagtgatgaggagatggagattgatgacaatgatgttgaaaagccttgtaatttagaaaacaagtcttcatttcctcacggggatgttgaaacaagtagatgcaagt

SEQ ID NO: 20663 - DNA, 1501 bp, Oryza sativa
cacatgtccatcatcctagcagttgcagcccctccaaacgaaagaaaataattcaataaggaaaataagaacttgatgtctcatggagctacagccatttatctcaccaataaagttcagatccatttttttcttaaaaatctttttacagaacaattaagctaatgaagcaacgaattcatggtttgaaactgatatagctgagtgcatacaacttacgactcacaacattaatgcatcaagaaaatagtcagtagggcgcacgtgaaatccatgtagccaataaaatgagtaaaaaagaaaatagtcaaatctcatgcactgtttcacatttgttttcagatttattattacttattcagaagggtttatacaaagcaaaattatgttgggcacaattcttttgcatccttagtctgcaaaaataatgaagaatctgagctcctcttattatcaattggtgtatctgagctcctcttatcatcaattggtgtgcccaatattttggaagccaatttgatgaactgaatagaagcttcttaaacatgcccccacacacttatcttgtcgatagaacagaagaccaaatttctggagcatcctaatcactaaagagaattttggatggtcaaaaactgataatgcatcatctatctcgatcaaaccgagtcaacatatgactaattacttgaagaagctcaatcaagcaagtaaactaaataatgaatcaagaaacattggaaaaacatatatatacaaatgtaccatgttattatcactggtcatccactcattgaacgtgagaaactaagttgcatgggaccggcggcgctggtctagcggtgcaagggcagccccgggtagggctccggcggaagggggaaccaccacggcgtctgtaggggcacgatgcggtggcgtgcggcgtggagtcgcgaggaggcacggcagcgagtgaggtggtccgacgatggatgcatgaccagggtttgatctatcggaaagagaaaaaatttcgggggtcagcggatttttttcggaaatttcgtacgaaattttcaagcaaaattggggaaaattgacctacacctcaatggaacacagggcttggactgccgttgtcgtcgatgcaatgcgccggcgagtgcatccgccgctgttcaagccaacgggcggtagagccgctgctgtctttgtgagaggaagagcgaggaggcgacggggattggtgtggcgttgtcatcgcgcgctcgggggcggattcatctctctctcttgatggctggatctgacacggacatatattaaacttgttgttgttgatgggacgagcaaggcccacataagggttaattgggccgaagaaaggcgtcgggtgttaagggcagccgagctgattcgtatcgggttttagggttttcttcctcttctcttgcatcctcccatctcctctccggcggcggcggcgtcttgtgcgcgtgagaaagagaggagaagaaga

SEQ ID NO: 20664 - DNA, 274 bp, Oryza sativa
cagtagttcatcacatgtatcggctaatactccgatactacgctatatcaggacattaaaacagatatagaatatgaagcaaaagcctaacacattcaaatacaccaatatcttggcataaagggcagtgaagcaaatagagataattatagttaaatcagatacgaccggctgaaactccgatgctattctaatcggcgtatatatatatatatatatatatatatatatatatatatacacacacgcacacataatagaaggattttgcagg

SEQ ID NO: 20665 - DNA, 158 bp, Oryza sativa
cgtctccttcctcccgcccggtttctctctctcccgtgcgaaccctagctcgctccctcctccaaatccgcttgattcaattggccaattccaaaattgattagggggttttaatccccattgattcctcttcaattccccccaatttcccccttgaa

SEQ ID NO: 20666 - DNA, 1266 bp, Oryza sativa
cacaactctcggagtgaagagtacttagtgacaaaggtcaaaagatgactgataggtgatatcgaaaaagatgtttattaccaggcaaagaagtaggtcgaaaggtgattgataagagaaatctaaaaagaatacgtcagggctgaatgtgtaaaggaatactttgaatgctaaatgatgacaaacatggtatcctagtaatgacaagctagtgttgacgcatgacatgaagtggtaacttgtatgaggttgactccaaagatacgagttataagaagttctggaactgaagccccatcttccaatgccgcatcccagtcgaagtcagctagaggtacaaccagggaaaagtcaggtgaagagaagattccatctgcaacaggagatcgagccaagcagtccagagtggagaagttttgttaggcaagtttgttatagaagacggagcggaagaagttagacaagaagagaagaccgcccaacctatcttcttgctagcctcctcgaatctcggggacgagattcttgtaaggggggtggatttgtcacgtcctgataaattcatcccgaaattaaaaatcattctttaaaaggaataatagaattaattaaaattcgaaaagaaattggcaaacactaaaatacgtgcaagaaaaattcaaatgtggcccggagaatttttgttaaattctccttggtctaaaaggagccctcaaattttacttgaattttcagagcaccggaaatatttataaaacaacaacaacatttatcaaagttcaataaaaagaaaacctaaaaatccctcctcttcctcctttgggccaagcccagtccgaagtcctcctctcctccctcttttctctccctcctcctcttgggcccccttcccctcgggccacctccctcttccctctccctcccgggctgcctctctcttcccctcccctcccggcctgcccggcccaggccgcctctcactcctctcttcctgggccggccgccggcccaagccgccccagcccccgagccgctcccctcccgcacgtgccgcgcgcgtgcgcgcgctgacgccgccggccgaccgcgtggggcccccgcgccaggcgcgtcttcttcctcccgcccggctcctctcactcccgtggaaccctagctcgtttcctcctccaaatccgccccgaatccaaccgttccttccaaattaattagggggaattaatcccctttccctcctctctctttcccccttaatttcccctttga

SEQ ID NO: 20667 - DNA, 1501 bp, Oryza sativa
tctactccgacgatttttctttttcctaggagaaccacgtggcgcttcggctcgttaggccctttgcccttttttcctttgctagacatgtccttgacgtaaaaaacttgcgttacatcattggcaaggacaaaaggttcgtccgagtatccaaccttgttaaggtcaaccgttgtcatcccactgtcatcaatagttacgcctccaccagtcaacctaacccattggcaccgaaacagagggaccttgagatgtccatagtcaagttcccatatgtcctcaatggcaccgtaatatgtgccagttgtaccatcgtgtcccatggcatcgatacgaacaacactattctggtttgtgctcttcatgtcttgggccctcgtgtagaatgcgtacccattgatttcatatctctggaatgtcgcgatcgagccagatggtcccctcgccaggaaggctagttgttggttaatcgtctcgttacccatgagatgttgacgcagccacgtggagaaagtatcaatgtgatgccgtgtaatccatgcatcggacttaccgatgtttctggtgcgaactagagccaagtgctcctcgatgtagggagccaccaatgaagattgttgcagaaccgtgaaatgggctttacgaaataaattgttgtctaccgtcattattgctttccttccgagagtcccctttccccgtagtctcccttcatggcgtgattcaggtaccccgattgggcgaaggtcttcgataaattctatgcagaattcaatgacctcctctgttccataccccttagcgatgcttgcctctggacgagcacggttatgaacatacttcttcagaacgcccatgtacctctcgaaaggaaacatgttgtgtaggtacacaggaccgagaataccgatctctttgacaaggtgacaaagtagatgcgtcattatattgaaaaatgaaggtggaaatatcaactcaaagctgacaagacattgcaccacatcattctacatggcttgtaatctatacggatcgatgaccttctgcgaaattgcgttcatgaaagcacatagctttgttattgttgcccggacattgtctgggaggataccccttattacaactagtaacaggtgtgtcatcaacacgtgatagtcatgagactttagatttgtgaacttcttctccttcgtgcttgttattcgctttatattcgtggagtatccagacggtaccttgatgctctccaaacattcaaacatactttccttctttgccttgctaagagtgtagctggctggactcaagtaatggcttcctttctcctttggttccgggtgaaggtcaccgcgttgttccatatgcttcagatcattaagtgcttccagtgtatctttcgactttccatatacacctaggaagccaagaaggtttacacaaaggttcttagtgaggtgcatcacgtcgattgcgtggcggacgtccaagaattcccaatagg

SEQ ID NO: 20668 - DNA, 235 bp, Oryza sativa
gaatgggattagtggaagcgtgggcgcgagaaaggagggggcgaaatagtgggcgcgagaagcgaggagccgggcacagcgctggcaagagtataaaggcactgaggaagggatctgtttccttcctttcgccattattccccttgtcttcgccgcttgcgccctaactccttctttcctgtgccctaccttcgccacacgcgctcgctcttaatcttctcttcctccggcgcca

SEQ ID NO: 20669 - DNA, 1501 bp, Oryza sativa
catcgagatacatgttgcacaactgatgaaaacaaacgtacagtttggtaatatggcagagggtgttgttgctgaaactgcaatcgcatttgatgaacgggttgatggtggggtagtaatcccagtcgatttcagtagaggcgaaaccgctgcagagctcgccgctaatgttccactcccacgatgccttcttgccccatctccctaggatcgtgttcagggcggccgctgtgtggttaactcgtcatgaagtactaatcatgtagatgaaaaaactaggcgattaatgaatcaaatttcctccaactcttctcgtgtcaatgcggcaagagaggacaccatatatcaaccgaagtgtactatactcctgcgatttatatggggaaaaacaaaacaactcaatacaaaccttcgactggatcagtttttggtgcttgttgagcctgagcagctgcaacccgcggccatgagcacaaaattagcaccagccacgccaggtggcgaacgacaacaattacgctgatcccgctagaacgcatctctctctctataaacaacactgtgcgcatgccaaagagatgtatctgtaggtatatatgtacgtgccactaaacattaaaaaatttggtcaaatatgtactcagcttcaacaacgaccctcgtgctttgcttaatctcattcgttatggttgataacgatatggagtagcaagcaagtttttggccaaattaaagatgagattaaccaaattaattaagcatgaggacaaccaactagtacatggcctggtgagttcttaattaaagataagttattttttatatatatatctaaattcaagaaaacagcttgaaaaattagatcctagtcactgatactctttttagtttttgcactttgcatccttttattcagttttacttcgttaaagttttgtcccatgagtacttctttaatgctatcttaggttgcgttcagcaacaacacagagaaaaaaattacttttttcaacctcacgcttaccaaaatactaaacgatattttcttttacaaaagaaattttaaaaagttgtatttttaaattttaaatttaaaagaattgttgtaatatttaattaatcatagctaatagttgtgttattttctgggtatgttttttttttctttcgtcaactctcaaacacgttttaaagttttatggtgttcgtcgtgtcaaaaacattgacttgtcgacccgccgttgttttgactgtctgccgcgggatgggaaaaacttgccgttgaaagctgatgctgccacggcatcctttgcggcagaacgtagttccccgttctttatttcttttgtcgatcagctctgttcaatcttatgattcgtatgctagctgtgtctataggatttcgtgcttgcagaaagtatttcaccaaagtacatatacacacctaggttgtgatttccacgtcaaaattaaaattttaaagaaattgaaatgatgtgac

SEQ ID NO: 20670 - DNA, 1501 bp, Oryza sativa
tttttcagccctccacagtcttcagatttgataaaagtacgtactcgggagaccatggcgaagatgattaaagcactagtcataagggatagcttatatctatgaaatatgtaacggatcatgacttgggttttacgtttcatcgtatattacggaacggcctaaagtcctggtttgataatagatttaggaaaccaatgccgtattggttaatgtttctatcttgtaatcctgcccccatcctatataaggtgggcaggaggcctctaggggcatatgagcaccttagatcgtcagatcaatacacacctggcaaattcaaatccccaaacaggagtagggtattacctctcatcgagaggacatgaacctgtctaaatccttatctccccacttttaggtctcctgcgctacccccttttgttattgctaaaatattgtttcgacaatgatcatcatgcaataaattacttcctctggccaataatatatagctccggttcacagcctcctttagttccgcatatacaaccgggacgcctaatccagggctaaagatgggcatctttagccccggttgaaataatcagggcaaaacatctatctttagtcctggttggtgttttttcctttttttcattgttttctttcctatttgcatattgcttttgagatgaactctccaacatcacaaattcacagattgaattaacatactcaaattgacataataaattcacagatcgaacgaacatcacagatcaaattgacatcaaagattaacagatcgaatgaacatcacggatcaaattgacatcacaaattcagaaaaacatctaaataaattcacaaaaattcaccaactgccgttgctcgctgcctgcctcctccctcccgtcggatccagcgaaggggagggcgccgccaccgcccgctaactctcccctcatgtgccgcgcgccaactgcctccgcccctcctgcaggatcctgctgaggggagggtgctgccaccacccgcccctcgccgcctcatctcgggcgcctcctacccgctgccgcggacaccccgccatcacctcagccgacagagagggaaaggagaggaggggagggagaagtgcagtgcgtgtggtgtgccaaggagataagggcgaggggaggcgtgcgggctaaagatagtgggggcctgacaacatttagatccgagattaaaaatcatctttagtcccggttggtgtttaccaaccggaacgaaagatcataatgtgccattgggattttgaaccgggactaatgtgatctttgccatccgggcaaagatcagttttcagtaattctaactactttcttaataaccgtgcacaactctaagaaaagcttatattctgagacggagggagtagttatcttttgaaataataagcagactcagttttgatggtaagaactgttaacatatatttagatttgcatacttagggtgtgttcggatgcctcct

SEQ ID NO: 20671 - DNA, 1501 bp, Oryza sativa
ccgtgatcccctccctctttcctccctatttttccctctctctctctcgcattcaaatggccggatttgctcccgcaaatctcgccggcgccattgatggcggccgcacctcccacgccggtttccttccccgccggccgccctctctcccttccaaccctatttaaaccctccccgcaactctctcgcccgtttccgccacttgccgcaccttctccccgccggaaacgagctcgcgccgtcgccctctctctcctccgtcgccgacgacctccggccggccctctccgctcaccgggaccatctcccgcctcggcatcgccttctccggcttcgccgcaccgccgccgaccccgtccaccacctcgccgagctcgccgaccgccggaacgccgtcgtccccatccacccgagccgcgccgccgccttcctccgctccggccgcctcctttgtcatcgccgtcgacccggggtgagccgtggaccaccgcctcttttcccccttcccttcccctctctcggccgccgctctgccgtgcctatggccgccgccggcgaccataggggcgcgggcgccgcctccgggcgcgccgtgtggccgccgagtggggcccgaccgtcagccgcccgcgccctcgggtgcggctgacgcgcggggcccacggcgccggccggtgtgagcccgggtacgcccggtccaccgtggaccgtgatgctgccgcgtgggccccactcccgtggacccggtccgcgcgccctcacacctcggctgacgcaataaaccctttttaaattaaaatttaaatgcagaaattcgtaaatattcatttaagagcagataaacttcaattggccataacttggccatttgaactcggaattggaccgttcaagtctctaatttttccttaagaagtcaagaacctatttgtgtgctttgttcttgcttgttatatggagtttattagagtaaaagccttttttcctttccgttggtcgtgtagacgctgcagcttcagaagatccgctccacgtggaggttgaagccgatgtttgggaaagcgagcaaggcaagtcacatcatctttgaacatattggatcccagtttgtgaaattattttgatttaaattaatgcattaccgctttatttaaattcccgcgttatcactattttatttagccatgcctatttgcctttgttatgaccttattattattgttattgtgattattaccttgttcaccctagaataaacaaaaccccaactagtgggtactctattcatggtaccactagtatgaatttaggtagatgcttcgctgtttaattaggcaacattaggtggttttataactctagactttgggaatattcatatcacttggacattatggaatggttggattattgtggaattggatgcacaccttcccctctattcaaaaccctcaaaatggttttaggctgggctcggggtgcatggttttgatagtagcac

SEQ ID NO: 20672 - DNA, 1501 bp, Oryza sativa
ttaatttttttaagcaactttcgtatataaactttttgcaaaaaaacaccgtttaatagtttgaaaagcgtgtgcacggaaaacgaaggagaggggttgggaaaggaggcatccgaacacaccctaagtatgcaaatctaaatatatgttaacagttcttaccatcaaaactgagtctgcttattatttcaaaagataactactccctccgtctcagaatataagcttttcttagagttgtgcacggttattaagaaagtagttagaattactgaaaactgatctttgcccggatggcaaagatcacattagtcccggttcaaaatcccaatggcacattatgatctttcgttccggttggtaaacaccaaccgggactaaagatgatttttaatctcggatctaaatgttgtcaggcccccactatctttagcccgcacgcctcccctcgcccttatctccttggcacaccacacgcactgcacttctccctcccctcctctcctttccctctctgtcggctgaggtgatggcggggtgtccgcggcagcgggtaggaggcgcccgagatgaggcggcgaggggcgggtggtggcagcaccctcccctcagcaggatcctgcaggaggggcggaggcagttggcgcgcggcacatgaggggagagttagcgggcggtggcggcgccctccccttcgctggatccgacgggagggaggaggcaggcagcgagcaacggcagttggtgaatttttgtgaatttatttagatgtttttctgaatttgtgatgtcaatttgatccgtgatgttcattcgatctgttaatctttgatgtcaatttgatctgtgatgttcgttcgatctgtgaatttattatgtcaatttgagtatgttaattcaatctgtgaatttgtgatgttggagagttcatctcaaaagcaatatgcaaataggaaagaaaacaatgaaaaaaaggaaaaaacaccaaccaggactaaagatagatgttttgccctgattatttcaaccggggctaaagatgcccatctttagccctggattaggcgtcccggttgtatatgcggaactaaaggaggctgtgaaccggagctatatattattggccagaggaagtaatttattgcatgatgatcattgtcgaaacaatattttagcaataacaaaagggggtagcgcaggagacctaaaagtggggagataaggatttagacaggttcatgtcctctcgatgagaggtaataccctactcctgtttggggatttgaatttgccaggtgtgtattgatctgacgatctaaggtgctcatatgcccctagaggcctcctgcccaccttatataggatgggggcaggattacaagatagaaacattaaccaatacggcattggtttcctaaatctattatcaaaccaggactttaggccgttccgtaatatacgatgaaacgtaaaacccaagtcatgatccgttacatatttc

SEQ ID NO: 20673 - DNA, 466 bp, Oryza sativa
agggttttcctccaaaaaaatcctccctccgtcaccgcccgttctttcccgtttgccacgtcagcttgccgccctagaggtgggtggcaggggctatttctgcaattttttttggtcgatagattatttctgtaaatattaaaaaaaaatctaaaaccgaaaaaaattcgtctacaggccagtacagttatgtttttctttttactcttcttcagacgatcgatagattaacctgtgcaaatcgattcccacgtgcacaacttgcaaacgagttttcacttctcggtttctgcatgaacacgtctggtcgcctcaccgctgcttatcctctgcctgattatgcaagagatttgggcatttttctgacgttgttgcacgttgttgcgcgccgcgagctagctgttctcctctcggcgtgagggccacgtgaaaactcagccgcggcacggcacaaaaccgagcggaa

SEQ ID NO: 20674 - DNA, 218 bp, Oryza sativa
gtgtctcggtagattgatcgcaccaccaacatattcaaaaatttatcaacgcttctcctgtctcggtcggctgtacaaactccccccctcccgcggccccacgcacaaacacacgcatacggagcaagcaattccctgtcaatctctagtagtagtactcctgacctcttaaccccaggaagaaaaaaacagtcgagtagcgttaatatcttggcagt

SEQ ID NO: 20675 - DNA, 168 bp, Oryza sativa
aggggggcgccgccgccgtcgctttagagaggggatcgggggcgccggtcgctgctccgcgccgccgcagccgctcgaggaaggaggggggcgccgccgccgtcgtcgctcgggaggggggaaatgaatcctagggttagggttagggtttgggtgtatttatttagg

SEQ ID NO: 20676 - DNA, 1501 bp, Oryza sativa
ctatgtttagtaatttatatcttaacgatccatcttatcaatttagtatttcatatttttttaagtacaagtttaacgtacacacaacacaatcgtgcaatcgctcacatatctaccaggactcgttttgtgaagattttaaaaaaaatttatagctatttagattgcatgtatgcaattagggccatgtttagatttcaacttttttcaacaaatttctaacttttccgtcacatcgaatttttctacacacaaacttccaactttttcgtcacatcatttcaatttctttaaaattttaattttgacgtggaaatcacaacctaggtgtgtatatgtactttggtgaaatactttctgcaagcacgaaatcctatagacacagctagcatacgaatcataagattgaacagagctgatcgacaaaagaaataaagaacggggaactacgttctgccgcaaaggatgccgtggcagcatcagctttcaacggcaagtttttcccatcccgcggcagacagtcaaaacaacggcgggtcgacaagtcaatgtttttgacacgacgaacaccataaaactttaaaacgtgtttgagagttgacgaaagaaaaaaaaaacatacccagaaaataacacaactattagctatgattaattaaatattacaacaattcttttaaatttaaaatttaaaaatacaactttttaaaatttcttttgtaaaagaaaatatcgtttagtattttggtaagcgtgaggttgaaaaaagtaatttttttctctgtgttgttgctgaacgcaacctaagatagcattaaagaagtactcatgggacaaaactttaacgaagtaaaactgaataaaaggatgcaaagtgcaaaaactaaaaagagtatcagtgactaggatctaatttttcaagctgttttcttgaatttagatatatatataaaaaataacttatctttaattaagaactcaccaggccatgtactagttggttgtcctcatgcttaattaatttggttaatctcatctttaatttggccaaaaacttgcttgctactccatatcgttatcaaccataacgaatgagattaagcaaagcacgagggtcgttgttgaagctgagtacatatttgaccaaattttttaatgtttagtggcacgtacatatatacctacagatacatctctttggcatgcgcacagtgttgtttatagagagagagatgcgttctagcgggatcagcgtaattgttgtcgttcgccacctggcgtggctggtgctaattttgtgctcatggccgcgggttgcagctgctcaggctcaacaagcaccaaaaactgatccagtcgaaggtttgtattgagttgttttgtttttccccatataaatcgcaggagtatagtacacttcggttgatatatggtgtcctctcttgccgcattgacacgagaagagttggaggaaatttgattcattaatcgcctagttttt

SEQ ID NO: 20677 - DNA, 166 bp, Oryza sativa
aattagatctatcattgagcatgtgatatcaatataaataagagtatgaaattcctatagagtttttattggacaattatatttcatttgaagaaaaaaaatcatgtaatatattttctacagaaaaattttaggcttcgaataacataagattgtgaacaggtga

SEQ ID NO: 20678 - DNA, 1501 bp, Oryza sativa
tgcaagatttataagtgatcggctatgaataaatgattgtaagagggaatcaaggtgagtggtttacccttgaaaagtgagcaggggcagcaagagttggaggagtttgcttgggtaaagccaatggtgttttttctccggcatcactcaattcggataccgcctgatcaacattgtcacgcccagaaattcccgaatataattccaagcagaatgtgcattaaaatccccgtccaggaccggccggggtacacaaacgacaatgttgacattcagatccacgtcttacaaacatcataaaagtcttacaaaaatgcagcggaaaaacgaaagacaacaggagctaagccttgactagaactgcagcgggaacaccactccacaggcatcctcgacggcacggacgaagcctactcctcggagaaacctccatttgacacatactcatactctggggttgggaaaaatagagcaagactgagtactacccactgtactcagcaagtcataccggaataggggtatgatgcagggaattatcaaaggagagctagagtggttcatttgcataaagcgagcatttataaacagaagttgaaagatttaaacagttgtaataattaattaatattaactatccactgtccaacgctatcccacgttgcaacaggcccaaccatccacctatactatccaaattcaatagactaaactagggtgagactaatcacggtgaatctggttgaccgcccataaccgcgggcacggctattcgaatagttttactctgattagaggtgtacaactgtacccacaagacacagccccacgacacgtttccgtgtgctgacatgccaccacgacataccggaaagagtccgtgacaggacccttcgcataaccccctctaaccaagcacaccacaccttaggtttcactcccactcctcgcaaggcagcgggcagtcccctctcgtgcctaggtgaatccggaagcgacataggccgtcgcagggcccatccaaactccatcacgcccacccttgcctggatgcgtcggctagagaaaagctacagtacaagcccagccgttgcccacgctggcttgtggtaagtacgataagatcttctagggcatcccgtgaaccggtccttaactgccatgggtgcgaccagcaaaaccatgcacccacagcccaccatgtgatttattttaattagccaacaccaaagcggtggaacgaaaccaacaaaaccattagaaccaacagtctaaacattaattggattttccccgctgtgcactagttgaactaagcatggctaagcaacccctagtccaatctctagtcatgttataaccccaagctgacaaagggacatggtataacaatagcatggctatgacaataggtaaacaccccatagtaacattataaatcaatgcgatatttgaagaaaaacaatagagcatttgcaatataggatcaacatgttcaagt

SEQ ID NO: 20679 - DNA, 1501 bp, Oryza sativa
ttgaggtgatggttggactgccacacgcatgcgcgcgtgccgagtcggcctcggccgtgggcgtagcgagacgaggcggccgaccgagccgagcctgcctgctgctcttccgttttgtaacagacgagaataaagtcaccattaacaaatgaaattatttgtgttgtaacctccacaataaataagagattcattgtgttgtaacatccagaacaaatgagagatttatttgttgtaaccttcacaacaaatgaaagattcattgtgtggtaaccttcacaacaaatgagatttattttgtggtaaccttcacaataaatgagatttatttgtatggtaatggagatctctctctatatataaagcaaaacagaggctctcaaagattgtgtcttccttctgctattgtttcttggtgatactctccttatgttcctgtgatgtctctctgtttccccggttctgttcatcccgtgcacacaggtgatcggaacgagcaggtgcctccgaaactccgtccgcttgagaacctgcacgggtaggcgggcgatcatgtttttgggtagcgcttcaagcgcgactgctctgcatcatcttcaccaacatgtcgacaaccggcgacaacaacaacactggtgacaaggaggaggagcctcccgtcaacaccaacggaggcaatactgtctcaaactccagcggatggccattctcggtgtataacgtttcactattaccgttcgttcttcgtttcctataactgtaggtcgcaatattattgcgttctcttgtctatgttgatacttattctatattaagcatgctcatgttgtacacatctagcaatttcactagatctactcaaattacaaatgtcatatgtattatcttaatattttggattaaaatatgccgaattatgaccaaatttctaacaatagacacacacaaaagcatagaaatttgaggagagataaagactcaaataaaacttttcatgaggttctacctcttgttaaatttccttcaaaacttacattggaatgagacattccatatgaatttggtaggattcatagggtttattcctttgattcaaataattttatatagaaaatcctataaaaataaaattctctaaaatttctatgattttcctttgaatcaaagggcttaattttgtaaggttttgtaagaatgcaactttgttttgcacatgaatcatatatggaatatttataggtttcaaggaggccttaattaattagaacgagtgataacttcagataaatttcgcaggatctaacaaatatgcatgtatttgagcatttctaattaattgagatcctcgtataaaagctatttcaaggcttccgatttacatcgataccgaaaatcattgtgttattcctatgaaccgttaaacacctatgtggcagtgttttactaaccactggtctatgtgtacatgaacatcgaatatctactttcttttctatattct

SEQ ID NO: 20680 - DNA, 1501 bp, Oryza sativa
ttgtcctctttagcagaaaaatgaaaatagaatttaggattcttgttgtgtcattggagccgatgaaggacccgatgaagagaactagggatgagcatagatggtgccttcaaaatggtgctgcaataaatgttcataattgaagtcaacagttgggaaatcaagcttctccaaatttccaaatttgtagtacattttttattttgaattccatcctaaaatataagacacgatccattttttcccgtgtctcataatataaggcgtgcatgtatgcatacattaactatcaccttttaggccgcgttcgttacctcccgttcccaacttcgctccctcgtttttcgcacgcacactttttaaactgctaaacgatgcgttttttgtaaaaaaaaattctatacgaaagttgcttaaaaaatcatattaatccatttttcaaaaaattagcaaatacttaattaatcacccgctaatcattgctccgttttccgtgccagggagtgagggttcccaacccttactcccgaacgcagccttagatctataaatttggtttattttaaatcatgtaccatcaagtattccaatcatattgcttgcatatatggatgtgattcaatcgaggaggtgattaatcttttcttggtttttgtgttagaagtggttgagccttatattttgggatgaagggtgtagtacacttcatattgaaaattcataattggttattccatgttccaccaaaactcagctaaccgctggttgaaaatactactccatccattccattttgatcaccttaaaatttttgaggtcttccgaaaacagtcattatctaacaagggtctctttatttatttgtgcagagagtacatgtgcataattgaatgtattgcatgcatccaaccaaaattaatttctattgatgcaatggcatacagtatttaaaacatgagaaatccgcaggacacaaagcgatgaagcaccttaaccgaggaggattaatttaagaatgataaatatttttgggatccatagtcttggtgtcatttgcttatgggatgatcaaactggtatggagggagtattactaaacactagacacttagggtccgtttgatgcataggagttatcaaaaacatattcacatgaacttcgtaggagtcaattcatattatctagatttcaagtgcctgaaatttcccaaaaaaaaatcatatgccttttctaatccatacttatcaactatcactccccagtagtttgaaatctaacatagaaaatgtcgacgtttgatgtcgtgattccggtatttgcataatatggggatcgttggtactaggatatatgcgagactgaggtaaaagagatggggacgaggatttttatataggttcgggcccctgaattgtcaggtaataaccctactcctgttggccgaaaccagtcgttgctcttattcatcataatcacaccagtacaatatttggggtagcc

SEQ ID NO: 20681 - DNA, 1501 bp, Oryza sativa
agttcctggaagatggaggttttggtgtctagctcgtgcctgccgtcaagcgcctgtggtcgtcgccctagtcttccgctgtttttcgttgtctttgagtgtgctgggccgtcgctgcccatgtaataattaactatttacgcttccgcttgttaaactctgatttgtatcaactgttggtgtaccttgcctcctgggacaaggattaatgcacgcacgtaaggaacgcccgttgggttatttccggtcgtgacaagttggtatcagagcccccttgaccctaggacgagccttagatcccaagccttagcagtattttcgaaataaaaatcctttgttatttgtgaaaactgtctagtctctctctgtcttgctgcttcatttatcgccaaaatatgatctttaaaatgttgtttttctttttgtttttgtttgtagatggccggcagcgtcacccgtcgtggtttggacatgactggcttcgtcttggagctgcggggcatgtgcgtggtcctggggtatccgcatggagtggactaccaggccaggccgcttccgaagcaggagggtgacgatgcagagccccacgctgcttgggaggtcactgcagtgatcctcgctggctctcccgagcggacttcgctggcagtcaccgcgggtggagattctttccccgccgcttgccagaacgccgctctcctcgccatcggcactcttcaccagcgctacccggacgagttgcagcactcgccctaccgctaccaccctcaccgcggaggagcccgcgactacgccaccttccgggatgctagctcggaggacgacgctaccatcgtgcacctggcgcgcatggtggaggcgtacgacgcggctcgtatcgacttccatcagatggtgcgccgtgggatggtcgagaacaacctgaagatcctggagctgcgtcaggagaacctgcagctcaagaaggacctagacgcggtggaggcgcagctgcatcagctcaagatcgcccagggagaggtctgccgccccaagcgtcgccgtgtctgccgcagccagaagatcaccgcccgcaagagcacctccaggcccgagcttgttcgtcagtccctggcgtggacctgcttcgtggagacccctcgtgccgagcccgcgcctgtggttccccaggagggggaagcctccggcgttggtagcacggaggatgcgctgttgctcaccttccgccctggcccgtcgcagtggtagacgagcagttagtaggcttgcgcgtgtgttcttcctcgtttgtcttcttgttggagttgtgtggggcatggttaggccggtgtgtggcataactgtgtcggagcctgtctttattttatttgcctaagcaacttgaactttaatgaaccaatttaatagcagtaataaatttaagaattatggtagtcgtggatggttagccttaattgtcagctctctctgtttgctggttctgtgtggggttttcagatgg

SEQ ID NO: 20682 - DNA, 256 bp, Oryza sativa
tctcaatgatatataggacccacatgagtcaatgacatgtgggtcaggatagtatatcttaaattttgtaaaatttataatggcatggttccaattttcccaaatttaatttaaaagctaaggtaaggagtaggcatcgtgagagatatggtacgtaggcccatctggcctttctaccaaatcgccaaccacgcaccttgattccgtatcacgcgacctccagcggttgacacctgtgccgcttctctgtcgcagg

SEQ ID NO: 20683 - DNA, 483 bp, Oryza sativa
ccctaaaaagtccctttttccccccctccctctccctctctctcctctcccccgcggcccatccggccttcccccgcgcgcgcgccgctgacgggcgggcccgcccgccaccctcgctgacgggtggggcccacccgtcatcccctacctcgcgccgctcccgccgcctcgcccgtgccctagcgccgccgccgccgcggattccgccgcatcccgccgcccccgcgtgcaataaagagggggaaatcactccccgtgattccctctccctttccccccattttcccctctctctctcgcgttcaaacgggcggatttgcccccgcaaatctcgccggcgccattgatggagcccgagagcgccgcgccggtttccttctcctccggccgccctctctcactcccaaccctatataaaccatccccgtgcctccctcctccgtttccgccgctcgccgctctctctccccgtcggaatcgagc

SEQ ID NO: 20684 - DNA, 440 bp, Oryza sativa
taacatctgtgggggcaagaagctagaggagagttgcaagagcaagctcggaataaaccaaaggtcagtgagattatccaatgttttgtgtttaattctaccaagtgtttttttttcatttttttctcttttgcattctgtaatatggtactatcctattctagtttgtatcttttgatcggtagaaccatgtttctgaaaaactcttgttcccttttttcaacctctgaaacatgtgcaacaccagaactgtcttatggtcactttcactggtctgaattcaagctcacgatttggtggcgttgaatattattttttatttttattttttgttttggaaccagatggtgatattgaatggttctcgacctggtcaaaatttcgaaccctagctaagctaggtcgatctgaagcatgcattttgaacaccattttttttg

SEQ ID NO: 20685 - DNA, 656 bp, Oryza sativa
ctgattgtgagtatatcagaatgtcgtcaatgaaaaccacaacaaacttatccaagtattccatgaacactttgttcattaagttcatgaagaaggcaggtgcattggttaaaccgaacgacatcaccgtgaattcatacagtccgtatcgcgtggtgaatgcggtcttcggaatatcttcttcgcggatgcgcaactggtgatatccggaacgaagatcaatcttggagaataccgtggcacctttaagctgatcgaacaggtcatcgatccggggaagagggtacttgtttttgatggtgacttcattgagggctctgtagtcgacgcacctcctcttcgtcttgtccttcttctccacaaaaatcacaggagcgccccagggggaagtactcggacgtatataccccttctctttcaactcttccaactgtttcttaacttcggccagttcatttgctgccatacggtagggtcgcttgtacagaggagtggttcctggagcaagatctatccggaactcaatctctcgcttgggcggcataccgggtagttcttccggaaacacatctccgaactctctgacgatggggatttctgacagtcctatctgatgaagttctgaactactgacagaggttgggggtgcaaagaaa

SEQ ID NO: 20686 - DNA, 580 bp, Oryza sativa
tctcgagacacatgcgtcaaagttaccagccgaaatccatccatcaattctcggcacttctcattgtaaaccattaatgtatcattcttgcggtcgtttgcggtcgtcgccgaaggttcagaaggccgttctctctgggcaaggcaagtcacatcatccttgagcatattgaatcctagtttataaaattattttgatttaaattaatgcattatcgctttatttaaattcccgcattatcactgttttatttagccatgcctatttacctttgttatgaccttattattattgctattgtttattattaccttgttcaccctaggaaaataaaaccccaactagtgggtaatctattcatggttccactagtatgaatttaggtagatgctcgctgaataattaggcaacattaggtggttttataactttagactttggggatgctcatatcatttggacactgtggaatggttggcttgtgatggaattgaacacacacctcccccctctattcaaaactcccaaaatggttttaggctgggctcgaggtgcagggttttgctagtagcacctcggc

SEQ ID NO: 20687 - DNA, 1501 bp, Oryza sativa
atgctatttaaactgttaattttactacttgacttacatctttgggtggaaatgcttcgattccattattcacatgagcattaacagcctcaagcttcatggacaaaaactgcagataacagcaaattatagagcgattagctgagatatggagggtaaagaaatttcataaagcgccaatggtgaaacagcatacctcaacttgccgttgcaaagcctggatataattaattatctcatcaagtactgatgctttcccaataacctggccaagcaagcaaaagttttccaatgaaaatcaattacagaaacagaactggggatgttttagaggtcatgttacaaaaatataatatttaaaccccaacttatgggacaaaatgaggaaaatatgttgagaccttgttgcatccagggacaagatcctggagaattttcatccgctcacttattttctcacgacgtgcctgccaaaaatgaacagaattttcagtggtcatatcatagtataaacatgaaattgaccgtttgccccccaaaaaaaagaaagatcttcagaggttcgatttgtaaccagattttccactcctgtaatgggactgtgattgacaagaacggtaacaaaaacaagtacactaactgaccctttcggcaaggctatggctgtcagtagcttgaccccttcttgccctcacatggatgtagtcttgctttggtggttctggtggtggcggattttgatcaccagacttgctagcatttcttgaatcagtttcagcctctgttcttaaactgctattatctccacttgatttacttgccttgaaacgctttgcttctgaatcagtctgctcataaaaattccacataatccgtgcatatcaaaacatgatccatgcttttttttttctctttaaaggttaaaggggaaaaggcactgtatattgccttctgacctcaaaagttaaaacaaccactcaagttatcaacatgatcaataattggtgaatatatgaggcaaaaatcatagaaatgcaccaatagaatcaaagaactagaatgcctgacaatgatgacctccactaatattaagtgtgcatgttcaaattcaaattacaggcacctttggctactaaatgcaagcaaagaaatgctgattgcatcttgtatttgagctcatgcaatttctagggttatagatctgatggtgctgcagaatgcctcaattatacggtggaccatggaaccactcaggatccttgtctccagccaaaacattgtgtggaccaacaggttgttgactcagtagttagtactggagaatggagataataaatagaatttaatagtctgtctaacaacagcttttaaccagcgtgaacagatagcagcaactgttgcaatttagtcaaagacccaaaagctgttgcattgcaccagagttactaagcacttggcattcgacaaggatagttaagacgggtgttggccaatagcttga

SEQ ID NO: 20688 - DNA, 471 bp, Oryza sativa
gcatcatccccctccccctcctccccccgtcgctgctgccgcccccgcggcggcgttgcggccgccatcgccgccgttgcggccgccatcgccgccgggacacgtcgccgggtgccggatcggccgccgccgcgagatcaggggtgggtcaagggctcgccgcggaatgggcaggtggcgccgtggccgcggcaaccattgggggcgaggagggcaaggagagaggagaggaaaggagtagagagagagagagagagaggaggaggagaggggagaagagagaagggggaaaagggcaacaaggagatttcgcgtgggggcaaaacagactgcgaaacggaacggagacgcatctgcgatacaggggtaggatggtaaattcgtggcgtgcggtttgcggggttttcgggaggttcagttctggttgtgcagttttgctccagattcatccaccctgttctttcgcttaga

SEQ ID NO: 20689 - DNA, 756 bp, Oryza sativa
agtatgggcctcacgtgtgtcacaatctcgatccggccttccggcccatctatcacggtccacaccttcgccgcattcccgtttcggcccaactagtacgggcccgcacgtgcgaagaagcctaagcctatgggcgaaaaggcccacacaacgtgggcgccacttcacgacgtggtgggcagccggaacggcggttcgtccgccgccagttcgccggagcaccgccgcggtcctaccatccttccttccgtcggatccatctactacggccggagatctcaaccagccacctacctgtatggatgcttctagtagagtctctcctaccgatctgcccgcccctgcccccccacgggcaccgtcgccgtcggcgggcggcaatcagggaggcaacgcgtcggcgaatgcgagcgctactcaaggtattcacctatgcaggtggaattctggctcgaatttgatattgcgtcaagctcgcccaagtcaaaagcccctctccccaacttgcagttgttttactgcggcctccagcggtcgccgctcctgcggttttccgccatcccgggcgcgcgatgccgtgggccggcgagggcggcgacacgttgtttcgagaaatcgatgctgtatataaacgattcttcagagattggctgtggaaacaagagccatttgatcttggattgggaaggtcaggttgcaagttcagttccattaccagaatcgctgctactagttgctagaccatggagatgcgtc

SEQ ID NO: 20690 - DNA, 1501 bp, Oryza sativa
tggagcatctgaccagtttaggggaggtgagatgcacacaagacgacagttcatgtctcagcatgcaatgcaatgcatgatttgtttgtttaatggcctcttatttacatctttccagcagttcgcaagcaaattaaacttcctaagcacacccttactgaatgaacaggaggattgtaggttccctgcctgaaggtctgaaactgacggtttgcacaacgggagggtgaaaatgggatggctacccgcccatctgttaagctgtgtgtgcaatttacccttatcaaatatatatgaaaatatattttaaatccacctacaaacgtgatgaaagattggttaatcgttattttacaagctcataagtaatattacatttttttcctcgatgtatattttttaatgcctaatcgcttctctagatttgttatctatgaattagagatacaaataaatatccatttccgaatccgattccgaagaaaaaatatgagatataatacgagttatatgctatccgatactatccgtacctaattctaactttgaaggaatatgcgtatcgggatgctgggatctaaccatacttggactaatttcacctctatgcacaattacgaatttttcaagttgtttaagaatttataagaaccattaacatacttgtacgttgtaatagaccaaattcatataattgtgaataagctagaagggtgattggagataaagtattggattcgatggttactcacgtgaaccttacggacacactcatatattgcacgaactgtccaagttgaatgttctattacttgatccagcaattcagaacacgaatatgtgattattacaaaaaaaaataaaagagataaggtttttgttatgaagcgcttgatttatacagcctcgtagtaaaactgttaccaaaattttggcacacggtagacaactcgtatctagatccggctcctctgcctttagactcaaaaggtagagaggtacacagcaaaaatatgtcttgttctacagtagttcgttcgtttgttgtgaatcgaacggctaaaaatacttccaaagtcagagcagtagagctctcagatgatccaaatccctcgcataccacccccggcacgtccatagacttttgagacatatttgtacttcctaggccgagttgctgagttatgatctgctcccaaccggaagcggcccatctggcggcccaacccgctccgcattacgcatttgcactcaacgcagcgcgacgcggcgtgtcgcgcacaacacaacgacagcgcgcgcattccacctcctccacgcctgcacgaacgtactgtactccactactgctgcgtcgcactgtgcattccaccgatacggaggccacgtcgccgtccacctccgaaagctagtagtattactgttactgcgcgcgcatttacacccaccacttgctctcatttactccccttcacctgcccaccctctccctcctctcctc

SEQ ID NO: 20691 - DNA, 1501 bp, Oryza sativa
aggaacatggggtgtgtcctcctcacgtggaaggcttcaccagatgaggtttcaagccttttgatcgatatagtttcctctggattgcttgtggaattacttctacatcgtagtataatatagaacacaatttattgttcacagctgggctgagctcagttgagagtgtcatgctctgttacacaggaaaacatggaacaagcttatgtgcaatcgttcatccatgtgactttcatattatagaatttctcattcaaccataagtagtgtttgacctttagtatttataaaacctggagtattagattgtcggttttctattgttaacataatggtttcactatatccaagttgattctgggtgctgtttttgacaaggactacttctatagtgtttgcacctttgtaatgttctcaacttttgtcaaaagaaagaacattataagacattcatattatagtactagttgttagcacccagtagtgctgtagtttgcatctatagtgaatttcctatcatgacattttgatttttgttgcttggtaatgcttgttatgtttgattcactggagtgttggtagcatatgaactcaactctcaagctaacatactactatactagtttatttttcccacaaaaatctaaaaaattttacctctagaagaaatggaactagttttttttgaactacccatcgatgtgaatatggcatagagcttgatatttttcttctatacataactgtagccaacactcaacactcgacattatgttactgctggaatcttcttggagctgtttatatttgatcaagctattggccaacacccgtcttaactatccttgtcgaatgccaagtgcttagtaactctggtgcaatgcaacagcttttgggtctttgactaaattgcaacagttgctgctatctgttcacgctggttaaaagctgttgttagacagactattaaattctatttattatctccattctccagtactaactactgagtcaacaacctgttggtccacacaatgttttggctggagacaaggatcctgagtggttccatggtccaccgtataattgaggcattctgcagcaccatcagatctataaccctagaaattgcatgagctcaaatacaagatgcaatcagcatttctttgcttgcatttagtagccaaaggtgcctgtaatttgaatttgaacatgcacacttaatattagtggaggtcatcattgtcaggcattctagttctttgattctattggtgcatttctatgatttttgcctcatatattcaccaattattgatcatgttgataacttgagtggttgttttaacttttgaggtcagaaggcaatatacagtgccttttcccctttaacctttaaagagaaaaaaaaaagcatggatcatgttttgatatgcacggattatgtggaatttttatgagcagactgattcagaagcaaagcgtttcaaggcaagtaaat

SEQ ID NO: 20692 - DNA, 1501 bp, Oryza sativa
cagcgtcatctattaaacaaatggtcaaagtattactatagcatcgtgggctcggggccgtctttctacatctctttggacggcgtttgggtgacggggccggcacgcacatggtgtgtgtgtcatcctcgcccatttcgcggcgtgatgaggctgcgaaaagcgtgcctcgatcccttcttctgttgctgctgtccaatctgatctgcagagatctggatggatggatgtgtgttggtacatcggttgggacacgggaaagatgaagatcagttcaacgtgcaagtgtacaaaatccaaaatggtagtggtggtggacgtttctctcttgtccggaatcacccaacattagggtgccatggccggacatgattggcgctgtcaagcaaacaaactgtgctgaaaaaaatataaaatgccacaacgtgtttaactgtttatattgcctggagaaaataggattcctgtggataatttttgaggcatttcgtggtgtgtactaagagtgatgccttggatattcggtgtgtatggaatgagtgttcagatcctcgttagcaaatgcactgtgatgatataggcttgacaacaactcgacgaaaaacagacaaggtcctagtactatttcgtatgctacggtttttcctgttcctatggaaaattaaattgttctatatgaaatttatatgagtaaactttaactagaatttgagagacacgaatctttcacaagatgtgaacgcgaccaccgaacaattatagctcctaagtgatttcacgacaaaaaccgacataattaaaaaagtaatgttactatgttaatttttttattaaaagaattgaccgatttattgaacactttttaaatacataattttttatgatccttaatactccatatgatctctttcttttgttgtgtgggtgtatgttttggttatgtgcattttagctatgcagagatagaaagtgttctcggagtaattttatcaccttaatataattgattgagatcaataaggtttttattaactttaagaaaatatagaattttgaaacccggctttctaagagacatggtgttgcatgtgacatgagtagatgctcaacgctaacacgccatatgtcctcttgatagacacattcacggtccatcgcacttgaagcacacattaattccgcccgatttcatctgccgacgatacaacaacaacaagccactttcccacttgatgccgatcgagctactccttaaataaataaaccccctccaactcgcaaatccccaattgcaatttggatctttagttctttattcaaagaaaaaaaaacagcttccaaatcatttcccctcctcgtctcctccagctagaatccgcggcctcctagatccactccgatcgcagcctagggttcgccttcgccatggccgcctccaccgcctcatggtcgcgctacggcaccgtcccgccggcggcggcggcggcggcgcctcccctga

SEQ ID NO: 20693 - DNA, 899 bp, Oryza sativa
aacgcgccgtactgcgctgcatgcagcgtgacacgcttgaccagactgcaataaatgctgttaggtgagcacagctgtgctcacttatcccatatatgtggcgcagacttccttaagggggtcggggtgcctcggccctcggggccggggcaagcgcaacccgaccccccctcgggggaaatcaggaggagggcggacacctcaccctcgggcccgacgtccccgaaggtgccaggccacgtgggcgattgtgtctgcctcaagcctctagtcatgatactcccggtcccatatcaccgacagtagcccccggcgttatgccagagcaatttcccttcccaagggaagcggtcaggtgtgacgccaccctgtgacaggtgggaccggtctccgtagttgggcaaaatacccaacggtctcaatccatgcacattggtattggtaactttggttgtccataatgggcggtctattcaagactgccacaccacttgagcagcgcgcgaatctgggtgagcagattcgtctcgcccggagatatggtaacgccgcttcggtcggcgagcgtaattaacgcgcgcacgatacaatccatttcgattgccacaaccgcatatccactcaatgcgccgtaagcgggcgaatgggattagtggaagcgtgggcacgggaaacgagggagcgagatagcgagatacgagggagcgaggtagtgggcgcgagaaacgaggagtcaggcccagcgatggcaagggtataaaagcatcgagaaaaggatttgcttccttcctttcgccattgttcctcttgccttcgccacctgagctctaactctttctctgctacgccctactttcgccacacgcgctcgttctcaatcatctcttcctccgccgcca

SEQ ID NO: 20694 - DNA, 1501 bp, Oryza sativa
atgctcatcagtgttggccctagggttcccttaccgtttttggcgtggttattggacccccacggcaaggtggttatcgcgaaaccgcgcggtaaccccgagagataccgtggttttaaaaactgaaaaggttaccgtgcatggtaatcgcgcggttttgtgtggctccctgatagtggtgagcctagggacaatgactaccaatgggggttctacacctagatttgactgagtgatgatgggacagtattgtctttacggcgtgttggtgtggacaatgatggtggtggtacaggtgatggccctaggagcagtggctactagtggaaacttttcatccatatctgactgtgtgacggtgagggtgatgactattgtggcggtgcttttcggcatggtagtggcaatgaccctaggggcagtggctgctaaatcgtcggtttataggcctaaatcgaaccatgtggattgggaggtggctctagctagtacgacaatgacaagcttggtggctgtgctagtggcaactggagaggaaggatccaacctaaagtcagacccgacgctcttttaatgagcaagacgaggagcggacatagggcttgttggaggtgctggcaacggttaggaagcgatgctgaatttgagacctaaacagggtttacaaaaccgcgcagttatcgcggttaccatgcacggtaatcttttcaatttttaaaaccacggtttatctcgtggttaccacgccaaaaatggtaagaggaacctagcatccatttccacgccattcacatccatgccagatttggaacgatggtctacacatgaattctacctggactgcactgtttcatataaaaatccacttatccataatatactattttgcatacataccatagtcaagagattgaatctgctggtattgtgaaaccagggtcgcaactttcttttctgcaagtaaccggattggatgttaatccatccatttacacagtattttaaagtacggaatctagctgacgcaaccgtccagtgcacaaagcaaaccatgcaattcgtcttcttttttcaaatagaaaagcaaaatgtcaacacaacgccgctgaccacgagcggcagcgttcactctgggcccgagtctgcaggcttgcagcggaaggcctcgttacagcgtcgaaatgggccaggccaggccgggccggaacacgtgggcctagcccactcaaacagcccttgacgcgcaccaccaaccactatataagcttccgagagctcttcccccaaaccctaaccgccgccgccgccgtctcctcctcctcatccaagcagctcgcgcctccgacccctcgcctcgagctccagctctccccaaccccttcaacaatggtgagtcgccgcctctcccgcaaccctagccgcgtgtcggcgcgttcgctcgtgatgcctgacgccgcgcgtggtggtgttttttttttttttgggtggtggtggtaggcgg

SEQ ID NO: 20695 - DNA, 1501 bp, Oryza sativa
gatttatatcttttacatttacataaaatttttgaataagatgaatggtcaaacatgtgaaaaaaagtcaacggcgtcatctattaaaaaatggagggagtactgctcctttcgtccaaaaatataatactccatctgttctaaattaatgatctctttaagatttatcacaatagagtaatacttgttccctcaatcacttttaattcaaaaatttctcttttctaccctcaatcatcctctcacatccaaccacacataatttaacaaaggacggtataatttctttcttaaaccttaatccatactaaacactttagaacgacatctaacatggaacgaggtagtacttatttttctcatcaaaactaaggagtaattaacccatctaccatgtaacaaaagcaatgaacggtagtattgtatacacatgtatcatgtatgtaatcaataagtagtagtaaaataacttcttgggttccaatcaacaatttaatttagcacataaaaattacaaatatatcttaaacttttgaaaaaaccaagaaataaaatagatattgtacttttggatagagagattaacaaaccatgcaaaacgtgccgagatcgcttgtcattttttttggttcaaaaggctgcctcgacttgttcgccgctgatacttcaaattttggggtatttatcgtgattttctaatctcaattacaagctcacacgtctagccatacatagtgatatacttaatactccctccgtaggaacatataagtactcatagagattaaggatgaaaagaaaaaaaatacgatgtctcttttaaaactatagggtttgggaaagttgggcgatgattgatggtaagattatttagtaaaaaaataaaatagaaggtaggtggtaggtgaagtaatacctataaatatttgtattcgccgttaaatattaaaacctctaaaatgtcaaaatgcttatatttaaaatcagggtagtctaacaagaaaatgtcgtctagtaggccagccgaaaaccctaggtgtttctcaaattgagacacattccaagttaacatatgagcttcactattcgaatcctgaacttgatactattcgaatcctgaacttgatgacaaaaatcaacaaaccctagagaatttgaccttacattaatctactggacttcttcaaattgttaaccacttcaagacaatcagaaacaaccttacgccgtcggaatccagagtctaaagccgacgaaattgcctcattgcaagccaaatcaggattcagtgaacttatttgcatgaaagccaaatttgggcctttttgcttgcctgcgttttattgggctccaaattttctacagcacatctccaagcctctcaggccttttctggccaacgctcaaatctcggcctaatctctaaaagatgggccgtaatttcggccttccaaaacgacctcgaagtttattgaacagaaagttgaaagttaaggtccgt

SEQ ID NO: 20696 - DNA, 1501 bp, Oryza sativa
tacataaaatttaggtgagtgatagcagcactgatacaatgaacctttgcaataattggcatagaagatccaaaacctcatagctggggagacaatgtggaggcgacctgtcacaccacacccttagctctaacatcggatgcttctacctgacaattcggctggtcaaccgttggcctcacagcagctcacctctcgattggccggtttttccagagtgatcaagcattttaatgccgctgtttggttgggtccacgacgtgtttggtagagtgctctacttctaaattctaatcaccaacaactaaccgatgtactcctacattagtagtacacatatagcagtgacgattagtgatcagtgagtgcctactaattaacaaaaggattcaatcctgcactgctataaaatgagagctgcaaaaataatctccatcaggatacattattacagagtagtagaaaaaactgacaagaatcctttgacttaagtcactatataactttaagtctttaagtcactaacatataagcctagctaatttactttagtcgcatgtgtcactgactaaaagacgtatgtgatagaagtattagtatataatgatttttctacagtagtgttgtctaacataatcatcttaagagagataataaaaaccttagatgatggtgtatcttctttgattagcacgaaaggcagcccttcatgcatgtaagcaaaagggtagctaatgcatctgtatcatgatatcttgataccaaatccaattagcgctttatctttctccaagtaaatcaggtttcgagatcatcttgtagagcttacagatgaagtctcataaagcaggatttgagatttccaaacgaagagtggtttaatatcatattaatagtttaattatcatgtactctatatgtcagcacgcgtacgtgtgtctggcattaggcgccgccgtaggcctttcacgccgaccgaattagccgcaaaattaaggataccaaaagtgctttcgatatgtaacgtgctgtcactaagggagtattagccattggctaagcatttttcttccgttgactagtgactactaggattaataaagggtcaatttagcagagctctagcttcagctctacctctcttgtagttagctcaaccaatagtttcagcatcactgattggaagcggagctagagagtgatctcacaaaaataatgaagttgtgttttaactgctccacgactccactctaaaccagcttttcaagttaaatttagagttgaagttctgtcaaacaaacctgatctggctactgctaggcctgtggttgggttggaggcctggacagaggtgacggcctaacgggccagttgcttggtgggctgggagatgatgtgtaaagatggctttgccaatggatggtctggactgggccatttgttctgaaccttttctttagatttagattgccttggtcgttaggcgttacaggcttacagc

SEQ ID NO: 20697 - DNA, 510 bp, Oryza sativa
ctagctaattagatcgtgctatatactaattggtgttagactttgctctaggatcacctaggttagatctagtcgggtggttctatttgggtttgatgaacgacattgtagatgaaagggagagggtttagataccgaccggttgaggagttcgtggaggaagaggcgccagacatcgtcgttgtcgtcgcggcttgacgtggatgcggcgccggtgaggtcgacggtgatgacggctgcggcagtggtggtcgtagacgtcccggcgatgaggcgtggcgcggcggtggcgtttcccgtcactggctgcgccccctctcgatcggattagggttttgtggggtggagttggcggcggcggtgaatctcgtacgatgtgccgtgccggcctccacccctcttttatatggcgcagtgtgacgggggcccaccagccattgggctgggcgcccccgatcagggcgcggtcaaggcccccttgagccgttgggctcaaggggagagagatct

SEQ ID NO: 20698 - DNA, 313 bp, Oryza sativa
acgtttctcccaaatcgtagttatctacaattcaccgaaagatcgggccaacaacagccttgagtgtctcgagtggagctcagggttcatcaggtggtatcagagctttcgttactcggtgagtttttgtctacctataactagaaaaagctaaaaaaaagttgcatccatcacctagccatatttgtgctattgcattgttcttttcagtttttgctctgttgaatttgtgttgcatcgtcgagtcgtgttgctggtcttagcgtttagtccgtttagagtttcgagttctggtcacgtttagtaccactgt

SEQ ID NO: 20699 - DNA, 1501 bp, Oryza sativa
ttggtgtctggtgcttcattcactcgggagcttgaggtacccatgtcctgacttctgaccttattgcctttctcattgtcagccatctgttgcaaggtttggagagggagagagggaaaacaaaggggagagacagatcaaaaactaaggataggaccttaacagatctaagtcttttgctgttatgatgtatgttaggcttattctgcaagttgattaagcaaacaacctagcatggttacatcacaccccactgatgcaaaccacgtgctacacacacaagcaaggaaacacacgactatcgaaaccctagagggtggcttaggttctacgacgggttctctaagatcttcactcctgcttcacatctagcttcactgcttccttcgcttcgctagcggaccctgcggtcttccggagcttcggcaaacaattggcgacatctttttcttcgcaaaactaaccatctagtactagttgaaaatctgaaggaggaagaagagaataaacattttgcaaatagcattagggaaaggaggaaaaaggaactttcgcaaatagtttcatttataaaatatgtccttaggttttatccacttggcttatcctacagtcgagatggctctgataccaccttgtcacgaccgagaaaatttgcattttcccgaacgctagtgtattaattcccgtcccaggaaaagccggggtacaccacacaaacatgatataaaagacacatctttattataaagataatatttacattattacaaaggcacctcaggcttgacaaacaaaaaaaaacagcagcggactagcgggcctacggctccatcttcacaggcgctcaactggggtataagccaggacaccacctaagacttcttctccaaagcttctcttactgaagtgggggaaagattgagcaagaatgagtacaaccaccgtactcagcaagccacatcggcagatgcatgattaatgcaaggggggtacaaggggataataataggggttaggttttgctgtaaacagcatttataagtcacttagttgcccaaatctattttgtaaacacgatccaagagctacacaatattattaatcaaggccgtgaacccacatgaacctgccttaacccaaggcctacgatgattcagactgaactggcaacccgacctgggtcccagctagtctcaagccaacccaggccaacctttccacattttagttattaagcaaattttaagaattaaaccactaacttgggtacattgctaggcttgcccatatctgagggctcggctattcgaatagatttactctgatcagaggtgtacatctttacccacaagacacatctttactccgcattccatgggcatggaacccgtcgtaaacatgtgacataacccttcacccatcctagccgtgtagtcttcatttgcctagacatctcgattaccgagccgcagctcgcgtagcctttatttggctcaga

SEQ ID NO: 20700 - DNA, 1501 bp, Oryza sativa
gaagagaataaacattttgcaaatagcattagggaaaggaggaaaaaggaactttcgcaaatagtttcatttataaaatatgtccttaggttttatccacttggcttatcctacagtcgagatggctctgataccaccttgtcacgaccgagaaaatttgcattttcccgaacgctagtgtattaattcccgtcccaggaaaagccggggtacaccacacaaacatgatataaaagacacatctttattataaagataatatttacattattacaaaggcacctcaggcttgacaaacaaaaaaaaacagcagcggactagcgggcctacggctccatcttcacaggcgctcaactggggtataagccaggacaccacctaagacttcttctccaaagcttctcttactgaagtgggggaaagattgagcaagaatgagtacaaccaccgtactcagcaagccacatcggcagatgcatgattaatgcaaggggggtacaaggggataataataggggttaggttttgctgtaaacagcatttataagtcacttagttgcccaaatctattttgtaaacacgatccaagagctacacaatattattaatcaaggccgtgaacccacatgaacctgccttaacccaaggcctacgatgattcagactgaactggcaacccgacctgggtcccagctagtctcaagccaacccaggccaacctttccacattttagttattaagcaaattttaagaattaaaccactaacttgggtacattgctaggcttgcccatatctgagggctcggctattcgaatagatttactctgatcagaggtgtacatctttacccacaagacacatctttactccgcattccatgggcatggaacccgtcgtaaacatgtgacataacccttcacccatcctagccgtgtagtcttcatttgcctagacatctcgattaccgagccgcagctcgcgtagcctttatttggctcagagatatccatcgtcgcaacgacttcatccatctctatccatgtccttttgttcaggactagactgagcaccaagttaagccttacccattagacatgtggttagtacggtagtgctttgcaacagaggcccaaagaccggtccttatagtggccgaggtgctactagcaaaaccctgcacctcgagcccagcctaaaaccattttgggagttttgaatagaggggggaggtgtgtgttcaattccatcacaagccaaccattccacagtgtccaaatgatatgagcatccccaaagtctaaagttataaaaccacctaatgttgcctaattattcagcgagcatctacctaaattcatactagtggaaccatgaatagattacccactagttggggttttattttcctagggtgaacaaggtaataataaacaatagcaataataataaggtcataacaaaggtaaataggcatggctaaataaaacagtgataatgc

SEQ ID NO: 20701 - DNA, 1427 bp, Oryza sativa
taacgaagagataattctcacaagataaatctaaattactcagaaataatattatattgaattcagagtaataaacataataaaagaaatgagagaagattaccgacaactccgaaattcttccgacttcttctactctactctcttcctattctagtatacaatatagtacaatagagcctcttataattcagctcaagcttgaaagtgtgtatgtgaagtgagggagtgatgtctttatataggggtaggtatgacagttagcgaaggggaaatgtctgaagtgccctccaaccgtcatcagggatgcatctgggacgtccacgccaaaccccacatccaacggtggagatggtggttcggccgaaccagggggttcggcaaaacctgggctgggcccccaggcctggctcttgacccatcttctcccctggtccacctctatctattcctcaggattttgggatgattctcgggaattttgatgaagtttagatcccatccttgtatggatacatatttctccccactttagtctagatttcctcccaactttagggtttatcacctgcatacaaatacaaaccaacacttgtggaatatctgagattaagcatctatccctatacacacccaacccactattggtgcgatgtttttggtgaacttttgtcaataaatgccattattagcacacgtgggtgcgatgtttttgaccgccatgaaaaaatttaaaaagcaccaaaacatgatttttggacatattggagtgtattaggtgtgttcgtggcaaaaaatcactccgtgattcgcacggcgaacttttgtcaattaatgccattattggcatacgtgggtgcgatgattttgaccggcatgaaaaagtttaaaaagcaccaaaacatgatttttggacatgttggagtatattgggtgcattagtggcaaaaaaaatcacttcgtaattcgcgtggggaacattattcaattaatgccagtattggcacacctaggtgcgatgtttttgaccagaatgaaaaagttcaaaaagcaccaaaacatgatttttggacatattggaatgtattgggtgtgttcgtggcaaaaaaatcactccgtgattcgcccggcgaacttttgtgaataaatgacattattggcacacgtgggtgcgatgtttttgaccggcatgaaaaagttcaaaaagcaccaaaacatgatttttggacatattggagtgtattgggtgtgttcgtggcaaaatatcacaacatgattcgtgcggcgaacttgatgtgaccatggctactacggatacaaccattgctcacaccatggatgaacaaggagatatcaagatcgtgtcctcctattgatgtaaaaacacgaggcctgggagatctgcttaactccagttgatgtgacca

SEQ ID NO: 20702 - DNA, 678 bp, Oryza sativa
actcatggctgcggcatcatcttagttataatttctcctcgaggggcaagttttgagtttgcttatactattaaaccctacgcgaccaataattaggctgaatatgaagcagttctcaaggggttgcaattattgaaggaagttgaagccgatgctattgagataatgggtgattcattgttggtgatcaatcagttggcaggggaatatgaattcaaaaatgatgtgctactgatgtacaatgagaagtgccaagaactgatgaatagttttcggttggtaaatttgaagcatgtctctcgggagcagaacgttgaagctaatgatttggctcagggggcatcaggatacaagccgatggtacaagacattgaagttgaagttgctgcaattacagccgatgattggagatacgatgtgttccagtatttaaatgatccttctcaatcggcttcacggaaattgaggtataaagctttgaaatatgccttgttagatggtgagttatattatcggacgattgatggggtattgcttcgatgtttgagtaccgatcaagccaaggttgtgatggagaagtgcatgaaggtatctgtggcactcatcaatcggcttataaaatgaggtgtactgggtatttttggccgacgatgttagaggattgcttatgataggctc

SEQ ID NO: 20703 - DNA, 175 bp, Oryza sativa
aatgtaagtaggtactatatactcgaaaagtattccataccattaatgtattagaagagtattgtaataaaagtacaaagcttacaaaagagaaaggaaagctactagagccaaacccgaactcttctgaaggcttccggactcctgattcctattctaattctattccaccagc

SEQ ID NO: 20704 - DNA, 1501 bp, Oryza sativa
acaagcatcttcaattcgtcttcaggaacttctccaacgaacgaacgatcctccgaaataacggaaaactaaacctagaacgcaaaacaagaaaaaacactaataaaaacccaaataaacagtacaattaaagttcataaataggtagagcttgaatttagatgaattatgagacttgaacgacctcattccgagttcgtatgaattagatatgaattttacaggatttaattccatttaaacctattaaagaaaagactattccaaattgattaaacaatttataaatgacttatagctgagacaaaagattaaaaccggaaatagattagatcatatttggtagatgacatatattaaaaaggaataatatgccattgaaaagagagaacggatttatatcgcttttggacggctgagattaatctcgaccgagtcgaccaagatcggatggcttggattgacacacggtagcggcacaacagcggttgcggtggcacacctacagcagcagcgcgacggcgacgtacagcgactaaatagcgacgcagcggcaacaaggcagctagcacagcggcggtgcacaggacagccggcaagcgacacggcaacagctgcgctagggttagagcaacagcggcggtgacacgaccgagggatctaaacctaacccgaggggacacgaatagaaatctcaccaaaccaaagggacaggagagggagggtcgacgatgacgatccggcgacaacacacggatacgatgacgacgctagggccaaacaacagattagattagattagattagattaaatccctagggataaactacaccggtaaatgacatgggagagaggaaagctcaccggataagatgacagcgacgaccaagacgacgacggcgaagggtgacggctagcggcagcggcggctagggtgttggaggaggcggctaaacaggaggaggaggaggctaggggcggctgaaaaaaaaacagaaaaaagatggggagggaggaaaacgatacgggaggaggggttgcctagaaaggaaaggtgggggagacagatgcggtgcctttttgggaaaggaaaatgaaacggaaccagaaagagagtaggactcggctcgtcatacaaaacgaaaccgtggcggaaagaggtcggcggatacaacaaaccgcagacagggagagtgaactgggaatgattcacaaccaaaggaggaaaaagaaagaattattaattacttttccaattaaattaatcactgaatgatctttcatttattaaaaatacttccaatgctcaaataattctgggaaaaatccttaaaatacttggacattaaaaatatttaatacaattttatctatatcaacttaatgttcaaaattttcatagattttattcacacacttgctttaattattaagtaatttctaaaaatttctttttcacaatgatttataatttagcgatttttcagggtgtgacaccca

SEQ ID NO: 20705 - DNA, 338 bp, Oryza sativa
tatgaggatgagtagtaatgcttatgtgtcaaactacccttggattatcttaacccctgcttagaatacgattatcacaagtaatatgtatgttattagttgagttctctctacatgatctttccacgggataaaataaatacgataccctttgaatactctcgtgtgaaataatacaatggtatatccgtgctcttgtggatgaactctgtaaccataatataccagaagtattgatgcgtcattgctgtgaattatatttctagtaatgtccttacgaaataccaacagtaataattttaatattatcgatataataaagatgtgtctttttatca

SEQ ID NO: 20706 - DNA, 1501 bp, Oryza sativa
gcggcgcgacgacgacgacgaggcggcgccgccgactccgcgtgcacgcgctggatctcaagcatctcctactctcttttttctccatagctgctacgacagcaaagtggtgtggttgtgatgttgaattactggcttccagtctcttgacgatttctctcaagcttgagttgaatccccagccaaaccgctggtggtggctgctattgctaatgttctggtagttgaggttgttgcggtactaatttctccatgtcgatatagccagtgcttgagttcttgctctcttcttgctttgatctcactcggctgattttcctagagattgtttctatggctataactagtactactgcagttgttacttgttttgatttctacgaccaaaatgacttggccgctcggacggcggcgggcgccacgacgacgacgacgagacggcgccgccggctccgcgtgcatgcgtgctggccggcagtggctggtcgaggcgaccgggcggccgtggctggtcgcagcggcggcgcccgtggcgattttcgctttttttatttttgggttttttttagttccgtgcgggcaatataatttgaccgcacgggataatcgattatcccgtgcagcccaattaacccgaccgcacaggaaaatgattatcccgtgcggttgggctgcccgcacacaaaaatattgatttttccagatgttttggtatagacggacaaatcttccgcacaggaaatttattttgaccgcacgggataatgctgtttgtagcagtgatcttcgaagactgggccgacaaatccttgagtttgacgaagtcattacaggcgcctcaccgtttctctttattccaacaatttaattttgatttcatataaaaaatacaatttaccctgattttgggttttgatattgccggatgagtttccatcagttattctttgaaaaagtaccatggatgttttctcctaatcaagctgccctccctcaggaacacaacacgagtattgaagtcaatggcattgggacatgcatccccctccttgcaaagtattgcaatttaattttctcatctaatattattagagcattgtgcaatgcacatgtatttctattttgacttaagttatagctagcatttttatatgtacccagtgccttttaaatctcttatcatcaaatttgcaaacataagttttatactgattcctcgcagcaatctagtaatatataacccgttgcacgcatgttgctagtatttataacaagaggaaatgcttaccttatacacttcatctaatatatacagaaccgatataccaaagcaactagtatatcacatgatacttttcctgaggcacaacatattcccagtgaagtgatgtcatgccagaattcacacaatccaaaaatgtaacacccccatggctgacagctttcttatacaccaaatgaaaatatatttttcttcatgtgagacggttgctgaaataag

SEQ ID NO: 20707 - DNA, 1501 bp, Oryza sativa
tggtgtgtgcctgtgaactcgcagaccaggtgaagatgtgagggaacccagtttttgtcacaaatacggcgttcttccatgaaaccagcttggtgaggccttaactgatcgtcgggtatcattcacattttttggtgaggccttaactgatctctgaaactacagaccgctatctaaagccaatgcatctgtaaattgttgtataatttgagagcgcttgacaaactccccgcagaccaatgttggattagcagttaacacgaacttttacgggtttgatgtgtgtgttcacgattgtttttcatctgcaacgcatgcatgggattccccctctcgtcctacaacggcacacccggacgaaggaactacccgtgtggccgtaactgcatcctccggcctgagagagagagagagagagagagagagagagagagagagagcccgctagagtaacatgtgcgaaaagacctgcaccattcggttaatacaatttccaaatcatagaaataaaaagttaaatgattcggataggacatggacttcaatcattaagaatttattattttgtacaagagatcttaaaaattatatgaaatactccatccgtcctaaaatgaataaaactagtactacaaatttagaacggtactaggttttaggtcctttttaagttcccaaataaaaattttcactctgtcacaaaatgtttggacacatgcttggagtattaaatatagaaaaaaaactaaattgcgagaagaatcttttaagaccatttgctccatgatttgacaatgtgatgctataataaatatttgctaatgacggattaattaggcttaataaattcgtttcgcagtttacaggcagaatatataatttgtttttttattagtttatgtttaatacttcaaattaatctacgtttaatacttcaaatgtgtttccgtatatccaatgttacacactgaaaactttttacctctggaactaatcagggctttagtttatttaagtttgagatggggagggtaaggttataataggattacaatgtaagtttacaaggctacaatctttgaaatttgataggagctatttctccggaacgaacgaagcatatatggaaaaatcgtaatttttcaatactacgatatgtaatattttgaaaattcttttaaacctaatgagccccgtattgttaccgtggcagcctggcagggtgcaaggcaaccaccggcgtccagggcacaccgccgcttcgcgacgaccgccatcggcaaccgctcgctgtcgctgcagtagactagcgcggacgctccctccctccctccatcccaatccgtccccttcacttcactcccattcccatttcctctcgctcccaccaagaccaaccaaacccctgtttctccctcaaaacctccctctctttcccccccgaatgctcgagcgctgcgcggcggaatcccctactcccctccgatgaggccctcgccgc

SEQ ID NO: 20708 - DNA, 1501 bp, Oryza sativa
aattggaaggattcctgtgtcgcgagctcggattctcctccttggcaatggatgtgtagggtttgggggatcggtgtatttgtagccggtggggagttcgattcggagtccgattcggacaaggatgatcttgctcttaccagccgcggcgcgtggacgccacgggaattttcccgggtgtcatgggcaaaaatctgggaataatgtccgattcgaggcccattatccagctcggcccacgaagacacgaggcccattcgatctctcgtcttccccctacaaggcccaccaaagtccatcaaagtccacgcctcgctcggcttgggctcgctatcgcgttgagtcgagtctgagccaccgccggaggagaggaggggggccgagcggcggaggcgcgcaagggtttgggagccgccgccggcgaccttggccggagcgcaaaagactgaggaggcgtggtcggggcttgcctgctgccggcggccggcgaccggcgaccaacggccaggacaggtctaaaattttactgcctcacttgaatatttcgattactgaatctgcagagaggaagcgtattattccctctttttagctggatcgagtgggttaaagcaattacgatagtaaaaaagagaggagggttaggatgcagtttttaggggatcgaatacactgtggaacagaatgctgcattttgctctatctgtttattactagtacttgttgaaggatggaattgtaggttttcccctttataaattggatagaggacttatgcggattaccatatgttgaattattgtgcaagattttttttgttaattgttcaaaaccattgaaatattgggtgcctctaatagtggaggatagatcattctgttacaggcaggtcttctgtaggcttaggtttgggggtcctctactttgttctgggcttgtggctgtgtagtaatgctagttgctaggtgcctgaccatatgcttatcaccttagaagaaaagctgcttcaattctaaattctaacaaggtaattagtggtaaatcatacttattccattcaaagggctgtgaccttttgaagtcactcggtctgagatgaaaacccagagaaatattatgaatgaatcctgacctgttctgagaacaacatcagcctttgttttgggatgtacttaagaggaaagcaaatttttggcctttagatttaattctgttctatcatctatctgatgacaaatcaacttagtatgattttcttttatttgcagctgtcctcaaatccatccctacattccaccaatgtatttaagctgttgaccacttgcacttgcacttgctctctgcctaaaatttgatgtataggctttatataagatggtatattgataataaactactgtttactaatcaactactaggctcctagcatgctttgatgtgtatttgccggcacccctatcaacatgcttgtgacacttttatttaatgttaacccgtttct

SEQ ID NO: 20709 - DNA, 888 bp, Oryza sativa
gaagagaatgggccggcggcccattcgaaaaataaaaaggggaaaaaggaaaagaaaaagggggaaaagaattttcatgggattaaatattgcttgtgctcatttttaattgattaaaattatttctagagctctgaaaattccactaaaaatcttgttagcatatttcgacacgtagaactcaagaaaattccacatgccaattccgattattatttgcattaattttgacggagcgtggggctcctcaccgggagaccgcgtaggcccccctttgccggttcggccgggggcgctaagtgaggttcttcgccctcgatctgaggaacgtcagcgagagaggaaacgcacaagatacgggcgacgtagacaggttcgggccgctgagaagcgtaacaccctactcctgtgttctggtggatctgtgtgtgatggaatacagagagctcgagagcgagagagagtttaggctctagaacccatccgtccccctcctctcctaggcctgggcctcctttttatctggtcaggggtcaccacatgggcctctcactgcctaagaaaggaaacatgctttttacaatgagggctcgtctacagccggaagtgacctctgacaagcagagcacacgccttctgccctgctcgtccgctttccccggtggacgcccatttcaaccttcatttaatggccagcgacttccttgccatacttgcgctgaagcctggaatggatctgaccgggactgacataccaactccaggagttagcacgccggcttcggctagggacgagagccaagaagctctcatcattctgacgggacggggcgaggcgtgtgacaggccgcctgttgccacctaacccgcgatctgaccggtctgtga

SEQ ID NO: 20710 - DNA, 361 bp, Oryza sativa
taggtatgacggttggcgaaggggaaatgtccgaagtgcgctccaaccgccatcagggagtgatctagagcgttcacgccaaaccctagcctgaatgtctgagattttggttcggccgaacctgggctgggcccatctggcctggtctttggcccatctcctcccctcattctcctttatccatttatcagtattttgggctgatttgctgacattttgatgaagttcacaacctattcttgtatggatacagaattctcctcactttagtctagatttcctcccaacatcagggtttatcacctgcatacaaatatacaccaacattgtggaatatgtaagatttaagcacctaccacta

SEQ ID NO: 20711 - DNA, 1501 bp, Oryza sativa
aggaatttgatgatacccggaatacccatcaaggaaacagaaaaaggaatgatttgccagccgttccaacatttcatcaatgaagggtagcgggaaatgatcctttttgtagccttgttgagcttcctgtagtcgatgcacatcctccatccggttatggttcgttgcggattaagttcgtttcgagcatttgcaatgaccgtcattcctccctattttggcacaacctggactgggctaacccactcactatatggtacaggataaataatcccggcatgcaggactttcaagacctctttctttacaacctctcgcattgcattattgagctgtcgttgaagttccctggagggagtactctcgtggtcaatatgaatacgatgggtgcaaagcgcaggattaatccccctgaggtcttgaagcgagtagccaagaacagaacgatgcttttccaacacgatgagaagacgttgagtctcgtcttcagagagcttgtcattgattatgacaggggcctctttgtcattgtgtaggaaaacataacgtaggcctggaggtagaggttttagctcaagcggaggtcgaggtggtggttcctgatccgcttcctctttgatgaaatcggggacctcatcttccagaagggcctcaggagactcatgagggggaactgcagtaacctcttccgctgactcaatttctgggagagggtcggtcaaggcaatccttgcccgtgagaatggaattgaaaattcattctctcccagtgttattttgaggctatctaatcggggtgtgttgatgagaagttgctcaatgggcagcccaatgaagatgtcaaaatcttggatttcaaacacgtggaaattcaagatcgcctccctgtcttcaaagcagacaggcacatcttgtacaatcctgaatccttcaatgatatttccgttcggatgtttgaagaatttgtttgtcggggtcatgtcacaccctaaaaatcctaaatatataaattgttgtttaattggaattattagaattgattttaaaagcctagaagagaagatctaatttttaaataataaattccaatataaaattgggccagataaaattttattaaatactttacttgattctatagttcctagatttttctgggatttatttgagccaaggaagaatttttaataaatggaattgcatttcatgaataatttaaattgaaaaaggttttaaaagttctcttttggctttgggccgaaagtcggcccaaaacctctgtctctctccctcggcccagtcggcccagtcagctcgcagcctcccgtgcgcgcgccctcggccgctgacaggtgggtcccacctgtcggactcgtcgtccacttgcagccgccgcgccgaaaccctagccgccgccgccgcctttccaaattcgctcgcccctttctcgatccggtgaaatcaattgaggggaaatgtttcccgagatcttctctacctt

SEQ ID NO: 20712 - DNA, 1501 bp, Oryza sativa
aacaaattgataatagagtacgaacacacagctatttaatattcgcaaataataatttattacagaggtggatagttcctctcaaagaataacattctacgcagcggaaaaataacagcaaactacggaatagctatggcgactccactccacaggcaacttaacccggatcaagcctagtcctccagatcatcaccttcactgaagtactcctcctctgatgaatgaatattacaagaataagcatatgacatactcaacaagccacacagcaaacatggaagtgcacaggataacaaaggatggcataataaagctcatttgcataaacatcatttaataaatatttaagagaatagtaaaacagttgaataattaagcagtattaaataaacaccatacaacacacccgtgttgcataggcccaacctcatctgaacaaccaaccccggttgtacaaatcaaacctctataccaggaatataccattccaaaccaggagtcacattaattagcacaaataccattaatgagtagcgtgagactaatcacgaaaaacattgcccaactcgcgcataaccgcgggcacggctatttttatagttttactctgatcagaggtgtaccattgtacccacaagacacaatcccacaacatgtcaccatgcgcctcagcaccaccacggtacctcggaaaggaactgtgacattaccccttgcacaacacaactcaccacaatgcaccgttcctagatcataatctccccgtcaaaaccagaggcaatggactccccagcgacctccacggacttctcgccgtttcacagtctggcacaccataatgaatcatgctatacaaaagataaagccgttgcccacgctggcttgtggttggcacggtaaatgtttcacaacagtagctcgcgaaccagtccttaattgtcatgagcacaaccatcaaaaccatatgctcacaacccacctttaaccatgttttaattatcaattaattaactttacacgattaaccatcgtgagctaccattaaatataaccataaataataatgtagtatatatgatccatcccattaattagctaatgtttctaagcatggctaagcaactatacttatagcatttagctgaaccaatccaatatataaggtccaagctaatcaaattgtaacccataggaaaataaagtcatcttcggccattaattatctgggaaaggctcaccacccgatgacattcgaaaataatgcatggcttcacgaaaattgcgctataaagctttgaaatacaccttgttggatgatgaattgtattatcggacgattgatggggtattgcttaaatgtttgagtgcctatcaagccaaggttgcgataggcgtggtatatgtggcactcatgaatcggcttataagatgaagtggttgcttcggcgggtaggatatttttggccgacaatgttggaagattgcttccgatattaca

SEQ ID NO: 20713 - DNA, 320 bp, Oryza sativa
aataaccaaaccattccatagtatccagatgatatgaatatttcccaaggtctatagttgaaaaaccacctaatgttacctaattaaattgcgaagcatctacctaaaactaaactagtggtgccatgagtagagtgtccactagttgaggttttgtttattctagggtgaacaaggtaataataacaataacaataataataaggtcataacaaaggtaaataggcatggctaaataaaacagtgataatgcgggaatttaaataaagcgataatgcattaatttaaatcaaaataattttataaactaggattcaata

SEQ ID NO: 20714 - DNA, 1501 bp, Oryza sativa
ttttggtggcaatccttcggaaaggagtattaaacgtggagttgacaatcggcagcaaaactattcctactacgttttttgtcatcgatgggaagggttcctatagtctgttgcttggaagggattggattcatgtgaattgttgtatttcttctaccatgcaccattgtttaattcaatggcaaggtgacaagatacagatcgcaccagccgacaggtcagttaatgttgctagtgccgatttagctatttgggggatggatggatttgactgactgtctggaaaagtttgggaaggaggttatttaaaagtgtttgattgtgatatacaaccaattgaagatggagagcctaaattgttactttgagggtgtcgtggagggttcaaatttctacaccaaaggcacattagatgatctcgatggcaagttaggacagggtttcatgtcggctgatgatttggaagaagttgatataggtctaggggatagaccaaggtcgacatttatcagtaagaatttatccgcggaattcaaaaccaagttaatagagcttttgaaagaatatagagattgctttgctggggaatattttgaaatgcccgggcacagccgatcgattattgaacatcggcttcctatcaaccaggatattggccataccaacaaccacccaggagatgcaaagccgatatatatgatgctatcaaagctgaaattactcgtttgtatgatgctggctttattcggccatgccgatatgctgagttggtttccaatatagttctagtcatcaagaaagaatggcaagcttagggtttgtattgactttcggaatttaagcaaggctacccctatggatgagtactgttgggacacccaatttaggtttggtgccccaaaaatccactcgtgatcgtccaggatttcgatcacgcacagattgatatacagaacaactttcgattaattatacaaatttgttcatacaaactaattatacaactattaatgctttaaagatccaaactattacaaccttatttgaaagtgcaaagaaaaacccaaagctagtaaacttcataggcataagcttgatgtaaaaacacgaggcctgggagatctgcttaactccagtgcaggtccaaaacttgcctttgggtgtatgagtgtgccagttgatttgatcctggaatcaacaagaagcaaaaacaaagaaaccgcagttaaatctataaacgatagtcatcggctaggtgccgatgacatatcatttatctttgggccgatgtcatatgtgaatcgatcggcaatcatgaataagtaagaacgaactaaatctactcgatcggttgtagatattaacaatatataatcctgatgtcgacatatacttaaatcaagtgattgggatagatcggttcccatgccgagacagtataaatcacttagatcgaaatatatattaacaatgagactatatatgtccatagcgtagccga

SEQ ID NO: 20715 - DNA, 1173 bp, Oryza sativa
ccatgacaagccatccgataggaccacaatgctttggccaacctagtgtgtcattgccgaggataatcagagatctttctcttaatgaacttaatcaaactcttattagatgcctcggcttgcccattagcttgtgcataatatggcgaagaattcaacaatttaatacccatgctatcggcaaactgaacaaactcatcggacacaaaaatcgagcctcgattggttgtaatggtctgaggaataccaaatcgataaataatatgcttttgaacaaattgtatagcatcccctgaatcaactttcttcaaaggaatcgcttctacccagttggtaaagtaatcggttgccaccaatataaacttgtgtcccttgctcgatggtggattaatcattccgatcatatcaattccccaacctctgaatggccacggtttgatgatatgattcataaccgatgctggcgctctttgaatcgctccaaacttctgacaatcttaacatcccttgtaatatcggaagcaatcttccaacattgtcggccaaaaatatcctacccgccgaagcaaccacttcatcttataagccgattcatgagtgccacatataccacgcctatcgcaaccttggcttgataggcactcaaacatttaagcaataccccatcaatcgtccgataatacaattcatcatccaacaaggtgtatttcaaagctttatagcgcaattttcgtgaagccatgcattattttcgaatgtcatcgggtggtgagcctttcccagataattaatggccgaagatgactttattttcctatgggttacaatttgattagcttggaccttatatattggattggttcagctaaatgctataagtatagttgcttagccatgcttagaaacattagctaattaatgggatggatcatatatactacattattatttatggttatatttaatggtagctcacgatggttaatcgtgtaaagttaattaattgataattaaaacatggttaaaggtgggttgtgagcatatggttttgatggttgtgctcatgacaattaaggactggttcgcgagctactgttgtgaaacatttaccgtgccaaccacaagccagcgtgggcaacggctttatcttttgtatagcatgattcattatgg

SEQ ID NO: 20716 - DNA, 672 bp, Oryza sativa
ttctgaaattcataactaattcatccgatctccgtttaaggccattcaagtctcagtaaatcaagaaaaatgtgtagaatccattaaaattggttttgttctctgtttcagtagtcttatagcttttttgtattgtttgctttgtatgtcgcttaaattccggctctcccgacgctccggtgtactttgaaatagtcgccgaggttcctccagtcgcagagcaaggcaagtcatgcttgtcacttgaacatgttgatcctatattgcaaatgttctactgtttttcttcaaattctgcattgttttacaataatactatgggatgtttacctactgttatagccatgctatttcttttggtaccatgctcctttgttagcttggggaatgacatgactagatattggactagggattgcttagccatgcttagttcaactagcacacaatgggggaaatcatattaatgtatagacttcaggttctagtgttgatgttggatcagtaccaccgtcctggtgttgcttaattaaaataaatcctatggtgggctgtgggtgcatggttttgctagtcgcgcccatggcacttaccacaagccagcgtgggcaacggctgggcttgtagtgtagttttcctctagccgacgcatccaggcaagggtgggcgtga

SEQ ID NO: 20717 - DNA, 1373 bp, Oryza sativa
tttatggctaggatgggttgggaactatgtcacgtctttcgtccgtatgccgtggtggtatgtggcacgtggttacacgtgaggaagatgtgtcttgtgggtaaagctgtacacctctgatcagagtataacctattcgaatagccgcgccctcggttatgggcaagcctagcaatgtacccaagttagtgttttaattcttaaaacctgcttaacaactgaaatgtggaatggttggcctgggttggcttgggacgagctgggacccagggtcgggttgccagttcggtctgaatcatcgtaggccttgggttaaggcaggttcgtgagggttcacggccttgattaataacactgtgtagctctaggatcgtctttataaaatggctttgggcaactaagtgtcttttaaatgctgtttactgcaaaacttaacccctatattattaccctttgtacccccttgcattaatcatgcatctgctggtgtggcttgctgagtactgtggttgtactcattcttgctctatctttcccccccttcagtaagagaagctttggagaagaagtcttaggtggagtcctggcttataccccagttaagcgcctctgaagatggagccgtaggcccgctagtccgctgctgtttatttttgattgtcaggccttaagtgcctttgtagtaatataaatattatcgatataataaagatgtgccttttgtatcatgtttgtgtagtgtaccccggcttttcctgggacgggaattaatacactagcgttcgggaaaatgcaaattttctcggtcgcgacaagctggtatcagagccatctcgactgtacgataagccaagtggataaaacctaaggacatattttataaatgaaactatttgcgaaagttcctttttcctcctttccctaatgctatttgcaaaatgtttattctcttcttcctccttcggattttcgactagtactagatggtcagctttgcgaagaaaaagatgtcgccaattgtttgccaaagctccggaagaccgcaggatccgctagcgaagtggaagaagcagtgaagatcttgggaaccagtcgcagaacctaggccgtcctctagggtagtgttgttagtcgtgtgtttccttgcttgtgtgtgtagcgcgtggtttgcatcggtgggttgtgatgtaaccatgctaggttgtttgcttaatcaacttgcagaataagcaaaacaaacaacacatcaacaaaaagagttagttcctttaaggtcctgtccctagttccggtctattctttccttgtatgcttcctctctcaacctctaccttgtgacagatggataacactggtaacaaaggctatgggaa

SEQ ID NO: 20718 - DNA, 177 bp, Oryza sativa
ttccactaaaatttatgtactcattttaggcttttatgaaatctacaaaaatcctccaagccgtattcgacttttaactttgcccagtctaattgtgggcacgctttcacatggatttttacttattctatgcataatttcgaggatgtatttgagagttgttttgggactcgacac

SEQ ID NO: 20719 - DNA, 935 bp, Oryza sativa
tcatgatggcttgcgttctgagggattagtgcttctatctttatgatactctaatcttgtttatgtaaatcgtcaagttatcatatatgctttataatctttatcagtttcacaacctaacctgcaatcggttgatacttatctttggagagtagccgatagagttagcatatctaccatcttttagaagttttcatcatcttgcctagatctttatttattcttatgcttattgctgcatcggttgggttcgatctattaagtaatattcataactacaatatctagcttgttttatgatcatcaatagagatagtatcggggttttagccgattttacctgatttagctactttattccctatatgcttacctgatatgctaaatctacactttatattaagatcttgttgcattaaagtatattaggcttgttgtttgatatattttgtctgttttaatatcttaatatgaagtggtatcggagtattagccgatacatgttagatctatttgatcggctatgctataaatgtatatataatcttcatcttaaagtacttttaagtataagtgatttatactgtctcgactttctgttcgatctatcccaatcacttagctcaaatatatttcgagaaaaagattatatatcattaatatcaacagccgatcgagtagatccaactttatattgcttcattctttattgccgatccaatgccaataacatcggctcaatatttgacgttatgtcatcggcccctagccgatcggctatcgtttatggatttaaccttggtttctttgtttttctttcttgttgattacaggatcaaatcaactagcacgcctttgaatccaagagcaagatttaggacctacactggagttaagcagatctcctaggccagtgtgtgtttttcgcatcaaca

SEQ ID NO: 20720 - DNA, 1501 bp, Oryza sativa
gttttctaataaaagtacaaagcttacaaaagaggaaagggaagctactagagccatacccaaactcttctaaaggctttcggactcctgattcctattctaattctattccaccagctagatactactaaactaaacttgagaggaatgagagagctcttgcttgaggtgtgtgttgaagtgaagagagtgagcttcttaaataggcaggtaatgacggttatggcggttggaaaggtcggtaatacccttcaaccgccataggttgtgaatctccaccgttccctcaaaaccctgcatccatcggcttcacgggaggtttggccgaaccaccaggttcggccgaacctggggccagcccaaccagcccacattttcgctggtggcctcctctgctgctttactttgtagacttgtgaattttggtctgattcgtcgtgtcaattctgagttcttggcccattcatacataagtctggacttcgacatcgttcgattgatttatcatttaagttgatgtcgattctccttcattttattgtcattctctgcaaaaggttagtaaacccaatactagtggaatattattattctaacatatttatgcattgcaagcatcactagttctcctctattttggtaatattgacggtcgaaactaatcaataacgaccgtcaacaattacaaaggcgcttcaggcctgacaatcaaaaataaaaagcatcggactagcgggtctacggctccatcttcacaggcgctcaactggggtataagccaggactctacctaggacttcttctccaaagcttctcttactgaagggggggaaagatagagcaagaatgagtacaaccacagtactcagcaagtcacaccggaagatgcatgattaatgcaagggggtacaaggagtgataatatagtgttaggttttgcagtaaaacactatattattaatcaaggccgtgaacccacacgaacctgtcttaacccaaggcctacgatgattcagaccgaactggcaatccgacctgggtcccagctcatcccaagccaacccaggccaaccattctacattttagttgttaagcaagttttaagaattaaaccactaacttgggtacattgataggcttgcccataaccgagggcgcggctattcgaatagatttactctaatcagaggtgtacatctttacccacaagacacatctttactccgcattccatggccttggaacccgtcgtaaacatgtgacataacccttcacccatcctagtcgtgaacaaaagtactgacccaaccctgcctacagccggtatcccggacaggcaggccaggattgagcccctagcaacaggatctagaccaggtgcgccacacacataggggtgagaccacccgcgtactagtcctgtgccatggcatctcaactaatggacaccggcccatgtagccttcatttgcctagacatctcaattaccgagacgcagt

SEQ ID NO: 20721 - DNA, 1492 bp, Oryza sativa
agaatagtggaaagtaaaccgaatgtaaagaaagtgaatccgagttgcttgttcgtgagagccattcccagttatgaaacaagtgatatgttcaaggaaaatctacagaggtcagattaaaatcacatccaacaacgaagcttcagatttggcaggataacgatcagacaataacaagttcagcagtaaagtcatttgggaagacgtcaaagcatgtcaagtgggataagttggttcccttgggaaacataattcaaaggcaaagttatcgaccctcacattgaatagaggaaatatctagaaccggagaccaggaaagctaatatgagacagttagtggcaacttgtcaatcatggtattcttagtaagcgggatatcatagtctaaagcatatggtggtaagctggaaggaaacgccaagcgtggtattctcccgatggcaagcatggtatcctagtaatgacaagctgatatcggtgcataacgtgaagtgggtaacttgtatgaggttgacgccaaagatatgaattatgagaagttctggaactgaagccctgtcttcaagtaccgcatcccagtcgaagttagctcaaggtgcaaccaaggacaagtcaggtgaaaagaagattccatctgcaacaggagatcaagccaagcagttcagagtggggaagttttgctaggcaagtttgttataaaagacgcgacgaaagaagtcagacaagaagagaagaccgcccaaccaatcttcttgttagcctcctcgaatctcggggacgagattcctgtaaggggggtggttttgtcacgtcctgagaaattcatcccgaaacaaaaatcattttctaaaaggaataatagaattaattaaaattcgaaaagaaattggcaaacactaaaatacgtacaagaaaaattcgaatgtcgcccggagaatttttgttaaattctccttggtctaaaatgagccctcaaattttacttgaattttcagagcaccggaaatatttattaagcaacaacaacaattatcaaagtttattaaaaagaaaaacctaaaaataatcctccttcctcctttgggccccctctctctctctccctcggcccgcggaccaagtcctctcttcctccctctctttctctccctctccttctctccctccttctcttgggcctccccttcccctcccggcccattcccttttcctcccctcccgcctgggccgcctcccggcccaagctgccccacccagccgccccagcctcctgagccgccccccctcacgcgcgctgaccgcgcgccccgcatgggtcccacgcgccgggttgtcgtcctgctcccgcccggcctccttcctctctctcccgtgaaccctagctcctttcctccctcaaatctgtgcgatttactcatgggattccaaaattaaatagggggaattaatccccattgattcctctttgattccccccaatttcccccttgat

SEQ ID NO: 20722 - DNA, 1501 bp, Oryza sativa
gaactccgtctcttaagaataaatctctcatcggctaaaggatcgtattaagttttggtgttactagaaaaattgcctatcgttgcaacgggtgaaggctattttaattttattattgttatacggtctagttaaggtgaaatttactgtgagaatttgctttgatatattattttctagaaaatcatgaactgcaattaggagttcgatcatcgcttggatatattattttgtagaaaatcataagctacaattaggagtccgataaatctaagttaacatgcaagtttttctaaaaagatatttcttatacgactcctcctgtatttccaaaagcgaacaaacttaaaactcgactcaaatacatatttgaatttccaaaagtaaacgaacttaaaaaccgactcatacacggaggacgtaccaaagtattgataaaaacatcttcaacttttataatagtagagataaaaggctatagctaacttttttagaagaaaaaaaatagagcaggtttcagatggagtaaattcatatttttaaacccacttagatagtaagggcctgtttagttggcaaaaatttttgcccctgcatatcacatcggatatacagacatacatttaaagtattaaacgtagtctaataacaaaataaattacagattccgctaggaatctgagacgaatttatcaagcctaattaatccgtcattagcaaatgtttaatgtagcaccacattgtcaaatcatggcgtcattaggcttaaaagattcgtctcgcaatttcccagcgaattatataattggtttttctctatatttaatagtccatgcatatgtccaaacatttcgatgtgacagcgtgaaaaattttatttgggaactaaagaggcctaaattcgtttttgggcctgtttagttcgtgaaaagaaaaatttttgagtgtcacatcggacgtttgaccggatgtcggaacgagttttcagacacgaatgaaaagcctattgcataactcgcctggaaaccgcgagacgatgtgagttactatagcacttatagctaatcatggactaattaggctcaaaagattcgtctcacgatttcccccctaattgtgtaattagttttttaatgtatctatatttaatactttatacatgtgtccaaagattcgatgtgatattttgggaaaaagtttttgaaactaacagggcctttaccgacaagtcagcccaccccagacccagttcggccgtcaactcatctgatccagatcgaatcatcgaaccacttcggaaaacagaaaaaaaagaggaaaaaaccgatcataaaaaaacactcgaagaacacaaacactcgccccgatccaaacccgagaggggacaagcccacgcgcgagaggcgagatccaaccccaaccccaacccgagccaccagaggccgaccagatccacccccgcagccagcgaagacggcggccacggcggcggtcaggatgc

SEQ ID NO: 20723 - DNA, 338 bp, Oryza sativa
aagtgtgtgcatgtgctgcctcatgcccatcagcacctgtgcatgcgtgtgtgtggagaggcagcatacgcaaaacgccgactggctagctactcctcccgctcctgcgtttgcagcagcagcgtttgcactgtactactactactggctggcttagctgctccgaccaggtaaacagtaactatatcgggcaaaatctttcccggccatttctggtgttgtagtagtaatttctaacgccaagccagcaaaagaagaaaaagaaaaagaaaaaaatcattgctctagctccatctccatatactacgtgtggcctactgggttgtgtggtctgtaga

SEQ ID NO: 20724 - DNA, 1501 bp, Oryza sativa
tttgtaggagtagagtttttttttatcaataatgtgtagtatttgagtaatgtacttatttattggaaaaattagacatgttgttagcttttgaagtattggtattgcaatggtaattacatattattttcaagtaattaatgtttatgcatgggttaaaaattgtagatggatagattggtccggcttcattatggtggttgtgtggtagatgaaagtacacatggaagccaatttgagggaatgacagttagacaattagtgttttttgcgaagcctacctttgaggagttaatgtctcgcatcaagcatgaattggattggaatgatgagtcggttggtatgcaagggagatacgatgtgggcggcggtgtcatgtcacataaatttatgttagacttgaatggagagatcgaatggcaaacatatatagatatagtattggggtcacatttcaaatctcttgaggtgtttgcatggaagaaagatggtaggatagggaagaaagaacttatagaccttaatgaaagtccactcatagaatcacccattagctgtcacgaactgtcggagaggtgtagtaggaaggaagaattgattgaggaagacgtggaggggggcgagggagtaaatgatatggcggatgtggaggtcagggaagagaatgacccggtaagggaggaagtacatgcagaggagaatgtgccgttaagggaagaagtacatgcagaggacaatgtgccgttaagggaggaagttaatgtggaggagaatgtgccggtaagagaggaaggagatgttgaggatggtcgggaggtaggagatgatgtggagttgcctgaggaagaagcgaatgctaagaatgtaagtatgggcctaagggagttggctaggctgaaattctatacccgagaggagtgtgaggaggctatgatacgcagtggattgaacccaggctggttggagtatgatacagaggatgaattggatgagtccgcttccgactccgatgatgatcgtccagtgcgtaagatgtcagagcatgaaaggactgtgtttgcgaaactggtgggtagaaacccggaaataacacaattcgaggatcttaccagatctgggctagcaattgctgatggggatccacaatatgacggtgccttcgaaccaatgtgtgatgaaccaaggaaggggttggagtttcgatcgatggatgatctgaaaatatggctacagagttattctatccgtgtccaccggccgtaccatgtgaaggaatctaacgcgtcagtaaagtatactgtggcttgtctcgatcgccattgcaaatggcagattaatgcaaggaagagtggaggagataggtggcgggtgactagggtgggcgaagaccacacatgctgtagtgcggaagtaaccggcaagcatttgcaacttacttcaaggtttattggaaacaggttacaggcatttgtgcgagctgaaccaactttatctccagcag

SEQ ID NO: 20725 - DNA, 1501 bp, Oryza sativa
cgggggtggatctggtcggcctctggtggctcgggttggggttggggttggatctcgcctctcgcgcgtgggcttgtcccctctcgggtttggatcggggcgagtgtttgtgttcttcgagtgtttttttatgatcggttttttcctcttttttttctgttttccgaagtggttcgatgattcgatctggatcagatgagttgacggccgaactgggtctggggtgggctgacttgtcggtaaaggccctgttagtttcaaaaactttttcccaaaatatcacatcgaatctttggacacatgtataaagtattaaatatagatacattaaaaaactaattacacaattaggggggaaatcgtgagacgaatcttttgagcctaattagtccatgattagctataagtgctatagtaactcacatcgtctcgcggtttccaggcgagttatgcaataggcttttcattcgtgtctgaaaactcgttccgacatccggtcaaacgtccgatgtgacactcaaaaatttttcttttcacgaactaaacaggcccaaaaacgaatttaggcctctttagttcccaaataaaatttttcacgctgtcacatcgaaatgtttggacatatgcatggactattaaatatagagaaaaaccaattatataattcgctgggaaattgcgagacgaatcttttaagcctaatgacgccatgatttgacaatgtggtgctacattaaacatttgctaatgacggattaattaggcttgataaattcgtctcagattcctagcggaatctgtaatttattttgttattagactacgtttaatactttaaatgtatgtctgtatatccgatgtgatatgcaggggcaaaaatttttgccaactaaacaggcccttactatctaagtgggtttaaaaatatgaatttactccatctgaaacctgctctattttttttcttctaaaaaagttagctatagccttttatctctactattataaaagttgaagatgtttttatcaatactttggtacgtcctccgtgtatgagtcggtttttaagttcgtttacttttggaaattcaaatatgtatttgagtcgagttttaagtttgttcgcttttggaaatacaggaggagtcgtataagaaatatctttttagaaaaacttgcatgttaacttagatttatcggactcctaattgtagcttatgattttctacaaaataatatatccaagcgatgatcgaactcctaattgcagttcatgattttctagaaaataatatatcaaagcaaattctcacagtaaatttcaccttaactagaccgtataacaataataaaattaaaatagccttcacccgttgcaacgataggcaatttttctagtaacaccaaaacttaatacgatcctttagccgatgagagatttattcttaagagacggagttcaaaaataatttaataacttttttttatctttagaaagttt

SEQ ID NO: 20726 - DNA, 1501 bp, Oryza sativa
caaccggagaggaattcggcctatttggtattttggtctagctagctctgcaattcgagtgagataacaaaacggcctacatgtggtgggctgggctctgggtaagtgctgcttgacttgtgaatagctatgtgggctgacgacaagtggactacgcactttgacagaaataaaaatggaaaaagtccaatctggctcctaattataggtcgaatcaatttttcctgaccacttaaggtgcacacgtcttttttttcatcaaagagaaccgtcctcaaaacagtaagttgttttgtatgactttaatagtttgaggagtcattataaccggttttacagttgaaagataaaaaaagatccgatctatatttgaggtgtcgaattggatctatttttttattaaataaaaggaaaattatgacttgtttggcgtatgaacatatggctatctttcttgcatctaacctttagcaaaagagtgcgtggttagccacaaaactgtgaccacatcttacaagaaattagcagatcatttttatatgattgaataccaagttatatttaaagtataaaatacttgagtataacttttgcttttttttccacgtatatgtagtactgtagttatttaactattttgtatatacaatgatgttgatcaatacacaccttataatcttcactcaccagtcaccgctaccaaacttcgcatatcttctctttttctttatctccaatcaacatcaacacctattcaccatctcttatacagttatactgtaactaatctactcaactcaatcaaacggatggcatgccatacgtgtgagagctaaatgtagacttctgcataaaacccaatggcgtttttaacactgaatgtctatataaaatatttttaaaacttacaccttagaaatttaaaactgaattctatattaatttttttaacctactccctccttcctaaaatgatcattatatatatttatataccaagaccaatgataatttaaattacatcaatcaagataccatgcacatattttgccacaatacatgcaacaattaaaacaccatgccaattacaccttagcatccacacattctctcgtgctgtattattgtattctgatgaaatccgtatccatatggctatatgatgatcaatttaagaaattttgaattctattatatgatgatcaattttgaaggagggaataataattacgtccacattactccagctatatagaagaatacaactttacagcgctagggtaggaaaattgttctatgacatagagtaggtaattaatgttgccgccggcttgccgccctataaataatatcaaattatgtgtgagagtataaatgaatttttcgtcttttgtaattagtaattaggttgaggttctgtatgaactgatcggtgcacaatttaacaggtcagcacagctagaattctatctcttgcatgcctatgcactctctccttcca

SEQ ID NO: 20727 - DNA, 792 bp, Oryza sativa
ctccttgttcaaccccttcaagaaatgaatgactcttcgcctctgcagccatttatttccaatcacaatgtcatcctcatgtttcaatagtaggggatcatagtgatcaagatctgcccataactgttgcagctcgctagcgtactcttggactgttctcccctcttgcttcaaattctccactttgttctgagcctcaaccatcatcattacatttccctctcctgaatacatgttgctcagcgtcttccatacaactgcagcattctggatagcttctatcatcctgccaatagaaggagccaccaaggtcatcaaccaagataccacagtggaatttgtagtattccacgtcctccatgcttggctctccttatcagaaggttcttcacaactctctagtaaaaaatgatccaccccttttgctctcaacatcagttgggctctcctacaccaactcaaataatttttgctcccctccaacctcaactcatttggcatcaattctagtttcacttcagacactccagccgcattcctaggacctatcatgcccatcttcagcaaatcctctagcaaacctttcatatcacctttagtaacaagcaatgaagtatccacaacctcctttccctccccagaagacatttttttcttcccttagcttcttctttaccacattaacagagatacaacaaggaccagacttcaatcccccatggcagatcaaatattagccaaatcaactaataggagcaacaacactactcctcggtttctcaccaaaacaga

SEQ ID NO: 20728 - DNA, 796 bp, Oryza sativa
aaattaaactctttagaccagaaaagatcaaacaacacaaaatctagtctactttttgacttgcagacatgtggatcacccccagaaaaaacgaaaacagttcacctctacacaattatacattgcacctgcgcatctacttccctgctagccaatggaagaactccattgtagaataccaactttctaaatgacgggtattattccactttcttaaacaaaaaccgagtatttggactccttagtccgtaccatagtccagtacataataacggcggcacacgccctggtctcgttcggcaccagaatttcaaccgggcacggcaggcggccggagacgagacgatggcaaacgtcacggcaagtggccagctagctataggctatagcacacggacgcccacaaccacaaccacaagaagcacaccgtacgcgccgcaatttgcaaacctcgttccgcgcgcgagcaagagcgcggccaaccagagccacgcaattctgcacccggttttctgggagccccccaccgattcacccgcacgagtccaaaaccgcgcgtacgcccacgccacgccacgccaccggcagcgacggctcgcgctctagcgatcactaatcgggtcgcgcgagcttggtctctcccctataaaaccacggctccgcgccaccaccattccggcagaaggcaacacacacccaaacacaaacaagagcatcatctgagcgtgcagagctcacacaaacacacgtacagatcgttcgtacaagtgcaacaaacacatggcgagcggcggag

SEQ ID NO: 20729 - DNA, 297 bp, Oryza sativa
ggaatgaatagtctacacacgtcactgtttagtagcgcaacatatcagctaatagtgggagtagctggcagattcaccaattttatggcctcacatatcagttggtaggtggtggcagattcaccctcactagattcaccattatacttaatatatttgtctagtttgaaaactgcttgtgaagcttttgcaatcataaaagtttaatctacttcggcatttaatgattcttttagccacacaccatcaggtgattttagcttcctgacatgtaatagtttcttgcttgtttgcagg

SEQ ID NO: 20730 - DNA, 321 bp, Oryza sativa
ctcccttgcagcttacaggatgataaggatctgccatatactactaatctaatccgttcaaagcaatactactaatcttttcatcaaaaaaaataatactactaatctgaggcctgaggcatcttgtgatcttcttaccttcttggtgagcaataaactatatggatgatggatcgtttctttgccggcactgactcacatcacatgcgttaggtgcagattattgttactagtaacaaattagtaccacatgttctttccggtgacggtgaacgcggagttatgggaggcgggcagggggaatccaggggctggacagca

SEQ ID NO: 20731 - DNA, 467 bp, Oryza sativa
attttgatttttctaaaaaaaagacgcattataacttgggacggagggagaactacatacatagtacttcatttgtttcaaataagttcattttttcacatctcatacatcttaataattaatataaaccaaaagacttttaatactcttactttatcatatactactcaatgtatttattgtaattatttatctttttatgtactctcaatgtatttactttcacaaatttatatgtaatgaaaaataaacttattttatttttagggatttgctttggtccaacaaaaactatctcgagataccagtacatcatggtatcaaatcgtttccgattgttggatctaacaatacctatcatgcctagctagatccaatggtcagaaacgatttgataccgtgagataacaatacctcgaaatactttttgttggaccggagtaaatttctttattttataatgaagg

SEQ ID NO: 20732 - DNA, 223 bp, Oryza sativa
aattggagctaataatcggctatactattaggcaacatatcctatgcacacgctacctatgatgcactcatgcactcagcctccatagaccctccgatttctatccaacggatacaaatcttaggtgagcatttttgcagaaaaccgcccgcatcctacacctaaatttacaggtaaccccctcgcttgcttttctcctctcttgttcattcttctccccaga

SEQ ID NO: 20733 - DNA, 1501 bp, Oryza sativa
tgaccggctatgcataacccagtctgaccggccaagcacctggtctgaccggccaatggcccggtctgactggtggtcaatgatgcggttataccggccataggaggcactatcttgcggagatagggcacggtctgaccggctatggcgggcgcggtctgaccggcaaagagtgcagtctgaccggcgtgatgcgcggtctgaccattggctaagctttttgtataactggttcctttggaatcggctatgtgaacacccattgatccatccatagtattatgaatatgttgtgtagacgcaaaagtagaagtagcacggtattgttgataactggctattttagagccaattttcttatcagaataagttttacaagcatcttctaccatatttttgtcaaaataagcactaaaatatgcatctacacaacgatcaatatgttttcgaatggcaagacttggatcgggcgaattggaggttaccttatcatcaaagacgtatttgggaagaggaccaggcttgagaaccacaccttgatgggtcctaatgcatgatttcatcaacagcacctgtgtgaccgccttgatccactcctccatgacttgacattacttctcatcaagatcctccaatgtaaccttatcgatttcgttcccgctcgtcgtaattgatgaaggaattccttgattaaatccggccatacagctcatagccgaaatatttgaccaaataaattaatatacggtcttgatttccttggtatgctactgtgtgtatctaacaaatatttggaaattgatgttccataataacagccgatgcactgcaacggcttttgagatttttttttctttttcggtcaccctgcacagcaagaaatagagaccgaaactactatgtactaccgcttgtctctcggtatatagatcaatatttcatgatttttttttcggtatgtgagcagtagcagatcggctttgatagcctgatctttttctacgttgccctgtgaagcaaaaggaaacgacttatctaagccggctgctgctccctgtatgcacaaggtttaatgtctagctgcgaccgaacagaacaattaagctcgaaaacaaaatcaatatcggcggcaaagtgtaggttaatttcggctgtttagccgaaactaatttgatgattcgacgaaacgactagactaaatcaaaattcggccctaatatggccgtatagatcgttccccagtggagtcaccaaaaatcgtgttgtcaactttttgtgacaagtcgacaaacacgatcacaacacttaaacgccttgcggtgacatggagtcgccaaccatctcgatctagccaaacggccaaatcaagatgggttttgtagaaaaacaactaaaccggctagcggagccgatttagagatcaaaatcagcctctaggcatatttagatcgatatgaggataactacccgtctcgtgggcaaaacagaaggttttcaggat

SEQ ID NO: 20734 - DNA, 390 bp, Oryza sativa
tgcacccggagcccaggcctaaaccattttgggatttttaatagaaagaacgggtgtgaagcaatttccacaattaccaaccattccatagtatccagatgatatgaatatttcccaaggtctatagttgaaaacccacctaatgttacctaattaaattgcgaagcatctacctaaaactaaactagtggtgccatgagtagagtgtccactagttgaggttttgtttattctagggtgaacaaggtaataataccaataccaataataataaggtcataccaaaggtaaataggcatggctaaataaaacagtgataacgcgggaatttaaataaagcgataatgcaataatttgaatcaacataattttataaactgggattcaata

SEQ ID NO: 20735 - DNA, 177 bp, Oryza sativa
caagcaataacagaaatagataaggcagcagaatataggcagcggctatgccattgccacaggcaacgaccataactaagacctacggagcgccgtcctcctccgcatcctcctgaagataagcatagggatcctcctcgacttcattgccatccactgattaaattttgtaatagc

SEQ ID NO: 20736 - DNA, 1501 bp, Oryza sativa
ttaacgcacatgtaagcgtttggaattttggatagaaattctgggcgtgacagtggccgagcttgtcctcacggtggtggagctaatggtggtcgtggcatgacttgggatgatcgggagcagcgacgagcggcagccggaggtggcaaatggaagtggcggctcgggttcacggtgggagtagtgcttcaggggttgaggagggagatggagtggaagccgagctgcgcacgatggctgcagtgccggggaaggcgatggcgcagcgtgaggtggaccagagaggcgacgcggcgcagctggaggcggcaatggtggcggagagagatggagaacgtggcggtggcgtttcggcaatggattggggaagaggagcggtggacagggtgtggctgggcatggcggcactgtgggtggcggcggcatggccaggcgaggcgatgctcaccggtgggagcccgctagaggcggcggtggctcgggttggtggtggcggtggtttggggaggggaagtggtggccgggtttgccctcgcggcgccgaagccagtggtggtggcagcgcgatgcggtggtagcgcgcggctggaactcgccggaaagcacggaggtgggggatggcgtgatgcggacatcactacctcggatacacacaacaatcctccaatggtcattcaaggaccgataacaagagctcgtgcgcgacaattgaattagaggtgagctcgttcctatgttcttctttgtatgaattcgagaatagattgctacctaatgattatattgtgattaggaacaatggaggggacaaggagacacttggagaagcacttagagccatggaggaccatcgaggacgtccaagtcaaggtggaggcccaaaccaattcgacctcaggtgcaatttagagtccaggactagtctgcactaaaacaggcgcccaggtcgcatacgtgctcagattggggcgttctttatatggatggaaagctaaggagataacttttccaatggttttggtcccacgtccaaattctttcggagtcaatgggaatcgaccgaacaaattaatgtccaaaatctgtccccgtgctgcatcacggtatttgggcctttttgccgtatatcgtgtatcgtgttggaacctattagggttgtgtcaagaggggattgcacgaccctaaactctatatatcagtaccgccaccatctttagatttttgggttttgcttagattattctgtcgagaacagtttcaccgctagatcggtttgtaagaccccaacacattagcttaatcattcatctgcaattttggttgttttctatctcgttcttgtttgtgttcttcgattggcaaatagggattagccttctcggcgaggtcatccgcgtttcgacatgggtcataaccagaagagacgtggtgctgcgattgcggggctcaagagcgtgcgcgttcaagatgccggatcgatttgtgtcgcgactccgcccaa

SEQ ID NO: 20737 - DNA, 273 bp, Oryza sativa
tatgcgcacttgatatctcagtaatgtaatcgtgagtaccagactacttgatccagggaaatggtactattaacacgagtgattcctgttataaaaacgggggtctacacaagatcacttgtttcttgtgtgaaggaattgatcatgtaccaaaagattgtcaactcagttttctgctgacgaagaagatggccaaccaacatgcccgttctaatggagagaagcatcaaggcaacacaaatcctcgccaagattacagtttcagcctaactc

SEQ ID NO: 20738 - DNA, 1501 bp, Oryza sativa
agaggcggcggcgggctcctcggggtgactcgtaacggcggtccggcggtgttccgcgagcaggaataggcggacgacggccagaagaacctgggaaatgcggtggtagggttaggagaaaggaaaaatgcacgacgagacggggaaaagcggctagaggctggtgaattaaggcgaagctcacctcaacagggagaagaaggctacggcggtgattggagccagtggagcggtggctgtcacgccctgaaaatcgcctaatttaataattcattctttaaatcatttttagaagttattttaaaagcctacaagttaaactctaataatctaggaaaagtttcaacataaaattgagctagataaaattttattaaatactttgcttgtttatctattttctagatttttctaggaattatttgagcaaggaaagtattttttaataaatgaaacatcatttcatgaattattttaattgaaaaagtctttaaaaccctcccctaggtcattgggccatttccggcccaattcctcttttcctcgcgcatggcggtgcggcccacgccagcccaagccgagccggcccccctcctctcaagccgccgacatgtggggcccacatgtcggggtcttctcctacctccggccggccgagccgagcccgagcgccgccgcctccccttcgattccgccctaaccgatcgtccccgagttcgattgcttgaggggaaatcatctcctccttatcctctccctttcccctaaagtttcggagatcaattttgcccggataaaccgaatcgaatttgttttgagtttctctctccaaactaaccctagatttttctggcttcgattcctctcgtttggagtccgatctctctaatccaagcctatataaagcatcccctagtcgtcctctatgtttcccctcaagtcccgagctctatcattgcccatagcgccgccgccgcgtagccctagccgccgccattgccggcgcctctccagccgcgccgcgccgccattgtagccgtcgccgccgctttacttcgccgccgttgggctcttgcggaggaggagcacctcggcagccccttcgccgctatcgcaagccgccggagcgccgccgccgccgtcgagccgagccgtgccgtcgtcggagctcgtcgccggtcgtcgttcgtcgttcgtcgtcgtccgccgtagtttcttgcaccggtgagttcgcgtcgtcgtcctcttcgcgtaggtgtcctcggatagcccaaccgagctctctatcgctggtggtcatgtggagccgagcctatgctggcgatgatgtcatcgatgacgtcataaatcctttttattagtttttctgtattagttgaaaatcgattaaacttcagaaattcataactaaatcatcgtaactcggattcaagtggtgcaagttgctaaattcatctaaaatcgagatctacatgttaaaaatatccacatgtactgttta

SEQ ID NO: 20739 - DNA, 1501 bp, Oryza sativa
ccgttttcgccggagaagagtttgaagagttccaaggccagtaaggcaagtcacacagatcccaaacaaccctttgagcatgttgatcctattttaagctattgtttctattcaactattgcatttattttcgaatgtcattgggtggaattaacctattctttgttatagcccttttgttcttgattactttattccttgataccttgggttatttataacttgactagttgggctatgtatattggttcaactagatattagatataattgcttagccctgcttagaaacattagcacattattgggataacttatgactcattacttaatgatggcttaatgatagttcacgatggtcaatcgtgattggttaattaattaatgtgccaactaaaacctgataatggtgggttgtgagcacatggttttgatggtcgtgctcatgacaattaaggaccggttcacgagtttcggttgtgaaacattaaccgtgccaaccacaagccagcgtgggcaacggctttatcttttgtatagcatggttcattgcggggcaccagactgagaagtggcggagataagcccacgggggtcgctggggagtccatgccttgtttataagggggtgattatgatccaggaaaggtgcgctgcggtggattgtgttatgtaaggggtattgtcacaactcctttccgaggtaccgtggtggtattgaggcacatggtgacatgatgtggggttgtgtcttgtgggtacagtggtacacctctgatcagagtaaaactattcgaatagccgtgcccgcggttatgggcgggtctaacaatgtctttcgtgattagtctcacccttctcaccatagtaaatgatgctataactggtaataatttgattagctcctggtttggaatggtatattcctggtttggagatagaactgtgcagccgggatggttgttcagaatggttgggcctatacaacagggtatgttgtatagcgttgatttaatattgtttaattattacttaactgttttattaaattctcaaatgtttgctaaatgctgcttttgcaaatgaaaccctattatgccatcctttgttatcctgtgcacttgcatatttgctgcgtggcttgctgagtatgtcatatactcaccttgcaatcattcatcagaggaagagttcttcagtgaagctgatggtgtggaggattaggtgtagccttggtcaagctgcctgtggtgtggagccgtctgcgccgtttatcttattttccgctgcttagatctttattgattgagttgagaggaactatctacctctgtaatgacattttattcgcttattaattagagtaataaatgtactctattatcaatttgttattgtgtgcctcggctgattcctggacgagggttcacacacatgtaagcgtttggaattttggatagaaattccgggcgtgacataggtaaagcaaatgtggtagcag

SEQ ID NO: 20740 - DNA, 1501 bp, Oryza sativa
ctcgtccaggaatcagctgaggcacacaatgacaaattgataatagaatactatcaaacagctaattaatattcgcaaaataaattattacagaggtggatagttcctctcaaagaataaaattctatgcagcggaaaataaaaacaaagactaaatagctatggcgactccactccacaagcaactcgacctgaccaaagcctaatcctcctgaaaatcaccttcactgaagtactcctcctctgatgaataaatattgcaagaatgagcatatgacatactcaacatgctacacaacaaatatgcaagtgcacaggataacaaaggatagcataataaagctcatttgcataaacggcatttaataaacatttgagagaatagtaaaacagttgagtaatttaaacaatattaaataaacaccatacaacacacccgtgttgcataggcccaaccacatttgaacaaccaaccccgattgtacaaatcaacctccataccaggaatataccattccaaaccagcagtcaatttaattatcacagtattataattaataacgagtaatgtgagactaatcacgaaaaacattgttagacccacccttaaccgcgggcacagctattcgtatagttttactctggccatagatgtaccactgtacccacaagacacaactccacaacatgtcaccatgcgcctcagtaccaccacggtaccttggaaaggaactatgacaatacctctcacacaacacaactcaccacattgcaccgttcctggatcataatctccccctcaaaaccagaggcaatggactccccagcgacccccacgaacttcttgccacttcacagtctggcaccccgtaatgaatcatgctatacaaaagataaagccgttgcccacgctggcttgtggttggcacgttaaatgtttcacaacagtagctcatgaaccggtccttaattgtcatgagcacaaccatcaaaaccatgtgctcataacccacccttaatcaggttttaattatcaattaattatcataacacgattaaccatcgtgagctaccattaaatctaaccataactaataatgtaatatgattcatcccattaatgaactaatgtttctaagcatggctaagcaattatacctatatagcacacttagctgaaccaaaccaatatataaggtccaagctaaatcaatttattacccctaggaaaataaagtcatcttcggccattaattaattgggaaaggctcaccccccgatgacattaaaaaataatgcataagttgaaataaaacattagctttaaacgggttcaacatgctcaaagggttgtttgggatctgtgtgacttgccttgagcttcttcaaacacttccgaaccttcctcaatgaaaacgctctcctccggaacgtcggaaactaaagcaaatgaacaaaatcaacaaaacagtacaaaataaagcataaactgatgtgacca

SEQ ID NO: 20741 - DNA, 1501 bp, Oryza sativa
ggcataatagggtttcatttgcaaaagcagcatttagcaaacatttgagaatttaataaaacagttaagtaataattaaacaatattaaatcaacgctatacaacataccctgttgtataggcccaaccattctgaacaaccatcccggctgcacagttctatctccaaaccaggaatataccattccaaaccaggagctaatcaaattattaccagttatagcatcatttactatggtgagaagggtgagactaatcacgaaagacattgttagacccgcccataaccgcgggcacggctattcgaatagttttactctgatcagaggtgtaccactgtacccacaagacacaaccccacatcatgtcaccatgtgcctcaataccaccacggtacctcggaaaggagttgtgacaataccccttacataacacaatccaccgcagcgcacctttcctggatcataatcacccccttataaacaaggcatggactccccagcgacccccgtgggcttatctccgccacttctcagtctggtgccccgcaatgaaccatgctatacaaaagataaagccgttgcccacgctggcttgtggttggcacggttaatgtttcacaaccgaaactcgtgaaccggtccttaattgtcatgagcacgaccatcaaaaccatgtgctcacaacccaccattatcaggttttagttggcacattaattaattaaccaatcacgattgaccatcgtgaactatcattaagccatcattaagtaatgagtcataagttatcccaataatgtgctaatgtttctaagcagggctaagcaattatatctaatatctagttgaaccaatatacatagcccaactagtcaagttataaataacccaaggtatcaaggaataaagtaatcaagaacaaaagggctataacaaagaataggttaattccacccaatgacattcgaaaataaatgcaatagttgaatagaaacaatagcttaaaataggatcaacatgctcaaagggttgtttgggatctgtgtgacttgccttactggccttggaactcttcaaactcttctccggcgaaaacggactctccggaaacgacggaatctaagcagaaaagagcaaaatcaccaaaacagcacataaacaagcatgaacagtacatgtggatatttttaacatgtagatctcaattttagaaaaatttagagacttgaaccaactaaatcggagctaagatgaattagttatgaatttttgaagattaaatcggattaaaacacttaaattgattttaattgaattatgacgcaataatgaattatttttgaaaaggaaaaagggatttattgcgtcagcgggctagggtttcggtggaccgggcgcacggcggcggttcacgcgaacggacggccgagatcgatccatccaaaacggacgtgtcgagatcgatcggtccacgaccggctcacgggagacggggacga

SEQ ID NO: 20742 - DNA, 553 bp, Oryza sativa
caactttgttattgatgactttttcagttgaaatcatttagtaattataaatgttgtttgaaattgtcataattttaaattcaaattcaaactgttcaaacgaagtcatatataaaaatgaccaaaataaaagatgaagatcttaataagttatacaactttgtagttgacaacttttccatttgaaatcatttactacccgaaaaattatttgaatttcttatattttaaaattcaagttttatatagtttaatcaaactcggatggagaaatgaccaaaataaaattggtagatctcaatgagttatacaactttgttttcgacaactttttcacatgagttcatttagtataataaaattcgattcgaagttttaatattttaaaactaatttttttccctcctcatccttccaaattttttcatctcctcttctccctcccctcctatcctgatattttaccttttaattttccccatccttatcctattcctatctctcctctcagcctctcactctttcctcctctcctctctctctctccgacagc

SEQ ID NO: 20743 - DNA, 462 bp, Oryza sativa
gaaaagatgtgctgctacgaagtaattatctgatgaacagtataatcactgtataagtaatgtttatcaaatgttcgcgtttgccatagcagagacagaaactgtgcgtgcatctgcacacgagagcatgcagtttctcagttctcacggtaatcggaggcgactgtttggtttcaggtgaccgtccgctcactaactggaggtttgaacggtggttggatcagcccaaattcaggtcttctcactgtaccagttcagtccaagctgccatcttcttaacacttcaagaagaaccaaccaaaacccacctcgctaacgccacttaaatctcctgtgatcttgtccatcagattgtctaatgcgtggtgagatcttcactgcaacatttggaatgaaaatgacgatgctgtagccgtgttcattatttcacattctgttccgggcgacagattttagctgaag

SEQ ID NO: 20744 - DNA, 631 bp, Oryza sativa
gggcgcatggttgtgagttcagtttgcgctaacccccacttttgcatgaggaggcaaacgaggtcctctccagctgccctgccctagtgtgatatcatttgagcctttcatgctttttgtgccatgcttgatctgttccaatccatttacttcactaaccaaattatgcgggtcatatgcagttttcctttcatgtttctctccaactataaaagtttgattggccgcagccacatagagaaactcggaagattagggagtaaaccaatattaccactgtccacatagctttaacaactaacagctggtcctgctctttttttccttttggcatcagtttgttattgtcatgctatgtttccatttgacgactggactagaatagaatctgtttctttggctcgttttttttttttcatcaaatagtgatgacaaacttgataaatttacatactgatacagtgatacttggctgactttcataacaaacggttttgtgtattgtgtgtttaatggttcctcttgtttttgcagacgctcttgcgtgcttatttgtcaaatcagatctgaatataattttaggagttgcttcagcatggatactggctgcctgtcatctatgaacataact

SEQ ID NO: 20745 - DNA, 1501 bp, Oryza sativa
ctataataatagctttaaaaggtacccctccgttgcataaaaaagcacaatcgtaactataaatctagacgcatgtgtgtgtagattcattgttaggattggactttttatacgtgtctaggttcaaatcaaggattggtttttttggacggatggagtataaaagtaactcaaatactccctccgtcacagaatatagcaacctaggattggtcaatgtatctagacaccccatcccataataaggctaagggcctcatcagttgacataataaaccaaatcaaaagctaaaattagaattttcgaactttatatttgaagttgagtttaaggtattttcaacgtaatttttttaatattgacttttaagtcattacgaacaaatatataaaaggtttacctatagattactttgtaatgtataggcttattagggaatatgaataaccgatgaaggtttaatccgttttcacctctttgctttatttttcagatcactccaatccactctattcctattctagatatagttggaactgttagttagattttaactttaagagaaataaagagaaatagagctagagctgaaaccatatcaaacatgctctagatactagttttgaaacatgaacatataaactgagtttcttctctagccctaatagaaacctagagtatttgttttgtcatactaattcgccatgtcatgtgttaaacataccgttcctcttccgttactatagctatagctataacagtccatactttactaacttgttatctcatatgccatatacttgtcacgtactattctctccgtcccataataaagtaacccgaataggacacttcacagtacaacgaaccggacatgatactataaagtgtcccatccgatactaagttgctatattatgggaggagggagtagttgataaatcttttcacttctgcgaccaacagtttgttagcaacactttgtgtatctttgtcatacttttagtactaagagggtgtttagatccagggtgtaaagtttttgcgtgtcacatcggatatatggacacacatttaaatattaaacgtagtctaataacaaaacaaattatataatccgcttgtaaactgcgagacgaatttattaagcctaactaatctgtcattagcaaatgtttactgcaacaccacattatcaaatcacgacgcaattaggtttaaaagattcgtctcgcaatttacacacaaactgtgtaattggtttttttcgtccgcatttaatgctccatgcatgtgtccaagtgttcgatatgatatggtgaaaaaattttaggtgggatttaaacagggcctaacttgtgttgtgatgaaatggtgagaaaacctgttgctcaaacggattcgaactcaggctagcacgttgctcctagcagctccctaccagctgagctaggtgctgttctcacctcttgaaatcttgatatacgtccaacgacgaca

SEQ ID NO: 20746 - DNA, 1501 bp, Oryza sativa
tgctgctgctgctgctgtgccagccaagccggcgcccatgcagctcatcatccacagcgctcgctgcgacggatcccatgattcccatctgcatccagccgtgcggccctgcgcgtgcggctctcctccgatccgatccaaccaaccggggtggattcgacggagaagcttcccgggatcgatgagcgtcgtgtgctgctacagtggtgacgggggcccttgctatggttgacacgacgcctcctgtgatccgttcggggtaacatggcgtgcatgcgtgtgcgttatccgtcctgatgacacggcacatatggacgcgaatacacgatgctcatctagtaggtattaaaagagctttgttcgatctgttgccgaaactaacgttatcaggttcagattataaccaaaataaatcatattaaatttagacaatttaataatattatcaagttttagcatgatttcttatttaattactagagtttcgtaataaactaaatggatgcatatatttgataactttacttaaaaaaatattataatttaaaatgacatcaatttgaacaagccccaaatgttagtatagtcaattcttgataagacaataaactaaacaagactaaatcaaaatataagaacctacgaccgaatagaacatttcctactattacgaatctggacagacgaaaatgtttcatccggttataggtttttatattttagaacggagggaataacatataaaaattcaacaaatttttaatcataaaactataccaaaatttggtgaggtgttaaacttcacatcttgatcttgtcagaaattttagcttttcaaattgaggggttttttttttctcattgaacagaacaaaccgtaataaatcaatttcgttctgtcggtcaaattaagtgcggttgggtctaaccaggcagtggggatgattttggctccgtccaatgtgatcgaaacgctttgagaaatgtagagtgcgatcagatttttcttagtggaccaacgcacgaatttcgcgtgtgccgatctatagctctcctcgtcaactacacatagtacgagcgagtgctgggaaggatggctcggcgtgcaacatgagatccccatgccttgggtcactcatttgccccagttaaatctctctactctctctctctctctctaacttgtagccaccatgaaccgcacgacggacggctgcagttgcgtgctcttctgctgctgctgctgctgctaccattgaaaatcctctttaatttagcggcaactgcaatctgattgcttgcccgcaagggcatgcatggtgtcggcatcagggccctcgtacgtactgtcgtgctacgctcaccaatcaccatgctttgctcgatgtcgtcgtcgatgtggccatgaaggcacgaattcatggtatcaaattgacgtactggtttggcattgctgatggcatgcacatgtcaggtgttcttcatggtggaggaaatagag

SEQ ID NO: 20747 - DNA, 451 bp, Oryza sativa
acatcagttatatttccttgcaattggttatgatttagatttctgcacatacaaagagaaaacatttagctctaccaaattatacaaatttaaaagcaaaatcaacttgatgtttgcaaagatactcacaaatacttaagattagacatcgagaaaatcgagtagggtaaatttccagtgaactggtttcctgcgagattgctgcaaacaataaccacttagcacacagacaccagaaaagctgatgtactttctaaaccacaacttcatttgaggaacttacagcctctcaagcttattagtgggaagattgtactgtatctgttggccaccaccaaggttgttttggctcatatcgctgcattaaaaaatcaattaagactgttatcaactgaattgtcacttgacaggatcagatatgaataatctcagatactcacatctcaatcaa

SEQ ID NO: 20748 - DNA, 262 bp, Oryza sativa
tattgttcgttggagcatggcaagaattggtcaaaaattgctatgagcatttcagctttcttttttttttctttcttttcttttttgcgattttcctcttaagatgtcatgctatttactcttgtaaatctgaatccatgcattggtgtctatgggcacttcaaatttcaagtttgctaatgtgtttgtttggtgacatactgacatgcattatacagtgttgcaattaagcccggcgaaaacgtgtagtaattatttgctc

SEQ ID NO: 20749 - DNA, 369 bp, Oryza sativa
tttgttagcctcgaggatcaatttttcgtgaagcgcctacaaatcgggcatccgatttgtttgtcaaaaatcgggtgttgtttcactaatgaggaaaaaaatgtttcaccaagtagattgaaaatgtttcgatcttttaaaatgctgaaacacaatcaaattacaccatgaaacattttttttacaacgtatgaaacaatgatttcgaatatattaaaatatgaaacaaatccgagtacatcgagaataagaataaaacaccatcgaattgaaaatgtttcagtgctgaaaatggtgaaacagaatcaagtcacacaatgaaacattttactacaacgtagaagcaacagtttcaaatgtattgaaaca

SEQ ID NO: 20750 - DNA, 221 bp, Oryza sativa
caccggagcgtcgggagagccggaatctaagcgacatacaaagcaaacaatacaaacaggctataagactactgaaacagagaacaaaaccatttttaatggattctttgcatttttcttgatttattgagacttgaatgggcttaaacggagctcggatgaattttctatgaattttagaagattcactgtgtttttactaaaaacatgcgggccccaca

SEQ ID NO: 20751 - DNA, 1501 bp, Oryza sativa
tatgtgaacaaggtcttgagtcgcttttgttatagtgactgcaaggcagctcctactccttatgatcctagtgtgctattaaggaaaaaccgaagaatagcaagggatcaattgagatactcccagatcattggttcattgatgtacttagctagtgcaacgaggcctgacatctcatttgctatgagcaagttgagccgatttgtttcaaatccgggagatgatcattggcatgctcttgaaagagtaatgcactatctaaaagggacaatgagctatggaattcactacgccgggtacccaaaagtgctggagggctatagtgattcaaactggatatctgatgctgatgagataaaggccacaagtggatatgtgttcacacttggaggtggcgctgtttcctggaagtcttgcaagcagaccatcttaacgaggtcaacaatggaagcagagctcacagctttagatactgccacagttgaggacgaatggcttcgtgagctccttatggacttgccggtggttgaaaaaccagtaccagcaatcatgatgaactgtgataatcaaacagtgtgattattaaagtgaacagttcgagggacaacatgaagtcatccaggcatgttaaaagaagactgaagtctgtcagaaagcagaaaaactccggagtgatagcattggactatgtccagacggctaaaaatctggcagatcagtttaccaaggggctaccacgtaatgtgatagactgtgcatcaagggagatgggcttgagacccacttagagttgcacaatggtggaaacctatccattgtgatcggagatcccatgaatttggatggtgaaacaaactattgtgtaactgagagaagagaccctaaaatgggcttatcttcatgatgcacttctcttctaatctgtatggtaggatggtatacaccttaatgtgatccgagtggcttttcataaagcagagatattggcctacagaacatcttagagggaacacacctatatgagttcgactgctagtcacagtctatgagatctaggtgatctctagatactcatgaaaaggccaggagtatgacttatatgctccaaacagaggggatgtaaacggcagcctagtaccagttaagggtttgagtgaaacctgaatcgcacaagactgacaattcaaggcatagtccattgttcagttgtgatctggtgtagctcttttcctaggtggaagttcaacttaacagtcttcaccgaaacactggtataacaaacaggatcagaatcgagaacatttcctgtgagccatgaaatttggtggggattgttagattaatgggctaggcccaattaaatcctaataaattccattggcccacattaagtgctatgggtaataataccaccttggaaatctaagtgaagaggtctcaacttaaatacggagctagtggagagtctctgttgaccggttgagatggtgcgcaaacaacc

SEQ ID NO: 20752 - DNA, 197 bp, Oryza sativa
tcatattgcaaatgtcatgtttattgtcttaatattttggattaaaatatgctgaattatgaccaaatttccaacagtccaaaaacttgataggtctttttcggtagttggctttgttgcatcactaaaaccacatgctttcgatggttcaaattataaaagatggaaagcacatgcacttttttggttgacggtga

SEQ ID NO: 20753 - DNA, 1300 bp, Oryza sativa
gtgatgtttggaaccagatacttaactttagtctatatatttagacactaatttagagtattaaatatagactacttacaaaactaattacataaatgaaagctaatttgcgagataaattttttaagcctaattaatctataattagagaatttttactgtagcatcatataggcttatcatggattaattaggctcaatagatttgtctcgcgaattagtccgagattatggatgagttttattgatagtctacgtttaatatttataattagtgtccaaacatcccatgtaatagggactaaaagttttagtcccatctaaacagggtctaagtccttctaaatctgttactcatataactgtctaactgagataaagtttaaggttgtcatatcatatcatcgtcacgttatatatatgatccctgcacttctctttttatagaatggacgagactcttttttctgtatatgtagcggtcttgtactcttgttagtaccattttgcgtcccattttgacgagacgactggcgtgccattttgcgtcctggttcattacagtctaatttggtgacaaacaaacaaggaacaaataggtcccatggtctagcggttaggacattggactctgaatccagtaacccgagttcaaatctcggtgggaccttaattttctcggttttattttctgcctgagcttattgtcctcctcctgattttttgttgttgtctattttctctgccggaaaaatgtatcaaactcgtcgattctactcgtttgagagcttagtgtgatattgtccttctcctgaagtttctattttttactctctctgttatgaaaattttcatgctagaatgatttacattgtgaaatggagagagaactcgtttgtgcttatttatccttcccctgatttttttccacaccaaaacatatattgtgataattgagtatgctacgcgtctgacgtactacgagtttactccctccgtcccaaaaaaagacaaaccctgagttttcatgtccaatgtttgatcatattatttgaaaaaattatgaaaaaaattaaaaagacaagttacgtataaagtattaatcatattttatcatataacaacaatgaaaatactaattataaaaatttttcatataagacggacagttaaacgttggacacgaaaatctaggatttatttttttttatagagggagtacgaggtaaaaatcgtcctcagcgccttcagaaaaaaaaaggacaaaaatcctcagcgccaaccgactccgctccacaga

SEQ ID NO: 20754 - DNA, 1501 bp, Oryza sativa
ggccatttaattcaaaggattgaagcttttcaaatcctatgaaattcctatggaatggcacattgcatgtggattttggaggaaatttagcaagagctccaacctcttggaaaatttcctttgagtttatctctctcatccgattcctgcgtttttcctgcgctccaatcaaacgaccattcctgtgtttttcctgtgtttttcaatcctctgtttcacacttcaattcctgtcaaaattctgtgttttttctattcctccgttttttatacatgtgattcaaagggccctaaaaatatataatggcaggtctgcatgaaatctaggtaactttgtgcagcacagtagattttaacctaaaaaggagagattgccgacatatatatggatgcaatttttttcataaaaagaagtactatatcgatcccatacattgcatactagtagtacatactcctagaaagcttgttgaattctatggtactcattgcattatttaattaattaatacgtcatttggaactcgatcccccctgtacttttaaaattaaaggacagcttgacgaatccaatgtagccgcaaggcacacatctgcaaaaccatatatatacgaaccccattatctttattaactttaggtaacaattatttgagccgttcctgtcagcagaaaacgtctgaaaagaagggtgtctgttgttagcaactgcgtccaatgcaaaggacaacgcaattttggctcacaggtcttattatattatgagaggttaggaaataatcgcagtcaaataaatcttgtctcttcaccactaataaactaattaaactatcgagttcagattcagatcattgagcgccttttagtgtgatgaaaaagtatgcaataatacaattcgatgaacttctttttggaaagaaaagtagctatagcaataattcgatcgtgctctatgttcaatcgaattatatgaactttatttgccataataatttgacactcatttataaatgccaattcattggaccctttcccatcttcgtgcgatgaaaaaaaatagaaccaacacctttgagcactatcggtgccgattttagagaaaaaaccggtactaatacaataggtacttgtttttaaaagaaccggcacatataatatattataggtaccagttaattaaaaaccaatatctataatattttaaaaaactggtacatatataaaaaaaccaagccggccaaagagagggctggcaggcatctatccttagagcaagtttaatagtatagccaattactagctccaaatcatctatagtcaacttaatacccaattcatacaatagttacctataaacatatgtacactattaatacatggtcccaactgtcatacacacattgtgtcttggagtccgtgctgcagctaattacaaatctgtagcctactgctcttctctctcattttttatcttctcgatatgtgtttgtagctggtttata

SEQ ID NO: 20755 - DNA, 1501 bp, Oryza sativa
gtatggtaggaagggaaagttagctctctaaaaataataaaatatgagtatctatgacaagtattttgatagaagaaaattaaatgcttattggaacagatggaggagttattatcgtcgtacagtatggagtgattaatctcaattaatgacaaattgacaaggacaaggacaagacaagttgtgcctattcttgacagttccatatataggttgtgtttagttcctgaaaaaagttgaaagtttagaaaaagttggaagtttatatatgtagaaaagttttaaatgtgatgtgatgtatagaaagttagaagtttgaggtagttgagggtgaactaaacacggccatatatatatatatatatatatatatatatatatatatatatatatatatatatatatatatatatatatatatatatatatattgggcgcccgtccgtccccctactccccctctcttccctcctccccttcttaaaccacacaaaaaaaaatttaaaaacaaaaagttagaaaaatttatgtatagaaatactatatataaaaaatttgaattcaaattcaaatttgaatcggttatataaacttttgacttataaactttgggtctataaactttagatgtatagaaatactatatatagaaaatatttgaattcaaattcaaatttaaatcgggtatgtaaacttttgacttataaattttggatctataaactttaggtgtataaactttagatgtatagaaatactatatatagaaaatatttgaattcaaatttaaatttgaattggatataattcaaatttgaaacgggtatataaacttttgacttataaactttaggtctataaattttagatgtatagaaatactataaaaaatatttgaattcaaatttaaatttgaatcggatatataaacttttgatttataaattttggatctataaactttaggtgtataaactttaggtacataaatttactaaaatagaaaagtaatgcggtgccaaaaaagaaaacgtggagggagggagggggagaggtggtgatcgctaccgagagcgatctcggtagcgatccatcgcgcattagactttccgacatctagaatgcagtagcctttgtattagaatataatacctacggcccacccaaaccatgcatggaatgggtcatagcaaaattattgtcagaatacagatcaacgaagttttgggttggcaataaataacaaagagtggacttattaatcaatactgttataaaaattgatcgaagatgtttttatcagtattttggtacgtcatctgtgtataaatcggtttttaaatttatttgcttttgtaaatacagattcatatttgagacggggttttaagttcgttcacttttggaaatacagatggagtcgtataagatatttctttaaaaatactcgcatgctaacttaacatgatcggactactaattacagcttatgattttttta

SEQ ID NO: 20756 - DNA, 333 bp, Oryza sativa
ccgctggattttgaggcagtattgcctccgttgatgttgttcatcttcttgtctccaatctccgttgacatcttggtgaaggtgccgatgcagtagcagtagccgcgaagaacaagagcagtcgcgcttgaagcgctacccaaaaacttgatcgcccacctacccgtgcaagttctcaagcggacggagttccggaggcacctgctcatcccgtacatctgtgcgcgcaggtgaacagaaccggggaaggattctgcagctcaggaacagaggaggaggaactcgaagtgcaagagtcgtgaagaacttcgttcgtccttctggtcgctgcgg

SEQ ID NO: 20757 - DNA, 1501 bp, Oryza sativa
accaacacatgtcttttctgcacactttgtcctcactcgtgtgcaccgggaagaatttcccggtcggtcacccatcccaaattgctccaggccaagcatgcttaaccttggagttctttggagattggcttccggaaaagaagttgcaacttgttgatatgaatattctattaatcctattaagccctagaccgggatgttacaccctcacccccttaagagagatcgacgcccccgtcgatcaaccctaggccaggaacgtcctctcttggccacgtccatgtgtccagtgccagcgcatgtgccatgctgtgtaaccactcccggtctacaccagccatgcgcaccatgcctgcgcaactgcgacacatgcgcccgtgaaaccgcgagagtcggctctgataccattttgtaacgtcccgccttcccccaggccgggcccgcttacatctgatagctttcacaggtcatagactgccctcacagaccaacacatgtcttttctgcacactttgtcctcactcgtgtgcaccgggaagaatttcccggtcggtcacccatcccaaattgctccaggccaagcatgcttaaccttggagttctttggagattggcttccggaaaagaagttgcaacttgttgatatgaatattctattaatcctattaagccctagaccgggatgttacaccacgcttgtcgcgaccgggaaaattgccttttcccgaacgctagtgtattaatccccgtcccaggaaaagccggggtacaccacacaaacatgatataaaagacacatttttattatatcgataatatttacattattacaaaggcacttaaggcctgacaatcaaaaataaacagcaacggactagcgggcctacggctccatcttcacaggcgctcaactggggtataagccaggactccacctaagacatcttctccaacgcttctcttactgaagaggggaaagattgagcaagaatgagtacaaccacagtactcagcaagccacaccggcagatgcatgattaatgcaagggggtacaaggggtaataatataggggttaagttttgcagtaaacagcatttaaaagtcacttagttgcccaaagccattttataaggacgatcctagagctacacaatattattaatcaaggccgtgaaccctcacgaacctgccttaacccaaggcctacgatgattcagaccgaactggcaacccgaccctgggtcccagctcgtcccaagccaacccaggccaaccattccacattttagttgttgagcaaattttaagaattaaaacactgacttaggtacattgctcggcttgcccataaccgagggcgcggctattcgaatagattatactctgatcagaggtgtacatctttacccacaagacacatcttcctcacgtgtaaccacgtgccacataccaccacggtatacggacggaagacgtgacatagtttccaacccatccta

SEQ ID NO: 20758 - DNA, 1501 bp, Oryza sativa
taagcgacttctccgcgtcgagcaacgatacggaaaggacccacataccgaggtgcaagcttccctttcgtctgaaacctgtgtacacctcgcaatggcgtgactcgaagatacacaaaatcatccactgcgaattccaggtcacggcgacggttatctgcataacttttctgccgggactgtgccacctttagattatcccgaatgattctgactttagcttcagcttctctcaggatatcagtcccgaacacttgactttctccaacttggtcccacaatagcggtgtccgacatttgcgcccatacaacgcttcatatggtgccatttgtatgctggcttgatagctgttattgtaggagaactcggcataggggagactcttatcccaggtcttcccgaaatctagtacacatgcgcgaagcatatcttctaggatctgatttagacgctcggtctgtccatctgtctgcgggtgataggcggtgctgaaatttaatcgggtacccaactcttcttggagcttcttccaaaagtgagaggtgaattggcttccccgatcagatacgattttcttgggaacgccatggagactcacgatcctggcgaagtagagttcagctagcttgttccctccataggtggtcttcacaggaataaatcgagctaccttggttaatcgatccacaactacccatattgtcgcgaccgggaaaattgccttttcccgaacgctagtgtattaatccccgtcccaggaaaagccggggtacaccatacaaacatgatataaaagacacatctttattatatcgataatatttacattattacaaaggcacttaaggcctgacaatcaaaaataaacagcagcggactagcgggtctacggctccatcttcacaggcgctcaactggggtataagccaggactccacctaagacatcttctccaaagcttctcttactgaagaggggaaggattgagcaagaatgagtacaaccacagtactcagcaagccacaccggcagatgcatgattaatgcaagggggggtacaaggggataataataggggttaggttttgcagtaaacagcatttaaaagtcactttgttgcccaaagttattttataaagacgatcctagagctacacaatattattaaacaaggccgtgaaccctcacgaacctgccttaacccaaggcctacgatgattcggaccgaactggcaacccgacctgggttccagctcgtcccaagccaacccaggccaaccattccatattttagttgttgagcaaattttaagaattaaaacactgacttgggtacattgctcggcttgcccatatccgagggctcggctattcgaatagatttactctgatcagaggtgtacatctttacccacaagacacatctttactccgcattccatggccttggaacccgtcgtaaagatgtgacataacccttcacccatcctagccgtgaac

SEQ ID NO: 20759 - DNA, 183 bp, Oryza sativa
ttttaagcaacaatgagtttttcatctaactttagtcgtccattttatttaaaaatatttataattagtatttttattattatgagatgatgaaatatgaatagtacctgtgacttatgtttttaatcttttttttaatttttttaattaagacagatgatcaaaattaagcacggaaaatca

SEQ ID NO: 20760 - DNA, 1501 bp, Oryza sativa
ttctctagcatgaaagaagtaggccgaaaggtgattgataaacagaaacatgctctgcatcgctcaaggaagacccctgatagtaattgccccgcaacagtcatcttgtcattaagtaagcgagatgacctaggtaaaaatgtttctatgaaggcaaggagcgaaatcttcaactcggtatcagatgctacacggagtgaaaagtgcaagcaccagttaccaggtaatgccatgtcttgggagatgatccaatgggaaagaacacatcaaggttaaaggtgtaaaggaatacgttgaatgctaactgaggacaacctgaagataataatgggaagtaaactgaatgtaaagaaagtgaatccgagctgcttgttcgtgagagccattcccagttatagaaccagtgatatgttcgaagatagtctacagaggtcagattaaaatcacctctaacaacgaagcttcagatctggcaggatcacgatcagacaataacaagtccagcagccaagtcattcgggaagacgtcaaagcatgtcaagcgggataaattggttctcttgggaagcataacttatagttagagtggttgaccctggcatcgaatagcagaagcacctagcactggagaccaggaaagccaatatgaggcagttaatggcaagttgtcaatcatggtatccttagtaagcgggatatcatagtctaaagcgtatggtggtaagctggaaggaaacgccaagcatggtattctcatgatgacaagcatggtatcctagtaatgacaagcaggttacgacgcatgacatgaagtggtaacttgtgtgaggttgacgccgaagatatgaatcgtgagaagttctggatctgaagccccatcatcaagtgccacaacccagtcgaagtcggctaaaggttcaaccggagataagtcaggtgaagagaagattccagctgcaacaggagatcgagccaagcagtccagagtggagaagttgtgctaggcaagttgttataaaagacggagcggaagaagtcagacaagaagagaagaccgcccaacctatcttcttgctagcctcctcgaatctcggggacgagattcttgtaaggggggtggatttgtcacgtcctgataaattcatcccgaaataaaaatcattttctaaaaggaataatagaattaattaaaattcgaaaagaaattggcaaaccctaaaatacgtacaagaaaaattcaaatgtggcccggagaatttttgttaaattctccttggtctaaaaggagccctcaaattttagtggaattttcagagcacaaataataattgttaagaaataaacaaagttaaaaaggatttataaaaagaaaaatccctaaaagtcttctttccccccctttcccttcttgggccggctcggcccacttctctccctccctctctctcctctcccccgcggcccatcggcctcccccgcgcgcgcgccgctgacaggcggg

SEQ ID NO: 20761 - DNA, 338 bp, Oryza sativa
catctgtcgagggagtggtgctgtggtggtggtggtcatggactcattgggcatggccgcctcgtccgagccaaaggcatgtgaagcgctcggagtcagagagaccagggctgggctggcgtctgctcgcttcccgagagaaccccttgtgaagattcgagccaaccccttcccccttcctcttctctctctttttctctcgcttctcctcttctttaaagcatggaccagcgcctagtagcatctccatccacggcagtaggcagccggtgccatgggaggggggaagtaggagggtttttcttcttcttctttcttctctctcgttttctcgcaga

SEQ ID NO: 20762 - DNA, 1501 bp, Oryza sativa
tctccttcttccaaggcgcttcaccatcggatgcgtgtgttttggttggaaagcaatgactctccacttgttgtccctaagccctacagccatatgagctttgcaatcatactttgcaacctttggtcgtttcctcttcccttccaccagcaagggagccttctttttgttaccttcaagcaggggcggattttccttgttctcttcagaaatgaagctactgccaccagcactatcttttgtggtattttctggcttacgtgcatgaacacactcaaattctctccttatcaacttcggttcatcatcatgattgtctccattttcagatactttacatttcttcgatgctttttttcccctgatgatgcctggctgtttctagatgatgcaattcttgttccaaatcctagcttataagcataagcgttgtaaacatttcttgcctcttccactatatcgaactccattccaatgtatggaacaattggtggggaacaaacaacatccttttctttttcatcattttcagatgcatcttcatccaattgttcatcaatttcaacagtcacagcagccacatctgtgttgtcaacactttccacatccacaacctagtacacaaaaaagtttcactaagttacatactgtgttttcaaagcaaaatatcccccctacatttgtgatatttcaaatccaaggacaactcaccaagtcagtttcatgcccagaggatttggataatagcacatcaaggaagccaccagatgagcttggtgcttggacatcaatctgtaacattttatcttgtttcattaacttgtacaattatgttttagcaagttaaggattattgttcaagtcaaattccagtccaaatttatacagaagttacaattaaaaataagacatgaatataaatgttgcatgagggaagacattgtttcatagatctatacttcaattttttattgaaactttttcaaaaaaaaagtgaaacaagtaaaaccctagaaattttttactcaccaaattcgttgcattatgcattggggttgttcctctgtttgcactagatgagctcggcgaaaaatccctctcaacttggtgtatcagatgagccatggcgtcggtggcgaagttgcagggcggtgactgcgtgtggtgtggcggcacgtcggcgttgttgcaggcttcgccggcgcgaggaggataggggcgcgagggatagggtcgccggcgctggagagaatcgccggtggcagcgcagcgccagtcgctccgcgaagatctcccctcgtgctagtggtcaacggcgggacacattgaatgaaacagattaatgtgtttgggtgttgcaacggcgcgggcgtcgggtgacagttgtttctccaatcggacggctggcgcgcgcgtgctgcatcggacggtcgtgcgaggcgtccgatttttcggctcgcgccgtacgtccgacgcgtatacgtctccaaacattcaataa

SEQ ID NO: 20763 - DNA, 1501 bp, Oryza sativa
ctataaatgttatgctgtccatacaataaatcactaatttaaatatttgataaggtccacacaattcactaacatcttcagagtataagttttgctcaaataaggtgatggttccaagaaagaatagaaccagttcaagaatagttctgaggaaagaaaataactaatcataatgtattttcatcaaatcaattaactgtaaggggggttattctttgatttatataatagctttacacttttcctatggcatgctgatgacagtattgaagtgtactcctaatttttaacactgacatcatatgatcgaaacttaatgaagctccattgagttctcaatcttataaactgtcttccaaacaggcattgacttgaacgttgatgcgcataatatataacaatcttttgcaactgtactaatagtctgtgggcaatgggcttattgaaaccaccacatagcaaaacattgcacaccaataccatttgcggcagtagctttatatttctatctagaataacgactacatgattatcagacactcagcagtcagcatcattagctgccaatttagacatactaattaatttagttggagatggcagattccgtggcttaccagttgcgctggccgccctccttgaagtcgtcctcgatgcggcgcttcctgtccgcgccgatcttggtcgccttggacgaggtgaagaagaaggccagcacgagcgcgccgtacctgtacccgcaggcgaggtggatcgccatgacgacgaacccggctgccccgccggagccgtccagcgagcggcggcggacggcgcgcgcggcgatgacggcggccagcgccgcgccgacggctgtccgggccgcgactgaggcggcggggatccccatcggctgcgctgcgcccgcccgcggcgggagtcaaaggcgccagcgattggggggtgaatcgaatttgtggtaggggcgccggattctgggagaccgggatgcgactgtaccagtagtagtccaagtgacgactagtaagtatgcagttcagcaaatctgaaccgtcggttatttcctccgctgatgacattgagcaacgttgacgtcttcttccctgccctgtctgtcgaattttttttatttttttagaatctttatgttttaattttattaatagaccattctaaaaatatcggtccttttagcgccagagtcgctggcgtggtctctctgatgctgccccctgccaccacggagatactaacatgcccacccccctatcccccgctcccgcgcccctcgggggctccctccactctccttaaattcacttgttgtgtgtttttgtttttgtttctgttgttttttgtttttcctgtagtaaaaaaatagtacattttttctcttattaaaaaattagggttccttgagtttgttttttacattcgagtgtccttccttcaaacagacataattttctcatatggactcggaattaagcaaattatatat

SEQ ID NO: 20764 - DNA, 1501 bp, Oryza sativa
aaacacaagattttatcacactctggcttcagtaagtagacaaaaaaattcaatcagactttttattgaagatggtgttaaattttatgacgatagcaaaaagctagatattgtaacctccttcttcaggcagctgttcagtgaaacttccccttcggacccaacattcacactacctctgctctaccctcaacaagaatgtcttcagagcctgtgtacacccttcaccaaggaagaaattgtaaaagtcatccatagtgcgccaaataacaagagtcccggacccgatggattcacgaatgagttttacaagcgattcatcaacaatatttaaccggatctgcaagcagtctttcaagacctctttgacaacaacatagatctttcaggtgtcaaccaatcctacattaccctgattccaaaggtcacagcagcagctcacatcaaagacttcagacctatatccctactgcacagtgtcccaaaactgctcagcaaaaccttaaccaacaggctgcaaaaggaaatattaaagttgatcgaccctatgcagtcaggcttcatccgtggccggtcgatcacagagaacttcattctcgcctcagaactggtacagtcagctttgaagggcaagaaaccaatgatagtcctcaagctagattttcacaaggcctttgataccgtcagttgggacgcactgttccgaatcatggaagcaagaggtttcccggacaaaaggattggttggatcaaagcactattatgcacaggcaaagctcagatcaccaacaatggacaaaagggagaacagatacagtacaaaagaggggtacggcaaggagaccctctatcaccctatctattcattttagtagctgatgtgctccaaaaaatgattcagcaagcattcagcacaggaatcctaaagcacccacttgacattgaaggagcaccgcccaatttgcaaatacgcagatgataccctgatcctactaaaaggagaagctgaccaagcaacagcaattaaagaaattttggattcctttgcaaatttctcaggtctgcaaataaattaccataagagcactctagtacccatacacctgaatgaggcaacaaaaactatggtgacgcaaattctacattgccctgctagttcactcccttgcagctaccttgggttacctctttcaaccacaaaaatctcgcataacatgctgctgccagtcatctcaaaagttgacagatatctagccggatggttgcctctatcaaagggaggaaggctaactatgatcaacgcagtcatgtcagctatcccgacatactacatgtcatgttgtatctggccggaaaaatctatcgaagcaccggacaagataaggcgtgctttcttttggaaaggggaaaaatccataaaaggaggtcactgcttggtggcatggcaaacagttctactacaaaaacagcaaggtggtcaaagatctcagggcacataaca

SEQ ID NO: 20765 - DNA, 1501 bp, Oryza sativa
catggtatttaatcatctagccgtcgtttttcactaatatactgtggacccattattttctaccattagatttattcatccaaataaaaagggataaaaaagaagggcccgcatatcccacccatcccatccagtaagtatgcttgcgtacgtatgtgcacccctcatatttcctttctcttctattttcctttttagttagatggaaaaaaatattccccgcctgtccaataagtatgcatgtgtgtacttacccacatatttcttctcttgttttcctcttttagttacatagaaaaaatattttatgataacaaattttaaacaattatattatctaaatcatatagataatttttatttgcacacactattagattatttactataaaatttaaaatgaagatccaaattaactatattattgaagaaattccttattttagtcatatattctacgaactatagctcgctattgttcactaatccatgcattttaagaaaaaaatcataatatattttaaaccttccaattaataacataggtaggcaagtttcacaataacaaacctaaccaattaaaatacgctcacttcattatgttagatatagaaacaaccataatgtttaagctactttttttttaaatatttctatgccttttaaaccggtataaccattatttctaacagttaaatctatctttattaaaaaagtgtttattcatggtacatgacatttcaaaaatattattgtcctatgatacttcatagttatcgtatttctactaggttgcgtggagtctctcatccacactatataaaatgttcatagatagatcacctctcaaaatatatcaattatattaggctatataaacccatgtatttagtggagcttcatgtaccacccaatttatcttttaagagattatgataatatattatacaattaaaaacaccttatttttattttacacttaatttactttcgttgacattttttctaaagaaaataaatctatttctaaagaaaataaatctactttcttttcaaatgacaaagaagattataaataattgcttatagatattacttatatatatatatatatatgatataacataaagctaatgggataaaatattattaaacaattaattaatgctgacaaaggcaatttatgaagaaatcatgaacaatattctctggttaatacctcgcttttatcaatacgtacgcatgatggacgagctcctttctagttatattaatgtatccaaaaatgcattatattattatttggattttcttccagagattgatttcaagttttcggtaaataaaataaacaagtttggctactttttttatgtttactcccatgtttaagcacctaagaccgtcagataaccatttgtaataatatatgccgatggtagtaacgtttggtgaaacggcaagaatcgtaatgacaatgtttttacaccactcgagtttc

SEQ ID NO: 20766 - DNA, 186 bp, Oryza sativa
cggcatgccaaatccattgttcttaagcccgggagcttgtatagtttttatttttggggtgatgtctcttgtcataagaacagaaagaacagaaaaaagttaaagttctactaaggttgctccaaaacagcgtaatgtgatgaacctagtctctaacgcctttcttccattttccttttatacaga

SEQ ID NO: 20767 - DNA, 1501 bp, Oryza sativa
tactctgaaaatttttattgtaaattgtatttgaacaacaactattgaatgattttcttttaaacatatgtttatgggcatataaatgttctttttacagttaatagtctaacattttatcaaaaaaatacataatttaatttttcaatgttcttgaaatgatagttttattaattagttcaaaataaagttaataatcccttctttctataaaggtaatgcccactaaacacctaaagctcaacatgcaagcacaatatttattagcactcctaaaatctatatgtaagtacgtcacatcaacttattaagcacacaaaactcaacatgcaagcatatactgtagtaattatatctataattttttttcattctaaaactaaacatatacatgctaaatcatcactctcaaatcattttcaaaatatttcaatccaaattatttcatctagttacataatgcatttaattatagagttcatctaaacgtcgctgtttcggattggattcttgttttttcccttatatttacgtatttgtttggcatagctatctgtgcgcattgaatttgaaatttgtaagttaaaatataaaaatttgaaaatttatatttcattaaagtaggaagaaatataatttttcctcctactttaatgaaatataaatttccaaaatttttggatagctctcacttataaacaagtatacacataataatagtatggtatcaccgtataagaataaatggatgacttgcaacggatgatatgcaattaatgttatattagttattcaaagctatttgtttaagtatgcaaaatatgcaaaaccactatccaaaatcatcttaaagggtaatatggatggtattataaagttcagggggttagatatccggttttaaagtttagggtgctaggtggacttacatccaatgtttataggggtatttagattttttttatgatttattaactagtagtagatttgaagttcttaagtttaataagtttattagtggagtcatatctccacccacataagcaaaaaaaaaaaaatccaacctagcttttagcttaagggcatcaataatgtatatagaccaagtggtctttattattcccatttccacgatgtatatataaatagtaattgacattaagaatgggacccacactctaaaaaactttatatccaaatgctatagttctcttgtagaaaaagcaaaaggagggagatattatattttaatttatatggatgatccttatagctatgggtagctgatcatatgactctttctaatatcatctctcacaatggcaaaggtacctatataaagttataaggatggccttttgtcacattgtgaatgccctaatcgtgtaaaagagagtggcttattgctttaaaagaccaaacaaaaaaaactgtttgtttgtttagatttaaaatattcagctcataagctagcttataaaactaaacaaagaaggccagt

SEQ ID NO: 20768 - DNA, 1501 bp, Oryza sativa
ccaccgacttctcttcctcttcttctcacattctcggttggggttttagactatttgccattgtcctgaagggcgtattctcaaatgccattctctagaataactttgactttttgctatcggagaaagaagatttcttgttcgtgagccatttttcagcccatgagaagccatgtcaccaaattcgaggacaaaatggccgccttgccctcctcctttctttcttctttgccttcactcaccttcatcatctccctctcctccggcgtgctccctgtcaatgaaggtgtacaagcagacgaagccacgtgagctccacgtcgagggtgcggccgagggtcatggccttgcagtaagcatccgcgagtgccatacctccaccatcggctcgctgtcgaggggtacgatcgtcgtggccacgatatcctcttccactagagccaccaacgacccatcgtcgagggctccacttacccgctggtgttgatcactcctgcctcacccatcaccgacctcgtcctcacggggcaaagccaccgctagctatcctctcctcttgcgcatacagaggagcggggtgaaggagacggctggagctcgcgggccagggggtttatcagcgtggcaatcctcactggagcccaagcacaaggcaaggagcgagaatgaaagacattgagaggggcaaaacggaccctttcgtcctcggatttggtgatgtggcttctgatgggctggaaaatggcaaatgagcaagaaatcttctctcttcgatggtaaaattaaaagttatttggaagaatggtatttgagaatacggcattcggaagagtggcaaatagaccaaaacccctcgctgccaggtccggacggacgtgatgatccttttagaacaaaggataaatcctaccaaagaaaacatttcacgtaatttggcaacattgaaaatctttaacccttttagaaaacttaaatatctttttcatcactacctccatatttagatattttaggtattaatcatgcttctaaatcgaagatttaagtatgcttcgatctgcaagctactttttccatcgtggaaatatacaaattgtagtaatggtgtaatggtagtatggtacagagggggaaatcactacaggttcatgccacaggttcacaagttttcaatttactactataataacttgcgggtttaaaacatgcgcacaaacatgactgagaataatatttcctccgtttcacaatgtaagactttctagcattgcccacattcattatgtgtttagatttattaacatctatatgtatgtggttaatgctagaaagtcttacattgtgaaatggagggagtaggtgttaccaaatcatgataaattacttgtcaaaaaataacagctccatgagttaatttgcaaagcaaagcaagtacgatacaaaaagtgggcagatacttccatcaaacaactaacccacaacatggtgcacactatgtatg

SEQ ID NO: 20769 - DNA, 1501 bp, Oryza sativa
  unsure (1)..(1501): unsure at all n locations
gatattgagaatgaaagatcaccaattttgcagaatgatatccaacatctgtaaaatgaccatatataattgtgttcatggtgtgtaaagtgcaaattttgagaagtactgaattactgatgatacatgttcttacttccctgtgcaaaccaacattcagcgctgtgtacaggtatgatggtacgcatatttgccactcctggccaccgtcctcgcaagagtttaccaaagaccccgatgaggggaaaccaaagaggcaaagaggaggaaaaccggagaaagaaaacgagagttgagtggaggttcgctatgaagaggggggaaatcgccggtggcggcgagctcgtggtgctattcgtcacttgtagaagaggaggggaaggaactgctgcccgggaaggaagttagaggagaggaagacgaagaagaatggatgctgatatgtgggtctcgtatgaaacgagttacttcctccgtttcacaatgtaggtcattctagcatttttcacattcatatttatgtgaatgaatctagatagatatatatatctagactcattgatatcaatatgaatatggaaaatgctagaatgacttacattgtgaaacggagagagtatgttaggaaaccacatttaaaaatcgctagggagttgaattataatggttttacaggttgagatgttaaaatatgagctggttataagtggtattgttgttgaggaatatgaattagattgagcctataataaagggagtcaaatcggacttattcctttgtagaaagcccttgattgggctgatcccctgggtcggcccagcatggcgccttgaactagcaccttctttgtctttacgggcataagcttctagcagctacagtttctcacataatctccaactctcttaagggtgtgttcgctgctgatggataggaacatatcacctaagcacgaaaaatgaagcagtccattaccgcgtgattaattagatactccctccgtataggaaaaaaacgtcgttctagccataacctcgtttgcgattttaacgacattctgaaccgcagcaggctatgtggacggaataacccttgtctgttcgatagccgctcccgcaattaatccgcagcacgcccgcgcttgcctcgtttaattccttaagcgtagcatgcaggcatgcagcacgccgctgaaacctggctgtcacgctcgccgccgccgcatgcgtcgcgctcgccgggcctgctcttgtcgctctcgccgctgccgccgccgcttgcgtcccgctcgccggccgcgctcttgtcacgctcgccgccgtagctctcgtcgcaatcgccaccgccgcngcatgcattgtgctcgccggccccgatctcgtcgcttgcgtcgcgctcaccggccgtgctctctcacgctcgacgccgccgccgccgctcgcattgtgctcaagatgcttgacgagaagcgcgaacgtgagctcactcccaggaaggatg

SEQ ID NO: 20770 - DNA, 1501 bp, Oryza sativa
gataaagcatgtgggagagagagagcagtgagggagagaggagagagaatgtcctttttgcagttttgcaggcttttgcctcacacgagagatggcaaaatgcagcatgcacttttgacttccttgtttcatataaatgggatcttctgagcactagtattgtgtctaactaactatcttatgtgtaggtatcttattttatataatattttttattagaacttatatatattagaccagtctccgaatcctattttctagagtttgccaagtcggacacacgagtctgagtcggactccaactatcgagtctgagtcggattccgactcttgagcctgagtcacggtaacactgacagagtttgtatgcatgaaaaaaaacatctgagcttaattgttattaggactgtcagtgagttctgactgcaggcttgatcttggttcggattcggaggaaacttggtcaggcttgagcttggcttgtgtaagctcgtgaacagtatagcatatgtttcaagaacaatctcttgataaagacaataaatttattgttaatcacattggcaacaggacgaggactaagagaaatatgtgatgctaagctgctgtgtatgcatactaatttatacttgatctactagtttatcaaatacaaaaaaattgtgcgcacagccaggttggcgatctattcaagctcggttcaacaaagcctgagagcctaggctttggcttcggctaagctcatttaattttcatttcacttctgattgtagattatgcctactattgtggcctactgatcacatgaccacgcaaatcctcatattagagtttgggctttgcatattcttggtttgatgcatggtaaaaatattgcgatctctgcatagagccaaatggtatagggttgttgatgggcatccctacttttgaaggttgatcggttgacctcttctttgattcgaatttcttaactgaatacccttgttaatgcctctatgaatacttacatttttcatttcatatttgcattttatttatttagtattgactgatcttcaaatgcatgatcctaaattttgtttctttatgtcgtctagatgtgctcgaaggggagatatttcttcagaatcttccaagtgttgtggctgctcgtgtccttggtatgaatataatttttaagttagcaaaattttcaaatttatggcaatatggctgttttctgaaagtcttaagtcatcttttatctgatattatgtcctttgctgtgtgatgtatcgtatatttatgtggtagaaatgctgaaaatcttaggtttgaatatagttattgaagcaacaaataaataagcaaatgttactgctaaaagattgaactagcaaatgttacagtaattgaatagttgtcacttgtcagtttgtacatagcatatagtttgctgacttttctttctatgcagaatatgataaatatttttctttttagttctgaatagcttagg

SEQ ID NO: 20771 - DNA, 1501 bp, Oryza sativa
tggttcattttaaatcttctaccatcaagttccccaatcacatttcttgcgtggatagatgtgattcaagcgaggagataatcaaatttttttcttcgtctttatgttagaagtggttaagccttctattttggatttgagggagtaggtctcaagacttttggatgaagggagtattactttattattaataagttaatagattcaggtatggtataatatggtaagttttggtaacggttcgtagaatagtaaaattcttcctgtatctatttttattttattattattatttttatcagttagaattttcaaattaatagttcggtcaaaaccaagtcggagataagtaacaagcaagaattttaattactttctcatccctactagactactagttctaatccggttgggggcaggactctcccgaaaatgcttctcttcgaacgtccgatcagatgaaaaacattggacgcctacggtcagctcagtccttacttgctaatttcttatttctctctgttgacgtcaagaaaatgctgttgatcagcagcctggtactgtcgtactgtaacatgcatgcatatatctagttgtttcttttcattcttttctcctctctttaaatattttctcttctaaattacttatctgatctacgaaccgatcgcaccgttgtattcgttgcaattaaatctttacaacaagatatcacatgattatattatgtcaaaagaaaaacgtatgtttcaaaccgttaaaacaaaatatttcatatgtgatagtgatatgtttcaatatgtgtcttaagtgtgtttcacaaaattcctgaaactacctactactactctctctccacctcatgcatgcatacatgcatgtattttagcaagcttcaaaatgatttttctcttaaattacctattcaatctaagatccgatcacaccattgtattcgttttaattaaatctttacaacaagatatcgcttgattatattttgataaaagaaaaacatgtgtttcaatcagttaatacttgttgtttcatgtgtgacagcaacatgtttcaacgtgtatcttcaccatgtttcataaaatatttaaatgttccagttgctgatttttttcaccatatatataacatgatgttttacttgttggtcaactgcaacatttgaccatccatttttttttaatttaaaaatgtttcacctaatgtactcatgatgtttcactatgtatgaatcaaatgttgcagtgagttaaaacatcctttcgctattcgctgaaacattattttcatataaggcgaaacggcgtccaataaaacattttcgatctacttagtgaaacaattccaatacttggtgcaacagcgtgcaacatttaaaaataatttaataataagctaaaaaaaatttcatcggattatattcatgtgtggtcttgttttaaagatttaattgcaacgaatttaatggtgcaatcggatcatgatt

SEQ ID NO: 20772 - DNA, 356 bp, Oryza sativa
ccccaacttctgcttaaaatgaactcgtgcaaccatttacgacttcgggtgtcgagaacgttgtcattcctggtgcgaggaccgtggagatagaacgtagtcgagcatgccgtttgaagcccaacggtcatgagtgaattttgaattgaagtccagaaaactgctgcgcgtaacgggcccagagatttccggcggggatctctctccgttccttggaattcgcaccgtcggtagtgcgcttatttaaaggaattttgggagctcattttcaagtctgccaaccttgttgaacacacaccacctgccagcgctccttgccttctccgccaccacaagaaaccctagttcgccaactc

SEQ ID NO: 20773 - DNA, 1501 bp, Oryza sativa
ttccgcctgtaaactgcgagacgaatttattaagcctaattaatccatcactaataaatatttactgtagcaccacattatcaaatcatagagcaattaggcttaaaagattcgtctcataatttacacgtaatctgtaattagttttttttcatacttaatattctatacatatcaaatatcaaacattcgatctaaacaggccctaagttagggggatcgagggccatgacttcaactaaacatgactgatatctcaaagcgccatatcagcattcgtttttcttttccttagacctgatctgatcgattttgttgatttgctgtcactctctgattctttgttctataatttgttgattgaatatgtcgtcttgttgtgcatgtgtacttttgaccactacatgtttctatctgggagagatcctttgcttacaaccgcaatcttgacaaatgttgaattagaatgactagctagaagtgcacaaataacaggctaatctatctataattttaaagctggcacgtctcactgcaacctaattggttgagttgttacgcacttgttcgtacaccatccatctaactgttagtgatataccctagaggcaatcatagagatgattgtatcacatactatgtttacatatttatccgactttgttacttgaaatagataactcattattggttaatgaatatgtgattctttcatgagactctttatgttgtgtgttgctatttctaaaggatccctgatcaaatatcatatgtggaacaaatatgtttagatgatcagcacatgtactaattgatgatcatgtctcatggatcatggaatagagataccaaattaataatgtggacacatgttggtgaacatgttgatgaatagacccaacatgagacactgcaagagccatatgtgttgtgtcatcagtaatctcatttagtgttggtgttgaatccttagacctgatattatcatggttcccaacatgtgtagtagcttacttagggactgctaaacgctactctgtaattgggtagttataaaagttgttttcgggtatgctatgaaatatgtagtgagatatgaataatcaagatgggatttgcccctcctatggagagatatctctggacccctcgatgttgtaaattatggaagtgcatggcatgccaaaggtgattgaggagtatatcacaagttatataatctatcaacaggttcgagtgaatgattgagctattagagtatggcacatatctagccttgagcttaatcgatattgtgaggcaaaggggttcatacaagtatacactagagattcagccgatatgatctttatgtatgcccggtgagtcaatatgttctgctagaggccgctgttgatgcgtggaccgaaaaggacttttcgggttacagcggagtgtacatgaacctacagtatcgcacgcttaataggctagaataaggggattggatggagatccaata

SEQ ID NO: 20774 - DNA, 176 bp, Oryza sativa
cccaaagtgaacaaactcgtattcaccagtgtattgctggagaaataaaaaaaaggaaaattgtacacttacatcgttttgttgatgtcaaaaatgcctcttgcacttagaagcccagtcaacatttaagagcattcatgcccataaacgatgaacacaactaggtccgcacccga

SEQ ID NO: 20775 - DNA, 1501 bp, Oryza sativa
ctgctgctgctggcgcagctctggctgccgtcattgttccagctgcactggccttcctcctcatgagcaagaagcaagatcaggctgtcgcaaatgctgccgctgaggcaccagctgatcaagctgaaccggttgtcgagaagaccctatctggttcggggagcagcgagggtcatcttcgtgtgaagggttcacagcttcagactcctcctgtggcagatgaaaccgagagattcggcggcggctccggcgcttcgatgtatagcagcagcttgtcttctggctatggcaggaggaagagtgccaaggaggacgagagcctgagccttgatccagtgtccaggagggattctgccgcgcaacccacatcgtcctatggtagtttcaccacctacgagaagatccctgccaagaaggtatacaattaagcggttgctgtttatatcctgaattcatcctttgaaagtttgtttgtgctaggttgcatgcttaattaatttaactttgtttgtgcagagaaacaaggatgatgaggcggtgaccaccccagtccggcgttccagcaggttgaggaatcaggttaaatcaccggaggcgtaaagatgggcagccccagtgctaactacgatctgtaggggacctaactatcagcttgattttagcacttgctgctttagcttaactgctcctcagctttcattgacattgctttagcacttgaattcgactgatgtatgatgataaataacagctctctgctgttcttttcatcgaaaaatggattacgatttctgttttttccccccttctttttagttgtgtctgttgagatgactgctttcgtgcagctttgttatgtttgctacctgaatatgaatgtattaatccaggacatcgctttgttaccattctgtcagtttctttgtgaccgtgacatcatctattgtcttccgtattaatgtttcagaaacatgctgtttttcgtttggagtatttcgatggatttacgattatggtactagtagttctgtagtagccacgacaaaacactttgaaacttccaactttccatcacatccaaaacttttctacacacataaactttcaactttccccaaacttctaactttttttaggaactaaacatagcccaggttagattcatattgaaatcagaaccaagcctgccaaattcacttagcattaaaatttcagatttactatgcaaacacttggaagctgtgctgtaacaatcgttcgtgtttctgcaaaaccgtgtgcaaattcacataaaactgctcgaattcatattccattgtgatgggtgtgaatttcaacgctgctaatatttgacttttgacaagttgccatcctgtggcgggaaaaacaagcttaaaaagaaaaaacaaactcaaacaacatttgcctaccggacccacatgtcagcttccaagtagcccaatccgttggctccctgacaggtcggacccacttgtcatct

SEQ ID NO: 20776 - DNA, 1501 bp, Oryza sativa
  unsure (1)..(1501): unsure at all n locations
tcagtgaaatctggagacacagtcttggtcgtcgccgactctgatctgaaccgaccccgtgctgctacctcagttttccaatccattcaagttcgaatagtggactaggttagtcattgctgagctagttgctagcagctgcagatctggatggatatttacaaattatacgatgattcttgaaattgttctgatgcgaacttcttgtggtatttggattaggggtcttcatctgcaataagtatcgaatgaaagtgttgcttgtgcgcacctggtattagtttgtatacattccaatcatgaatcatctcccctttttcatactaaaaggcttcaaaaataattctatgttcaaatgttagcgttatgtgcagaatctaaaatgtacgacgttctaaactgtggcccactatgtctatatccaagccaccatgtaatcatacaattttgattctgatacctttgagtcgttctgataacatacgaagtgtatgagttcatgggtattggcattgcaagcataatgccgaagagccctaatttaagaacaatacatacaaaaatttaaagaaaagctnnnnnnnnnnnnnnnnnnnnnnnnnncgtttggtaagcgggaggtcttgaagttcgactctcaacgaaagcataatttatttgcccatttgattttttatgaaatttttgccacgattttgtttgagtttgtgctaagggaagcaattaaataaccatgggtttgagacgatttacttgaagtatatataaccacgatttcattcgagtttgtgtaaggaaatcaaataaccaggattttcttgagtttgtctttaggaaagcatataactaattaaccacaatttcgtttgagttgtgtgttaaggaaagaaataaccacgattttcaaacgctgcgcgcgccacacatgcatgcctgcaagataaatttgtgcacttgtgcagtgaaatctattagtactattcactgtataattggtaagaaacagctagcctaccataatctgcagaagcttgctacaacgccgtttcgtctatgttcattttaagttaaagtagaaaaagccgttcctctttaaagaaagcagtaaaactgtggaacatatactacattcgttttataatatatgacgttatatattgaaaacgaagggattattattatcatcatcatcatcatcatcatcatcatcatcatcatcatcatcatcatcctcctcctatcaattccttttcaatcattttgtatggtttttatggtcatgcctcatacttgtcttcattaatttgcagaaatgagcttatccatgcttgaatgcatctccccattttcgttatatggatgtgaacattacaacctaatatcgctatgtccatggacgtagaacaactagaggaaagttcaagagtgagttggtgtgcctacatcaattaatggaggagcacgcagcaaaatgattcctacgtacccccgatccacaagg

SEQ ID NO: 20777 - DNA, 1501 bp, Oryza sativa
cggattcgtccggattcatcccgcaatcgtcgccggcgtcttcaatggcggccgagatctccgcgcccgtttcctctctctccggccgcgctctcctcctcccggtgctattaaaacgttgcccgtgctccgctcttccgtttccgccgctcaccgctcgctctcgccgtcggattcgtgctcgcgccgtgctcctctctctccgccgtcgccgccgaactccgttccgccgccgccgccgctccggacctcctcccgactcggcgccacctccctcggcatcgccgcatcgccgtcgacctcgtccgcgcctccgtttcgctcgccgaccgtcggagcgccgccgtcatcgtcatcccgaaccgcgccgccgccttcttccgctccggccgccgttctcgtcgtcgtcgttgtcccggggtgagccgaagaccgccgttcgctttcccccttctctccgctctctcgggcgccgctccgccgcaccggtggtcgccggcggtgaccatcggggcgcgagcgcgccgctcccgtcggccgcgccggcgaggccgccctcgggcgcgccctcgcggctgccaagtgggcccggccgtcagccgcccgcgcccgcgggtgcggctgacgcgcgggacccacggcgccgaccgccgccagccgcgagcgcccggtccaccgtggaccgagcggctgacgcgtgggccccacttcccgtggacccggtccgcgcgcccgctccctcggctgacgcaataaataggaatttttaattgaaaattaaatgaagaaattcgcaaatatccatttaaagagcatataaacttcaaatggccatatcttggccatttgaactcggaattggaccgttcaagtctctaatttttccttaagaagtcaagaacccatttttgtgctttgttcctgcttgttgtttggagtttattagagtaaaagccttttcttttccgttggtcgtgtagacgctgcagcttcggaagatccgctcttcgtggaagttgaagccggtggttgggaaagcgagcaaggcaagtcacatcatccttgagcatattgaaatcccagtttacaaaattattttaatttaaattaatgcattatcgctttatttaaattcccgcgttatcactgttttatttagccatgcctatttacctttgttatgacattattattgctattgttattattaccttgttcaccctagaataaacaaaaccccaactagtggacactctattcctggttccactagtatgaatttaggtagatgcttcgctgattaattaggcaacattaggtggttttataactttagactttgggaattttcatatcatttggacactatggaatggttggcttatggtggaattggacatacacctctcttcctctttcaaaacccctaaaacctgttttcggtggggtttgggtgcatgccagttatgggaagtagcaccccggccactataaggatgaa

SEQ ID NO: 20778 - DNA, 500 bp, Oryza sativa
agaggagagatgaagagaggggagatggggagagagaggaggaaaaagaagagggtgagttggactgacatgcggggcccacgtgggtcccacattttttattattttctatgtgagactgacatgtgggtcccactggttttattattttttcgaattgaattgccacataagcgtcacgtcagtgccacgttgagagacgaaaatcggattcgttgacaagttggacctcagttagaaatccacaatcccgttctggcccaataaatatggcctgcacgtgggccacaatcccgttccggcccaacttcgtcttttcggcccaatgggctaaaccgaacacggtggcgacgcaccgcagtccgcagccggaggaacgacggcgacggcgacgtggacgtcgacgagagagagagagagagagagaagcagtggcggagaacgcaacgagatgagatgagcttcccggggagatgggaggagagctagctagccgccga

SEQ ID NO: 20779 - DNA, 690 bp, Oryza sativa
tatccgaaatgcattttaacacttttacttaaactttattacgcattgctgccttccttaaaaaaaagataaaacccaaactgcaatgcgaaacgcacaaatttaacatgaaaccaaaaactctggaacaaagttacaaaattctccatcaaacaaaaggacacctatggaagggtgaagattacactacagtacaagacctcccttgcaaagcaaaacaactggtgctccctccgttttaaaataaatttattttttatccattcgacacatcaataaaaaaaaatagagtactgttattttatcagatccaaatataattattctcactttatttactctaaatgtaattatattttactttcacaaaactctaaaatgattacttttagagtattttatccgttaaaaaaccccatttctaactatagatgtgaatatacgctacattcacattcatactcagaaatgagattttctttatagagggagtaggtagtaaaacgagagaaaaaaaaggaaaaaaaaagaaaaacgagaactagactagacctcctcctcctcactaatcccgatcccgatctcccccttccttccctacaccgaaagcccgaaacccaccttgcctcgcctcgcctcgccggatccagatctccaccgcctcgcctcgccgcgccgccaccaacccac

SEQ ID NO: 20780 - DNA, 472 bp, Oryza sativa
tgcacaattaatgcaagggagtacaaggggataataatataggggttacgttttgcagtaaacagcatttaaaagtcacttagttgcccaaagccattttgtaaagacgattctagagctacacagtattattaaacaaggctgtgaaccctcacgaacctgccttaacccaaggcctacgatgatttggaccgaactggcaacccgacctgggtcccagctcgtcccaagccaacccaggccaaccattccatgttttagttgttgagcaaattttaagaattaaaacactgacttgggtacattgctaggcttgcccatatccgagggctcggctattcgaatagatttactctgatcagaggtgtacatctttacccacaagacacatcttcctcacgtgttaccacgcgccacataccaccacggtatacagacggaagacgtgacatagtttccaacccatcctagc

SEQ ID NO: 20781 - DNA, 334 bp, Oryza sativa
tcaaacatttcgaaacggagagagtatattttactagtagtattataaatctgaataatttgatttattttgggttaaaaggaatacatgtttaggttcgtgcacccatgtttagtcgtaaactagctgcactagtattttccagacactgttgtgttgggagtattccgtacaaaagtaggtgtttaatgaaatataactagaattgtaactggtgaagagttgattagagttgatgcctttggtgttgtgtcagcgtgcgcgtctcactctcacccctgtcggcatttggagtggccaatcatgcaagcgtccatgtacacaaacaatctcg

SEQ ID NO: 20782 - DNA, 1501 bp, Oryza sativa
gtgaaacttctgtgatttgcttcgagggatatgtgttggatgaatcgatggtgatagtgtgaaacttctgtgattttgttttggatcgaaggtggtctcatgtgagaaacatctgtgattttgttttggatcaatggtctcggggtgacggggaacggctcgatgcatcggctcgattcgagccaattcatcgagccctatttttttggattcttgggacctcaaaggtgtcggttcctaaaccggcacctttgaatacttacatcagtgctgcctcctttgtgctggctgggaaaaccgacatctatgtggggttcccaaccagcactgatgtggtgttatgtggtagtgaatgtaatatttctccattcacatcattgactgctaaggcatgaaaataaaaaaaacagttgcattgtggaaccagctatagttcttttacatgttttcgtagttatctatatacatcatatagtcaattatttactttcaagaacttataattaacattttcttaatgctagttgtaacacaacatccaagaccatacatctgaattttgtagccttatcttatatgtttcgattaggaagcattggggaagtatatttatccaagaccctacataatccaaggaaattatatgcttggattaggaagcatcgggaaactatatgtatgaagaatcaccattactagccacttagtcgtgcgttgcacgactttgggtgcccgtaatgtacaatcatacttaattttgattttttttcttttacagaatcatacaacttgataaactattagttagaactatagattcagctcaagctatatttgaactgaaggttcaaataatatgtccaggatcaacctcttaccgtataccatcaaaagatgagaatgtttactcagcaatatgatgcataaggcataaaatagtcaaacctaacgcaatacacattagcaaactaaacggcaatctagtccatgatttgaaaccaacacaaattgctcaaagatcatttgacctctaagtatctcaagaaaataacataataaacatcacaaaataaaaatgcacaattttgttatgaagtgtagtaaaaaatccagagtcatcacaattaatgtagtttgtctgtttgttcattgttgccaaccaaaaacccttcagcccaaagctaaggaggacttctcaactcttccctgtaggcctgagaaagtagatatgattgacatttactaattacatacgctaaatgcaaagtcagaaattacactattcaggtgattggtgtacaactaaaaaggtgccatcgatgtttgttgttaattaacaggttaaggttaaggtgccatcaggcctaatgaacacaccagagaaccaataacatagtgaccatgagctgtttgcttggtttttagcttcaaaactcagaaggcaaaaatattaaagtgaacaggtaataatagatattctatgtgcttagcatttaattgt

SEQ ID NO: 20783 - DNA, 1501 bp, Oryza sativa
tttataaagttttacataatactacccttatgtattttgagatcgaatttacttaaaattctaaaacatagaatttatatgtaatttttaattattaagttgttgattaagattgacagtttaattctttattacttttaatttttaatatatatgctagaatttatcaagatttgaataaaagtgaggttttatgaaacattgagaccatgtaacttgaggttatattgccatacatcataataccagtggtttgttttatacctttaactatgaaataactggttttctaaagttttctccttcaggtatggatatttcattttatattagctagcagtaaatcagtaatttactttgggatttattttgaagtaaaggattgagaggtgatatttagtttttttttatcaaattattatatctcttggcagctatatatgtatcgtaggacatgcttcggatagtaagaatccacaataaacaatttgcaggaattgtagaatttgtgcacctaagcatttaaaactaggtgcattctattttggaagattgttagagcggccaattttttttagaaaaaaatatttatcaagaaactacgagcgtgctcggttatctgttgcagccactagctatggcagctgctgcagcccttccctttgctacggctgtgctgcacaattatagccagcacaaccgatcaccgcctatttcaccaaatgcttcaaaaatcagggtcattagaatgaacttcaagtagttttgtttccttatcatatatagaacacataccattttttatgtatacaaaattttctaccattaatttatactcgctccatcgaacaacagataaataaacccaaactgagttagctaaatgacgatacataaaacgagataagtcactagtacatgattaattgagtcttagtaattaaaaatagttcatttaattttctaaataaactttcatataaaagttattttttaaaaaatataccatttaacaatttaaaaaacatgatcacggtaatagagtatttgtagaagccaaacaacatctgaaactcagcctaaatatgaggttaattcaataaaaaaacatactaaatttatgataaagaaaacaaaacaaagaataatcatgggtcaaagttgtcaaactgccatatggccatatctatccatccaagacccaagataacattataaaaccaacccaatcccccaaaaagaagaaccacaccccacacatcaccccaccccaaaagaaaacaagaaaaatatcacatcttttttatgaccccaatatcacacacaatcccccttgtggccttgtgtgtagtgttctcaaaaccatagcaaacttgcaaaatacccccacctttccccttccctcctcccctcactccctctcactctcttgtctccactctcctctcctctcctcgccgcgagcgtgagctctcccctctcctctcttccaatccaagaa

SEQ ID NO: 20784 - DNA, 1501 bp, Oryza sativa
agggcgggtttggcggtccattccgaaatcttgtctggttgttcctcagggacaacaaagactggatccgaatgttctatctgaagatagaaccatctcgcccgccatttactacgagaagaggggcactggaaggggatgtatcgcgacttcaggccattccgaagtcggaaaccgacacatctggatacctttttaggttccatccagcgtaactcatagtagaagcggaagagatcaataaatggctttaccccaatgtaggcctcacaaagataagagaaaatactgaggaaggcgatggaattggggtttagatggagcaaggaaagaccgtacaaattcaagacaagaagaagaagctcggagggcggaggaagaaaaccgcaaagaatataatcctcaaccaaaaccatgcggcccaggataggttcgggttcaatacctcctggttctctctccatggtcccgcgaccagggagggcaccgtcatcctgcagcttcttcagggacgcgttggtggaggtggacttgtcgagatccatcgccgccggagatcgccggtgaatagaccgagatgagcaagctagggtttttctgcgggagtggagaagacgagggacgcttgggggctggaaagttttgcagcaaacggacttcaaaatggatccccaaaactcccttaaataagcgcactaccgatggtgtgaatttcaaggaaaggagagagatggccgccggaaatttctgggtccgttacgcgcagtagttttcggacttcaatttaaattcactcatgaccgttgaacttcatacaatgttatcgataactctttgtctctacggttctcataccgagatcgaccagttgagagcgataacgattccgacatcagaagtcatgatcggccacatgagttcatttaagcagaagtcgggggctactgttagggttacggataaggtatactctttacccttggatgtatgccgtatactgatatggtatacctgcgcgtgtacggatgtttcctgtacacgttaaggaaattcatgacgtaatagaaacggagttcacggatggaaggagtcctactcggacagaactgggtcgttactgtatcgtgtggggtccgatgtctctgagttctacttggagaccaactgacccgcggtataaaagggactccccgggaggacctaaggcatcgaatctcaccgccaacacaaccaccacagcctacgaagtcggagcctacagcaggcaagtcgccgggtgatctagtcgaaccaactcgactacggtctcgtcggtatcatctagttctgctattccctttgtaatatgtggtttccattatataatcccatatcaactggattagggctattacctatcaaggggcctgaactagtataatctctgtttcctgtttgcttgatgtcatactacgtagatccttataccagcgtaccccaataccctctatatccggtctac

SEQ ID NO: 20785 - DNA, 1501 bp, Oryza sativa
ctcctcaggcatcagcatgcgtatgagtgcaagattgcgtccacgggagcaacttccagatcccagatgatggctattttgatggaggaattaatttagcatgcagttatgaacgtgaccaacgtacgtcaacattaaacttaaatacgtactcctccgttgattacacgttactgctgctttcacaaccggttaacgtagggcttattaaggaggcagggcaatcaaaaggtactaattaaacatcatgtcattgttgtttgccaccagacagaaatgttttttcgtctaaaaaagaatcatttttcttcgcacaaataaacagtaaccattgcatcgaagtgtttccatactcatctatccgtacaaagaacacatcaaaaatgcatatgccatgattaaggatgcttctttttttattgtaaaacaatatattataaagctgttcagatgaaatgggtgcggctatggttgctgcagcctgccattgcattgagatgtttatgacactgttgatgttggctgcggcacaacggtacgctgattttctataccactcctaaatccgatccttgcattttgggagtaatccacggatttgggatttttcaccgatcagtgtgtagaatccaatgtcaatgtcaggtgagggggcagcaggcagaggatggcgccatggcaaaggcatggaggagtttatcaccatggtccagaggcgccatggatgttggatgatggttggtgcagctgtgtgctgtgtgggatgggagggaggtagtgtacggcgtcgtgtaccggagggagggaagggaaacggaccgttggtgagggtgggcccggccctgcgagtgggccccacacacccctcttctgttccgtgtcgtcttcttcccccgcgacagctgccgccaattaattattctaccaccccattaaaccacctccacccttcttcttgttcttccttccacttcccccactcgtcgtctcccctcctcctcgcgcccaatctcctcctcctccggaatcttctcgtctcctcgtcgtgtcgtgctgcccaccaactgctcgtctcgggggccgtgacgggttcttccctcttcccggcaatttgggtggagggagcaacgtggattgggggccccgaccttcctgtctgttcttggagagagagttgcgcggattctggagattcaggtggcattctgatccggcattcgcggtttcttgggcggcggcggtggcggcggcggttggtggccgcccgggcaagtcgtcaccggtgcagtggcgcctttccgtggaagcttttgtgtttttttctttctttccgccgccgcggtgtgctacttttggtgtgtggtaggtatgcgcctcgcccccttttcccgcctttgcgtggcgtggctatcaagcgtcggcgcaattgcgttggtttctggtagatagtacccgcatcttttttgtttggtgggagctctcgagcgaaggttcctggcaa

SEQ ID NO: 20786 - DNA, 1501 bp, Oryza sativa
tgcttgcgaagcaactgtccagttttggacagaacagcaatcatcggttaaaactagagtctttttaagcaaactagggacaacggctaataacgaatagttagcgaacttttattagtctattacctgaaaagtattttactttggacggagtgttaagtgacgattttgagagcagagctctagcaggttgcacgtagcacgattgttgttctctttggttgtcatcctgtcctgttttgagttgtttttttaatgttatttgatgaatgttcaggtcgtggtgcgaatcaagaagtggaaacctccacccatcgctcatcttcacgcggttaaggcaagtatattgttaaacagtaaatgggcggtgattataaattataatgtcacaagatgccgcctcttgttctttctgtatcattaatgcttgttatgaagttatggaaatgttatggtggtataataacggttacaaggtgaaaatggagtaagtcggcatttaatgttaaatgcatttgcattatatgcatctatggtatgaagaaggcccaccttgtgtgggcatatgggcctacttttctatgttatgaaagagggtgaatgttgactggcattcacccaagcaataccaatataagtaatgacatgagcaaatgagcatgtagttagctattcattgcatttggagtatgataaatgtttaacatggcaatagaatagttcctatgtgatgtttactgtttaattcatatgctttgctgaatcctgtactcatgcttgttgttttgatgtttttccttgttaggtaatagttgaagccaacatatgcatggggaacgggtgtagctccatatgagaccactatatatcacttatgcaaccttatcactactttagatgcttagttaatatttaagcttattcaccggattattaaacatattatttgctccacacttttctgaaaaaacttctaccacattgtgtagaccacctgttttaagctacagtatatgttaagtttatttctcgaaatatttgatttacccctatattagagtagataatctgcaacaacaatctactcgataatctaaatcaagtagggctgaagtgctggtgtcttttgagctttggctgcaagcgaaacattaatgatcgtcagtcatggttatgtgtgtatggctgctgtacctgtgagcttgtttagtcttatgttgaaatgattatttggttagtctagtctctagtgtcctttttgcagaggtggtgctgccaaaatttgatttttttgtagtatatttatgtgtgtgctgttggtaggatttaggctcacaatctccccgaatctttctcctcaattccaattccattctttgatgcaggagcgagcgatcaaatcaggggataatggaggaggacagcgtcatcagcaacggcggcagggaggaggaggtggtggttgcgaacggcagtggcggaggggtaggggggacggcga

SEQ ID NO: 20787 - DNA, 1501 bp, Oryza sativa
gtaccgttgtgccgcagccaacatcaacagtgtcataaacatctcaatgcaatggcaggctgcagcaaccatagccgcacccatttcatctgaacagctttataatatattgttttacaataaaaaaagaagcatccttaatcatggcatatgcatttttgatgtgttctttgtacggatagatgagtatggaaacacttcgatgcaatggttactgtttatttgtgcgaagaaaaatgattcttttttagacgaaaaaacatttctgtctggtggcaaacaacaatgacatgatgtttaattagtaccttttgattgccctgcctccttaataagccctacgttaaccggttgtgaaagcagcagtaacgtgtaatcaacggaggagtacgtatttaagtttaatgttgacgtacgttggtcacgttcataactgcatgctaaattaattcctccatcaaaatagccatcatctgggatctggaagttgctcccgtggacgcaatcttgcactcatacgcatgctgatgcctgaggagcatcttttttggggacaaatccaagattaaattttaatgtcaatttctcataaatatattcataataggtataaaatcaactttgtgggggaaagtattttaaattacgaatctattggattagttttaaaacaccgcttatactttgagtttgactaattttgtgggccaccgttggaaaatactaattttgtgggtaaattatctggaagtttcgctgtttaaaaacaaacccaataagagaacacttgatactttgatgattgggtaccctatttgaagatcgatcgaatagcaccgtccagtgtactgctagctacaacctcgaatgtttgattttgtatcttgtatttccgtgctaaatctaacctgcttctggatgcaccaaacaatcattgagatttggtccggatcacgaacactattcatcttgaattttgaaacgaacacgtcaacaaaatcattaaattgcttgcacaattattttttcttttttacaaatatcattttcttgcattagtggcatcctccgtgccgcacctaacatgggcacgactttctggtggaccgatagaactgttcactttctggagatgcagtgccactggccactgccaacccgccttctgaacttgaactaaaaaaattttgaaatgtacgtgaaataattaaaaacacccaactacaaaactgactcgtttgttgtgtttgtgctttcatgtcttcaaggcatcaacacaggcaaacaataatttgacacgaagttcagaagttgaatgcacgtggagccaacaacaaccaaatgaaagcaatgtatacctcggtgaagtttttgaaacgtgtgtgtgaacaaaataaaagccccaacaacgaaaacttctggtagttatgcttaagcctcagataccggaggcattcaaatgaaaattcaaaagtcaaatggccatggagccaaaacaatt

SEQ ID NO: 20788 - DNA, 1501 bp, Oryza sativa
acaaataccacagagaaaatcttttttttatagaaacgtgtttttaattaagagtggagcaaataatccggtaataagttgaaaataacatggccaaattttctccgaaaaaatgtatggttgggttgactgactggttgactcggactctcgtagtcgcagggctgggctccataaccactgggtgtctgggcctcatgccgagaaaatgggccgtgtaggattgggccatcgccctgctctgtttttcttttcttttttaaatataaaaagtctgtgctctggtttcacgtcgtcatcgtacagataaataaccaatagctctctacgtagtactcctccctccgtcccaaattataaaccatattttttatatgatctttaataatatatgttaatcattaatttattttatgttatgtttttcctagaagctgattagacattgtaggtttgcggaggaggccgaagctcatgcctgtctgaagggtattcgtcttgtaataaaatggattaatctcccgatgatcccagagacagattgtgctaatgtagcacatgcccttagaggaaatataacggacagggtctcagctgtggttcatcctgcacgaggctacggcataaggcgaagccgctgctgctcgctcagtttacaattaagaaggaactaatatgcccatgctaaacgctacggtgcaatactatttgtctttaataacttctaaaatttaatgttagcaaaaaaatatttttctatgatcttaattttccaagggatcaatagtaatatatacaatgaacttcccatttcattacacctgttgtttggttattggttatatctccaaatgcaattctcggtccactgacaaacatatttttctccatacatacactacatctgtttagttattagtaacccaactcatgtttactatacatgcacatgccccctttggacgtacctacaaatctagatcgaattgaatgaaacatacagcacatgctaaccatgcaaaagatgaataaaaaaatattcatagataagcccactgcaaaaatgttgtctgcacgtgtgctctatactgaacaccattgtaatatctgacacactatagcttatttacatatttgagtgcagaaaacaccgattgctatttctttatgtagagatcaaacttctccaccttgaggctgaaagatatatatgttatataaacaagctgtatgcaataacaacgacaatattgtttggatctacaaatggttgcttgttccaggcaacttgaggcattttatgtaccgccaatccttcatttcttatcacagtagtaatcttgtagagatgtagttgttattgttacggtgctataaagatatgggctatgcaatgagatggttatgcagtttaaagaaatacaatatagctaagctcaataaaatataagcagtgaacccctcgaaacaataagcagccaatggtgttaggtatctggat

SEQ ID NO: 20789 - DNA, 190 bp, Oryza sativa
ttgtctataatacccattcatcttatttaaaaggttatgaaattattatttattttatctgtgatttgttttattatcaaaagtattttaagtataacttatccatttttatatttacactattttttaaataagatgaatggtcaaacgttaccagaaaaaatcaaaactacacctaatttatgatggg

SEQ ID NO: 20790 - DNA, 1172 bp, Oryza sativa
tctcttccctccaattgacttctcttcattgatggacggagatttgtatggctgccatccgaatgaccttctgatgggacggcccatacctacctccacttccgccggaagcaggcgcgacgtgggaacatggctgtctgctgacgacatgaccattgtcagaccggtctcaaatcggtcattcttgtacaccacgtgtcagtttaacaatctgcatgctcgcccctcttcatacaatgtcttgcttgtaatggttaggatgaagcctggtatatatctgaccgggaccaacgtgccatctccaggagctaacacgccggctccggctagggacaagtgcttggaggctctcgtcctgacgggatggggcgaggcgtgcgtcagaccgcctgtcgccacctaacccacgatttgaccggtctgtgactgatcacagaccggatgaacgagcgcgctgcactgcgctacatgcggcgtgacgcgctcgtccaaaccgcaataaatgcgattaggtgagtgccgctgcgctcacctaacccatacacgcggcgcaaaatccacaaggggtcggggcgccctagccctcggggccgagacgggagcggtccgacccctcggggagacaaagagaagggcggccatatcaccctcgggcccgacccccccccccccccgagggggttaggccacgtgggtgatcgtgtctgcctcaagtctctaagtcatgatactcccggtcccatgtcaccgacatatatatatatatatatatatatatatatatatatatatatatatatatacacacacacacacaaataaaacaaataaaattttctttattttataaaatcctaatacaattttcttatgtttatttttttggttttttgggacggatggagtaagttgctggtgcgcacacgccctgctcatgtgcaggttcacctggccctagccctggagggaggaatggggcaaaacttgtaacgaagaaactgcttatccatatattatgacaccatgatttaaatataattagtatactatgacattaataatagacacgttatgacaccaacgaaacgattttctggatccgccaatggcaacgagacagcacggcgacgagccaacgactgactaggtagcgacgaatcaacgaccaacga

SEQ ID NO: 20791 - DNA, 590 bp, Oryza sativa
cgagcctcccatttgccgttgtgatgatgcctgaataaaacagctgttaattaactgattctactagcaatgttcagtagaaaactggaaccttcagtgtagattagtactgattaactaccttgcaactcctctgtacttggacacccctcttgagaagccactgctcttcctgcagggtgaaaaaggtttatgatcttaatcaagaagaactacttcaaaacacagcttctcagacatgaatatttcactatgtctgatcagagaagcatatttcaatgggttttgatttggatttttctgaaagtttgtaatgatctgaattaacttctctttgttgaaagtcagtggtaacatggggttaactgaatatttacctccggagcgatccgatgtactcttccctggactgcccctccatttccttcaattcctcgtcatatgttgacagctgcagagagttccaacatgagaaaaacagcaacaatcttcctcagaaaaccaaacagaatcaaacaagctgcactgtgcgtgcatttcttgaagggttccgaagaacgcttgtgcagaggattcagttcagagaaaga

SEQ ID NO: 20792 - DNA, 1501 bp, Oryza sativa
ttgagcctgaccaattctctcttcaaataagtctattttgcatccttcaactcattccctcaaccgcaatagcgggtataacgcccccttaatctttgaaaaccagagcaaatcgagtcttaggctgtttgaatagcgggtttgtcttacgtgtcactcataggacccacatgtcactagacgccgacgaacttcactagctccgatgactcccatatgagagccacataggacgaaaccgctacccaaacagtcgaggaactcgatttgatctggttttcgaagattggggagatgttatagccggtatttacggttgtgggagacgattcaattaggagcaagagctgagggaggtgaagtagatttattccttctctcttcggcctttgtgctttggctcagcttggcccaaacagatttgtagagctggcccaaattaatggtacctacgaaaagtggcctaaagcagattctattatacttctcttgaatttttggcttttctttcctttgctaccgacgccagtgtagaaattccttacggaatcaatttctttttcgattcttttttttttctcttttttgatggttacggaagcatctttccacttttatgaacaaaaatgttaatgacttgagtatagcagttgaatactaataacattattatcactgctcatgctaaggaaaccattatcctgcgcaattagaattgcacatgtcaagttctatcccttgggcatcaacaatatcttatgactttaccatgacccgtgacttgatcatgagcacatgataaaaccaaactgtttgcgaagaaaaaacttatgactttcattttcaatcttggccacttgtattcatctctaactattctttaataggtaaataatgtttatatcgacaacaagatgtctgtaatggttttattaatctcaaaacatgatgcttaggggctggtcagattgataccatttttagccataccacgtttagtttgttgctaaactttggtaaatatataagaaattctaccaaaacttgataatggttgatgccattttttatatattttgacaatattgttaaggtttattttagctacaatctgcacagtccctcagttccaacagttcgaagatactggctcaaataaagtgtacttgttgtatgtgtattcgtgtttatgcgaacaatatttcagaaaagaaaagaaaaaaaaagaattgctaacgaaagaagaaaaaacaagagagagaaacaaaaccggattcagacttgtcgtgccggtcccaccgtggattcccaaagctaggtgggccccacctgtcagggtcacggactctacgcgttcagtggatataatatcccggcccgggggtggggtggggggtgtgcccatcaattgcgactccagaaccttctcttcttccttgttcgttcatcccctaaccctttctttgttcatcttgttcttcctcttgtcgtctcgtcgaga

SEQ ID NO: 20793 - DNA, 1501 bp, Oryza sativa
accaccgccactatgtagggagccccatgcctaccctccaaccagatttagcggtgggagggcgtcaccgctcgcaggtgggaagagagaggcgcgatggagagtgtcgttcacttctcaccttatctgttcgtgaggataaagatgaacagtcggcttggtttgtcttttactggtgctgtttttagaaaaccgacacctacaatatattataggtgttggtttttaattaactgaacttatgataaattaaacgtgttggttttttttaaaaaaacaatgtgcacctataatattggtttcaatttatctctagaaccaacacctatagtcacttaaaggtgccggttgtttattttaggtgccggttgtttatgttttcagcctacgggggtgggaaaagttatgggaaattttgctacagaacactttttatgtatggttttacccataggacattgcccagactcacttttgggggaaaacactccgtaaatatggtaatttgtcaatggacaccgcgccgattaaaataataatttccggttgaagaggatagagaaatcgcgtgaaatgtcaaaaatgcccttgggcccacatgtcagctctatctcctatttctcttctccttctccttctcttttctcttcttctcttcttcagctaccacggcgacgaagcatgcatagagcggcggcggcggctagcggcaagcgtgagccgcggctggtgtcgtgtcccaacacaactctaaaatacatcctctaaattatgcctagaataattaaaaaccgtgtgaaagcctccaacaattaaaatgtgcaaggttaaaagtcaaataaggcttagaggatttttgtatatttcctaaaagcctaaaatacgtaaataaattttagtggaattttcagagcacaaataataattgttaagaaataaacaaagttaaaaagattttataaaaagaaaaaccctaaaaagtcccccttccctcccttgggccggcccggcccatctctccccccctctctctctctcctctccccgcggccaatccggcctctccccgcgcgcgccgctgacgggcgggcccgcccgccaccctcgctgactggtggggcccacccgtcatccccttcctcccgccgctcccgccgcctcccccgtgccctagcgccgccgccgccacgaatcccgccgcctcccgtcgtccccacgtgcaataaagtggggggaattactccccgtgatcccctctccctttccccctatttttccctctctctctctcgttcaaacgggcggatttgcccccgcaaatctcgccggcgccattgatggcggccggacctcccgcgccggtttccttccccgccggccgctctctccctcttccaaccctatttaaaccctccccacacctcctccgtccgtttccgcctctcgccgcccttcctcctcaccggattcgagctcgcgacatcgctctctctctccgccg

SEQ ID NO: 20794 - DNA, 1501 bp, Oryza sativa
gtgctgtttggtttaatacttcaacttgccacacctctttagctttgtgtttggttcagtgccatagttatggcaagcaacactttcttactacctccgtcccaaaataagtgcagctgtggatatccgtgcccaacgtttaaccgtccgtcttatttaaaaaatttgtgaaaaaattaaaaatatttagtcacacataaagtactattcatgttttatcatctgatagcaataaaaatactaatcataaaaaattttcaaataagacaaacgatgaaacgttgaacgtgaatagtgcaaaactgcacttattttaggacggagggagtactattttatcctatatgtcatagactcaattctttgcctaattttgtcaaagggtggcttacaatttataggccacaaaaagtgtggcaagccccaaaccacacttgcctaacattgtctaaagtgagttatggcaatgttagttaagaaccaaacagccattttctatgtatacaacgtactaacggagtattggcatattggagtagcagttgcactgttgcaggatgcagccacatggccctagtgctgcacgcctgcaccaccacatcacaggcatacagtagtacaagccgctgccttgacgatttgaccgaaccaagaacaccatcactacgagctctgcgcagtcagcttttcgagatttgatgattcgttcggcccgatccgttgctatcctgatcagattctgaactccttttctctctgcgcccatctactgttggtactgaactttgctactgttgctttcacgctgtgtgacttctgtgctttattgtttgctcatgcgacatatactctctcccttccaaaataagtacagttttagcactatttatgttcaacatttgaccgttcgtcttatttaaaaaaagattatgattagtattttcattgttattagatgataaaatatgaatagtactttatttgtgactaatttttttaatattatttataaatttttcaaataagacgggtgattaaagcgctaaacacgaatctttatgtctgcacttattttgagagggaggcagtatgtctctcgtactctcgtactctcgtactcacttgcttgcttctcgcttggcgttcatggtgtcgtgcaaaccctgtgtgctcggtcatgatactgtggcacttgccgctgagaaaataaccagagatgcagtggtggagtagagtggagtaattcattggggcgtgaaagcgtcgtcagaaattcatcggggcttgcagatgcagcagtgtttgtagcgagcaagaggaagaagatacgacggtctcttctactgctactctagcttcttccttgcaagttgcatctacagttccaggaggagataaaagatttatttttttcctttcagtgctttcacagcttcattttgcaaggtaaacacactgttctatctatctgataaggatcttgttacaagcagttgttttc

SEQ ID NO: 20795 - DNA, 1501 bp, Oryza sativa
gcattgcatgtatatatgtacagtggaactcacgcaatttcactatgtgagcagtcacttgacatggacaccttacttgctaagacaaggccctttttgtccacccctgtcatgcttgattgtaatccaaggatagattatggttgggggagcaaaatgacggctcaggcgatcgtcctctcaccgagcatatgggtctgaataattctacgagcccacgacaaacttgcatatatgccaacatgtgttcgggtgaggggatatattaagtgtgcatgttctccacctcatttcatacatgtcctctaaatagaagaaatgttttcgttggcagccggcttaagtcagccccgagcaaaaattgtcttcattggctgctaactaagggctaccagcgaaaatatatctttactagcggttggcatttgatgatatgaggcccgctagcgaaaaagcattaaactagttgatagacgacaagtgacccactagcgaaaactattcgctagctgcttgttgacacgtggcccgtccgcgaatatgtttatatattttcttttttacaaaatttgaaacagtattattttttgtttgttttgtgtattttagaattacacacagaggatataactgattgagctatcgatagctttatatttacatatttcctacatgtgtgctttttcagattttttaagtacttccgtggaattctaagattgaagttttttttgaaaaaaaaaactaagattgaagataatttccaagtttctacctatttccatcatatatttttataagttatcatgctaccagttaatttttgtatcatccttctgacgtgtgacagacatgttagtgttgttatatcctcttgagtgtgcacacgtttatatgagtgcttacgtctatactgtgtgttttgaaaaaataaatgtagcctctctctctaaccaaatttaattatttctaaagttttacacgatgattaattaagaaacactagtacagatccttccatctgtgacggcccataacaagactggaatttgcgggccgtcacaaggaagtaatctcaatcgggccgaagtttcgcccgattgagatatggtcgcacaaccatggtatatcggcataaaactaaagcccgtcacggatgacacttatctgtgacgggccatagttataggccgatataccttggttgtgcgaccatatctcattcgggcgaacggcggcccgatagagattacgcccatgagacggcccgcacatccccgtctggttctgggccgtcccggatggtaggatcggggcaggcgttatggagcgattcttcgtgtttttccctaggaatagggcagctggactacagtgaccagcatggctgaaccgactgactaatattaatcattaattgagcaaattcatcacgtcttacttttgcaatactgatcttataagatgtgcatgtaatttgttttttttattttgtagcaat

SEQ ID NO: 20796 - DNA, 365 bp, Oryza sativa
cggatgaagaaatgaccaactatataagagatgtatattttgtgaacaatcttacaaatcactttgtcggatgaagaaatgaccaaaatagaagttatagatcttgatgagttatacaactttgttattgatgactttttcagctgaaatcatttactgaaataataccggtaagaacacaataacatgatagagcatgattttagaaacatttaggaaaaagaatcatccaatttggagttcatatgagtgagatacattagtttcaaagttttcaaaaaaaattttgcaagcggctacttaagacgcccgtatggaaaaatcgatttttccatgcgggcacttaagtgagccgtatgcaaaaa

SEQ ID NO: 20797 - DNA, 1501 bp, Oryza sativa
tcaaactttcaacttttccatcacatcaaaattttcctacacacataaactttcaattttttcttcaaacttttaattttaatcaaactttcaattttagtatggaactaaacatagccctagattagtgttcgttcagattcaattttagaagcttttttagacggatgacgtgtagtaaagcctcaaatcaactttcagaacaccagacaatataaattgctgcaatggtttgaaacccgaaatcaatttttttttagaacttaaacccgggatcaattcaatctcgttccaattaataaactgtactacattttccgtcaaattaggcgggagatattttgctctccgcatatgaagtagacgagatggtcatcgcctggcacggcacgagcgtcgccacttggcagagaggatatcattcaatatggctctctcgtccacgttaaccaatgatgccaatcagtttctctttagagcaagttcaatagtatagccaactactaactccaattcatctatagccaatctaatagctcattcatataatagttatatactacactattaatatctagtcccacctgtcatagacacaccgcgtcttagagtccgtgctacagctggctacaaatctgtagcccgctgctcttctctctcctgatttatcttcttaaaatatgtttacagctggcttataggctgttattgtacctgctattagagtttagaagaacaaaatgctgacaaatcctggtcatttcttgaccgtatgaattctagaaaaataagattagtactcccttagagcaggtactatagcaggctattagctagctgtaaacatattttaatgagataaaagatgagagagaaaagcagcgggctacagatctgtagccagctgcagcgcgaactccaagacacaatgtatgtatgacaggtgggatcatatattaatagtatattaagcaactattctatgaattggctattagattgactatagatgaattggagctagtagtgggctatattattaaacttgctcttaccgacctttgaatcgatttcagtgacgtctcgctcgatctcgtcagctttccatggcccaattttctcgacggatatatccacatcagcgtgcatacaagtgtgtcaaagctcgtgccagtctccaacacacggaagcttccggctgctggtcccggtatcttgcacttgggtccaaacgagacaacatcacacaaggaaaaataaaatcgcatcttccaatcgcctcacactgcagcggcgcgcgtggtgatctgtccatttctcatttgtcgccgccactggaaaatcagaggagacgaagacttccagcaaccatgtcaagctgactcccaagcttatatgccgcgccggcttgcacgccctctgctccacgagacgcgacgcgacgcgacgcgcgcgcgcactggggagagtgtctttcttgctgcaatggctgagaagaagg

SEQ ID NO: 20798 - DNA, 1501 bp, Oryza sativa
attatgccgccggggcccaagccgacggaggagaggagaacggatggagacgtatttatgcgccctcaacctcaagtgggtggcggtgcatggtatggtggtatacaatacaacgtttcctgggctactgcctctcggtgtctcccttggatgcaaattgcaggagacctttctcgcccaatactccctccgttcacaagaccgttcacagaagttaagtatatttaacatttgagttttttcaaataagttattcctatttgtaatatttatacatttaacacttaaatgaaaagataaattaaatgtttgattagaattcaaggagtcatctaaatactcattggatacatacttgcattcactccctgattctataatattcaacaacatgatttaatttctctctagtcttgatgacaaaagtaataggtgtaacttttatagatggtgggagtacaatacaacgcgtcctgggctcctgcctcttgggcagtgtttggcaaatgtgttagagaaatgatttcccacccatctttaaatcctaaccattcattatccctcatccgtttaatcctaaccctttattcatttctcaatcccaatcccactcctcatttcccattatccaaacacaccctccatgtctcccttggatgcaaattgcaggagacctttcttgcccaaagtttcaccctgatgatttgctgttcttggtcaagcaacgagctagccaacgagctcgtggttagctttgatgcgtttgagaagtttaaaattcttaagagtaattggttgatagcccgatttctgataaccttattattttttatttctagtttattttttatgaactttatagttacagattctcgtaatctaaaaactatttaggaaactaaagattatagaagaagttactacggctaaaagccctctacatatgacctaagtaatattatctacgctgttgagggtgtatgtttgcatcgcagagagagcttacggctatacgagcctttctatcaagggaggatctatgattgagagggattagagtggatgggtacgggcattagtacatggctctattattgctcttgtcccaggctttatggatagctttttgactcgagcctttgctttcacttttcgttttaaaagattttagttggattttcaggagactcaccaacctactgatgacagatacttcacctcatgacctcaagtcctcaacccagcagcagcaggatgaaaattttcttttattttttcttaaagtaaaatatagaaatccacgtacacttacgatcaaatttatagctaattattctttcaatgttaggtgatgtatccgtcgataacgatgcgcctatgatgacttcataaatctcagcatgtcccgatccagccttttgaagatgccgatacagtgatgggtcatttaactataaaattaaattcacttaccgtctattaactttacgtcaagcctgta

SEQ ID NO: 20799 - DNA, 1501 bp, Oryza sativa
cagttgtctggataatggagtgcatctgttacttcctactgtaggaaggaattatgagacaaaaagctaacaagtatgtacttataagataaattgaacctgaaggaaacagagttcatcagttacgacagaataatgaggaacttcacacatggaccttataacttgagcatcagcatttaacaatcatgacaagtacaaagtgagtcatggtgcagatggaggacataaatgttgcaatcaagtggccacacatgacacattagaaatcaacttaatccttcgaaaccaaaatgttacatcttcgtagtcccaagtatattgtagtctacttaaagccccaagctctgaagaatggaatgcttgactttaaaggcatgcatacatttggaacagtgttttgaagataccaattttctgattctgggagatgaaggttcacttgtttcagaggcaccaaattgtagaccactgtaaagaaaaataaaacaggagaattttcagatggtatgacaatcatatactgtaggcatagacatagccatgaaattaacacataaatcatgtttgaatcagtgttcatgccctcaatattcgttcaatttcgaaacaggcaactcccaaagcattcacctactgcaactgtgcaaaaccaaaggattgagttttatacgaagtagcagttgagattttctttgttacacataccttcaaacaatgaaaactacaataatgtgagaattagatataactacgaaacttttaacatgttaaataactaatctacaggagtgttatgatttcagtctacctaccatcacagcaagccacaagaaagagatgcctttattttttaatatttgcctcttttatgtattttgtcctatgatataggggctacgggttcaataatttgttctcattgttcattggtctatatactacagtcctatcattgagctttgtaaaagataggctggactacatgaaattgagtgctacagcctactggtatgaaactgttgccaagtgtcttaacattatctccaatcctgttgattaagagaactcctgtgggtaacaaaagcaatcatcacatccaggcttgttacaaacttagacaaagtttccagtccattacctgggctgaaggagcttgtcatggaaaatggaacatttgtcagaactctcacataggctggtcctactgacatccaaaatatagaacctgagctgcacagtgaggtggtcgagtacttgagaacttccttttggtcataaagattggtcattgggatccttcaaatcctgggcctgaattggccacacaactagcccctattggcacctaggctttgttgtcccaattcaattacaagggggcacccccaaattgggcccccccccgggggcccccaaacccaaaaaccaaaagggggctgaaaccctggcacccatggtctgcggttctccatatgtttattctccctttttaaagtag

SEQ ID NO: 20800 - DNA, 501 bp, Oryza sativa
attttgctatacatacgagatgaggatgatctgtgccgtggtccttttgcgtcttagcttgaaataagggttcgtgcccttggatggctcgggtcggggctagtgcctggggagatccacatgtcgagactggccaggccgggaacgtggtgaccgaggggtatgggtgacccgattgtgggtttttgccgattcccccccggagttcaccatgccccggggcacggctcggttctgggccccgcttggcgattttagctgaccgaaccgagcccccgagggcaaggttgagcacgagtgaccttatttcaagttaagattcttcaaaaggaaaaacggcacagacacaacctttagaaaattgaaacttcttttattgaaatgctgaaataagaaaagtaagactgtgcatgtgtggtagcccccggccaaccctgcacacccgaggggggtgcggggttggcccgagccaaaacctgacacccgaccccccccttcagg

SEQ ID NO: 20801 - DNA, 237 bp, Oryza sativa
tttttggcggtattccgacttccgaagggatcggagatcggcggtgcgaactccgaatcagaatgggagtcgaattgattcgcgaggatataaggcgcgcgcgcgtggatgacgcagcccatcaattcgacgtgcgattccagcgcgcgctctcgtctccggttaattgcttcgatcgcttcgcgtcgcggcacgtacaactatctccctcttcgtgacatttcgagcagctagcca

SEQ ID NO: 20802 - DNA, 154 bp, Oryza sativa
ggatccccgtctcctccgccgagatggggagcacctcgtcgatgctgacgcatacgacatcgaggaggtccaggaccactgcgaccacgcctgtgagtttgcgcgcttgtgtttctctctttcgattggattctgaactctcaacgaagattga

SEQ ID NO: 20803 - DNA, 191 bp, Oryza sativa
cgtttaattatctcgttattacaaacatggttaattacaacttccaaataaagatcaaagcagacatattatgttaaacttgtgcctgcaaaagctgttttattcagttaggatagtactttcctttcatgcacgttatgtgttttagccttttagctagctaatattattacttgtagtactagaacaca

SEQ ID NO: 20804 - DNA, 814 bp, Oryza sativa
atctttgtctacatgatatccttgaatccttctaagatacatgtttacatagcattcaaataaaaaaatcagcaagatcaaaccttgtcgtgtgattttggccttggttcgcacgcaccaaacaagtttgtgcattaaaacaagcgtttttcaagacatgcgctagattgcaccctcctaacaaattcgtttaccgctaatgcaatttacttgtttggaaatgtacggtttcagtggaactttcttccttaattatatatttaattatatatgccaacagtatataaattaagggtatttattttttatgaaaatgaatagatttttcgtagaaaatatcttcatcataatataatacaagatgtttatatataaaaaaaatcaagtattgattatttgggttggagaccgtgtgtatatttgttgtacatttggggtggagcctaaaaaactgactcttttttaaaaagaaattctttggttagcaccaattattaaatactactgtacctcgtacacccatgatggtctaatttgtagtgacgcctaaaaaaattatcacatttatctaagataattctagtattatatagctgatgaagttgagtttgttgctgcaattttgcatggttgtctatttacatatttccgacatatgtgtgattcttttgaaaactttataagaaagttcaaaattttcaccctacatgtggtttcaccatatatttttctgattaacactgaatctgtgataaaattgactaatttggtgaaggtccgatcccatgcattcttgaaatgtggagaaccaaaa

SEQ ID NO: 20805 - DNA, 278 bp, Oryza sativa
tacacaaaagcttgggtgctctccaacacttggatgtgaaaagtgcttttctaaatggtgaaattgtcgaactcgtctttgttgaacaacctcccggttttgaagatcctaaaaatcctaaccatgtttataaactttcaaaagctctttatggtttaaaacaagctcctaaggcttggtatgaaagattgagagattctctttcatcaaaggatttcaaaattggaaaagttgacaccacccttttcacaaaaatcattggtgatgatttctttatt

SEQ ID NO: 20806 - DNA, 641 bp, Oryza sativa
ccgttcaagtctctaatttttccttaagaagtcaagaacccatttttgtgctttgtttctgctgttatgtggagtttattagagtaaaagcctttttcttttccgttggtcgtgtagacgctgcagcttcggaagatccgctcttcgtggaagttgaagccagcgtttgggaaagcgagcaaggcaagtcacatcatccttgagcatattgaatcccagtttacaaaattatttttaatttaaattaatgcattatcgctttatttaaattcccgcgttatcactgttttatttagccatgcctatttacctttgttatgaccatactattattgttattgatattattaccttgttcaccctagaataaacaaaaccccaactagtggaccctctatttatggttccactagtatgaacttaggtagatgcttcgctgattaataggacaacattaggtggttttataattttagactttgggtatattcatatcatttggtcactatggaattgttggtttatggtggaattggacatacacctctcttcctctttcaaaacccctaaaacctgttttcggtggggtttgggtgcatgccagttgtgggaagtagcaccccggccactataaggattaa

SEQ ID NO: 20807 - DNA, 218 bp, Oryza sativa
aacgccttataacctgaaactgagatgatccgtggcgttggacgctgctcttaactgcgtccatatctgggacgttctttttcacctcgtccttcccatttttttaattcctagatcctaatcaccacttatttaattattaaagggattattaattattctatgtatagaaaatgggatatcactgatatgctgagataaattatgtgtgtgtcagt

SEQ ID NO: 20808 - DNA, 499 bp, Oryza sativa
tttatatgccgcgatgaaaactgtaactcttttacatctttcgtataaaactaatatcacgtaacgtaataagaaacaccgagggatcttccggttagctacacaaggtggtgagctagacgacttggattcaaatgctcatccattataattatttgatattaggtaatttcttaatatttacgtctttacataatataatataataggtagatataatcggtaagaacaattcataatactgattaaatttcataaagctacatatacttatatgctatatgtttaacctaatacttttcataaaactacagacttaaagtatcgtatcatattagaaaaatacaaatttaacattagttttatcacaaaactacaacttttatagccttaaatatgatatggataaaaactctaaaatctatagatattttataatttcatcagtaaatctgtagttttggatatgatgccttaaatcagtaattatatgagaaat

SEQ ID NO: 20809 - DNA, 1501 bp, Oryza sativa
tcaggtgcatcgactagatgcaccgagtggtttcgataattgtagtcaaccaagcgacttaatattaatatgtagcatatgcggtgtgaatccctgaataatatgatccaagtgatataccgactgctttgtaaaatatgatgagtgtaacctaaagttggctacatcattgaaaattcacatagcaaaatagctataaggaagcttgtatgttgtgaataaagaaatttccaaagtattgggcatacgccatgcgcacactgctttaacagatgtgcttaagtccctagaagacacatggttccaccacacctggaaatatatggcatatgtggtataaaatccgagtaaataaactcataaaggatttaccaaccgcctgaaaaatgatcacaatatataatcagcctaagccataatattggtcaataaaaatgcacacttacgtggcaaaaagcaatgatattgtatccaatcaattgcttaaaaacccaaacagcaccatgactatataaaaaagtcagcgggccagctatataaagctttactgtttgacaccttttaagatgcattgtaccaactcctaaaaagttgagtaactgcggtataaaaggattttaaggtattgggcacttgatcacgcgcactttggcctaagcaaaaagtgcctaagtccctaaaagaacgtgacaggccacacctaaaaatatgggctgcagacatattaggcctaggccaaaaaatatgccttcgacaccctttaaaggatgacgcatgtaacatgctcccgagtaataaatcttccgggtaatatagaccaagtgtagctcatatgaatagcttctgatctgaatgattatcccttatgggatactctaaaataaatataataattgaatcccgactggcgcaagtattcggttgatagcccttacggggaataataattggtccagtctttgagcatagaaaatagactcatgactttgaatccatgtgggatgtatccggaacaagtccaaattggagatataatcctcacgcttgagttgatgagcccctgagcatatagcttgtccttctgtcatagtcaaaattgtatattggcaatagctgacgcagtcggcatggagatgaaatgaccaacatgaagacgaaattgctcatcagaagtaacggaagatgtcagtggtagtaaaaacagtgacaccaatcaaaggtaatgaagttgcataaccatggaggcgaagaaaccagtcggcaacagtcaggtcagccagcaatgaagatgaaagcgcccagcgataaagttgtgtagccatggcagcgaaataatcagtcggtgacagacgatgcagttggtgaagaagatgaagatgcccattagtggcaacataataagccatccatgaaggcgaggataccggtcggtggtgacgaaagcaagccgacggtgaagatgtagacacgcatcaaaggcgatgacgaaatccaccaatca

SEQ ID NO: 20810 - DNA, 568 bp, Oryza sativa
atttttcaatggtacatgatttataaaagtgtatatatatatatatatatatatatatatatatatatatatatatatatatatatatatatatatatatatatatatagtaaatttgtttggtgctccatggtgcccgggcaccattgttgaaattgagtatatacctaattcaaatgagtatgaaactttttcaattacttagatattaacattagctactttactaactagttcaaagcaagtttgaactgaatttgaacttgtttttgttagattttgattctaggtatatagcatccatacatataattagttaggtatgtaatcatggattgtgaaataaagttaaatttgagttgttttgttgataggtataggtatgaatcgagttattataactaggtatatactcacaatttgaaaattttgaaaaatttgagtgattttgtgtatttgataccatggtgcccccatatgagtgtcctatatatatatatatatatataagtaaaagtatatttagtcttgaggaagtttgtgccctctagaactggccctggacaga

SEQ ID NO: 20811 - DNA, 384 bp, Oryza sativa
  unsure (1)..(384): unsure at all n locations
cgcgccattgagtagcttatgccctcattcctgcacgncgactctagaggatccccatgcatcacacaaacaattattgttatttaggaaaactctcagaaattttaaagaaaacattttgaattttgaacacatcttttttcctgactttgaataggtcttttttgctatatttgacaatactttctttggcccgaagaacatcatattgggacccacaacccacgtgtagacacaaactaaaattcacaaattttgaaccaaaattgtgaaccctactttttttttgcggggaaattgtgaaccctacttaggaatgagatttatgtgaacccacaatccatgttttgtttacatataattatactttcccctttttttatt

SEQ ID NO: 20812 - DNA, 1501 bp, Oryza sativa
aaattattatatatggcatatataatatatacaaactatgatatgaaccagagagtagcataatatatatgtgttggaccaaactcatcacttaacataatcacatcagctgaactgctttgcaatggctgtacactattttataacttagttatgacatgtactccctccgttccaaaataagtactccctccgtactcttaaagaaaatcgtttaggacagcgacacagtctccaaaacacaactttgacttcttgtttctataaaaatatttattgaaaagtgatatatgtatacttttatgaaagtatttttcaagacaaatctattcatataatttttacatttttaaactcaacaacttaaaagttattcatgatttatattcccaaggtttgacttaaacattgttctaaacgacttcttttataagtacggaggggtatagttttatattgttcttatccgacatttgaccgtttatcttatttactttttttataattagtatttttgttgttattagatgataaaatatgaataatactttatgtgtgattattatttttaatttcttcacaaatttttcaaataagacggacggtcaaacgatatgtatacccacggctgcactaattttaggacggaggtagtattaattagttaatcaagtcgtactagggaccacacattaattatgtgaccgttgatatcccatactctagttcaagttgtgtgtaagcaacaaacagagagaagctgaacactacaataactagctgcctgcatcaattattgggtcaagatattagacgactcgcactttgggtacggcgtggtcgtacagacaaatgtatttttgatgatctgatgttggatgctctggcaaagtggggcaacttacaaaaggaacaaaataatggcaggctacagtacttagatatatagagtacaaactagttatttaatatacaattcacatattatcgtctgtataatctttcaggagatatatatatatatataaatgcacatcttattctatgttttgccattaacaaatatcaactatagaaaaatatcatcatacaaacaaatttatctaagaaataccatcgccatcagttaaccctatccattttttctaaatacccaaagtgccctcacataacaaaccaaatcacaaacttgggccgatggacagtggccttgtggttgcagttggttccgtagccagcagcgtccttggccatctcaaggcagagggaacgaaggagctattgggctagagatcacattgccgacttcccgtgtagatgggcggcaacagagctcatcagaacctggtgaagcttcggaaggaggagaagggcccttcctaggatagcgactactctcctaggttatgcagtgacacaactacaaaagttgtggcatagattcgatagttgaaatcttgcagctgcgacatcgaggtctcacggtgatggtggatctagc

SEQ ID NO: 20813 - DNA, 1501 bp, Oryza sativa
acccgaacgaacgctgctagcagtagaaatcttcatactgaaaactaattgggttaatttacaattacaggttggacatattcgtcgtccattgcccgccaccatcaccgaggaccaaatccatctcttttaggcccatagtcaaggcccataaggtagaagcatgcctcatccacctctaccgaaccgtccccttcgtggccctcctcaatcgccgttgcttctccccttcgctgcagctgagcccccttcctaagctcagtgtgacggatccgcctcgcccaagctcggtcacaaccttcgtcatcgtcgaggttgctgtcacgtgcagtcacaatcgtcttcatcattgagatcgccgatcgcaaccatcatcaccaaccccgttttcgccgccaatgtccttccctctagccaaatctggtagggggaggggaggggagtggagtggaggagggagttgttgtcggccgctcctatcgagaaagtgagggaggtgagttgagagagcctgagagggaaggaaggggcaaatgtacttagggcctcttttggggagctcctgtcagttgcagcttctcctagaatttccaactgccaaaagctcccccaaacaattcagattttcacccatattttaaaaagctgtagttgtataatccagaaaataaactagaagccaaaagctgggtttactagcttctccatattctcacctgctgcttcttaaaatcttaagctccaccaacagggtcttatgctcggcgacttctcgctcttgctgtgctgatatttttgtagtgtttccatgttttcgctagtgggcctctttatgcctcgttggtaaaaatcaatttttactaaccgtgtctaaagagggaccatgtgtgaaaatgaggtattttttaaagctgtcctcttaagactctgttagtgaaattcaatttttactagcgggcctagggtgtgttcggtgctctcagtttccaactcatctccctcattttccgcgcgcatgcttttcaaactactaaacggtgcgtttttttaaaaaaagtttatatacgaaagttacttaaaaaatcaaattaattcatttttttaaaaaatagctaatacttaattaatcacgtgctaatggactgcttcattttctgtgtggagaagatgggttcccaaccccaagttacaaacacagccctcttgttatttttataagcgagaatttttagatccacctggaaaaaaaaccatagtgagtatgtggacggtgcagcatggccagagatcatagttgatagcagcaggcctgaagaatgtttctgaaattgctcatcaacaatatggactcaataattgattagaggtagaaacagtgtttcattgacataattctctcatttgtgactaaggcagtggtcgcaatgaaaacatggtaatgcatccagcggcgatggctgagggagaagggcagtgcaagggtggaagtgggaagggggtg

SEQ ID NO: 20814 - DNA, 1501 bp, Oryza sativa
tttacaatttgacagaagccaagaccgcttcagcagtaattgatctccagcgtctagaggtactctttttttttttttaataactggccaactttcttaagcagataattgtgacaattgttacactttactctctttctcacttctcaaccagattcttgctggaagctacttctgtgctgctggagcacttgttggtgtcataaaccctgggaggatgaccttgtttggtacccttttggttatctggggtctagtgaaagaagcgctctttgggaaaccggtgaacagtgatccaacacaatcagttcatgtttatccgaccattttaattgcactgatttgtgcattcttgtcaataacttacaatgtaaagaagacagtaagaaatagtcagtctgtttcaatcactaagcctctgcaaagttctgccaagtcgaaactgaagtagacacttcattgtctatttgccccttcatccttgtagttcatttccacaaatttattgttgaagactggcccaaaggataacactactgtggttcttgtgtaccactttgaatactgtaaccttcagttttcacctttgtatcaaagacttatatctataacttttattgcaagcatattcactttaatttccctcgtatttatttatgtatatgctgtttacactgttaagactactggcatcatgtcacccttcctcttgaaggatgatattttatctttttgtaaattccatctattacttgctataacctatagctctgaagttctcagatacatgggaagttttcccacagtataacttgttcaatattcattttctttgtcagtacaatcttgctttaatcctctgataaatcaagaatttatgattaccattttagtttaactatttaagtttcccagtaactttgttttcacctatattctcacactggcccaatggacgatgtgtccttctattttattctgcatttggaattctacacaagaagtactttctgaactgttagctgatgaatcgaacaaaatggagttgaagaggacaggacacatgtatctgtcagaatttgctctatcatgaagtgatacatcattagcggcagtactgctgtcctagcatttgtatacttgtattgtgtaaagaagggcaagaatcaaggctgcatgtgcaagtggctcgtctcctatctcttgctctctgttgatgtctggttgatgatgagatcagaggaaaggagacaggctgagccccacccaaaccccatgtgagcattgtccttttaacctgtctgtatttttgtacactctgctgcttgcccttctggtgaaaccagacctgaactcttttatctacccgactgcagcctgaagctgattaacaagtctgaagaagcaaacaatgccacggagctactggatttgtcatgtagaaggggctgaagagataagctgattcggtcgaaatgttaggtggtttctcaagtcagct

SEQ ID NO: 20815 - DNA, 1501 bp, Oryza sativa
ccggagggattacttaaaaatttattattattatacagggtatatacacaaaaagaaaatcaagttacaaggagaaattaacctaactatgttggaattaataaaccaaagaacaatttgggggtagatgtgaaaatttagataaattgctaggttgtcgaagaaaaaaaaagaaatcggtcttctggaaatcggacttgttcattcaaaattgtcttgatgagaaaccctgttcagcaagtccaaaattgttgaacatctctaccatcggattaatgatcatttgttttgtccagacaattgacaggtgaatgaaagagcatctaatcttctttagaattttgcataacataatcatcctacaaaacacaggtagaaccaaatgtcaaactccctgcaaaaacctatgcatttgaaactaagaagcctgctttatgatgataggaacatacttgcaatggggaacgaaacgcgaggcaattgatctccatgacgacgatgaggacatggagagatggcaggcgcggcagataggaagcagccgaactgcgtctacgtggtgatcgaggggtgaattcagtcagctagttcacatgcaaaccatcagcggaaatgaacaccgatatcactacctacaatcatccaatataatcatgtttgtttgggttccagatgatcgatttcacatggattcagttactaaaatacctttaaaaatagaaaatcatctgtacatacacacagagaatacgaacaataatcattggtacctaaaaaatccaaaaaatacaagcgataatttatatgttccagttgatttgacgtacctgaaaaaggtggcaaccagttacttcgtggggcgaggaacgagcttgagccttgaggacggagtcgcatacaacaatcgtggctgcgacgaggcttgcggacgaccagcgacgtgctcatgaagattagcgacaaagatttgtggaggcctggctgcgtcgtcggatatggcgaacaaccagcagcccacgacgaagaagctcgggcacgtccgttcatgcaacggcttgtcgacggagaatctcgccgacgtcgtccggcggcgtagcatcatggagtcgaaacaacaacagtatgtaaaatatggaatgccatctctactagtgtatatgtacacaaagaatagaaagtataaatcggtattgatggaaataaatcaattacatcgaaattagttgatttgattcaatatcatgtcaaatttggaaatgaattatcacacaatcacattaatatttcaaatggaaattaagtacgtgcatggaagcttatatggaaacgatgggagttaatcacgtcagtgattcatagtatttcactagtacatgcatgcaatcctgcgggtatagtaaaaatggaaacatctaatcgggtttaacccgctaacaggtctaataatccggtttaagtagcatgaatcctaaagcacttaaacggtggatgatgttggagc

SEQ ID NO: 20816 - DNA, 274 bp, Oryza sativa
ctcggattcgaaccagtcgggaagaagccagatctccgccccgttcggtatcccaaactcggccaagatctaccccaagatcgtctccaccgagtcggcttcaaaccactcgaacgagatccaatctactccaacacgactcgatcaagacgatggggcctatccgccaatcctgatgaaactccccgatgatttggctgctgtcttcaccacaagggcatcttctccccgtagatctaggcgggatccggcctctaccccgatccagcttagc

SEQ ID NO: 20817 - DNA, 269 bp, Oryza sativa
cgagcctcccacacggcccatcacgagcccgcggcttgtgactccccccgacccaacccgttccattccgttccgttccaacggaacggattccattcccgcgccccgctacataaaccccccttcgcctcggcgtcgtcgtctccaaggcttccctcccatcccaaaaccagcgcaagcgaggcgaggagtacgtagtggtaggaggtggcacgccgcggcggcggaatcggaatcgactagggagatggatgcggcggcggagatgc

SEQ ID NO: 20818 - DNA, 1501 bp, Oryza sativa
atgcgtcattacagcagcatcctttgggccaatgtcaagttccaaattattggagtgctgcagggcaatcttcatttgtgcatccgagcataacaatgaacctattcacaatattgccagcacctaacagtcatccaactacttttgcctcaagcttgttgatggggccttgtgagaaaatagaggtttttgagaatctgccacaattaccacatttcggaaagttgattggttgccctcctgagctccgcgaaggaaaggctctggggctaatggcatccttcgcaaatatagcagagagcatacaaaacatgtgaattcaggacgaagaaaacgtctttgaggagaaactgaggtgcctctcggaattggaagaggacggatttgatgttagggccctgaaggagcggcttgaaaacctcgtgagcataaagaatcaccagacagaactcaagaagaaaagagcaagattggatcagttcatgcttgagagagaggtggacaatgcctctgtagagcaaagccagaagctgctcgacataatgatcaaggagcttgagctgaaacttttagagtaccgagagaagaaggcatcactcgtggagaagaaagcagcgaactgttcggaaattgcaaagctccaaggcgacatggatcaaattgaggagtcattcctttctgccgagtatgatttccacaccaccgctgctgcgccgtggtaaacattgatgacagtaagtactgctttcttgcttgctcatttgtgcactgcaaccaagtccatttggatggtgttaactgatgtgaaacaatgcaggcagagagctctgttcacagttcacctagacatatcacatacgcatatggttcactgatgtgatgtgatccaatgcattaggggaatgaggcagctagttctcttttgcctagacttgaaatgctgaacttaattaagtttgtatgtataatggttgtcacttgaatttggtagatcatctcattcaatcaggcttgcccccctgacattgatatgcgctgtttggcctttaaccccccccttagtgttggccaatcaagcagctgtaattttctttgtattctcttggttgtaacccctgtactccgttttttttttctactctaatgttaaattctagcagatctcctgccgatgttctccttaaaaaaaaaaaacaggcttgccccatcttcaatgctagctctgttcactgatgtatgtgaaccaatgcattattaggggagtgaggcagctagctctatttgcctagacttgaaatgtcgaacttaattaagtttgtatgtataaatggttgccacttgaatttggtagatcgtttcactcttgccccatcttcaatgtgagcaaggtctccaacgtctagaatcacctgacctggttaatagttttctgctggaaaaatatgatgctcctcacagtcctctggttgttggggaaaagtgaaaacctctttcggggata

SEQ ID NO: 20819 - DNA, 1501 bp, Oryza sativa
ccaaagacattcgcaacgatcatgttccttgctgccccaccaacgaatctgaagagtgccgctgccatctggttgattgctaacataagcagatactgcttgaagaacctaatgccgcgcaacagttcaggagtaaagaatagctagtgaaagaaattggataaattatactgaccaaataagattttgtccaaaaatctcaccttcctgcactcggatcaaacccaatcacatagtatgacatgaaaacaaacccaccgacctcaataaaggacattgggatcttgaggatccatgagggtatggtgtaggtccatgctggaaagaataagaggtctctctgcttgaagaagactggcaacttaaaaatggttagcggtagctcagatagaccattgaacattatcatcatcactgagaagaagagtgcgcccatgaagatgactccatcagtcacggaatcacggtgcatctttgtacggaagaagacggtcattgcaattgccgacaccaccatcagctgccatagcaattcaacaagaagtcagtcgtatgatgttgtttgttttctcaaatatactaatactccatttgtttgaatggatccctaacaacctggcaggctctgaagatataaacgaaggaatttctcttcataagcaagaactcccggtcgatgtttgccttcaacagttccatggcactgacaccgtacctcgaggtggtcaatgcagccggatgatttttgctcttgtcgaatggagtagcaagttcgtttgctatacttttcccagtgtggaacgactggaatgcactagcaaaatccttgactggcacgtaccgatagggcttgtcatgctgcatccagtactgcttctggtctttcctggaagttacctgttcggtatttccatgttgataaataaccgataaatttgtgcatatacatttttgaagatagtagactcactcacttcctgtaagaagtccgcaacacccttcctctcagggcatttgaaccccatcaactcaaaaaattctagcacaccctctcgaggcccctggtatacaatctgaccatcagagaggagtatgatgtcgtcaaataggtcatatgtctctggagctggctgcaacagcgagatgactgctgtgccaccgaggatgtggatggcctgtctgagcgacttcacgatctgaaatgtagttgagctgtcgagcccagtcgatatctcatccatgaaaagtgcattggctggcccaacaagcatctcacctggaagaaacagtcaatcaaaacattgtccagcaaatcccatgttctgaaagtgaaattctatttttcaacctgtggtgacacgcttccgttgtccaccggagatacccctcaccatatcatctcctaccatcgtgtctgcacatatatccagtcctaatatctgcaacatgttacatatgtaaagtagtaaataaaacgaatttgcttaatccaatctgaagt

SEQ ID NO: 20820 - DNA, 1501 bp, Oryza sativa
gtcaccactgtgttgcaccagaaggagtgctcctcactatgcactgcttgatcaagggtgcaagggtgaggggaaattgccacaacggtcgaagcttgtgtcgtggaggggctaccgctctttcaacaagtcagaaccattgattttactcggacaattgagatcatatagagcgatattacaaatcataaatcatccatttacattagacggcctggatcattctcaaccatagagatcaccaccgttcattctgttcaggacaatctacatattaaaccacatctacgagggacatgggaatcaaccatggtcaacttggaaggtggactgcttacgtggtatgacattgctatcacatatacggttcataattcttatgttttgaacaagattaatgttaaacttttgtaatttcgactattttaacttcaaaaatatttactttaaagaaattagaccaacgtatatagatttgtttttttaaaagtacgataataaaagtaaacatatattttatttattttatattataatagaaaataaggttaaaaatctattttgtaaaccgtgtcgatatccaaaacgaattatgaaaccacaggagtacatcacttttgataatggcgcatcagacatggaagaatatgtagcgtttggagcgatcaaattgccatggccctgtttagataatggtgcatgcctaaacaatcgaagagaactaaaaaatatatatggctctgtttatatttcatgtcacttttcttgtccctcgaatgtaattttagtggctcttatcatttctctcattctctaggggaaaacacaattacacaatggattattctaacttaaaatgaaacaaattagtaattaaaaaaacaaaatcacatatgcgagtattcaaactagatacaaccgtgcaagtgtaaaaatctagctgctgcttcgtcttgaaggaagcacaacatgagtcacacgagtattattcaacaccaaaatgtttgatgtttccgtggatggcgcagagacatgacacatcaccggtcaacacaccgttccgtccagagtccagactctaaacataatatcacttccaaatacgccatccgttttatatcataagtttaagtttaattaaatttatagaaaaaagaataacaatatgtacgatatcaaattggtttcgttaaatttaacattaaatatattttgataatatgtttattttatacggaatgaaaatacgaaatgaaggtataattatatttttttataaacttatttaaactttaaaaagtttgactaaaaaaatcaaataacttataaaatcatacagagggactatatatgcagccactgattctcgtttctccttatcaccaaggtaaaggtcagcagcaaagaactcaaaaccaacgtgcgtgatcggtgtacgtgtactcgttggactgcaggtgaagagatcaccgatcgatggctgccgccggagatggagcag

SEQ ID NO: 20821 - DNA, 1501 bp, Oryza sativa
aggaaaaggtagatcttaggcggaccgggcccattgagtgaaggaaagtgggccgggcgtggtggccttcttggcatatggcctcttgcgcataagcatattattgtttaggccgagagaattctcgaataaagaatccacttcgaaagtagtaatcactgatcaaagttgattatacgtgtgatgatgagggataccaatgacattttcatttgctaaagtatagttttagcttaagaaattatttttggaatgatctaattttgaagtattccactagaccactttaacactgcatcatctttttttcttcttgtttttagctatcgaaccaatagtgttccccacttcttattttctctccgtattaataaagtgtataatagttttttaaccttttgcttaatatcagaagcggatttaaaagctctgtttctgtgcgtcgggatgttgaaaaagaagattttcgcgatttgggctggctaccaggaccagcccacatgtcacaaccacgaaatttggcccacgaagaggcatagcaaatttgggccgctcccaggcccagcaaacataaccaagtccaccaccggaccagccgtcaccgtcgtcctctctcccctcctcccaaatcgcgactcgaattttttttatttttaattttttttattaaaagttttacaaaaataattttccattttgaaaattggcggaagtagtcgcctaccgctctctgggagggcgatttttaaaaatcgccatcgcagagggcggcgaaaatgacgtggcagacggccgttcgctctcgggcgacggccgtcaacgaagtttgcaggcggcccccttgccaccctccgctacgacgattttgtattatgcggggggccgcctgcaaatgggcggcggggggcctggaattttgcaggcggcccccttgccgccctgggggagggcgattttgtactgtgcggggggccgcctgcaaatgggcggcgaggggccatggaattttgcaggcggcccccttgccgccctgggggagggcgatttttgcctcccccctataaagcccagtcccccctctctgaaatttcattatattcactaaaaatccaaaaaaaacgaaagagagagaggggagggcagcagaaggggagcggcgaagccctgctggttcgctcacttcatcacaggtttgctcccatacatcttttgcatttgtactaatatgttatgtttgagtatatatgttgcgttttagttttagtttcatatattttagcatatctgtagcacacagcacatatgtgtagatccagagcatagaatataatagtatgaaatgagacatagacagtagtgttaattgtaagatgtagtttagtttgatttggagaatgtaacctacttttagaattttggagaacaatattgtagagaatgtaacttagggcgtagtacagaaatgcgaggttaacgcagttattgttttcatcaggcacaa

SEQ ID NO: 20822 - DNA, 975 bp, Oryza sativa
atgtttttcctattcccccgttttttcattcctgtgattcaaagggggcctaaggaaaatttcctatactttcctatgaatcaaagggtttcataggaaactttccttagtaaattaaatcctccaatattcctatgccaatccgccaattcaaaggagccctaaaattcctataaatttcctttgaatcaaagggagccttaggccccctttgaatcacaggaatgaaaaaacgggggaatagaaaaaacataggattcagataggaatacaagtgtaaaacagaggattgcaaaacacaggaaaaacataggaatgaccgtttgattgagccgcaggaaaaacacaggaatttgaggagagagaaacacaggtagaacctcatgttaaatttccttcaaaatttgcatgggaagaggcattccataggaattttataggattccataggattcattcctttgattcaaagagctatataggaaaaattcctatagaaattaaatcctttaaaattcctatgaatttcctttgaatcaaagggggccttaaggtggtagagacaaggtgtaggtagggttaaaaaagaaaaataagttaaatctcgccacctctattgttagtaaatggcttattttctctgaggttgtcaaaattattcatagtaaaatattagctaatcttatcaatgaaaatttcgtttatatggaaacaagacatagggcatgtttagttctcaaacaaaattttcacgctttcggacacatgcatggagtattaaatgtagaaagaaataattacacagttcgccagagaattgcgagacgaatcttttaatcctaattgcgccatgatttgacaatatggtgctacagtaaacatttgctattgatgaattaattaagcttaataaatttgtctcataattttctagtgaaatcagtaatttgttttattattagactacgtttaata

SEQ ID NO: 20823 - DNA, 813 bp, Oryza sativa
aacagaaagagagaggaaaaaaatccccacctttccatggcctccagctcgaggacgttctcccccccccccgaatgaaccctccgcctccgcgctctccgccgccggcgcatcaggggtcgtaaccggtgccctcctcctcggcggcggcggcgggggaggaggaagcttctcgagcctgcggctcctgagctcgaggtactctcctccttgcctcttctgcagcgcgagggagcgggtgcgggtgcgcaccccgagcggcgcgggggcaacggcggcgagctccatgactgcggcggccaccaccttggcttggcgcatgtacttgcccatggctggccttgcactcatacttgttgacggtcgttatcgatcagtttcaaccgtcaatattactaaaataggagagaactagtgatgcttgcaatgcataagtatgttagaataataatattccactagtattaggtttactaaccttttgcagagaatgatcataaagtagaggagaatcgacatcaactcagacgataaatcaatcggacgaaatcgagaaccagacttgacttgtgtgtgaataggccaagaactcagaattgacacgatgaattgggccaaaattcacaagtctacggaatagagcaatagaggaggccaccagccgaaattgggctggattgggccagccccaggttcggccgaacccaatcctggcgccgttgaatccaggttttggcatggacgtccaggattgcatcccaataatggttggagggcacttcggataattccccttccacaaccatcataact

SEQ ID NO: 20824 - DNA, 1501 bp, Oryza sativa
cctccatgaaagtaacaattattaaataatagatacaaaactcataatttgggatgtaattttagaacttcaaaatatggtatatcaaagtctaaatgattgatggtatggttttgtaaaacttgatagccatagaaccggggttatgtgtcacgtgccaaaattttagtggttttgttcaactaagactacataataggtggggttttatgaaatttgctaatgataatactcctaagaaccaagatcatttcccccttatttttgcactcttttattgatgaaaaaaatatagttataaaaaataaggtacattcttatgtttatccggtattaaagtcaaactgattttctctgtagcctttgctatgactacttttgacctctgcttctcaattttaatttttttacaagaaatctgtaattggaaaaaaaacatgtacaattcaacttaatgttgctctcattgttcaagagggtgcggctcctccaatattactttaacaattgttatatgtagcatgaacatgaaataaaaataaaaaaaaactccctttggtttccataaataaataccaccattgattaacacgactttaacttagactatcaataaaatctgaatgattagatcataatgtatgaaagtattatgaatagtttaggatgcaacatacttcgttaatatagaataattttgaagtatttaaatattttttttataaaaaagacgagcaaccaaatatttaagatgaaaagcgtccaacgacaagtatttgaaggcagagggatgatacaatatggaaattgtttttttttgacaaatattttttaaggtgtgtttgtttgacaaatatatgtttttgaatacgtttgaaaaaaaaactctaattgcaagcttccagaagtcatatatttatgcacattgggtgtagctaggagcagttactaaccacagctacaattatggcacaggaacactttacaaatcctgaacaaccatccaatggaacttcactagttacacaccttgctctctagcctcctaaccttgattacttgatacttgtaagttgtaatagagaatccaaccggaggaaacatggatgcaaaaattattgtctactaacctccaagtggcctcactcatgctctaactaactgatctctttctcttcccctccaaaataaaaaataaaaaataaaataaaactcatatttcttctctctctctaccaccctacctagcttagaatatttaccatgcattctctctcctctcctcttctcttccctctctctatatatatactcatctccaagctgttcttggctcctctctcttcttccaacacctcctaatcaccacaaaggcttaaaaatctccagtctccatagagagaaagagagagaagagaaggcagcttgatttggggcgaggagacgcgatagccgcgataggctaagcagctggcagcggcggctgctgcgatggccggcg

SEQ ID NO: 20825 - DNA, 1501 bp, Oryza sativa
ggcggccggccggctgcacggcattgctcccctacagccatatcgcgcgtgcgtgcgccccatgcgttcgttcgttcgttcgccgccgtatcgtccccacacacgtgtatatatcgtgtacgtttataattcgttttgttagctagcgctcgtcgactcgtcgcgtgatcgtgtcatctctatcgctctatcagatatagattatctcgacatatatcgatcgatcgatcgaaggctaggaataatgctgcgagtgtgactgtgtgtgtgtgcaagtgcggccctgtatgtgcatggcatgggcgccaggccacgccagtgcgtgcgcgtcgtctgccgggcatttgggggtgtagtattggcaggcaggcaggtcggccatgctagcttgcttcctccactccgctagccttttttttaggtaatgaaatatatttcagtctttgcttcgaagaaactacaaccactcgttacaaatatccgttcaataataaaaaaaagcacaaaatattacttacaaagagcaaaaaaaaagaaggaagtgaaacatagactaatgtcaaccaccaacactcaacgaagaatcaacattgttgacaaaaatctatatatccgttgtctctctagcttaaggcatgcagtacgcatgagtttgttgttctcgtcatgtatttgtaattgtgctcagaaaccgaagcctttacgttgccataaaaagtacctatacataagatttagatggggatttatcaaagaccatatcatttctactaatttagaaaaacccaacatatagcagatgtttctacaaggattagtttcattgtttttatatcaatacccacaagtcaattctcaaatatatatgatatactactaggaggatatagaccaaaagagaactgtaccgatttttagaaaaaattagcaaagtggcaattaaaaaataaataatgtatcgtcttacttttcatgcaaaaaaaagaatctcaaactcatgcccttctaatttcttctagccaaattatccttagttatagtactaccttttaaaataaataccacataaaaatcttaatcttaaacaacatttccacgtaactttactctcctcaatatgaccattattcctcttcactccgcttgctagctaccttcacacttttgctctacttaattttctggtgctagccaagctaccagtgcagaagcctgaagctgaattttgccgtcacggcctggaccgtctcaatctgatgcgtacgctgcgtcgtcattcgtcaaggcgtacgctgagtgtgtttagctcacgttaaaattagaagtttggttgaaattggaacgatgtgatagaaaagttagaaatttatgtgtgtaggaaagtttcgatgtgatggaaaaattgaaattttgaagaaaaagtttggatctaaacaaggggcttattttcaccatccctacattaatctgatatgaacattctgacatctatatacgcaca

SEQ ID NO: 20826 - DNA, 1501 bp, Oryza sativa
caatggtagctgtgaaccaagcagcatgctcggaatggaccaagggtgtgccctggttaactctcttgaggccagtggtggattgagttgaaaacttgagttacttgaggcatacccgctgacattctttcctttttctctgttaaacatctgttacagggattgaggtgagagaggaaacaagctaggaaagaatagaccagaactagagataagaccttaaaggaactaactcttcttgttgatgtgttgtttgtttcacttattctgcaagttgattaagcaaacaacctagcatggttacatcaccacccaccgatgcaaagcacgcgctacacacacaagcaaggaacacacgactaacaacactaccctatagggtggcttaggttctgcgacgggttctccaagatcttcactccttcacagctggcttcactgcttcctccacttcgctagcggatcctgcagtcttccggagcttcggcgaacaactgacgatgtcttcttcttcactgacctgaccatctagtactagttgaaatttgaagaaggaagaaaagggtaaaccttttgcaaatagcattaggggaagaagaaaaagaggaactttcgcaaatagttttatttataaaatatgtccttaggttttatccacttggcttatcctacagtcgagatggctctgataccagcttgtcgcgaccgagaaaattgccttttcccgaacgctagtgtattaatccccgtcccaggaaaagccggggtacaccacacaaacatgatataaaagacacatctttattatatcgataatatttacattattacaaaggcacttcaggcctggcaatcaaaaataaatagcagcggactagcgggcctacggctccatcttcacaggcgctcaactggggtataagccaagactccacctaagacttcttctccaaaggttctcttactgaaggggggagaaagatagagcaagaatgagtacaaccacagtactcagcaagccacaccggagatgcataattaatgtaagggggtagaaggggataataataggggttaagttttgcagtaaacagcatttaaaagtcacttagttgcccaaagctattttgtaaacacgatcctagagctatacaatattattaatcaaggccgtgaaccctcacgaacctgccttaacccaaggcctacgatgattcagaccgaactggcaacccgaccctgggtcccagctcgtcccaagccaacccaggccaaccattccacattttagttgttaagcaaattttaagaattaaaacactgacttgggtacattgctcggcttgcccataaccgagggcgcggctattcgaatagattatactctgatcagaggtgtacatctttacccacaagacacatcttcctcacgtgtaaccacgtgccacataccaccacggtatacggacggaagacgtgacatagttcccaacccatccta

SEQ ID NO: 20827 - DNA, 1501 bp, Oryza sativa
ggcccctcgccgcccatttgcaggcggccccccgcacagtacaaaatcgccctcccccagggcggcaagggggccgcctgcaaaattccaggccccccgccgcccatttgcaggcggccccccgcataatacaaaatcgtcgtagcggagggtggcaagggggccgcctgcaaacttcgttgacggccgtcgcccgagagcgaacggccgtctgccacgtcattttcgccgccctctgcgatggcgatttttaaaaatcgccctcccagagagcggtaggcgactacttccgccaattttcaaaatggaaaattatttttgtaaaacttttaataaaaaaaattaaaaataaaaaaaattcgagtcgcgatttgggaggaggggagagaggacgacggtgacggctggtccggtggtggacttggttatgtttgctgggcctgggagcggcccaaatttgctatgcctcttcgtgggccaaatttcgtggttgtgacatgtgggctggtcctggtagccagcccaaatcgcgaaaatcttctttttcaacatcccgacgcacagaaacagagcttttaaatccgcttctgatattaagcaaaaggttaaaaaactattatacactttattaatacggagagaaaataagaagtggggaacactattggttcgatagctaaaaacaagaagaaaaaaagatgatgcagtgttaaagtggtctagtggaatacttcaaaattagatcattccaaaaataatttcttaagctaaaactatactttagcaaatgaaaatgtcattggtatccctcatcatcacacgtataatcaactttgatcagtgattactactttcgaagtggattctttattcgagaattctctcggcctaaacaataatatgcttatgcgcaagaggccatatgccaagaaggccaccacgcccggcccactttccttcactcaatgggcccggtccgcctaagatctaccttttccttttttttcttttgtgtatatgtctagacaatctgtttggttagagggagtttaaaaggatgagactattaactgttttgtttggttgggggatataggaattttggtgggatggggatgaagaattaaggaatgaactccctcctttccaatacctgggtaggggcagggaattaggagggaattcctcctttacttcgcctaaacaaatctcagtcatcggttttcattagtgatctaatctccaactaaactccctatcaatttccaccacctctaccaaacaaaagactgggatgaaaaattaaattcccatcttaatctcaccatcaattacctcgtgtaaacttccaatccccttccctcatgttgccaaacaagccgagaaaagaaatgcgaaaagaagagaaaagaaaaaggcgagaaaaaggcaaatggcaaggggggaagaagagtggaggaagaacctaagcagcaaaccctagtcgcgactacaccaccac

SEQ ID NO: 20828 - DNA, 441 bp, Oryza sativa
ggaaaaagactttttagagcttttctttttataaaacctttttaactttgtttatttcttaataattattatttgtgctctgaaaattcaagtaaaatttgagggctccttttagaccaaggagaatttaacaaaaattctccgggccgcatttgaatttttcttgtacgtattttagtgtttgccaatttcttttcgaattttaattaattctattattccttttagcgaatgatttttaattcgggatgaatttatcaggacgtgacaaatccaccccccttacaagaatctcgtccccgagattcgaggaggctagcaagaagataggttgggcggtcttctcttcttgtctgacttcttccgctccgtcttctataacaaacttgcctaacaaaacttctccactctggactgcttggctcgatctcctgttgcaga

SEQ ID NO: 20829 - DNA, 1501 bp, Oryza sativa
ggaagaagagagaggagccaagaacagcttggagatgagtatatatatagagagagggaagagaagaggagaggagagagaatgcatggtaaatattctaagctaggtagggtggtagagagagagaagaaatatgagttttattttattttttattttttattttggaggggaagagaaagagatcagttagttagagcatgagtgaggccacttggaggttagtagacaataatttttgcatccatgtttcctccggttggattctctattacaacttacaagtatcaagtaatcaaggttaggaggctagagagcaaggtgtgtaactagtgaagttccattggatggttgttcaggatttgtaaagtgttcctgtgccataattgtagctgtggttagtaactgctcctagctacacccaatgtgcataaatatatgacttctggaagcttgcaattagagtttttttttcaaacgtattcaaaaacatatatttgtcaaacaaacacaccttaaaaaatatttgtcaaaaaaaaacaatttccatattgtatcatccctctgccttcaaatacttgtcgttggacgcttttcatcttaaatatttggttgctcgtcttttttataaaaaaaatatttaaatacttcaaaattattctatattaacgaagtatgttgcatcctaaactattcataatactttcatacattatgatctaatcattcagattttattgatagtctaagttaaagtcgtgttaatcaatggtggtatttatttatggaaaccaaagggagtttttttttatttttatttcatgttcatgctacatataacaattgttaaagtaatattggaggagccgcaccctcttgaacaatgagagcaacattaagttgaattgtacatgttttttttccaattacagatttcttgtaaaaaaattaaaattgagaagcagaggtcaaaagtagtcatagcaaaggctacagagaaaatcagtttgactttaataccggataaacataagaatgtaccttattttttataactatatttttttcatcaataaaagagtgcaaaaataagggggaaatgatcttggttcttaggagtattatcattagcaaatttcataaaaccccacctattatgtagtcttagttgaacaaaaccactaaaattttggcacgtgacacataaccccggttctatggctatcaagttttacaaaaccataccatcaatcatttagactttgatataccatattttgaagttctaaaattacatcccaaattatgagttttgtatctattatttaataattgttactttcatggaggtaaagttttataaaattttgatatgtgaatatgttaaattggttaatgttgtggttttgtgaaactttaagggcccctttgaatcgcagggtagaaaaaacggaggaataggaaaaacataggattctgacaagaattgaagtgtaaaaca

SEQ ID NO: 20830 - DNA, 1501 bp, Oryza sativa
aaatagctaaattaactgcaaggatcctggcaatacaaaccaactcagcattacaaagtaaacccaaactctgctctaaggttgttgtgtgctatagaagaagtgttcttccctaagaaaactaaaccaaagtgatttgcactggcccagcacaccctcacacggcagatctagcgccccatagcgtgactggagcctagcaagacatgaagccgctgtgagagcagcatccactgcagaggatgcaatctttctataggaaagcagcatgtgaaaattgtagtcatgaacagcgaaccggtactttgcttgcatgaacctaacaacctgctgagcaaccatctcgtgtgaaacaattagcggatctgttgcagcaacccaaaagaacttcctagccagattgttggatgggtgagcctgaccactggcagggtcttcaggcggaaggataagctctacaccagctaacagcgtaccatgcccatcaagctcccaaaggtatgacaccaagggcaaccggcaatgagaagctgcagcattcaacaacgaaacgaacgaaaccccaacaacggccatcccaccaacagcactgcgaattgcagagagagttttcaaacaggagataaaccacccttaaacagtactttaaaggatgaaggtgaggaaggaggcagtgtgcaagaagaaatcgtcaagaagcaacatatagggcaagtatacagggccaagaccaggagacactatatctgtccctttcgtcaagcgtgggaaaaaaagcgctgacgatgcgtcagccccaccaacggttagcgccccccccactccccggcccctctcacccaccaaacatataatgcaatagagcaaggaataaaggtgcgcaaaaaaaaatgcaagcacccaaaaattttaaataacagccagagcaagaaagcaccttcgccgccacgcaccggaactgtcacagcacccgccacaaggaggaagaaaaccagaggaaagaaaggacctcagccggttcggacggaaagaagccctccctgcacagcacacaaacaaaagatgaagcaagcataagatggatcaagaaaaagaagaaacaaaggtgtcgctgacctggccaaaacgcgaaatcacacaagaaggtgtcctcctatcaatcggcagtgaggtcgctgcaagaagcacacacgaagtaagcacaaggaactccgccaccaagcacagtcgatgcgaggatagcacatacctcgccatagccacgaacagcaacagagaggccggagaagaagcggaacaaaagggacagcaagacggaagagcagtacagtcgaagcaaagaggattaggctggagaagaagcggaagaaaagaagaggagaaaaatatggcgcctttcttgcgtgggacgccgtctcgggcagatctgtaccacgttgtctaacaccgattggccaagcagtacatttgtggggcccacccctctgtccacaaccaccct

SEQ ID NO: 20831 - DNA, 980 bp, Oryza sativa
gggctggggtgagactgacaggtggggtctgaatgagctttcatcagttcatgtatttattttttagaactaatggctttcatgtacagtgccgattctagaaggtctctgggtgtttgatgcactgtttttctcatgttaatttatttggtcgtgtaccagggttgctgttacattccttgacacgtgtggaatgtgttgacctgcttcgaaaatttaattcatttttagggtcaaattttcggagggagtattcatattgaatcacacgctggttcgcactacagtataccaaaccatccaataggcaaaagcaaaacctcagcaagtaattcacggtgccgagcaaaatcagaaatcaagtctgctcctcgaatttatgggatccagatcgtatatgaatgactactgcggctggagcctggaggtaggtttgatgagatttgaaaatagcctacaaagttaaaaggcagattagcccagcatattaaatcattatatttgggcctgtttgtttttgtgggataattattagccctaaccttttagccataaattagtccttaagaatccaaacaagtaagctaatttgggacttaagtgaattagcccccctcaaaaacattagcccctctctctctactctctctctatcttttagccctcaattagcccataaatccaaacatatcactctaggatcattaaatcattatatttgggcactgtttgttttcatgaggctaatcttctaaacagggtccaaaacccacgacgttaaatacgattttaggtgccgcaaaagaaaaaacgattttaggatcatctaatcggcggccgaatttctccggttacgtgtgagctctgtgagcttaaatgcttacggatgtatatatacaggctatgtatcactatttcacaattttgtagggcagagttgttgaggaaaactgggcaatacaattaacaaaaatagtagt

SEQ ID NO: 20832 - DNA, 1501 bp, Oryza sativa
ttcggttggaaaccgctcccgcaaacctcgctggcgccattgatggagcccgagatcgccgcgccggttttcttcccctccggccgttctctccccctcccaacactatataaacgctccccgtgcctcttccgtccggttccgcctctcgccacccttcctcttcgccggatttgagctcgcgacgtcgctctctctctccgccgtcgccgccgagctccggtccaccgccgtcgtcgccccggacctcctcccgtttcggcgtcgccttcttcgggttcgccgcaacctcgccgacctcgtccacccctccgtttcgcccgccgaccgccggaacgccgccgtcctcgtcgacccgagccgcgccgccgccttcctccgctccggtcgtcgttcccgtcgccaccgtcgacccggggtgagccgtggaccgccgtttcgcttcccccttccctcccctctctcgggcgccgctccgccgcgccggtggtcaccggcggcgaccatcggggcgcgggtgcgccgcctcccgtcggctatgccggcgtggccgccttcgggtgcgccccgcggctgccatgtggggcccggccgtcagccgcccgcgccctcgggtgcggctgacgcgtgggacccacggcgccggccggtgtgagccgggtgcacccggtccaccgtggaccgagaggctgccgcgtgggccccactcccgtggacccggtccgcgcgctcctctctcccggctgacgcaataaatctattttaaattaaattttaaatgaagaaattcgcaaatatccatttaaagagcatataaacttcaaatggccataacttggccatttgaactcggaattggaccgttcaagtctctaatttttccttaagaagtcaagaacccatttttgtgctttgtttctgcttgttatatggagtttagtagagtaaaagccgtttcttttccgttggtcgtgtagacgctgcagcttcggaagatccgctcttcgtggaagttgaagctgacgtttgggaaagcgagcaaggcaagtcacatcatccttgagcatattgaatcccagtttataaaattattttgatttaaattaatgcattatcgctttatttaaattcccgcgttatcactgttttatttagccttgcctatttacctttgttatggccttattattattgctattgttattattaccttgttcactctagaataaacaaaaccccaactagtgggtactctattcatggttccactagtataaatttaggtagatgcttcgctgattaattaggcaacattaggtgattttataactttagactttgggaattctcatatcatttggacactatggaatggttggcttatggtggaattggacatacccctctcttcctctttcaaagcccctaaaacctgtttttcggtggggtttgggtgcatgccagttgtgggaagtagcaccccggccactataaggattaa

SEQ ID NO: 20833 - DNA, 1501 bp, Oryza sativa
tgataacatgactatacgttaacacgtctttctgaacatatacttttgccatcaataaatttcagtacagatatctttttagtattcgggtcatgaaagaagatgttagcgagatgacaaccacttgttatcttgttatacatggtaaaactattaattttatatctacttcttattaaactgttatttgggtttatattcacgccatcatgctatgtgatcaaagggtagcggtcggcgtgtgtcttatgtgacgaatagaaaaatcaagattttaaaagttattaaagagaaatagaattgtaccgtagcgtttagcacgggcatattactagttagatacgattaattaagtttcagttattccaaacttgagaaaaatagttttatctgatattttaaaataatttttatacagaaagttttcgcacaaaatatatcgtttagcattttgaaaactaagctaacgaaaactgaggcaaatctacatcttaatcataaaagaacatgtgtaaggccctgtttagattttctggcaaattttttcatcctatcacatcgaatgtttgaacatatgtatggagtattaaatataaacgaaaaaaataactaataagacatattgcgtgtaaattgcgagacgaatcttttaagtctaattgctccagatctgacaatgtggtgctacagtaaacatttgctaatgacggattaattaggcttataaatttgtcttgcagtttacatgcggattatgtaatttgtttttgttacatgcggtgttacagacatattatgtaatttgttttgttattagtctacgtttaatacttaaaatatgtatccgtatatttgatgtgacacgtcaaaactttacacccatgaatctaaacacagcctaagataacaatttgatcatacgaatagagtaattttgtacgaatttgtactacaaggtgaaaatataaaagacaaaagaaaagcgtggcggcgtgccatccaaaaagcatttggccatttgcaccaccacaccagtcacaccggcacaactcgactggagtccttcaagttacaggtcaacgacccctctggcaagggcagtttggtaactgcaccccaaaacgcacgacatcccggcatcccgccaccgctccaccttcccaaaaataccctcaccgagatgcccctccgtctcccgtctcagctgctgatttctcccacccatccgcgtaattatccgcagcgtcgagggcatatatggaaaccggcacgccatttcgaaatatttcgccaagtggcgcacggctggtagtttcccacataccaccctaccctattccccaaatcccccaaagactccctatacacagagtctctctctccccaacgccccccattatatgtaataataatatcattattatttgaggggttaagtgaaaagcgcactttttcctatatcatccctagctagccctttcgtgggagtaaagaaaggaag

SEQ ID NO: 20834 - DNA, 1501 bp, Oryza sativa
agccttgcctatttacctttgttatggccttattattattgctattgttattattaccttgttcactctagaataaacaaaaccccaactagtgggtactctattcatggttccactagtataaatttaggtagatgcttcgctgattaattaggcaacattaggtgattttataactttagactttgggaattctcatatcatttggacactatggaatggttggcttatggtggaattggacatacccctctcttcctctttcaaagcccctaaaacctgtttttcggtggggtttgggtgcatgccagttgtgggaagtagcaccccggccactataaggattaagctcgggcctctgttgcaaagcactaccgtacttccacatgtctagtgggtaaggcttagtttgtggctcagtctggttataaacaaaagtacacggattggagatggatgaagtcgggggtcgatggacattctccagggcaaataaaggctacacgagctgcggcccggtagtcgagatgtcatggcacagggctggtgtcctgctgctagggggctcaatcctgcctgcctgtcccgggggttccggccgtaggtggggttgggtcggtactcttatttatggctaggatgggttgggaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagtcagtgttttaattcttaaaatttgcttaacaactaaaatgtggaatggttggcctgggttggcttgggacgagctgggacccagggtcgggttgccagttcggtctgaatcatcgtaggccttgggttaaggcaggttcgtgagggttcacggccttgattaataatattgtatagctctaggatcgtgtttacaaaatagctttgggcaactaagtgacttttaaatgctgtttactgcaaaacttaacccctattattatccccttctacccccttacattaattatgcatctccggtgtggcttgctgagtactgtggttgtactcattcttgctctatctttctccccccttcagtaagagaacctttggagaagaagtcttaggtggagtcttggcttataccccagttgagcgcctgtgaagatggagccgtaggcccgctagtccgctgctatttatttttgattgccaggcctgaagtgcctttgtaataatgtaaatattatcgatataataaagatgtgtcttttatatcatgtttgtgtggtgtaccccggcttttcctgggacggggattaatacactagcgttcgggaaaaggcaattttctcggtcgcgacaagctggtatcagagccatctcgactgtaggataagccaagtggataaaacctaaggacatat

SEQ ID NO: 20835 - DNA, 1501 bp, Oryza sativa
gtcttgggtcgtcgtcttggcacatgtggtcttgtagaagctactacatgaaatagcagaagctatttttcctccccgcgaccaccggtcgacgctgcattgttggcacgtttgctctgtcccctggaatttgcaagagcaccttctctgcttttttatcatgcggctggtattagttgcaggtgagcaccggtttctctagcgaagctgcttactggctcaaccgtcgtttactcatttgatcaacagagggatagtggatagctttttattagccctgtttggaacagaaaagtattctgtacgatttttttttggtggggtgtggggagggggaataaattaatttctagtaataaatcgggaaattgctaagttcaaaaggggcttggaattcttctctcccttttttttggaatatagtctttttagaaataaaccgggaaattcgtagttgaaaggagttttgaaaatttgaatgctacatgaaaatcttctatatataaagtcattttcaacaattatattaattccattggaaatatatacgatctcataatttatcctgtttgtgtcttacgacttctttggggggtttgccaagttgtcgtgttattttaagttcataacctcttcttatgacgattctcaattcacgtggctttactatatgctgttttcaatctctaattttctatatcattattaaacatgtgcctgtgagttttttagtctccggtccggtagtatagaggaatttcatttgcctgatagacaaattgcgatagaaattacagcacagaaggaggaaattgttatacaatttttttgagcacatgataaacaactgagagactacgacaagttaacacacgaggaggctatcacggggaacacattgtaataactgaataattggaatcactcatcactcatgactttgccttgaccatttaattaagccttgatttatataaacagcattatcagagtatcagtccataactcctccatgcatgcatccatgcacatgctaaaaacatcctcaaggtattttataaaggtcctaattaattagtaaattgaaaggtacaccttgtcaacagtaaactaaccacttccaatagaacccccaaaaaaaaaacagcacagtaaccactctatgaacaatttagaagtttccataggtttctgtgccgccaaaaaaaatggtgtgccggaaggagaagattcagctggtccaggagaagtctttactcgtcattagctcttcaaacatcgcactagcgacagcgtgtggtaaaatcatttgacgtgttgattaatagttgggatgctgattcaagttcacatttgtgtgagcgtctcctgttcaatctactcgttgcttgaatttttcccccttttgttcgacagtcggagaaatactattttaagtgtattgaagggagaaaaatacgccaacatgctaataagataatcatgttgattagttgcaatg

SEQ ID NO: 20836 - DNA, 1501 bp, Oryza sativa
gaccatggtaatcctcacctcctccacccttaggtaccttcctagacgctatcctcgcatctttgaccaatagccacaaccagggtctgcatcacggcacggggacctagcctcacaatctaaggtgaagcaacagccatggctgctattatgcgagaggaccataggtcagtacgagtggggcttctctcccttctgcttgtgccatgctgattaggtctctgttctgttttggtcgtatgctaccctcacccatcctacttttgttggcatcctattctatctctttgatagttatctttaatgttctatgtttactatgctaatttgtgtgtgcatgattttattcttaattgcagctgtaactgctgaatacattactgccttgccttttctggtatggtaactgctctggtaatcaggtataatattcaaatcaatgattctatagtgtgttcgcgtttcctgcttttttctgtctcagttagccatatcttttagtgagatctgcttccccctccattgtttagtttggcatggaatacatttggttctagcttctcatacactatttccttttgttagagaaaataggatgcagacagactcagaacgccatcttctcgagcacatgatctacacaagtagccaattctgcacaaagttaagtaaactctaaactatatacattgaattttgcttcccaatagcagtgtagaagataatagattttctaattgcttttctttgtatatgctcattactgtccttggtttgtccttattcataacaagattgtttgcccatcctttttctctacaagatgggcacatttaaatgaactatttatcattaatccatgatggagataatgcgttgaaagctcagttagtctgttgcttattaatttaagttaaccatttttcttaggtcaattattatcttacattaacacaatagagaaaaattttcacttttgagaggattcaacacaatgtttcattcaaacaagcgccttcagcaactgttcatagaagtgcattcttcttccggagcaatgtacaatgatttaggatttgacaaagtaattttcaatttatcagaactgatttctcataattacatcttcatttcatattggccagagcattgccaatgagcgcgctataactgtggtatcccaatcagtggcactaagttttaggttgactgcaatgctttttctctgcagttgctcctaactgcaatttctttttgtcaagcctcattgatgtattcaacaagtatcagttgctgaagcaagttctgctgcagcacaaatctaacagtgtcaggttctcatgttcttctggttatacttagcattctttaatgtcaatttatcacatttctggttatagtttcttactctttttttacagcatctgtatgaaacaacaacagtcatttcatcattctttcctgctggtaggaaaaatgtggactcataacaaatgtccaa

SEQ ID NO: 20837 - DNA, 1246 bp, Oryza sativa
atataaatataatactcgagaaaaaatcaagtattttaaaatatttataaatatgtatttctcctcttgtcaattttgatttcccggagcagatgactcattacgtttaaacgctctgcccaactagtcatagccaccaagcactgggagtcggcctaagcacttcccaaacatgcatatgagtgacatgagttcttcattaatggaacaaagtttcacggatcggagtttactactcgggtacttttgcaattattaagagcagaaaataaatttatctcatctctatgcttttgatttattccgaataatacttagcaccttgcgttactcggtccatccaacgagcccccgggtgctaggaatcggcccaaaggcaaccatccattggcaaaccaaacggaaagcataggaagatagaactccataactcgataggtacttttgtactcagattatgtcgcaagcaatcaagatgaatattataaaaaatatgatataacatctgtagcccccgactcactactcaatggaagaccaattggtgtagtgaggcagaggaaaaggaaaaatatcatataaagaataaaataaatgacgacttagctttgtaatattccccttggtgatggcagaagtagccaatgtgggaacgaagcagtccatcaatggtgacaaaaacaccagtcggcgccagtggaaccaagccagtggtgtagatgatgaagcccattaacagcggcgaagtccgtcaaccgtataggcaaaaacaccagtcggcagcggcgaaggccagccggtcggcgaagacgtggacgcccaacaacggcggcatgataggccagccgtgcaggcgaggacaccagtcggcggcgacgaaggcaagccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaaacaccagtcgacggcagcgaaggtgagccaacggtgaggacgtagacgcccaacagcggcggcataataggccagccgtgtaggcggaaacaccagtcgacggcagcgaaggtgagccaacggtgaggatgacgatgcccatcaacggtggtgtgaccaaccgaccgtataggcggggacaccagtcggcggcgacggaggcaggccgg

SEQ ID NO: 20838 - DNA, 1501 bp, Oryza sativa
caagactgatataatatggcagagaatcgacgtactgatcataatctagctttatatcctcgcttagatatgttggtcgagtttatatttgaaattttgtgggggtgttttatatctaaggtcgaaacattgattttttttttcataaatgcctgagttttttttatgatcttttatattaagcattattttgggttatgagggggacattcccttaagtactacccactccatttcataataactgatacggggcactatttaccttttaactttgaccacttgttttatcaatatttataagcactagagatgttctatgttattaacgtgggtatactctaagacataaacataaaactttgatcttgtaattcaagcacaattaatagtcaaagtttaaataagaaaatacaaatcgtcacttattaaaaatggagggagtaaatgagttttctcccatcattacgagtcaaaactcaaaagtaatcccaccgaaggattttctttaatataaaaataagagtaaatttcataaaattcctattatgatctaggttacacgaaaccataaggattttggcacatgacacataaccccgagtattatgatcttaaagttccacaaaacaacaccgttaatcattttgatatacctatctatcaaataaaaaagaatataatatttacaggatatatgatggataaagttttcataaatttgagatgcgattatagaacttaaaattatggtagatcaaagacaaaatgatcaatagcaaggctttgtgaaaagttagtaccataatatctgagattatgtcccacttgccaaaatacctatggttttatacaactcagatcataataggtgaggtttcacgaaatttactctaaaaataaactaacggaatgaattaaacagttggtattgggtaacaaaggcctggttggcctggtttagttcccaaatttttttccaaaaaacatcacatcgaaactttggacacatgtatggagcattaaatatagattaaaaaaactaattgcacagttaggggggaaatcgcgagacgaatcttttgagcctaattagtccatgattagccataagtattacagtagctcacatgtactaatgatggattataattaggcttaaaagattcgtctcgtgattttcagtcgaattatgaagttagttttttcattcgtctccgaaaaccccttccgacatccggtcaaacatcggatgtgacacccaaaaattttcttttcgccaacttacacaggcccaaaagaaaatgaaaataaggttactactattactattggcagtatggcaggcacgtatttttttgacttttcgatgaattttgtgagggctcgcacctgggcccttgatttgaaccaacagtagcaatcggacggcccatacgaattcaaagcccgcgtgttctcccgaacagccaccgccgccgccgccgccgccgatccatgg

SEQ ID NO: 20839 - DNA, 1501 bp, Oryza sativa
ctaacagtctgtcagtttttatatcggtgtagtaaatcgattgatctactatcctgtcagagagtaatgggtgaagccagggtggcgtgcgtgtgaatatgtgatgaacgatgatgaactgggggctgaatctgaaacacaattcattttgccgtgctgagcacaagctcagctatccgctatgctgaatgaatgaatgaatgaatgaatgaatgatcagttcatccattagtcgccacgcatgcatgccatggtcagcctgaatccctgaagtgctcctcttaagtgtatatggcttagctcagcgacgtcttcaatggctagcttgggcgcatctcgcattcactccatgtaggaccaagccatggatgcgtcgagctcggatgattggagattaatttgagaggagtggttgggtacgtggacctgtggcgccattggtgcgtgggtcagtgggggagatgggaggaggtggaagaagaagaaacgctgcgatccgcacggacgcaacaaaaactgtcccagttatcattcatttcctgcagctgcaggggccactgccaatgatcaccatgtatgggctacctccatgattccatggggggttttcacgaaaccgctaggtgttagtttatgaaaaccggtcaatattagtcggttttcgtacggcgttgactaaaagccatcggtttttactagtttttttcggatttcggtaaaccaatgagatatgatttttaattcgaaatcgaaaaagttaaaccctgaatctccatctccttgttcaagttcatcttaattttttttttgttcttttttcctctcctattctcctctacaagatccgaaaccatttctctcatctatacagaagtatatccattccgatctagtatgtctgaataatggtgtatggacgagctaggcttgatgggcgttgcgagaggactggctggctggctggctgcatgtcgccagctgtacaaagcgccatgaaagcgtcgtcgcgtcggagcgagatcttgagcgacggtcagtcctgtactaacgtcaggactggggctgtacagctctgacattgtgtgtgtgaccatagttacgacatccctctcgagtaaaaacgcccatgcatagcatatagtaggactgtatgggagctttcaaccaggaagaatcctatgtcaaaacagtacggtacacgcgcatttaaacacatcttaataaccctgctaatcaaagtttcttgcgctacgcttattaatcaaggtccattcttaccagcatttgtcgcctcatgcaaaaaatgcgaagcgagatctcggcgtcggcgcggaggatccacggccaacatgcggagaaaatggcgcgaagttgcccagctttggctgctcctcatcctccgccgattttgtgacgttggacccatttgtcacagtttcagctcaggctctatcctcttaaaagctatagcccagctaaataatttcagctccgtaaaatg

SEQ ID NO: 20840 - DNA, 1501 bp, Oryza sativa
agtttgggggaagtttggtgcgaaaatatggcctaaattgagtaaataccagtatattggttgatgggggcggcgggagcattaagtatatataaacactggaccgtcattgccgtcgcggcgtcgtcaacaaatgatgagtcatgctgcaagcctgcaaccctcgtcgtcgcatcgccctggcctccagtctatggatcgatcggctttgtacatcctggtccttttttaagattttacaaatacactgtcagcaaaacttatgcagagatggacatgacgctgatcgattgcagccgtagccccgtagcccgtagcgacggaccgcacggcgcgtgcttctcttcgcctcaaacctaccaggtgttcggcgaaatgccggagcgggcttcatgccgctcgctcaccaccacgccggcgaggcggcgaccgtcgggtgttgctcgagctcggccggatcaaccaagccaccgccgacatatggtgaatcttccgtgccggataacttgcgccgccacgccagtctggtacggttgagcttaattcctccttctgcgatactcttgtatgattgggaaataggaatagggtttgggatgttgcgttgttgcaacaaatatacaacgggatgggataatcagacctgcagtgccgtaatgcaatctttaacaccagccacagtcgaattcacagggtggaaaatttacccaactcgactagaatagaaggattctgttgcgaaaagtgtgattctttctttttcatccaaagttaaagaactgtttgtttggtgggtcacgaatgtgtcgatttagtcaatactcctgtcactaatcaagtactattagttgtggtaggagtactagtcaagctcaccacctgtgtggtttagcagcgttatcctctagtttgttagcaggatccacatgcgtttctaagtagatttctccatttctgcccaaaaaggccttcagcttgtgtgccaaagctttctttctttgatctctcaaggactcaaacatggctggtgttgctgcggtttttgcagggaaagctattgcaacatcagtcatcacctatgtcatcaacaaggcattcgactacttgaaggataacaaggaagctggagggctgaagcctactagagagaggctggagaaactcctccctcagatcaaggtggtcttggatgctgtggacatggagcatatcggagaccaaagtgatgcactggatgcgtggttgtggcagctcagagatgctgttgaattggctaaggatgcgcttgatgaactggagtactacaagcttgagagggaggccaaaaaaatacaagcgggtagcaaggtgagtggctctctgcatcagtataagggcaagattgttcagcgttttaatcacacatttaacactgggtcactgaagaggttgaaaaatgctgtcaaggctttagctgatgttgcctctggtgttgagcgatttatccaagttctgaatcagt

SEQ ID NO: 20841 - DNA, 1025 bp, Oryza sativa
caccccccccccccccccgcgcgcaggcctttcttggcccagcctcctttcagccgaagtccacttcgcctccctcctgccttgagccaccaaaatgtggggtccacctgttagcatcatcctttttcttcggcttgagagccagcaaccgtttcccacatcacgacctctccggtgggcctccccgcttccacactcgcgtctccaggtgcgtggacacagtcttgtaaaatcaaaggtgtttttgattattattttgtgatgaacaattgggcattggagattattggttttgttatttggaatttattcacgaagtggttttgaagatgattggatttcacatgtgatcgcaggattcgtcattttatgtgatcggtcagaccgggctctggtagccggtcagaccgacgtgtaatgcgcggtcagaccggccgacactgtgtcggtttcaattttgggttgtttatttggatatccgaatttattttatgattatgacttctagatggatactatacgtatgtaatactattgtttgctgctgatgagtcaacttggagatagcttggtctcggaatatggtttctttgtttgttccatgtgtaggtgactcgatgtctcaggggagtatttgcggtgatggaccgggagtcggcttggggataagacgacgtccgtggtggtcagagatcatgcgagatacttaggctagagttgatgcacgtggttgatggagattttatatggcatacgatggagttattgtgtgcgtatgggatgcggagtcaaatttagaaggagtccaaatatggtacgattggttatgtaaagtttctttcttgtactagagggtttcctaaggtgtttaggactcctagtatgagtttggttcgtggctttaggctgcctacctcgggtataaatagagagggagcgtgaggcttcccggtatcgcttttgagagcaattgagttgagttttgagttagggtttcgagtttagtcgaaatttttgtaaggagt

SEQ ID NO: 20842 - DNA, 1501 bp, Oryza sativa
tttaataaatcaaataagtttatttttccaagtttttagtaattactacttaattaattatgttttaatggcttaccttgtttcatgtggcattagttcaaccgtccaatcgaactccgcctaaagctgcatttgtaagtgcgaaaggtttactctaataagtggtatgaaaagcgaagcatgcaattagcacttgattaattaagtattaatttaaaaaaaataagtattaactatgaagtacaaatttgaaatttttattttttaataaacttctatataaaatattttgcgcaaaataatactccctccgtcctaaaatataagggattttaagattttgcttgcaacgtttgaccactcgtcttatttaaatttttttgaaattattatttattttatatgtgacttactttattatctacagtacttttaagtataacttttcgttttttatatttgcaaaaaaaattaaataagacgagtggtcaaacgttgcaaacaaaaaattaaaattacttattgtgggacggagggagtaccgtttagcagtttgtaggagaagcacttacggagaatgagacagtagctcagcaaagatggagatccctacgtctttgaaaatgagaaagagattagacaccttgcctctgaattttgatatgagtagtcatgggatttcacacctggaactctcctgtttatggaactctcttgtttatggatttctcacaacagtttttttttctattgctacttgggaagaaggattgttacacaatacatttggaactactacttgtttagggctagctagttttgaattttggagcttaatattagacaaattagacctttttttttccgtttccgtcatactcgtgccttttagactgatgatagtaataaatgcataaaagtcttatcgtgacttttttttatatcagtaatatgtctttggcttatataagctgtagttgaaaaaaaaaatctctaatcatgaatatttgacgctccagataagattctaaagatttatttttatattataaacaagcctgtaaaatctaatgtgtttatatgatatttattagtgtttctcaaaacaaatgtatattttttgttcttaaactaatcatttaacaaattattgattgtcgatttttttttacggaatcttgtaccggagggaaatacctagtataactttggacacgttactgcaactttcgtcccaaggtcctgggagtctccatcattagttgccgcttctagaagaagtaccaagttgttttccatttaggagaaaaaaaaagagatgacatcaattaagataccgctcgccttctagaacgccgcaacatcactgcgtcacacatgcatattcacaaaattcacaggtgagtccttcgatccgctgcatctctcgggccacatgggttcaaagatacgtacagtttgcttgttgaaaaaggcacaagattttgcaggtagacgtgca

SEQ ID NO: 20843 - DNA, 1501 bp, Oryza sativa
tccatgatcatttcatcatcatcaattcacaagtggagtcacaaagttgccacgctttgcaggagaatcacttcgcatttcaacgtcatggacctgattactaacagacaggctatggttctctctccctctgttgctttaattttgttgttgtcgctgccacgaggaatatatataaaacagccatcatgattcatcgactgatcttccactgcttttttttttcacggtcaccggcgaagaaggctggatcgccaatctcaaaagaaagtgacgcgaatagcatctgatcgggcgctgctgctgctgatgctgcttttgtttgttttttgtgctcaactaaaaagattttgtgtcgcgttcagttctccacataatatcgcatctgatctttttgttctgctggtgctaagcatataatactcgccttaggcgagtgagtcccctcttctggcatgctatggcaaacgaaacatacagaaagacagaaagagatgatcaatttgtcagggatatgattttttttttggatcttctgaagttctgagatgatgatccatggctgttgagaggaatgacgtccggtctgaagatcgccgtccccaggcggtggcttcggaccaggcttcattccccatgactcatggaacccacacgtgtgtactgatcctgtgagcttcagcttcgtatgaattatgatcagcaaccaaccaagattgcagggaaggcaggtaggcaggtaggcagatgtccattcaattctgttgagatttctgaaggttttcatgtttgggattttgcagaatcgcagtgccactaggcactggctgcttgttttggatgaactttgctagcttggattggatgcacaggttggtactacctacctacttgctgttgctggcatggcatgctgatgctggcatgctgcacctacttgcttttcgtgcttcgctcgaacataaggcaacaaaagattaggtgcagatttcaggacaggatcaacaagaatgaaaagttcatatagcaaataggatttccagtttgaatgaaatgcgaaactgaatagtgacattacaaggacaaaacaccggaaaaaatattctggtcttctaagtactgatgaattattctggtcttctgaatactgatgaatcgtatgtagtagtagcctatagcgtcaaccctagacaagcaagtaatgcattcagtccaaactgtcaacgtcagactaactagaatgaaaagccgctcaaaccagcttgttgcgatcaagtaccagcctcgcaccttccttattacaatctccggttttttagcatacggtaccatctaattttaaaaattgtttattttattgtgacttattttagaactacaatctaaacctaaacttttacatatttatactaaattttaaataaaacgaatgatcaaatgttttaatggcgttatggccggggttgatgtcaatttcgaaattatagatttaagctacatt

SEQ ID NO: 20844 - DNA, 1501 bp, Oryza sativa
gttgtttatttggtccacgttcaaatagagagatctatggcggtttgcagtgattaagttttgtttgccaaaataaagatcaaacactggttgattttttattatctatttgatttagttaatatacattttctccggtttcatatttcttaatgttttggacaataacattatctccaagatatattttaatcatgtttttctattataatatgtgcaataagtaaatatatttttacttttactatagtattttataagataaagttctagtactgcctttaatcaaaacatttttaaagttattgccattcaaaattataaaagtttgaacttaatcttgtccaaaatgtaaagaattaatattgtccaaccttatcttagattcttggatagttttaataaattataaattggagagttgtttcatgtggtcaagttaattaccttgctaaaactcaacagggcatgtgtatcactgtatcaaaggatatcatagtataatacagagcacaatgtacatgcttctattaaatatacgtgtaagtacaaatagtatccgactatgacctttacgtaccatgcatgcatgaaaagcatgtgttttttttctctttgagatgattcaaatcatatttatgaagtaataatttgatatacaatcttgcattttaaacaagattccccgcgagatcgaatgtgcgaatgaagcaggctttttagacattttcttggtttattgacacatttttctaaactttgttgaaattttaaaattttttgctaatgtcttgttttgcttactcaatttgtgacatgtcactctagaatgtacattaaaggcaagtgtgcttatgacatatacgcccatgtgggtaggtcccatatatcaagtgtgctttattatgtttgaaggattcctaaaggtattctcaattcctttggaataaacactatttatgcattcggtccataggatttaaaggaaattttacatagaaacactatgtcaatcctccataaatccttcaaaatgtattcattccataggaataaaaacatccactccatcctcttttattcagctcatcgaagaaaagattcatattacaattctttgttttgcacgtgtattcatatattattctcgtgtatttcctattcatgtaatttagaaaacctatgaacctgagagaccctaaaccttttttctcgctgcatttttccaacttccaaggcatagctagaaattcgatgaccatgtcttaggctaagttcggttgtgagtttgaagtgggatttttcgttgcatataaaatgagacaagttattagtacataattaattgagtattaattattacaaacttaaaaattaagttaattttttaaaaccaaacttttatataagtttttttaaaaaaatgtatatattgtttacttcctatgtttcacaatataagtcaatctagcatttctcacattcatattgatgttaatga

SEQ ID NO: 20845 - DNA, 158 bp, Oryza sativa
gaagaaattgaattctaaaaaaaagacccggatttaactaatccagtctccaacacgagagataaaaattgctccagaagacaagagaatccatgttctttttttttttggtgaaaacaacatgtgggtgtgggagtgtgttggggggggggggggga

SEQ ID NO: 20846 - DNA, 1501 bp, Oryza sativa
ttgagttttttttcatcgaagtttacttttcagcctttacttttagattgctaagaacacgtatataaaaattttatttataaattacttttcgtttgcagatacgccgttgcgctaaaacgatggcttcaaaaataacttttttggccgtactattttccgtgagatactcggatgacgtgatgtacttgagtaaaacaaagatactaatccatcatctttttcagaaactctgtgtagtgtcacttttgtcaaatccgaaaaatgcattagcaagataaaagccatatatatatatatatatatacaatactctatacaagtactacctccgtctcataataagtacaactgtgaatatccatgcccaacgtttgaccgtccgttttatttgaaaaatttgtgaaaaaattaaaaatatttagtcacacataaaatactattcatattttatcatctaatagtaataaaaatactaatcataaaaaaaattcaaataagacgaacggttaaacgttgaatatgaatagggtaaaactgaacttattttaggagaagagaagtactataagggcaagttttataatagaggaggtggtcacatataattttatctaaatcatctacacattaatttagaggtaataaatacaatagattgcatctatttacactacacccaatatatttgctaccaatccacttctctctttctcttccatttcttgaaacttgtatggaggttaccccttgcatgaggggtggctgctcttctctctcttctctcctccacatcatcatttgagtctatatggcatcttggaattagtgataagatgattatagtacttgccctaagaaaaaggaaagaaaaagtatgtgctttcagactataccgcagaaggaggacccacctgtcagcccaaacagcagcacaggacaggagtaccaaccccaatcccagggatacgatgacagacacgccgctggccgcttgacctcgcccttctagaaaccccacacatgcttggtagccacggctgcatgcacaaacacacacatgttgcccgtgtacggtgctcgattcgtacttgtaccgaaccgagcaccagcaggctagtcttccacacatcccgcctccgcgcctcgctactctgacccgcgtcccccacctcctgcactcgcacaaacagaccacagcaacacagcgcgccgcctccccacccaccccaagttcccaacggtttcccaccccctacaaaaacccccacagccccactcgggaccaaacacaccacaccccgcgccgcgccgcgccttcacttgcaaaagcccggaagaaatcccggtgccgcgccgcgcagcgcagcgcgcagactgcgaggaatcggaatcacaacaatcacccacctcgagaagcgcacaacggagagggattagaattgatagctctcggcgaggaggttttggtggtggtgggagatggacgcggcgggggaga

SEQ ID NO: 20847 - DNA, 1501 bp, Oryza sativa
tgattaatcccagcttcacctgtctgcttcattttacggagctgaaattatttagctgggctatagcttttaagaggatagagcctgagctgaaactgtgacaaatgggtccaacgtcacaaaatcggcggaggatgaggagcagccaaagctgggcaacttcgcgccattttctccgcatgttggccgtggatcctccgcgccgacgccgagatctcgcttcgcattttttgcatgaggcgacaaatgctggtaagaatggaccttgattaataagcgtagcgcaagaaactttgattagcagggttattaagatgtgtttaaatgcgcgtgtaccgtactgttttgacataggattcttcctggttgaaagctcccatacagtcctactatatgctatgcatgggcgtttttactcgagagggatgtcgtaactatggtcacacacacaatgtcagagctgtacagccccagtcctgacgttagtacaggactgaccgtcgctcaagatctcgctccgacgcgacgacgctttcatggcgctttgtacagctggcgacatgcagccagccagccagccagtcctctcgcaacgcccatcaagcctagctcgtccatacaccattattcagacatactagatcggaatggatatacttctgtatagatgagagaaatggtttcggatcttgtagaggagaataggagaggaaaaaagaacaaaaaaaaaattaagatgaacttgaacaaggagatggagattcagggtttaactttttcgatttcgaattaaaaatcatatctcattggtttaccgaaatccgaaaaaaactagtaaaaaccgatggcttttagtcaacgccgtacgaaaaccgactaatattgaccggttttcataaactaacacctagcggtttcgtgaaaaccccccatggaatcatggaggtagcccatacatggtgatcattggcagtggcccctgcagctgcaggaaatgaatgataactgggacagtttttgttgcgtccgtgcggatcgcagcgtttcttcttcttccacctcctcccatctcccccactgacccacgcaccaatggcgccacaggtccacgtacccaaccactcctctcaaattaatctccaatcatccgagctcgacgcatccatggcttggtcctacatggagtgaatgcgagatgcgcccaagctagccattgaagacgtcgctgagctaagccatatacacttaagaggagcacttcagggattcaggctgaccatggcatgcatgcgtggcgactaatggatgaactgatcattcattcattcattcattcattcattcagcatagcggatagctgagcttgtgctcagcacggcaaaatgaattgtgtttcagattcagcccccagttcatcatcgttcatcacatattcacacgcacgccaccctggcttcacccattactctctgacaggatagtagatcaatcgatttacta

SEQ ID NO: 20848 - DNA, 1501 bp, Oryza sativa
tttgtaaatatataaggaatcgtaaaagaaatctgtttaaaaaactcgcaggttaacttgagatgattggactctaattacaactcataattttctaacaaaatatatatccaaacgaatttaacacaatgtgtttcatcttaactaaaccatatatctctatctcttctttatctctatctctactattataaaaatttaaggtgtttttatcgagattttagtaggtcacccgtgtttaaataggttttaatttaatgtttccatctgagcgaattaattgggccgccttaaaaagaaaacgtgtccgattcctcgtaagaactaagaaaggtgaaaaaccatccgtaaaaaaaattaaaaaagagtgaaaaagtcccccagaagaaaagtctgattcccccagagcggcgaaaaaaagttcgttccttcaaaaaaacaaaaaataaagatttgttttgtatgcaacaataaaaaaggcagtccaccagtccgtgaaaaaaatccatccaaaataataaaaggcaaaaaaaaacaaaaaaatgcttcaaaagagaacaaaatgtttccgtcgtaacctttacctattataaaaattgaagataattttatactcatcgaattttcgtccgccgtcccttcattccaacaagccgtcttgttccgattcatatatgtttttagcattttgaccatattcacgtttcctttttttttttctctgcacatccaatacgtttttgcacatatgggcctaaaattgtaaaagggcccaacgtctatcacaatctgtcttcctatttcgagctgtctcagtgaaaaatattgcctatcttctaagcatatgttacatactatttattacagatttgtttgtgttatttcaataattttgtacacatgcaaatgaaaaacatactaatttttgtatgggtggcttgcatgcatgtccgtttattttgtgaaggattcatctacacatgattctttttaacataattttttcaacatatgattccgttcggccatttaggattaagtgatttattattaaaactgaagttgtttccgctgtgaagttgtttccgctgatagttttagtatgttgtccgtatttaagttggttttaaaattcgtttgcttttaaaaatacaagggtttcgaattggatatcatatcaaaataaaaatcccatatactttttagacaaaaaaaaatctaacaataatacaattaaaatagtcttcacccgttgcaacgcacggatattttttctatttaaattaaaaaaaaatagaaataaacaaaattagaaccagaacatggtccacattggacattggacattgggccttgctgcttggctggtctaatcaagccggtagtggcaggtcaccacatggggtcgtctggcgggttgtgcacgatgtgtctgcatggctgaaaaaattgccgcatctgcaactgcaactgctacaataatcgtcagttcccagatcca

SEQ ID NO: 20849 - DNA, 1501 bp, Oryza sativa
gcagttgcagatgcggcaattttttcagccatgcagacacatcgtgcacaacccgccagacgaccccatgtggtgacctgccactaccggcttgattagaccagccaagcagcaaggcccaatgtccaatgtccaatgtggaccatgttctggttctaattttgtttatttctatttttttttaatttaaatagaaaaaatatccgtgcgttgcaacgggtgaagactattttaattgtattattgttagatttttttttgtctaaaaagtatatgggatttttattttgatatgatatccaattcgaaacccttgtatttttaaaagcaaacgaattttaaaaccaacttaaatacggacaacatactaaaactatcagcggaaacaacttcacagcggaaacaacttcagttttaataataaatcacttaatcctaaatggccgaacggaatcatatgttgaaaaaattatgttaaaaagaatcatgtgtagatgaatccttcacaaaataaacggacatgcatgcaagccacccatacaaaaattagtatgtttttcatttgcatgtgtacaaaattattgaaataacacaaacaaatctgtaataaatagtatgtaacatatgcttagaagataggcaatatttttcactgagacagctcgaaataggaagacagattgtgatagacgttgggcccttttacaattttaggcccatatgtgcaaaaacgtattggatgtgcagagaaaaaaaaaaaggaaacgtgaatatggtcaaaatgctaaaaacatatatgaatcggaacaagacggcttgttggaatgaagggacggcggacgaaaattcgatgagtataaaattatcttcaatttttataataggtaaaggttacgacggaaacattttgttctcttttgaagcatttttttgtttttttttgccttttattattttggatggatttttttcacggactggtggactgccttttttattgttgcatacaaaacaaatctttattttttgtttttttgaaggaacgaactttttttcgccgctctgggggaatcagacttttcttctgggggactttttcactcttttttaattttttttacggatggtttttcacctttcttagttcttacgaggaatcggacacgttttctttttaaggcggcccaattaattcgctcagatggaaacattaaattaaaacctatttaaacacgggtgacctactaaaatctcgataaaaacaccttaaatttttataatagtagagatagagataaagaagagatagagatatatggtttagttaagatgaaacacattgtgttaaattcgtttggatatatattttgttagaaaattatgagttgtaattagagtccaatcatctcaagttaacctgcgagttttttaaacagatttcttttacgattccttatatatttacaaaagcaaacgaacttaaaatcaactcaaatatgaa

SEQ ID NO: 20850 - DNA, 1501 bp, Oryza sativa
gatctttccatgagttgagataatcatgatttaggagagaagttagcaactcaactacaaccgcgcgagatggtgttgtgttgcgtcttagcggtcgatatacctctttgtgtattgttgatattgtcggtgcagatcaaccttattcctgcaagcaaatcgctaaacaagaaaaacaaaacaagattaaaaaaaacaaaagtgcaaataggaataaagcccatgataaatcggatacttgaaaggtgggttccgaagataagtaattgaacagtatagctatcacacataataataagataaagtagtaatggctaaattttaatataacaaaaaccaagagaagttgaaggggtacctaactatttcgaaagtggaaggacgattaaggttttctagagccatgctccactaggttaggcacacacaatatgaaccctacttaggctgagcttctatacgaagttacaagcccaaagattcatgataggtgaaacaacatattttttccgcaatcacacccgagtcagatgaaatttagagatgatactatgttaaaaaggggactcaaaaaattctgatggacggagctatattgatgttttgattagttgttgtatagtttgagtcattaaagaagtataatcttttattatagagtaaatttcataaaactacacgttttgtagtccaagttgcagaaaaccacacatactttgacagttggcacttaagtacatatattttggttgtgtaatttcacaaaaccacactattgataaatggattcacccgcgagatgacgtggctgtttcacctaggacgaggacatggcatcctattatcagccatcgcatgaaattaataggatgccacatccttatcctagatggaacaaccacatcatctcacgggtgaatccattcattgatagtgtggttttgtgaaactaaactaccaaaatatatgtacttaagtgtcgagtgtcaaaatgtgtgtgcttttctgtaacttgaaccataaaacatgtagttttatgaaatttactctttattatattgtcttgcaatgagatattcatggagtgatccaggtgctccttggaggagcttcgactttggtccacaaggatccctcccccaaatctactgtataggcatgggccattgaactgtttatcatgatttttttagttttcaactcaaatgctagttttaatggatttgtaataatatgagaaattattttctatatctagtttgaacaaattttgcatatggtcgacgttataatattttggaacatggaagagaaccaacaaaaaaatttactagaagataagagtgccattttataacaccaaatgtttattatagtaccatctgtgatacttgtctgattagctcgattttatgaacctttaattttaattagagtttcttgcatcggtttccaatggggaagtcccctgcaaaactcttgtcttgagaaaaaagaaagg

SEQ ID NO: 20851 - DNA, 1501 bp, Oryza sativa
gaggagcaaccggagtagtggccaccacgatgcgtcggcgagggtggtggcgacgggcaccagccctagcccgacgttcatggtgttggtggcgaccgtggtggtggcggcgactcctctcccatcgacggagaagatggcgaaggcgacggacgcgctgattgcgagagaggccgagaacggcatccataatccaatgaaaggtaggcatcgtaccttctttgttgattcttctgttcgcttttctgttagatcaaaagcgatgtttcttccttctttcacttcgcgatctccttcgcgagagcgaaagtgctaataacatgttaaaagtgaataagattgattgagcgagagggattgagcgagagagagagagaattgcacaagaatgtagggaatgaatgagcggaatcctttattgatcaatgcggtacaatatatagatggggaaggggtggcaaccggagacacgatggttgggaaccatcgcgtctgttgccaaggagcgcctaaggaaggcgcggttgccttcggttgtgatccatccttttatatggatgatatcaccctgttgtttcataacagatccaaatgaaaaaaacaccttcgagcaataaagaagacgccctactttgactgatagtttaggtgtttaaccttcacccattccttaaacttgggtgtttaatgagttaattacaccctctaacaaggcttttaaaaacaccaccactccgcgaatcaagttctaaacgtctaagctgagctagtgttttacgccttcagaaaaggtttacgtaggacctgtttgacacagcttcagctccaaccctcctggagttggagctcagccaaatagtttcaactccaccaaaactgggagtggagctgggttgagctatctcacgaaataaactagagttgtggagctggatttaggcagctccacaactccacattagacctaactcctataccaaacaggtccgtactaccattatccgccttctcgctgtactggcaaccgtatacctgaaggtaacacaggttatacagcacaaaaaccgtgttgttaatttcgcaattacccccttaaaaaaatccgttgactgaatcggaacgtgattagcgaaagcgttaacgcaccccaccaacttcctcccgttccccaccgaatcgacgaatcctacccgtccatcccatccgccagacagaacggacggcccagatcgaaccaaaatttccccaatccaaccctttcgccacgaagcatcctcctcgctgtctcggagtcacgcgagaatgagagaaaaaaaatcatgaaaattaggtggaaaaattaagaaacaaaaacccgtaaaaatcaccaaacacacgcagccaccgaccgaccgatcgaaggacccctcctccgccgacgtaagcagcggggggctcccagatctcgccggcggcggctgcggcggcggcggaggcggaggcggagggggaaggggggaga

SEQ ID NO: 20852 - DNA, 1501 bp, Oryza sativa
atacatataccacttttcaataaatatttttatagaaacaagaagtcaaatttgtgttttggagaccgtgtcgctgtccaaaacgacttcctttacaagtacgaagggagtatactacaggtggatggctgggccctattaacacggtgtagcattgatcggtgatcaatactccctccgtactcgtaaaggaagttattttggacagcgacacagtctccaaaacacaactttgacttcttgtttctataaatatttattgaaaagtgatatatgtatacttttatgatagtatttttcaagacaaatctattcatataatttttatattttcaaacttaacaacttaagagttattcatgatttatattctcaaggtttgacttaaacattgtcctaaacgactttctttacgagtacggagggagtattgcttaacattatccatagctttattgttttcaaccgcaactgtttactagtgctttatacaaatgagcgcttatgttgtccttgtaatcccttgcatcatacccatattcggtatgacttgctaagtacgatgggtagtactcaaccttgctataaccctcaagtgtttcattttgttcttcaacactgtagatctacttgcatccgtctgataattataaaatgaagtacaatttatttgtcgactttgatcgatcaaacgaatatagcatgctcattgctcagtttgcattatctgaacttgcaaacctgaagaaatacttttataaatttaaggggcagtgtcactgtccttttgcaagctatctaaatttgaaaacaaaattgtgttaaaaatttgttcgagattgagagagtagtagtggagctgataggtgggcccaccattttttattcttacccttgtcacttgtaagtggggcccacttctagttttaattcctttaatgactggattgccacattagtgcacttggaccaagtcaattatgccacgtcagcaaaatcgcttcgcaaaccacctaaagagtcgatttgcaccggttttttaagttgggaaaggtgttatacccggttttgtggttaagggatatgattcgatccaggaaagagttaaggatgtatagtagacttattcgtttagaaaatgtgctcgtaacaaatgagtaagtagctacccaacagcccataaccacgcagcccaaatttccatcatgccaaggcaaactcaacccaacctgcgatggggaaaccatttcttggtatacccacttatcattgttccacgccagccgctagtaccagagtacagcctattgttgtggccgctgttaactggttctttctttttccttcttttttttgcgaggtgctcttcaatttcgttgtttgcgcggtttcagcacgtagtatatgctctctctctcttctttttttttttggggaagcacgtagtatatggctatggccacgttcgtttccaccaagggtggatctagaacaaaataat

SEQ ID NO: 20853 - DNA, 1501 bp, Oryza sativa
ttccttctagtagtttcatcttcagaaacctcttaaattattattttcaccatccatctaatccaacggtcaagcttcatttatcctcttttgttttgtagtaaatccaacggctaatatttcatttatcttcatttatcctcgtttcattttaagttttacctttcattagttaagatttgattctttttgttattaagaagttcaggcattaacttgtaaaatttacaatggtagtagatgggatggcagattcactgccaccaacaataactttttttttcaagaagtatagattatatgttggttctgttatataaatgttcggaaaaaaatttggcaatcgtatgttatcacatttgataaaaatagagtgaaaaattaatagttctatttggtaaaatgtaattattgctgcaaaatgatagacttaataaaacatgttggcaaacttcgttcaacattattttaaaaaactaaatactacaccaggtgcacacagtttggtataacgtactggagactggcatctgaaggctcaatattgttatcaaatccaaaaaaacttagttttatttgctacatacggaatacgttcactaatcaatatatatttcattctgggttttggacattttgggacataattaaactttccctgcatgactgatatatgcaatcactactagaaaaataatttttcatggcgtcacacaacttttcgctggcggccatacgcgaaaccgccagcaacaacatcaggaagggtggggggcttaggactgccagcgaaaaccgatcttcactggtgttggtatttcttacgatcacagatagaatccacaagcgcacggatataccgatgtagcacttcccctacggagtattccaaggatatcgaatccaagggaacgtgtgtggtcagatcttcctccggttcatcctaggacaccaagcagatgataggcaaggatacagaggatttagtagtgagaaacagtgtctagggaaagcttaactttaatcctaatgcaatacttcaggcactggcaacccgctgttctcagatgtcgctctactacgtacccggacagggaggacttaagtgatctcgagggctgtcaccacctctatacctacctcaaacgtactgtgggatacgcagcaattactggataacaactaccaaaacaccacgtctaagcaattaatatatactttagtgtttataactcaccaaaacaatcgctatattttagttgattatagtgaacaataatcccatatgctatttaggaactaaccaagagataattcttacaagataaatctaaattactcaggaagataattctattgaaatcagagtaataaaaagaataaaagaaatcagtaagaagtgcatatagtttggcagtatcactggcgcgtgctgaggaggggtcaagctcgtcagacagcaacctaagtaaggcatggaatatggtttggaagtgcaatg

SEQ ID NO: 20854 - DNA, 1501 bp, Oryza sativa
caaaaatgctaattataaaaattttttaaataaaacaaacgatcaaagttgggcgcggaaactcatggctgcacttattttgggacgaaagtagtatattgttgtagcaggtacttataacagtttcaacgtctcgtcgtgcagttggatcgatcgatcgatcgcatcatggtccggcagccagtgaaggagtagctaaaagtagagtaggcgaatggtggcgcaacaacaatgcgctacagtggctaagccgttgaagtccgaacgttgcacagtgtttctctgtacccggggatcgatcccatgtatgattggcaagtagtactagtacatattggaccaaccatggtggctagctctgtaggtacgtgccaacttatacacatatacatgtatgtatatagaggtcggatcaataaaaaaaatattatctaaaagacttgtatgtgtatacgtatacatatacatgtagcgcattggttctcaccgagaagaagtagaagaaagatgatgattctaaaattcattgttctcgaccgacaactgcagcgtgatcgctcaatcatgcgtgcactgcgagtaactttcttgtgacgagcgagctggtactgatggattgatgagccacctccactgttccgctgcccaatcatggccaggccaaagatcacggcgagacagccagtataaaatatgcatgcacacctctttttttcaagaagagaaatcttcttgcgaatggaaatagacagtactacctagacacggtggcataataatatgggccttgtagtttgctgcccaaaccaaagttctctttttaagattatggttcagatgagggattgtggtcaatggttgagattaggaagcagatgaggaaaaattaaataagaaatagctggttgaagggcctatccattttagaggaacttcagcacataggaatagaaatacatgcacacttcaattcataggaatttttccataaagtttgtgtagatggaaaatttccttttgttttctctttgtaacttgtagggaagaaaatttttttttggttttcctatatctacattcgtatgaaccaaatgacattcatacgaattattccttaggaatctaaattctttgaaattcctctaaaacaaataggcctcaaatgagaaagtaggcggtgatactcttatatctctactacttaaaaaatttaacatgtttccgtcgtccgtcaacataaaaaaaacagcgaaaaaacaactaaaaaaatccgattccctagcgaaaaaaaaagatccgattcccacctaaaacaggaaaaaaagtccgatacctggcgaaaaaaaagaaacgtagatggaaaaaatatatctgattcccacctaaacggaaaaaaaatccgtttcctggcaaaaaaaaaagagaaaacaaatgtagatccgattcccacaacgggaaaaaaaagtccgattcctacaaagcgaaaaacaaaaaaaatccg

SEQ ID NO: 20855 - DNA, 1501 bp, Oryza sativa
ccaatatatataataatataaagacaatcaggtgatgatgataaatagcaatataatctagtagaaaccaatcggctaataataatatgatagaataagcaatgatccgaaggttaaagcatacatcggctggaggaccgatgtcatgaaatccaaacaattagataaacaatgaaatctttgtcgcaatcgactgaatctatcttgtatataatccttataagccgatgcaacgtctagatacctcatcggctgaaactccgatgaaaccgttattggcaatcaaaaagcaggctagagattatggttctaaacacgacttagtagatcaaacttaactgatacaacactaagtatgaaaagaaacataatatctagacaatcaagcccttgactgattttcaggatggtagataccttagctaatataatctggtaaagcaatttagtcgataccggcataaaccctaaaacgaatatcagccgatacaagtaaattgaactaccaaactagattaattaagatatataataggtaagtgcttacattgacaagattagagtgtcaaagcactatccccgccgatgtaaacaaccatgacaagtcttagcataaacttgtcgaaaaaaatagaaaggtaaaaaagggtggcgatgcgccgaatttgtattaatcgtggagatagtttacaatgaccccgattgtacatatttatacccatggatagatactagttcttattggacaagaaagaaacttccctaaatataaaagaaaaacatgaagtccttattggatactaaacacactttcctagagttaaaaggaaactaacaaactctttctaattaatagataaactgccatgtcgaatcctccttgaactcggtcacatctagataaagcaggtatcccctctgggtaatgcggtgcttcttgatgctgttgatggcacgaggcgtgcattcacgctaatctacataggctcaaggataagacatacacaatcttacgcattgtgcacaccatacataactgaagacggcttcgttttgctcccctctctctccctgtcacctctcttcctcaaatccggtcgatttagtgttgttttccgcggtatttcttgcggaaattgaagagcaaggtatactcctaaattccccttatttttttccattttaatcggttgaaattggagtttggaagatagccctaggaatcactttttgctcaaatttgttattttatgccttgcaatgtgagatttgaggcttgtattgttacttgtgagcaatgtgctggtaggctctttgtcacacccagaaattctcgaaccagaatttctaagctgaatgtgcattaaatccctgtccaggaccagccagggtacacaaacgacaattgttgacatacagacccacgtcttacaaaaatataaaagattacaaatgcagcgggaaagataaaagcgagctaaaccgggaagcttgacttcag

SEQ ID NO: 20856 - DNA, 1501 bp, Oryza sativa
tcatgagactccataattgtaccaacatgcatgtcaggtacctcagatttaactatagaaaatctatgagcaatgctatgatgagcatatcccagaaagacacatgccacagtcttaggtccaagtttgcgcttcttcgttattggtacattgactttcgccaagcactcccatgtgcgcaagtaagaaagtcatggttttttcccaatccatatctcgtatggtgttttgtccttatttctgttaggaactctgtttaacgcatgattcgaggtaaacaatgcctcccccaccatgccttaggtagccctgcggtgtccaacatggcattcactaagtcagtcagtgtgcggttcatcctttcagcaatcccattagacttgggagaatagggaggcatcctctcatgtatgataccatgttccttacagaataagtcaaactcgtttgagaaaaactctccaacacgatcagacctaagtctttttatctttttacctaagtacacatagcaaaatctagtagcatcatcaatcaacgtcatgaaatattgcttttcacccttcgtcaacaccccattcatttcacaaagatctgaatgtaggggttctagaggtaccaagtttctctcctcggcagtcttgtgaggcttgcgaggttgcttcgattgcacacaactatggcacttagaacctttgacaatggaaaacttaggaattaaacacatgctggatagccgagacatcaagccaaaattaatatgacataaacgtgagtgccaaacattagcctcatcatccacactgccacaaatatggttcacagacttattgcagaaatcagaaagggaaaagcggaataggcctccgcactcataacctttaccaataaaatattcatgtttagacacgactactttattagactcaaaaaccaacttaaatccgtccctagtcagacgggagccactaacaagattcctattgatagtagggacatgctgcacgatctttcccgaagtaaacttcagatctaccgtgccaacaccatgaacggtgaaaccccattccccattaggatggtggaaccccgtgcgacctgataagaagaaaacaatgagatgtcagcacaaacatgtacattggctctagtatcaacccactagttagtagactgattaactgaaaaaatagtaggtaaattagcatacccgcttccatctccagtgttgccaatagtcacattttcagacttgaaagtctgccctgcaggtaggtgccttcatccccttgcgttgtggacacttcttggccagatgaccagtcaagccacacacaaagcaagtcctctcatccaggttaagatggttgttgttattcttctgtttcttgaagttggtggtctgtggagctttgtatttccccttgctcttgttctaggccttgagcacaacattggcactggactgcccaccatcgcccttagacgcggcgtccttttc

SEQ ID NO: 20857 - DNA, 1501 bp, Oryza sativa
ttgctctgctctactctgcttttgtggggggagttttctccgatctccttgagatctgcgaccacatgccggcctgatctcgctgctcctcctatccttccttctttccaaaaaaaaaaaaaaaaacaacaacttcttccccatgtgcgttgcgtcgccggctagtactactatgtttttttgggttgtttagtttgttcctggtggtgcctgaggattaacgaagctgctaatgtcggatggctcaacttggccggccgtcgatcgtctcaaaggttaggtaattaggctggctgtggctggttgtcgtctgctacattggccgaatcacctagaaaccaactcctatactctcctaagttatatagactagattactagtttaccaccctacaagagctcctagtttggattgttagggaagcaatgatcaagccccccgtgttttcaacgctgttaccccattttatcagtgccatttagcctgaacctatacgtctgcctatttggatgcataaatactcattctttgctagtgcgtcagctaatataaacgaaaaaaaaaagaattaaactgtcacgtacacgctaaacactcgttctttaacacacacttaagcaaaatctttcccgcgggcaaactattgctttcggtgtacaaactgagggagaaaatttaaccacatctgacgttataattgctgactatctgatatccagtcgttagcaatctgacgtccattgaatatgtacagttgtacccacccttaaagtatgcaacgaaaattttcatctctgattgatctcccaaacctgattaagccgcctcaagcatctgtccaatttggaattttgtgatcctctcctctccctctttaactgaagaacatatatatgctctcacgcacacagaaccgaacactgcatacccaaatctccaatcatatgcaacggacggacagacagctcattctgcagcaaagggacaccaatttgtcaatttcacatcccccacaacccatatactcacccatcatcttgtccccctcatttgcttcaaccccagcacgcacgcactcgtgtgccctctcgatcacaaactgcaaaaaatgagtcccccaatcatggcgcgcaagaactgattctagttctgcgacgatcagcggagtttggcgatctagcttgattactcctgcagctctgcttctgggctttaatgggtgagttagtttaagtaacctgttcttctttcgttgaattcggcattgttctgcgcattttgtatgatttgtttgtttgttttggtcatactggcgtatacttctgcagttcctagcacaacattccatgtagatttgttttcatggctgcccttttttactcctccctttccctctccttgatttggacagtttgaaccccatttgaacttgtggtcctacagtgatcttctctgctctgttcgtactgtaaagaaacccagcgatctttcgccggatac

SEQ ID NO: 20858 - DNA, 378 bp, Oryza sativa
tctgtggcctgaaggctttccttctcaagagatacatcatgcaagaatcgggttgtttcatgatgataaacaagaacaacgttatgagggccagagggacaaggcttagacttgatcgagggtgatgagggtcgttcagtttcatgaagatggtcaataggttcagaagaaatgaacgaagatacaaacatcacctcctcgaatggctcatgcttgggatgagccttgattttgctggaataattcaaggtgttctcataatcttcataaagatcatccctgaattggaatggaatttccggaggatgaatttcttcttcctccggctccaacgactggaatgaggattcgacagttgagtcgggtttcgactccaca

SEQ ID NO: 20859 - DNA, 1501 bp, Oryza sativa
tataagtcaaaatttaagttatataactcgattttgaatttgatttttttttgcattttttaagccgctaaggacacaaatatataggttttactcataaatattttttatttgctaataagagattcgtataagtatacgaataagcgaaataatgggacttggaaataaaggacgttcactttagtacctttggaattcgtctaaaatcaaaccataataaactttgaaacaagacaacgcattgatcaaactattatagtttcataaaactatagattgaaaaatgagtatcacaaaactacagatttaacactaaaattttcacgaaactacggatttaagttattgtatcataaaactacatattttgtaactttgtaaaaataatagtgctatggattctaaactctaaactctgtacttcttaactttatcactaaatttgtaattttatgatacaatgtcttaaatatatagttttatgataaatgtggtgttaaatcagttttgtgatttgttttatcaaaatatatgtagttttgtgaaatgtatttaagactaacattaccacacaagtatcacattataaaaatggaccctaaatctagttgatggttgaatggtgaacggttatatttagttttcagaagtttgatgaaagttcagggctacaaattgagaaattttacccttttttatcgacaagtgactgactctgcaaattgtaaacgataaatgtaaatgcgattgaacaaatgttcttttccttttttttatcacagccgttaggtccatttttaaccataccatttgttggcatagttgtcaaaaatatgtctacgtttagtttgtggccaaactttagtaaatacattaaaaaatcctgctaaaatttttacaatattatcaacttgctaaaatttggcaataccaacaaaatttgataaggtttattttaactacaatctaaacataccctttataaaaaaaaaccatcccccacctttcgttaagaccactctgtagaatatagaaagttgttttgccagctactattcaattatttatgagattcctaaggatagtttgggcaattagtatgatgacatttgtccaaatgatttttttattagtcttgcaaaatgaggagggggggtgtttgtaagatggtattttgtataacttaagtttagcaatttgtaggatcagatagttatcaatgacaaaacataaaatttctctccatttctatgaggatatgaaattttggagtcggcaatcatgggattttttacccaatttgattttttgtgtcagatactccctccggcaactaaaacagtcaggatttgattcctttttaaactggtaatgtatgatagtcagccttgtgcgtttaagttttggattaagtttcctctgaaaaaggatggattaagttttggattttggtggcacactttttaaaccgctaaacagtgagtttcgtgtaaaaact

SEQ ID NO: 20860 - DNA, 1501 bp, Oryza sativa
aggagctccttgaagatgaaggctttggtgtctagctcgtgcctgccgtcaagcgcctgtggtcgtcgccctagtcttccgctgtttcccgtttgtctttgtgtgtgctgggccttcgctgcccatgtaataagttaactatttacgcttccgcttgttaaactctgaattgtatcaagttttggtgtaccttgcctcctgggacaaggattaatgcacgcacgtcagggacgcccgttgggttatttccggtcgtgacaagttggcatcagagctacccttgaccctaggacgagccgtagatcccaagccttagcaatattttcaaaaataaaaatcctttgttatttgtaaaaactgtctagtctctctctgtcttgctgcttcatttatcgccaaaatctgacctttaaaatgttgttttctttttgtttttgtttgtagatggccggcagcgtcacccgtcgtggtttggacatgactggcttcgtcttggagctgcggggcatgtgcgtggccctggggtatccacatggagtggactaccaggccaggccgcttccggatcaggagggtgacgacgcggagccccacgctggttgggaggtcaccgcagtgatcctctctggctctcccgagcggacttcgctggcagttaccgcgggtggagattccttccccgccgcttgccagaacgccgctctcctcgccatcggcactcttcaccagcgctacccggacgagttgcagcactcgccctaccgctaccaccctcgtcgcggaggagcccacgactacgccaccttccgggatgctagctcggaggatgacgctaccatcgtgcacctggcgcgcatggtggaggtgtacgacgcggctcgtatcgacttccatcagatggtgcgtcgcgggatggtcgagaacaatctgaagatcctggagctgcgtcaggagaacctgcagctcaagaaggacctagacgcggtggaggcgcagctgcatcagctcaagatcgcccagggagaggtctgccgccccaagcgtcgccgcgtctgccgcagccagaagatcaccgcccgcaagagcacctccaggcccgagcttgttcgtcagtccctggcgtggacttgcttcgtcgagacccctcgtgccgagcccgcgcccgtggttccccaggagggggaagcctccggcattggtagcacggagggtgcgctgttgctcaccttccgtcctggcccgtcgcagcagtagacgagcagttagtaggcttgcgcgtgtgtttttttttctcgtttgtctttttgagtcgtgtggggcatggttatgccggtgtgtggcataactgtgtcggagcctgtcttattttatttgcctaagcaacttgaacattaatgaaccaatttaatagcagtaataaattcaagaattatggtagtcgtgggtggttagttttaattgttagctctttctctgtttgctggttctgtgtggggttttc

SEQ ID NO: 20861 - DNA, 1501 bp, Oryza sativa
acttctccgcgtcgagcaacgatacggaaaggacccacataccgaggtgcgagcttcccttttgtctgaaacctgtgtacacctcgcaatggcgtgacccgaaggtacacaaaatcacccactgcgaattccaggtcacggcgacgattatctgcataacttttctgccgggactgtgccacctttagattatcccgaatgattctgactttagcttcagcttctctcaggatatcagtcccgaacacttggctttctccaacttggtcccacaatagcggtgtccggcatttgcgcccgtacaacgcttcataaggtgccaattgtatgctggcttgatagctgttattgtaggagaactcggcataggggagactcttatcccaggtcttcccgaaatctagtacacatgcgcggagcatatcttctaggatctgatttagacgctcggtctgtccatctttctgcgggtgataggcggtgctgaaattcaatcgagtacccagctcttcttggagcttcttccaaaagtgagaggtgaattggcttcccctatcagatacgattttcttgggaacgccatggagactcacgatcctagcgaagtagagctcggctagtttgttccctccataggtggtctttacgggaatgaaccgtgctaccttggttaatcgatccacaactacccatatagaatcatatccaccttgggtttttggaagtccggtgatgaaatccatcccaatttcatcccatttccattctggtacttggagaggttggagaagtccggccggtcgttggtgctctgccttgacacgctggcacacatcacatagggccacaaactctgcaatttcccgcttcatgctaacccaccagtatttctccttcaagtctaggtacatctttgtactgcccgggtgaatggaataagggctctcgtgagcttcctgaagtatcagctgtttaagttctctgttatctggaacgcatacccgctttccgttccatagggttctgtgttcatcctctgtaaaaccagcggctttaccctgtttcatattcttgaggagtccatgcatgtccggatcattcttctgagcctcgcggatttgatcgagcaaggtaggcttggcttctaacgcagccaagaatccgcgactaactatgcttaggttcagggcttccatctgttgactaagttcgggtggaatgccacggacgttaagagtgttgcaatggctctttcgacttagagcgtcggcaaccacgttggccttaccaggatgatagtgaattcccacatcatagtctttgatgagttctaaccatctcctttgccgaagattcagatccgactgggtgaagatgtatttcaaactcctatggtcggtatatatttcacagcgattcccaatgagatagtgccgccagatttttagagcatgaaccaccgcggctaactccaagtcatgtgtagggtagttgccttcat

SEQ ID NO: 20862 - DNA, 1501 bp, Oryza sativa
cccggtagtcgagatgtcatggcagagggttggtgccctgctgctagggggctcagtcctgcctgcctgtcccgggtgtcccggccgtaggaggattgggtcggtactcttgtttatggctaggatgggttgggaactatgtcacgtcttccgtccgtataccgtggtggtatgtggcacgtggttgcacgcgaggaagatgtgtcttgtgggtaaagatgtacacctctgatcagagtataatctattcgaatagccgcgccctcggttatgggcaagccgagcaatgtacccaagtcagtgttctaattcttaaaatttgctccacaactaaaatgtgcaatggttggcctgggttggcttgggacgagctgggacccagggtcgggttgccagttcggtctgaatcatcgtaggccttgggttaaggcaggttcgtgagggttcacggccttgtttaataatactgtgtagctctaggatcgtctttataaaatggctttgggcaactaagtgacttttaaaggctgttactgcaaaacttaacccctatattattatccccttgtactcccttgcattaattatgcatctccggtgtggcttgctgagtactgtggttgtactcattcttgctcaatcttttcccccttcagtaagagaagctttggagaagaagtcttaggtggagtcttggcttataccccagttgagcgcctgtgaagatggagccgtaggcccgctagtccgctgctgtttatttttgattgtcaggcctgaagcgcctttgtaataatgtaaatattatcggtataataaagatgtgtcttttatatcatgtttgtgtggtgtaccccggcttttcctgggacggggattaatacactagcgttcgggaaaaggcaattttcccggtcgcgacaagatggtatcagagccatctcgactgtaggataagccaaatggataaaacctaaggacatattttataaataaaactatttgcgaaagttcctttttctccttcccctaatgctatttgcaaaaggtttactgccttcttccttcttcggatttcaactagtactagatggtcaggtcagtgaagaagaagacatcgtcagttgtttgccgaagccccggaagactgcaggatccgctagcgaagcaaaggaagcagtgaagccagatgtgaagcaagagtgaagatcttggagaacccgtcgcagaacctaagccaccctctagtgtttcgttcgtcgtgtgtttccttgcttgtgtgtgtagcgcgtggtttgcatcagtgggttgtgatgtaaccatgctaggttgtttgcttaatcaacttgcagaataagtgaaacaaacaacacatcaataagaagagttagttcctttaaggtcttgtccctagttctggtctattctttccttgtatgcttcccctctcaacctctaccttgtgacagatggataatactggtaacaaaggctatgggaa

SEQ ID NO: 20863 - DNA, 1501 bp, Oryza sativa
ggacgcttctggggacgatgaggtcctttggcttgctgcctttcagtgaaaccttggtggggttcgtcaaaaactatactgactgtctttgcctttgatccgaaaaagacacatctgaaactcttagtccaaacaaatgtctctttggttgatcacttgattttcttttccatcatcaggttgggtattaactcgaggttagaacatagttcctctgaaatgagaccctaggtctcctttgacagtaaccaattatacacataatcccatatcagcatcttccaaaagaacccccatagaacttgtctgtattacacatttctctccttattacatgaatacaaggcactgctttaaacaaaaagggaaggtgcttaacatcggtacattgtttctgctatggattctgattaacacaaggcctcacgggtacggcgtttgctccagtgaccacaaggcgagtgacctgtcttcttcttgcataatggccggagtgatggcgcaggttacgcttcggctgtggacaatctctagagaaatgacctggttctttgcagttgtaacaaatcaacgtcttctttgctgagctgtccatctggggatgatcattgtgacttggagttggaattggtggttggaaatccttgctaacattggcatcagtggtaccatagttgctatcaccattggagtctttctcagcgtcaaaattgctaaggttgtcattctgggttccaacattgatactatcgttgacatcttggtgaatgctactgacattgcacgctttgttcgagtggtcactaatggggcaagaaccatggttgttggtggtatcatcatcattagtattgctagtgttgttgtctgcattgcgttcatcttcttggggcaggaactcttgatgcacaacagaagatccggtgatctgaagtggctcagtgcgctgtctttggttaccacctggaattactgggatgttgacaatccttctcttgcagttcgtcatccgattatgctcactttcaagttgcatggctttgtccacaagtttctcaaaatcttcataatcctctaggagtagttgcactgcgagctcatcttttaacccctggagaaacttctcttgttggtcttcatcattttccacatcttctggtgcatagtgagccaaacgatagaactcatgcaggtactctgtgacggtcaaatctccttgcttcaggtagcgaaactctcgttttcttagtgtgatcattcctgcgggaacatgtgatctcttgaatacagatgaaaactcgttccaggtgatggtatgtccttctggccgtgatgcttcgtagctatcccaccactctgaagccggtccaaccagctgatgagttgcgaagccaacccgctcctggtcggtgcactgaatcaaccctagcttcttctcgattgtgcgcaaccaatcactggcttccataggatcgacggcaatggcaaaggttggaggctc

SEQ ID NO: 20864 - DNA, 1501 bp, Oryza sativa
tgatgtgctatgacttaatgagaaaagaaaaatatcataaactaaataaggatgaactatataggtatataggatattatagaaaaataatggagagaaatactgaaacattatgcgaattatgtaagatgatttgacaagtttacattttaaatctctaaaactattagattaataaattataataatatagcatgcatgttgcatgatgtttaaatgttgttatccttagtatgtagtaataatatcttgggggtttgcaatgaaaactcggtatatcgactataattattataattattagttgatgatgatatgatatgtttgcatgttaaattttaggaattagtgatctataaaataattttatagtaagagatgatttatttatacccaatctacaactggagtaactgggacgatagaccaattccctgcttcctctttctcaagccgacgaaggatatcccctgtggttggcctcttatctggtttacccgctatgcatgtctctgatatctcaatgcacgcttctattatttgccggtaacgcatttcgattggcgtctgcctcatctttgatgaatcctgttccaacctatgcctccagatttctagtacctgacaagcaattcaatttcattagcaaaaagttacacacgtagtagtattaactcaaacaatctaaaatgtagtactgattattaattatttcttcttgaatatacattttctgtcgttgttccttcattattaggacccatcaccatctctctgattatcaaacccaagctgtatatatctgacttgactgtgatatctccattaactaagtattcgggtgccatgtatctcctgcatcaatggacacctgtaatctcaggtccaaggaaagcggatccacgggaaaactcatttgcaaagatatatgaaactctctctctctctctctctctctctctctctctctatatatatatatatatatatatatatatatatatatatatatatgggactacatagtgcccggactccaaggtatatgaaacacacaaattctcttaaattttttaaaattttcaaattgtgagtatatacctagatataagaatttgattcatacctatacctatcaacgaaaacaactcaaactcaactttatattcacaattcattattacatacctaactaataatatgtttggatgttatatacctagaactaaaatctaacaaaaattgttcaaactcagttcaaacttgtttgaacttgttagtaaggaagttaatattcatacctaaacatataaaaaaaattcaaactcatttaaattaggtatatattcaatttgaattttagagcccgtgcaccgtgcaccatggagcctgagttaattttactctctctatatatatatgtgtatatatatacatatgtatacatgtatacgtatatacgtatgtatatatatacgtgtatacatatacatgtatacat

SEQ ID NO: 20865 - DNA, 1501 bp, Oryza sativa
aatcaaagccatgcactcatgaataaacgaagccaagatcagttacaacctataaattattcaggtacaatgtacaactcagtttttatgaaaattaagttacattcattttccattgctatattctactccatcctacatcctgcatactattgttaaaatatgcaggagcaaagaattttgcagagtgaaacctgtagcaactaagaagtaccctcaatagggagagggatgccacaaaagactcgcaggtaacaatcattaacctctcagaatcgtatcaatagaattaaatacattaaattatttggtatcagcatgctggtgatatatgttcctgagataatactccatgtgctttcttgaagaaaagcactcaagccacagctttggagctgcaggatgcacattgtacaggttggaaatgaacctcttctctgagttagcaagcacagttgcaggggctaatgttcttctaagaagaccattctctcggagccaccgaagcattgtatacctaggctttacccggttctccaaatcaaagcacagaaatgctggaaataactcgaggtactccactgagtatcctagctccttagtcatatagttcaacttgtcattaagcatcttctttccctggttgagaatctttgggaatacactcacgatctgacacagcatcttgtactccaaccctctttccaggaggcaatcaaatctctcttgcagagtatcccgattgctgtgcagtacggctattatctttgtggctatcttattctcaccatatccaatgctcttcaagaattccagcttgccgtcaatatgctgagctcttttatcagccttcatcttaatcatccctcccaagaatgctcgctcaatctcaacgtcataactaacatcctccaacacaaaatctggaaataaataccgcaaactctccccaccatcagaaatcttctccaggaaccaatgatccagttccattgcccgcagcacaccagggaggttctgcagcaggttcttcccaacaacgtacgggtgcttctccaccgctgcattaacctcattcactgccaaaccaactctcctcaggtactccggcaccgaaatgacaacatcaccaaattcaagataaaaaaccatgggattggtaagcaagaatctccccacctcctctcccgccatccccaaccccttgaaaaacttcaacattttaccaatcctctcctcctcaagctcaagaaacaccctctggttgttgcagccgacaaggtccccaatgcccccgacctctgaaccagcatcatagaacatccatgtcctgcggcaaacccccaagaaagcatcaatgtcattggaggtccccaaaccagggcccagccttccaaacaccttgccaagatcgtcgacgagacggtcactgctggagagatcgttctcaagaagcgaggggaaggcgaggcaggcggcgatgatggcggcacgggggagc

SEQ ID NO: 20866 - DNA, 1501 bp, Oryza sativa
cgcgaatctaaacattctctagcggcaaactgagacatgccttgggtgctcccatgtgcaggtgacaaaagaaaattaagagcagagcaggagctttgatcattagctcacatgcatagatcgatcaagcgaggaacatattcatggtaccttccgtggattcatggccccatatatagaattcgcttacaattttgctatatatttgtcgacaaattttctcccaaaaatttgacagatgtaattacagtacaaccgtagtataattacactgtaactataatataacttgtatgtaactttcaaaaatctctccataacatattattttggtaaaataaaggttgtgggaacaatttttttcagatatgtgtgtactgtgatttttttcttcctcaccaaaataaatctttataatagatctaataatttaaaattacgtgaaacttacatacaaattacactgtagttacatgcaagttacagtgtaagtacatacaagttacagtgtaattacactacgattgtattgtaattacatctgtcaaatttttaggagaaaatttatcgacaaatgtataggtggtcccttcgcttaaattaaaagctgcttctaaaccttacaggatgaacactcagaaacagagttagttttctctccgtctctaaaaagagtgaaaatgaagcaacacgaagtttttagacaagagaaatgaaaatggtacgaagtctcacattagctaagggaaaaggaaaacaaaaataggatgtagagtgagacctagcgccaagatctgaatccaagcctaagagtaagatgtagagagagatctagctccacatgcaaaataaagctactctctccgtttcttaataacgggtaattttgactttttcgtttaaattttgataattaattgcccttaaattgttagcccaaagcgaacaaatattttacttgtatttagggcataccctactttaataacatatggtatcatttttatcgtttgtaaatattaaaaataaattgagtgattaaggtttgaaaaaaaatagtgacttagtgtcacttattatgaaacggactaacggaggatactgcaatgtaagtccatctatacacctgagatggaaggaatctagggtggtgtttgaatctcccgaagatgaagatgaagatgaacattaagtgtttcacgtaaaacgaggtggtaataacgtgtgattaattaagttttaattattacaaacttgaaaaatggattaatctgattttttagaacaactttcatatagaaagtttttacacgaaactcactgtttagcggtttaaaaagtgtgccaccaaaatccaaaacttaatccatcctttttcagaggaaacttaatccaaaacttaaacgcacaaggctgactatcatacattaccagtttaaaaaggaatcaaatcctgactgttttagttgccggagggagtatctgacacaaaaaatcaaat

SEQ ID NO: 20867 - DNA, 1501 bp, Oryza sativa
tttttttcacaaacactttgttaattcctgtgcaaaagtcaacatgatctacaattggaatgagtggaaatatcaattgtcatattaaggctaacctcttagcctcccccttcaattgttttgagaactcattaaagacacttagattccgattattcaaatgcctatatccagtaactccttgcaccctgacacttgctgcctgcacacatgataagggagacggcaatcagtaaactgtatgcataaatactccctccatctacttttgatagtcatatttccaaatctgaaaaatttatttttgataggcatattacaatccaacaacttatcatcttaatggctttcttggatttaatgcgtgactcttcattcttccacacaagattggctacataggcatcgagaaatgtaaatattaatgaatcacttgtttacgaggaatgagtagtagtatatttaaatggatgataagtataatcccttatccttggtctatgtgccaagatgaaatatgactatcaaaagtagatggagggagtataacgcaaggaataaagttgaaataacataagcaccacatagtgaataatatatccacagacatccctcaattcattttattaaagaaaagaataaagcatcaaaatacttttagaagtatattacactgattggaagccattatttattccatgtttacagaataatgtttatctactcaacggaaatcttaaccaagttcaataataaaggcaagctctttgctaatgcaaatgcataagcagcaagtaattatttctatctctccgagagatttagttcaagactgctatgctgtgacagcataccagtctcaaaataaaactccggcattctaagctacacgcacaaagtgttgaagtgatatgccatatacagctcaaccaaagctacatccttgttgttcgtgcatcattccccggtgatattttgaaggattatatatgttaactaacatttctccttcaacaatttcgattgagatcagttatagctaactttctctttgggattctcaggcgtatttttcttccaaataattcatatgaacatttaatatccttttatgtgctcgacatattcttcatatgattactaagatactgaactaaaggtgcacaaaaaccgattgaaaagtacccattttcctcagatcaaaattccattgtcagccaacaaacagaatttttcctctcattccacagcgttctaaatgttgaattttcaacagatggaccagagcgaatgaagaaaaaaaatacagtaacataggcaaaccaagccacaatttatagtatctcgctcagtatactaaatcaacaatttttattccaacctcattattctcctatgcccccaacatcgatgaacaacaaaaacgaacccgaacaagttggctggcgctccaatcttcgcaccgcaataataatagtacagcccccccgcgcctcctcga

SEQ ID NO: 20868 - DNA, 1501 bp, Oryza sativa
taaaactacatgttttatggttcaagttacagaaaagcacacacattttgacactcgacacttaagtacatatattttggtagtttagtttcacaaaaccacactatcaatgaatggattcacccgtgagatgatgtggttgttccatctaggataaggatgtggcatcctattaatttcatgcgatggctgataataggatgccatgtcctcgtcctaggtgaaacagccacgtcatctcgcgggtgaatccatttatcaatagtgtggttttgtgaaattacacaaccaaaatatatgtacttaagtgccaactgtcaaagtatgtgtggttttctgcaacttggactacaaaacgtgtagttttatgaaatttactctataataaaagattatacttctttaatgactcaaactatacaacaactaatcaaaacatcaatatagctccgtccatcagaattttttgagtcccctttttaacatagtatcatctctaaatttcatctgactcgggtgtgattgcggaaaaaatatgttgtttcacctatcatgaatctttgggcttgtaacttcgtatagaagctcagcctaagtagggttcatattgtgtgtgcctaacctagtggagcatggctctagaaaaccttaatcgtccttccactttcgaaatagttaggtaccccttcaacttctcttggtttttgttatattaaaatttagccattactactttatcttattattatgtgtgatagctatactgttcaattacttatcttcggaacccacctttcaagtatccgatttatcatgggctttattcctatttgcacttttgttttttttaatcttgttttgtttttcttgtttagcgatttgcttgcaggaataaggttgatctgcaccgacaatatcaacaatacacaaagaggtatatcgaccgctaagacgcaacacaacaccatctcgcgcggttgtagttgagttgctaacttctctcctaaatcatgattatctcaactcatggaaagatcatgccactattgctcatatcacaagagtttcatcgagaattagaaccaaaaattattttttatttagttttaaattgtgttgaaaatgttgtacaaatttcattaaactaaatttgaaaatatatttatttaaaaattttaaattgtagtcgaataattccatcccctttgtttttttacgagtgactttttttcacttgagaatagtgttctctcgcaagtatgagaaaggggcaacatagtcattttgaaaaaaaaagatgaactaatataataggtatagaagggattaaaatgagaactcaaaggcatgcataaggatgagacaaaatttagagatatagaagaaattgagacaaaactccgggacacaaaaatttctcagaagaaagttggtgagagtgagactagtctccttttagcttggggcactagggtgcaacctgatgggtgtccagtgctcc

SEQ ID NO: 20869 - DNA, 1501 bp, Oryza sativa
actaatgattgcaatgtgtttcgacgacaggttcaatcggccatagatgaaggacgattgaagttcaccgatggctctaagatgaagcttgatcatgatccttttccagtgaatacgattaatttcaatgataagaaggtgttgatccggccggagcaagccgaatctactaagggaaaaggagtggtcattggcgagccaagacctaagatgatagtgccaaagaagccggagattggcgtttggaaggagaataagagtgaagcttcaacttctaaagcccctaggaagaccaaagtgacttttgatatgcttttggagaagtatgagaagcaaggtggtgagaaggctcacaacaaaggaaaaagaccaagatcacctcctagggagtgatttggtcattcaccgagacgatcgcattcacctccatatcatcatctacaagacatgtcatggggttcttattcaatgccgccaccgggttatccttatccttattatataccatggggggcaacaccgccaatgttcaaccatatgcctccaatgcaattcaaccaagggtggggaggaccaagaaggccaattcatgagcgtttgtcttcaccacacaatggccggttttatggtaggaaccgggccaatgaagaaaagagggaaggaaagcgcatcaaggtggaggcaaggacttcggaagtaattaccatcaaagtggggtttcatgatgtgccaataccttctagagatgatgttggagagtcctcaagcaaaaggtccgaagccggtaccagctcatcgcagtcggccggtctgaccaggccttctggccggtctgaccgcagccatacggccggtctgaccgggccatcaggccggtctgaccaccgacccgatagcggtccaaccgacgcctcaggccggtctaaccgtgcgccaaatgtcggtctgaccggcgcatctggccagtttgaccggtggtatacgtccggcctgaccgggctccagcgccggtttgataggaggtttgcaaagggcgatattggattcatcgtcttcaagcaaggttaatagaggacattatttatctcctggaacagagccgaatcctaggtggatgcctaaggatttgacggctactcaaaagagaaggttgcaacgtcttcgggctcaagaaatgggggcttttaactatttgccacttttagatttggcaaataactatttgccacccctatctcaatgacatgtgggtccacatgtatctatgacatgtgggtccagtggcaaaaagttaattgccacatctaaatgtggcaaatggttaaatatctccaagaaatgagagagaaaaaggccgaagaacaaagagataagaggtttaatgagttgcgaccaccaccggtatggaggcgtaagtccgtagagaaggaaaaatcggttgttgtagaggagaaggaggaataatcggttaataaaggtgaatcatctccaaaagaagata

SEQ ID NO: 20870 - DNA, 1501 bp, Oryza sativa
aatacgcatcaacatatgtctgaatatgattactttagaatggataataagacagtaaagcacaaagatcagtggtacagcttaacattaagcaagaggattcagatcaccagtatactggtgctttcttatcattgacactaacagattgctattatgcaggaacctgaccagagaagggcagaaacaaggaattgcatgggaagaaagtagatttatataaggggagtgccatagtacatactagttacaaggaagttttaacatgttttcctcgcctaacatcttttccacttggccattaggattaaaattgaatggtgagagaagtatatataaagtgtgtattacagggacacagtcataaccaaaaacctaactgctcttgcgagtacaagtgcatgcatgattcaagtgttctataaaatccctagcaactgtaacacttcatatattaaacaagcaacgagcagcaaaggaaaaacatcacaataaaatttgacatcaagagttcatcaaattcagaactagcatgatatgtcaaaggagcacacattatagcttcaaagcgatcttgttaaatataaattaatataatggtcattgttgaattctaagttactcaactacaaaattctaaattcctatagagttcatcatttattttatttatttatttatttattttaattttattttattttttttgggggggggggggggaactataggagaaagtgacatacccaagtaatcttcaatgtctgccttcaaaatgcgcccatcaggaccagttccctttacactcgacagtggaacctgttttaggcagcacaatccttgtgttcattaagtatgttacaacaacagttggcaagtaacaacctagacagctaacatcagaaaacttacattgttatcttccgccaattttctagcaagagggctggagaatattcgatctcctgaccgcgaaggttcttcagtccttggggcctttagctcagatgctttggaaggctctctttcctccacctttggttctgtaggctcagactgagccttcagttcagaaggggctacaggtgcagccaaagttgaaggtttataatccttaaacttcttgatgtcaccctcttcttccacggttacagcaataatctaaaatgaatagcatggacataattcaaccaagattatgtcagcgaaacttaaagactgaggtatttgtaataactgtattagtaaacagaggataataaatgattgttcaaatatgtacctcaccaactttgatctctttggaaccatctccatgaatgatcttagcaagatagccctcttccatgcactccatttctacggtggctttatcctagtcagcagaaatgcattcaaaggatatttagattctcttgcagcttaaataaaagaaaataattgagcaccactaaaaataagtactaactaagatattgctgccttagagatcagaaaactt

SEQ ID NO: 20871 - DNA, 1501 bp, Oryza sativa
gaagcaccgcattggtgatgcccttatcgatatcggaaacatcccgaaccgggacagttggtgcgtgtgtcaagtttggagttttaacagaatcttgtcagttcgtataacgaacttcctgagcggatacgtgttggtggaatatttggaccatctcggtgcgttcccacgtacagttagctcctctgctaattgtatggacagtttgccaataccatcgagcaacaacagaggtaacaggccgcctggttacgcatgggctcagttgacccataatttaatttgttattatttttcccttttcaaacaaaactcttgtggatatttatgtttggtgcattattttttctataagtaatctaatgaccccacataaaattattactaccttaattgtttggaacttactccgctactaccattttaataattgtaagggtgagtgtcaaaattctttccatgcaccatttgactaaaaggcgctaattaattataattataattgttcgggagtgttattaaagttttctttgaggtggcactcacttcaagtgaattggtgtaataattagctgtagctcgttaagcaaaagtcaggatgatattctattacaagcaaaagtatggatgatattctattacattatctaaaaattgactaaaaggcgatagtcttttcacccatactatatcatttcagtgataacaacaccacaacactgccacacgctcctaattagtactccttccgtcctgttttaagtgcaaccatgagttttcgtatccaattttgatcgtctgtctaatttgaaaatttttttaattagtatttttgttgttatgagatgataaaatatgaataacaatttatacgtgatttatatttttaattttttttcaaaaaatttttaaataaggtgaacgattaactagttgagtacggaaaagcatgactgtacttaaaatgggacggatggagtatatattcttactctacagactgtattactgtacgtctgtaccctttatttacagatgcatgcatctagcatggctgcatggggaccatgtccactaattagtccatgcaatgcaatgccccagttcactgcaccagtaagatatacgggcaggtactatatactatacgctacaaatggtcaccaatttgctcacgtgtgcttttttgtctgaccttaattgtcactgtgcatgtgatgaaaggcaagcatgagtccaattttatgtcacgatttgaagcagttacgttgcagccttttttcacatggaatccactaccaactgatcggtcgagttcacacactgcattgcaaggcatggatgtgatcgagttgaagtattgaactcgcgatcgatcgcgcgcgagagctatgtttttgcaggttcgttcgcatcatcatcaatggctagtttgctcggacatccagaggagctcctctaggtagtcggcgccgaggtcctccagctcgaggacgatctg

SEQ ID NO: 20872 - DNA, 1501 bp, Oryza sativa
taggacttacatatgtaattttgagacttacattgtaaatacactaaaattacatatgtaatttagggacttacaatgtaaacacatgccgactattttttaataaaaaatatggcgtcataaatatagctactccccaaaaatttttgattctactcaaagtttgactctaaattgacatcaaaccaaatacaattgcaccctactttaaaaaagtagtaatgctaaatcttagcactaccaatattggtatggtactgaactaaacaagctcatcatgctttaagagcattgatacacgtatcattacatacatgtatatacatgcatataaagttataaaatataatcggccacaggtgttaaacctagaattttgaacttcttttccacctaatggaattggatataataataagtacacatgcttcttgagctttcagaaaactttctacatatagttttctcaaaatattattctatatcctttctttaactttatactaaatacttcattttgtcgtgcccttgaatcattttattcagcattgcattttatttccttcagcccagaagaacacacccaagtgtcaacgaatgcacaaccacattttctttacgtttttcttaccgtgcacgtgcgatctaaccaatgagaaaaatcacagtatcaactaattgcacgtcactatcatttacgtgccaggtgacagagctagtagtataatttttttttacgtggatgagagggctcgtaaatttgtaatacagcatttccctttctaacttatctaattctttacatcgctccgtcgtcccaattcatacaccgcacacaccttacctactacactcacatctgttccaaaactggacaaaattatttgataattacacccggggaaatcaaatctcatacttatctttagaagtattataattaatcattcttactacttaattttcgtgctgtatgagtgaatccatccagatagggatcgaatggtcagcgttcagtatcagtgaatccctccagatagggatcgaatggtgtcaagtgccatggattaaatcgggttcgttaattaattaattttcgtgctgtgctaattttgagatgaacggaacataataaatgcataatactccacagcctatctgcagtgtcacgctaccgagaatcaatgaatcttattttacaagctcacgaaacgtattgattttgtttattgacgcacaggcatacacaactagcaacaataacgctccctctatttttgcaatattcaactacagtttgtctgcctccgtttttttgggggaaagattctaactatataatgatgaatatgacttttccaacttgtgaagcatatatagttttccattaatatttttcgtactacccattccggtgttcttttgggctgaatgattaattcgatggaagatttgtacaaaagttattcaatagcacaaatgaataaatcaatcattttaa

SEQ ID NO: 20873 - DNA, 1501 bp, Oryza sativa
tctctagctctgcccctgctatccgagaaaagtattcttgttaaactcttcttgatcatggagcaacctctttttgagctgtccgctccttgaggcgaattctatgagccatctccttcatcggagcccatatatacaactggctatgaaattcgccccgagctaatcaatatggttaaggaaaatcctttttctaactttgatccagaaaatccctaccatcatctccgagactttgagcaagtctgctcatgccttaagattcgtggcatgagacaagaaactgtgcggcggaaattgtttccattctctcttccagaaagggcaaagcaatggtacacctctaccgttggatgtgtaaacggtagttgggaaaagttgcaagacagattctgtcttgccttcttcccagttactcgtatcactgcccttcgagtagaaattctcagttttaagcagatcaaaaacgaattaatcggtgcagcttggtccagattcactaatttagtgcagtccggaccaaccctgtccttcctcgagtatgtgctactacagcatttccatatgggtctagataaggagtctgcattttatctggacataaccgccagaggatcgttcatgcacaaaatgccgtcggaaggaagaacaattttggatcaaattctagaaaatacttccttcatgacgcaatccgatgaaccccagacagaggcatctgtgtcaaagatagaggaacctctaacgattgagccactctctgaaccatccacttttgctagcttgattgatgagaaggttcctgagcagccgtccgtcgaggatgaagaaattcagactccggatcatgccgcaattctgtttagggatggttttgacgaagattatggcaataccctgaactatttcagtaagaataaaccactcattcctttgtcgcctctcgatcctatggaacttggcttcttaagggaaactgttcgggagctaacatccataatgagcgatgaatggctaagggaggtatagctttcatccgaagtaattcgggtaaataccgctccccgaatcattcgctgccatctggaagggaacgacgtcggtattctctacagcccgatcgtcgaggtcaatctcatttctgagtcttttgcattcgcttatctaagcgataaggcaataaccccaacgaacaaattcttcaagcatccgaacgggaatatcattgaaggatttgggattgtacaagatgtgcatgtctgctttgaagatagggaggcgatcttggatttccacgtctttggaattcaagactttgacatcctaatcgggctacccattgagcagcttcttattaacacaccccgattagacagcctcaaaataactctaggaggaaatgaattttcagttccattctcacgggcaaggatcgccctaaccgaccctctcccagaaattgagtcagcagaggaggttaccgcagttccccctcacaagt

SEQ ID NO: 20874 - DNA, 1501 bp, Oryza sativa
gatgttttatgtaatttccttagagatacgtttgggaaaaagtctgtcgcaaaaacttatggtatcttagagtttgttagagatagcagttgtgtccgttatggacatatcttgtaattctcgggtataaatagacccgagccctatgtaatttttaacacacacgtccaatataatttcggcgcatcgccactctttttcctttagttttgtttcgacaagttcttgctttcgggttgagccgcattggtttcgatcttcaacaagaggtaaaacttgttatgacgacttgtgttctcgggattagggcttccatctttatgacactctgatctcgtttatgtaattcattgagttatcttatatcttacataatccctggcaatatcgttatctaatctacaatcgactaacatctgtcggtagagggcagccgattaggttagatatcgatgttgatttagattatataagatatctacaactctatgaaacttccagcggcttgattgtctagatattgttcttcttttcatacttaatgctgcatcagttgagtttgatctattaagttgtacttagaatatcaatctctagcctgttttctggttgccgattagggtagcatcggagtttcagccgatcttatttgacttaactacatttgctttatatgcttcattgacttgttaaatctgcccttttacgtcaaaatattgttgtatttaagtatattagacctttgtttgatatattatacttgttttaatatcatgatatagagtagtatcggagtattagccgatacatgttagatctatctgatcggctatgctataaacatatatagtcctgttattaatatatattttgatctaagtgatttatattgtctcggcacagcgaccgatctatcccaatcacttgatttaagtatatatcgatgtaagaattatatattggagatatctacagccgatcgaatagatttagtttttttattgtttatttacaactgccgatcgattcacacatgacatctgctcaaagataaatgatacgtcatcggcacctagccgatcggctatcatttatagatttaaccgcggtttctttgcttctatttcttgttgattacaggatcaaatcaactagcatgctagcatacccgaaggcgagctttggacctgcactggagttaagcagatctcccaggcctcgtgttttctgtcaacagctgcgcgccttcgtcgacgcccgcaaccgcgagtagttcctgccgagcaaccggtctttccacaatctcggtacgtgttcaatatgttgcgcatatttgatctgttcatgttatactgtgtagtttacatatatagatctaatgatgcgttcatgctagtttacatctgcaatgtcatgatttgtttatggaataaattaaatcattatgtgcttataatttcaacaatccaaaaaccttattataggccctgtggttttacta

SEQ ID NO: 20875 - DNA, 1501 bp, Oryza sativa
catcaacaatcacaagacaatgactattaccaccaatgctcttataggttgttaggccaaacaaatccatatgcaagagctccaatggtctagatatggacatgatactcttagtaggataagagcatgcaacttgcttgccggcttgactagcactacaaagcttatccttctcaaacttcacatctttcaagcccacaactagatcacgttttgaaagtttgctcaattgattcatgccaacatgggctagcctcctatgccaaagccaacccaatgatgtttttgcaactaaacaagttttcaaatttgcttcactagaattgaaatcaaccaaataaagatttccatatcaaaaacctttgaacacacaagacttgtcatgaagactagaaataataacctcttgggggaagaaagcacatgactagccaagatcacaaatttgagcaaccgaaagcaaattgaaatttagatattcaacaagagagacattttcaattcacaaatcattggaaatagcaattttacctaacccaattacctttccgttgctattgtctccaaatgtcactttctcttgttctttccctcttacttccaatgtggtgaacatagccctatcaccagtcatgtgttgagtgcatccactattaagcacccaatagctcccaccggtgtggtagttcacctacaaaagaagatcaaactcttttaggtacccaaacttgtttgggtccttggaggttagagaccaaagctttgggcacccaaatggcattctttttaccaccaagtataggggaacccacatatctagcaacaatactaccatcatgagtcttcctaaacatataatgagaatcaaacatgcatgtcttagaaggcttaccaccggggccatcattcatcaaatgcccaacctcacgacacttggagcaatacttaccattgctcttgacaaaacgagtggcatggtgagaaggtttcttacccttctttgaaatgaatccaagtccctccttgttaaggatgcaccattgttcactcaaaatcttgtcaagagtgttcttatccttgaagcatctctccaaactcttgttgagcttggccacttgctccttaagctcattgttctcaacaacaagtgagacatcacaaatagaaacacaagacctagagctaggcatatctataagatcatcacaagaggtagaaatgctagatgatgcaacatgaggaatatgacaagaagcactatcatcaagcaaatcacaagatatgccaacatcaatgtgagctccatgttgagtagtggaaagaaggttgtcatgagctttcttaagcttctcatgagaaatgtggaaagcaatgcacttgactcttggctataacaacctcaaccactacaatggatgaacactaagctcaaatgtgtgtgagagaggtgcaaggggtgtatacaattgaattgggtgccaagagtatttatactcccacc

SEQ ID NO: 20876 - DNA, 1501 bp, Oryza sativa
aaaactgtgatagtcaaatgctatttctatttcttgctgcggtttgtatttgaatttagaaaaataattttgaaattttaagttatattttttttttcacatatgacatttagagactccaaatacaataattattttcatgttcaaaaactattttgaaattactttgaatttagtcaaaactctctcacttttttttgacaagaagggtcctattttttttaacagatgatgttgcatatatggtagaattaacatgtataattaaatttggaagtataatatatctaccgttacttccctttccggaattacatcattaatgaaatgatctcatatgtttttatttaacaaaacaattatcaataatcaacggttgggatttctttgagctcttaccccatatggaagtaagtggagcaacatgaaagggctcaataataaataaacataaaagaacacatttggattatttatcgtttccttgtctgttcatggacacaaacaatgatttatgaaacaagtccaactaaattttgtacaagaaaaaccatcagagaggtggaagaggaagacacctgcagagcacatgacgacgtgctcttgctgttggcattggccaatggaatgttggtcttcagtttcccgttttgatgtttctagaggtcacgcgacaatttaaaaatgaacaaaatttttgcaagcgttgtcatctgaaaaaacaaaaaaaaaaaggttgctcatttgttcataaataaatgcaaaggtttacactcgatccattcatcaaggggccaatgtgcctaacatgattactgaacaataactccacactaaaaacacagcctgacaattgggccatgtttagttcacaccaaacttccccccaattttcaacttttcatcacatcacatcacatccaaaactttcctacacacataaactcccaacttttttttcaaactaccaacttttctcaaacttgaacccaattttagaaactaaacacagccttcatcccgagtgtataaaaaggaagtgaaaagactacacgatgagtatgaaacaaagatcaatctaggtgtgttgtgcaagcatggatcagagttcccacaaattaaattgttgtgtgcgtctatagttgatgcagagggcatagtttaaagaaatcagagtgctatgagaatgagaggtgtggctgtgtacaaaaatgagaatgagaggtataaatgtgggtcaagggaatgagaggtatccaggaagcaagtcagaagcagtagacgccacactgatcgaagatggatgaagacaccggcataagaatcacacggtctgccacaagcatagctgcagtaggtgctttgacctgcaaatattctagatgatgtatttggtgaacaaggcggccgagtggtataagcgaagaaaaaaagttatgttgcactttgatttcggattgagtcattagtttgaaaaacgcttggagttttcaaagggtat

SEQ ID NO: 20877 - DNA, 1501 bp, Oryza sativa
catctaacaaagcaggctcatcacgtgtaagataaatttccacatcactgaatacagatttattttttttcaaagtactctgatagattaaaaaattgagtatatacatatttttactgttgagttaaaaaagatttgttcaaatgaaagtttcaaataaaaatctacatatgaaaacatgatttaatttaaatatgtatgttctctcctcagaaaaaaataatttatatggtgcaatcatttgtattactgtttataacttgtaaccatggattaagccttctccagacagtattttcttatctgttccagctgaattttgtgtggcatttatatggtgaacatatgtaggccgaattaaccaggtgagcatcacaaatagatccatcttctcaaaacgttaagataattaaacaagttgcacatcaaaaggagagaaaagaagctgtaccatttttgggtaaatgcaagagctaccgtgcgtgcaggtcggagcaaccactgctgctaagtgtgaggcaggattcaatcacattaattgttgtctagctctcaccaaatgtccatcatcagatagagcatctttaatctagacattttctcgatctctttggcttggagttcctctcacttattttctcgatgcctctcattctcagatcttaactgaatacccccaatctcactcttatggtactatgatgcttgcacaattactcgattaatcatgtttcacccccatagttgtccaatctttcatgatttcctttcataggaccaaggtcaatagtgtggtaggggagagtttgatggttgtatgtttactgtagtatggagctgttgctcagttatcgtgttaggtcccatgttgaatgaactgaatgtggaccttggtatttatgcacgtcaggaaaacggtgttcgcatgaaaagtatgaaaaatttgttgttttgggataaattacggcttaatcttcacaaacatcaaaatgggaaaaatagataactcgctgttgtcgaatcaactgactaaaacagtgtttacattatgttttagtcagtaagaaatctcccacatgcgtacgtgcttctgtggaaataactaaattctagggaaattcatgttagtgttgaaggaccagattggttaattagtcatgtggaatgtctgtgctcaatttcagtttttgaatataaaaaaagagggtaaattttggaagaacagaacaaattaatatccattaaaactgagtttttcggtttcgaagttatgagtattaacaaaaatttcagttatgagtattaacaaaattttcagttagccaaagcctttaaaactgaatttttcggttttgaaggtaaaatcattgtttgttgggaaatttgatcaagtaccattaatttgaccaaaaattaaggattttcaatatctatttcaaaagcatgtgggggtaatttgaagtcacttacatgtctgaggatggtaatatcaatttatcta

SEQ ID NO: 20878 - DNA, 1501 bp, Oryza sativa
acatataccttttatagttgtaaacaaaatattttaattttattgataatcaaagtttcaaaagtttgataaagagagtcaaacatcatttttttatcctttttctttcctcaagctataggtccttgtgtcaatttctattttgatctgcatagccataggttaaccctttaacctatgtatgctgcaatcgtttatattactgtttatattaacttgtaattaaccatggtaaagccttacccaaacaatgttttttttcctctgcaacacctgaatttctgtggcatttctacggtgaacatatatagaccgaattaaccaggtgagcaacacaagtggattcatcttctcgaaacattaggatggataacaacaagaagaggtatcatcttacatttcctatcaccatccatcctgttttcgagcaaaatacatcgttacagtgtgtgtgcggtaaaaaaaaaaaaccgctgctgccaggtgtgttctcaccaaatgttcatcaaaactgagatcgtctgcaatgcggaaacttagatgatcggtgtcggttcgagctcccctcgcttgttttctcgatgcctatcattctcaaatctcaaatctgaatgatacctctcactcttatggcagtctgatgcttgcacaactactcaattaatcatgtttatattaacttgtaattaaccatggtaaagccttacccaaacagtgtttttttcctctgcactacctgaatttcagtggcatttctatggtgaacatatatagactgaattaaccaggtgagcaagtgagcaacacaagtggattcatcttcttgaatcattaggatggatagcaacaagaggaggtatcatcttacatttcctatcactatccatcctattttccagcaaaatacatcgttacagtgtgtgtgcggtacaaaaaaaaaacccgctgctgccaggtgtgttctcaccaaatgttcatcaagactgagatcatgtacaatgcggaaacttggatgatcggtgtcggttcgagctcccctcgcttgttttctcgatgcctatcattctcaaatctcaaatctgaatgatacctctcacacttacggcagtctgatgcttgcacaactactcaattaatcatgtaccatccccatcgtcttgccgatctttcttgtttcccttttataggacaaccatgaatcatcttgcagtggagattttgataggtgtatgcgtttacaatagtatggagttattgttcagttaacttgtttggtcccatcttcaatgaacaaagtttaaaccttgacatttatgcacgttaggaaagcattgttcaaatgagatatgaaaattttgttattctcagaaagaaaaatatatgacttaatcttcacaaagatcgaaatgaaaaatatagctaactcattgccgtcgaatcaactgactaggtttttggtagacattatttatattattcttttagtccgtaagaaatctcc

SEQ ID NO: 20879 - DNA, 1501 bp, Oryza sativa
aaaaggttttggtgcatacaaatcacctacaccatcgctttgcttggtattgcaaaatatcaacattgtttgaagctaatttctttagtttttgcaagtttcattattttcttgaaacaataattgtttaaaataagactataattatataaatttaattagtatgggtagtttacttataaattttgaagtgttttgaagtaaagtttttctatcatgtagtctggttatatcaataatatagttttgttcaataaattcaatattatttacatcaccagaattaataaaaatttatgaaaccatccatgactacttaaaattttggtttgtctgatttgtttatttcaaatttagataatcacatattctccttctaatcggtgtgtttgtcattattcataataaaaaaaaacactccttgtacagctgacacatcatattgtcactcaatcacatacaaacgtaaaatatttgtcattattctcggaccgctcattcctcattggtatcttccactcatccatcatcttataatagaagtatacaccatattttgtctaactatttagtttacataagggacaacaccacgctcctcctccctcatgcatgggacacagtgtccaattttttttccaaagcaagtttttaattaacacatgtaattagaatattacatgtgtaatatatgtgtatgtgacacatggtaatttttattctagcttcgccctgcttatatactgtatagagagattaattatattcaacctgcagtgcttgattcttcttctttctacattgcatcttcgcgatttgttttcatgttattaaaaaaaccaatcgttgcccattgatgatttgacacgttttcattttagcgaagcaatagcgctataacatcatgatcaccttagctaccttaggtatacgatgcttcgtcatgcgtgtaaaaggtaaagacgtcaatgtgttgtatagagagacaaagaggacttccgaggctagatctcatggtctaaataatatgtccaccggtttaactaaaaatcgataaacaaatatttttattaggaaatagtctaaaataattggtacataatatcatataatggtgttaactctatttttaaatattgtagatctaatttatttacatctaattgtaaagagttatatgttgacattcaatgttagtaaagcaactattatgtaaagtttattatcatgaataataataattatagtggctcaactaaatacatggaaaaatggaaagggaaaaagaggaaggtcctcctgagtggaaggaaaggagggtacgtagggagagaagaggtggaatcgtagtttaatctaacggcttataatattggacccaccaatttatgtggaaattaagggatatatgttttgttttttttctcaaattttgtagcatttggtaacttgagagcgttttgaggaactttaatggacatacgttgtatcgtttggttga

SEQ ID NO: 20880 - DNA, 1501 bp, Oryza sativa
acatataccttttatagttgtaaacaaaatattttaattttattgataatcaaagtttcaaaagtttgataaagagagtcaaacatcatttttttatcctttttctttcctcaagctataggtccttgtgtcaatttctattttgatctgcatagccataggttaaccctttaacctatgtatgctgcaatcgtttatattactgtttatattaacttgtaattaaccatggtaaagccttacccaaacaatgttttttttcctctgcaacacctgaatttctgtggcatttctacggtgaacatatatagaccgaattaaccaggtgagcaacacaagtggattcatcttctcgaaacattaggatggataacaacaagaagaggtatcatcttacatttcctatcaccatccatcctgttttcgagcaaaatacatcgttacagtgtgtgtgcggtaaaaaaaaaaaaccgctcctgccaggtgtgttctcaccgattgttcatcaaaagtgagatcgtgtgcaatgcggaaacttagatgatcggtgtcggttcgagctcccctcgcttgttttctcgatgcctatcattctcaaatctcaaatctgaatgatacctctcactcttatggcagtctgatgcttgcacaactactcaattaatcatgtttatattaacttgtaattaaccatggtaaagccttacccaaacagtgtttttttcctctgcactacctgaatttcagtggcatttctatggtgaacatatatagactgaattaaccaggtgagcaagtgagcaacacaagtggattcatcttcttgaatcattaggatggatagcaacaagaggaggtatcatcttacatttcctatcactatccatcctattttccagcaaaatacatcgttacagtgtgtgtgcggtacaaaaaaaaaacccgctgctgccaggtgtgttctcaccaaatgttcatcaagactgagatcatgtacaatgcggaaacttggatgatcggtgtcggttcgagctcccctcgcttgttttctcgatgcctatcattctcaaatctcaaatctgaatgatacctctcacacttacggcagtctgatgcttgcacaactactcaattaatcatgtaccatccccatcgtcttgccgatctttcttgtttcccttttataggacaaccatgaatcatcttgcagtggagattttgataggtgtatgcgtttacaatagtatggagttattgttcagttaacttgtttggtcccatcttcaatgaacaaagtttaaaccttgacatttatgcacgttaggaaagcattgttcaaatgagatatgaaaattttgttattctcagaaagaaaaatatatgacttaatcttcacaaagatcgaaatgaaaaatatagctaactcattgccgtcgaatcaactgactaggtttttggtagacattatttatattattcttttagtccgtaagaaatctcc

SEQ ID NO: 20881 - DNA, 450 bp, Oryza sativa
ccatgcccgacccgatgcccgacattgcccgctcaaaccctacccactagagttagcgggcaaaactccgtgcccgtacccatgtctggcgggtgcgggtatgtctgacgggtacccaatggatctcgcatgaataataacttgaaagatatgtaatttaacaaagagaaataaaattaataatttaccaaattattggttatcaacaataatttgaattacatcacaacttagtatcagttagcatcacaaatgaaccgagagaaatggtataagaattaagaaatgagtcaaaattagctaatacatatgtatcaggtcgggcatggattacccacgggtaaaaaaatgaaacccgcctattgcccataacgtcttcgggtctcggacggacgtgcccatggataaaaaatcattaccacgcccatgcttatcgggtacccgaaccca

SEQ ID NO: 20882 - DNA, 250 bp, Oryza sativa
agatgtcgactagagggggaggtgaataggcgatttaaaaaataaatgacacctaatcaaaactaacctaagttgctaggcttggtgagggagtctaactaagcaactaagttatgttttgcaaacctagggtgagtggctcaattatatctctaggaaattaaatcatactcctatgtcaatgtttagtaatcctagggtgatatgatctcaagtatgtctctaggaatgtaaattgcataaatgtaaa

SEQ ID NO: 20883 - DNA, 830 bp, Oryza sativa
cccccccccccccccccgcgtcgggcaccggccaggagcattttcaaaaaaaaaagcacggcaaataaagtttctatatatctctttatctcaatctaatctacatctctatctctatctttctctactactttcataaaaaaacatccgacttccgtaaaaaaaggaaaaaaaagaatcaccaataaaagaaaacgaaaaaaagtccgactccgtaaaaaggaaaaaaaattctcacgctcgactccgtaaataaagggaaaaaatgtctcatacgtaaaaaagaaaatttctgactcccgtacaaaaggggaaaaacacttgtctgtacaaaaaaaataacatccgatttctatggaaagtttttttaaaaaaagtatcatcagtaaagaaaaaaaaagtccgactcccgcggaaaagaaaaaaaatacttctcacgtccgactcccgtaaataaaggaaaaaagtctcatccgtaaaaaaaacaagtctgactcccaaaaaaaaaaggaagaaaaacgtcttgtcaaaaaaaagaaaaattgtccgacccaaaatcaagaaaaacgcagtttataaaaaaaaatcccgtttataaaagaaaccgttcgaaaaaaaccactcgactcaacaagagaaaaaacatagtttacaaaaaatgttttaaaagaatattcgactcaatgcgagataaaaaaaaccgctccaaaataaaccgtcagaaaaaaaaacattgtttttttaaaaaaaagatccaagaaaccatccgaattcatgcgagaaaaaaagatataaaaaattgtctgactccacgcgagaaaaagccgcca

SEQ ID NO: 20884 - DNA, 1501 bp, Oryza sativa
tgtaattttgataaaaatattgtgtaagtaaatatgtacttattattttctttaaaatataaaattacagtcctatataactaaaattacatttgtaaatttagttgatttgacatgtaagtgcactgtattttttataaaaataatgtgtaagtaaatatgtacttattattttctttaaaatataaaattacattcttatataactaaaattacatatgtaaatttagttgatatgacatgtaagtacactgtgattttgataaaaatgtcgtgtaagtaaatttgtattagatattttattttctagtatgttggacgtaaatccaagggaagaaaaaatctgggtgaacccgagtgatgcataggcggtccctgaacaaagtgaacttaattcttttgctatttcgcagggacaggctcatcttaattgggcctgcacattgttgagccggatgctaatggacggcccagcttataaacccaagaaacgggccaccaattttgctcgtgtgctgagctgaaaggcacacatgaattctcacatgaggcagcacagatgatcgcggtattgctgattgctaatccctccttgctttccggggagctgtctcggccatctccaatccaccggaattgagggggggaaaccaccaagggtcgccgcaaccgccacggcgcgtggcgagaggaacacgacgccgtccatcgtttagccccgcgggcacgcgcgtcctcgcgctcgactgcatgtatgaagccaaaacaactctcgccacttgtgccaaaaagccctgcgtcctacaggcacttagcccttgttttcctcctgcttctaggcacaaaagcacgaaatctgccgtcacctgagttcatccgtgcatactgcccctgatgcaactccccctgaccccctctataaattggctaagctactgctagtcgatagtacattgagcttgcgatcgacgtatatatatgttggtgtacttgtgcagggtggagaagcagggcacgtgagcggccatccagtgtagcttcgctgcgcgtccatggcggcgaacgcgcgtgatctggagtttggatggtcgttcatgtgtccgtcttctccaccgagcactggcatatccaagaccgagacagcgagactccgagagacattggtcgagcgagcgcgcgcggcaccgtatcctgcactgtctatgagttgacaacacagacagctgtgctttgactgtctatattcataacactgatctactacaagaaagtgtcatatcttatagtactatgttagtttattttaagatactgttacattttattttaaattggtatatctcatattaggttgatttattttgagagacgattacatcctattctggttggtttattttaggatagtactgtaataatatatcaatatctcatattaaattaatttattttaagactgttacataaaatttttgattgatttatttaagtacagagcggg

SEQ ID NO: 20885 - DNA, 1501 bp, Oryza sativa
gctaaattttggtgctcgaatggaggtgtccttgcgaggttttgggggatttcgtgtgggggcgtcgcacgttcggtttgcgtttcccccgtctagggtttggggtttggtggattcgtcgtcggtgtgatcgcatttagtggctctagctgctgttggtggtaattttagttctcatattatggattggtcatgtcaaaaccctagatgagttccctggaacccgttagctcacctcatgggtttgttcttcgtcgtgctggacaccctcctttgctcttgttctaaaaactaaggcatgcatgacgatccttgttgcggtggtactgttttatatatgcttatggttaatggtgagcctattagtaaggtgaaacagcggatacgaacatgtcagttgaaaaagcattcatgtttttatttcctaccctatttaagaacacacgtttgatcaaaggcgctaactgttgccttttaggttgaaaacagggtactccaagccattgttgagcctcaagttttatgcatgtactatgtagttactcctctaatggccttcttattcaccatgagcattcatgaaacttattacattttctttactcctgtttagtgagcatgtagaattcatgccaaccggaaaatgtagcagattgatttgtccaaaagataaaaaatcgaacgacttcctgtgggattttattccagcataacctaaaatgtaactaatcagcatgacagatttatttatcaagcagatggatctgtacttccattatgtttgcttatttaccgcgaatattttggaactttagaataaccacagcctatccagaaaaataagaattaattaggttggtttaaaatgcatcaccatgcagcaatcggttgcaatttcatatctttatatttttttatgtgttatctttgatgttcccgcatgcattcagctgtagataaaacattgctacattcagttgcaaaatagggttcagctgtgaaataggacttttcaagaagtctgagagaagctgtccctttctttgttgagaaaataacatctgctgcagttaatatttcatctttctcaattcattaaactaactaatgtatatacagcgtattagctaggttaactaatcttgcaaatgacatagatttgctaggttaactaaaatgttaacaactcaaattcaacatgtgtgaagaaactagatttacgattttcgttatgaagcgaatgtctaaattcacacttgatacggtaatagtactattagtttgtaagcatggtttgtatgtttgttgaccacctagcataaacagcacaattaacagacaccaccctttcgagcttcagaaactacgtatgttctgtgctaacattatcaatagtcaagtctgatgtgttgatattgcctaatttgatctaaagtttgacctgctgattttatcactctaggcttatggtgagtgcacagtgagctacaagttaccatta

SEQ ID NO: 20886 - DNA, 1501 bp, Oryza sativa
tggcctattttcttaggcataccaaaatctggcttcaaaccaatatacactaaacactactaaaattaccaaatattgataagcctaatttagttctcaaaccaaaccagcccatcgtgccgttgaaagctgacctttcatgtaggagtagtaaactgactgcagatatgagagcaacgagacaccgcgatgcagtcatgcatgatgctcgccataccaagccaaagctttggaacggcagttcagttcacttcgctggacacactgaggccacgcactctgcatgcagactgcacaaagtcagacgttcaggttccattcggcaggtgtgtattcagtattccaggggcgccgaatccgtttgagtcgtgagcagcagatgtgttcttgcttcttgttcagatgacatgttggtttcctcaattatttagccttgaaaataatccgtaccaacactttcaaaatgttaatggtttcctttaatcctgaagtatatccttatctattaacagtttcagcgtgaaaatgattttacctttgtgtggcacatcaacaggataagtcataagtgataccattccaaaacattcgcttatcagggagccatggttctctgatcaagttgactgttcagtgcagctcattttataggggagagaccgaatagcataaaaagatgcctcgattagggaccaagaatatgccatggtcagctcgtaatgcttgcatctgtgataaagaacaattcagatgaagtcttgcctgatcagttgctgatcaactggtgaagattctcgtgaaagcggcgacaggaaagggagaaaacgaactgtcctgtccaggagtggcgacagggtatcaaagatcgatccagcgagcatccgaaactattccctctccctgctgggtttggaagtgatggttgtagctgaaacattccaagtgtaactattaaccacaaaaggtaaatagcagcagcagcagcttaacccagtgatatatagaacctgatactgttagcttggacattcttctatacaatctgcagcctacactggacgatcacaatttgcaacatcagaaaagttggcatgtagcacattatcagaatgttcctcagaaacatacgatcagaatatatgcccgaggaccgtaatattcatatcaataataagttaccagtaatgctaggaggatataagcagaaaaaggttgatttgcaagtaatgtatgattaatccaaattggcatgcgattctctctatcaattatgattcagataaagtactttagtactaggctgaaatttttgagaattctgaacatgtactatttagtggccggcgtgctcgtttctgaacttcaagcttcgcatacggagccaccgatgctgtagccgtacacggtacaaacaattcgatttgctcgtaccggttattaaagagatggaaaaaattggggcagacgaaatcaagaaagggggctgctatataacggaatc

SEQ ID NO: 20887 - DNA, 1492 bp, Oryza sativa
cgcagtagtgcgcggtcttgagcgcgaacacggcgctggagccacagccgcggagcagcaccttggcgaccacgcccgaggcgccgtcgccgaggttggcgatcttgtcgaagtccgtcagccgcagcagctgccccaaatccatcatcgtcgcctccggcgcggcggcggccgggcgcgccatcatctcgtgcggcgcggcgaagggggatgctgccgccgccaccgtcgccatgaggggtggatggatcgatggaagcgacgagatgaagaagcggagcttgcaatttatgggcgcaccgaccaagtcgagatggagctcgggaggcttacgctttgcttggcccgtacgcagttgtaaagagactcggagtcggattggcgggaacgagaaagcgcgggaaaaaaaatgggagtggcgggtaaagcgaaacctaacgccggtcaaaattcgaacgaaattgccatattagcgcacgcgcgctacttccgattccagcgaacacctccagataaggaagggaaagagctcatggtctccgtatatcgtgcggtcgccggtcaactcaaaatccaaaactttcaaatcaaaattcaaaacttactccagaatctgaaacttttaattccaaatttgaaaagctttcaactctaaattaattaggaaaaatactattaacattagcatcgggagagatggggacagagggtcgcagcctcgcagcgggtgtgacttgggaaagttgacgcagagctgcgccaactagcatccccaaattcaaaaggaaagttatgtgggggccagttgcatgcttccagccatcaaacagaaggtgcacatcatgacagaagtattaggccctatttagttcgcgaaaaggtgtcacatcgaatgtttgatcagatgtcggaaggggctttcggacatgaatgaaaaaactaatttcataactcgcctggaaaccacagacgaatcttttgagcctaattaagccgtcattagcacatgtgggttattgtagcacttatggctaatcatggactaattaggctcaaaagattcttctcgcgatttctatgcaaactgtgcaattagtttttgtttttatctatatttaatgctccacgcatatgtccaaatattcgatgtaacgtttttgggaaaaataatttaggaactaaaccagggcaccaggccttactttcgcagctattgacttctaaccatttcgatttatttaaaaatttagtaaaaaaaattaatgctttaaatacctttcataataaaatgcaagaaaataaataattcttaaaaatagtgaaacattatgttcaaaagaaaacaatatcatatatttaaaaatagaggttattttgttagtaaattactacaagatcagtaaccgcattgtgaaaaatttactccgctattagtcaaatctatagaacaatggaacaaaagttattctgaagagttgctgcaaagggattg

SEQ ID NO: 20888 - DNA, 1501 bp, Oryza sativa
ggcgacgcggagcgctctccagcgaccggagccccgcggtccccggtggggggttgggggcggaaccacgcgcggccgcgcagcgaaatccagcgcggaacagtgacgggggacggcggggaggaagaggggagaggactcacgcgtggcggccgccggcgaggagggcggcgaggtggaggccgggggcgcgtggctcccaggtagcaggaggaggccgcggtgggagagggaggaggaggaggaggtgagatttttgtggttgggtctcagtacggacgcggatggtgggcgtggcgcgtgcgttatttctgcctccgggacggagccacagcggcgtacgccgattctgcgagtgaataggaaaagtttggcatacatgacatgacaaatagtaatggtttttaagagagaaatttctagtgaggtggataaatcattttgacaactgcatcaagctcgagtatccatttcattcgccgccgaaaattgtacctcctcgccagcacgtcgagtattgccatgcagtcttgatcaatcaattttgatgtctcaccgcccacatcaactccaccagcaccaaccgcatcagtggcaacttcctcatcccggccatccttcatgtcgacactatcaacagcgtgatattgtctcctccgccgaagaggacgagcatcatcaccctacatctccagatcgttgcggatgagctccacggctctctgcacaccagcagtagcacgtcccatcggtgacgcctaaccccaccatgtttagcacgtcgcctagcactaaccgcaccaagccttcataagcgagcagctcaggaagcctcctccattggtgttcagcgaggggtagccagaataagaagagaagatggggaagaatgagctcaaaggcatttttgtcctagattatattatagtatatagccatatgttgagagtaatattttatcgaatccctttagtaaaatggcatttgggcaatacacacttttgacaaaatggcatgatctcaattttttcaatgggagagagacgatgaagagttgccgtatggggtttggattcaggctcgatgtagatggctcggccggggcaagcttggtggccccatatttaggtctacacacttttatttttcatagcatctaaaaaaccaagagcgttgttaaatttagttctcgacatggagaatattttcttttcaaaagattatctcttcatatccttgtgcactccaatagcatgggcaatacacaaaagtatcaactctcgactagtggtttcaacctctacttaggcaaaagcaattgaaaccactattaaagcaaccgtgtatttacaatgtacgtaggcatagcctaggcaagcctatgtaactttttttttaattttggcctcttttaattgtgcttcactcctataatttagaaaaacataaattatttacacatgtatcccaaattatacgaattgtacttcaatgggaagaa

SEQ ID NO: 20889 - DNA, 1501 bp, Oryza sativa
tatcgaattcacctcagaagtttgtcgccggtgaaatactattgcagcttcaagctaaccgatttagtgacgcatataatgcttctcactcatttcccgatggcctctcattcttgcccaaatacctctaattctaatggcgctctaacttactcaaggtaattctagcatatgccccaattttaatttgtggacagtctaatgcatgtacaacttcagaatttcacgaataatcttcattccatccttgttgtttgatctttcttgcttcccttttatacaaggatggattgtcaggcagtggaaagtttggtgggtttctattttcagtgagaagttattgttcagtaatcatgttatgcacttaggtcccatgttgaatgggattaaatgtgaatttttgcaatttatgcatatcagggaagctggaaaggggtgctcaaatgagaaaccatttttgcttcttcagaagatgacgccggtacaacttttgttattttgatgaaaatttgtggcatgaccttcagaaatatcagaatgggaaatttaggtcactgccaccaaatggttctctgctccacctggattctgtgtctggtacttgacaaatgatcattctgagtcgggtcgtcttgaatccggaagatcggttcatcggtgacctatcaagtgcctcccacttctctccggggactcctaactagcgcgtgctcgctgctagcgagcactcttcccctattaactacctctattaacactattacttaatatacttaactacctctattagttaatatacttaacactaaagatagtaattaggaaagattcaggagatgtttttactaatagattgaaaattttttaagttacatttgaaaattttcgatttaaattttaaagtcaaattttaaaaactttcaactcagatttgaaaactttcaactcaaattcgaaaactttcaactcgagattcgaaaactttcaagtccagatttgaaaaatttgaaaactttcaatttgagatttgaaaactttcaactcgagattcgaaaactttcaagtccagatttgaaaattttgaaaactttcaactcgagatttgtaaactttcaagtccagatttgaaaattttgaaaactttcaactcgagattcgaaaactttcaagtccagatttgaaaattttgaaaactttcaaatcgagatttgaaaactttcaagtcaagatttaaaaactttcaagttcaaatttaaaaattttcaactcaaaatttaaaactttcaaactcaaaatatgctaaagattaaaaaaataatcacaaaaaaaggaaaaagcgaaaaaaaatgggtaaaaaatgaaaaaaaaaaaaagagtgggaggcgcgcgcgccggcgctgggccttatgggccagaaatgcgcgcgcggcgcgcgccgattagcaatcgcgcttttctcctgactcctgactgcatctcattccaacatggcactctgatg

SEQ ID NO: 20890 - DNA, 1501 bp, Oryza sativa
caaacacggctgctcattttgattccggagagatatagctggcattgttctagtgactgcatccttgattggttctgtgatgatgtgataggactgcataatgctatcattcacaggagaagattccttctgattgctggttgaagcggatgacggtcttctgcttggtatcgccttccggaggttgattgcccttggctcggcctggagtaggtcggggagagacacaacttcttccatctacgacaattctttgctgaggctgtcgatgcagagagtggttgctatgatttattgccgagtcaggtgcagcaggaggagcattggtgcattgtttctgctataggttctgattatcacgaggccttacgggtacggcgtttgctccagtgaccacaatacgattggaatgtctgcttcgtgtaaattggcggtaatgtggaggtcgattttgccttggttggggacagttttcggagtaatgcccttcttcactgcagttgtaacaaacaataactttcttacactcgggttcttcatcttgtacttgatttctcagctgctgtattggaacctccaaaggtacaacgcagatactggcctctgtcttgtcagctggtggctggggctgaaattgagcattgacaccttgtggtagtgcattcattggaattggagctgttgcaacgcgggctataggactgcttcgggatgcatggatgacaattcgttgaggtgcaagcttctgattgcagggagttgcgtggactgacgtgccggcagctatgtttctcggttttgggcacttgtcggcgaaatgacccattccttgacaattgaagcaacagatgtcttcccggactcggcattttcttttctcatttcgattcctctgtcctggcactggagttaggctgaaactgtaatcttggcgaggattggtgttgccttgatgcttctctccgttggaactggcgggttggttagccatcttcttcgtcagcagaaaactgaattgacaatcttttggtacatgatcagttccttcacaaaagaaacaagtgatcctgctcgttggacacctgtcgggtggatggtcttcctcgcaatgaacgcatatagtggcacatgagctggcgacatgaccgatttctccacaacgagagcatgccttacgttccatttcatcttcatcatctgaggagacttgatctgaatcttcactatcagacactctacctccattagctaaaagatgctctgtcaactgtggtgcacctcggaaggtatttcttctctgacgtctggtcattcctggtggaggccattctgtgctagtaatgatcatcttacggacttcatcttcggttcgcattggtgtttttcttttctgctgaggacgctcccttgcatagtgcccttgctcctcacacataaagcaaatgttacttgcttcttttgggtcaacatgtggcacgtcaccatgggtccttcgggatgc

SEQ ID NO: 20891 - DNA, 1501 bp, Oryza sativa
cactacacctaaagctcaacacgtaattatggtatttattaatactcctaaagatcaacatgcaagcatgcaacatcaactcagtaagtactcaaagctcatatacaaatatattaattatgtttataattttatttcattctaaaactcaacatacatatgctaaatcatcattccctaatcattttcacaatattttacaaattcaagtaatttcatcatttctataatattttacatatatcccacgataaaaagcgagacaccatgaagtaaacctgacaactgcacctagattttggggcatttaacaatttgccacttttaaagaatcaccaacagtcctcatatttcatcccaaaaccaattctgagggatttagtagaaaaaaaacaatccaacagatctcctactctattgcatgatttttgaagttctcccgaaatattcgctctgttgatgtgggagaaagcggcgccctcgtccactcccaatctcgcctctaccaccttgctcccgcaccgtgcttgggagattggcgtggcttcagagggagcgcaagaggtagcgtgctaatggaaattctgttggtagtttaatagaatagcccatttttagcttttggggatacaatttaggttttctcctgaagagatcagttattttctttcctatcttcagtttagcaaaccaataataatttttttgggagattatacacagtttggtgatgctctcaagatgcggtaattaaggatttgtcactcacaatcaatgatatgatacatgatatgtggacgcttatgtgtctatgacatgtgagttcagtggtaaatttttaattatcacacaaattgcatcaacggtacaacaacttagcaggtgggtgcgatatattacaagaacttgagaattgaatgtccgagtgcaacaacttgataagtgggtgcgttctaatacaataacttgacaatttagtattttggtgtatcaacttggctaagcatatgctaggcgagttttttttcacgatgtcaatatgcaattacatagtaatcctacagatattaccttagacattgaatttaatcttgaagaattatactgcacacagagtttacatccaattaccttaagatttttttcttcaccttctcaaatatcaaccgaaatataatttacatccagtttaattgacttttagttattagttattagaataaaaatataaatatgcttatacaaatccacgctagtatattgtaaaaataattacttaaaaattgaatctatataaaaaatgctccaaataattaagttgtcgctataacttcttagtttattgtatgaaaatcgtacatatcttgcaagttgttacatttatatgattacttataaagattttatattaaattatatttgtctaccaaattgttgtactagaacgctcacctgctaaggtgatgcaccatgggtgcaatttacttcctagatttctcac

SEQ ID NO: 20892 - DNA, 1501 bp, Oryza sativa
taaccttggaacagtgaatgtttcatcctctaaagaaagtttggagtgcctaatcttttggattctaccagttctctttgacgatttttgacttctcaaatatgaacttcccttccttgtacttctgtgtttcctcataggctctctcgtacttccagcccaacacctcccggcaatcattgcaatagatatcagcaacagtgtgaagccccgtcataagttgcctgtcctccttcgcgcccacaacaacattcatggcatgagagaacagaaaggcacggccattcctcccctaaaataaccaaaataacggtaagtagaaggcatcagccttcaagcatttgtctaaaggcccaatgatgcagtatttcttcagaaagctactgtgcttgtgttcagttattttgagttgttcttttaggaaagcaaaggtataaattttaacaaatataagactgcatttttttgttaacttttaggctttagtgtcaagttgtttcattgtaagcatgaattaaactgaggaataaaatgcagcacaccgaattgaggtgctggttctttagcataacatacacacaaccccggtagtaaggtaagcaaaaggcgtgctaaatactacctcaaatctttactgaaatcatgccaatttacacaaagggtatatcatctacagttattcttatacagtatgcatgactagaaaaaaaaaaaagagtttgcaaccatcgacagctaatcacataatgactcataaaccgcacaggcaatcagaaaccaatgccacatccaggttttttgttagtccaattaccgttaccgcaatgatatggactacttgatcactgcatatccaaccatatcccactaaaacatacgtagtgcggagtagtaacaagcatgtatctcatctgaacaactactgatcatttcttcgatcaagcaggagccctaaattaggcaggcaggtaattagctcctaggaacaaaaaaaaaaaaaaagaattcaaggagaaggaaaagctccccggctgccgagggccgacctgaaaagccttggagatgatgtcgtcgtggaggcagacgtggttccggcagttgcagcagctgtacacccgcggacccaccagctccgccatgaacaccatacctcgagagcaaaaatccctcgaggcaactcaaccaatcctgcaaagaatcgagacgcgaattacatacaccatctcgtggctagtaataataaaaaaagaggaatcgaactagggaccccaaatttcaccaagaactttgggttccaagaacccttggaacccccgaattgcgggaagaggggagaagcagaaatcgggaggtttggactgaattgaacacggaggtgaaagggagggttccgagtaagtactaaccgatcgggcgtgaccggaggtggggggcgcggggagcggagaggaggcggcgccggaggggattagcggaggagtcgccggagtttgggagaaga

SEQ ID NO: 20893 - DNA, 1501 bp, Oryza sativa
cgcaggcagcgcagcaggcaaaggtttgctttgcatttttgcaggcgattgtttccccgcgtgggtgctctctgctggctgcgacgccatatatgcctttcttccccgcgccatccgtcgtcgtcgaaccatcgcgtcgcgtccccgtgtctgtcgagcgagatggatggatggatggatggatgggaccggacgaggcatcggtttctcgccggccgtcgtgttgcgtcgccagtcgatcgccaggtgaaaaggctgaggcagtcagagctttgcgccatggtgtccggccggccggggcaccgattaccgggtacttcacttgctctagtaggaccagtgtactgcacttgttgctcttgtgagttttcttgtgttccactggttcaaattaacttttcaatcttggctgtgtttggatccaaacttccaactttttctatcacatcaacctgtgatacacatacaacttttcagtcacatcgtaccaatttcaatccaaatttccaactttgaaagaaacccagtctcgtagtttcttatacataaaacttgcactccttccatcttaaaaaaacgatttctgagcactggggtggaggctttgtccaaaaaaaaaaaacgatttctactccatacatcgagaaacagcgatagcgggcagtcttatcctttgtctctctcctcacccaagcgtgattaaaaaaaaaaaaccaaaaacagaattgactcatcctctttcctctcgtcttgtctcgtccgtcgctctcctccttccacccatctcttacccctcccattggcgatgaaccgctctacccatgttccttccctcccaccatcctcgcaaatagctcatatgcgacacctgcaccctgatgcggcagcttggatgtggccgcagaggcagaggcttttgaggaggcggatccaatacagatgatggcactgtcggacggattcggctcgaatatggcggcggtggtggttgaggcaggtgcatctcgttattttgcagatggaggtggaggctacgggtggatgcgacgcaatcagtggcggaggcagaggatctaatgcaagaggatgcacgagcgtacggtggtgaaggcaaacgattaatctctgttcttggtagttagttcttgctaattcttgcatttgaccgtccaaagcatttcttttttcagattggagatgttatatttctttcggcaagtgaaaattttgaatttttggatttttttttcgcaagatgtcgcttgtgttcttcgtatatgctgtgtaattattgggtttagagaaacaacagtatcggaacggaagtagttattgggggcactttagtattttcacgctactactaaacttgcatatggaatataggagtggctctttttaggacggatgaaatacgtcatacataggggtggatgtcgagctggctcggctcgactcggtctggcttcctaacgagctagaaatcaagctcggctcggct

SEQ ID NO: 20894 - DNA, 1501 bp, Oryza sativa
taatgtgcatacacatcttaaggtatgatccataaatagttagctatttgttatagtatgatgcacaacatatatagtctttaacgtaggtccactataaaataaaaatatgagatggctgctaacttttttgggatagtggggagagagagagtaagtagaggagaaaaaaatagttatttattcactatggccgattgtaaccttgaggtgcaccacaagaaacttttttctattgctggcttacacaatgtgtaaggtgcacttcatcaatatatttattccttttttacttttttttaagcatgttgtggttgtcctaaggcataactcatctctgacccagcagcggcactgaaactcgcgttaaacggccaagatattcacaagctcgaacaggaattttctgcgccaaaaattctgcaccccctgaagcgtatactccctaaaaaagacaaaccgcgggtttacatgctaacatttgactgttcgttttatatgaaaattttttataattagtatttttattgttgttagatgataaaacatgatgaatactttatgctgacttatctttttaatttttttcataatttttttaaataagatggacggttaaatattggacacggatatcagggtttgtcttttttttttttttttttttttgactgaggaagtatgtcctgtggtacccctgtcgccgaatctacgcatctgccaaagacgcatgcagaaacggcaccgagccgtcgagcatcgatgatccacacacgcacgcgcaggcagcgcagcaggcaaaggtttgctttgcatttttgcaggcgattgtttccccgcgtgggtgctctctgctggctgcgacgccatatatgcctttcttccccgcgccatccgtcgtcgtcgaaccatcgcgtcgcgtccccgtgtctgtcgagcgagatggatggatggatggatggatgggaccggacgaggcatcggtttctcgccggccgtcgtgttgcgtcgccagtcgatcgccaggtgaaaaggctgaggcagtcagagctttgcgccatggtgtccggccggccggggcaccgattaccgggtacttcacttgctctagtaggaccagtgtactgcacttgttgctcttgtgagttttcttgtgttccactggttcaaattaacttttcaatcttggctgtgtttggatccaaacttccaactttttctatcacatcaacctgtgatacacatacaacttttcagtcacatcgtaccaatttcaatccaaatttccaactttgaaagaaacccagtctcgtagtttcttatacataaaacttgcactccttccatcttaaaaaaacgatttctgagcactggggtggaggctttgtccaaaaaaaaaaaacgatttctactccatacatcgagaaacagcgatagcgggcagtcttatcctttgtctctctcctcacccaagcgtgattaaaaaaaaaaaaccaaaaac

SEQ ID NO: 20895 - DNA, 1501 bp, Oryza sativa
attagctatgtaggcgccacgtcatccaaaaccgccatctaaaccgccgagggacctcatctgcaccggttttaataattaagggacccgttgtatctggtttttcggttgaaggacgaaaatcggattcgttgacaagttaaaggaccttagatgaacttattcctctacgttgtatacttgtacggaataagttcacctgccatccctcaattttacaccgactttgtatgatatcccttatcattaatatcagaaatcttcacccctaaactatataaaacaattcaatttaggtcccattacagtatagatacatgtttttgctgacgtggcatccatgtcatcaaaataaaaaagtatgtgggtcccacatgtaggtgaagcgagaaaaagatgtggggcccacctgttgggaccatcttcttagagagaggaaggccggctagagagagtgggggcgccagcggtagaaggggtagagggagggtgttgacaggagatggggagagaggcggacgacgcgacggcactggcggttggcacgacggcgctagcaggatagggagagagagaggcggatggcacgccagcggcttggagcgcctcatccagaagctccgctatcctccatcgacaagaccgccgccgtatgcgtcttcgtcgacttcatctaggtctcccccctccccgcctctgtcaaagctgccgaggaccaagccgcataactcgtcgccatgcgatagggtttcgccaaggcggtcgcccgtcgcctccactcctgagatgtgaagagttgcctccacctccacctccacccgccttagtcgcctcccgccgccgcgctttgcccaccgtcgcagtgaaggaaggtaggcctcctaacggcggtgaagggtgcgtttgcctatgagtccaactggaggacgtttgtggacgcaagccgccacttgggaagaggggggcgggcaccactggcacgcggatctagcagcccgctgctgcgcccgctttgcctgccgctgcacctgctcaagagaggagaagaaaaaaacaagaagaaaaatttctcacttacatgtgggacccacatattattttatttttattttgctgactaggctgccacgtcaataaatctatgcatctatattaccatgggacttaaattggacggtttgatatagtttaggggtgaagatttctggtattgagcataaggaatgtcaaacaaactcagtgtaaaagttgagggattgaaggtgaacttattcctacttgtacagaggcaaacgtgtacatgggctgtggacccaacgcgccaatacggcccatcgatattttcgcacgcgccgactacgaggcccgagggccgaagagagaagcgaagggggcagaggaagcaggagagccaaatccctcaccgcggccacaatatcgcggccctctctcctgctcgtctcgtctcccttcctcctcgtcttcggcggcggcgcggcgg

SEQ ID NO: 20896 - DNA, 1501 bp, Oryza sativa
catattatattgccaaaaatcataagtgtcacctcagtagttgcaggcatgatgattgttgaacacgtattttagtggtgggatggtaggtttcgtggccttgtgattttatacaataaagtgtgcggccttctactactatttggctattatgggattcttgttgcattcgtggccctcatattaggtgtatgcctatccattctcccatctatgagtaactttgaagtccatgaacgtatattgtgcatgctacccatgcattggcatgtttctagtggaaaagcgatcgcgcgaagatagccacagccactcagccagccaggctacagtgtagttgtgctcactcgtgcaacctatgtgctggtaggagtatctcttatcaggtcggtacaggtagccggtagcctggaatttgtaggggcgttgtcttgtcgctggacaccgttcgttccggcaaaaatcacacgagataaatcttgtagcgtactgaccttgtgaacagtatttttgtcgtgtaagagggggccgggaggaaaccatgtgacatgttaaaaggcgtttgcttgtttttgctgtgggttaattcgcctttttcacctgtgggccgggagtatgctggatgtagatggatttttttctggggttgcttagaatggtactaactatgatttgttttcaacaattcatacagaagtataggttttactgttgtctctggctgcagcccgtgatattccttgtgctaggaaacaaagcagcaaagacaatttcatggtcgttctcttatccctgacgaaagaaaggggagattatacgatcaagtgatgacggaatcggcgcattacaacaatgctgcggatatgatgaagtgacgacgacagcatttgaatgttctgttctgtccacacaaaaacgcaaatgtgcagatcatttcaacagaagaattttacctttcgattccaaatttctcagctatttcacgcatgccctagcagtaagtagagagtactacgtataatgggagttcacaagaatcgtcgcatacacgagcagcaacaaagccaacaaaattaacaagttcagatgcactccgccggcggtacggtggggcccacatgggtagtagagtcacctcccggtgggtcccgcttgacctgacctcacccctcccccgggagaacggacggagaattaattagcctcccacaactccttaattccatctcctctcccctgctgatgtgttgtgtcatcgtgtgcttacgagaaagaaatacaccttggagaagaaacaaaaggcccggcccgacccgacgaggcgacgaagaagacgaagcgccaaaaaaagcgtaaaaggcagcgcagagagctcttctcttagccatctgaattggaaagctgcactagcgcagtaggcaccagcggcgcgcatccggcagcttgcaaccgagaaaaaagctgccattgttagcttgcaaggaggagaggtggagggcaa

SEQ ID NO: 20897 - DNA, 1501 bp, Oryza sativa
caaaatggtttattttagtgactaagaaataatttattagtaaaacttttatatatctatgattaactacttaaaagcggaaaagaaaactatgttgaaatacctagaattaactactcactctgtccaaaaagaatcaatgtgtatccagattcttccctataatttgattctttttaaaataaagagagtagaaaattatgttttaaaatttaaattttgtggggattctttacaagtcaaacgttaaggttcctagcagcaatgataaaagtccaaaatatctctcattaatagaaaaatatattggtgtgtgagtagttaaggaatattgaagggataaaatttattgatttatgaacccaaaagaacatagaaataaacttgttttgtgataaactttaaaatctagaaattaacttattttagaatggaagagtaagtctctgaagctctatttattaattctgcaagcgtgtccataaaaaataagtagctgattcaaactctaccttaagcacgaaatccaattgggcaaggaaaaaagcacggtcagatcgacctaggcacgtagtacttgtttggtgacaacttggtaaaaggcatgaagctgatttgttccgtgaagcaattaggatggtgttacagcaatcacactccggattctattaatactccaactaattaatccctcacttgggaacaaatctacctgcctatatttaggttgaaagagttggaactcgcctccgatcggcaaccactaccgctggaaatcgtgggagccaagttgaaacgccaacaacgcctctcgagtcttacagtgaggttgaccaagcctacctctcctgcagctgcacgtcccaaacaaaaattccaaaaaagatcttgatccgctctgcctcaatcttccacacgaccacaccggttcaatcctaaagttcagtctaaggcatgcccgttccgaccgacccatatccacgcaaaaaacatttcgaaatgtgcatgccaaggaacaacagaaaaaaaaaacgacccatttgtagtgcatgttgttttttcaattgtttcgaaattaaattgactggacttttttaaaatgattttttcatgaattttataggcttactagagagtgaactctttttcagcgtcaaggtcccggatcctgaccgaaacaaaaaaccgcgcacccgtggcggtcaactcgaccggctccaaccatgtgccgcgccactcggtctacccgtcacgaagccgagacaactccctgcctcgctgctgcctcgcacagtcgcgttccacgaatgctcacgcgcgcgcacccgcgcggcagctgagccaaacacgtcgacggaattgtggtcagaaaacgcagtgtcgctttcgacgggggagggaagccgtgcgcggctgcgcgccccaacgggctatataaggcggtgtccggtctcccctgcagaggcgcacacactatcacttgctaggacagggtcgtaca

SEQ ID NO: 20898 - DNA, 1501 bp, Oryza sativa
ccaaaagaacatgccttggatgcctcttgaatcttgaattcttgatgagtcgagtaaactagaggctcctatgtttcctgtagcagtagcgtattgttcagaacattactgccactacgcactgtgatctgcccggtttccacgtagtatgtttcgccgtggtcctatgcagaaataaaatccaatttactgaggtgcacccaacacagtaccactaccatctcagcaatcgagaatcgttttgcatcatatccgtttctagattgacccacaatgatttctagtcatggtccttgcatccacattccacaaaggtgttgcagatgaaacatctggttatctcacgatcacagacaaaccgcacaaccctcttcaatacattggagcaatcagtggggtcaacttcttctcttccaattacatggattacacgcacaaaaccgcgtatgcgcccattacgttaaaaaaaacatggaccaacgataaattttatttgaaaatacaccaacgtgtggtaatattcagaaacaccagaatttaaaccctattaagtgaagtcatgcacctatggcttaactatctcaccacatagttttgtgcgatcaacttttggttcctctcgatatttgtcttagagtgaacttaaaaaacaaaactcggtttgtttagcatccaagatacagaactccaaattttacaattcactctattataatttattttaatgaaccccatattttagagcaaaatattttgcaagaccaatacaagcctagatgttacatttaacaaatatatttgtgcataatactcggaaagaataacataagagttatcaatagctctggatgaaatacctagacactataaactaatatttgaaacaccttactggagaaatgcctgaatagaaaacatgttaaaataaagatatatgaatagacacgcgtatgcaaaacatattattaaagaaacgcaggaaactatatgaatgattatttgatggtgtatagaaaaaacatgggaatgttaagtattaaatcaacagtaaataaaattttgagggctaattcgaaatacaggataaaaacacacacatcaatagaggaaatgtaggactatgataggatcaacatggaaacaaaggaattttatagggctggttgtttggaacagagggttgtcttgaacatatgatttagcttctatcctatgctagctagaggttgcggtgaattcatgcgttttcatggtaatgctataatatccctccataattcgtttgagcaattccttctacgtgaacagtggcagatccaaaggatcattaatcccacaaaaatcatgtgaaaacccttcgttccaaaggaccaccagatggttttaatccatacaatctagggtcaagaaaaagtaaaacatatcttccaatcgtgcttcgtttctatcgtacgcatagtaaaaaaaataagtttaaggtggatgttaattttcttagaat

SEQ ID NO: 20899 - DNA, 448 bp, Oryza sativa
agatgaccaacgggcacacaacataggaagtaaagtagtgtatgcatagttagcaaatggggagttcagtgggggtgaaaccagacataaaaccagcggcgtaatttcatgggcatacctggtgacacagctaatgcagaaattgcttttgatgaagatttaaatttctctacaacagagccatctgaggcattgatcctacagaccatgccatcagtgcctccggtgtacaaacttcgcccatgcttcgagtaggctacagctgtgacacccctgaacacataaaaacaagcactccaatgtaagagaacacatctagctaaagcttgcggagattaacatagaaattccaaacatgttcaaagcgacaatcaagggttcaatgagcttggagtatagtttaacaaatgaagccacgagttcccatggaagcaccaaacgtacccag

SEQ ID NO: 20900 - DNA, 367 bp, Oryza sativa
tgcaagtagctcatcaccatcagtcaacaagttttactactaacggtagtaacagccttaataacaggctaacagcggatcgaagtgcaacgcagcgtgtattgcacagactggccagccggtcacggtgtacgtccactctgatcagtgaacgcacttagtaagtgtaacggtgaaagcggtagattaaggctcacccgacgactttcaccacggttgaacggagacattttctgatggttgtactgctcactagtcgcttctaccccgtgtacttgtacattaccgtagtacggtgcagctccgactgttaaaactcaaaagaaggccactcctcagtcctcactgtcctcggcaactcagatca

SEQ ID NO: 20901 - DNA, 1501 bp, Oryza sativa
aaacaactctcgccacttgtgccaaaaagccctgcgtcctacaggcacttagcccttgttttcctcctgcttctaggcacaaaagcacgaaatctgccgtcacctgagttcatccgtgcatactgcccctgatgcaactccccctgaccccctctataaattggctaagctactgctagtcgatagtacattgagcttgcgatcgacgtatatatatgttggtgtacttgtgcagggtggagaagcagggcacgtgagcggccatccagtgtagcttcgctgcgcgtccatggcggcgaacgcgcgtgatctggagtttggatggtcgttcatgtgtccgtcttctccaccgagcactggcatatccaagaccgagacagcgagactccgagagacattggtcgagcgagcgcgcgcggcaccgtatcctgcactgtctatgagttgacaacacagacagctgtgctttgactgtctatattcataacactgatctactacaagaaagtgtcatatcttatagtactatgttagtttattttaagatactgttacattttattttaaattggtatatctcatattaggttgatttattttgagagacgattacatcctattctggttggtttattttaggatagtactgtaataatatatcaatatctcatattaaattaatttattttaagactgttacataaaatttttgattgatttatttaagtacagagcgggtaagtaaacgtacacgttgccatgtcgttcacgtttgcaaccaaggcaacaactcgctacatggatcagctcatcagcccacggaaaagcggtgctgccgcgtgggctgctcgtgtagtaggcccagcccatgagtccaggaatcacccagccgtctctctccaaagcctctcaactccatcagcgaggcatccaccagcgagccctttcctaatccgacccgcgccgccgccacctcttcctccgctgcccaagagcgatggccgcctcccccgccgccggggccgcggccgccaccgtctcgtcgttcgtctcgccgtcgtccttctcctccgtcaagtaatccagtcatctccgcgcgcgcgcgcgctcgcgcttcgttgattgattcgttgtgctgtggttctcactctgtttgggcgtgattgtttacagggcatcgaagcccgaccgcctccgtccggcgaggagggcggcggccgtcaacgtccgatgcgtcagcagccctccggccaccgaaacttgtaccgtcctctccctttccctctccctctccctcctagcaactcatttatggttgctcccaaactgctcactgccgcttagtaggtttttgctatagtagttatcgttggaggtgtgcaatcgaatgcaatgagctcgatattgcctccgctgatgctatcacacgcagtttaggaacaaccagaaagttactgatactatcactagcactgtggtagtaagtttactgaaagattca

SEQ ID NO: 20902 - DNA, 1501 bp, Oryza sativa
tggttggaccgacagcctcgagtccgagtccaattaaggttattctcgtggttccttgcttggttccaaggtttcttatatcctaagtctaataggcatggagaaggtctatggaggcaagaaaaactcatttataaggacgatggcagattcaattctagaccaacccctatataattaaatcgttcttttacctttactttttagccatgttttctactttaccctttatcatctatctttatcaatttgcatcgtaaatcatccatcttcactgtgagaatgtgatatcctttgtaggtttgtcctgtaaaacttccgattcatccatgagacgggtggttatctccttattgatctaaatcggcctagagaatggttttgatccctcaattggctctgctaaccaatttaatatctgaaacccatcttggtttagagttttctaatcaaggtggttggcgactccgttaacactaaatgtatgttcctattcttgaatgatgaaattttagccgatataatgtcaaagtaatattattatctaatgatatatcttgtcatgcactcacactagatgacaaccactcttttatatttttaatttttaaaaattttgagctggctccagttgaaaaactagtaaactactagtcaaattcaaaaaaaatagaaaaggtaaaccaatctgttaacaatgaaatttggtaagcccctaagagaataatcatgtcgccaatagtcagattccttctatattcggttaaggaaattaatctattaaaggaaactaatccagatgtgaccgagttcaaggagaatgcggcatggcagtttatctattaattaggtagtatttgttagtttccttttatctttaggaaagtgtgtttagtgtcccataagtactttatgttttccttttatcttttaggaaagtttttttcttgtcttacaagatctagtatctacccatggatataaatatgtacacccggggtcattgtaagagctttccacgatcaacacaattcggcacatcgccacctttttatcttttctactttttatcatccggcggaacttggcacctaacgcggggctgcatcggctttcgatctccggcgaaggggtaagccctacgttccgtcggcgcaggcaattgtattggctatattggcgtcgttcaatgctgcatcagtacattcgacctcttggatttctctggtttggttgatatatttacctacctatttatcatatatcttagttaatctagtttagaatcttaatttacttgtatcagctgagatttgttttagggtttatgctggtgtcggctaaattatcttgctagattagattagctaaggtatccaccaccatgaaaattagtcaaaggcttgattgtttagactttatgcttctttgcatacttagtgctatatcagttgagtttgatctattaagtcgtgcttagaatcataaagtctagcatgtc

SEQ ID NO: 20903 - DNA, 1501 bp, Oryza sativa
tcaacaaatttgaataaacgaaaatcaaatggttatatttaacatacaccaaacttcgctaaaatagtagtagtcatagttcggaaataatagtgcagggtgttgagtagcagtatttaggaacagaggaagcaactgtctatttttttttagagaaggctttttttaacccagcctctatatccaaccagatatatatagccatatattgggaagcaactgtctatactttacagtgaaaacataagcaatttttttcactattattattttattttcctattatctgtgcagcatgagtgattttaaaaggagaaaaatctgagctttcttgcccctggatttttcaactttttgaaaacttattttacaaatatacccctagaaaaatttattccaacgatggatccttttcacagcgccttgttccaatatgtaacggcccgtcctctagaaccatgcagtccaacccatccgacaagcaagcccatatacacatatcatcccacttacactttcatcatcgcttcgggtaaaaggttgaacccggaacaagaagtgatatggctggaggtataaccccttataagttagttccaccattgctaaactagcattgtgatattaaacatgcgtacacaactttcatgggtcacacatgccaaatcataattggccagaatttcacacaacatgacgtcgccaatgatattggcgttgtctccctcgcactcccgtggaagctaagtcactgatgtgaaagggatcaacgttatgtacctatttataaaaagagtaaattgcatccacggtgcatcaatttggtaggtaggtgcaatttggtacaacaatttgagaaataaacgttctagtgcaacaacttggtaggtaggtgtaatttagtataagaactttataaatgattgtataaatgcaaataggtacgattttgatacagtaaactaagaagttatacgacaacttaattatttgaagcaatttttttatatagattcatttttaagtaattattttgacaatatactagcgtggatttgtataagcatatttatatttttatcgtaataatccatagctgaaagtcaattaaactggatgtaaaaattattatatttcggttaatatttgagaagataaagaaaacaaaaaaatcttaaagataattggatgtaaactatatgtgcaatataattcttaaagattaaattcaatatttaaggtaatattcgtaggattactatgtaatggcatattgacatcgtgaaaaaattcatctagcatatgcttagccaaattgatgcaccaaaatatcgaattatcaagttcttataccagaacgcacccacttgtcaagctattgtactcgaacgttcaattcttaagttcttgcactatatcacacccacctaccaagttgttgtactatgggtacaatttactcttataaaaatttcaaaaaagatatatttgtaataaaaaa

SEQ ID NO: 20904 - DNA, 1501 bp, Oryza sativa
tttgcagttggaattagcacctccatcggaggaggcagttggaggggcagatgatcaaggccttgttcgaggcagtcctgatggtcctcttcgccggcggtattgattggaattttgtagcctaaggcacgcaatgctacacgtgcgggcgacaacaaggagctggtactggaggaggtgacatcgttgagctggtaacgagggtatcgggtctggtaccgatgtccgataggtacaagatcggatactgatgggtatcagccgatatcgatgggtatcagatctgatgcatagtaagataccagctatatcgactaatctgcgttcagcagcaggtgaaagagagaagatttctcttgttctccgcgtgcacgcttcccgaactaataaacggtgtgttttttttaaaaaaaaaaattctataggtaagttgctttaaaaaaaagcatattaatccatttttaaaatttaaaataaataatactcaaataatcatgcgctaatgattcacctccttctttttacgcatattctcaatcttctcttttcctattctctcaaacactcggatattagaaaaatctggcaattaattgatagaccctcaacttcacaatggacccaccaaactttccactgtctaactattcgtcagggtctaaaaaaggaagcaaaaaacatggctgaggaggtagcaaagattaattaatcgagaagttgtgcaagcatccacatatacaaatatcaaattgttatctgcatctatatatagttggtggagacgccagaattatctaaagaaaatcagaatgccttgaaaaaaaaagagaggtacacgagggtgggaatgagatgtattcaggaaacaggtgacaagaacaagattcattgtggatcaagtaggatcggaaggtcaacatgacctgattgattgccaacatatggtgagaagtacacagcctcatgcttaccagcagtaggtgctttcaaccgcctacatggtggatccattctgttctgtaaaaaatgctaccgatggggataggaaacttctgagtgtagtttctacgactcccctctgcagttttcaattgttttgtcgtgcaatttgggttcataagtctgaacaacatcaatcacaagtccgcaagaaactcattgcttttgcaacaaatttgcgtggattttgattagctgtatgatgttttctgaacagtacaactcagtttttttgcaactctgttgttattcaagaatttcgaggatatggatccacttgtgatgcgagttcaagcgaccaatgtagaatattctcaaaaatgttgagaatatgacaatgtagaattccaagcgaccaattaaccaatctcctgactatcgtaacagagacaattgagctcccaaactagtcaaatggtaaaaccatttggtggcaatgacctaaatttcccatttttgatttttctgaaggtcattccacaatttttttttcaaaataaca

SEQ ID NO: 20905 - DNA, 1501 bp, Oryza sativa
cagggcagcctcggtgggtgcaaggaattttccatactgctgctgtagctgtacacgcccgtttctgcacggtgggggcaatgcttccaatgcaaagaccgtgaaacactggtttggggagttgggatcagacgggtggtattttttttcccacgggggcgtggtgaaattttcgttccgtggaacgtttgagcgggggcctcggaattgggcgggtgcggagatagaggagggaattcagggtgtgttcggctgcacattacagccgctgaaacgcaaccacatagctgcttgcagtaacacaaattaccatgcaaaatgctttggtagtggcaattgtcgtagtataggtttgttggttgtgattatattaagttgtgatgtggcaaatcttgtaaataatttcactacttttcttaacacattagtagcgataagtaacacaacagccttattcagtaaccatttataaatgacttgagactagttgacaagtatagctaacatgtccatttcatgtagaatactaaattgaatattttcactagaaattctaaatctaaggctacaaaagtcataataaacactggtatccatattttgatcacatacgtaccacctggatgccccatattgcttgggtaacatatctcttataactagtagtattggtatctactcgacactttccaattccatacattaactttttaagagcaaaacaaactgaagaccttactcagcattgactttgataagaaatccaacttttatttatatatattgttttttttgaaaggaaccagcacaagaatgtgcttattcatcgaatatagcaggagaaaaatacaacccctagggataaagaaaaagcaaaaaacaaggaaagctgtatgctatacaaattgtgggatgatctctccaagacgcttggtgcctgccaaggcccacatgccgacaatttatatatattgttggaagtatttttcttgcttgcaccctaaaaatacaagagatcaggatataataattcaagtttcctctgtatatgttgttcgatatgtatttcattcttgcacccaaaaatatgagagatcaatagataatcctgtggcaaatcctagtaccagtgcaaatccaacgatgcataatgtgtttttcatcatcgcacataaatcttaaataaaatattaaacaacgttagttcaaattaaaataatgaaaagtattttttgagacaaaatgctagtaactaaaaccacattaccgtctaaaactaaattctatagttcattctatcatcttaattataactaacattatctaaattctaaaagttttaaaggtaaaagacaacacgatacatgggcaaaaggacttgtacatgggtttgaggtggaaaaatgagtacttttttgtgattttgcaaaaggggtgtatggagtaaaatcggttgatattagtgaatggtagtagtgagggtaaaatattacaagctcta

SEQ ID NO: 20906 - DNA, 1501 bp, Oryza sativa
cggttagttggtcggaacgtgctggcactattgatggccttcagccaactgttcagatcaaggcggcggcggcggctcagtcgggctaggggaggatggcgcccgtgagcgcccattagtgcggtcgtgcttgggatgggaaaacgagaggagaagataagattaactgttcatgaacaaatctcaagacaatcctggatgtacaaaaaattgaccttttttttcaggaagtgggaattagactgtccctataggaaaacattttgttaaatattagttccaaaaattttgagaccaggagtggataaaaactaaaaagtgaccatgctactcttttttttttctgttttccatagttggctggtatatacaagtagctatgagaaaagtctttgatttttttttctgtatcacggagcagccctcccccccccccccccccaaaaaaaaaaaacctctactacaccacaccatttttaaaaatctgatcagggtatttaactccttgagatgagaatctgagagctagagtcctacttttaccaaaacacacccaggctgctccaaaatgttatcaactcaaataagttatgccaaccaatattgtagagaattattaataaaaaatataaaaaaatgtgttcatcacactttcaaagtaggtgtatatagaatatcagttcaaagctaaaaatgtgaaatacattaattgttggcataaacatatggcaaatgatgcatgaagtacatacaagcatttcctcttggtgctaccagatgccatgtaatttaaaccacatgtagtatatcattttcatcctatgttggacgttaggacattccaatgatcaagtaattaaggtaattcttgttcagaatttttctatgcatgtatgcatcttaataaacacaatttcatcaaacaaatgaaacatggttttacacatttgggaacgatttaacaaaaagctaagctatttttgacaagaaattaaaggtaagagaggataaggatggaaggaccaagtgatcagcaaggaagtgatgagtactgcacacaaaaagccacagagattgctaataaagatcatatggaagagatcataacatacatgaatcaaattatgaagacgtggcagaaggaaccattagcactaaaacatcaatcaacaccccccctccaatcattgttttcaaagaaccggtttatgttaaaaaccatatatcatgtttgaaacaacattaccagtttttagtgaaatcagccaaaaaaaagctgaattagattcctcgatcccacactaagttcattgtccacgtgaggtccccttcataccccctatatctccattcatccccctctagccctccctcctcttctctggatgacgtaccacctgctcattctcccttcacccgaccatgccactagttctgtatttttgccaccttcctcccttccattcaacccgaccataggaaatgccacatccagccagca

SEQ ID NO: 20907 - DNA, 1501 bp, Oryza sativa
caattgaaaactgcagaggggagtcgtagaaactacactcagaagtttcctatccccatcggtagcattttttacagaacagaatggatccaccatgtaggcggttgaaagcacctactgctggtaagcatgaggctgtgtacttctcaccatatgttggcaatcaatcaggtcatgttgaccttccgatcctacttgatccacaatgaatcttgttcttgtcacctgtttcctgaatacatctcattcccaccctcgtgtacctctctttttttttcaaggcattctgattttctttagataattctggcgtctccaccaactatatatagatgcagataacaatttgatatttgtatatgtggatgcttgcacaacttctcgattaattaatctttgctacctcctcagccatgttttttgcttccttttttagaccctgacgaatagttagacagtggaaagtttggtgggtccattgtgaagttgagggtctatcaattaattgccagatttttctaatatccgagtgtttgagagaataggaaaagagaagattgagaatatgcgtaaaaagaaggaggtgaatcattagcgcatgattatttgagtattatttattttaaattttaaaaatggattaatatgcttttttttaaagcaacttacctatagaatttttttttttaaaaaaaacacaccgtttattagttcgggaagcgtgcacgcggagaacaagagaaatcttctctctttcacctgctgctgaacgcagattagtcgatatagctggtatcttactatgcatcagatctgatacccatcgatatcggctgatacccatcagtatccgatcttgtacctatcggacatcggtaccagacccgataccctcgttaccagctcaacgatgtcacctcctccagtaccagctccttgttgtcgcccgcacgtgtagcattgcgtgccttaggctacaaaattccaatcaataccgccggcgaagaggaccatcaggactgcctcgaacaaggccttgatcatctgcccctccaactgcctcctccgatggaggtgctaattccaactgcaaaatcgtgaaacatagatgtgtaggcgtgtagctgccatcttgttcaactccgatggacactgtgctgtccttcagcgtgcagctgctccattacggagcttgagataccgcggagttttagttggttatttcctatttcaatctttacataattttttgaatttttttctaacaaaatctaacatttaaaatcttttagtttctactgaaagttttcatagaatatttttagaaaaattcccatgcaaaaatctaacttcctattaaaggtttattcccttttttaacagagcatctatgttttatcttaaagttacataaaaccctactccatgtaccaaaaaaataaatatatgatatgatgtaactcattctactactacgaatctggacaactctctgtccaga

SEQ ID NO: 20908 - DNA, 1501 bp, Oryza sativa
aagtagtgaaattatttacaagatttgccacatcacaacttaatataatcacaaccaacaaacctatactacgacaattgccactaccaaagcattttgcatggtaatttgtgttactgcaagcagctatgtggttgcgtttcagcggctgtaatgtgcagccgaacacaccctgaattccctcctctatctccgcacccgcccaattccgaggcccccgctcaaacgttccacggaacgaaaatttcaccacgcccccgtgggaaaaaaaataccacccgtctgatcccaactccccaaaccagtgtttcacggtctttgcattggaagcattgcccccaccgtgcagaaacgggcgtgtacagctacagcagcagtatggaaaattccttgcacccaccgaggctgccctgtagaggtggccaaacgggcggcacggcccggcccggcacgggcacggttccggcacggcccgtttcggcacggcccgttaggcacggctgatgaaacgggccgtgccgtgccggcccacgtgccgagccgccggcccaagcacggcccgtggatggggccgtgcccgtgccggcacggcacgcccgcggcccacgggccgttcgggggcacggcggcccgtgaaggcaggccgccagcagtgcactgtgcacagtgttttttttttttaaaaaaaaggaaaggaaatgtataaggaaaaaaaaattaaaaatggaaataaaatgtttaaaaaaagtaatgatttactaatgttaaaaaatgaaaaaatggtatttaaaaaatggaaataaaagttttttaaaaaagtaatgatttgctaatgttaaaaaaaaagaaaaaatggtattttcgctacagtaacgggccgcccggtccgtgccgtgccgcgggccgtgccgtgccggcctgctacaggagccgtgccgtgccgtgccggcccgcgggctcggccagcggcccaagcacggcacggctacacgggccgtgccggcacggcccgttactgtagcaggccgtgccgggccgtgcctgctacaggaacggccgtgccccgggcggcccgtttggcccggcccatttggccagctctactgccctgcactgcatgtgtctatgggagcatgtaggcagttgtaaacatattttaaaaagataaaagagaagagataagagcagcgggctatatagatttatagccagctgcagcacaaagcatttgtgtataataagtgagaccaaatattgattgtgtagtatatatttataaataagtattgtatgaattggctattaagttgactacatatgttttgaagcgagcttggataaaacgcgctctcctttggataaatacatcaccgtactccgtagtactagtagtagacgacgtgttcccacctgtccgtacgcccgagcgagaagagcgcgaaaaagtcaacagtgccactcatcacccgacacacgtgcgcccgctctgacaccccctccc

SEQ ID NO: 20909 - DNA, 1501 bp, Oryza sativa
ataattgaaagaaatctatattatttgactatcaattaaaacaaagagttcaaccatgaaaaatggccacctattaataaaagttaaaacagtttaacaaggctgaaaaagaaaaatgttgcctatgaaagcatgtcacacaagaaaattcagcaactagcataacacataaatcttacacagggtctctgcaaatgaacagaatgattatctagaccaaaaaaaagctgggaaaaacagaagaaatgcttattaactttagaacataatgtaggcagtacctgacatgctgagaaaagtttttgcaacagtagaaaaaataatgaggatgaagctttaagaatttatcacatggaagattcgatcaagtcacaagtcattatcaatcagatatttatacaacagctagataagtgaggaccgatgatccatacacataatgcaggaaacacatcattttgatacttagaatcattaagaaaaagaccaaacatggaaaggaatgccaagctgccatccaaagaagaaaagaaaactacctcctggacatagtggcttgtcagaatcattgtgctttggtggttcacttgagtagaaggcattactacggggaagctggcaccggaaaaccttcacgctgtaacccacagcagtcaaaatcagcacaacaataggctattagcaaaacagctgtagaacttcaattcaccttctacacggattgccttgtctatgtttccactggtcgtgctggtctcggagtaagcatgccattgacgggcacatgaacatgaacaaagtgcggtgaaatgatgccgcattgtcctcaatcggtgcatatatctgcacaaaattgaatcctatttgtgattgatttcacacccaaacaacaagtagtcagctacaactgcactatccacaaagcaaacacctggaggacgaactgcaggggctcgccgcagaagccgcagcaacgcgagttccccgatggcaagttcacaggatccaaccacgcctgcaatacagcaattcacacaaaccacaacatcaacacctggtcgacgaattgtaccaatttagcgagtgaagttcatcaaaaacgcgtgcaatccgtacgcaccgggatgcctccggccttgctagggaacaggtggcggaggaggaggcccgggtgcttcggcttctccagaaaaccaagcgtcacctccgcctcttcctcctcctcctcatcgtcgtcctcgtagcccgcgccgccgcctccgccgccgccgctggcgggtggggatcggtggggcagttcgggctcgtcgtcttcctcatccagcgaggtgatggtgagaccacgaagcttctcggcgttggactccatcctcggcggcggcgtgggggcaaaaatgcgtgcgtgttcggcgactcgcacttgagagtcgagacggggaaatggtttgggcgaaaaaccctagctagcctcctctcgggaatctcagccgtccgatgcggg

SEQ ID NO: 20910 - DNA, 1501 bp, Oryza sativa
tcatctggttctctgatgtttcggtcaaaatcaaaccatgcttaatagttcccttgctttctaataatcttcgaatgctatatgcaggtccgaatattgcgtaacttgatgattgtgctgttccgatttaattgtttagagatggatttcttcaatttcggaggaattatgatcctaggtgtccggagcctaatgcctgaataatgtatcaatccttcctactgttgtaggagtagctggttccccatgtggctggctaatttttcttgtgataattttggtacaattcactgcaagaggcttagcttcaaactatatttactatcaactctcacgcatttcgttattttggtttgaaaatattcaacggtgtactcccttcgtcccaaaataaattaatcttaaatatgatgttatattttctagtacaacaaatttgtacaaagatatcttaaaatttgttatattataaaatatcacatcatatctatagattcgtttatttttaggacggatgaagtatattgttctacaagtactccacttgataactgacattgaatatcgctggaggaaggtgggctgtttgcaatggtcatgggagtttgatgactgacattgaatatcgatgtcattcacagtttacaatggttatggagtaattaactgtaacagtgaataggagatgtgatataaattctgttccatctattctggagttggatatgtgatcttcccacattgtgaagattctcacaccttatgttctgtggattaatcaagtgttctggttcagatttggatatttttgcttgtactctgaacttgggatgtaagtggacattgtttcgcgggttagcatatgtaagactgtaaagactgtaaggtctttcggttaaaccctcacatggagattgaggctaatttattccatacaagtacgtactgagtatggaactaatcctctcagtacgtattattttcttagttgtactcttttccctgccgcctgtatcattccaaacacataggattttttttcaaccatgcctagccaggcatagctcattgaattatcatactactcttaacttgcagatctctatcatgcttcccaggcctgttgatcatgcttattgggaatgcttttcattacaagttgtttcaccatacttttatgtagaactgcgagctatttaaccctctttgaaacaatagggatggtataacacatgattttttttcttaaaagaatcatggtgttcgtaactgttagctatcacagacacaatcacacaacgatggtaaaacacatgatgttggcaagaatgcctatacaaaaaaaaaaaagcaaaacataagggaaaccatttggacggaccgaatgaaaacatacgaattggatgaaaagagactttccaagaggttgaacttcatgctaactttggacctattccaaaggaaactcataaaattcaatggtatcaaatcctttgttcca

SEQ ID NO: 20911 - DNA, 1501 bp, Oryza sativa
ttatttttttactttctagaagtcccggcaaccgccttgcccgtttgctttacggcctgcccgtcgtccctcattttaatcgtcattaggattctatttggtgttttattaacaatttttatatgtcgtattgtcacgccccgaactagtcccgaccggaactagcccgtgacgctccaaattaacctgttaatcgataccggtcccaggaaacagtgctggtatcacaggaagacagaatatcacagcaatagaggtttgtttattatagagtaggagtacagtcatgttgggctgcggacagatcccgagctcacaactgcattacaaaagggaagcggaagccaagacttggaccaaacatcacaggcgctgacggagcgtggggctcctcaccaggagaccgcgcaggcccccctttaccggttcggccgggggcgctaagtgaggttcttcgccctcgatctgaggaacgtcagcgagagaagaaatgcgcaagacacgggcgacgtagacaggttcgggccgctgagaagcgtaacaccctactcctgtgttctggtggatctgtgagtgaaggaatacagagagccggagagcgagagagagttcaggctctagccccgttcgccccctctcttctcctctttttttcctctcccttttcttcctaggcctgggcctcctttttttctggtcaagggtcaccacaagggcctctcgccacctaagaaaggaaacatgcttttacaatgagggctagtctacagccggaagtgacctctgacaagcagagcgcacgtctcctgctctgctcgcccctttttcggtggacgcccatttcaaccttcatttaatggccagcgacttccttgccatacttgcgctgaagcctggaatggatctgaccgggactgacataccaactccaggagttagcacgccggctccggctagggacgagagccaggaagctctcatcattccgacgggacagggcgaggcgtgtgacaggccgcctgttgccacctaacccgcgatctgaccggtatgtgaccggtcacacaccgcgactggtcacggaccggataagcgtgcgctgcgccgcattaaatgcggcgtggcgcgctcgtccaacctgctataaatgcggttaggtgagcccgctgtgctcacctaacccacacacgtggcgccaaaaccacaaggggtcggggcaccccagccctcggggccgaaacgggagcggcccgacccctcggggagacagagggaggggtggccacgaccgtcgggcccgacccccccccccccgagggggtcaggccacgtgggtgaccgcggctacccaagcctctagtcacgatacccccggccccatgtcaccgacaggcgcgacttgggaactaggccgaaaccctaaaactcatcgtagccggcttgctcctggaagaactcctcgtcagcgggatccgcttcatcttcttcagcaactgggggg

SEQ ID NO: 20912 - DNA, 1501 bp, Oryza sativa
tacaaaagttgcttaaaaatcatattaatccttttttctaaaaaaagctacaacttaattaatctcgcgctaaacgttgcttcgttttgtgtgccggggagtgagcaagtttaagagcaagtataatagtaggctataaaccggctaaatgctgagttgaggagaaaagagaggagagagagaagaagcgggctgtaaacttacagccggcttggacataagaaccaagaaacactatgagagagacaagtggatcatgtattaattgtaaagagctaactattatatgggtaggccaagagaggactacaaagaaccttatagacaataggtcggctgtattattagccttgctcttagatagtatagctaactactggctccaaatcaactatagctaatctaatagctcattcataaaatagttaactataaaaatatactacaccattaatactcggtcccacctctcatacacacgtaacatttcggagtccgtgttgcagctggctacaaatctgtagccccctttcttctctctcttctcttttcttctcgatatgtggttatagttgaattatagtctgctattgtatctgctctaagtgtggtacttaactatacttgcaacatgcatgtcataaacacattattttcaaatagttaaacgctaaatctaagagtggtaaatagttaaatattctcggttcacgtgtgcttggttcattgtgagttctgttctacaagaaaatttatttacatgtagaaacttttgatgtagcaacatttgaatcaaactcgaagttggacgtacaaacttttggtttgtaaacttctagtgcataattttcgatcagtgaaaaggtagaacacggtgaaaaacaacaagcacgaacgttcaggaattagccctttctgtctacgtccttttgttgtgtacatgttccattccgtttttcctggaccttcacgttgctgacactgggacgcttgctggctggctggctgctactctcaaactatgcaatctgaacaaactgcacatggacctgttgcttgttgggttactatatttatggtcgtactgatgcctagtactgctccaaccgaagaagttgaccagtcaaccatccctcgtcatccatcctatataccccagctcctacagaaaaatggtgaagctgatcgtacaaaaagaaagctcactgccagaaccaatgtttgcctttctattctcaatatttgacgcttgtttttcctacaactcaaaatccactcaaattttgctgtttcaagcaatgcacattattatttcggttagcgagcccggtccaacaagcaactgaacctaccgaatgaatgcttgatgctaacaccttcatcgcaaaatataataacttttgattataaatctggatataaagttatctaaattcatagttaaaaatacttatatttttgagatggagggagtacgtttgtcgtggcagctaaaataatt

SEQ ID NO: 20913 - DNA, 1501 bp, Oryza sativa
taaattttaaaattgattttaagatattttcaacgtatttttttaatattggtttttaaatcgctacgaacaaatatattattttttattttctaataagccaaaacggcttattgggaaatactttgtatgagcacccgatgagactctaactcgcggcataggggactttttttttggggaggatgttctgggttttgactccatcaagaagtctatgtttactcgtagcattaacgccaggacgtctgagttcttaaggagaaagatcagctagaaccagaacatcccgcatgtgttaaaagaaagtcaaccaaatgatgctcagcttgcaccaacggtagcgcaggatttgcagcatcatgctccgcatgaatgaatcaataaaaaaaatatttattcctcaaatcacttttcagcatgttagtgccatcagtcctggctacatctagcagtacatcacttcgtcaaattcgtaccgtcatgccagatcattttggttgctggaccttcgatttccatattgctgagcaatgcagctacatcattttgtcaatccacccaattacattgcctcctgttttcacaactagtagatgactaaaacatgaaacagtggtaccgtgtggacaagctctcacgtgaagaatcatagtaggttttgaacacatcagcttttgacaacatcaacagcctgtacagttagaaaatgtcagcaatcggtagtccccagggttaacgcagtctatatctaaaacacggtgtttgttgcgttccaccacctggcacgaacaaaccaccccaatcctgcatgcatataagcataaaacaaacacatgatcgtgcgtgccagttatgttatctcaggtttgacatggacatataacacattgatattgcgtgcagagatgataatacgctactcctcctcagctgcaactcggaacaagtctggactctctggatggaggagatggtcagaaccaaaaggacgttgctgttaactgaagtgtgcgatgtcataagattactagagaaaacaatatctatcctgtataccagtatcgtccgtttctttgattcggtcaatgctcataaagaagggcataagattgtcagctgcaagttgctttcaagaaagcgaaaggcttcttgctgtttgaaacctgaacgttgcaaaaaaactataggcttgcaaagttgccaaatggtttgaaattacattggcactgaagctgtggtccccagctaacccaacggccatttcgagcgttatcctccaaacatgttttgaagtttgtatacaagaagcatacgaacattcatttagttcgtatttaatactgtagagatctgattaagaagcatccaatgttgctcccacttgcaagagcaacagtttcagaattactagtaccatgtatcgtatggtatgacaataaactgaagagagcagcttagcttcagaaaagcagacagaaaatgagcagacatacggttt

SEQ ID NO: 20914 - DNA, 1501 bp, Oryza sativa
gcaacactttataaatgccatcagtgtcaggatgagatcggtcaccagctttaaattcatgggtgctcctccctaactcaacccaactcaagcccttgctcttcctaattccctttttcttcctctctttccatacttcctctgaatcttcccatctattcgcagatgagtagatgtttgaaagaagggtatagtcaccactgccctggaacgctatctccttgacggtgatctcacctagtttagtttgccggtacctgcaacaagcactgagtaatgccctccatatcacagcatcaggtttcacattcattgtctttaccaagtcatatgcttcatccagtagcccagctcgtgacaaagtatccaccattgcaccataatgttcaatcctcggagtgatagaatactttgtagtcattgcttcaaagtattgacgagcctcttcaaccatgccggaatggctgcatgctgtcaagagtgcaacaaatgtaaccccatcaggaacaagaccttcactttccatctcacggaagaacatcaccgcatcagatccaagaccatgtgctgccaggccaccaatcattgtgttccatacagagacatggtttctcttaattgtcatgaatatcccaattgccacgtcaattcttccacattttgcatacatatcaacaagtgatgaacttaaaatatggttcatttccaatcccagttcagccattagttgatgaacccacataccataacaacgggcaccagcttgagcacaagctgataggactgaggagaatgagaagccatcaggcactagacctgaattgaccaacttgctgaaaatattcattgcatctttcaggcacgagttccttgctgtacctgcaatcattgaattccatgagaccaaatccttgacaggcatcctcttgaaaatctgatatgccttgtctatctgtccacacttcaagaatcccatgagcatcaaatttccataaaagggttcggcactccactccagcattagccaaaatagtttgcaagcttccatcacgcgaccatgatcaatgtataatttgaagagatgagttactatacgttgattagatagcaggccaagtttaacgagatgggaatggatttccatgatagcatagatatttgaacattttgcacaagccttgagaaggagcacatatgttctgtaatcagggcagaaagcagtgaaacgaagcatactgttgtaatctgtcagtgacttttccggagatcctttctccaaagaagctcggaggatggcattagtgtatggaaagatggctctaactggatatctcctcaaacagtttgtgtaggacattgtgcaaataagcttctcaaatgcgatcactacaatgcagacacaaaataggcaatttcaccaggcaggtaagtgtataaacattttctgcaacctaatgtaattcacagaataccatcaacgagacaacgataaccaggcaac

SEQ ID NO: 20915 - DNA, 983 bp, Oryza sativa
aacccatccataatcttgaactaattcgtgagacgaatctattgagcctaattaatccatgattagcctatgtgatgctaccgtaaacattctctaatgctaaagttcttggatccaaacaccacctagcatgcataggacgaggcatttaattttacttataacgagacgtgccaaaaaatgatatccacataacggcataaaactaaacagctgcatatgaatgtaaagactaaataaaataattgcaccaaatcttaagtttttaaatgcatttttggaaaagcttactactggtactactattcttgtactcatatgtggagttgtggacttgcaagcaatagcacatgggtccataacacctgacaccaaaaccacctgtggtcagtcaaacatatccattttagcagctggcaaccatacattcaaacatgcttaaaaaatcttaaaaacattactagtagtcctcagaaccggacaacctgcggctaaatccacaatatgaacacacttttctttaatccaactcagatttcttaatccaaaagttgctaaccactatcgaccagctggcctcgctgctgctgcaagcttgcagaaatgcaggcatttggcaagcacatttgcaccgaggccccctatttcacctacgaattacaaaaagatcccacctcttctactatcgtcagctaattaaatcgttgttcctcagttcggtacttcttcttccttcactctccccaccaaattcccccaaatcgcagctgttcgccacccgcattgcgccgccattgcctccaaatccgagtactccttgagtaatctcagatccatctcgggttcctcccgccgttggcagcagccggagcttttttccgcggaagaaatggcgccgtttcggtgagttcttggcagtttgggatgatgcttggtgggtaggaggactaggagtgcggcggctcggggagaggctgcgatgg

SEQ ID NO: 20916 - DNA, 154 bp, Oryza sativa
aaaaattcatacctaattcatcttagctccgatttagttggttcaaagtctctaaatttttctaaaattgagatctacatgctaaaaatatccacatgtactgttcatgcttgtttatgtgctgttttggtgattttgctcttttctgcttaga

SEQ ID NO: 20917 - DNA, 1501 bp, Oryza sativa
tatcctgcatcatacctcctcttccggtatgacttgctgagtacagtgggtagtactcagtcttgctctcttttcccccacaccagagctgaagatcttcctagttggagctgttttgtcaaagttggtttcgtcgctgccgtcaaggattgcctgtggagtggagtcgcccgctgctgaagtcaagcttcccggtttagctcgcttttatcttttccgctgcatttgtaatcttttctatttttgtaagacgtggatctgtatgtcaacaattgtcgtttgtgtaccctggctggtcctggacagggatttaatgcacattcagcttagaaattctggttcgagaatttctgggcgtgacaaactgccatgtggcttcctcaaaacgctctcaacatgccacatggcacaacgtgaacccgtgcctagaagttgaggacccacacgtgcgcttttgccatgatcataacatggagcgtatttatctcaagattagtttcctactttgaatcaatgaagctggcaagattagctatcctacgtcaacctaatatcacattatctctacatatacatatatacaccggtcagtagattagcaaattttaaatcgatcaagcaggcaagattattacactggtggagaaaccatctttcgtcggtcggccgatttccacaatagtcccggatgcaataaaaaccggggctaaagatgatctttagtcccggttcaaaagggtaacgggcatatttgatctttagtcccggtttgtgttaccaaccgggactaaagatgatttttagtcccggttcgaatgctgtcaggtcatgtcaggcccccccggaatcattaccaaccgggactaaagtcgtaactttataccaaccgggactaaagatcccggtgatctttagccccggttggtgctaccacccgggactaaagtcccacccctatatatatgtcttcttcctcctccagctgcccgagcaagcttcaaaatttcttcaaaaaagaggggaggtcatgccaaaatttctattgaatttattttggtgattacatacaaatcggaggtgcctaaaaggtttgcaacttcatcctccaatgtttttttttgtcatactacatttgcacctatgttttgcacacttttttttgtctccaaaatttagttgtaagttgatgagagagaaaatgtgtgtggggaagaaagaatatatagaaatttagttcatttgctaaacaaggttttataaaatagttgagaaggaaaactctagtgaaagttaatcttaaataatagaaaacaaactaaaatgaaaattaaaagaagtaaaacacattaaaattagtttaaaactttacaaatagtttttaagaattatttggtgtaatattttatgatttttgtatgaataaagatatcttataattattgtatgactgtcattattgtaagaataattatttgtgtacggtttttttgactcatgtaga

SEQ ID NO: 20918 - DNA, 400 bp, Oryza sativa
tccaacgctatacaacataccctgttgtataggcccaaccattctgaacaaccatcccggctgcacagttctatctccaaaccaggaatgtaccattccaaaccaggagctaaacaaattattaccagattaagcatcttttattatgatgagaggtgtgagactaatcacgaaagacattgttagacccgcccataaccgcgggcacggctattcgaatagttttactctggccagaggtgtaccactgtacccacaagacacaaccccacatcatgtcaccatgtgcctcaataccaccacggtatctcggaaaggagttgtgacaatacccctcgcataacacaatccattgcagcgcaccttcctggatcataatcacccccttataaacaaggca

SEQ ID NO: 20919 - DNA, 335 bp, Oryza sativa
cccctacctagactttgattatacacgtgatgtatataaattgttcacatagttcttttataaatcttctcttgcgattaaataaatatgataccttgaaatacttccaggtgaaatgcaacaatggtatatccatgcgcttgcggattacttctgtaaccataaatataccaggattatttctttgccattacttggaatttatatttttagtaaagtcgttaagaaataccaacacctagacttttgcggcccgataagagctatttccgctgcattatataatacagcttaatttgggggggcatgtgttaacaacggaattttgcatcaga

SEQ ID NO: 20920 - DNA, 1501 bp, Oryza sativa
ccaatgctggccaatttctgttatgtcaaatctggggttgtcaatttggctgcccaaacttataataaatttactaaagtatattgcatgcccagtatttacaaatgaaacacttcccaatttcaacaacatggtcagattttgatcaatattacttggaaaaaaactgagactataactgtgtgtttactacgtcaagaaaaagaactgaaaattcaaaggtcgaactgaaccaccgcaactatgagcttaccatgtcttaccatgtcgaacatacaaaacaaaaaattgaaatgaaccattacagctatgtgtttttcttcttttttcttcttcggggaattgcaactatgagtttaccatgcgaaacaaacaaaaccaaagttgaagagattgaaagaaaccatttttcgtttgcagatgtgtggggaaagatacaaagcagctgaagatttactgaagctttctggtcgtcttcgattgctcatggctcaggttttaaccattaataatactgcgtaatgagtcaatattcttagtgtataagttaatgatgatttaatgatcatgtgcgtacttcacttttgtagatcgtcaaggatccaaacgatgtttctgagcttccatcagaggagatgcaggattcagcggctgctcagtctgatgaagaggaggaagatgatgaaattgatgaaacggtgtatggtgaagacgctgattcgtctcaaacaagtgatgacgacgctgaatagaaacactgagactaagcgtagcattcttatgatgtgttgttttatattcaaacttgattaccccgtagtcaggtttgtatgactaagcaaccccgaagggttgcgcagaattttgacgaggcgaagcatcctctgaatttcacctcggtgtttctcccctgccttcaccttttaccacaacacggcattaagaccgagctaaagctcatatgccgtggttaactacttgatgggttctctcaagtgttaatgcctgcttttttatcacaccaacccaataactttagtccaagatttagattggtgatcactgcatcactttgatcacaccaacccaacaagtagtccatgatccaacagatggtgatcacaacatcacgttgactacaacgaccgtgtagccaacccggcgaaactttcttcgccttcaactaaacattgacaaaaacgacatgctaactggggcctcctgacgtgtccttccaacccccccggcctagtaaagagataaacgaaccgtcggcgccatccaatttgaaccgtcgccggccggtgctcaccagacaccagagtaccagacccattcaggccagggctcaccaaccccccacctttggcgtacctatttaaaccgctagctgccactctctccggcatccactcaagcagagcagagcagcggcaaagcaagtgatctctttagctcggatcatctctgcatttgcatttgcagctgctcgtcacggcaa

SEQ ID NO: 20921 - DNA, 1501 bp, Oryza sativa
acaaataattaggttttcaaagatcaaataaaccatgaagaagacgaataaataaagaacactaaaagagaaaaagaaaatcatggcgcgggtcgagaaggggtggttgctacgacctcaccttggccttcgttcgatcgtctcgtctcgtcggcgtcgccggttgcgctgcaacctgctgcggcggagcacgcggaagcggtgggcacttctccatctcctcggggagaggcgccagcttaagatggtgtttggttgttggggataaaatggagctaaattttagtccctcttaaaaaaatataagtccctattatagggacttataattttcccaaacagcccctaagtgcttccttctctactaagctgggccaagagaataggcccatgaagattagggctttctatccttctactgtactttttttttccaaattagatttcttttctggttttacaggcttcctatatattttaggctgcctatattttaagggtagagaattacaaagttgacaaatacttatacaattatcctcaccaataatgttattgctaatatgttttggtcttacttccttcgataataaatctttgacgttgatgataaattttgaattggaaatcttattatgttgcgttcgatattttgcacaaatttatcaaactaataaaataactaggggattttcccttaaaattttgtgcaagtatatataattgaaatataattatggatacagtatttgtaatttctactccagcggtccctaagtcaagatgcatggccaaaaataaggtgttttagggggggtggaggtagtacaatagtagatttacaaagtaaatttgaatcatatacaactcctatacaactcctagcacaccggcgagctggcgcccggctagtggccaaaacgacccggtgtgctagcggccaaaaatccaataatcttataaattcaatatcttcccaaccgtaaatccgtttgactccgttcaacttccaaaattcctcaaatctcgagatctatctaatggcacgcttagaggtcattaatagggctttattttcgccgtttgttgagttgtcccattttgcgtgtagtttcggagcccgaagacccgcagtgcgaggatttcgaggatcaagctcaagatctcgagcgaggcaagccacctttgaatatcttgagcctatatttgaacttaattatgttgcttgaaaaatattatgcattgataggatcacacttaatctgcttgtcccgtctgcaaggcagattggaggacctacctatttgttgcatttgatccttcctctgttaattgttataccatgtttccttgtaaccacctagtcacgcctcggaaatcgtgcactctgcacaagtatcgacggtcgccttcaaacctaaaatctgagtaacttcttgggtaaaacttgggttttacaaaagacttggaaaacccgacacctgggtcggtgcttgtgaac

SEQ ID NO: 20922 - DNA, 1501 bp, Oryza sativa
aacttaattatgttgcttgaaaaatattatgcattgataggatcacacttaatctgcttgtcccgtctgcaaggcagattggaggacctacctatttgttgcatttgatccttcctctgttaattgttataccatgtttccttgtaaccacctagtcacgcctcggaaatcgtgcactctgcacaagtatcgacggtcgccttcaaacctaaaatctgagtaacttcttgggtaaaacttgggttttacaaaagacttggaaaacccgacacctgggtcggtgcttgtgaactaaatgaatttccaaaaccgcggaccggggaacgtaccgggtgtacggtttcccgctcttgcacttaaggaccgtttccttggaatttcatccgaacttaagacaagtacgaccacatgggtggaatgggacacccctggctgagtaactagcttatcaggggagccttgatgccgagagacatgtggattcgccggggtggtgtcggggaggacccccgggcttcctggcacagtatggtctgggacctaacctgttgttggtctgggacccctctcgtcggcatatggtaaacctgtgtcggctttcgaaatgccttgtcatgaaagcttggaggtctcccgacgtggctgatccccacgggctgggtgatccgggttagtaatatcgtgtgggtaaagtgtaccccctctgcagaggtgaacaaactgttcgaacagccgtgcccacggtcatgggcggatgtgaggtgattcctagcgtagttttgtttgactactgccttatgaaattgctgttgtggaaaggggatcgatgtttggaaaatctgcagctgatgggatcagctaggcccgggtggccgtttgaaagttgttggcccgggtggccgtttgaaagttgttggccgggtgccaaccttgaatcaattcaaaagactgatacattgcacatactccgaccggacgagacgcattgtctcatccgtgtcgtttgagaagcactcacttagttgatttcagaaaagagttcaaataaaatcaattgcaaaaacaacagcctttccttgaagcctgcattaaacacttatttcccgtggcttgcagagtactcccgtactcacccttgctctatataaataatccccccagttgctgaagaagatgaagcggatcccgctgacgaggagttcttccaggagcaagccggctacgatgagttttagggtttcggcctagttcccaagtcgcgcctgtcggtgacatggggccgggggtatcgtgactagaggcttgggtagccgcggtcacccacgtggcctgaccccctcgggggggggggggtcgggcccgacggtcgtggccacccctccctctgtctccccgaggggtcgggccgctcccgtttcggccccgagggctggggtgccccgaccccttgtggttttggcgccacgtgtgtgggttaggtgagcacagcgggctcacctaa

SEQ ID NO: 20923 - DNA, 1501 bp, Oryza sativa
tatgtaaagcctggatccttcctgtttttatcctgcgcgtgcccctgcatgtttcgatgcttctgccaccatggggagtaggttagcagcgttgctgcatctgcatgtgccggatcaggtcgaccggaaagctgtttgcatagcaaattcagtagcctatagccacctctttgcccgtgtctgtacatgtaaaaggatcaactcgatgcacgaagctggcgaatcataaacagtaaaaaaaacaaagggaagtaagcaacacagtaattctacagacctccagggctccctccagtttgctaggaacatcagggtatagcacttagcattctttgtgcacacctgtgtgtcggccatgtctcctagccggcttagctcatgacgacaccgagtcagcagcatcagcatcagcagcagcctcggataccaagcgcgagcccagggacagcaaagggccgagcgcgcgcccaaagcgggcgaggggagaatcagcatcgtgtgcttaaagacctgccctttcttcccacatggacgaggggagagctaggatgcctcgcctttgtttgaattgctttcctggagatttgaagacagcaatggcagtgtgtggcaagagaaaaaaaaaggaaagccctagaggaggaggagcatgatgtaagccgcttttcagtttttaggggcaaaggcgacggtagaggcggatgagaggctctcccctctgccgccatgtcgtctgcttcgttatcctggggaagtgtgtgtgagtctgtgtgtgcctgcctgcagatgccctggtttcgcactttctaggattccttttcgggaatttggggggatgatagaaatgagaaatccatttggatgcctgcgcctgcacgtctgcatggccagtcggccactgcatacctgcagacttcacatcaggaaatctgcagagaagaagactagaagaggcagataggcagtgcctagatagaggatcagattagtgatgctgatactctgttgctcaggacaaaacaaattactaagacaatacacgccctgatcgttgaactgacttactgaactcgcaccattcttcttccgttccaagttccaacacagcaattttcagtagaaccaatcatgaactgatcaacagtgttcgttcgattttattctcacatttccaccgctgaatggagcaaaggagagataaagtggaaaagaaaaaaaaaagtaaacgcaaaggctcctatcacctcatctcctccatattctcgccatgcaaaaccagcacacgtacgaacgcacacgaacgcccgagagatggaggagaagaatcgcaaccccgcactctgtttttttcatcctctgctttgcgctttctcctcctcaaatctcctttcttccctctctacggtgttgcaccgcgcgcgcgaggccgcgaaaagctcccctttgtacccatctttcatccccccacgaaagcctactaccacccatcctccccgtagta

SEQ ID NO: 20924 - DNA, 1501 bp, Oryza sativa
tcttgtggctggctcagtgtaacccactagcgaaactacattttcgctggcggtcgtcttaagccagccgccagcaaaaattaatctttgcgggccaataaccgctagcgaaaatcttgatttttcactagcctttgctttgtggcggctccaaattccgccagcgaaaacccaaactgaccgccacgaaagatgattttcgtagaagtggagccctcttgctagtgcaacaactgtaagtactggctccatcttctgttgctgctgatgctgcttgcccatcatagtgattctcattctataggcgagacgagctgtagcagtgtactcggcgtgcattcatgacgcccatgatttggctcgtccgggtcgacaattaccgctcatcagctttattctccatgaggttgacaattgatcgactatttgtggcgactcccaaatcatatttattaccatccgatttggcatctactacttcactaacaatttataatgccatcatgcagctagtttacactacaaacctatcgctgcctagcaggggcaaatctagaatgagggcgacgaaagctcaagcctccacggctgacaataggaccaccataaaatccccaataaaactttttatcacatgcacatacagaatatacatacgaagaagagatatatatagctttctcaagtttactgaaacccctcgttattttcttcttgatccatcagtgtctagaatattaatttgggtcaacttgacggtccttcttagggtgtgtttaggaggtgagattgggaactcacctttcccgcacgcaaaataaagcaacacattttcttatgattaattaagtaatttattatttttttaaaaaaaattgattaatatgatttttaaaacaactttcttacgtaaaccttttttaaaaaaacacaccagttagcaatttgaaaaacgtgcacatggaaatgaagaaggtgagttgaaaaagatgggggaataacacagccttagacacagtacaaaacatatggatgtaactgtacaatattaattttagtgcgtctgctagctagatcgagtctgtttcgatcggttcttccattggtacacacacgtcctaatctatttataccgtgtacgtagcacaagtgcacaactggtgagattctgggctggacacatcaaattgacgagggccagcgggtctctcgtgcgcccgtgcttttgcctgtctctaaaacgttgatcgggttcatggtgccatgtgcattctatcccatgcactgcaatgaatgaacttaactgacaaccaccgtatcatgccaattgatagtagaagcagtattagctagctctggcccgtagttgcagaggagtactatactgactggcaagagctaaagaaaactgtactatatattcagtgctgtggcggcaggagaacgcacattccgctggtccaggcagagagaccaatggcgtcttgctgggagcagctgc

SEQ ID NO: 20925 - DNA, 1501 bp, Oryza sativa
ttatggaatagattaaatcattatatgtctataatctcaacactttgttccagctagcagaactatcgcgttccacatgaatttctacgtgcacaagaataagaccactggctgggagatgttttgagaccttggcagtagcagaaatccctaggtccaaaacacatttgatgggtctggatcagtaagagcaagtttaatagtatagccaactactagctgcaattcatctatagctaatctaatagcttattcatataatatatagttacatactacactattaatacatgatcccacctatcatacacacattgcgtcttggagtccgtgttacagttggctacaaatctatagcccgctgctattctctctcctcatttatctacttaaaatatgtttgcagatggcttatagcctcctattgtacctgctctaatgtggctgtacatggtggcaaacattttgcttttaacccatcatgatgattaggacggcagtgatcgatcatcggtagtcagagatccccatagggatacatgcatgcagtatgataaggagaaggtgatcccatgaatctgccgcggtgccatcatcactgtgaaggcaggcaacacacctcacactactacggagccagtcatccgtaacgggtcacaaccctcatcattaaccacaaagtgtgtgatcactgattattggtcactaatgtgaaaatctcatttgtgtctggcgagtagccgtcacgaccgatgatagagatatacttgtcgggccccaactctcaccgttcaccgataggtttttcagcccgtcgcagaggtgtcatcggtatcattatcgacatccacctgatcaccacccaatggggaagcgacaagcatatcttcgtgtccttcctcgttcacaaggctgctcgcttcattgccttccattattcagtgcctattgctcttcgtgctttgtccaacatgtgtaacccttcatgaatcctcgacagatcagatatgcgtcatgcttgtcctcatacggtgctggtaaacatcttctcattcttacaatcaaagcatggacaagtcatgcattgattgttccttatgttcttgtcttgctctacaacatttatgaaaccgacaatgccccttctaaactctgggctcactcgatcacttccatacatccaacttttatccatcggcaatttggaacaaaaaatagatataatatatgtagctatatatcacacgaaaattgtggttgtaatttatttgttattacctagcgagactcttgtattttttttcttcaaataaagagcaaaattttgcccctctagccctcccccctccccaacccgtcccggttagaaagacggtaagatatagagtagagaggactagggttggggacaaatctgtagtcaaggagctaaacgcaaatttgttgccatggtggatttctaagttggctaaatgctaaatttaattggtgaaaaactagc

SEQ ID NO: 20926 - DNA, 1501 bp, Oryza sativa
gtcggaaggggttctcgaacatgaaagagaaaactaatttcataactcgtatggaaagcacgagacgaatcttttaagcctaattaatccatcattagcatatttgggttactgtagcacttatggctaattatagactaattaggcttaaaagattcgtctcacgatttcccctctaattgtgcaattattttttttaatctatatttaatgctccatacaggtgtacacagatttgatgtgatgttttttgaaaaatttttgggaactaaaccaggccatagtagcttacaaggttcagagaagaaagacaataagagacagcataaagactaaaaaagacagacaaaaggaaaaggaccaggttttttgcgcaacaggagttccacactatcaagcatatggccttccatcagccgaagcagaagacacacaaaaacagcccttcaatttagtttagtctggaccaaccttatctatacctgagtatgtgcttttacaacattttcatacgggtttaggtaaggtgtctacattctatctggacataaccgccggaggatcattcatgcataaaacgccgtcagaaggaaaagtaattctggaccgcattatagaaaatacttcctttatgacgccatgcgatgaacctccactagaggcatccgtgtctaagatagaggagcctttaacagtcgaatcacaccctgaaccttccacatcgaccgactcgactgatgaagaagttcccgagccgccattcgttgagaataaagaaattcagactccggatcgtgccgcaattccgttcagggatggttttgatgaagattacggcaacaccctgaattatttcagtaaaaagaagccgatcgttcctttgccacctaccgatcctttggaacttgggttcttaagggaaactgtccgggagctgacatccataatgagtgacgaatggctaagggaggcagagctttcatccgaagtaattctgataaataccgctccccgagttattccttgtcatctagaagggaacgatgtcagtatcctttacagcccaactgtcggggttaatctcgtcttcgacgcatttgcattcacttacctaagcgataaagcaataaccccgacaaacaaaatttgaagcacccgaatggaaatttttcaagccattcgtagaaggattcgggattgtacaagacataactgtctactttgaagatagggaggcagtcttggatttctatgtctttgaaatccaagactttgacattctgattgagctgccgattgagcaactcatcataaacatgccccgatcagatagcctcaagataactttgggagggaacgaatttccagttccattatcacgagcaaggttcgccttgaccgactcactcctagagaatgagtatgcggaggaggttacggcagttgcccctcacgagtctcccgagacccttctggaaaatgaagcggaacccaaagagac

SEQ ID NO: 20927 - DNA, 1501 bp, Oryza sativa
cttcttgagctgcaggttctcctgacgcagctccaggatcttcatgttgttctcgaccatcccacggcgcaccatctgatggaagtcgatacgagccgcgtcgtacgcctccaccatgcgcgccaggtgcatgatggtagcgtcatcctccgagctagcatcccggaaggtggcgtagtcgcgggctcctccgcggcgagggtggtagcggaagggcgagtgctgcaactcgtccgggtagcgctggtgaagagtgccgatggcgaggagagcggcgctctggcaagtggcggggaaagaatctccacccgcggtgactgccaacgaagtccgctcgggagagccagcgaggatcactgcagtgacctcccaagcagcgtggggctctgcatcgtcaccctcctgctccggaagcggcctgccctggtagtccaccccatgtggataccccaggacaacgcacatgccccgcagctccaagacgaaaccagtcatgtccaaaccacgacgggtgacgctgccggccatctacaaacaaaaagaaaagcaacactttaaaaaggtcagattttggagataaatgaagcagcaagacagagaaagactagagggttttcacaaataacagaggatttttatttcgaaaatactgctaaggcttgggatctacggcttgtcctagggtcaagggggctctgataccaacttgtcacgaccggaaataacccaacgggcgttccttacgtgcgtgcattaatccttgtcccaggaggcaaggtacaccaaaagttgatacaattcagagtttaacaagcggaagcgtaaatagttaatttattacatgggcagcgaaggcccagcacacacaaagacaaacgagaaacaacggaagactagggcgacgaccacaggcacttgacggcaggcacgagctagacaccaaagccttcatcctccaggaacccctcttctgggtttgggaaaaattgagcaagactgagtacaaccaccgtactcaacaagacacacccacaagtgcagaataaatgcaagggagtacaaaggagttatactataaagggttagggttgcagtaaacagcatttaaagacattagttgctcaaagctattttgtaaacacgattctagaactatacaattattaatcaaggccgtgaacccacatgaacctgccttaacccaaggcctacgatgattcagaccgaactggcaacccgaccctgggtcccagctcgtcccaagccaacccaggccaaccattccacattttagttgttaagcaggttttaagaattaaaacactaacttgggtacattgctcggcttgcccataaccgagggcgcggctattcgaatagattatactctgatcagaggtgtacatctttacccacaagacacatcttcctcacgtgtaaccacgtgccacataccaccacggtatatagacgaaagacgtgacatagtttccaacccatc

SEQ ID NO: 20928 - DNA, 1501 bp, Oryza sativa
actgtatgtttcgtgcgtcctttccaaagtctttaaattttctgtcgatgtttcgtcactgcgaaccatcggcggggtgtctcggcatcccgtcctgttgacgctcttcagcgtgccatcgcatcattgtagcattccccttgttcttgaacaaacgccttagccatggtattatagggaaataccacatcaccttagcaggaattctcttgcttgttagctgcccgtcaacttctcctggatcgtctcgtctaatcttgtatcgtagtgcattgcaaacagggcatgcttctaggttctcgtactcctcaccgtgatataggatacaatcattcggacatgcgtgaatcttctgaacttccaatcctagagggcagactatcttcttagcctcgtacgttgtctcgggcaatttgtttccctccagaagaatgttcttgacgagtttcaataaatcgccaaatgccttgtcactaaccccattttttgccttccattgcaagaactccagagtggtatccaactttttatgcccctgctcgcaacctgggtacaacaatgttctgtggtcctctaacatcttgttcaatttatggggctccttttcactttcgcagtccttcttggtgtcctgcaacatctaaccaagatcatccgcaacgtgttttacttatttactatttctaaagttttaaactaattttaatgtgttttacttcttttaattttcattttagtttgtttctattatttaagattaactttcactatattttccttctcaactattttataaaaccttctttagcaaataaactaaatttctatatattctttcttccccacacaaattttctctctcatcaacttacaactaaattttggagacaaaaaagtgtgcaaaacatagctccaaatgtaatatgacaaaaaaaaacattggaggatgaatttgcaaaccttttaggcacctccgatttgtatgtaatcaccaaaataaattcactagaaattttggcatgacctcccctcttttttgaagaaattttgaagcttgctcgggcagctggaggaggaagaagacatatatatagagaggtgggactttagtcccggttggtgttactaaccggactttagccccggttagtaacaccaaccgagactaaagttacgatctttagtcccggttggtgttactagccaggactaaagatccgggggggctgacaagccctgacagcatttgaaccgggactaaagatcaccaaccgggactaaagatcaaatatgcccgtaactctttttaaccggggactaaagatcatctttagccccggtttttattgcatccgggactattgtggaattcggccgaccgacgaaagatggtttctccaccagtgaatgtcggataaatatgaaaacatagtatgtgatacaatcatctctatgattgcctctaggacatatcactaacaatatatgatagtattatccc

SEQ ID NO: 20929 - DNA, 1501 bp, Oryza sativa
ggcgaagcgcgcggcacggcggcggcgttgcgcggtggcggcgtgtaacatacctgaattttaggattaaggaatttccatcaaaactagttgaaagggaagttcttcaattttgtaaaccaaaaatttccattttaaacctaggtggagttgattcaactcttgcatgaataaaatttgagaacaaattaaaaactttttcatctttaacctaggacttggatgcaacccaagtgaaagcatgcatacgtgcataaatcatattttgacttgagtccttcttatgcatttggattttcgatttgcatttcataataggtctcatgaatattaactaagatctagataaacaactaaaccattagggcctagtgttaactaatggaaaataatacataaaaaccatacaccttaaaaaaaatatcaacatggctaatgtcaagcctcacaaaactaatttggacatccatctgaagacatgtcatgaacatgaaagtgaacaaataaattatatcatatagggtatattctatcttaatcatctctataagcattctcttaatttaatactaaagtaaacttatgcataaatagggaaggagcttatgacatgtgtaaggtaaactgtgattctaacatatcaacatcacctcaggttaatgagagtccaaatataacttttataaacatttacatgcatttaggaaagagaaacacatataagacataagtcctgcgaattatctaaaataattcatgcaagataaaatcatgggaaaattcatgtaggctctactcaacacatacaactcactgtaattttggtataatttaataactaaatttggtacctcaaataaatcagtcaaactaataaaaactagattaactgtagttcttaatcggctaaaaccatactttgtctaaaagtgcatttaactgcataaaagtgtataagtaaaataatttattcaaatactaggtcatttatcatgaataaaaataattttttcagaatttatcttctctgtttaggtctcctaaaaattcgaactagtttccaaagaacccatattcctctaatttctgtgagtaatctatccataatttttgagtgcaaccaaagaaaatggaaactaggtacatacacctacctccagtaaaatcaatactagctaatctgatcaacacattaagtattgaagctacaaaattagaggagaaaataattccggaaattcgtccaaaaaccaagctcacccatgtttctgcctacacatctctcttccacctagtttacttcgacctgggcccccttgtcagtccctctggcttgcccttcctctgtgcaacttccctagctgaccgagaaacactgagagggagagatcgagcgccgaccggctctagacgccgcgcgacgcgtggccacgacgtgtcgacaccctaaaaacgacgagctccatttctgcctctcccagacgcgtcgccactcttcacc

SEQ ID NO: 20930 - DNA, 1501 bp, Oryza sativa
agtgagctttggcatcacagctagacaactatcaaaataggtaagcaacacctagctaatcacatcatatgtgactcttgtgctgttggggtgacatctccatgtccaacccaacctatgccccaaggtccaaaactgttttgataaccttgtcaagtaaaccaataatttccgcatatagatgttcgacatctatcctattttatcatgataaaaagtgacactttgctatggcaaacccatcacatatgatcacaaccataataggtgcaattattggaagagcataaattacacttaatttttctgaggtaatctatcctaccatgtcatatcaaatatataacagcaataaagtaagatagatataaaaaccccaagcgaaatctaaggggcaacgcacacgccggttagcgggcggggggtcgaggggggagccaccccccgcgggtttcagggcagctccctgaaaaggtcacggggtacatagatctcatctacgattcgccatgtgaaaaccttaacggtgtaatcaaattatgccgaaaccgagtcaatctcattggctcgtttttctcattggcgtgcggttccagtggacatcggactatcgcgctcggccttggtgagtactagacattccagtgaagtcaccaacacacataccgattgatctcatcaacccatcggctatcggttcatctcatgttccgatcacctaagaactcatatacaacataatagatctcatctactacacccgcacatcaacaatatgcattgatctagatcataaactatacatggcggctttgataccactattgggatacgcgtaggctacgatagcataaatcaaaattttctatcgcgtaaaccaggaaccatgcaagtattagatcatagatcgttaccactcgatacgctgtgcagcggaagaagacactgagaagtcgaaggaactctcacgaagtagcgcacgttgatgtagaggaagtagtaaatcgcactggctcgaccttctcctcctcgtgcgttctcctcgccgtactcccacgccgatcagcacctcaaaccagcggcgcctctaccggtatccacacgccatcaccaacatgtgtccgcattattaatttggtatctctataccatgatccatgagacatgatcatcaattaatacatgtgctgatcatataaacatatttgttccacatatgatatttgatcagggatcctttagaaatagtaacaaacaacataaagagtctcatgaaagaatcacatattcattaaccaataaggagttatctatttcaaggaacaatcactggtggagaaagcgtttgtagtcccggtttgtaaccccctttagtcccggtttccaaaccgggactaccaatctgggactaaagatcgctatctttagtcccgggtgaaataaccgggactaaagatcgagctgacctttttttttgcatggcccatttgctgcatggttt

SEQ ID NO: 20931 - DNA, 1501 bp, Oryza sativa
accacaacttgtacatactttattctttttaatgaaaatacactactaggcaaagctctgatagttcccggtcaaaaaaaacttaatcaccacaaatcattaaccagtagactatgtttcttgtgatgaattttttttttagtaaaattttatcttctaacatgtgctaatccgtatagtattggcacatgtagtaatgatactgtaatggttgttattgtacacttgaaaccgtcttgttgcactatcgcaaaaatattaatgcactgctacagcaacatcaccatgtgaattatagattactagagtaacataagacacatcatcatttaattctcatgagtagaagccaccgccacactattgattttttgtccatacaactaccattcctaaattatagtatttactctcacatgttactaccagttgtactatgtgttattccaaacctatattaacatcgtgaaataaatatagtaacaaaattatactgtagtaccaaaatataatcccaatctctctttgcccctcatgatccctctgctctatcttttcccgatatatctctctcttcccagaaaattatcctccctcccctcaagaaaaccagcctcctccctccatctacatactcccccttccttttagcagtaacgctttcagggaactgtcgtaactcgcttggttactacaaaatgcatatgttcaagcactagtgttactgcacaattttcacgaaacgaatgttgcgtccacttagggatttgaccaagattggatacgatggattcgttttgactagtattaagcaaggtggttcgcactactacaggatagatttttctggacgccgcccccttttgtttccatgcggtctgtaagtggaaccgcatgggacaataaggggacaggcgctaggctttcgcccacacgggaaaatcgattttcccgtacagacgtcctaatccgaccgcacgggacttaagaggaccgcacggaaaaatcaatttttgtgtgtgggctttttaagtggtacacacaggaaaatacctccctcctttccctccaacccacttcaaaattttcacatcctctctcttccttttttccgtttttctccctcaaccactcccatctctctctctactttatctcttccttttattctcctttcccaaccacacacctggcatccccacacctttccccaccttaactcctccccttcccctctatcgggccgacgatggcggcggccgggcgcggcggtgaccggatgaggcggtgaccggatgagatgccgaacaggaaggcggcggcgagacctcctcctggtcgtcgtccttgtcgcgcacgtcgtcgctcggctccatcgacgacgacgctatcgttgcgtgcgttgtcaaggcggcaagcgggcgtcgtcaaggcagcggacattgtcgtcgtcaaggcggcggacgtcgtcgaggcagcggccgtcgtcgttgtctctgcg

SEQ ID NO: 20932 - DNA, 1501 bp, Oryza sativa
agccacaaactaagccttacccagtagacatgtgaaagtacggtagtgctttgcaacagaggcccgaagaccggtccttatagtggccgaggtgcttctatcaaaaccacgcacctcgagcccaatcgaaaaccattttgggggttttgaacagaggggaaggtgtgtgtccatttccacatagtccaaccattctatagtgtccaaatgatatgagcattcccaaagtctaaggttataaaaccacctaatgttgcctaattaatccgcgaagcatctacctaagttcatactagtggaaccatgaatagagtacccactagttggggttttatttgtccaagggtgaacaaggtaataataacaatgacaataataataataaggtcataacaaagataaataggcatggctaaacaaaacagtgataacgcgggaatttaaataaagcgataatgcagtaatttaaaccaaaataattttataacctaggattcaatatgttcaaggatgatgtgacttgccttgctcgctttccccaacgtcggcttcaacctccacgtagagcggatcttccgaagctgcagcgtctacacgaccaatgaaaagaaaaaggattttactctaataaactccatataacaagaagaaacaaagtacaaaaatgggttcttgacttcataaggaaaaattagagacttgaacggtccaatttcgagttcaaacggccaagttatggccatttgaagtttatatgctctttaagtgaatatttgtgaatttcttcatttaaattttaattaaaaatagggtttattgcgtcagccgaggggagggggcgcgcggccgggtccacaggggtggtgggccccacgcggcagcctctcggtccacggtggaccgggagcacccgcagctcaccagccggcgccgtgggccccacgcgtcagccgcacctgagagcatgggcggctgacggccgggccccacgaggcggccacacggcgcgctcggaggcggccacgtcggcgcggccggcgggaggcagcgcccatgcccctatggtcgccggcagcggccataggcacggcgaagcggcggccaagagaggggaagggaagggggaaagaggcggcggtcaacggctcaccccgggttgacggcggcgacggaggaggcggccagagtggagggaggcggtggcgcggctcgggttgacggggacggtggcgttccggcggtcggcgagctcggcaaggcggtggacggggtcggcagtggtgcggcgaagccggaggagacgacgccgaggcgggcgatggtcccggcgagcagatagggccggccggaggtcaacggcgacggtgcgagctcgattccggcggggagaaagggcggcgagtggcggaaacagacaagggaggtgcggggagggtttatatagggttgggagtgagagagggcggccggcggggaaggaaaccggtgcgggagatccggc

SEQ ID NO: 20933 - DNA, 507 bp, Oryza sativa
atgaaacacaaaatacaagaccaacttcaaattcaattcctttgccaaaattcaaaggaggccaaagaacagagctgggtgatgtttcttgagctgggtgatgtttctttagataatgactgagagttatgcacctttcaacatatttctcaacaggctgtgcactcgcttctacagtctgatgcaggtgctatcaatgaatatatgtcggccaattcaatctttagacaccagtagtaaatgacattcgtagtacaatactactattggactattggttggctctaattatcagccgcgcaaaatatcgttagagcaagtttaaaactaggctataatgaactataatcttatatggagtacagacaatttgaaaaataaaaatgattggtaaatgcatacagaggtgtgcttctacgctcctcaaccaaaaaaaaacgcacgcagagggtaaagcatgtcaccggctcagattaaaagttatcgaggggtatttccgtccatagg

SEQ ID NO: 20934 - DNA, 1235 bp, Oryza sativa
ttactgcaaaactcaacccctatattattatccccttgtactcccttgcattaattatgcatctccggtgtggcttgctgagtactgtggttgtactcattcttgctctatctttctccccccttcagtaagagaagctttggagaagaagtcttaggtggagtcctggcttataccccagttgagcgcctgtgaagatggagccgtaggcccgctagtccgctgctgtttatttttgattgtcaggccttaagtgcctttgtaataatgtaaatattatcgatataataaagatgtgtcttttatatcatgtttgtgtggtgtaccccggcttttcctgggacggggattaatacactagcgttcgggaaaaggcaattttcccggtcgcgacatttggataccttgtgagctgtcacttgggcttattactcttggagatcttctcatagacggttaggtgtttcccgtgagcttccaaagatcttgtggatgtcccgggaaagtttgtgaagattttcctcacctccggaaggaaacgaggtaactgagtaaagattcttgtgctgagttttcagaggttgtcctaggcagagcaacttgcacttgtggtcttttctagaagaaattttgagttggatcttggtggtcactcaattctagaaaatgacctagaagtgttgagttgaaggttgtggatctcttctgggatctttgcataagtgagccaaggggttaatcgagacccggctctttggagcacctcaacggagagtaggattcgtgtgatccgatcttcgggaaaaaatcgtctttgtctctcttgtgcatgatctttgtgtgaatctgctgatattctgcgatctttatcttgttcccctatgtgcctaaacttctcttgctaggacctgtttttcatctcagtttaatttatctctgctgcccggaagttcctggctcaagaactccggaagttctgggctactcatgctgcccggaagttccggtgttcatcaccaggaggttccgggccctgtcaattgaaccgatgcaattgttgagaaaatttcaggaaagcctattcaccccccctctaggctacatctctgcacgttcactgggatcgttccctgtgacatgtcttcgattataaaattttttgccgcatcaaagcaaaaatcatcagcctcttcgttacgacccgcgacttccccgtgaaaagtccatatcttgta

SEQ ID NO: 20935 - DNA, 1501 bp, Oryza sativa
gttgacagctgcttcggcaaatgcgacattgaggttagtcattgtctctcgcagccgcatagcccattggttgacgtcggggttcgtgaccgggtcgaaaggactttcactcaatatcgcatctaaggttcgtagctgctgagtgagtgttctcgctgctgtggacgcgcttgtttcagtgttgtcaaccacgtttacatcccgtggtgactccgaataggactcgtagtcttccaggaggtgtagcacaaatggttcattcggattagcttcgacatatcctacgaaccgatctgatgtcgtcatcgcatctgggtccctgggagcacatggagtttgaactcgcagttgttggacacgatgatgcggtggtctcaaagttgtgagaaagatcctgcaacttgtaaggtcgtgagacctagatttgtgaattgggcgttatgtgactcctgtcggtgaagtgcgttgaatcccacactcctagcaggcgtagagttcagctttcacgtggagtatcaccgggcaatcctcgagaatatacttggatgtcagcttttaggtagtattccttgtcagctctggtttttgtacaagggacgaaattcggccatttgaggatttttcccaagtgttgggaccgtcgatgttccgttctccacttgagtgggaggaattgtcggcggggcatcgtttctcggagtcgtaaccatgcctctctcgttcccgatagtgtttgggccagtcgagatcggtgtgacgatatagaccgaaaagacgatggatccgacttgattccacaccagcgatctcgaggcagggattccttgatcgacgccagtgttggaactgttgtcggggagccttgaagtcataccggtagatccttgagcaccaagtccccctacctggcgcgccactgtcgacgagtgatactcgcggaccggatgagtagagtattggggtatgttggaacgagggtctacgtagttcgacatcaagcagacaaaagacaaagtttatactagttcaggccccttatcaggttatagccctagtccagtttatatgagattgattatgatgagaacagatgacaaagatactagtcgaaatagagggtatcgacgagatcgtagtcgaggggttcgacgaaatctcccgatgatttggctccgcataatctggcttcgtaagcgttggtgggtgtgttggcgattgaattcgatgtcttgaacccttcccagggggtcccttttataccgtggatcatcttgatccccaagaaaggtttgacgatatcggacctagtatggtattacagaaaatctatcccttccgagtaggactttggaaatcacttgactcgtagagatattttccataattcgaagtggtttccacgtgacatttacgggaacaatccgtatgcgcgaaggtataccttatcgatatatttcataagtcgtaggataggaggtatgccttatctgtaaccctgaca

SEQ ID NO: 20936 - DNA, 1501 bp, Oryza sativa
accgcgtcccgcgaaccgcgatcttcgcgatcatttggactatcggcggagggacaggagagatcgcgacaacaaccggtgtcgttctccttcacgccgtggcgataacaccgccgcccaacgacatcgccaccacactcctccgcggcagagaagggacgacagtcgaggaggcgccccaaatgaagatcaggatcgacgggcccacagcggccaccgcaatgacgctaataatgacaaccggcgagatcagggagctaatcgccgagatcaggagcaaaactgtggcaaccgacgagatcgaaactcccgatctcccgctctcggtcgagatcgaggacgagatcatcgttcgagaagccgggctcccgaacccagcaacccctcatcgtcgtcatcatcatcatcagaccagcctcctcgattacgtcaacatcgcgggccaccttttgctataaggcacagatgcagggcattcacgctcgaacttcgagatgtgcggtggcccgagaagttccgaccaggtgcaatagagaagtacgatgtaagcacagatccgaaagaatttctgcaagtctactccacaatcctatatgccgctagcgcagacaacaacatgctggcaaattacttgccagctgcgttgaagggatctactcgttcatggctggtccatctcccgtcccgctcgatctcatcatcggaagacttgtggcagcagttcgtcgccaacttccagggaacctacaaacgccacgcaatcgaggacgacctacacgctttaactcagaaccaaggtgaatcgtcgagggactatattcggcgcttcaatgagtgcaagaatatgatccccgagatcaccgatgcttctgttatccgcgcgttcaaatcaggtgtccgagatcgatacaccacccaggagctggcgacacgacgaatcacgtctgcccaaaagttgttcgagatcatcgacagatgcgctcatgcagatgatgcattaagacgcgaagagggaaagagcaagacgagcgaagagaagaggtcgagtaacaaggatgcaccagaatcaagcaagaagagaagtcgtaaaagtgggaagcgcaaaccctcgggagaagtccttgccgctgagcaaacggacatggttgagcagtgcagtgtgacaagcggagcctcgacattgttctactcaaaatgccaggaccaaaagggacaatcactatccagggcaatgctaaattggcagtgcagtgtgacaagcggagcctcgacatggttgagcatactcccaacccacccaccacaaccgagcagcccaagaaagtgagcaaacccagcaaaaagtcaaagccagacggtgctatcaagataatcccgttgtctagctccaaccccgacaagatggtcaggataggggctacactgggtgacaaataggaactcgcgctcatcgccttccttcgcgacaatgcaaatgtgtccgcttggcaaccgtacgaca

SEQ ID NO: 20937 - DNA, 1501 bp, Oryza sativa
ttcaataaatgaaagaaaatatataattattagacagcaggacagacaaggtggtgaataagtgtgaaaatcattgatgctgagagtggaaggtgagtattgttatgtaaatgttaataattcaaacaaaatctgtttgcaaagtgcaaaactgatggatgctgaagaccaagcagagcttctgctctccaactctccgttcctgaagaaggaaacatgcaagaactttgtagttcctccctcagaaatagtagaagtgaaacttgtagttacatctttcatggcagataggctttctttagcttgtgatatactaccagatgattcatatgcgcttcatgcatctcaactcaactcagctgcgcatttgctttccttattattatgttgtctctgaatctttctgtattacctgaatagagcaatgcaaatcgtcagcatttctaaagttcaaggagaacacaagttttattttatcctcttgaacaagggtgtagggatgtttttgcacaacacgaattaataataacataagctagcttgaaatctgtagtcaacagacctcctaattaattaaaacacaggcttccgtcacacaatcacaacagtgtgcagaacaacaatcaaatttgtgctgggccaaagaatcattgagatttgtgcaactgcctatcattgagtcattggcagtggtcttgtggtgcccatagaagttcatgcagagctcgatcctttgtgacgtacaggccataccacctagaatttcttcctacaagaaatgttccatcttgtcaccgagctagtggttgtgttcgtaggtgatttcatagaacatgaattgtatgctagtacagccaccattttcctaatgcctctcattcatatcagatatgacacacttgaatcataacggaactctttcggaattattataacggaactcctctattataatccccacgcagctccatcgtttttccttgtgtggtttttgctagtttacttctaccaatactggtatattgtgatgagagtaagagtggcattcattgtctctcgcttttaccagtaaagtacagctcattggtccaaagatgggttgatcacttgctgtgatattaattgtgcttaaaaataaggacaaaggactgaacaaacaagatttgtcacaactcacaagaaaggaaagacgaaggaacatccctttggaacattgttttccatgatgtgcgaaaaaggaaacaaaaaactacatcgtttgcacaattaagatgatcgataccaggcagtgcaagagacctattaattattacaaattattcactacaaaacctgaacaagctttgggtggttttccaacatatatagaactcatacaagcacaaggcatcatgtgcacaggaccccatggacatactctgccaccatcctagtgatccatgacccttggcaaatgaggttacctcaaccaactaattacttggctacgggtgttccaata

SEQ ID NO: 20938 - DNA, 1501 bp, Oryza sativa
tgcatctcacactactataatagtatgagaaaatgtaataagcttgtatactatgacgatagaatgcttacaagagagccggccactattaatgtgtattgtctcataccacagctactaattgaagcaactgaagtattttaacatataattttagtatttcagtaattaagagtggaactacagcttaattattttcaccatttatatgactgaaagttgctgcatttttaatgtcaggtacaccttaaattacaggattagaaagggttcagccaaagtatcgtaagctttttttgtgtccacctcttgcggtccttaatagatctttggtaaactaaattattgatgattttactatccaccattgtattacaagcaacataatgatagcattcacatgaattctgttctgtgagcaatataattggtgtgctatgagcatgctttctgctcttatagtaattttccttcggtctggggtgatgtttctctggatctgttacccgttggtttatttttccaattagagttctattggtaagctttatacagatgccttgcaacatatgccgaatacctttaaactatggttgttagttgaacagatccatcagtatgtgtagctatttacttaagcattctaagtttctcataaatatcctgttaatgtgattttctcttaaagtatgatataaccactattgccatatacatatgttaattgtcacgccccgaactagtcccgaccggaactagcccgtgacgctccaaattaacctgttaatcgataccagtcccaggaaacagtgctagtatcacaggaacagaggtctctttattatagagtaggagtacagtcatgttgggctgcggacagatcccgagctcacaactgcattacaaaagggaagcggaagccaagacttggaccaaacatcacaggcgcgacttgggaactaggccgaaaccctaaaactcatcgtagccggcttgctcctggaagaactcctcgtcagcgggatccgcttcatcttcttcagcaactaggggggattatttatatagagcaagggtgagtacaggagtactcagcaagccatgggaaataagtgtttaatgcaggcttcaaggaaaggctgctatttttttttcgattgattttatttaaactcttttctgaaacaactaagggagtgcttctcaaacaacacggatgagacagtgcgtctcgtccggtcggagtatgtgcaatgtatcagtcttttgaattgatcaagattggcacccggccaacagctttcaaacggccacccgggcctggctgatcccatcagccgcagatttttcaaacatcaaacccattccacaacagcaaatttcacaaggcagtagtcaaacaaaactacgctaggaatcacctcacatccgcccatgaccgtgggcacggctgttcgaacagttttaataacctctgcagagggggtacactttacccaca

SEQ ID NO: 20939 - DNA, 1501 bp, Oryza sativa
cgacgtcccgtcggtcgcccggctcgtcgtctcgtggcgccacctccgtcgtcggcatcgctgcggcgtgttccacgccgtcctcgcatctgtgcagctgctgccggctgccctcgtcgcctcctcgccggccccggtcatcgtcgtcgtcgtcctcctcttgttgtcctcatcgtcgtggcgttcgtccttccgtcaagccgttcgcgttcaccgcccgcgtttcgtcaagtgtgcagcatccccgtcgtcgtcttcgtcctcggctccgcgtcgtcaagccttgtgccggccgcgtctcgccttcgtccaaggatcaccgccgaagtcgttccctcgccgttcgcctccatcgtccccgagctgtctccgccgcgcccgttcgtcgttgtcgttcccatgcctcgtcgcgtggtggtaaggatccctctccctcgctgccccgtcctcgtcctttcggtgccgcccatgcccgttgtgcggttgtcggccccggtacccgtgtatcggtgtcggcagtcgttcgcttgtgcgtgtggtgaccgtgttagtgtgtccgctcggtagccgcgtggtttccacgtgtgcagcccgtgtggtgtctagtggagttcgtttgtcggccactcgcctcggttgacacacgggatctgcttctgtcgacccgtggaccgtctctgtgtacccggtctaccacggtcctttaggttgacatgtggggtccgcatgtcaacagcgcagccttcctgtcttttccagactagcgcttacacatgttttatagttgcaaagcctaattacaataatccgtaaatctccatgtaacaacattaaacttcggatgatcatatcttggtcatacgaactctgaatcgacccgttcaagtctcctaatgtttgttataacctaaagaaccgtgtgctttctttttatgtattgttattgcttctttataggcttgtagctttgcttgtgtgcttcgcgtagcttctgtcgttccggaggttcttgaagcgtggttcgcggtcgtcaccgaaggttcagcaggccgttctctgtgagcaaggcaagtcacatcattcttgagcatattgaatcccagtctataaaattattttgatttaaattaatgcattatcgctttatttaaattcccgcgttatcactgttttatttaaccatgcctatttacctttgttatgaccttattattgttattgatattattaccttgttcaccctagaataaacaaaaccccaactagtgggcactctattcatggttccactagtatgaatttaggtaggtgcttcgctgattaattaggcaacattaggtggtttttataactctagactttgggaatattcatatcacttggacatattggaatggtcggattattgtggaattggatgcacacctccccctctattcaaaaccctcaaaatggttttaggctgggctcggggtgcatggttttgttagtagcacctcgg

SEQ ID NO: 20940 - DNA, 751 bp, Oryza sativa
accacatggtggcttgtgggtgcatggttttctagtcgcacccatggcagttaaggccggttcgcggattgccctgaagaatttatcgtacttccacaagccagcgtgggcacgggctgggcttgtagtgtagctttcctctagtcgacgcatccaggcaagggtgggcgtgatggagcggggcgggccctgcgacggcctctgtcgcttccggattcacctaggcacgagaggggactgcccgtcgcccgctggggacgggggtgaaacctgaggtgtggtgtgcttggctagagggggttatgcgaagggtcctgtcacggcctctttccggtatgtcgtggtggcatgtcggcgcacggaaacgtgtcgtggggctgtgtcttgtgggtacagttgtacacctctgatcagagtaaaactattcgaatagccgtgcccgcggttatgggcggtcaaccagattcaccgtgattagtctcaccctagtgtaatctgttgaatttggatagtttaggtggatggttgggcctgtcgcaacgtgggttagcgttggacagcggatgtttaatactgcttaattattacaactgttttcgcattcaattcctgtttataaatgccagtatttatgcaaatgaacctgcttagctatcccttgttaaatccctgcatcatacctctattccggtatgacttgctgagtacagtgggtagtactcagtcttgctctacttttccccccaacctc

SEQ ID NO: 20941 - DNA, 1501 bp, Oryza sativa
gaggggatgttcccttctttacttaaaaaccatataaacggttatgaaaaattctgaaaaaatttggcaacattcatacaacacatatatacaactccacaaaatcttaagttcaaactcaactcacatgtcgagatataaaaaagacaaattcagcatatgaatagtagcgtactgtttatatctaaatttgtcttttttgtttctcgatgtgtagatcgaagttgaaactgaattttcgtgaactagtaggtatcattatactatacattgtcaatttttttcagattttttcacaactatttacatcaaatttagaagaaaaagatatacgatgggatatcccctcgagggattagaatccactcccgtagtagaccgttaaaaattgtcacgacagtcatggtgaccagtagtatggatcttcccttatggcttacttcagcggctggctagctaccgtggctagctgaacaggagtaccttctatccttttccccaacacgagtactagccatggcacagcattgtgcacattttttagataaaggaatatattattccggtctctgcataagccatgcactcaaccattcattattacaaggatttccagtttattcacgagaagctggaggataggaatatacattttgcagctgagagctagctgtggccgccagtggaagcaatttgtggaggtccccggcatcggttgtgttcaatgattgtgcgaggctggattagaaattagctacatctgggatgatagtgaattaaaaatctagcagatgcagttaccaaccattgcctaatggcatgatgagagattaacaccgatacaggtggaagcattccatgtatatgttaatagttctttcacagattggtagttgttctaatcaggaaaagaaatatagtgctgctcatcttgttgcaaggcaattcatctctgtccatttttttcataccattacaaaacctggtgacctctgtatatatgcctgactgcctgtcagtggtggttgtgcccaacacaattaactttccattgcatccactatatgcttaaatgatgatgcggaagagagaagagaagagagaggagaagccacccctcacgcaaggggcaacctccacacaaacttcaagaacaagagaaaattagaggagttgattggtggcaagtgtactgggactagggtattaaatgcaatacatctatataggctagggatggataattggataaaattggaggtgaccaccacatcttttataaaacttgcccttagttctgaggagacgtactacggtacatataacttcaagtcatataaaagtttcaaaaccttaccttcattatttctagctctccaagggtgagtaattaatggtacaaaaagtctatgtagaaatcatagcacatttattttcactatttaattcagatcaacccaagaagttgatgatactatatgagagaaatttaattatgacc

SEQ ID NO: 20942 - DNA, 1501 bp, Oryza sativa
catgaatagataaccaaattgcactttctttctgctacacatgatacttaattattcaaatggaataagaatcgagaaacaaaaacaatcgagaaccaaataacataacaacattatgtacttaaaagttaaccaaattgaaacctgaatagataatagaaagttaggcatcatataagcacgaaataatcaatattaataattactcatcatgttaataatcgacaacaagtgaattaaacatagtagtcatccatttattacatgtcaatcatattcatcatgcacttgccttaattgaatataacccagcatcacgccagcggcgccaaaaccccccagacctaaaagaataaaataacagtaaaaacctacttccgaactaacaatatatatgctactagctaaatactccatgtaatccctcagaacaaactagagaaatctgaaactcggaatttgaacaacccggctaaaactctatttcttaccgttaccataaattacttttaaaccagtaaactagacgaagcatttgagtacctctcagacatctatataaagttatctacaagttttgtgttatacaaaagatatacttcaatttccatcaagctcagatctaaagaaagtaatggcagtactggttttcttacaggtcaacaacactgattttcttacaggccttaacccgattgccacggcttcgtccgaactccgattatggcaatcatatattactaagcagcagaacaaacaatatgtgtcacaatgaggtgtatgcaaaaaaaaaaaaataaagaaagaaaaatctgttactcaggaaatttcttccatgagaaaaaaagagtaaagagctggataggtttttgtcagctttccttcctctttgtacagtcgttgttagctttatcactgcttaattctagttgtatcacatcaaatggtaaaaaaaaatatcgaatataataaaaagcaaaggaataatgacaatggaggaaattttatttttatgtgtcacatttgttcaatcttaagaaaatatttgcttggcacttaacactttttttagaaacacattacatacacagatgtccacaacgcacgtacagtcacctctatgaacgcacacacgcacatcgtaccttgcatatcactgaaagaataattatccgtaaatgggagcatccgtgttaaatctaaaatttgaacccgggtggattggttccaccacaaggaacctaactagttaaactatgctcacttcgcgcttcgaacttaacacttagttgactcatccatctaattaaaatatactttttattcatatgcaaagtacagctaatgaacatgtacacgcatatgagctatactcgcctatataggttcacttccgaatattcaggtgtgtctaaatagcctggtcgatctctttcatttgcagatttcatccttgattacactgggaaagtgcaccgaataccattttcaactatgctct

SEQ ID NO: 20943 - DNA, 1142 bp, Oryza sativa
tgcgccggcgaggattgcgggcgcgattcgaacgaatccgagggagagagagagggaaaagagggggaaacgggagagggaatcacgggggtgattttccccctctttaatgcgcgcggggacggcgggatgcggcgaaatccgcggcggcggcggcgctagggcacgggcgagcggcggcgcggcgcgaggaggaagacgacaggtgggacccacccgtcagcgagggcggcgggcgggcccgcctgtcagcggcgcgcgcgcgcgggaggccgatgggccgcgggggaagagagagagagggagggactgggccgagccggcccaagaagggagggggggaaaaggacttcttttagggatttttctttttataaaaccttttcaactttgtttatttcttaataattattatttgtgctctgaaaattccactaaaatttgagggctccttttagaccaaggagaatttaacaaaaattctccgggccacatttgaatttttcttgtacgtattttagtgtttgccaatttcttttcgaattttaattaattctattattccttttagagaatgaattttaattttgggatgaatttatcaggacgtgacaaatccaccccccttacaagaatctcgtccccgagattcgaggaggctagcaagaagataggttgggcggtcttctcttcttgtctgacttcttccgctccgtcttctataacaaacttgcctaacaaacttcttcactctggactgcttggctcgatctcctgttgcagatggaatcttctcttcacctgacttggaccagggtgcaccttttggctgactcagactaggttgcggtagttcagtgatgcttccgttccagaacttctcatgattcatatcttcggagtcaacctcagacaagttaccacttcacgtcatgcgtcaacactagcttgtcattactaggatactatgtttgtcatcataagaatatcatgcttgtcattcacttctaacttgccatcaactgtctcatattagctttcctggtctccggtgctaggtacttcggctattcgatgcaagggtcaaccactctaactataagttatgcttcccaagagaaccaatttatcccacttgacat

SEQ ID NO: 20944 - DNA, 755 bp, Oryza sativa
agcgcttacacatgttttatagttgcaaagcctaattataataatccgcaaatctccatataacaacattaaactccggatgatcatatcttggtcatacgaactctgaatcgacccgttcaagtctcctaatgtttgttataaactaaagaaccgtgtgctttctttttatgtattggttttgcttctttataggcttgtagctttgcttgtgtgcttcgcgtagcttctgttgttccggaggttctcgaagcgtggttcgcgttcgtcgccgaaggttcggaaggtcgcatctctctgagcgactctagtcacatcatccttgagcatattgaatcccagtttataaaattattttgatttaaattaatgcattaccgctttatttaaattcccgcgttatcactgttttatttagccatgcctatttacctttgttatgacattattattgctattgttattattaccttgttaaccctagaataaataaaaacccaactagtgggtactctattcatggttccactagtatgaagttaggtagatgcttcgctgattaattaggcaacattaggtggttttataactctagactttgggaatattcatatcacttggacactatggaatggttggattattgtggaattggatgcacacctccccctcttctcaaaaccctcaaaatggttttaggctgggctcggggtgcatggttttgttagtagcacctcggccacataaggaccggt

SEQ ID NO: 20945 - DNA, 1501 bp, Oryza sativa
ggattcgttcgaatcgcgcccgcaatcctcgccggcgcaatcaatggcggccgagatctccgggcccgtttcctccctctccggccgcgctctccccctctcggcgctatataatcgttccccgagctccgctcttccgtttccgccgcttgccgctcgctctcgccttcggattcgtgctcgcgacgttctcctctctctccgccgtcgccgccgaccttcggttagccgccgtcgtcgctccggtcttcctcccgactcggcgccacctccatcggcttcgccgcgttgtcgccgaccccgtccgccccttcgcttcgcccgccgaccgccggagctccgtcgccttcgtcgtcccgaaccgcgccgccgcgttcctccgctccggcagtcgtttccgccgtcctcgttgtcccggggtgagccgtggaccgtccctctcgcttccctctcctctccgctctctcgggcgccgctccgccgcgccggtggtcgccgacggtgaccatcggggcgcgggcgcgcgtctcccgtcggtcgagccggcgaggccgccttcggccgcctcccgcggctgccaggtggggcccggccgtcagccgcccgcgcccgcgggtgcggctgacgcgtgggacccacggcgccggccgccgccagccgcgtgcacccggtccaccgtggaccgagaggctgacgcgtgggccccactcccgtggacccggtccgcgcgcccttctccctcggctgacgcaataaatgggtttttaattaaaatttaaatgaagaaattcgtaaatatccatttaaagagcatataaacttcaaatggccataacttggccatttgaactcggaattggaccgttcaagtctctaatttttccttaagaagtcaagaacccatttttgtgctttgtttctgctgttatgtggagtttattagcgtaaaagccttttcttttccgtcggtcgtgtagacgctgcagcttcggaagatccgctcttcgtggaagttgaagccggcatttgggaaagcgagcaaggcaagtcacatcatccttgagcatattgaatcccagtttacaaaattatttttaatttaaattaatgcattatcgctttatttaaattcccgcgttatcactgttttatttagccatgcctatttacctttgttatgaccttattattattgctattgttattatttccttgttcaccctagagtaaacaaaaccccaactagtggacactctactcatggcaccactagtttaattttaggtagatgcttcgcaatttaattaggcaacattaggtaattttataactttagactttgggaattttcatatcacctggacactatggaatggtttggttattgtggaattggcttcacaccgctccttctattcaaaatccccaaattggttttaggctgggctcgaggtgcgtggttgggttttgctagtcgtacctcgggtactataaggattaa

SEQ ID NO: 20946 - DNA, 1501 bp, Oryza sativa
cggaaagcagcggtgaattcaagccaagtgataggttcatcagtagtcctgttaaggcggaagtgatcccaccattcagaggcagggccatgcaactgatgtgatgcaaatgagaccttctcctgatcagtacactgaagtaaatccaacttcttctctatggcatgcagccaatcactagcttcaacaggattagtggtactagagaaaacaggcggccttacacgaagaaattctgctaacttgttctgtggaggtgcatgattattcccttggttttgctgattctgaaattgctgcatcatcatgttcataagctgagtctgttgagcaagaacttgggccagagtgggattctctccattgttgttgttattggggttgttgggaccattcccattgctacgagtgttcaccatctggcatggacagggcacaagaagagaaaacgggggaactacttaggacagagaattactttaacttttattgatcttaactgagtttcattattacaaactgaagactctcacaccactaaactcaccaacttcctaacactcaaaagcaaacaaacgcatgcacttacatcccaccactgatgtaaatcacatgcgagccacacacacacaagcaaacttaaaacaagcaaactaacacatcgatctaagacaacgacttaacaagtcactctagttcttccaagcatcggaggtcgattgagggctcgtcttcatcatcttgagttgctacccactcaatcttggaattgatgcgcttggattcttcttcttcatcactacttatgatgatgaccggaggatccgcttgagctggagcaacttctttctccaccacacgaacctttggcgccaattgatagcgagggacaaatagagctctcttccttgcggtaagacgaatccaggccttctgcggcggtgcttctcccttcaatgcggctaattccttctccaaacgatccaccttgtcttctagcttgcaaatcttaccacgattccgatcttcacgatcttgagctgctaacacagtctccgcacgactttcatccatagcccacaacatctcaaccaaatgtttcgtggtaacatcattctcaattccttcagtctcaaggtaactgccacggtcacttccctggggttggcgaggatggtagcgatactcagtgtcggccaattgatcactgtagcgatcacggagctctcctatggcgatccttgccacttcctgacatgcatggatgtaatttcttcctccagcttcaaacatcactgaggggacctcttcactattgctgttcaaggtgactttgactcggcacttctcttcatgacggtcatgaggaatctgggcataaaaaggggcagtcccaaatccaatgacaaaggacatcgtgcgcaactcctggacaaaaccctcaacaccaaacaggtactcaggcttgtaacgcggcatctaaagacaagtgaaaggaggg

SEQ ID NO: 20947 - DNA, 1501 bp, Oryza sativa
cagagcctctttgaccctaggttatgccaaatggttacccatagaagccctctgaaaaatattggaaaagtagaactgttctcctccctttctcttttaattaaaccaaactaatggcacatgcacttcataatctcttttaatggttctcattcaaaatttattccagtgttattagtactgtacatctattactgtactaatggctcatttaccagcaaaagttttacaatactgttttatttaatcttgctgcaataaaataaatttagtatgttgattttataactttcttttgaaaccagttattcaaaattacaaaatttgtgacctcgtttccaactattttaatttatttcgcaaagcttggtttactttatttacttacctttttactctgattttctaactttattcaaattaatccaaaaacttgtgctattaattggataaaggtcttaactccctcctttcacttgtctttagatgccgcgttacaagcctgagtacctgtttggtgttgagggttttgtccaggagttgcgcacgatgtcctttgtcattggatttgggactgcccctttttatgcccagattcctcatgaccgtcatgaagagaagtgccgagtcaaagtcaccttgaacagcaatagtgaagaggtcccctcagtgatgtttgaagctggaggaagaaattacatccatgcatgtcaggaagtggcaaggatcgccataggagagctccgtgatcgctacagtgatcaattggccgacactgagtatcgctaccatcctcgccaaccccagggaagtgaccgtggcagttaccttgagactgaaggaattgagaatgatgttaccacgaaacatttggttgagatgttgtgggctatggatgaaagtcgtgcggagactgtgttagcagctcaagatcgtgaagatcggaatcgtggtaagatttgcaagctagaagacaaggtggatcgtttggagaaggaattagccgcattgaagggagaagcaccgccgcagaaggcctggattcgtcttaccgcaaggaagagagctctatttgtccctcgctatcaattggcgccaaaggttcgtgtggtggagaaagaagttgctccagctcaagcggatcctccggtcatcatcataagtagtgatgaagaagaagaatccaagcgcatcaattccaagattgagtgggtagcaactcaagatgatgaagacgagccctcaatcgacctccgatgcttggaagaactagagtgacttgttaagtcgttgtcttagatcgatgtgttagtttgcttgttttaagtttgcttgtgtgtgtgtggctcgcatgtgatttacatcagtggtgggatgtaagtgcatgcgtttgtttgcttttgagtgttaggaagttggtgagtttagtggtgtgagagtcttcagtttgtaataatgaaactcagttaagatcaataaaagttaaagtaattctctgtcc

SEQ ID NO: 20948 - DNA, 1501 bp, Oryza sativa
gcagcaaatatgcaagtgcacaggataacaaaggatggcatagtatagtctcatttgcataaacagcatttaataagcaattgagaaaatagtaaaacagttgagtaattaaacaatattaaatcaacactatacaacacacccgtgttgcataggcccaaccattctgaacaaccaatcccggctgcacagttctatctccaaaccaggaatataccattccaaaccaggagctaaacaagttattaccaattacaacattatttattacggtgagaggtgtgaaactaatcacgaaagacattgttagacccgcccataaccgcgggtacggctattcgaatagtttaaactctagccagaggtgtaccactgtacccacaagacacaacctcaacatcatgtcaaccatgcgtcgcgatacttaacaagtacccgaatagagattgtgacaatacctcctgcataacacaattcaaagcagtgcaccgttcccggatcataatcacccccttataaacaaggtatggactccccagcgaccccggtgggcttatctccgccacttcacagtctggtgctctactatgaaccatactatacagaaagtaaagccgttgcccacgctggtttgtggatggcacggtaaatgtttcacaaccgaaaatcgtgaaccggtccttaattgtcatgagcacaaccatcaaaaccatatgctcacaacccaccattatcaggttttagttggcaaattaattacttaaccaatcatgattaaccatcatgagctatcattaagccatcattaaataatagtgaagcataagttatcccactagtgtgcaattatatctaatatctagctgaaccaatgtataaagctcaactagtcaagttataataacccaaggtatcaaagaatagggtaatcaagaacaaaaagggctataacaaaacaataggttatttccacccaatgacattcaaaaataaatgcagtagttgaataaaaacaatagctttaaacatgatcaacatgctcaaagggttgtttgggatctgtgtgacttgccttgctggccttgaaactcttcaaaatcttcccctgtaaaatcggactctccgggaacgtcggaatctaaagagaaaagaacaaaatcaccaaaacaacacttaaacaagcatgaacagtacatgtggatatttttaacatgtagatctcaattttagaaaaatttagagacttgaaccaacaaaatccgagctaagataaattagttatgaattttcaaagattaaatcggattaaatcatttatatggattttaattgaattatgacgcaataatgaattatttttgaaaaggaaaaagagattattgcgtcagcggctagggttcacggcggcggctcacggaaacgaacggccgggatcgatctatccaaatcagacggccgagatctaaacggtctacgaccggtctacggcggatggcgtcga

SEQ ID NO: 20949 - DNA, 1501 bp, Oryza sativa
ggattcctctctctctccgaaccctaacctttccatcaccgccgccggccgccgtgggccttcgccgcggccccctagcccctataaaaggacccccggtgtctcctctacccgccgccaccctcgccttcgtctctcgccgccggtagagctctagcgccgtgtagcctagcgccgccgttgccgcagttcgtccagccttgcgccgtcgccgctccggtcgtcgtcgtcgctcgggaaggccgccatcgtgatcgtcaagtcgtcgccgacctcgtccacccctccgtcgtctctgtaggtcgccgaagcaccgccgtcgtcgtcaagccgaaggacgccgccgcttcttcctcgacgccgtcgccgtccgttgatcttccgccgctactttggtcaccggtgagttcgccgtgtcgcccgcaacccgtaggtgccgtccgttcgcgccgccgcgccgtcgttcgccggcgagcatgcgccgtccgagccgtcgccggtgatgacgtcaccgctgacatcatcgacgccatccgccgtagaccggtcgtagaccgtttagatctcggccgtctgatttggatagatcgatcccggccgttcgtttccgtgagccgccgccgtgaaccctagccgctgacgcaataatctctttttccttttcaaaaataattcattattgcgtcataattcaattaaaatccatataaatgatttaatccgatttaatctttgaaaattcataactaatttatcttagctcggattttgttggttcaagtctctaaatttttctaaaattgagatctacatgttaaaaatatccacatgtactgttcatgcttgtttaagtgttgttttggtgattttgttcttttctctttagattccgacgttcccggagagtccgattttacaggggaagattttgaagagtttcaaggccagcaaggcaagtcacacagatcccaaacaaccctttgagcatgttgatcatgtttaaagctattgtttttattcaactactgcatttatttttgaatgtcattgggtggaaataacctattgttttgttatagccctttttgttcttgattaccctattctttgataccttgggttattataacttgactagttgagctttatacattggttcagctagatattagatataattgcacactagtgggataacttatgcttcactattatttaatgatggcttaatgatagctcatgatggttaatcatgattggttaagtaattaatttgccaactaaaacctgataatggtgggttgtgagcatatggttttgatggttgtgctcatgacaattaaggaccggttcacgattttcggttgtgaaacatttaccgtgccatccacaaaccagcgtgggcaacggctttactttctgtatagtatggttcatagtagagcaccagactgtgaagtggcggagataagcccaccggggtcgctggggagtccatacc

SEQ ID NO: 20950 - DNA, 1501 bp, Oryza sativa
ctgcaaaaggttagtgaaccaaatactagtggaatattattgttctaaccaaatactagttctcctctattttggtaatattgacggtcgaaactgatcgctaacgaccgtcaacagtgtccctcaatgtacggcttgaggatggcgagttgttgcagcatgccgctatgtgcttccgctacagctttgtagtcgttatcatagaatcttttcttgtctatggtccacttcccagttaactgaccctcgtgttcaacgggggttataccaatgggtgtggtgtccttcatgtaatatctttatcattgattccttcggatgagctgggttacggacataccctttcagaactgacatgtacctctcagacgcccacatctgatgtaggtataggggaccaatttcgataatctgagggacgatgtggacaatcagatgctccatcatattgaaataagatggagcgaaaagcatctcaagctgacacgctgtttcggttgcgaatgtttgaagggggcctaaatcttcaggatcaaaaacgttctgtgatatgtgagacatagaaagcattggctcggcttggaggtggtttccttttttaaaagaaattcggggagagcacaaaggtaccagttctataaccgacaccaataacctagtgtcattggtgccaaccaattggtgccggcagagaaactggcacctattgccggttctcaaccgacacctatagggggtttctgtactagtggatgtcatcaataaggaggttgagtaaatagttaacccgattaaggatcataatcaaggcaagtaccctccctccctttgaatatattgaaactcaagctttcggcaaacatgttgttttacaaaatttgcacatgtaattctaatgaaggaataattagaataccttgtttgtactcaaatggatctatttatctttttatatatgccaaatactttgccttgcttgacaagcttatcatggatatggatcatacttatccatgttgttttgaacacatttaaacttatttccatagatatgccatggagaattaccatagttggccaggcaagaaacttgcaactactatgtgcacctcagttatacacctacaaatatgccaccagacacgctgaaatgactgcagcgcctgcatcactgatttccccccttatatcagattcgatacggtacttgggcttcgatcttaatttctttctagctagctgaaccacagatatttaaaaagaaacgatggagctggtagctagcgatagatactctgaagtctgaacttacagtgctttggatcaggagtgccgtcaactgcacgagaacatatgcaaatcgagtgtgtcgtgctggcctgcagctacctatctgatcaataattaatatgtgcatgcatatctcatgttaatttactctctgtggatcgatgcctattgtcaccttccttatatatatatatatatatatatatatata

SEQ ID NO: 20951 - DNA, 396 bp, Oryza sativa
ctatcccgaccgaaccaacatggcacccggagcacctcgtattatgtgatgaattgataagctaggaactaaatccatatataaatgaataattatcaaaaaaattacatatataccacatatcctatatcccaaaaatcacaaaattgacatataaaaaaaattgcatctacatttttgcctaacaattgacatcgcacaaatttgataattggtcatctcacaaatttcataaatatcaccctaagtcccaaatttcacatatcaaaaattgcacatatatataaaaatattgcacatatcctaaatttcacatatcacaaattgcacatgtcacaaattgcgcacatatcacaaattgcacatatcacaaatttcacaaaaaaaactcaaaaa

SEQ ID NO: 20952 - DNA, 1501 bp, Oryza sativa
tagctattggataatccactagggggagggagtacctgcacctgggtgtacagaagagtcatcatatatatatatatatatatatatatatatatatatatatatatatatatatatatatatagtaaatttgtttggtgctccatggtgcccgggcaccattgttgaaattgagtatatacccaattcaaatgagtatgaaactttttcaattacttaggtattaacattaactactttactaactagtttaaagcaagtttgaactgaatttgaacttgtttttgttagattttgattctaggtatatagcatccatacatataattagttaggtatgtaatcatggattgtgaaataaagttaaatttgagttgttttgttgataagtataggtatgaatcaaattattataactaggtatatactcacaatttgaaaattttgaaaaatttgagtgattttgtgcattagataccatggtgcccgggcaccatggtgccccatatgagtgtcctatatatatatatatatatatatatatatatatatatatatatatatatatatatatataaggaaggtgacaataggcatcgatccacagagagtaaattaacatgagatatgcatgcacatattaattattgatcagataggtagctgcaggccagcacgacacactcgatttgcatatgttctcgtgcagttgacggcactcctgatccaaagcactgtaagttcagacttcagagtatctatcgctagctaccagctccatcgtttctttttaaatatctgtggttcagctagctagaaagaaattaagatcgaagcccaagtaccgtatcgaatctgatataaggggggaaatcagtgatgcaggcgctgcagtcatttcagcgtgtctggtggcatatttgtaggtgtataactgaggtgcacatagtagttgcaagtttcttgcctggccaactatggtaattctccatggcatatctatggaaataagtttaaatgtgttcaaaacaacatggataagtatgatccatatccatgataagcttgtcaagcaaggcaaagtatttggcatatataaaaagataaatagatccatttgagtacaaacaaggtattctaattattccttcattagaattacatgtgcaaattttgtaaaacaacatgtttgccgaaagcttgagtttcaatatattcaaagggagggagggtacttgccttgattatgatccttaatcgggttaactatttactcaacctccttattgatgacatccactagtacagaaaccccctataggtgtcggttgagaaccggcaataggtgccagtttctctgccggcaccaattggttggcaccaatgacactaggttattggtgtcggttatagaactggtacctttgtgctctccccgaatttcttttaaaaaaggaaaccacctccaagccgagccaatgctttctatgtctcacatatc

SEQ ID NO: 20953 - DNA, 1501 bp, Oryza sativa
tcgaatctgatataaggggggaaatcagtgatgcaggcgctgcagtcatttcagcgtgtctggtggcatatttgtaggtgtataactgaggtgcacatagtagttgcaagtttcttgcctggccaactatggtaattctccatggcatatctatggaaataagtttaaatgtgttcaaaacaacatggataagtatgatccatatccatgataagcttgtcaagcaaggcaaagtatttggcatatataaaaagataaatagatccatttgagtacaaacaaggtattctaattattccttcattagaattacatgtgcaaattttgtaaaacaacatgtttgccgaaagcttgagtttcaatatattcaaagggagggagggtacttgccttgattatgatccttaatcgggttaactatttactcaacctccttattgatgacatccactagtacagaaaccccctataggtgtcggttgagaaccggcaataggtgccagtttctctgccggcaccaattggttggcaccaatgacactaggttattggtgtcggttatagaactggtacctttgtgctctccccgaatttcttttaaaaaaggaaaccacctccaagccgagccaatgctttctatgtctcacatatcacagaacgtttttgatcctgaagatttaggcccccttcaaacattcgcaaccgaaacagcgtgtcagcttgagatgcttttcgctccatcttatttcaatatgatggagcatctgattgtccacatcgtccctcagattatcgaaattggtcccctatacctacatcagatgtgggcgtctgagaggtacatgtcagttctgaaagggtatgtccgtaacccagctcatccgaaggaatcaatgataaagatattacatgaaggacaccacacccattggtataacccccgttgaacacgagggtcagttaactgggaagtggaccatagacaagaaaagattctatgataacgactacaaagctgtagcggaagcacatagcggcatgctgcaacaactcgccatcctcaagccgtacattgagggacactgttgacggtcgttagcgatcagtttcgaccgtcaatattaccaaaatagaggagaactagtatttggttagaacaataatattccactagtatttggttcactaaccttttgcagagaataaccataaagtggaggagaatcgacatcaaatcagacgataaatcaatcggacgatgtcgtgaatcagacttatgtataaatgggccaagaactcagaaatgacacgacgaattgggccaaaattcacaagtctgcggagaggagcagtagagtaggccaccagcgaagttgttggctggatgggcctgcccctggtttggctgttggatccaggttttggctggacggctgagatgaagcccctatgacggttggagggtaattccgaccattccaactgtcagaaccgtcatagt

SEQ ID NO: 20954 - DNA, 1170 bp, Oryza sativa
atatatatatatatgttacttcgcatttatcctaatacatcttttttatcttgcagaaaagacgtgttgttggagtcgtccgtcaagcctgagtggaagagctagccctagaaggaattggagcaggcaagtgacgtaataatataaatgattgttatatttgtaatgcaattaattaagattattagacctgtaattggacttatcatataagattgtgtagtgttgtaatattatttgagttttaatataagattactttatttgtaattagacttagtatgtataattattgactacggaattggggcgacaagtagcaattgactattgtagtcttaattagacttagcatatacgcacgaaacacttagcatagatgactattttagtcttagcatgtaatattattggagttttaatataagattactttatttgtaattagacttagtatgtaattattgactatggaattggtgcgacaagtagcaattgactattgtagtcttaattatacttagcatatacgcacgaaacacttagcatatacatgactattttagtcttagcatgtaatattatttgagttttaatataagattactttatttgtaattagacttagtatgtaattattgactacggaattggtgcgacaagtagcaattgactattgtagtcttaattagacttagcatatacgcacgaaacacttagcatatacatgactattttagtcttagcatgtaatattatttgagttttaatataagattactttatttgtaattagacttagtatgtaattattgactacggaattggtgcgacaagtagcaattgactattgtagtcttaattagacttagcatatacgcacgaaacacttagcatatacatgactattgtagtcttagcatgtaatattatttgagttttaatataagattattttatttggaattagacttagtatataattatttactagctagggttgtacaatatacgtcacctagacttagcttatatcacgatttgtaattagacttagcacgtaaggttgtgtagggttctaatgtacgacatttacacttagcatacatgacttagattgttaaaacataaatgtctcgtgacttagcagatgtttcttgtatcaacaga

SEQ ID NO: 20955 - DNA, 1501 bp, Oryza sativa
gaaaaggaagggctgtatcctaaatttgatggggtatataaagagttggaaaaacttttttattgaagatggtacaatgttttttttttgttctgctgatcgaatgaaatggaatgctttaaaaacataaaataagctttatcattcttagccaattacatcaagataatataattactctaagactacttttggcattaacataactagaatgcacatacaacctattattattacataaagagaaatattatgccgcagcagactataacacaagctatttcttcctaacaccccacagcagcaacacttgggctgcaaaacaaaaaaggctgtcctaacgatgcctccgagaaagaaaatgacactcaaacgtgctgccattgccatgaccgaacctgtaaaggccaaaacatatgtttctccttcattagagagcaaatctttgactctaggcagtgccttcaacatggaagggaaacaccattggcaggaacaaccagctaagggctgtcctaggaaaagatgatttgtagaggcatgatatattttcatatgcttataatatcttttcatattatcttttcattatgtgtcccatggagctccttatctaccgatttgcaaaataggctatattttatagatatttggttgttaaacctcgaggcattttgtggacctcagtttccgtttgaggtgtagccttatcagcctcaacctgcttcagttactttgaggcagagataatcttttgaggcagtgttctctgccacaatagacaatttggggcaagagtatctgagacatggggaggctatctcgtaatctcttttgagatagactttgaggctgatttggttgctttgttataaaaacggcccagaaatcacatcggaaaccaaatcgcggaagaaaacgccataggagatccaaacatgatgacgacaccgaggtacgatatttgataatggagttcagccgaggcatacatcttcggggcactgattacgggcactccttcccgatccagtatattagagcgtatcaaagttataacgactcacggctggtcgccgccggcagccactccctctcgctatgctaaatcgccatgcggttacaacaggcatgctcctctatttatgagagatcctaggatagactccgactcatactcgagtcctaatacctattacaactccaagtcctaaattgtaaccgactttgtatacatattcgacataaactctaacatgtttcatgttgtctatgatcctgtagtgcttttctgttgtggcatgctaattttctagtccaacatacggagtctcgctccggtgctttctacttggagtagaaactaatttgagtcgttgatcatatctaattgtaggattgagatctatttctactcccaccagagttagtggtaatatatatgtggaggggtatattcgtccaaggatcataattcgcgtaggggtattatgtaatttat

SEQ ID NO: 20956 - DNA, 1501 bp, Oryza sativa
tttatactatattgtatttatgtaatacatagaagcaattatttataatgttattcatcaactgtaaagaatggtaggcttattttctttaaaaaagcatgcatactaaattaagtgttaaatgaaaattaagacttttttaattggatataggttattgttttctattaatggatgaattgggtggacatgaaagtccactaaatgcattggttatatagtctaatatgatttggtgtagttcgagatgcggcccaggaatccaagaattgagaatttttttacggtggattaattgttttttggattttaatatttgtatgttaaaattcagcagctatcagtgagatggagtaacctcagttttgtatttttcttcagaacagaagaattaaacattggtgctaattacgtctaaatagaaaaaagtacatttagttctaataacaatgattaaaagaagcaatattaaacacataccacataactgttgatcttcgttctttctgccccataatgttttcttgtctgtaaactcaaagtagtagtccgagaaacattcttttttgcttcgacctattttattattgtatcgtgataaaaaaagattttgagatatctttcggtacacagtacttatcatgttccataactttgattatttttaaaaaatgtataatgagtttatcttaatttttggcctaaagtggtttgccaattgctttgggattgaggcatgtattgagttgcctcgaagaaaatagtatttacataatagaacaatatattaaatgacatgtttgcaacaatcataccttgcatctagtagactcatctgtataccatagaactcacagccattgtaagattaaccgcatcctatagcctaatcactcttactttaattatacacaatacttatcatgttccataactttggaacttttaaaaatatataatgagtttatcttaatttttggcctaaagtggtttgccaattgctttgggattgcggcatgtattgagttgccccgaagaaaatagtatttacataatagaacaatatattaaatgatatgtttgcaacaatgataccttgcgtcaagtagaatcatctgtataccatagaactcatcagccattgtaggattaatcgcatcccattgcctaatcactcttaatttaattgtccacctatcattttttctgtgttaacgcagtaatcaaattgtaaagtaccatgttatctgcaaatgttcatatgcaatataatatatacatttatgttattcaatagatgcaatatagtgtagccttaattaatacaggatagcattattgtgttcttctataggtgcacgattaccttcttttgccaaatatgagcagcctgaattgactaatgtcaccaaacacctcttatgccaagatgagtcgccagatagagtcgtgtattgtagagattaaaataccatctggtcgtggtgttgctgaaggagat

SEQ ID NO: 20957 - DNA, 1501 bp, Oryza sativa
ctgatggagtggaggattaggagtagccttggtcaagctgcctgtggagtggagccgtctgcgccgtttattttattttccgctgcttagatctttattgtttgagaggaactatctacctctgtaatgacattttatacgcttattaattagagtaataattgtactctattatcaatttgttattgtgtgcctcggctgattcctggacgagggttcacacacatgtaagcgtttggaattttggatagaaattccgggcgtgacaagttggtatcagagcccccttgaccctaggttatgccaaatggttacccatagaagccctctaaaaatattggaaaagtagaactgttctcctccctttctcttttaattaaaccaaactaatggcacatgcacttcataatctcttttaatggttctcattcaaaatttattccagtgttattagtactgtacatccattactgtactaatggctcatttatcagcaaaagttttacaatgttgttttatttaatcttgctgcaataaaataaatttagcatgttgattttataactttcttttgaaacctgttgttaaaaagtacaaaatttgtaaccttgttttcaactatttcaaattatcttgcaagtttggtttactttattcacttaccttttactttgaatttctaaactttattcaaattaatccaaaaacttgtgctattaattggataaaggtcttaactccctcctttcacttgtctttagatgccgcgctacaagcttgagtacctgtttggtgttgagggttttgtccaggagttgcgtacgatgtcctttgccattggatttgggactgcccctttttatgcccagattcctcatgatcgtcatgaagagaagtgccgagtcaaagtcaccttgaacagcaatagtgaagagatcccctcagtgatgttcgaagctggaggaagaaactacatccatgcatgtcaggaagtggcaaggattgccataggagagctccgtgatcgctatagtgatcagttggccgacactgagtatcgctaccatcctcgtcaaccccagggaagtgaccgtggcagctaccttgagactgaaggaattgagaatgatgctaccacaaggcatttggttgagatgctgtgggctatggatgaaggtcgtgcggagactgtgttagcggctcaagatcgtgaagaccggaatcgtggtaagatttgcaagttagaagacaaggtggatcgtttggaaaaggaattagccgcgttaaagggagaagcaccgccgcagaaggccaggattcgtcttaccgcaaggaagagagctttatttgtccctcgctatcaattggcgccaaaggtccgtgtggtggagaaagaagttgccccatcccaagcggatccttcggtcatcatcataagtgatgaagaagaagaatccaagcgcaaccattccaagattgagtgggtagcaacccaagatga

SEQ ID NO: 20958 - DNA, 1501 bp, Oryza sativa
agctttcctctagtcgacgcatccaggcaagggtgggcgtgatggagcggggcgggccctgcgacggcctctgtcgcttccggattcacctaggcacgagaggggactgcccgtcgcccgctggggacgggggtgaaacctgaggtgtggtgtgcttggctagagggggttatgcgaagggtcctgtcacggcctctttccggtatgtcgtggtggcatgtcggcgcacggaaacgtgtcgtggggctgtgtcttgtgggtacagttgtacacctctgatcagagtaaaactattcgaatagccgtgcccgcggttatgggcggtcaaccagattcaccgtgattagtctcaccctagtgtaatctgttgaatttggatagtttaggtggatggttgggcctgtcgcaacgtgggttagcgttggacagcggatgtttaatactgcttaattattacaactgttttcgcattcaattcctgtttataaatgccagtatttatgcaaatgaacctgcttagctatcccttgttaaatccctgcatcatacctctattccggtatgacttgctgagtacagtgggtagtactcagtcttgctctacttttccccccaacctcagagctcgagtatgtgtccgatggcgggttctccgaggagtaggcttcgtccgtgccgtcgaggatgcctgtggagtggtgttcccgctgcagttcaagtcaaggattagctccagttatcttttgttttccgctgcatttctgtaagacctttataatgtttgtaagacgtggatctgtatgtcaacattgtcgtttgtgtaccctggctggtcctggacgggggttttaatacacattctgcttggaattctattcgggaatttctgggcgtgacagataagcccacgggggtcgctggggagtccatgccttgtttataagggggtgattatgatccaggaaggtgcgctgcagtggattgtgttatgcgaggggtattgtcacaactcctttccgaggtaccgtggtggtattgaggcacatggtgacatgatgtggggttgtgtcttgtgggtacagtggtacacctctgatcagagtaaaactattcgaatagccgtgcccgcggttatgggcgggtcgaacaatgtctttcgtgattagtctcacacctctcatcataataaaagatgcttaaactagtaataatttgattagctcctggtttggaatggtatattcctggtttggagatagaactgtgcagccggggtggttgttcagaatggttgggcctatacaacagggtatgttgtatagcgttggattaatattgcttaattaatacctaactgttttattaaattctgaaatgtttgctaaatgctgcttttgcaaatgaaaccctattatgccatcctttgttatcctgtgcacttgcatatttgctgcgtggcttgctgagtatgtcatatactcaccttgcaatcattcatcag

SEQ ID NO: 20959 - DNA, 1501 bp, Oryza sativa
cggttcggccgccacgtggcgccgccgcccctcctttcccccgtgccgctgacccgtgggcccgcgcgccgccaccccctttctctctctcccggtcgctgaccggtgggccccgcctgtcggcgccgcgccccctcgctgacgtcagccctggttaatattgcgcaataaattatttaaggatttcttttatagtaataaacacagtgaatcttctaaaattcataactaattcatccgagctccgtttaatcccattcaagtctcagtaaatcaagaaaaatgtgtagaatccattaaaaatggttttgttctctgtttcagtagtcttatagcctgtttgcaatgtttgcttggtatgtcgctagattccgatccctccgacgctccggtgtacttcgagatagtcgccgaggtccctccagcagcggagcaaggcaagtcatgcttgtcacttgaacatgttgatcctatattgcaaatgctctattgttttctttcaaatattgcattgttttataatatcactatgggatggatacctattgttacagccatgcttttggatatcatgctcctttgttagcttgggttataacatgattagactttggactaggaattgcttagccatgcttagttcaactagcacacattggggatctcatttaaaacctagactataggtttatatgataatgttggtttaataccaccgctctggtgttggttaaataaaatgaaccacatggtgggctgtgggtgcatggttttgctagtcgcacccatggcagttaaggaccggttcgcgggatgccctggaagaatttatcgtacttaccacaagccagcgtgggcaacggctgggcttgtagtgtagctttcctctagtcgacgcatccaggcaagggtgggcgtgatggagcggggcgggccctgcgacggcctctgtcgcttccggattcacctaggcacgagaggggactgcccgtcgcccgctggggacgggggtgaaacctgaggtgtggtgtgcttggctagagggggttatgcgaagggtcctgtcacggcctctttccggtatgtcgtggtggcatgtcggcgcacggaaacgtgtcgtggggctgtgtcttgtgggtacagttgtacacctctgatcagagtaaaactattcgaatagccgtgcccgcggttatgggcggtcaaccagattcaccgtgattagtctcaccctagtgtaatctgttgaatttggatagtttaggtggatggttgggcctgtcgcaacgtgggttagcgttggacagcggatgtttaatactgcttaattattacaactgttttcgcattcaattcctgtttataaatgccagtatttatgcaaatgaacctgcttagctatcccttgttaaatccctgcatcatacctctattccggtatgacttgctgagtacagtgggtagtactcagtcttgctctacttttccccccaacctcaga

SEQ ID NO: 20960 - DNA, 1501 bp, Oryza sativa
gcgttttttgcaaaaaaattctataggaaagttgctttaaaaaatcatattaatccatttttaaaatttaaaataattaatactcaactaatcatatgctaatggctcacctcgttttgcgtatcttcccaatcttcccaatctcctcaatccccttctcctcaaacacacccttagctttttagtcatgttaataatccggttgttgatgtcgcctgcaatctctgttgaccacaacgtatcaccacacgtgggctggttgaactcaacatgtgcattaacccaaggtgattctcttcttcaaaatctttctcttcatattttccatagggggtaaattagagattgcaaatccatattaacctgtttacagtgaaaattggaatcactttaaaggagaggggttggaggagaactggaaactagaaggtatgttgcttcattagactagatcatatgtgtatttttcaagtacatcttttttgcttgattagttccagtctgcgctcctccgcaatgtgtcatggattcagagacattgaattgctgattttaagtacagagtcaatcgttaatccatgtcgaggatgtccaaaagcaatgataggctccgtgcaagggcatgaagcctcactggtggagaaaccatctttcgtcggtcggccgatttccacaatagtcccggatgcaataaaaaccggggctaaagatgatttttagtcccggttcaaaagggtaacgggcatatttgatctttagtcccggtttgtgttaccaaccgggactaaagatgatctttagtcccggttcgaatgctgtcaggtcatgtcaggcccccccggaatcattaccaaccgggactaaagtcgtaactttataccaaccgggactaaagatcccggtgatctttagccccggttggtgctaataaccgggactaaagtcccacccctatatatatgtcttcttcctcctccagctgcccgagcaagctttaaaatttcttcaaaaaagaggggaggtcatgccaaaatttctattaaatttattttggtgattacagagaaatcggaggtgcctaaaaggtttgcaacttcatcctccaatgtttttttttttgtcatactacatttgcacctatgttttgcacacttttttttgtctccaaaatttagttgtaagttgatgagagagaaaatgtgtgtggggaagaaagaatatatagaaatttagttcatttgctaaacaaggttttataaaatagttgagaaggaaaactctagtgaaagttaatcttaaataatagaaaacaaactaaaatgaaaattaaaagaagtaaaacacattaaaattagtttaaaactttacaaatagtttttaataattatttggtgtaatattttatgatttttgtatgaataaagatatcttataattattgtatgactgtcattattgtaagaataattatttgtgtacggttttttttgactcatgtaga

SEQ ID NO: 20961 - DNA, 1501 bp, Oryza sativa
aggtgtagccttggtcaagctgcctgtggagtggagccgtctgcgccgtttatcttattttccgctgcttagatcttcattgattgagaggaactatctacctctgtaatgacattttattcgcttattaattagagtaataattgtactctattatcaatttgttattgtgtgcctcggctgattcctggacgagggttcacacacatgtaagcgtttggaattttggatagaaattccaggcgtgacaagttggtatcagagcctccttgaccctaggttatgccaaatggttacccttagaagccctctaaaagtattggaaaagtagaactgttctcctccctttctcttttaattaaaccaaactaatggcacatgcacttcataattttttttagtggttctcattcaaaaatttattccagtgttattagtactgtacatctattactgtactaatggctcatattccagcaaaagttttacaatgtttttttatttaatcctaatgtaattaaataaatttagcaagttgattttataactttcttttatttcttttgaaacctgttgttcaaaagtacaaaatttgtaacctggtttccaactgtttcaacttatcttgcaagcttggtttactttatttacttacctttttactttgattttctaaactttattcaaattaatcccaaaaacttgtgctattaattggataaatgtcttaactccctcctttcacttgtctttagatgccgcgctacaagcctgagtacttgtttggtgttgagggttttgtccaggagttgcgtacgatgtcctttgtcattggatttgggactgcccctttttatgcccagattcctcatgatcgtcatgaatagaagtgccgagtcaaagtcaccttgaacagtaatagtgaagatattccatcagtgatgttcgaagctggaggaagaaactacatccatgcatgtcaggaggtggcaaggatcaccataggagagctccgtgatcgctatagtgatcagttggccgacactgagtatcgctaccatcctcgccaaccccagggaagtgaccgtggcagttaccttgagactgaaggaattgagaatgatgctaccacgaggcatttggttgagatgctgtgggctatggatgaaagccgtgcggagactgtgttagcggctcaagatcgtgaagaccggaatcgtggtaagatttgcaagttagaagacaaggtggatcgtttggagaaggaactagctgcgttgaagggagaagcaccgccgcagaaggccaggattcgtcttaccgcaaggaagagagctctatttgtccctcgctatcaattggcgccaaaggtccgtgtggtggagaaagaagttgccccaaccctagcggatcctccggtcattatcataagtgatgatgatgaagaagaagaatccaagcgcacccattccaagattgagtgggtatctacccaagatga

SEQ ID NO: 20962 - DNA, 471 bp, Oryza sativa
ttgtttgggatctgtgtgacttgccttgctggcctgggaactcttcaaattcttctccggcgaaaacggactctccggaaacgacggaatctaaacagaaaagagcaaaaacaccaaaacagcacataaacaagaatgaacagtacatgtggatatttttaacatgtagatctcaattttagaaaaatttagagacttgaaccaactaaatcggagctaagatgaattagttataaattttttaagattaaatcggattaaaacacttaaattgattttaattgaattatgacgcaataatgaattatttttgaaaaggaaaaggtggattattgcgttagcgggctagggtttgcggtggaccgggcgcacggcggcggttcacgcgaacggacggccgagatcgacttgatccaaaacggacggccgagatcgatccggtccacggcggctcacggcagacggccacga

SEQ ID NO: 20963 - DNA, 1501 bp, Oryza sativa
tttatcagatgaagaaatgacacatatatatatgtaaaatttatgaacaatgttactaacattttattagatgaagaaatgaccaaaataaaagttttagatcatgatgagttattcaactttgttgttgataactttttcagttgaaatcatttattatttgaaaatgttgtttgaagttgtcatatttttaaatttaaattcaaatggttcataacatgttatatagaaaaatgaccaaaataaaagatacagatcttgttgagttattcaactttgttgttgattacttttttagttgaaatcatttagtatttgaaaatgttgtttgaagttgtcatattttcaaattcaaattcaaactgttcaaaaaatgttataaataaaaatgaccaaaataaaagttatagatcttgatgagttataaaactttgttgttgatgacttttccatttgatatcatttactacgcgtaaaattattttgactcataaattgaattattatactgcaagttaattgtttttctatagttcaacttacaaatataaacatttcatatgtaaaatggaaaaatactcatcgatgacgggctttagttaatgcccgatagagattaagtcatgtcaaccggggattagtatatagtccgtcactgatgagtcatctgtgacaggcctcaagttggtgcacgtcacggatgatggtcatctgtgacggcccaacttaaggcctgtttgagatatggaatgttatctcaatcgggcctaaactacgtgcccgtcacggatgatggtaatctgtgatgggccccaacttcagccccgtttgagatatggaatgttatcttaatcgggcctaaactacagcccgtcattaataggtgtcatccgtgacgggcttaagttttatgcccatctaatatgtctatgcgaccatatctcaatcgggcacttttttggcccgattgagatgacttccttgtgacggcccgctatttccaggcatgttagaggccatcacagatagaaggatctgtactagtgctggtacgctcaagtttcacgcgacagtactgatgctgagacaggaacagtacagagtgttgtcgagtgacagtgatgcccaaaaaatgatgagcagcacccaaatccttcatcgaaaaatcagactagagagccgagatagtctcctcaagccatcatagatgacctgttagagatctgaggtaatgtattagtgaggaattgtatgataggaaagaaaacaggtatgagatgggttgtccatggaaatacacacttactccctccgtcccattataagtacagttgtggttttctatatttaacatttgatcgtccgtcctatttaaaaatttttttatgattgatatttttattgttattagatgataaaataatacttgatgtgtgactttatctttttaattattttataaatttttcaaataagatggacggtcaaacgttggatattg

SEQ ID NO: 20964 - DNA, 743 bp, Oryza sativa
cttgagaattacagtatctaatttcttggaacaaatttctctaaaaagctacatagctcaattatagcctcacaaacattagcaggcagaactccacgaatagaaagtggaaggtatctgtgtaaaaatacatgacaatcatgacacttcatccctgatattttagcttttgttgcatccacatagtgtgaaatttttgaagagtatccatctggcacttttatttctctaaggaactcacaaaatgctttcttctcagctagtgtcattgtatagcatgcaggacgaaataagaacttcccatcaccagttggaggtgcatgaagttcatgtcgtattttcatgagttccaaatcaaaccgggatttaatattgtcctttgtcttcccatccagatttaacaaggtacccacaatactatcgcaaacattcttttcaatgtgcatgacatctagattatgtcttatcgataacgtactccaatatggcagctggaaaaatatactttttttttcttccaaactccatacaatgtgcttgagcgttttctcttattgttatgtttcccaaatttcacctgaatacataaagtgatgtcaataataatacactactcatattcttatactctataaagtaataacaaataaggcatagaatagcaaatagtataataatttactttcagattgaccagataggatctactatcattctgtacgcaaaattccccgagatctcaa

SEQ ID NO: 20965 - DNA, 467 bp, Oryza sativa
agcttagacatctaccaccgtaaaaactcaatcaacggcttgattgtctagatattatgtttcttttcatacttagtgttgcatcagttatgttttatctactaagtcgtgcttagaaccataatctctagcctgcttctagattgccaataagggtttcatcggggtttcatccggtcagttatttagacgttgcatcggctcataaggattgcatatacatagaagttggatttagccgataacaacaaaggtttcactgtttaatctaatcttgtggatttcatgacatcggacctctagccgatgtgtgctttaaccttcggatcgatgcttatttatcatatcactatttgccgattggtttctactggattatattgctatattatattatcatcagtcgattgcctttatatcattatctacattggacatatagccgattgcttaaccctatcgctatt

SEQ ID NO: 20966 - DNA, 1014 bp, Oryza sativa
attcctgcagcccgatcatagataatagtttacctcaattaatcataaatgaattttcacatacggattgcttaagtaaccacataggtactaatgaattactgcagatggttctcttaatgaacctccttcaagaatttttttttaaaaaaaacataattcaagagaaaaaaacttttacacaaatgaagttagatgcacataaattttatacgaaatttattgctctcagtgagatctaaaatttttttagttgatagcgcttttttccatttgacattttcatattccctaatatttgttacaagctattagaacgaaataaattttagagttttttgaaaccacctcagatggagacgtgctctccatcaaaattgtagaggtcaacgggataagtttatgtcttttcattagatgccatctgtagtgccaaatatggagcataattttttgaaaggttaagtcaaaataatagcatacaatcacatcgtggttgtcggtagttatatccaactatatacggtaggacgtaacatactagtagtacgtgataaagagagcagattcccgatatggaatctgtgcctatatataaatcgcttatttttggctgtgtttagtttcacgctaaaattaaaagtttaaagaaattggagcgatatagtgaaaaaattgaaagtttgtgtatgtagaaatgttcgatgttatgaaaaagttgaaagtttgaagaaaaaacttttaaatcacgcgtgggtacggtgactgaatgcctgtacgttcgtagggtatggttataggttaccacccgtacgtggtaaaaatggtttacctagctagctaacagtacgaatgcatgcatgcacggacgtacatgaacatgtacatatattgcagtacatactttgggtgatggttggacgttgttgatgaagaagtcaccgaatatcgcagggtggaaagccggcgccatcttggcgtcgggagacggcgacgtcgcggtactactgcaca

SEQ ID NO: 20967 - DNA, 471 bp, Oryza sativa
tggtcaaagtcaaactattttaaatttagctaagtttataaacaattataataatatttatattaccaaattaattttattaaattaataattaaatgtatttttataataaatttattttgggtcgaaaatattactatttttttctataaacttggttaaaattgaaacaatttgactttgaccaaagtcaaaaatatcttataacgtaaaatgatggagtatttctttttcttttatataaaatccaccgtttagcggttaagaaaacgtgataatagaaaaatgagaaggttgtagtatggagcgaaagtttagaactaaatcaattgggtcgcatgaacgattaattggaactgtcaactagcgtttgtattacgtccgtccgtgcatctacctaatacgagtatagtgcaatcccacttccactatacgcggaccatttcaattcgattgactttgtctcttagg

SEQ ID NO: 20968 - DNA, 183 bp, Oryza sativa
cactggtactaaaatttgatcagtctatagtaggttttaggcttgtgaaataattgtaaaattagctttatgcaaaagaacctgaagccattccttgaaataccctctatcatatgcattgttgttgtggtggcttcctgagtacggttggtactcacccttgctattcatatatcttttagg

SEQ ID NO: 20969 - DNA, 293 bp, Oryza sativa
ggggactaagaggagggcgaacgcatcaccctcgggcccgacgtccctcgggggtaccaggccacgtgtgcgattgtgtctgcctcaaacctctagtcatgatactcctgatcccatgtcaccgacagtagcccccggcgttatgccagggcgatcgccctctttaagggaaacggtcgggcgtgacgccactcctgagacctggtgacaggtgggaccgatctccacaattgggcagaaacccaacggtcacaaaccacgcacatcggcaatggtaactcggctgtcaacaa

SEQ ID NO: 20970 - DNA, 703 bp, Oryza sativa
tcgattaactccctctgttttctgcttgcgtgcgtggttgagtcaatcgtggtcaaagtgaacggcaaacgacagaaaagtgacgaaagtgttaaaagaggaatgaagggaactttcggtgctattaaagtgaaccggtaactttcggtgctagagaaccaaaaacgtgaactttcgatgctttgaaaccaatttttcctagttttggccacatcagaagtgattgatcagaccattttattacatgcatgacaaaaacagaaccatatagtctggctctatagcatccagtccacatgctcaatcttggtagcgtcttatgggttttgctctattggtaattggcctatcagtttaaagcaagtaaacttttgaccacccagctgttggagcaaatgctttaaattgtttgttattcttccatttttttaatggataaagtgcctattcccacagattaatcttattatacaatcagttaacaaggcctgcttttattgtaatttttactcaggatatggagctgccctcacaaaagtcacaacgaacaaggaaatcccatttgggttacgtcagatatccttaaaccatttaatgaagttattttatgcccaaaatttgtagcgcataccctttctctgttagatttggctttcacacattctacttccaattgttgtttgttcgtccttcactcctcagt

SEQ ID NO: 20971 - DNA, 528 bp, Oryza sativa
ggggggtcggccgatctgcagcttggaggcgcgccggagatcgaggaggaagctgaagcccgcggcgagtaagcagccggcagagactccgggttgcgcgccacccgcgaccggcgacgaccggcgacggcgacgaggaggagagcgacacccgggcggggagaagacggaggaatatgcttcgcttgtatccaaaagaaatggttaagtgacattattataaatttgctgattttaaaaaatttattcaaatagagtaaattggaatcatgccaatgtaacatccaaaatcatatatatgtcaatttatacatctgaaactaaatcgttttgttgttaccgtatttccatatggaccaaaatacatatgccccttacaaatcaagcattgaacaacaacatgaccttcctcctatcaacttcacaatttgatgctttagatctaatcaaaatttcaaatctaaagtatgaaattgttatacaaaacttgtgtacaaaatgattgaacttcgtgtaaaaaaatataca

SEQ ID NO: 20972 - DNA, 1501 bp, Oryza sativa
caagaaattttggcgaaaatcgtcttcctcgagcgctcggcgacggcaacgggcggggaggagggtggcagcggggagggagaggtgtaccttgatggggatgccgccggagccggagccgggagccgccataggcttgccgccggcgagggggggagagcgcaggcgcagatccgctcgtggcgagatggaagtgggaactgcgcgatatgggttgggggttttcgaaagtgggcctgcggcacatgggccaagaaggcgcgttgcaacggatattataagagataaaagcaaaagcaaaatcttataagtttatcgcatagttagttgattaggcatataatgctatgctcaaagcaaaagcattcaacttgtggtattggaggtagtctcggacaccaccactagcatcatttaaagtagtatagataactgtgaatttattcttaaaaatacaatataatcatagtgtaattgtattgtaatttatatgtaacctgaatgtagctttcacataattttgaaccatatatttgttttaagattcgtaacattgttacagcacgtatatatgtaagaggattcggtttcacgacactacaaaagttgtacccatgccttgctatacatctaatacgtgttttgaatcttttttttgtctactgtatttttatatggaccaaaatacccctagcatatcttttaaccctagccccaaatctaacaaccctatcccaaatcgatcccctaatcgccccatgctagcgcctagcagcaatggcgatggctgctaagcaagctccaattgcggcagtggtgacggtaagatttcggcatagaggacggcgtgtccggcagctacgatgtgcggtccgatggtagcgacaagctccacattgctcgtgtcggtggaagctgccgatgctagcaatggaggggatgggcagcagttgactggaacgggcagtcatcgtgtatgatgatccctcctcaccagctccatccgctactgtggatgcgctcggcgatgacagatcgagtggcacagagggagcagatttggagggtggcaccgatgagcaatgctgagtacggtggctgccggtggtcatgaacaacaacccgactcttccatcgccctttttttttcccctacatttgttcttctttttcatgtatatttttttacacgaagttcaatcattttgtacacaagttttgtataacaatttcatactttagatttgaaattttgattagatctaaagcatcaaattgtgaagttgataggaggaaggtcatgttgttgttcaatgcttgatttgtaaggggcatatgtattttggtccatatggaaatacggtaacaacaaaacgatttagtttcagatgtataaattgacatatatatgattttggatgttacattggcatgattccaatttactctatttgaataaattttttaaaatcagcaaatttataataatgtcacttaacca

SEQ ID NO: 20973 - DNA, 1501 bp, Oryza sativa
gctcataaggaccagcatagccacacattttgtttttgacttttcttttttcagtcggcaacaaccttatcttttcccggaggcgctaaatcttatcgtaactaatcatattagttttggatataacgataattaaggtaatattttctttctttgaaggttttttttactaggagtaacagattgaaagaaatctatacgtgaaagaaacattcaaataaaatctaaaactttttattaaaaactaaaagtcatacaaaaaatttaaaacattcaacttaaaatttcaaactataaacccaaattttgaaaattttcaagtcaaattatgaactttcatgttaaactttgaaaactttcaactcaatatttaaacttcgaggtcaaattttgtaactctcaactcgaaatttaaatttttaagtcaaattttcaaaacttttcatctcaattttgaaaaagtttaactgatatttgaaaactttaaactcaaattttaaaactttcaactcaaaatttaaaaactttcaactccatatttgaaacttccaatttaaattagaagatttttaagtcaagatttgaaaactttcaacttaaagatttagggtgtgtttggttctaggccacacattgccatgcttaagcttaagtacaaggctagccagagtttgtggcaaaattagactgtttgatttatgactaaggtgtggcaaaatcaatgtggctgttgttttggatcgttgccacgaatgtatggcaagaagttgtggtagctgtttggattcctcttacagaatgatagaaatacctcaatactatagtggtgagaatagtacagtactatagtgctcctatgcatccctatgaaaatagagaattattttaaaaaatgataaatgaacatgacacctatagtttattggaaataggagttaccaatttagatgtacctggtgtccctttgcctccactgcctccgttgcttctatagggcttagaaactactcagatatgcacacacatacaacgaaaaccagagatcaacaggtgccatctattggtggtgacaggagatcggaaggcagaaggccaaaggaagactgcctttgggagaaggcagtacctctgcccgtgagctcaacgagcacggcggtgtggaatggcagccatggagcatggcggaaggagagagatgtggtaagatagggtttgttgtgttgaacaaggcaagggggtgaatttatcgcggtagttggtgatttttttcgccgatatggcgcgctacggatggttgtggtggggaaaaagcccgccacacttctgctggaaaatattgtggtgggaggaggtttggcttgtgacgagcatagctttagtagtcaaccaaacactttccaaagaaattgtggcaatgtgtggtgggcaaccaaacacctccttaaaaaacacgtacgctgaagattaaaaaaaaaacagaaaaaaacgctccgacggaagg

SEQ ID NO: 20974 - DNA, 624 bp, Oryza sativa
cgcggtggacaagaatgaccgatttgtgaccggtctgacactgaccatatcgtcagcgcacagccatgttcccacgacgcgctcacccccggcggaagtggaggtaggtgtgggctgtcccatcggagcgtcattcggacagcaaccgtgctgatctccgcccattcaagagaaaaagaacagtccagtttggaaagagaagggtgcatgtggtatccccttgaagtataaaaggaggaccttgcccatagagaggggagttgattctttcccagataatgagcttagaacgggggagaagtcagctcacacttgtagctcattcatacgcagatccaccaaaacacaggagtagggtattacgcttctcagcggcccgaacctgtatagatcgtcggtgtctcgtgttttctggctggcatacgatttttccacatacagagagagtgagagcttgagatttcaccctaagccctcggccgaactggcaaaggggggcctgcgcggtctcccggtgaggagccacgagctccgtcatctggcgcgccaggtagggggctcagcgtgtgctttcagagctctcagactcttccgtgtgccccaagtttttcttgttcagcctaa

SEQ ID NO: 20975 - DNA, 1501 bp, Oryza sativa
ggtggatctgcgtatgaatgagctacaagtgtgagctgacttctcccccgttctaagctcattatctgggaaagaatcaacccccctctctatgggcaaggtcctccttttatacttcaaggggataccacatgcacccttctctttccaaactggactgttctttttctcttgaatgggcggagatcagcacggttgctgtccgaatgacgctccgatgggacagcccacacctacctccacttccgccgggggtgagcgcgtcgtgggaacatggctgtgcgctgacgatatggtcagtgtcagaccggtcacaaatcggtcattcttgtccaccgcgtgtaatcttggcaacgtgcatgtttgcccttcttcacacaacatcttgcctgtaatggttaagatgaagcctggcatatatcgaccgggtctaacgtgtcatctctaagagataacacgcttaacgccggcttgagacgagtgactagaggctttcgtcttgacgggatggggcatggcgtgcgtcagaccgccagtcgccacctaacccgtgatctgaccggtctgtgactggtcacagaccggataaagggacgcgccgtgctgcactgcatgcagcgtgacacgcttgaccagactgcaataaatgctgttaggtgagcacagctgtgctcacttatcccatatacgtggcgcagacttcctaaagggggtcggggtgccccggccctcggggccagggcaagcgcaacccgacccccccctcgggggaaatcaggaggagggcggacacctcaccctcgggcccgacgtccccgaaggtgccaggccacgtgggcgattgtgtctgcctcaagcctctagtcatgatactcccggtcccatatcaccgacagtagcccccggcgttatgccagagcaatttcccttcccaagggaagcggtcaggtgtgacgccactcctaaagcctggtgacaggtgggaccggtctgcatagttgggcaaaatccccaacggtcccagtccatgcacattggtattggtaactttggttgtccataatgggcggtctattcaagactgccacatcacttgagcagcgcgcgaatctgggtgagcagatttgtctcgcccggagatacggtaacgccgcttcggttggcgagcgtaattaacgcgcgcacgatacaatccgtttcgattgccacaaccgcatatccacttcaagcgccgtaagcgggcgaatgggattagtggaagcgtgggcacgggaaacgagggagcaagatagcgagatacgagggagcgaggtagtgggcgcgagaaacgaggagccaggcccagcgatggcaagggtataaaagcatcgagaaaaggacttgctcccttcctttcgccattgttcctcttgccttcgctgcctgagctctaactctttctctgccacgccctactttcgccacacgcgctcgttcccaatcatctcttcctccaccgcca

SEQ ID NO: 20976 - DNA, 1501 bp, Oryza sativa
aaacgaggtggtaataacatgtgattaattaagttttaattattatataaacttaaaaaatagattaatctggtattctagaacaactttcatatagaaagttttcgcacgaaacatatcgtttaacagtttgaaaagcgtgccacaaaaatccaaaactttattcacttcttgtagtggaaacgaacagcaccgatatatgtaaaatagtctcttttccccttttttcgtaacatttaagttgcattcaagtaagggccggcgcatattttctttcgatcgaatcaacgaggccaccaatttcattgaatagaggagatgaaactgtacaaaaatgagaatgtaaaaaaaaaacaaaaccagggccacggccctaactacaggcaattatattgtcaaccaggcagtgagattttttgcgcctgccagccaccatatttttgcttcctcctttattttggctagcagagttggcgtcgataattccttatgttggaaagtcatctggttcctttcgttccatatctcccagttaacaagtaaggttaacgtgcgtagtgtcttcttagatgcttcccgtatgcttacggtggcctcccaccactcatgtaccgttaaaattatttaccagctagaaggtcttaggtggtcattgaatgtccactgcgtaatttcattccagattctccttgtgtatctacattatgctagaatgctagcaggtagagagctgtctcttgagtctggcgacataaagggcatgtggatccattgggccagcctctggttgctagtctatctgatgtccacactctgttttggagtatcagccaggtaaaggtcctgcacttgcgcggtgcacccaagtataaaaaagatctggtccgacccaaatactgtctaataaagttaatacttttcgttagaccgactctatatcatgtctcatgcgtggcgggtagtcctactagtcctatccctaatcctctcttaattatgtttcataaaattacaaagtgtgtttagctaaactggatagaagataggaagagggaccgccaaacatagcctttagacctatgtatctttggtcttaaaagaaaaggagctagctcctccatgtgaaggggcattaaaaaaattccctctccataatttacttcatacactgataaactatccatctgattaggaatggcaacagggcgggtcaggggcgggttgagctagaatgcccctgcccccgctccccgatttctcactccggccctagctccggccccatagaggtggtcaggtgggaaacatcacccgtcctagtccccataggggacccgtgggtgagcggggccccgcaccaccgacggcaaacagcgacgaggtggccacgagatgaggagaaatgccggaaatggcgccgccgccgctgcgtatgaaccgcatgtcgacgccgacgcggttggccatgcccctagccgttgacgatgccatcactacaagc

SEQ ID NO: 20977 - DNA, 1501 bp, Oryza sativa
ttcaacaccggcccccgcggctggaagtagcagccgccaaccaccgatggcggtgacaccgactgcacggtgaagaaccaccggaacagctgaagagaggggcgcaccccaatgaacatctcgcacaggtgtgcgaagatggccaatgtcatcaccgcattgggggtgaggtgcgccatctggagatcgtagaactccaggacatccatgaagaaatgagaaaatggcgggaccagcccagccattgcgaaggggaggaagaagatggaccgccccgggtagtctggtgccgggcgcccctcgcccagcatcactatctcccgaccggtggcggactccggcatgaagcggcgcggcagtccggcgtgcctctcattcacgatgcgggaaggcggcagtacactgccgtcgagcagagcagagccccgtgccatggcggtggaggaagagatgattgggaacgagcgcgtgtggcgaaagtagggcgtggcagagaaagagttagagctcaggcagcgaaggcaagaggaacaatggcgaaaggaagggagcaagtccttttctcgatgcttttatacccttgccatcgctgggcctggctcctcgtttctcgcgcccactacctcgctccctcgtatctcgctatcttgctccctcgtttcccgtgcccacgcttccactaatcccattcgcccgcttacggcgcttgaagtggatatgcggttgtggcaatcgaaacggattgtatcgtgcgcgcgttaattacgctcgccaaccgaagcggcgttaccgtatctccgggcgagacaaatctgctcacccagattcgcgcgctgctcaagtgatgtggcagtcttgaatagaccgcccattatggacaaccaaagttaccaataccaatgtgcatggactgggaccgttggggattttgcccaactatgcagaccggtcccacctgtcaccaggctttaggagtggcgtcacacctgaccgcttcccttgggaagggaaattgctctggcataacgccgggggctactgtcggtgatatgggaccgggagtatcatgactagaggcttgaggcagacacaatcgcccacgtggcctggcaccttcggggacgtcgggcccgagggtgaggtgtccgccctcctcctgatttcccccgaggggggggtcgggttgcgcttgccctggccccgagggccggggcaccccgaccccctttaggaagtctgcgccacgtatatgggataagtgagcacagctgtgctcacctaacagcatttattgcagtctggtcaagcgtgtcacgctgcatgcagtgcagcacggcgcgtccctttatccggtctgtgaccagtcacagaccggtcagatcacgggttaggtggcgactggcggtctgacgcacgccatgccccatcccgtcaagacgaaagcctctagtcactcgtctcaagccggcgttaagcgtgttatctcttagagatgacacgt

SEQ ID NO: 20978 - DNA, 1501 bp, Oryza sativa
cactgcctggttgacaatataattgcctgtagttagggccgtggccctggttttgttttttttttacattctcatttttgtacagtttcatctcctctattcaatgaaattggtggcctcgttgattcgatcgaaagaaaatatgcgccggcccttacttgaatgcaacttaaatgttacgaaaaaaggggaaaagagactattttacatatatcggtgctgttcgtttccactacaagaagtgaataaagttttggatttttgtggcacgcttttcaaactgttaaacgatatgtttcgtgcgaaaactttctatatgaaagttgttctagaataccagattaatctattttttaagtttatataataattaaaacttaattaatcacatgttattaccacctcgttttacatgaaacacttgatcttcatcttcaggagattcaaacaccagcatcatgtgatataatctggatacaaacaatattagactcgatctacgtgtatactgtatgttctaaaaataacgtttatattgtgttattaaaaaatcgttctacaattggagaaaccataatgaaagaaaaaataaagcaacgaattgaattgtgcccgcacaacatgaatatatatatttttctccagtttaaacgtgcatgtttgtttgtgtagtaacttatcggtccaatcactaaatatatttttggtgtcagcgctcttaaaaaacttatcggttggattgtttcactatagctaattatacataaaccgtaacacacttattagcaatacaaaataatttataaataataataaataattaacggatactatacactggtggagaaaccatttttggtcggtccaccaaattccactatagtctcggttgcaataaaaaccgggactaaagatcatttttagtcccggttcaaaaaatggtaggtgatgtcagacccctctaatatctttagtcctggttggtgttaccaaccgggaaaaagatgggcatgcacagagagatcgaggcgtgcgcgtgaatcggatcgagatacatgtctcatcctccctcccggttctatctcctcctctcctcacaccctatctcttcttctcctcccccttctcctctcctccccattctcctctcctccgagatccccttctcctcgccatcttacgcgcggaggatcctctccgcctccccctcccctcctcctccccgatctgcaggcggcggcgcacgacggccggtggaaggtggcggccgggcggtaggtggaagaggcggcttgcgcggcggcgggcgacgcgccagatttgttttgttttgtttttgtttttgagaatttgtgatccggatctgagatgtatttgatttgtgtgtggtgtgaatatgtgatgaattttgtagaagttgtgatgtaattttttttaagattttatgatgtatttggggatgatcgatttgaggatttggaggtgttagttgatttgagat

SEQ ID NO: 20979 - DNA, 151 bp, Oryza sativa
tcgcgacgacggtgggctcgtaccttcggaggaaagaagggcggcgcgagcgcgacgacgccgtgagtagcacgacgacggcgacggcgagcgccgccgtgagggacaaggcggcgcggctagcgaacaggagcatcttcattatcggcga

SEQ ID NO: 20980 - DNA, 396 bp, Oryza sativa
ttctgggtatgaacctcgacatgcatgcatcaagattcgcagttaggatataatatttttatagcacagaggtgtaaatttaatgtgactataagtttctaggcgtatacaaatcaaccaaataccagtagggtctttgattcgtgcaggcaaaccattagtcgtcttctttcttcctcgcgtcgcggcatccgccatcgaagctttgctcgcggctttctgggcttcctcctgccaccggagacgccaccggcatcgccgccttctactcactcctctaggaacctacgccgcagaaccctctcacctccctcctccaaccccgcggctccgtccaccgccgcctcgccgcccccgaacccaaatctaggtttttgttttggttcggtaaatcta

SEQ ID NO: 20981 - DNA, 1501 bp, Oryza sativa
tgagtgggagtaaaagatacttccgtagagatggatggagcaggtcatgtcgttgctgcatcttcactcttgtcgcattgtggccattggttcctgggggcagttgagttgggtgcatgtgagtgtactgggcgtgtttcacggctacactgtgacggtaaagctttcatggtaaaaagttagatcggaaatgactcaaagtcatgattagattgatggtcaagtgagtattatagtagagtaaattgtatttgttaggtgagtgtaatttagtgcataaacttgtaaaatactcgttttagtgtatgaaattgtatggtgcatgtggaggaaggcggaaaggacactacatggctaatcttattgatttagaagcagattaggatactatgtaaacatatatctgagaagattgctattagacatacacctctttagtaaaaatagaatataatatagtgatagtagaaaaagattaaaaaatccgagcaatgatgtaagggttagaaatatatgaaattcatcatttccacgatgaaggataaagtagagaccaaatttataaatattgcatttcttatgcataatcactacacgtacacacgtcacatcctaatcaacatcagctttgtaaaattaacattactaagttattttggtcttcgttcgtacgaactagacaagttcgtgtactgaaacgagcattttacaagtttatatactaaattacacctatctaacaagtttgtgtaccgccaatacaatttactcagtatagtacctccgttttctaatacacgatgtcgttaacttttgagcatatgtctgaccattcgacttattccaaaaaattatgtaaatgtataagatataagtatgcttattataattacataattctttttaatatgacaaatggtaaaacgtgtgacaaattcaatggcattatctattaaaaaaaggagatagtataggctttcatcgtttccttttttttctttccgaaaacattagggaattacctccatttcattaaaaagaaaagaaaagaaaatcgaaagtagggaaagtactacctctgtcccataataattgtatttttgtaggattcaaatttgtctcaaaataattttcacaatagagtactaattgttctatcaatcacttttcattcaaatttcttcctattatatcctcaaaaaccctcctacttttatctatacaccgattaatgatggacatcatagtctcacttttcaaaccttaatatattccgaaattataattattttgggacgggtagtactgaacgtcatctaacaaacatgggtcgttcgatttcgattccggatgatgcaaaccatccgatccttcaactgatgaaaccttctcgtgatccttcacgaaacttcttttttcaaggaagtccttccacgtccctgctaggggaaaaaaaatcgcattttgtcgttcacggtgttgctagctaggctgcgacccc

SEQ ID NO: 20982 - DNA, 956 bp, Oryza sativa
ctatatagcaatctttgttttccaagtctacatgctatagttgttttagcttaatgttttacacctatatatttgtcctcaaaaaataaaaaatattatgttattagtgtaaaattggacttatccagatatgttatatttttatacatattttaaaaatgaaagctcacgttttatggtcagagttacagaaaatcacatgtgttatgaattgtaacacgtaaccacgggttttatagtctaaatgttttataaaaccaacacactctatgttttgtgaaacttttgaaccataatagatggggtcaggtggcactaatcgtaataccgggtttttatgcaattaaccacaaaacatcaggtattttgaaatttgctcaatatatttttaagacatccatggtcaaatttaatcttgaagacttttcaaaattaaatactctaataatccagatagaaaataaaattatacataactatacatacataacgcttggactatatttgcattagtcactagtggggtgtggtggtgagttatgcatggattaacctagtatatgtattgcactttccatagaaatttagtggctttagagatttactgttggtattcatctatatgagtatgtgttagatggtacatccatgtaatcggagaaaaaaaaattaagaaacgtatacgacgctgggttggggaatatcgtgtgatagggaaaaataagatttagacataaaggatgttggataacacgtgttaggggaaaatggatttagacataaaagatgctggatacagaagagaggagccaaatagccaatgtgcttgtctgcatgtgtgttgacagacgctttgtgtaatttggaaaaaaaaatatgtacacgacgacactgatctgactagataaaatcggtatcatttcgggttaggagggccgtaaatcggacgacaacca

SEQ ID NO: 20983 - DNA, 384 bp, Oryza sativa
tacaggaacaggttatgaaagagttgccttgtattcagacttgatcataacatttcagttgtcaaaaatagagcataacattccacaccgcaaatttatgatcaatcatattatatacagatatccaaggaaagtaggaaactacagcaaatgccagaacgcacagttgttcatgcatacattctagtacttggtgtttacaacagttctgtaaacttcagagcaaagaagagtttatggtttccctttctaagcctatatcaacaaaaaagaacaacaagaagacatccaatctctgtcatttgatctgaagatacgaaaattactgaagagatgatgtcagaggttctgctattgtagttctgtgacttctatctcgtcaga

SEQ ID NO: 20984 - DNA, 436 bp, Oryza sativa
ccatttactggagacttatctgactgtataagaggaagacagatacaggagcagaacctctcatggtaaggtttccattttaccccatgtatggctggtcatctttttttttccctgacacagtttctatgcattaatagtcattcacttgtgataatcctttagtcttcagtttgtattttgtcctgcatcttttgtgacaaacttctgcatcgatttctttctaacagagcttggtactgttcttaataaagttatatccatttgtcctctaggaaactgtatagcatgtctggtttggagagacttacctgaaaactgttggaaataatggtttgttggttgccatacatactcatgccccgtccttgtggattttcaatctgtgtacatgtgctaaaatatggcctgaaggtagtttagtaattgggaataa

SEQ ID NO: 20985 - DNA, 795 bp, Oryza sativa
taactgatgtatattttgcaagccatgactttaggtatctattcctctgttgcaagacaagacttcctctatgtatgaaagtcctactgctgaaatggttctgaaatgcaatgcaagtcctatctatgccattcctctattgctacttcatgccatatgattctgaaatgttaacacaaatatttcctgcaatgcaattcatctcaattttgggcaaacacacatatttccagcattacaattcatctcaattttgggcaaacacaaatatttccttgcaaatatttaagtgcacaaattttgattcatcacaattcatctcattactgcatcacattgttctacttcattacattcatgccaacatacataacaaaagcagtcacaactacaatcccaaacatacaaattctactcattgcctccttaatctcacatcttaacatctcaattccatcatgtactcctttcaatgaagcattcactaattctggggcatcaccttctgtcctctgcgcactgcattctgtccatccatgaaggaaaccttccttcaccaaccaaacagcataatccccttgccacatgaaaaacttgcattgcgcacttgtctgaaattacaacaataacacacagcttatcaaatcaaactcgaattcaactcaaaccctagaaaaattggggattgcaaagaacaactaacatactgccctgtaaggcatcgatagaacttgcggttgaagttctcttccttcttgcatgtccgctccactaccgtcaaatcgcccttgcaga

SEQ ID NO: 20986 - DNA, 222 bp, Oryza sativa
ttgttaggaaccctcttctcccaattagtaacaacaagcttgaatacaactctcacaagtattttgggggaaaagagagaagcaaactagctagctgatacaagtgtctagaagtttctggaaaggagagagagaagctggaggtagaagaggatgggaagagatcgccaagattccagcccggaaccaggacgccgccgccgccgtggccgaagccgccaa

SEQ ID NO: 20987 - DNA, 1501 bp, Oryza sativa
ccggaaaatttcaaggaaaatccagaagctttcttccggagcgtcagaccgcgagtcgctgctccgcagaaaactctaccgacagagaaaccagccgtaccagcgccaccaattttcaagactatggctagcaagactctccgcgagttcgctgctccctctgctgacaatgtggccattgggccacagatcaacatgggagacatggatttcaatttgaagtccagactcatcacgatggcgcaggctagcccattctgtggcaagcctaatgaggatgccaatgctcatctgcaacagttcctggagatctgtagcatgtacaccatcaagggcgtcagtctcgacgccgtcaggctggactgtttccattctcccttctcgggagagcgaagcagtggttttatgccaaccgtgctgctgtcaacacctgggataagtgttctatggcattcctctcgaagttcttcccgatgggcaaaaccaatgcccttcatggacgaatttcaattttccagcagacgagggatgagtctattccagaagcatgggaacgactgcaggagtacgttgccgcctgtccttatcatgggatggacgactggctgattctgcagaatttttataatggactcaccccgacgtcccgcgaccccgacgtcccgcgatcacctggatgcggcagctggaggagcattcttctttaaaacggttcaaggagtcgttgatctaacagagaagatggtctccaatatgggatggagcgaggaacgactccagacccgacagcgaggtatacacaccgtcaaggagacggagttacttgctgccaagctggacctacttatgaagcgattggacgaccacgagaaacgaccacaaggcaccgtcaaggccttggactcacacgttacgtgtgaagtctgcggcaacacgagtcattctaggaatgactgcccggaaactcgtgaggaggcgatgtacatgggcaacaacaacaacgggtactgtccacaaggtggtcaggggtggaaccaaccacgcccatattatcaatgaggtaacaataacggtaatttctctaaccagccctccttgaaggatctcgtttttgcgcaagctaaaaccactgatgcgctaagcaaaaagcttgcggctaatgacaaggtcctagagaacaaaaatgtcaaattagatggctttgcttccgtttttcaaaatcagctgagctttaataaaatgatagaaacccagttagctgagttggcatctttagtccctgcaaatgaaattgggaggattccggggcaacccgactcctccattgaaaatgtcaaggcgatcacgacgaggagaggtaagtccactcgtgatccgccatatcctaaccctgcaggaactactgggatgtcaaaagaagcaccgtctagtgactcggctgacaaggaagttcagccagaaaagacagtgccgcaagagtacggcgacacacggttgctgc

SEQ ID NO: 20988 - DNA, 1501 bp, Oryza sativa
caccccgacgtcccgcgaccccgacgtcccgcgatcacctggatgcggcagctggaggagcattcttctttaaaacggttcaaggagtcgttgatctaacagagaagatggtctccaatatgggatggagcgaggaacgactccagacccgacagcgaggtatacacaccgtcaaggagacggagttacttgctgccaagctggacctacttatgaagcgattggacgaccacgagaaacgaccacaaggcaccgtcaaggccttggactcacacgttacgtgtgaagtctgcggcaacacgagtcattctaggaatgactgcccggaaactcgtgaggaggcgatgtacatgggcaacaacaacaacgggtactgtccacaaggtggtcaggggtggaaccaaccacgcccatattatcaatgaggtaacaataacggtaatttctctaaccagccctccttgaaggatctcgtttttgcgcaagctaaaaccactgatgcgctaagcaaaaagcttgcggctaatgacaaggtcctagagaacaaaaatgtcaaattagatggctttgcttccgtttttcaaaatcagctgagctttaataaaatgatagaaacccagttagctgagttggcatctttagtccctgcaaatgaaattgggaggattccggggcaacccgactcctccattgaaaatgtcaaggcgatcacgacgaggagaggtaagtccactcgtgatccgccatatcctaaccctgcaggaactactgggatgtcaaaagaagcaccgtctagtgactcggctgacaaggaagttcagccagaaaagacagtgccgcaagagtacggcgacacacggttgctgccattccctcaacgaaggagaccgtcagtggacgagcaattcgctcgttttattgaagtaatccagaaaatccacatcaacgtgccgttgttggacgccatgcaagtgccaacatacgcccgttatctcaaggacatactcaacaacaagagaccgctcccaacaacggaggtagtcaagctgacgaaacaatgcagcaacgttatactccacaagctcccggaaaagaagaaagattcggggtgtcccacgatcacctactcgatcggggcacaacagttcgaccaggccttgtgcgaccttggagctagcgtcagcgtcatgccaaaagacgttttcgacaagctcaacttcacggtgttggcaccaacaccgatgcgcctacaactggctgactcgtcagtccgttacccggtagggatagcggaggatgtgccagtcaagatatgggatttcttcatcccagttgacttcatggtactggacatggacacgggaaaagagacgccgctcatcctagggcgtccgttcctcagcaccgcgggagccaatattgacgtgggaacggggagtatccgtttccatatcaacgggaaggaggaaaagttttagtttcaaccgaggacggaacaatg

SEQ ID NO: 20989 - DNA, 429 bp, Oryza sativa
ggggggtttttggattttttttttttggctaaaaaatatctttgcatgcggtgggctatgtggaccgcatgcgaaaatcccctttttgcatgcggttgtgttgcccgcatggagaaatagcgatttttacagaccttttgttccatgcgggcaggctagccgcatggaaagatccatttcgcccgtatgaaaaaagctcttctgtactagtgccacccatgcctcatgtcacgcccagaaattcacgaaccataatttctaagctgaatgtgtattaaacccctgtccaggaccagccagggtacacaaacgacaattgttgacatacaaatccacgtcttacaaaaacataaaggattacaaatgcagcggaaaaggtaaaagcgagctaagcctgaagacttgactcctgcagcgggcgattccatt

SEQ ID NO: 20990 - DNA, 158 bp, Oryza sativa
gattccatgcacggaaggcaaagttatcaaagtcttaaattcgcccagaaatctttatcggcagtccacggtgtcgcgccggccagcctaccttaacagcgcggttagtcaacgtgcttgacaccgacgttgtctaagctatccaccctaacatccta

SEQ ID NO: 20991 - DNA, 390 bp, Oryza sativa
tgctctcgatttactctttatcttttctttctctggaagtttgtgtacatgttacctcttgcataagggtggctcacaggctcctcctttctctactcccttctttcctccacctcatcatatggcatctgtggcatcctggggatagaggttaaggccgtgtacttcctctagaacttgtactttgcaacaagtgttctggttgttacagtggaagtagagtaactcaaagtaagctgaatatctggatggggcttgtattgtaggactatttgtctacatcctttctttaagcatgatataaccagctcctaactagtactagtaaaatgataattgccatctcattgagatgtacaaatgccgctgctgagtatgtacacatattgc

SEQ ID NO: 20992 - DNA, 1501 bp, Oryza sativa
  unsure (1)..(1501): unsure at all n locations
gtaataccctactcctgtgttttgggagatctgtgtatgaaggagctacaaagtatcagccagcctctcccttgttctgggtttctaatctggaaaagtccagtcccccctctcagtgggcaaggtcctccttttatatcttaaggggataccacatgcaccatttctctctttttttgtggggacttacccccccttttcataaatggacggagatttgtatagttgccgtccgagtcaccttctgatgagacggcccacaactacctccactttcgccgggagcaggtgcgacgtggaatcgtggctgtctgctgacgacatgaccggtatcagaccagtcacgtcggtcattcttgtccaccacgtgtcagcttagcaatctacatgctcgcccttcttcacacaacatcttgcctgtaatggtttaggatgaagcctggcatatatctgaccaggactaacgtgccatctctgggaggtaacacgctagctccagctggggacgagcgcctagaagccctcgtcctgacgggatggggcgaggcgtgcgtcagatcgcctgtcgccacctaacccgcgatctgaccggtctgtgactggtcacagaccggataaacgagtgcactgcactgcgttacatgcggcgtgacacgctcagccaaaccgcaataaatgtggttaggtgaggctnggtgtgctgacgcaccccatgcactcggagaaaaaacccacaaggggtcggggcgcctcggccctcggggccgaggggggtgcggcccgaccccctcggggggactaagaggagggcgaacgcatcaccctcgggcccgacgtccctcgggggtaccaggccacgtgtgcgattgtgtctgcctcaaacctctagtcatgatactcctgatcccatgtcaccgacagtagcccccggcgttatgccagggcgatcgccctctttaagggaaacggtcgggcgtgacgccactcctgagacctggtgacaggtgggaccgatctccacaattgggcagaaacccaacggtcacaaaccacgcacatcggcaatggtaactcggctgtcaacaatgagcggtctcttcaagactgccacattacttgagtagcatacgaatctggacatggcgattcgtttcgtctgaagatatggtaacgttgcttcggtcggcgagcgtaattaacgcgcgcacgatatgatctatctcgactgccacaaccgcatatccacctcatgcgccgcaagcgggcgaatgggattagtggaagcgtgggcgcgagaaacgagggggcgaaatagtgggcgcgagaagcgaggagccgggcacagcgttggcaagagtataaaggcactgaggaagggatctgtttccttcctttcgccattattccccttgtcttcgctgcttgcgccctaactccttctttcctgtgccctaccttcgccacacgcgctcgctcttaatcttctcttcctccggcgcca

SEQ ID NO: 20993 - DNA, 208 bp, Oryza sativa
agtacaacgaatctagacatgcttcctgtccagattcgttgtactattaagtgttccatccggtcctaagtttctatactatgagacggaaggagtagcatttcccctttagagccatagcgggaaaaacgacactccattgccctgcctcttttcttcgatggctacacgctctaaccctccctcatctattccccacccccaaagc

SEQ ID NO: 20994 - DNA, 1501 bp, Oryza sativa
cactatctcttgccctctatgtgcactgaattttagtacctgatgggtcaacctccttcgaaagcttaatggcatcagaagtggcaatgtcctggtttgctggagatatagccaaaatgatacaattgggctgcaaaatatcatacaaagtaacctattagccttgtataagttctcaaatttgaacaccagaaattaattaaacaatataacacctaaagttatttgggtgtgaataattaaacaaccaaaacagcagccaagttaatgtcatcaatttgctactagtacaagaatgctgaagacatggtattaaaaaaaatgctacttcgtttgttgattaccttctcaacatacgaccgaaccatattctctatatcatgaacaacactttcaggttgtccctctgtgaattagaagttgaacaagttagaggaaggtgggggggggggatgcacgataaactaaacacagtatcaaaagagagagaattaaatctttgattaaaaaaggacataatagtgcatacctacagcgacttttgtcaatccaggaagatcaatcaatgttaagttcacgactgcaacatatgggagtaaactactattagccaatcaatgtatagtatgagagaaatatgtgaagcagacattaaaaatcctagtttaaattgaggagtctttgacaatgattcaaaatcctatatagtatgagagaatctggataaactgtagaaagctacaaacttggataatcacaaaactattgcatgcatggtatatcattcaaagcatcttaatgtccagatatactcatagagtatcttttgaagattatatgaaaggccgcaaactggcccacctaaaactttctttcttcgtgaagatcccatacatttcaaaaagtttatgttacagggttaacagagttccaccagtgaaacacaatcgcagggctcgggtggtccagagaatagttcaattcaatttgcaagatggagatacatttctgggaggggattacaacataggttgcacatttgcaacaggaagaggttaccgttgggtgagtagatgctgagatgtattggcacaggggatatttgtttagttttcccagtcactctatctgtctcatctgcaatttcttgacgaacaagagctacaccacagtagagaaaaataagtggtgctgttaagtataagttttccttttgttttagaaagatgttgatatataagtttggcagtgctattttaaatcagaaataaagcagtggaaacagaatagtgcaataggacagacacttgaactaaagcattatttgcaagaaacagcaggatacagagatgtgaggtttacattacaatattgcaaagctgtataaagaaattaacggggaaggattgatttcaagttcgcaccaaaatctgaaaaccttgttttgggcaagtgtaagaactctgcataatcgtgggcccctttgtcgatctgatgcagc

SEQ ID NO: 20995 - DNA, 211 bp, Oryza sativa
gtttaggtttttgattgtttgcgtatagttgcggttaccggattttcgtcgatcgcgggttttctcgaagattcgtgaagcttcgtgaagaccttgagcaaggcaagtcaccctttgatcaattgctcctataattggaaaatcattattattttgtttgcaacttgcattattagaatcactcacttaacttgcttggcctcggtttgcg

SEQ ID NO: 20996 - DNA, 1501 bp, Oryza sativa
ccattcccatttcgtcgatagtgtggtccatggtatactcgctggtctcggccacctaggccttcgcgtagctcgtgtgcacgaaataggcctccgccgccactacctctgatgctgattctcctgcctcaactaacaccgtcacgttgcgctgctcatacatgccaaggtgagtgccctgcaaatgcaattccaaatcaatgcatctagccatgtaggtggccatcgaggaatatatgtatatgcatatgtaccttgagggcatcgaggtcgacctggacgcagggtgacactacgcagagctcgccgatgacgagatggtcgtcggaggatgaactccttggaaggatggggaggaggaagggtacaaagtaggtccccacgacaagcaaggctggggcggcggtggaggtggcgctagccaagggggaaccggaggaggtgaggagagggtgattggggaaaccgcgcttcaggctaccgtctcctccccctccattgctgcattaattttagccacactttggctcctcggtcctcacaaatatgctcacaaatatgatgtgacagtaatatgaatatggacacatgtatgtccagattcgtagtactcagtattaggttggtttatatgggacggagagagtacatcgcagagctatatagaaattattgccatgtcaaaaatacatcatcaaatatggcaacaaaataaataagccattaataacaatatgttaactagtaatatgttcgtgctaaatgctacggtgcaattctttttgtctttaataacctttaaattttcatgttaggaaaaaatatttttctatgatacgtgcaattgagttttatttcaattcatatcatacatcaaatatgtttcacgcaaagtacaataatatgatcctgcatgggtatcaccggcacacatacatcaccacacatgcaacaccatactcaccccacggatgtttcacctaacacacgctagaaccagccatacattcctaatctcactaaattcctattgaaaacctaattgcatagacgtaatatttgtggactttttttttctttaatgacttcaaactaggaattttgcaagaaaacgcacaatttaaattgatatgttttttctatgtccatccaagtaggaagctattttccaccctgatttatgtagaaatttatagtgaaaagatatataatacttccttggttttatattataagtttagatttttttttcatagctaaactttttttattttgacccgtttataaagaaaattttagcatctataatgtcaaattagtttcattaaatatgataatgataatgtgtctattttgtattaaaaatattattatatattttttataaatttgaaaaaaaataattaagaaaaagttaaaacgagttactataatatatataagagagagagaggagatcggccggaaccggaagggagaggggagtagacagacggggaca

SEQ ID NO: 20997 - DNA, 363 bp, Oryza sativa
tttctatataagatgtactccctccatataaaaagtctaagacatatttcattctttgtttttttaaaagtctaagtcttatttgtagtcactatgtggtaattaaattgttgattggaaccgaagtcattttatattagtacttattggtttcatgctcattggttttatcacatggtgaataaattaattggtcattggtcttgataaaaaagaaatatgccttagacttttcaatgatggagtatttggtcaaaaattttcctaaatgggttattatatctttttaaaagatttgtttcccataatgggacataatttgatttaatttgtgcgggcccatctattttatgtgcatttagc

SEQ ID NO: 20998 - DNA, 622 bp, Oryza sativa
tcacatgtgcacgctccagttaaaaccgctcaaaacagtgtttaggggggttatttgtccaatataaacaattgagggtgtaaaatgtctggttttatagttaggggaggggggtaaatcgagcaaccgtgatagtttagagaggtactccatccgtttcaaaatatttgacaccgttgactttttagtacgtgtttaaccattcgtcttattaaaaaaattaagtaactatttattctttttatatcatttgattcattgttaaatatacttttatgtacacatatagttttacatatttcgcaaattttttttattaagacgaacagtcaaacatgtgctaaaacgtcaacgataccaaccattttgaaacggagggagtaattcgtatttgttccgaatagaaacatagatgtatacgttccaccactccttgcaagtaggagtaattgcaaacaaataatttgggtgaaggcagcagtgaggtcatgtgctattacgattcatttaattcatacactaaatactaggatcttgagatggatccggaaactttaaaacggtctcatcttgggactattgaaggccaatcaccatcatcatcgctctggctctttgcagt

SEQ ID NO: 20999 - DNA, 273 bp, Oryza sativa
aataaataataatttcaaaaaattttgaataagacgagtggtcaaacgttacaagcaaaaacttaaaaaacttaaaatcctctcttatattatgggacggagggagtactatcaaaagcgccaagaaatcggttttttacattgacatgctacacgttaattgagaacaagggtcagcaaaagatagcgccttctctttcataacaagtaaattcaaaactttgcttccttccagtaatatcctcattcaaatggcatagacacacgaagaag

SEQ ID NO: 21000 - DNA, 361 bp, Oryza sativa
atttagtaccaatttgcttactcccagccaccaaagcagaatcttcattgaaaccaacattcccttgtcatatgataatactttttgacattcttttccctattcgaaagtatgggatgttgcaagctattaaatacacccataaatcaaaggtatctatctgaattatttgaatgagggtgtttggtttgtgcaggcattcaaaaaatcgagttctagccaagtcgaaaaacttacgatgcagcgcgatgtcgtcactgtggagcttaagtcagccaaggagcgtaacgctaatctagaactgcaactctcagaacagataggccgtattgaacggcttctgtcgatccaaaacagtgaa

SEQ ID NO: 21001 - DNA, 622 bp, Oryza sativa
tataaacatggttgaatcaaatggtcacaagtgttgatctcgactcaagcttgaccccaagatggatggcgcaaggcaaagtataatgtagctaagaatattttcttagtcttttcccggtcttggtgtttggtgtagaccggatttgctagatagtcgtcgtactttcaagaggggtctatgaagcgggagcttgtggatgatcttgtgccatattagttcatatgcatataggtgcatttggtgggcttgtctagccaagtgtgatgagtttttatcaagtcctaaaccaagaaagaagtgggcatgtccaataggagtgagtgacatcttgtgggtatgtccggtggatatcctttggagtgtgagccctttatccttggcttaagttgtgtttcttgcatggttttttcatgggttggatggccctttgaataagctttccatagagtacaagaacgccaaattccgagacccgagtcaagagatatcgccgttttactaacggtcggttgagctgaaaagtgacctgcggtctaaccatgggcattaggccggtctgaccgggcctgttagccggtctgaccggcgtggtaaggccggtctgaccggccccactagt

SEQ ID NO: 21002 - DNA, 1191 bp, Oryza sativa
ctccggtagatcatcttattttttttagcgtcttggtcttaatttcctgacaactaccggaatcatgtaatcgtgacgcataatatagcacgtaattgggactacgcatcttgttagctacttaattaatttcgatggaatcaattggttgacagaccttcattttgcaacgcaaaatatatttttctcgcaataagcagttataaaattacctctaccaaacagcacattggtcgttgacaatagctactcccatctctatttaatgtaacgtgctaattaaattaaaaatattaaccacgagatacacctgtatctacgcgtataatacagtcctataccaatccatacccgtaccttcccagtaaaggaatattgcaatacgtatatctctctctgtgttgcagttaattttcttttctttaaatatacttgttaatttgaagatcatttcctaatgtaacctgctcgaaatcttcaaccacaaaatacacctattccagctcagacgcataccttcccattaaagatatattacatacttattctctctgcgtttcagagaacaattccaaatataattgtttctttgaagatcatttcctatctaatctaacctagtagtgaaaaaaaattccagccataaaatatctgtattatacgcatcctcagttctatgcatctcagccacaaaccttcccatcaattgaaaaacaatttttttatatgtaaatgaagtaggaggtctgtcccttttattttatacctagaagggaacaataaagaacaaactattctaagatataccatcacaataccagtagtacatatttatctctgtatttcacggaattatacttccaaatacacacatgttactatcgagttaatttcataatgcgttgcagccttatcctgcgatcaattgattacacgattaatttagacctaaacgcagcatttgtcgcatcgggtcatgagtcatgacgcgaggccagcgacgtaattacattctaaactttgtggtattttcaccaatatattttccgtctgaccttcgcgcggcctgatcccctcacggtcgtcgtcgtcttcttcccaacgaccgatcgatcgatcgatcgatcgtcgcggcgagaagggagatcgatcgcgatcggagccgatttgatcggcggcgggcggcggcca

SEQ ID NO: 21003 - DNA, 269 bp, Oryza sativa
caaaatttgctacatggcatctaaaatttgtgtaattggtcataggagaccgtaaaattgtgtgactgctaaaggacatcaaaaaacggtgtaattggctacaggacgccgaacacattattttataattttcaaggcaaagtagagagagaattttttaaaaagacaagtttacccctgattaccctttctccccatggctatgaggaggcgacggcagcttcaacggtggcgagtggcagtgcaagcaaagcagtgacctgctgcga

SEQ ID NO: 21004 - DNA, 160 bp, Oryza sativa
tcgtgaggtatttgtggctacatacgtataataaatcgatcgatcagttccccgaatgtggacgtgcgcaataacgaacatgtaaccgtttctttttcgggacttgtcaatgtcagtcgagcaatgcattataacctcgcccccaattatcacttgtagt

SEQ ID NO: 21005 - DNA, 160 bp, Oryza sativa
gcaagtagttcatcatgtggacttattccctttttaaaagattttgcccaggattgtctagtcatggaattacaggtgcaggccacatcatatgggctgtactatctatgaaggcccaggtatcacctcacgtcctcatcctcggccgcgggcccacagc

SEQ ID NO: 21006 - DNA, 1106 bp, Oryza sativa
cctttagtagatcaatttccttaaccgaatatagcaagaatccgacaactgacgacttgacaactctcatcggctaatctcaggacttcgaagccgatgctgactctaagccgatgactacttcgggcttgccaaatttcactgttaacacattggtaagtggtactaagcagtaacacatctcattgatgttccttatctcaggtagccctattatgctctacttcctcgtcaatgttgtccctcttacgctacctatgcacctcaatctgctgtttttttcccaaaccacatcactgccatttactacctccgttacgtaaaaaaccaacataatactggtgtgacacaccctagtactataaatctgaacaaatatctgtccagattcatagtagtagtactagaatatgtcacatccggtattagattcactttttatgggacagagggagtatatatcagtgtaaaatggaaatttgctaattccggctactccatcatccttcacaaaaaaatgagctataaaatattgggaatgtgtcttctggtcattagattgtttcctagaaaagaatcaaccgattccacgtttgcaatctcttcaagatcacccaattaaaccgtgcaagcacacaagaagatcagatcaacactgttacgtagacgtcacgttagcgaaactgtcatctaaaaccatcgagagagtcaaattgcaccagttttaatagttgcgggtcaagatatccggtattgcggttcaaaatacaaactagattcggtcactagttaagatagacaaactgaacttattccattttcagaggaaaaaaatattccaattgttacccacgctacgggcccatcccacctctcaggaatactgggcctcgtgtcgtgccaggcccaatacgcgtcccctgttccaccaacctcctctcctcagatgccacgtcacacactgtcacacacaccagccaaaacccgccgctaccgatcgcgctctccagatcgattcccccaacatattagggctcacgcctcccaaagtcaaaacagcccagcccgaacaagcatttcctcgaacacttcgccctccaccacca

SEQ ID NO: 21007 - DNA, 216 bp, Oryza sativa
taaacaagcaatttgatcgcccctacacctcgatcaatttaaaactaaagcactagttttaccgtcttcttttcttcgcttcgcgccatcaattttaatccatcggtagtcactcatgcgcacacacataatgtgaacctaactcaaaaaatatatagctcaaagacaatggttagtccacaattagtacttgtcattaattaccaaaattaacaa

SEQ ID NO: 21008 - DNA, 272 bp, Oryza sativa
gccctccgcgccctcgtcttcagccagaactggaggggccgtccttcgctgccgctcggcccggaggagaggagagccagcgccggcggagggaggaggggagagagccggtgttgagactgagtagtagttgggggatttggataaagtagtatttgtgggtgaagatttacattgttctctcgattttagggtggttactgtaaaatttggactcctttgcaaattgataaacacatgagggctgaaatggaaagttacaggggctgaaa

SEQ ID NO: 21009 - DNA, 753 bp, Oryza sativa
atactaattaatttcactataatccgtgcttggttttccgtgtcgggtgcctcccgaacacagccaagtcatcgatctgcaaaacggacaatggaaaagtaaagccattgatctgcaggaaaaggctgttgcattttggctaggttgtgcggggacgtcatcaggtggccaagcagcagcttttccttttacggttttaccaacttgcccatatttgtaactccgggcaattaacacaaagtactctactttagtggttaattggctagttatactagtcgtagtagttaataatataagtagtactccctccgttccaaaaaaaacctaactctagatttaaatctggacatagtgtatatccaaattcaaacccagaatttaaattctttttttgacagagggtgtatattactatatattatatcactttcatcttcgtgcacttgctggcgctgccaactgtgccacgtagactaccattaagctcctttaattaactcgatctacttctgacagatgtactcctatatagtatgacagtgctctctcgtctacctgcaatgcaaattggagtaaacccctagctagaagaggctagagaagagcaaatctctcccttctcccttgtgtccaatgcatctcttgaatttactgtactctggagtagaagatacgaacaatgctcagtagtacagtaaatccatggatggaacggtagagtcggtgtttgcgggcgtggcatcatcaaga

SEQ ID NO: 21010 - DNA, 1501 bp, Oryza sativa
tttcctgcgtatatgtttctcaaactattaaacgatgttattttttttgaaacatttttgttgaaattttactgtagaaaaatcataatgatctatttccaagtctttttaatacttaattaatcatgctttgatgaactatcttatttaggttgtgtttcttttcaaatatacctatctaaatttataattcttggatatatcacatcgcacttattttgagaccgatagagtatactaccaccgtcctaaattgcttttcctttaaaattgtttggcatattctaaggtttagaataaaaaactacaatacccttataaaaaaaattatgttttaagaatagaaggttggttgacagaagtttgaatgatatgtgattgatgagacaagtaatacttggaagtgacaagtactgtgagacaaaaattaaatggtagaaagataactaaggttgtgtttggtactggaggatgaggatgggaacatatcttctccgtacgaaaaacaaagcggtctattagcacgtaattaattaagtattagctattttttaaaaaatggatcaatataatttttctaagtaattttcgtatagaaatattttgcaaaaaaacacactgttttgtttagtagtttaaaaagcgtgcgcgtggaaaacgagatggggagtgggaacttttggtatccaacacagcctaatttgggatggaggaagtagtacaattttagcaggatgtaaacaagagttcatcccttgtgagtccacacaaggaccctatgcagaggagccggccaaacaggaagtacattttgcagtagaaaaaaaaaactgctgctttttcggtttcccccagtattgttggcccctctcttttgctgtcccactcccaaatattccaatcctccctggccctcttcttctctctctctcttctgctgcttctcatcttcttcttcttcattgttccgcttctccctccctgcctcacagtcgcagcagcagcagcaccacgccaatgctgcctccctccaaagtgccccctgttttgcttccgctttgaccctcttaaaaacctcaataactccaaattttcccaccgcctaataatccccattaccgtctcctctgaatcgttggatttgatacccccagggattcagagagagagagagagagagagagccaagaaaccctgtagctgctgtaggacgagtaggagtaggagtggttttgcttcctctgttcttgtgttgggattgaggaatgaagagcccgtctcccgtggatcctgagtcgccgagttctcccgattgcaaggtatgggttgggtggtggaggtcgtgtcatgtttgatggttaatggtctaatcttgtcgggtttgcgagggttgtggtggtcgtgattgattgattgatcatggtgttgttgaatcttggtgcgatcttggattctttgctaatgtgtgtgtgcgcgtgtgatttgatttgggtgggtggat

SEQ ID NO: 21011 - DNA, 169 bp, Oryza sativa
acgtgaaaacacacccctagaatggcgatgaggacgaagctgatgtggagtttgatggcgacggagccatcgccgtcaagcacgcaaacttatctagctgcgactcctgatgttcctggccgtgatcgagctcctgcgttcttgcttaatttgagtggtcggatcggct

SEQ ID NO: 21012 - DNA, 610 bp, Oryza sativa
aaaatttgtcgacaaatgtataggtggtcccatgtgatatatttggtccgatataaagtgtggtcgcgtacggtaacagtgagaagggaatttttctactacgtactacatccgtcccaaaataagtacagccgtagatatccgtgcccaacatttaaccgtccgtcttatttaaaaaatttgtgaaaaatttaaaaatatttaatcacacataaaatactattcatgttttatcatctagtaacaataaaatactaatcataaaatttttttaaataagacgaacggttaaacgttgaacgtgaataatgtaaaactacacttattttaggacggaggtagtaaaaagatgggtatgcaacttgagtacgtgcttgacataactgtgatgcagtccaagaacttgatcgcgaaggaccgagatcctctgagaagaccgtgactttgatccattatcagtcgtccgatctacagtatctggtgaatagtaaatcaaagcagtagtttttacttttttactgtgtctacagtaaaaaaactgcagagcaatgttttgcactgtaacaccagattcattttactatgtttatcttccgttcgcttccaaagt

SEQ ID NO: 21013 - DNA, 1094 bp, Oryza sativa
atagatctactaagccctcggtgaataattcaatcacaagtaaataattgagtaaaatgaagtcacctttttattgtcaaagttttactttggatcacacttaaaccaatcttttcattttagaccggataactttgcctatagtatttggcttggatcaccccactctctttactattcatgtatagatatgagcagcatataaaaggggaagttcaccattataccgaaaccgatttgattgaggttatttatgggtgtttgaagaagttaaggatgatccaaacttaaaaaaaattgataaaattttctgatcatccaaactaaaaaatatacaaaactatctgattctaaagtgaaagattgatttgagggtggtccaaagtaaaacttaggcccaaatcacaatccactcgcaataatttgatccagtgatcacttgggcctcatttctctcatgggccgtgaaagaggtttcaaggcccatgacgcacacctaagattgaccagttcaactaacgtttgctaaatttaagcggaagccgttgaaaagccaaggaagcaaaaaccacccgtttgtggcgcgcggtgatccataaacagtaggggcctcccttcgggagccccctttcctcgcgtcgtccccttcgcggagcctccccttcgggggcgcgctccattgttttttcccttccaacccaatcctattatgacattacgatgcctatccccattgctttctttttcttcttccccttcttcttggcggcttcttcccatgcaacggcttcttcccatgccacggcttcggtggtcccacaaactcgaggtaattcatggtactcccttcattttatattataataaattttatcttttttattaaataatccattttggtaaacttataaaagaatataaaaatattttctacaaaacaaacatatataatcatagtatatctaatggtggtggtgttgtatatgttgctaattgtttatgtaaacttgattatatctaactgatcagaaaaaaaagtttaagccactaattatatcacaaacacggagtaattgattcttgcatgcaagaaa

SEQ ID NO: 21014 - DNA, 579 bp, Oryza sativa
gcatattagtaaactataaagatgcttgtgcatgtactattatcatttatcatacagcatgctacccttattaaatctactacaagtagtgcatattagtatactataaggatgtacatgcatgtaccattaccatttaggcattgtttagttccaaactttttcttcaaacttccaacttttccatcacatcaaaactttcctacacacataaactttcaacttttccatcacatcgttccaatttcaaccaaacttccaatttttgacgtgaactaaacacacccttattagaaggcacgaattttggtccattatatatatatacatatagagagatattcgttttgaaaatatcgtattagactgtttccgatcgtcaaaatattaagatttaattatgggcaaatgcataatagattttcttttcaggctttcagtctctccaccatgttttcataaatttcataaaaacctataataacatgaaggagaatacagtgatgattgttgtagtagaacagtagaagtacacactctttggtactacactccaatactccatcgctcatcgacaga

SEQ ID NO: 21015 - DNA, 488 bp, Oryza sativa
tataatttatacgctttatatgtgagaaatgatcaattagtacatcccagcttaatcaaactctgctacggcaggcagaccaatgtatctctaccaaccacaacaaaaactattgttaaaaatttacaaatggataacaagcaataatagtatactcccgctctctgttttatattataagtcgtatactttttttttgttagttaaactagtttgtagaaaatataattacattttcaatactaaaaaatctcaaacgacttataatataaaatatagttaaatttaatgaatctaatttggtgttgcagttgttgctatttttttataaatttagttaaatactaagaaaaaatcaaacgacttatataagtataaaatggaggaaataccatttagcaaataatagcatgaagagagaggtgaggacaaatacatagcaaaataataaatattttttattcagtgttcttcttagtactccacga

SEQ ID NO: 21016 - DNA, 689 bp, Oryza sativa
tatatcacattcgtttaaaatctcttatttttttgggacggacggagtacgttttaaattgagtgaatattagatgttcgaaggtgcattgcagttttacttctgtttggagcaacgaagccttccatgtgattatgtgaaataattcaatttgaaaagattccttccaggtttctgttttccaatttccattcaaggcccaaacaagaaatttatttctcgctgttggcgcactatcccatccaaatggaccaatgatcatctagattcgttgcattatgatgtattacattcaactaaaatctttatatatagggactgagggagtacatgagctgcctgacttttgcttttgtgtcatctgtcactgacatcgactaattaattcgagaagacgcaaatgaggaattttgctacacttggcggttgattagcatttgggccttctaattatgcgtgattgaactttgcacgttgtttctttgccaaagagtggtttttctacgctttattagtgctttacagatcaactgaatggtggttcgagtcaccacaatgtcctttggatgttcacaaatcacaaatacttcctccatttcacaatataagttattctaacattttccatatttatattaaagttaatgaatctagatagatatatatgtctagattcattatcatcaata

SEQ ID NO: 21017 - DNA, 474 bp, Oryza sativa
ggcccagaatgcatgcgtcagacgtaggccgattctttttcagccccagcattaggccttgttcgtttaatcccaaaaaagggatttgggggagaatacatcacaatagatatggaaaaatccttccaaatccccccaatttttttgtggaagggattaaccgaataagatcttaatgggacccaagaaggatgccttccatttcccttcaaaattaattatactccaatcttttatcaacgactttttcttcctaacgaaatgagagagggcgaaaggggtgaatggaaagtactccgtgctacccgttgccacaccatctccagctatacggatcacaaccactatcggttgccaactatttgtgtctattgttcgtcatcgccttccaaatcaccttacgtcgccaccacattctgaacacttctagtgtgtcgtaaagcactctgccatgctatcactgtcttccgcaga

SEQ ID NO: 21018 - DNA, 165 bp, Oryza sativa
acacattataggctgctagaaaatatacaaaaatcctctaagccttaattgacttttaactttgcacattttaattgttggaggctttcacacggtttttaattattctaggcataatttagaggatgtattttagagtcgttttgggacgtgacattgtgtagg

SEQ ID NO: 21019 - DNA, 1501 bp, Oryza sativa
aagttagaccatacttcaaactcgtcattgggaagaaatcctgaatctgctggtatgatattgtggaacccagcagagacgtgaaactgatgcacaaacttcaaactcgccatgggaataaaatcatgaatctgttggcgttaatatctggaatccaaacagaaacgcgaaaaattgttgtgcacaaaacgaagtacttatatccccgataacatcctggtatgttgggtacaatggtagcaaaattcaccggacaatttgatcaccatgtgatctagacaggagcgaggctccctctcgacgacttgaatgtgcttctcttttttttttcagcatacttctcctcctaggtaaataccccgctgcaaaacttcacttgccataataaaacttcacttaccataatgagaatattgcatctcaatccaagagcggtagatcaaacttcaaactcgccttgagaataaaatcctgaatctgctggtataatttgtaaaaccctagcagaaacgcgaaacactctagctgcataaaacaaagtattttgatccccgtgcagaacctcttagtaaacttggcttgcaaatatagccattttgaaagtgaatttggattcacctcgacagaaccaagcaatgcacagaactttaattcctggtaaactccgtgtgccacaaatttccaaccgtgaaaattaattcacgtgatcagaacagaagcaatggctctcggtggcttctgatttttctccacctgtgtgtgctcgaggatgacaccggccggctgctgcttcctcgacgcgtgcggctgcgtaggcgtggacgacggctgctgcatcgcctttttatcctcgcacaaaaacaccgactccgcgtcggacttgatgagccaacaaatccatgcggcggcagaagatcgatctcggcgagacagatcgattcgactacgcagagtcgttttcgccgaaaactcctgacaacagcgtggggaagatcgatatcgccgaaccggcgaaacgacgtagatgtgaaacacggcagcgggtgaattgcggaacagatctccaatgctctgataccacttgttatgaaaatagatgcaaaacggagacacgaatttttacgtggaaaacccttgcgggaaaaaacaacgggcgcggaccggcaatgatcactattgtggagttcgatacgggatacattgagttgtcgcaccctccccgtacggcttacaagggatatatatataggagaaatctaggagtcctaatagaaaactaattctataaagtagagtcctattggataactaatcctattagataactaattcgaatatattgtgggcctgaaattcggatcacatatttaacactttatacatataaaatttgtacacgtacaaactttgtatgtataaagtttatacatacaaatttaaaatttattagaaaaataatttatattaaaaaaatcatgcatgtggacttttaaggcccatg

SEQ ID NO: 21020 - DNA, 474 bp, Oryza sativa
cacaatttcacacaagggatttagttggtagcagctctcacactcccttcgagcaaatattgttttcaggtacttatctcatttaacttaataagttgcttgattattgggacttgggagcaactcacacactcccttcgagcaaatattgttttcaggtacaatactgtcgatgattctattctacaagaaatgtgaattatggaccattatactaccttggtaaatatttttgttccagtttgaagctgaaaaagttatttccggttgttctgattaacgtggttcaaattgattcttagaaaatgaaaagtcttcagtaggtcctgttattctgtaacatgtaggttctaattgatgcttagaaaatgtggatttgggattttgttatagcgagcggactgtcatcaatattaacgaaaacctgttgcatattaaaactgcttttatatgctcatggtgtgttcttcaagg

SEQ ID NO: 21021 - DNA, 1501 bp, Oryza sativa
acggaaatttttggctctaaaaattggagaagttaacctctaactattttgacaagaaatttttaagtcctaaaatttcgggtatgttacacttccaccccaaataatgaggaaataggtcccgatcttttgataggtattgattaacaatcgatttggtggagtagcgacacaactcgatccggcttctgaacaaacacgctcttaagccccataatcgcagcaccatattttctctggttatcaaccatgccgaaacccggttgaccttgtcgagaaggctaatccctatatgcgaattcaagaacacaagcaagaacaagatagattgcaacacaattgcatatgaatgattaagcactcgaatttggggttccacaaaccgatctagcggcgaaactgttcttgacagattaatctaagcaaaaccccctctaaacgatggtggctactgaataaatatgattagggacatcgtagggttgccttagggtgcacacccgcttgggttaagcccacgacacaattacaaggcccaaaacccaaatcagattcggactggataaggtatgtggcttgttttgcagattcccgacagctcggtaggaattttgatgtgggaccaaaaccatctgaaagtagactccataagtttttcaaaaccatctgacagtactcatgggccccgaaattccttctatatcagcagctaggtccgtttgaagttggtgctgtcaggaggcccgaatccaaatcctaaacgtgtagaactttatcttttgtcttctatgtgttagtggtatgccctagaggtaatcatagagatgattgtatcacatactatgtttacatatttatccgacattgttccttgaaatagataactcattattggttaatgaatatgtgattctttcatgagactctttatgttgtatgttgctatttctaaaggatccctgatcaaatatcatatgtgcaacaaatatgtttaaatgatcagcacatgtattaattgatgatcatgtctcatggatcatggtatagagataccaaattaataatgtggacacatgttgggagaacatgttgttggatagacccaacatgagacactgcaagagccatatgtgttggtattgaattcttagacctgagattatcatggttcccaacatgtgtagtagcttacttagggactactaaacgctactccgtagtgcgatacgaataatcaagatgagatttacccctcttatggagagatatctctgggcccctcgatgttatagattatgaaagtgcatggccatgccaaaggtgattgaggagtcaatcacaagttatataatctatcacaagttcaagtgaatgattgagctattagaggatggcacatatctagccttgagcttaatcgatatcgtgaggcaaagggcactacaagaatctatttaatatgtgacgaaatttgatgaaattttcgtgatgttttcagaga

SEQ ID NO: 21022 - DNA, 474 bp, Oryza sativa
taaaaagaattacaaaacttgctttgcgcaaaagaactatggccatcctttgaactccccctttcatatgcattgttgctgtggtggcttgctgagtacggttggtactcatccttgcaaatataaaatttatcagaagcgggagatgaagcctcggaggatccctatgcctactatcaggagggagatgaagacgatggcgtccagtaggtcttagtacggtcgttgcctgtggcaatggcatgccgctgcctgaattccgctgccttatctatttctgcttttggatgtattccggacctctcggtccgatgatttaagactatgcctgcgggcctatgatgtaataattcgtatcagacactcgtgtatgtgcacttgatatttcagctatgaattcgtgtgtaccaaactacttgatccagggaaatggtactgtttacacgattgattcctgttataaaaacgagggtc

SEQ ID NO: 21023 - DNA, 410 bp, Oryza sativa
ctaatgttgggaatgaaaagattttattttgttctcaaattataatcatgcaatggtttaaattggtcatcacctaaattaaaacggaaatttttggctctaaaaattggagaagttaacctctaactattttgacaagaaatttttaagtcctaaaatttcgggtatgttacacttccaccccaaataatgaggaaataggtcccgatcttttgataggtattgattaacaatcgatttggtggagtagcgacacaactcgatccggcttctgaacaaacacgctcttaagccccataatcgcagcaccatattttctctggttatcaaccatgccgaaacccggttgaccttgtcgagaaggctaatccctatatgcgaattcaagaacacaagcaagaacaagatag

SEQ ID NO: 21024 - DNA, 262 bp, Oryza sativa
ccgtgcaatttaggtcctataatagtataggctgtgttaagttcctgaaaaaagttggaagttcagaaaaaaagttggaagtttgtgtataggaaagtttgggatgtgatgtgatgtgatggaaagttgaaagtttgtggtagttgggggtgaactaaacacggccatagttatctggtttcgttgacgtggcatactagttaaaaaaaagatatggggcccacaaattagcctattctttcttctcttttcttgccaacta

SEQ ID NO: 21025 - DNA, 1501 bp, Oryza sativa
ccatgagagcaaggttgcctaaaagtgatgatatcatcaaacaattgaagcaagtggtgcttttgaaacattttcatgtatacaaaagctgtggctaacatacatgaaaaaatagtagaaagagagacagcagccagagaagatgttttacagtccagtttgtttaaaaattaaccatcttgagcaatacaagggaaaatcttctatacgccgatctgaaggatttcttgtgcacattcacagttgacatctgcataagatcaaagagggaagacataaaactaaatgaagaaatgtatttgtgtaaaggaaaataaaattctataaatggataaacccaaacttttgttctaattgagttcagaacttgaaacataacaatgggaaatttttacaacaaacacagcatgcacatttttgaaatgcccacaacaaaaaaaattaagtgcatagaactagaaaccagacaatgaaaagagaagtacagttaacattgccttgctacattaggaacaaatatcagttatgagcagtattcatctaagaaaaacacatcagtgcaaaaagaaagaaatagatgcatattactatcatgaattatgtacactgttttgtgcatagacaaaaaatcatgacttgagttttcacattgaagtatggcatccagctttatttcattgcactattctgaaacactgtcaagagtcaagactattgaagacaaagttcatacactaattctcatccccatcattaaaagtttagccagttatgtaacttttttaactggacttcaaactctgaactctgtaccagtaatctgtaacttttgaagttatagcttcagttctcccttaattcctacaaatattcacatttttcccagtatgtacatgctaaaataaatcaaaggcatcaaacatgttaatacatgcacttattcacatttattccaatatgtatttgctaaaacaaataaagaaaacgcttgtcataacatgctccggcattaagattcatggcattggctcattgatgcaaagaatagtttttgtgagcatacctactgacactagtcactaatgtactttcagaccagcaatatacttcaatcagaactatgcacaagaagaatgactgcatcaagctgcatctgccaattaaatgaaatttcatctccgcactgaagcagaacagagataaaaccatccatgggtgcaagaacagatcaagcctgttcactccagattatgggagaagcaaatatgttcctttcgataagatgagaagcgaaagagctaccggtgagaggggcaccaatgcaggaaccggaggtggaggaggtctgcaacgtggctcagcccaatgttgaataaaccccggcgcgttctagttaggatagttagttgagtttccttgttttcagctgagcccgagttttgggcttgtcttgtacagaggctcgacgtgtgcacgttcacgcgggagtctggtagtcgtg

SEQ ID NO: 21026 - DNA, 824 bp, Oryza sativa
ttttatttaggtttaattagacctaaagtgtatatatatacttatacatgtttatgtattacttaaacaacactatgtgtttaaattcttatttcactaagttaaggttttgatcaatgttctctacaaaaggtgacaaattttattttactatgttgaagataactatttgctggttctatagaaactttgttcatttcatttggactaaaaataaattttctacaagttttacaaattaaaggctgctctatgttagtaaatccttatatgaatatttagagacttttactacacagtaagtatataatattatttcataacatggaaatacatgtgttagtgatcctacataacttaattttattcaaattgaagctaaattgggttctacatgaatttctaaagtttagcttatctaaaactagtcattttaaagataatagttttagaggcttttgatgcaaagtaagtaattacttttatttcacttaatcagagactgtatgatgatgaatgatgaatctgtagaatttgattttgtttcaaaatgagttgaaatgaattttctatgtattttataagtttgtacatgttttatgcatgacttatcttagataaatcttagagacattatttgtacagtgagtgtcaagttttatattcctggaataaagttcataacttcaagaatctacagaaactggaatcacttcaaaatgagctatatttgattttatatagattttacaactttgtgcatctttctgctaaacatataattgtttgggcattttcctaatttttcttcagattttaaagga

SEQ ID NO: 21027 - DNA, 211 bp, Oryza sativa
ctgtctgacactagtttcctttcagccttaccctcctcctgtacaacaatcgtcaagtgaccagaatgtcttagccgattgtggggtgtcatcacgtcgagaaagaagaacaaccagctgctcctgctatcccagtaagtttctttttgtctcaacaagcattcagatcggctatgactgtttctaactgcttctaaattgtcactgcagg

SEQ ID NO: 21028 - DNA, 1501 bp, Oryza sativa
aaatcatgttcaatcttatatctcatccctctttagagattattttactttatgtctcatgttttgatttttaaaactcttatcttgctctataggaccgaaacattttagaaatactactcttgttgaattttatttgaaatcacttaataatcacagcaaaacagtaacatagtgttttgaaaagttttgaaatccatttgcaaactactcctatgtattagcacggatttctaaaatatcgggttaaacatagcccctagaaaatgggttttgagaatgagtcgataaaacttaaaacttgctagaaaatattggaattccatctccctatgttatctctgaaccaaaaatgaatttggtgggattttgtactttcctctcccgatatttcaaaattttatcggtatgacctaaagcgtgcagttgggtatagaatagaatttgctgtgcttaaccctctagattgtttgcttagatggaccacccaaaattcatctagcctctggaccaccctaacataatatgactaaaatggtgataaaatttatacaacctaaaacttgattaaagtttctttttgtgccggttgttctttttctggaatcttgagtcagtctgcttgttaattttgtctagactaaaccgtaggtgataaacatgagaatttttacatgcatcatgtagactaacccagtaagcttcatgaattttggcataatttttagacccctgcatcatagtgaaacaatctagatagttagcataatcatattctggaaattggtagtagctgcattcatcttttcatgtagcccaaaccataattgattaaatatgcatctttttacagtagttttcatacataacctgtaggctccacgaattttggttgaattttttttgagtcattgcatcatggcataaaaattcatataatactgtatagttctgtccggaaatctgtaggttgtcagtttcacaaatttgtgtagcctaaactacaaatgataaagtcatgattccttcagggtagctcctaatctaacccatctatctctctgatttttgtcaaaatttttgtatctttagagctagacctaaaaatttgattaagacagtaaagtgatgaatcccagcacctagcactcatgtcagattaacccctatcctttgaagattattagaaaaccctagtgcaaaaaaaaaattattttaatttaagggggatagtaagccatattcgtatcaaaactaaagataaaatttttaaccttgtataattcttcttagacctaaaatgcaaatcccattctagtaagccctgtaccgttaatatgaccagaattaatgattagaggtctatataaccataggttgttaaaaaaatgtgtgtcgaccttaataataacagtaaggaaaacctttaatttgtaagtgttaattttagaggtttttggctaatccgtgttctaaattttattcttatagatgcctacca

SEQ ID NO: 21029 - DNA, 1501 bp, Oryza sativa
gcgtggaccgagtccactgtgcgccgacctcctttgagccaccgacaggtggggcccgctcgtcggcgccacctattcccccccggtgacgtcataaaccattaataattgcgcaataaatcattaataattatagaaattcatttaatggctcaaaaccttctaaaatccatatctaattcattcgaattccgaattgagccgttcaacttgcaaaattcatctaaaattgaactctacatgtttgtttagtttttatgtactgttcccttggtttttattagagtttttcctcgttttgcgtgccggcgtgtagaatccgtcgtttcggaagtccgcggtcgcgaggaaaagagttcggaagatcaaagtgaagaagcaaggcaagtcacacattccccttgagcatattgagcctattttataaatgttttaccgtttgcaaataagtatgcatgttttgttaattacatgggatccgggtattacctatctgctcgcttgtgccatgtttacttgatatctgtcctttgtcaaccgggggtaataaatcgactagctcatgttacttatgtgacctagctagaactatatgcttagccatgcttaattaccactagcttagttgatgggataattacagtattagacatttttagtatcagaatgagctgcgtgctcgagacatctggccatgcttcatggtcgtaattattcaactaaaatgcgactgaatggtgggctgtgggtgcatggttttgctagtcgcacccatggcaattaaggaccggttcgcgggatgccctagaagaacttatcgtacttaccacaagccagcgtgggcaacggctgggcttgtagtatagcttttctctagctgacgcatccagacaagggtgggcgtgatggagtttggatgggccctgcgacggcctatacggcttccggattcacctaggcacgagaggggactgcccgtcgcccgctggggacgggggtgaaacctgaggtgtgatgtgcttggctagagggggttatgcgaagggtcctgtcacggcctctttccggtatgtcgtggtggcatgtcggcgcacggaaacgtgtcgtggggctgtgtcttgtgggtacagttgtacacctctgatcagagtaaaactattcgaatagccgtgcccgcggttatgggcggtcgaccagattcaccgtgattagtctcacacttaataaatcgacccaatgcactgtagttcaggtgggttggttgggcctgttcaacgtggtgtagcgttgatcagtggagatttaatgttactttaattactcaattgttttactgtttgctcaataaaatgttttacagccgcctttatgcaaatagccacaaactgtccttgtgttccccttgcacgtctgcatcgttggtgtggcttgctgagtacggtggttgtactcagcctgctattattcccccttttcagaagtgcagtgcttctgagttgaa

SEQ ID NO: 21030 - DNA, 1501 bp, Oryza sativa
actgttgcagagtggatgttgcgattattttgcttgggttgatggtccgtcgaacagtttcgttagagaagtgttgaacgatttgcgcgacgaagtgtggaagctgaggagggagaagggagatttttcggctgctgttgaagaaggaagatgtgtgcaatcagagctggttttagctaggaatgagttggccacatcgaggaaggttgttggtgagaaggaagctgtggtaggggtgttgaaggataggaatagtaggttaaagtttgagatatgtgtgatgttgttggtagatttaggactggttgttgttgtgtttgctatgttgatgggtaggaaatgaatctggcatctttttagtcgcagtggaatgtaatgttgtcagttatggaatggaacttggttggtattgtgtaatggaatctagaatggaattgtgctaagtttgtggtttttgttggatgaattgtggaaagttggatgttgaaaacaaatggtataatggatggaatagggtgatgcaattttgagtaggatttgtgcagctgaatgatgaaatggtctgaatcaaattttgtgtgttatttgaactctgaaatggtagattatgaaaatgggtaggtaataaagaaatgattagtttgatacaaatttgagcaaatcaattgtgcaataggccacatatgataaaattgtagaatgaaccaattaatctgacatcattgtaaggcaatattttcagaccaacatagcaggtgccaattttgttgaaaaaaactcagcaaatttcagctcaatgacataggccaaatcaacaaaactcagcaaatttcagctcaatatgacataggccaaatcagttcaggcatttcatagatatttcagcaaaagaacaaataatcaggcatagcagcacaacacacatcagccttacaagtctggcatagcagcattctaaccattacatgacatatggcatgaatggcattacatcacagataggataaatagctaaggcatgtcaatacttagcaatacacacagattgattcaaagtttgtcagattcccatggtggcagcatgagaattgatcctggagtcttggccttcttggatggagcaggcccagtagatgttttcttctttgctggttcttgagctgagactgaaacagatgccttcccagatatgatctgaattgaagctgatgtagaaccctgggaatatggcacaattgcctacaggttgactgttgcggaaccacctgactgtgttgcaaccgccttagcattcatcctaacaatatgatcatgtagcccctgaaaaattatgtagacagtgtgaataagcatataggttcagaattgggaaatgcaaattaaagtaagaacaattggaaaacatctaaccttctgtttagttgaactgttgttgtgtgttaggctaatagaaccatagttattagaaccggaccagaccggcggttcgaccgggaaaaat

SEQ ID NO: 21031 - DNA, 247 bp, Oryza sativa
ttttttcttacagtgtagcaacctccaagttgctcttgacacgggaacgaatagtagcccatttggatttggtgacttatccacagtcgagtaccctgaaaccccttaccaagtagaactgtaagtatcaacaattttgttctatttaactaacttacaccatagtttttcctgtacacatttataagttttacattttttttattttctctacctagtcatgattgcgggttctgcgttctgagaa

SEQ ID NO: 21032 - DNA, 1501 bp, Oryza sativa
agatcgggatgtgccagcctcatgcacgcaaggacatggcatgccccggtgtagatgccgttggacgtctcctcgccgatcctagccgcatgcttggaggggatctcctccatcaccgtagccagttccacaagcgatgacgtcagcgagaactcatcggggtgcgccgggatggtagtcgtgacaccacactccccggcgagttggtgcaggctggtgaacgatgttcgcagcgaaccgcggatgtcaatcatatggccctcgagctccaatatccggtgctcgagtccgcgccgctgcatctcgttgccggccaccagctccctcatctttaggaggtcctcacgggcctccgccaggtcgcgcactagctggtcggcacgctggtttgccgacgccgccgccgccctagcctcctcgatctcgcgacctacgccgcgagtaccggcctagaggatgcgctccatctctgcttggagctcccccccaggtgagggcatcggtggacggaccccgggtaggcacgaggctgacggcagggccgctcggtgccacctcctggtccatagtagcgaccacgactcctgtcgaggtcgccgtaggggacgcgctggaagcggcatcagtcccgccttgcgccgcctttgcccatgccgccctgcaaagttttttctcttccccatgaggcgaggtgatcggaatttggaaaataacaagatctcaagaacgtttacttacttctcgccgatagtcaccaacctttgccttcggtgaggcggaggagacgcgtccgagtcctgagtaagatgaaatggtatgagatcaaattgttccgactacgcactagggaacgatagagaagcttacagcagagtttggcatcttccgacgggtcccaagtacggaggagaatttcctccccttcttcggaacattgctgccactcgtggtagcagcagcagcgtcggacgcctccttggcgacgcccttcttcaatgacaccgccgcctggtggtccactagtggcccgatgacgtccgtaaagggagagcctgcacaatgtgaagtcacgacgtgatctcaaggagaaagatgtaaaggaatcatcgagtacactcacattgatcgcagcggcgcgttcggctgggcccttttcgcaaagggggatcgggatgtcgctccctgctgagggggcgctgatcatcacctgactgacgcggcaccccacggtgtcactgtctagacctgtgaatcgaaaatgagaactcgataagtcaggagaaacagatgcactcggaacaagattagaaatgcaatgtcacgcccgaaaattcactagtaatttccgaacttatttgtgcataaaatcctcgtccaggaatcagccgaggtacacaaactgacaatttaatatacagattcatcaaattaactaaaacaataaatacttacttaagaggcactaagtcctcaccaagaagaaaactgcagcggaaaataa

SEQ ID NO: 21033 - DNA, 222 bp, Oryza sativa
atcagggggctgctaactacgcgcgtaagggcgtgatggaagaagacggtgacttggggagtctgtctccccctttttgaagagtaggatttcagcctccttgtactccttaatcaattgcgcttgtaaaactttcgtaggttcaaactgcttttgtgtatgcagtcatcaccttcgttttctttagcatgttgattttgagtactttgttgtcgtcgtaga

SEQ ID NO: 21034 - DNA, 515 bp, Oryza sativa
attagctcctggtttggaatggtatattcctggtttggagatagaactgtgcagccaggatggttgttcagaatggttgggcctatacaacagggtatgttgtataacgttggattaatattgtttaattattacttaactgttttattaaattctgaaatgtttgctaaatgctgcttttgcaaatgaaaccctactatgccatcctttgttatcctgtgcacttgcatatttgctgcgtggcttgctgagtatgtcatatactcaccttgcaatcattcatcagaggaagagttctacaatgatgctgatggtgtggaggattaggtgtagccttggtcaagctgcttgtggagtggagccgtccgcgccgtttattttattttccgctacttagatctttattgattaagaggaactatctacctctgtaatgacattttattcgcttattaattagagtaataattgtactctattatcaatttgttattgtgtgcctcggctgattcctg

SEQ ID NO: 21035 - DNA, 1501 bp, Oryza sativa
tacgggagacaatccaatacaacttcgcgcatcgccaccctttttactcttcttcgttttcgacgagttcttcgcaagaggtaacccgtctcaatggcatgcgctatcggggctaacatgtcgctttagacgtgttaggctcgatatcgcgagtcattgctatcatatgtcttagttaatatattcttagcttctcaattttgctctatcggttattgctcgctttagggtttatgctggtttcggctaaattgtcttgctagatttagctaaggcatctaccatccttaaaagtgtttaattgcttgattgtctagactgcatgcttcttttcatactttcaaatgcatcatccctagtcgtgcttagaacaatgcaaactagcctgcaattagacataagaaggatagtattggggtttcagccgatcttacctaatatgcatgcttctttattcgtttcatgtatattcgccacttatacatacaggtcattttatataagcatatcaagctttagtcactatcaaccagatccttacactatcatgcttgatcattgtttgacatgtttatatagatcaatttatttatataggtttgtactagagtattagctagtacattatctttcatgctcgaaatactgtcacatcggctacttttatgatattgtcttaaaccaatttatcaaacttgatagacagtattacaactgattaggcatatttaggatttaatattctttgatatactcagcccatagccgatttggtctaactccattggctgagaccaccaacgatacgctattggccgactaattctgcttttgtctttctcactgattgcaggatcaaatcaattggcgcgtccttgacacactcgaggctagccttggacctgcactggagttaagtagatctcccaggccgccgtgttttcacatcaacaccaagtgaagcctagtagcttagctccagttggcatgttgctggcgagcgagagagagagagagagattgttaggcgtatagttggtttccagttaatacaagatcacgcctcaattcctaccaaactcttggctcgactgtgaaattccaaatcggggattggaatccacttcgttgaagaggaattccgtgaaaaggaaacttgcctcaatcggttagctgagttcggagcaggatttgaggggtgtgagagcgagatccagttcttagtaaatgggcggaatggatttggaggggaaatttgactcgctcctaaagacgatcgcagagaatgagaaaaagagggaagcgtcggagggtcgcacgcgagctgatcttgtcgagctcaagtcagcggtggaggggcgtcttccccaagtcgattagtaggtggaggatctgaattcggcactcgggattctgagttctaaggtcgagcagctggtaaacaactttccacgtgcggtacaaggtgagaaggaactcaattgggccatcaaggtaggcc

SEQ ID NO: 21036 - DNA, 1501 bp, Oryza sativa
catttcctacccatcaacatagcaaacacaacaacaaccagtcctaaatctaccaacaacatcacacatatctcaaactttaacctactattcctatccttcaacacccctaccacagcttccttctcaccaacaaccttcctcgatgtggccaactcattcctagctaaaaccagctctgattgcacacatcttccttcttcaacagcagccgaaaaatctcccttctccctcctcagcttccacacttcgtcgcgcaaatcgttcaacacttctctaacgaaactgttcgacggaccatcaacccaagcaaaataatcgcaacatccactctgcaacagtgaaccaatttaaccctagaactcagctcaacaaaatcatggaccccttgaaccctagaacttagctcaaaaaactcacccttgcattcacacatttgaagtaccggcacccgggattgtctgggatccacgaaatccacctcgccgccttgttgctgtacctgcataccaccgctggctcatactccaaagggccaacccgatacgggatgggggaggcagatgtgcgcctagaagacgccgacgagccctcactcctcgagctcgccattcaccgccactcatcgcgctagaaacttcgccgccgtcaaccgcgccgccactgtaaccccccgcgtcgtacccctctccgccgccgccacaacctactcgtagcaacaatggggaacgaacgagcgacagagataactctagaagagcccccgctatttattcccaactaccgtcgctgagtcagcgatgttgaccaagtcaagcagccacgtcagcgaaaactgcacgcaaaacagccatgggagtcagtttgctcgggatttcaaagtttaggggtcaagatatctggttttgcggtttagggtcacgatttagattcggatcacttttgagggtcacgaattgaacttattcctactagaaaatctgtgcgcctattatcacacccactatatagcctgtttatttgtttatccatgtgcctattagtttattgcatatactttcccaccatttagtacataggattccatatttaaaatatatttttgaccttcatgaggccaaacaaaaatgatcatccccttattttctctcaacttgggtgattgtatgattttgcagatattttctctgtagtaagtcgtgccatactccttgctcaatgatcaatttaagaagacatttgcttaacattctggatttctatattatgcaccccaagtccatcatggtcattttcaataaatctatgcatagtagtttgacacaacttcagatctacatcatgctagtcttgatgactgaatgttaaattataggggtttgaaattttatatttaatttaacacagaaaaatgattcatataaatgttattaacatatccatatatttgtgagcctaaaagtacctacctttgatcgagttgtgtcaaacaagacctaag

SEQ ID NO: 21037 - DNA, 396 bp, Oryza sativa
actttattatattggttacaatagatattagaaataattggttagccctgcttagaaccattagcacactattgggataactcatgattcactattatttcgtgatggcttattgatagttcacgatggtcaatcgtgattagttaattaataaatgtgccaactataacctgataatggtgggttgtgagcacatggttttgatggtcgtgctcatgacaattaaggaccggttcacgagtttcggttgtgaaacattaatcgtgccaaccacaagccagcatgggcaacggctttatcttttgtatagcatagttcattgcggggccccagactgagaagtggcggagataagcccacgggggtcgctggggagtccatgccttgtttataagg

SEQ ID NO: 21038 - DNA, 288 bp, Oryza sativa
gcagccctttgggccgaaagtcggcccaaaaccgctctctctctctccctcggcccaagccggcccagtccgggcgcgggcgcgccctcgctgccgctgacaggtggggcccacctgtcaggcccgtcgtcttcctccggccgaaaccctagcgcgccgccgccgccgccgctttccaatccggccgttcctttccttctccggtcgaattgattgaggggaaacaatctccgggatctcctctaccttttctcctttggaatctttggctaaatcgttttggaaagc

SEQ ID NO: 21039 - DNA, 651 bp, Oryza sativa
atgtttcactgtgtacggatcaaatgttgcaatagattttgatattatagaagacgcccttgcaacaaatcacgcgcatattatggaaatcttctattaaggaaatccgttttatattttgttccaccaaaaatgtttcacatagtgtactcataatgtttcactatgtatagatctaatgttgcactgaacgaaacattccattgcaacaaaaagcccacatattttggacatctcctattaagggaatttggtttatttttttttgttccaccgaaaaatgtttaacctagtgtactcacaatgtttcactatgtatagatctaatgttgcagtgaactgaaacattctttcgctatttgctgaaacattgtttttatataagttgaaacaacatccaatttaaacgagtgaaatattttcgatctacttagtgaaaccattccgatatatctggtggaacatcgtacaacattttaaaaaaattcaataataaattaatttttttcgtcggaatatatccatgtgtggtcttgttttgaagatttgattgcaacgaatttaatggtgcaattgaatcatgatttggataagtaatttaagagaaaaatcggtttaaagttcgcttaaaaagttaacatgcatgcatga

SEQ ID NO: 21040 - DNA, 396 bp, Oryza sativa
ccaatgtttttttttgtcatactacatttgcacctatgttttgcacacttttttttgtctccaaaatttagttgtaagttgatgagagagaaaatgtgtgtggggaagaaagaatatatagaaatttagttcatttgctaaacaaggttttataaaatagttgagaaggaaaactctagtgaaagttaatcttaaataatagaaaacaaactaaaatgaaaaataaaagaagtaaaacacattaaaattagtttaaaactttacaaatagtttttaagaattatttggtgtaatattttatgatttttgtatgaataaagatatcttataattattgtatgactgtcattattgtaagaataattatttgtgtgcggtttttttgactcatgtaga

SEQ ID NO: 21041 - DNA, 190 bp, Oryza sativa
  unsure (1)..(190): unsure at all n locations
tgtactgacagcatcggtgttattaggcaaacggagaaacaacaaaaatcagaacagaatgctgctaggaaaccttagatctcaagaactaattttttggaaaaagggccaagaatttttttaaaggggggaaaaaaaattttnttttttnttncnancatagttntaatttttggaaatacgttgtcgc

SEQ ID NO: 21042 - DNA, 232 bp, Oryza sativa
actcaaatgtaaatatgaatatatagggactcaaacgcaaagtgcaaaactaaaattggatcatctcaaaaatggattgctcatatcatgtaggttccatttttatacaaatatctcaaatccgctacttaacaattctataaaggaaaatacggatagtcacagatagatctgatctgatccggagtctctccttagacgcacagagtactcccctcacgcgcgcgcacaa

SEQ ID NO: 21043 - DNA, 922 bp, Oryza sativa
tgctgcccaatgtgttccttgttaaatggccagtgatgaattgctcaataagaacaaattatctacacttgttttttttttatgcacaagaacagattttctgcacttgctcttttttctggattgataagagagactatatacacttgttttctgtcattctttgatgatttatatacccttgctgctgctgcccaatgtgttccttattaaatggccagtgatgaattgctcaataagaacagattatctacacttgttcatttttttgcccctacacttgttcatttatataccactgctgttgctacccctgtggcatatatactcctcctgctgctgttttatgtcaatcatgcaaattctgtacccttgctgctgctgttttttaaatttgcatgattgattcagtggttatatacctctacacttgttctttttttatgcataagaacagattttctgcacttgctctttttttatgcataagaacagattttctgcacttgctcttttcttctggattgataagaggagtatatctagacatgttgttttagttaatttgcccctgctgttgctacccctgtggcatatatactcctcctgctgctgttttatgtcaatcatgcaaattctgtacccttgctgctgctgttttttaaatttgcatgattgattcagtggttatatacctctacacttgttctttttttatgcataagaacagattttctgcacttgctcttttgatgttatgattttctctttttatcccttcatgcaaatgattgtaattgatgcatatttctcagcaaaactgaggccatatctttcatagtataccccgtattacattggatctaatgctatttagtctaatggtaggaaatttataatctttttcgtgaaagttaaacca

SEQ ID NO: 21044 - DNA, 1501 bp, Oryza sativa
cacgcctcctgccccgctcgcctgccttcccggtggacgtccatttcaaccttcatttaatggccagcgacttccttgccatacttgcgctgaagcctggaatggatctgaccgggactgacataccaactccaggagttagcacgccagctccggctagggacgagagccaggaagctctcatcattccgacgggacggggcgaggcgtgtgataggccgcctgttgccacctaacccgcgatctgaccggtctgtgaccggtcacacaccgcgaccggtcacggaccggataagcgtgcgctgcgccgcattaaatgcggcgtggtgcactcgtccaacctactataaatgcggttaggtgagccccgctgcgctcacctaacccacacacgtggcgccaaaaccacagggggtcggggcgcccatccctcggggccgaaacaggagcggtccgacccatcggggagatagagggaggggtggccatgtcatcctcgggcccgacccccccgagggggtcaggccacgtgggtgaccgcggctacccaagcctctagtcacgatacccccagccccatgtcaccgacaagggctattacctactaaggggcctgaactagtataatccttgtcttctacttgcttgatgtcgtattacgtagatcctcgtaccaacggaccccaataccctctatatccggtctacgggtatcccccgtcgacagtggcgcgccaggtagggaaacttggtgctcaaggttctactactatgacttcaagccttctcgacgatagcgtcaaccccggcatcaaccaaggagcttcaacttcaacgatgctggtgtggactcaagtcgacgaaattgtcttcccggtctacaccacgatgccgatctcgactggcccatcaattaccgggagcgagaacggcgtggttacgaccccggtcgactctatgtcgaaagatcctcccgcagaagcagagaacggaacatcgacaacatctgggcctgagaaggatcctaacgcggccaaatcttgtcctcctgataagaagcatgagccaacaaggataacttccgaggcgacaaggacctggtgtcctatccacaagaccagaaggcacaccttgcaagcttgttcggttttcttcgacgtacaagctgaaatccgtgcctgcaaagagcgtggaattcaatgtacttctccaactcgtgatgtctattgtcccattcacaaggcaaagactcacgacctctcaagctgcaaggtccttctcagcgccatgaggacgtcacctcctaaggtccagcagtcacgaatctcttctagagatgcggacaaggaacaaggagcggcgactatttcagatcgactcatcggggcaatcgatatcgatcccctcgagccatatgtcctacatctgctcgaagaccaagcctcatcatcaacaagtacaccacgcgacgtgtacgctatcgatgggaccagcacatcta

SEQ ID NO: 21045 - DNA, 1501 bp, Oryza sativa
tataaaatccctcgttaaatcgggagacaaatttattaagcctagttaatccatcattagcaaatgtttactgtaacgctacattgtcaaatcatgaagcaattaggcttaaaagattcgtctcgcaaattagtcgcaatctgtgcaattagttttttaagtctttatttaatatttatacatgtgttcaaacgttcgatgtgacaggtgtacaatttttatgtgggtcctaaacagggcctaggttcctgctccggcccttcgtttcgtagaatggagtaaaggtattttgttttttttccttaagtggcaacattttaacgtactcccttcccttggtcccgttccaagtaccgtcccattttaagtgtagtcatacgttttttttccaatatttgatcatccatcttatttaaaaaatttatgataaatttttaaaaattaagtcacgcataaagaactattcatattttatataataataataatgatgataataataataataataataataataataataataataataataataataataataataataataataataataataataataaaaaataagacggacggtgacactgaaacccacaactggacttattatgagacaaagggagtagaacaaatatattataaaaatatactattcaataatggagtttcattttttagagcgatagtggagttaatgaattgattttgtgttttaaagttgttattttttataaacttaatcaaacataaaatagtttgacttataacaaaactaaatcattctagtacgttctaagatgcacgaagtattagaaacttatgaattatatttctttagtttttgcacatattctttaaattttcaacgtaggtaggaaggcagaagtgggtcatttggtccaattttatttttaactgtagtgaaaggatatgtaatgagctctaaaactatggcattgtaataaatacatgaattataatgtcatatgcctaatcctaaaaatttataatagcatggatccattaatccaaaataattctagcagtggcaaaactaccttggaacgtgaattgaggtattacctgtgcaacttgaaacaggcttgcttagaaaaaaaaaaaactcaaaggatcaaaagagagtttcgcgcttgagaaaatttgaggctgtaccacgagaacaagtcctcctcgcagaataaatcaaattataaacgttccgacaaactcccacttcttaagggcctattctgttgtccataaaatgaagggataaaggaggagattagagagaatttacaggaattaattttacattttaataggtacgaaattattcttcacaaaatccgcttcgaccctcgataatgcttcctaaaatagttgcaatgctgttttctcgtgtgaaataccgtacaactttatattcctctagacaaaaaggaaaaaagaacgaattatccctgaactatcgcggttgaccgaa

SEQ ID NO: 21046 - DNA, 157 bp, Oryza sativa
ttttctgaccgttactgccgtgctttaaatactaaccgtcaccctcgagaaacctcacaccgtgacttctgttttctctttcttctccggcgactcctccggcgcaaaggcgatttctaggcgacttcctcctcgacgagatctccgcccgcaacaa

SEQ ID NO: 21047 - DNA, 1501 bp, Oryza sativa
atgttgtcgatgttccgttctctgcttctgcgggaggatctttcgacatagagtcgaccggggtcgtaaccacgccgttctcgctcccggtaattgatgggccagtcgagatcggcatcgtggtgtagaccgggaagacaatttcgtcgacttgagtccacaccagcatcgttgaagttgaagctccttggttgatgccggggttgacgctatcgtcgagaaggcttgaagtcatagtagtagaaccttgagcaccaagtttccctacctggcgcgccactgtcgacgggggatacccgtagaccggatatagagggtattggggtccgttggtacgaggatctacgtaatacgacatcaagcaagtagaagacaaggattatactagttcaggccccttagtaggtaatagcccttgtcggtgacatggggctgggggtatcgtgactagaggcttgggtagccgcggtcacccacgtggcctgaccccctcgggggggtcgggcccgaggatgacatggccacccctccctctatctccccgatgggtcggaccgctcctgtttcggccccgagggatgggcgccccgaccccctgtggttttggcgccacgtgtgtgggttaggtgagcgcagcggggctcacctaaccgcatttatagtaggttggacgagtgcaccacgccgcatttaatgcggcgcagcgcacgcttatccggtccgtgaccggtcgcggtgtgtgaccggtcacagaccggtcagatcgcgggttaggtggcaacaggcggcctatcacacgcctcgccccgtcccgtcggaatgatgagagcttcctggctctcgtccctagccggagctggcgtgctaactcctggagttggtatgtcagtcccggtcagatccattccaggcttcagcgcaagtatggcaaggaagtcgctggccattaaatgaaggttgaaatggacgtccaccgggaaggcaggcgagcggggcaggaggcgtgtgctctgcttgtcagacgttacttccggctgtagactagccctcattgtaaaaagcatgtttcccttcttaggcagggaggggcccatgtggtgacccgggaccagagaaaaaggaggcccaggcctaggagaaaaaaggagggaaggagggggaatgggcgggagagcctgaactctctctcgctctccggctctctggattccttcacgcacagatccaccagaacacaggagtagggtgttacgcttctcagcggcccgaacctatctacgtcgcccgtgtcttgtgcatttcctctctcgctgacgttcttcagatcgagggcgaagaacctcacttagtgcccccggccgaaccggcaaaggggggcctgcgcggtctcccggtgaggagccccacgctccatcatctggcgcgccaggtagggggcgcgcgtgtctttctaagccctcgtcctctttcgtatgcgccaagcttctccggctcagcccaa

SEQ ID NO: 21048 - DNA, 1363 bp, Oryza sativa
cacaccgccgttaacgaacgagaacgagaacgatcgaacgaacgagagcgagaacgaacacgtcaacgtacgttgccgcgacaacgtgaacgagaacgagaactatcgaacgaacgagagcgagaacgagaacgatcgaacgaagcaagcgagaacgagggaacgaacgtgaatgagaacaatcgaacgaacgtgaatgagaacgagcgaacgaacgtgaacgagctagggaacgtgaacgagcgaacgaacgaggacgaacgttaacgtgaaatgcaatatatatatatatgtatatatatgtatatatatgtatatatatgtatatatgtatatatatatatatatatatatatatatatatatatatatatatatatatatgttacttcgcatttatcctaatacatttttttgtatcttgcagaaaagacgtgttgtcggagtcgtccgtcaagcctgagtggaagagctagccctagaaggaattcgagcaggcaagtgacgtaataatataaatgattgttatatttgtaatgcaattaattaagattattagacctgcaattagacttatcatataagattgtgtagtgttctaatattatttgagttttaatataagattattttattgcaaattagacttagtatgacattattgactacggaattggtgcgactcctagcaattgactattgtagtcttaattagacttagcatatacgcacgaaacacttagcatacattactattttagtcttagcatgtaatattatttgagttttaatataatattactttatttgtaattagacttggtatgtaattattgactacggaattggtgcgacaagtagcaattgactattgtagtcttaattagacttagcatatacgcacgaaacacttagcatacatgactattttagtcttagcatgtaatattatttgagttttaatataagattactttatttgtaattagacttagtatgtaattattgactacggaattggtgcgacaagtagcaattgactattgtagtcttaattagacttagcatatacgcacgaaacacttagcatatacatgactattttagtcttagcatgtaatattatttgagttttaatataagattattttatttgtaattagacttagtatataattatttactagctagggttgtataatatacgtcacctagacttagcttatatcacgatttgtaattagacttagcatgtaaggttgtgtagggttctaatgtacgacatttacacttagcatacatgacttagattgttaaaacataaatgtctcgtgacttagcagatgtttcttgtatcaacaga

SEQ ID NO: 21049 - DNA, 354 bp, Oryza sativa
aaccacagggggtcggggcgccccagccctcggggccgaaacgggagcggtccgacccctcggggagacagagggaggggtggccacgtcatcctcgggcccgacccccccgagggggtcaggccaagtgggtgaccgcggctacccaagcctctagtcacgatacctccggccccatgtcaccgacagtagcccccggcgttacgccagggcgatcgcccccctcgagggaagcgctcgggcgtgacgccactccttaggcccggtgacaggtggggccggtccctacaggcggacagaaacccagcggtcgcaaatcgcgcgcatcggcaagggaaaaccgaccgacaataa

SEQ ID NO: 21050 - DNA, 1501 bp, Oryza sativa
ggtctccttttggtttgagaatcacttcctacaaagtacaaacagtttaatttattcaaattagaaaaaagaaacctttccaaaacccaattcctctccagttaggaggtgtttaaattcaggggtgtaaagttttggcgtgtcacatcgggtattatataaggtgtcgtatggggtgttcgggctctaacaaaaaaaaactaattacaatatccgtcagtaaaccgcgagacgaaattattaagcctaattaatctgttattagcacatgtttactgtagcaccgcattgtcaaattatagagcaattagacttaaaagattcgtccgcaaagtagtcgcaatcggtacaattagttatttttttagactatatttaatgtttcatatatgtgttcaaacattcgatgcgatgtaaaattttaggtgggatctaaacaggcctcatgggtaggatgtgtgtctctggtactggcaatttcacagcctgctataaggtgaaagcctaaaactgtgggcgagtttgctgaacacatcacgtattaacccaccgtttcccaacgcctgacgccctagatcctgcagcatacggaggattcatcctctggagatttgacagccacaacaacacacaagccactctgtcacaagggacaatgtcacggatctcccatacatgcttcagttaattgtttgctccataaaatctccacaaaaaaatatcctctccttgggcggtccagcctcttcttcttcctctgcccaattgcaactcacaagtcacaagcttcgaggtatatctgctactactagtacaacctatgtcaccatgaattccatgtcctttgtctccctttccaactgttcctatgcaagaactaagaagtcacggtacattccaaacgatgatgcttccagaacaccggatccaaatattctttttcaaaatttctcacgggtagagcccgtgacaaaagtttgtgtgtgtgtgagagagagagtgcttgaaaccctgaaaaagaattcaagagtttttgtaccctcctgttaattggtagctagagcaatggcacaaaaggtccagatgcccttcacatgttcttgtttcatgtgagttggattggagtgatgtgtcccacccccctcccaatccctttctctctggcctcaggagtcagcatgcatgagcaatgccctgctcaattacacattttcccttaatttgatcatctcccaaccactagtttaggttttcgctacgcgtacaaccgggttttcggtgtattcttccctcgacggtcactgacatgtggggtctctattgtgccggagtatacagggcccacctgtcagcgagagcgagcgggttttcaggacatttgtctttgtgtttgtggatgccactctcacaaactcagcctgaaatggacatgctactacactctatagaccttgggtataaagctggagtagaggcctatcagcttctccagctcttgcag

SEQ ID NO: 21051 - DNA, 555 bp, Oryza sativa
aataggttaattccacccaatgacattcgaaaataaatgcaatagttgaatagaaacagtagctttaaacgggatcaacatgctcaaagggttgtttgggatctgtgtgacttgccttgctggccttggaactcttcaaaatcttctcctgcgaaaacagactctccggaaacgtcggaatctaaacagaaaggagcaaaatcaccaaaacagcacataaacaagcatgaacagtacatgtggatatttttaacatgtagatcttaattttagaaaaatttagagacttgaaccaactaaatccgagctaagatgaattagttacgaatttttaaagattaattcggattaaaacacttatatgaattttaattatgacgcaataatgaattatttttgaaaaggaaaagggaattattgcgtcagcggctagggtttgcggtggaccgggcgcacggcagcggttcacggaaacggacggccgagatcgatcttatccaaaacgaacggccgagatcgaccggtccacggccggaccacgagagacgacgacga

SEQ ID NO: 21052 - DNA, 1501 bp, Oryza sativa
ctaccttgatttgccaagaggttgctagagtgacgttagcaatgagcgataaacctccaaccataacttcaacatttttctacaatcttcaaacaaataaggtaatacggatgtgatcgttggcggtacgtacacgatcggtacagtgaagacacgtgggcatatttgagaggcggtgactagtgacttggttgttttggatgtcgatccaacggtttagggcctgatggcctgttccgctttagtgttaaaatgaaccattttaaaatttggtaatactaaaattttaataaattagcagtattacgaagtagtaaatgtgttactgtcaaaatttcttagtagtagtaatactacaattttcttcctgcattccacccaaagcatagacaaatcttgggcagaaattcagcgagtgattgtgtgtgtgtttgtttacaaggaggagcagtgtctgacgttaattagaagccatcatggtgccggccttcgctgcccctgcccctgcccacgtggaggaacggttcgggccaaagcgtgcatgcaacctgaaccaaagcttgccaaaaatgtggcaacgagagaatcctctcccacgaacgggtgcgtcgctggagacacaccgtcaataatagtagcagcgtgtttcatcggattttgcttaaactctgtggggattgtcttgatcagttggttggttagttcaaccaagttttattttagaggggcaaaatcagttggtttctctttgtgagtttgaagacgtgtgaattaatttggtctgcacgtgctgagatgttcagggtgcctgccatttggtctgcctcttgctagctccgagtgattggattttgcacgatgttgggaaggtgagggtggatttgaagtagtgcagccattttcacgaggaatatgtgggagtgcttttttggaggttaattcagtaaatcaagactcagacctatactcctatagtaacatatggaagatgggacaaagcgtgcatttattactgtatacatgtgaagaaaagaaatccagtagcgacaaatatcatgctgatcttaccgcactataaaaaacaatttttctgtacgagaccctcgttaggttacaacggaccataactgactacgtctgcaaaaatcgaccaccattttcgcatatggtttcttaagataacataagcacccgcacacaaaaatagtgtcttttgcagacttttggcgcgtgcggtaggactaaccgcacgcggaaacctgtttctgaccgcgtggaaaaatgtctattgtaatagtgtcgttggtgactaccgcgcacggttggtcttgtttgttgcgtttattccattcgtatctcttcattcctctcaccatgcaccactaacaatcgcacctgtacatagaataaaaagaaatgttggagtgtcttatggaggcttaacactaaaattactaacttgtcacgttagccacctgtcaagaaaaatcaaaagtaaagg

SEQ ID NO: 21053 - DNA, 1501 bp, Oryza sativa
tatgttcggcgacctgaaaattaagcatgctgcaaaaattaggattcaaatatggcattaaaattaacaaagtagcacccgacagacaaaggccagcattaaaaaaaaatactctttaccttctgaaaatgtgatatgtcattgtcagtcagctttgcacattgtgcacgcagatggtcgattttttgtttggtaattgcctctttcctctgttcattttcaaaatattttgaacccttgctcatttcgtagattaccttctgcaccttctctttgtcaactccctccattcctaaggcagaataacaagagaataaagaccaaagccatgctttgcacactggggttccatgttgtttccacagatatcacatattcacctaaacatgtaatataacttcctaagtaaagctccatctaattcgtgttctctctaccttaatcttttggatttatttgtaccagtgatttgcgcgatgcagaccccctaatgcccaaaaccctaccccctactggcaacaatcttacgcgacgggaagaggggaaatgcacactcaccagctttggcgttggtgtaggcggtgtggtacgactcccacggcctatctcctccgccatcgggtggcgtccccgccatcgcgtgcgacggcgaggttcttccccccaccgcaggcgggcgtcacgcgaggctaacagaggatgggaaggactgatcgagccgtcggtacgtcgggcaccggcgagctctccgccgtcgttggcaatcaggacgaggaagaatggaggggggattaaactccggcgaggtgaggtcggctccgccgccagccagcggtcgcgcgcgaggaaaggggttgccttttcctctcttttccttagaaaaaatgtcccgcccgtgggtgaaagctattttaattttattattagcttaggtaaagtaaaatttattatagaaataggatatatatatatatatatatctttttagaaaattataagctgtaattaggagtttgatcgtgtcaagttagcatgtaagtttttttttaaaagatttcttatacgacttcatttgtatttccaaaaacgaacgagcttgaaaactaactaaaatacggatttgtattttcaaaagcgaaccaacttaaaaatcgactcatagacggatgatttactaaagtacaggtaaaaacatctttaatttttataataaaatagagatttcaattaataactttttcttttttttctattcttctgtgagcggaagggaaaatttatattcacacaccacttctgcaattcgaacgctttttatatgagtttctaatgtttcaatgtgcatctttattattttaaaagaacacttattattttagtgcagctttattattttattattttagtttgctaccatgtataatcatagatatatacagagtttgtcagggttatggataaggtataccgtctatcctcggatatacgatgggtaccgata

SEQ ID NO: 21054 - DNA, 335 bp, Oryza sativa
gtcctcaccatgaagaaaactgcagcggaaaataaaatctagtgaagctccggctccactcccacaggcagctcaactggggtataagccaaacgtcttctcctcctagatctttttcttcaactgaggttgattgattattgcaagaatgagcatatgacatactcaacaagccacccagcaaatatgcaagtgcccaaggataccaaaggatggcataatataggctcatttgcaaaagcagcatttagcaaaacatttaagagaaataaaccagtggagtaattaatcagaaattttaatcaacactgaacaacacacccatgctgcacagg

SEQ ID NO: 21055 - DNA, 307 bp, Oryza sativa
aatgcagtgccatcatgcaaccactgtgtaccatgttgtgcattcatcattagcggcaatttgttggtttgaacatgaaatgaaatgctgaatgtatgtataaaaactggttcaaaaataaaaaccgaggtacatttcacattctagcaagtatatcatggttgtactagcaggattcatggtgccaaaaaagaaacaaatgcttcttaccatgtattaatcatgtgaattggcaactgaaatcacactatctaaaactatctcaattttctcaactgagttatgtaggacatacactgtccacaga

SEQ ID NO: 21056 - DNA, 1501 bp, Oryza sativa
tacatttgttccatttgtggatttgaactacctccaggttttgaggaggagagacaagaacattcagatttccacttggctgaaatgcttcagcaggaagaggcagtggacagcacaggccccctctcgaaagagaggtatgtatctattgccacacgctcatagatatccctatgttatttcttgatctgctttagttcagtgacgtaataaatattatttaacgagatgtaaatcctgaagtgttttactgggattattactgtgggtgagttgccttttgccatggttatttgaaaataaattagctgagatgaagaatttcatgggtatgaaccttttttttccctgtggagctgttatcatgtagacatcagatgaatttcatgggtatgaaccttttgtgtattcagcaggttagctgaaaggccatgctctagcacacccacaccaaagaagaagctcaagtcttcaaaagaaggaaaacacatacctattgatgctttctttcacaaggttaacaagaacttgtaacatactgtagctacctattcaggcactctttttaatcctacagagcgatttgcccacttgaaaaactgctgtacatgtaacttcattccatgttcttttcagactagcatgtaaattgtaaatatataactcaagaatcctgttaaattaatttcataatttattcaaatgtcatacgattctgcacgagattttttttctgacataaagaagctctaccttatagccatttcattgatagaaatgataagttacgaagttggcacgattaaggggaaaatgagaaaaggaggaggaaaggaagaaagagagagaggggggcacgggaatgtacaaaagttgaaaaaaggactgtacattagcctcgtctgattagttcagaccagaggctgattttcgttttgatttagttgttggcccggcaactcggatggtccggagaaccgatgatttattgctctgtgtttgaccacccatattgctgtctttcccaaattctgttgtccatcgacttccatagtgcgtgagcggaccgcacgttgcaaatcacatggtagcaggtcgccactcctccgtgacaataatataagtctggtctccgacatgctactttgactatctatactatataaaagtgagacgttttaaatacaaggagctgtgtatcatgacaaattgcttaatgatgactgtagtaatatcactttgtatatgatcgatctttcttctattaatacttcatgtatataatgtgacttgtctctatactaaacatattcatattctgagactgagggagtaacacatgtctaaaaataacctgtcgagctggatgatattatctgcagtctttatcatcaggcaaattttttgaccatgttggctttaggatactccatataatttatccataaaaggcaacgaaaggaaacatattgaaagcaaaatatttgacagggagaagagg

SEQ ID NO: 21057 - DNA, 277 bp, Oryza sativa
  unsure (1)..(277): unsure at all n locations
attcctgcagccctatcaagaaaaagaacgccacaagtctcatctatggcaacccgggcggctaggaaattttgcatgcaacatcaagaatcaggtaaatttgagataaatgtacctgaccttatccgcaaattccactgctgaagcattatgattttgaaattgcaagatcaaattagtggaagagcaagcagcagccgaccagggacgaaatgtggtgggcgttgcgaatctaatttggnaaccccggcgagttgggtagacagagaaccgctta

SEQ ID NO: 21058 - DNA, 195 bp, Oryza sativa
gttttcagcaagcaaagaacgggaacatatcctcgcttgtgctcttagcaacccaaatcacataactggaccaggcttcttcccgcacctgtcaacaaagaaacagaaataaacttgctctctttcccacaacaagctcacaaatcagtcccaaatccaactcccaaaacagtaccgtcttttcttcctcctagc

SEQ ID NO: 21059 - DNA, 1501 bp, Oryza sativa
gaactgagcccctagcattgggcaccaaccctccgccgtacgacatctcgactaccgggccgcagctcgtgtagccttcatttgccctggagaatgtccatcgacgcccgacttcatccatctccaatccgtgtacttttgtttatgactagactgagccacaaactaagccttacccattagacatgtggaagtacggtagtgctttgcaacagaggcccgagctttagtccttatagtggccggggtgctacttcccacaactggcatgcacccaaaccccaccgaaaacaggttttaggggttttgaaagaggaagagaggtgtttgtccaattccaacataagccaaccattccaaagtgtccaaatgatatgagaattcccaaagtctaaagttataaaaccacctaatgttgcctaattaatcagcgaagcatctacctaaattcatactagtggaaccatgaatagagtacccactagttgaggttttgtttaatctagggtgaacaaggtaataataataacaataacaataataatatggtcataacaaaggtaaataagcatggctaaataaaacagtggtaacgcgggaatttaaataaagcgataatgcaataatttaaatcaacataattttataaaatgggattcaatatgctcaaggatgatgtgacttgccttgctcagaaagaacggccttccgaacctttggcgacgaccacgaaccacgcttcgggaacctccggaacgacgaaagctacgcgaagcacacaagcaaagctacaagcctataaagaagcaataacaatacataaaaacaaagcacagggttctttaggttataacaaacattaggagacttgaacgggtcgattcagagttcgtatgaccgagatatgatcatccgaagtttaatgctgttatatggagatttgcggattattataattaagctttgcaattataaaacatgtgtaagcgctggcctggaaaagacaggaaggctgcgccgttgacatgcggaccccacatgtcaacctaaaggaccgcggtagaccgagtacacagaggcggtccacggtcgacggaagcggatcccgtgtgtcaaccgaggcgagtggccgacaaacggactccactagacaccacacggtcactacccgcacacgtgaacgaccaccgacaccggtacacgggtaccggggccgacaaccgcacaacgggcacgggcgacaccgaaaggacgaggacagggcagcgagggagagggaaccttaccaccacgcgacgaggcgtgggaacgacaacgacgaacgggcgcggcggagacagacgggcacaacggagacgaacggcgaggggacggcttcggcggcgatccttggacgaaggcgagacgcggccggcacgaggcttgacgacgcggagccgaggacaaagacgaggacggggctgcagcggctcgcttgacgaacgcggacgacggacgagaa

SEQ ID NO: 21060 - DNA, 467 bp, Oryza sativa
gaatgtgctaatagttgtgaatgcatataattataatatcgtaatttcaaattaagctagtcctttctgcaggatcttatagtgcttatgcttctgcttataatcgaatcggataagcatatgaattagtgaaacaacaaggctcctatattttgtcagtgctttactaatggtatcaatatcatatccaaaatacaatatgctcggtaatttatacgaaagtacatgtagtttagtggtttgtagtgatctaatcgaatagcacctcaaggtcatatgttgaaatcttcatgagagcgaatttcacattgagttgtttgaggggctaagttcccaatttaaatgacaccacacaccgccgtgacgtgtggtgtccctcatcgagcgcctcggtcgtcgtgcgcattggacggaggcggctcttgcggctgccatggaggcgggtcaccggcgcctgcccctatagc

SEQ ID NO: 21061 - DNA, 831 bp, Oryza sativa
gcaagcttcctttgcttcctccactcaaatctagagcctatcttgtgagattgagagattagattagagtataggagtgttttggagatggcttaaagattatgtttgtttgagcactttggataccttgtgggctgtcacttgggcttattactcttggagatcttctcctagacggttaggtgtcgcccgtgagcttccaaagatcttgtgaatgtcccgggaaagtttgtgaaggttttcctcacctccacaaggaaacgaggtaagtgagtaaagattcttgtgctgagttttcagaggttgtcctaggtagagcaacttgcacttgtggtcttttctagaaggaattgtgagttggatcttggcggtcactcaattctagaaaatgacctagaagtgttgagttgaaggctgtggacttcttctgggatctttgcataagtgaggcaaggggttaatcgagacccggctctttgagcacttcaatggagagtaggacccgtgtgatccgaacttcggaaaaaaatcgcctttgtctctcttgtgcatgatctatgtttgaatctgctggtatcttgtgatttacatcttgtgcaaccttgtgcctgattgtctatagctaggacctgttttgcttccccaaattttgattttctctattgcccggaagttcctggctcaagaactccgaaagttccgggctgctcatctctgccaggaagttccggtgtttttcaccaggaggttccgggcactgttaatcttaaccgctgcgattgttgagaaaatttcaggaaagcctattcacccccccccccccgctctagg

SEQ ID NO: 21062 - DNA, 385 bp, Oryza sativa
tacagttgtacacctctgatcagagtaaaactattcgaatagccgtgcccgcggttatgggcggtcaaccagattcaccatgattagcttcaccctagtgtagtctgttggaactgattagttcaggtggatggttgggcctgttgcaacgtggtgtagcgttgaacagtggatggttaatattgattaattattacagctgttttactgctttcaacttctgtttataaatgctcgctttatgcaaatgaaccattatagctatcccttgataattccctgcatcatacccctattccggtatgacttgctgagtacagtgggtagtactcagtcttgctctattttccccaaaccccagaatttgagtatgcgtcagatggtg

SEQ ID NO: 21063 - DNA, 261 bp, Oryza sativa
gtgacactatagaatactcaagcttgggctgctcccatgtcgctctcgctgcatgtgaatgatttcctctcatccgctcgcgatttccaccggatttcccattaaccaaaagccatcgtcctcgcggcgagctcggtgcaaccactgcttccacctaccacttctactactcatacacgcagtgccattggtgtccacctcgatcgatctctcccctcacaatcctctctcacgtacgcaagctagctagctatctagcca

SEQ ID NO: 21064 - DNA, 1501 bp, Oryza sativa
atcatatatatttagtagcagccatagtcaaattttgcttagattaatatgtcgtcatgctatttcgctgttagtcaatttgaagaaccccaacatcgaattcgtaatcattcatctgcaactagaaaattgaaccctatcatcatcgggttcccctttttgcagtttgcaagagtttctttcggtcggttgtgaagtggcatcaagtgttacgatttccatgtaacatagtccgtgcttatatgtgttgggagttaggatgagaaggactaggaaaacagatagatctacaccagcttcagtacatagatagaattaatattcgatttttcttttttttttgcaagccagtctactccagaaaggcggccgagaccattgttttcctcacagtaacttttggttcctgatttagatatttggttagttcctgttaaaaaattagggaaaaaaagcaaatagaaaaagatagaaagttgaaaaaaaaagaaaaaaaaggtgcaccaaataagaaagaaagaaaagaacgaaaagaaaaaagtgaaaaagaaaatttcagtgactcctttgattttgtgtttagagtgtagagttgtgcattgatttatatctagtccttaggctgcgttcgtttgtgtgagatagggtgacaaagcacctcgtttccgcacgcacgcttcccaaactactaaacggtgcgttttttgcaactataggaaagttgctttaaaaatcatattaatccatttttgaaatttaaaatagttaatactcaattaatcattcgctaatggctcacctcgttttgcgtatcttcccaatctcctcctcaaacacacccttagtgttgtttggtgcttgcttgagctagagtttgagtctaggctagaccaacacatttactagtactttgaactattattatacatttttctgattggcacaattgctttcctttgcttcaataaatttggcctcctaagctccacatacatgcttctcgctcagtacagcttcgacccttttcaatcgccagatcatgccctccagtatcacgaaccagccatcggttataccatacttagcataattggtaaaacacttgtaagagcttggtaagatgctttcatttgctagcctccactgcgatccttgtctagtagctgatagggataatccttttgagtttttgttttctattatatgttttcgctaacaatgtcaacaggagaaaatagtccaaaggttttcgcactcagaggtagggaacaatagaccaaatgatgaaaaggttggatgatgctatggccaatttagacataaccaatttcattgagcttttggaatgacggttagctagtcttaacgacatacttgacgagttgaagggccgtctactccttcgagatggtacccatgaacatggagaggttcaccagcaagcaacataagatgaatgactatgtcaatgccttcgctgcaatcatcaatgtatgggagg

SEQ ID NO: 21065 - DNA, 1501 bp, Oryza sativa
gagttagtcacagaaggtcatatctcttatagtgtactagggtggtagatctgcacactgcccaagagatatattagcaaaatatttcaaacttcaaaatattttttctcataaaataatcatccaatttatgatttgattgcaccattaaattagttgcaattaaatctttagaataagaccgcacctgattatatttcgttaaaaactatttagcttttttaatggatttttaaaatgttgcacttgtttttatttaaatgtctcaatgacctcaaatattgcacatgatgtttttttaatgtttccatcagtattttataatgtttgaacaaatacatttcacacatgacataaaaatgtttcaacaatgtcaagcttttgcaaatatggatcttttatatttttttaatgtttcactccttgggactcaatacttcatataagtggttgcttgtgttgcagccaatattttattaatgttgcatttctttgaaacattttatacgctgaactaaaacaattttctataagcggtgaaacaaaattcagttttgctgaaacatctaataaataggacgttacgtttgcaaagaactaatgaaatatcaaacaatatttactcaaacattgtaacaacaccaagtgtaacattagaaaaatacacgttgcaacattgagaactaagaaatgtgcaacagagtcgggttccagctaaaacatccaactatcacgcgtgaaacattaaatttcaatggatgaaacatatataattttttattagaatataatcatgtgatattttgttttaaagatttaattgtaagaaatacgatggtgcaattggaactagatcgcatgagcagtttagaagaaagatcgtttcaaatgttaaaaatagagtagataagaggaggagcacaactccacgcagtggagggcttcttgtagtgttgcatatgggcgctgagtatatggccgcccaatctctcagcgccggattgggcgctcgataagaagcaattttcaagtctttaagaaaactgtatatacaggtctttttttttaattggaagtggggtgatttttaccggcaatgcagaatcttgtagaagtcaaaattaaacttggtgaaaaatgagagcaatactatttttaaaaaagatcttgtaactttttcatatcaagttggattacataatattttatattggctatcaatgctatctacaactttcaactggtttttcttttgagatcatttaggccccagatatttattaaaagcttcattttttgagttttccaaacaaccttgaatggagatatgcaatctataacaacattgtagaggacaacggtatttacaactttgtacatatgagattgtttaagtgtctaaatattcgttacaagctctaatatctacttttactagtgagttttttacgatgtccaaacattgatgatttatttgaaatttgattgaggtgaaccaaag

SEQ ID NO: 21066 - DNA, 276 bp, Oryza sativa
cccgtaaacagcgattaaaaatgccaataaattgttgagacttagttataatgcatatatcaatcccaccaaatttcattgcaaaatttgacctatatagagataaacaaaaaagataaatatcgtgagggagtaagacaacattttcaatagttcggtgagtaaaatgagccgagaaattgtttaggggattaagtgctccagcgaaaaagtttaggggggtaaaatagactttttcccttaatttcacatataaattctatattgtaacttagg

SEQ ID NO: 21067 - DNA, 1501 bp, Oryza sativa
atttgatcatgtaaccaacaagaagtagaagcaaagaaatcgcggttaaatctataaatgatagccgatcggctaagtgccgatgacatatcatttatctctgagccgatgtaatatgtgtatcgatcggcaatcttgaataagtaagaaagaactaaatctacttgatcggctgtagatgttaacgatatatactccttatatcgatatatacttaaatcaagtgattgggatagatcggtcgccatgccgagacagtataaaccacttagaccgaaatatatattaataacaggactatatatgtttatagcataaccgatcagatagatctagcatgaatcggctaatactccgatactactttatatcaggatattaaaacaggtatagaatatcaagcaaaagcctaatatattcaaatatagcaatatcttggcataaagggcaaatttaacatgtcaataaagcatatagagcaaatatagttaaatcagataagatcggctgaaactccgatgctaccctaatcggcaaccagaaagcaggctagagattgatattctaagcacgacttaatagatcaaactcaactgatacaacattaagtatgaaaagaagaacaatatctagacaatcaagccgctggaagtttcatagagtggtagatatcttatataatctgagtcaacgtcaaaatctaacctaatcggctgccctcttcgacagatgttagccgattgtagattagatagcggtattgccagagattatataaaatatatgataacccgacgaattacataaacaagattagagtgtcataaagatggaagcactaatcctgagaatgcaagccgtcataacaagttttacctcttgttgaagatcgaaaccgatgcagctcaacccgaaagcaagaactcgtcgaaataaaactaaagcaaaaaggtgacgatgcgcattgtattgaacgtgtgttaaaagttacatagggctcgggtctatttatacccgagaattacaagatatgtctataacggacacgactactatctctaacaaactctaagatactataagtctttgcggcagacttttgcccaatcatatctctaaggaaattacataaaacatcctaattaatagatacaattgcctcctcaggactctatccatttgcggcaatcaccttgaagcacctcaatccaacccaacatcacatatcaagttgtattgctaggatcggctacatcggcttacctaatccgactcagactcagccgatcttatcgtagccgatctggactccagccgatccctgctctgtttcagaactcgatctccacctccgacttcgcttcaatctaatcttctttcccaatgccgatattaccaaatttggttgttaacacttccgtccctttctcattgcgtgcttttttatgtgtgcatagccataatagcattttcaattcaatccacgcatccaacccatcct

SEQ ID NO: 21068 - DNA, 387 bp, Oryza sativa
ttcctgcaccccagtggcagcatcaagggcctgtgacaccacgtggagccatggaacgcacgtgaggtttcgcttttgcctgcactagcctatcactccaaagtccatggcagcagcattctttcgttttcgtgcagcattgtcacacgacttggagtatcatgaccaggtgacctggtcatcagaattcagacagggtcctttactgtctctgtccatggagtgtctgaaatttcagggaaaccttttcagccatctcacatttctcctgatcttcagatgaggtgacagcaagggaattgaactccaactacaccagtccatatctgcattatgaatgaaagatataacttgacccatgacaagcaaacgaagcagaaagtctaa

SEQ ID NO: 21069 - DNA, 1501 bp, Oryza sativa
taaatattgaaatcatgcttgggatttaaaactgaaggatcaaaatggggtgcatggatatagataatatcttaccatgcatacacaccctatattatatttatcaatttggctatggccccaattaattttgaacaaaggtgaccggatgtatatctcatatctatcgtttagatcccttctccaaaataatacgtaaatactttgcattctttacccttgcctttccttccactcccctcctctagtcgccgcctcttactcaacagacatccaccccttttataaagccacttcaattagcacatctcaccctctcgaggaaaataaagcatataatagtgatacccggatacagattctctgcagtactgcatgtacagtcgtagtaaactttactgatatgtgttctacagtgagctgcatataggatctcgacgcagtgataccctatagtcaatccgcccaaccatagtgcatttctgttaagcctgaacactatgcaatgtatgcatgataagttcaatattgtgcaaacaatatatcaacattacattattcctctcaagtcttccattctccaagcttctacatgtattttcattcttgagctcctttataagttaggtccaagtccaataacctatcataacccccttttattttggcaattggaaggtaagcaaatacaggtaagtgcaactgtatgttattcttgggtcccgaaatgaaatagggctagctaccgacaatttcatcacggccaccaagttgcgccagcttccactctatatgcatgactgcatgctttgctccagttagctacgtactagcacaaccattccattttgaatatctattatatactaactaaaagtccattgaattctctataaaagctctcaagctgtcacatggcgttctacaaattaacgctcctaagacgtcatacagtgcttaataaacgagaagaaaatttctaaaatttatggtaaagaaaacctaacgattgatattcctttaaataggtagagccaataattttcacccttaaatctccaaaaaaatcaggtatccccccccactctcctcccctattttctagctaacacataatatataaaaagataatagttagatagcaaaatgatcgtgattctcaagttacacatacttttcttaatttatttgatttgttgtgttatttataattaaatactccctccatccaaaagtctaagacccattctattatttggttttctctaaaaatctagtcctatttgtagtcactatgtgctaaattaaattattaatcggaaccaataagtcattttagtatttattggttgtatgtttattggttttgtcacatgatgaatgagttagttgctccttggtcttggacttttggatgaagggagtacataattcaagatccatatttctcatatttactatataaaaattagataatgcagccgttctaattacaaatatt

SEQ ID NO: 21070 - DNA, 271 bp, Oryza sativa
  unsure (1)..(271): unsure at all n locations
cctgcaccccagccgcccgggttgccatagatgagacttgtggcgttctgtttgttgatatgtctgcaaatgggatggcttaaccaaattatggagttgtggcactttactaaagtctgaatgtacatttcatttgtattatggggtataggccaacaacttttaatatgagcttttgctgtaatcttgatttaattcgttgatatgctgagggatcgtggcattccttttcccattntnaanccctgttcctgatctgttctgtcagtga

SEQ ID NO: 21071 - DNA, 1501 bp, Oryza sativa
attttttaaacaactataatttaacatgtaaatttcaaatctacaatggatcaaagatatagagctatgccaaacagatcctaatggttaaaataacatgcccaccattttaggaataaacgttaggtgttttttttctcatgatttctaagattttttatattaagttgttagttagaaaatagaatagcgaattaaatgggagaggagaagagtgaattaaataaatctgatgtggtgtttcaatttttaagtttcctgttttgattctgacattaatttatccatgtagtattatgtggatcatgcacaatctttaattttaattttgttggtttaataatctactccccccatctcgtataatcagactaatttaatgttgtagatgttgctatattttttttataaatttggttaaactttttaggtaacgaaacaaaatcaaagggtcgtacactatgaaatatgaaacggagggaggaataatctctcgagcatgcagtccttgattgttttggtgcattaatttgtggatcaagtgcagtcttgaattatctctcgatcatgcagttcttgattgggttaaaaattggagtccttttttttaaaaaaattagatctaatgtaaatcaacagttagatatttttcttttttatcagaattttaggatttattaaaacgccacgtggtggtttaggagcgtttatagtaagacacgtgtcgtttcaggagtgtttgtaaacaatttaataaatttttagtatataatagatagatagatttgttcttttttttaagccaccaaccggcgcagccaaatactatcctgctagttttatcagatatttttaagatgagcatgggttttaagaaggttgatggaaatgattgaagaaatattgcgatttatcgagaagagaaagtatatgagaaaattaaatggataatagtcgtgactaattgaaaaaattaaaggatatatatgaaaaaatagctccattttaagatatgatagctgctagaaatagataaatattttataactataagtaaacgtcccctaccaatagccacattatttgactggactataaatttttatatattttttttgtcgaatcttggaaaatgagtcacgctcatcatagggacaggatcctctacagttaaagtcatgtaactttgtcactgtcacgtgggtctaatgatccctagctcacatgttagtaacaaagaaaaagaaacttatccttgtcacagactcgcaacagcaggcagtgccagtggcggcccggcgcacctcccagcctcccctcccgttgcatcagccgtgacgcactacccgactcccgtggaactcatacccgcatgatgagcctatatcaatgccacattaattgccagtttgccacggtgcgctgaattactagattcgcacgagcaacagttagctagctatagccggcgccatcatgccctcgtcgacggccgtcgtcc

SEQ ID NO: 21072 - DNA, 435 bp, Oryza sativa
gcgctaagcacatcaaaacgcctaaccgtacattgtctaaagaatccaagaagccaaccatatagagtcgttttacatggaccatataggtagcatgtcatattccatctgatggtgatctaagcaaaaaagaacacaacagttgttggtttcaactttcaagattaatcaataggcgcaacattggtcagtaaatttgggtgcattaacagtgtattagcatgcaattctaagaatggaaaagcacatacaagcaagggaagcagccaacaatcaccgcaaatgaaggatacacaaagatgacacaaaagagaaccacaagtccacaacagcaagttaattaggggttattcacttgggatgtacatggtttgctaggagcccttctttcagaaggatggtctacagtttgtattacgtcgaatgcatggaaca

SEQ ID NO: 21073 - DNA, 1501 bp, Oryza sativa
ggtccttacatacaactctcagtctcacacaggcttatctttcctcaagctagctccctcaatagcctcaaattccccaaccaattttataattgctttaactgaatcttctattctggctagtttgggtacaccataaattttcacccataaaactaccggttcatcttctgcctcttatgttatccttgtctcaaccacaattgccttgatcatagatgtctcaaagtcaaagcttttacatgttgagatcttactctcaccttatcagaagaaaaattaatgagaaattctttctcattaagttgtttcactttccactcccaattctaccccacaaacaggtgtttcaattcaataaccaccttcccacaactgtctccccatggattactgtcaaaattcctcttactagagccctagctaactctgtttctaacatatcaacttgcaggctatagaaaccttgccctaggattccaaatccacatagtttgatacctcttttcatcaaattcattgggcagtgtatagagatgtgctagtgttgcgacgtgaataacagagaaagagatttagacaagttgcctggttgtgaccttcgcggtacacttgaagaatttgatcttaggagctcccgcccctcgctctgcctccacccctagatggcgccttggtttgccctggggttttgggcaagcagttgccgccggagctcctcctcttcccttgcatcctgtccccccctcccaacctccaccgtgctccaccgtacaatgtttgttgacttgccaatccgaccgatttgccagttggcgctccatcaccacttgggcaaacgaaaacggtggtcgcacttcctctccaggaccttccaaatccggcgcgctgtgtcaccaaatcgccatatctcatcacctctcgccaggaaccctaggtgtggttgggtctcacctcgccttacctagatctactcttgcgaaacaatgggagagatattggggaaaatatcctccaatccaatcctcaccttagttttgtcatgactttccctcggttgctccgcttggggcttcgatctcactgtgggtgggcactgtagctagtggtcttgtgtcgccattgatgccgatctcgggccattcctctgtcgaaacttccttcacgggctgcagcttcgcgccacgagcctttgcttttgggccgcgtgccacttccgtgaggatatccgcatgggtaaaccccatgggacaccggttggtgaatggtgatcccctccggcaatcgccaacgcgaggacctcggtggtattgccatgttactcctgctctccctaaaccctaagctcaaagccatctttcctcaaaaggcaaataattgtcaacactggctgcttccgctattcatgatgcactaggctcaatcattcaatcgattcactatagtgagttagtgacctctgctcgtaattgtctgttcctcttgaaagcaatggctcctc

SEQ ID NO: 21074 - DNA, 396 bp, Oryza sativa
gcgaattcagccagctatccaagatgtgcaactctttcatcggctgagcaattcaccgttactgccgtcgaaacacctccatgtcttctacatcttatgcttttgggcgctttggaaccataggcatgatgtggtcttcagagggcagcaaccatctttagctgcttgtttacaccgagcgataagtgaagcaaccctttgggcagaaacactagctgtgcaagatcgacatgtaatagatgtctggaaacatcttttctcttccgcacttcaaactctgaatctgttgtaacaaaacctttcaatctattatgcaatgacaattcaggtggggaatctctcccccccccggtgagttagtaaaaaaaaacaatttggtatcagacccagcctggt

SEQ ID NO: 21075 - DNA, 1501 bp, Oryza sativa
agtttattgaaccaccatttgattctttgattctctcctcctcttgcacacaattagcaatgagcttctcaaagttccatttctctggacttatgttgtagttgacaataaaattgtcaaactgctttggcaatgaggccataaccagatggaccagaaagtcatctgttatgcccaaatccattggcttcaacttggaagccatgttgctcattctaagtatgtggtctctaacaccacctccattgtacctttctgtcacaagctgcttgatcagctgtgtagcataagtctttgaagagccagtaaactgactctttattctttcaaggtactctgagacagcgtcacactctgggatcgagcccaatatggtaggctcaatcgtattctttaccacagccaaacatttcttgttggctaaggaccatttcttttgttcaatgtcatacgacatgacgagaggagcattgtccctctgtctcttttgccagtcagcatctgactcattttcacctctgacaaggtcagcaggttctataggacatggggtagtcaatacccagtccacctctcccaagataaaagcaaggtcgagttttcttttccattctgcgtagttatctccttttagggtcggaatatctttaatgcaacccatcaaggagtagccacctgaaataatcatgtgcggtgagaacaaaattaacattaaaatattatgcattaagcctacatcaccgttgggcagaattagacataacacatataaccataactataatattgcaattaacaacgttggtcagaaaattacaacatcatagcacataattaatgttcctaaaattaaattctcccgttggttcgaaatttaattttagaaacactaattttcatcaatttcatctatttgcagcggaagactatataaaatcatatgaacagtagcaaaatctctgtaattctctctctgtgaaaattctcccgttggttcaaatttaaacagaggtaaaacatgcaaaaatctattcaaaattctattgaaatttgcatgaaaaatcgacaaaataaaatggaaaaattgctactgttctcttttattcattttcggccccgagggacctaaattgaacttttccggcctttgccggtcggcctatggccactttgcgcgcgggcgagcgccccctcccctcccccaggccgcaacctgggcctgggccgggaaagccgccgccgcgcgctccccacttgggccgatttcggtccggccgccgccggccgtccgatcagctagggtttcgatcggacggccgggcgccgagatcggaggatcaaaaacccccctctcccggccggccgccgaaaaccctagcttctcttctcttctctctctcacgcgaccgcgtggacggcgtcgccatcgccggcgaccttcgcgccgccgcgccatggccggcgctcctttcttttctcttctccgctccccccaccgtct

SEQ ID NO: 21076 - DNA, 378 bp, Oryza sativa
actcatgatgacatggacgaatctcggacgtccatttttcgatccaacggtagttttcaaattttcaccacatatttgcatgtgcatgtacattagggtggaacaatttgttgtgatggacaatttacaaatatgaaagttgatgtggtagtatttgaggccacacttacatagttaggattattctatcggatttgttctaaatttccttctttagaacccattggtgcgttaagcatggaagggatgtacgatgcaggcatgtgatcaagggagcacttttttttatcatacccatatcacgtgagttggagttgtcgacatatgttgcatgtgttcaagatttgcatgtacgctaagtacatgttgttgcatcaa

SEQ ID NO: 21077 - DNA, 736 bp, Oryza sativa
atgtgtagcaactattgaattttttctgtgagttttttctgaatttctcaaaacattgctcctatactgatataaaaaatgaagtagcaagtcagcaaccagtaagttcttcattagatgatttttcacatctgtttttcctggctttgtagattggtgggctcgctgctatgctggtagcatactatctcttaggaaatggatgggctacaagaacacattcaccactatgtatcctattttgcagatctgattctgaaataacacgctgcaaaattctatcttttttgtcaattaagacttccatccaaatttcttatgaactcaagtaaatgatgttgaaaatccctcactttgtatagatagctttggaagtgaatcactggagaagggaacacaagttattggaatgaaagaaatggtggtcccacttactgctggaattttatctgctttgaggagagtattagctcggcgggtgtcccttaaggtactcttgatttcattaactttatcaataatgataaagtgttaattattttccttaagaaatactatagttacaggcagtatccatagtaaccaggatagtcattctacagaaggtaattagcatgcaacgagacagatcattttctgcagagtataaaacattgtggaacatgaacatcgatgaaatttctatcgattcaatatgcaaccacatctgatatgcactttttgcaatgtttaaagt

SEQ ID NO: 21078 - DNA, 1501 bp, Oryza sativa
ccacaccaaactccagactgctaactccaacttctaactccaaactcctacttcagtgggagctaattcctaatggagttggagactcgttgagaagtgtttggctagttttcagctctagatctgaaaaaaaattgaaaaaacaattaaattgaaaaaaaaattgaaagaaaaaaagaaacctagtcgccggcagcccaatcacatggcgccgcccgccgccgccaatgcgttgtggccgcgcgcgccgcccactgcctgccggccttcgcccgctagctcactgcccgccgctcgcgcgtcgtcccgccgacctgctgtggtcgtgtgcctgccgccgccgcctgctagctcgcctcccgccgccgcgcgtcgtcttgccactgccaacaccgcgggacagccccgaccagagcgccgccgccgcgccctccaccgcgacaaccgacgccatcgccccgatccctctcactcctccgctgtcgtggccgaagctacctgccgccgctgctgccgcccaccgccgcagctattggactcgggaggaagatgggggaggagagagaacgggaggagaggatgtgggtagggatagttcagtggcatttttacataattacactaaaaaattaaagggtaatgggtcttttggggtggagtggagcagcaaaaacctagctccacccccgtagtacaattttgtggagcagttctgctaactctgctccaaaaaacggaggatctagactgtttggcacaactccggctccaggtaagttgggaactggagctgtaccaaacggggcattatatgccgatctccggatccacatctaaagtctccccatgcgattcaatgtacacttcctctgccactgcatctcgtgctcactggcccgtttgcgccagccctctcatcaacaccgtgcgagtcgctcatcaatcacgtcattcgcccacacacccaagccagcagtggctcctggtagcatcaagcatgcatgcctcctcgaggtcttcttccaacaccacgttgtcaagtgagcctggctcatcggttaccctttctcaccgactgtactacacagttctcaattcgctgctatacgtgcttgagataatatgtgatagatatatggggccaagggcatttctgacccttttgctatttaattggtagtgaatattatagtagttatggtgtcaaatagcatatattcacattttgggaatatcttccctatagatcaaattttgctatatccagaagctaaatcttgtattaacggtgttgtacggaaaattcgcccaaaagaagaactcctggaggacgggagtgtatattctgtaaactttcaaaagaaatatttttataaataaaaacatatgcgtatacataaataaaaaaaaaactcatcataagaaaatgagaatgggctatgggctccagtttctagtgggcttgctggttgcccaaatggcccaagaactggcctgtgtt

SEQ ID NO: 21079 - DNA, 208 bp, Oryza sativa
cattcgcaacataccgttcacgaagaaagatgttagtaacataaggacatcaatgaggaaccggactacatgcaatggtgacatggctgaaaccatcaagtacttccaagaattgcaagcagaagacccgatgtttttctatagcatggatgtcacgaccggaaataacccaacgggcgttccttacgtgcgtgcattattccttgtc

SEQ ID NO: 21080 - DNA, 237 bp, Oryza sativa
tcatggtaccactagtatgattttaggtagatgcttcgctggttaattaggtaacattaggtggttttacaactctagaccttgggatattcatatcacctggacactatggaattgttggattattgtggaattggattcacacctccccctctattcaaaatccccaaaatggttttaggctgggctcggggtgcatggttttgatagtagcacctcggccatataaggaccggt

SEQ ID NO: 21081 - DNA, 1501 bp, Oryza sativa
ggcccgagggcgatctgggccgtcggtcccgtggaccggcggtggaccacccgcgtggtcccggtccacggtgaaccgctcacccttgagtcgctgaccagtgggccccgcatgtcggcgccgcgcccccccgtgctgacgtcagccctggttaatattgcgcaataaattatttaaggatttttgttatagtaataaacacagtgaatcttctaaaattcataactaattcatccgagctccgtttaatcccattcaagtctcagtaaatcaagaaaaatgtgtagaatccattaaaaatggttttgttccctgtttcagtagtcttatagcctgtttgcaatgtttgccttgtatgtcgctagattccggttcctccgacgctccggtgtacttcgagatagtcgccgaggtccctccagtagcagagcaaggcaagtcatgcttgtcacttgatcatattgatcctatattgcaaatgtcctaatgttttctttcaaataccgcatttgttttgcaatgttaatatgggatggttacctattgttacagccatgctattttgataccatgctcctttgttagcttgggttataacatgattagagttaggactagggtttgcttagccatgcttagttcaactagttcacaatggggaaaatcatattaatgtttagactgttagttctaatggtaatgttggtttagtgacaccgctttggtgttggttaattaaaatgaatcacatggtgggctgtgggtgcatggttttgctggtcgcacccatggcagttaaggaccggttcgcgggatgccctggaaaaatttatcgtacttaccacaagccagcgtgggcaacggctgggcttgtagtgtagctttcctctagtcgacgcatccaggcaagggtgggcgtgatggagcggggcgggccctgcgacggcctctgtcgcttccggattcacctaggcacgagaggggactgcccgttgcccgctggggacgggggtgaaacctgaggtgtggtgtgcttggctagagggggttatgcgaagggtcctgtcacggcctctttccggtatgtcgtggtggcatgtcggcgcacggaaacgtgtcgtggggctgtgtcttgtgggtacaattgtacacctctgatcagagtaaaactattcgaatagccgcgcccgcggttatgggcggtcaaccagattcaccgtgattagactcacattagtttagtctaatgaatttggatggtataggggttggttgggcctgttgcaacgtggtgtagcgttggacagtggatgcttaatactgcttaattattacaactgttttcgcattcaactcctgtttataaatgccagtatttatgcaaatgaacctgcttagctatcccttgttgaatccatgcatcatacccccattccggtatgacttgctgagtacagtgggtagtactcagtcttgctctatttttcccccgatccccaga

SEQ ID NO: 21082 - DNA, 1501 bp, Oryza sativa
agatttttcaaaacgagtcagtctagggttttagtaaaactattgggatttattcgtcagtcagttggggtttgatgggtgaaatgcattaggtcctagctcaggaacatgggttgcaaggtatttatgctttatttgttattattaatatgtatctaatttctcattattttatcgttatgtgagtctgtcttgtttattcgctctcatgcaaaatgatctatgcataaaaatttcgctcttattcctttcccttatttgagtcttttattgctttatttaaatttggatttgagcatgcattgatcctactcctttgtcttctctagatggccggtcacccacccaaccaccgcggagaaggcatgatcgactttgtggcagagctggcacgcatgacactggtggtgggctaccccaacgcgccagagtacacgacgattccgccgctcagtggcgagcttcctcaccgtgtccgcttggaggtccatggctacgtggggacttgcctcgctaacatggcggtcgaggcatgtggaggcacagcagatcatgcctgtcaggaggcagcctacttgatgatggccagactacgggagcgccacaactacatcttccacgacacggcgtaccgctaccacccccgtcgagccaacggtgatggcgtcagctccttccgtccgacagccggcgagaacgacaccacatttggtcacatgtgtgctgtgatgaggggattggacaggatgcactcggacctgcacaaggcgaccaaggccttgaacgatgggaagctcatgaggatcgtcgctctgaaggacgagatagcgcgcctgaagaaggagaacgctcagctaaagggtcttccagcgccaggaggagtccggatccgcactacgccccgcaagacgacgacggcacccgtgcgcatccagcttgcgcccaggaacccacctccaccagcagctcccgcagcacctccagttccgcccgcagctccggcagttcctgcagctccagctccagctccagctccagctcccgcgttcgctctctccttcgctccagcatcagccgccagaggtccagccagtggcaccggaggttggttgtctgctactcccagtggctcagagtcaggcagtggcgagacttatctgccaggttccaggagtcgctcagagggacctggtgacgagcaggaggacgccttcgactccaccgaccgcaggagccgttccgagcattaggctcgttttccattagtttatcgactgtctagcttttgcttgttagtttgtgtgtttaggttgcttgtttgggtcagtcgacggtcgatatcatgtgcctatgatatggctgtcttaataaggatttttgtttgctcttttaagtgttttaattcagatcagaacaattgcagtttaaattcctttgtaataaagcttagttcctgagcatctgtttttcttcttttcccccatctgcttttccctccaga

SEQ ID NO: 21083 - DNA, 1501 bp, Oryza sativa
tctagtactcgttcatcagctgatgtctcgatggaagacgccgaagctccgcgatgactcctgaacgacaccgacctcgaccttgtcagtgatcgggagagacaagcctactacatgctgagcgaccgggagtatgctcacacgcgagaatactcaccagacctactaaaaaagataggtatggatgttgaatttcgttctatttggaaagctgttggttggcagagatttgatgtggtagatgagcctggttctcgtttgcttactttacaatttttgtgcactttgaaagaaatagaagatggtatttcctttcgctttttccgtgaggagttcacacttacatggaaaggcttaagtacacttcttggttttcaagattcctgtaaaatcgatctccagaaaggaatttctgggttcgagaaaaatagattttgggaagacatttctggtgctccaatatgcaagaaacctagaacgaatgatatccataatcctacacttaggctcatgcacaaatagattgctatgactttgtttcctagagatgatctgagactcattaggggagatgaattgattatcatgtttgccatggttagaaagatcaaaattgctcctgtgaaatgtatgataaggcaatggttagaaagtataaagttctctgctcctgtggagttgtcacgccccgaactagtcccgaccggaactagcccgtgacgctccaaattaacctgttaatcgataccagtcccaggaaacagtgctggtatcacagggagacagaatatcacagcaacagaggtctctttattatagagtagaggtacagtcatgttgggctgcggacagatcccgagctcacaactgcattacaaaagggaaacggaagccaggacttggaccaaacaacacaggcgcgacttgggaactaggccgaaaccctaaaactcatcatagccggcttgctcctggaaaaactcctcatcagcaggatccgcttcatcttcttcagcaactgggggggggattatttatatagagcaagggtgagtacgggagtactcagcaagccaggggaaataagtgtttaatgcaggcttcaaggaaaggctgttgtttttgcaattggttttatttgaactcttttctaaaaacaactaagtgagtgtttctcaaacgacacggatgagacagtgcgtctcgtccggtcggagtatgtgcaatgtatcagtctttagaattgaaacaaggttggcacccggccaacagcttttcaaacggccacccgggccaacaacttttcaaacggccacccgggcctagctgatcccatcagctgcagatttttcaaacatcgaacctcttttcacaatagcaatttcacaagcagtagtcaaacaaaactacgctaggaatcacctcacatccgcccatgaccgtgggcacggctgttcgaacagtttgttaacctctgtagagggggtacactttacccaca

SEQ ID NO: 21084 - DNA, 171 bp, Oryza sativa
atatgtagatctttattttatacaacttttgcaatttgaaccacattaaactgagttacaatgaattagttatgaattttcaaagattaaatcggattaaaacacttgtgtggattttaattgaattatgacgcaataaagaattatttttgaaaaggaaaagggaattat

SEQ ID NO: 21085 - DNA, 175 bp, Oryza sativa
cccgatttcgccggccgacgtggggaggtggaggtggagagagaggtgggatttgaatttcgaatcccggccgtctcgggtgcgggcacgggcgagagggatggggagtgggtgcgggagacgcggcgcatgcgcgggcgtggccgacgtggcccggaggaggcgggagcgtgga

SEQ ID NO: 21086 - DNA, 1501 bp, Oryza sativa
cttcctccgcgcgcgcgcgtcttgggccgctctgggccgccttcttgggccggccggcccgtttagatcggccggtccgctccaattcccttgggccgcgccttagccgcccgaggaaaagtctaatttccatccctcttttctttcttttcttttctttttcaaaaaggatttaattaaatccttttcctttagaccaaaaatccaataatcttagaaattcaatatcttcccaaccgtaaatccgtttgactccgttcaacttccaaaattcctcaaatctcgagatctatctaatggcacgcttagaggtctttaatagggctttattttcgccgtttgttgagttgtcccgtttcgcgtgtagtttcggagcccgaagatccacagcgcgaggatttcgaggatcaagctccagatctcgagcaaggcaagccacctttgaacatcttgagcctatatttgaaatttaattatattgcttgcaaaatattatgcattgataggatcgcacttaatctgtttgtcccgtctgcaaggcagattggcggacctacctaatttgtcgcatttgattcttcctttgttaattgctataccatgtccccttgtaaccacccagttacgcctcgatattcgtgcactctgtgcgagtatcgacggtcgccttcaaacttaaaaattcgtttaacaacttgggtaaaacttgggttttacaaaagacttggaaaacccgacacctgggtcggtgcttgtgaactaaatgaatttccaaaaccgcggaccggggaacgtaccgggtgtacggtttcccgctcttgcacctaaggaccgtttccttggaatttcatccaaacataagataagtacgaccacatgggtggaataggacacccctggctgagtaactagcttatcaggggagccatgatgccgagagacatgtggattcgccggggcggtgtcggagaggacccccctgggcttcctggcacagtatggtttgggacctaacctgttgttggtctgggaccccactcgtcggcatatggtaaacttgtgtcggctttggaaatgccttgtcatgaaagcttggaggtctcccgacgtggctgatccccacgggctgagtgatccgggttagtaatgtcgtgtgggtaaagtgtaccccctctacagaggttaacaaactgttcgaacagccgtgcccacggtcatgggcggatgtgaggtgattcctagcgtagttttgtttgactactgcttgtgaaattgctattgtgaaaagaggttcgatgtttgaaaaatctgcagctgatgggatcagctaggcccgggtggccgtttgaaaagttgttggcccgggtggccgtttgaaaagctgttggccgggtgccaaccttgtttcaattctaaagactgatacattgcacatactccgaccggacgagacgcactgtctcatccgtgtcgtttgagaaacactcacttagttgttttt

SEQ ID NO: 21087 - DNA, 1501 bp, Oryza sativa
aaaatgatttattcgaatgctatcaatgtaatcgcggatataaataaatggatttgtgaaactagaaatacacggttttaataaatcttgtatccgaacctatggcaaaaacaaccaagatctatttttaaaaatagacaactcaaatggatgaccaattggatctatgtaaagaaaacaaactatcctcccctccccctgctgctttacatttatatgtttctccttccgcaccactctcccctcctctcctcctcccatttaattcacccctcctaattttgaactaatgacataataataaaataatctaatagttacatagctaaattatagttatatttgctttttaatttgtttgaactgttttacaaatggatagctaaataactcgagatttatattactcatataaaaaaaatcaaataagtcgtttcaacatatacccctattcttttgcatggaaaccaaataacattctaattttaatttttatatagttatataaattattgaaaatcttgaacatagcccctatcttttgcacctcaaccaaataacaataaagcattgaaaataatgatgataagttttatgtcatcttaaattattctacgtaataaagaaccattaaacatcctctataatgctcttaagtctccatgtgtcattgttttaaaactagaaaaaaaacttagaaattcaaattaaaaaagtaaaacatttgatcattggtttgtgcaggcaattagagattagtaatttgagagaccaattgctcagcatgtgtggaaggactttcaactccaagtatggatcagtcttccaattctaaccatataagtgatgctaaagaccatatatataagtcttgcaattttattattcccaaccactaaatctaccttttggaaaaccataagcacccacattgccccttcttaaaagttaggaaacatattagaaatccgaggagaaaaaaaatatgatcatcggtttcacttaaattatttagaaaaaattctagggtctttctacaaatttatggaatgcaacataattatcgcaactggattggcattgtaggcttcacataaagattatataatataaatgtacttaattcatgccaagtgtaggctggattaaaaagaaatacatagttacatgatttctagcattaaaatataaattttatagaaaaatattaaaattatggaagcaatcataatacatcacattgcaaaaatagtgatgtttgtgcagctatatttattcgtctgatcatgttaatactagctaggatgcattgagcctcgcacactccacattaaacatttccaatagatcgtctcccacacttccccaatcgcattggactctacaaatgcatacatttagtgtagcctcatatcccacacaatccatctgttaattaacaataggaacctatatcagtcttaacttggtgattatttttcaaagttgacttaaaataaga

SEQ ID NO: 21088 - DNA, 1501 bp, Oryza sativa
ttgaggaaagataagcctgtgtgagactgagagttgtatgtaaggaccctagagaattacacttctccatacacatctacatcaacaaggtgggctacatgatcatatgataaccagatggctatccaccatatgaaaataggcaaaatccccttgatgatggagattgtaaggatgacaaggacaatgagggtcaggaagaagatatgaacatggatgatgagttcaaaaccaaaaatagtccaagagggagacaaactcagaggtgaagggagccaacaagggagcagatttggaacatattatgcacctcctacttacatagggaaaacacagatgactcatagtgggaaaaccctgaagaaattggcatcaaagaaagattcattgctgaagaaagtagaaaagacagaatgttgtactactatggtgctctgggggaagaaggaggaaaatctagtcatagaacaagagtctcaggagatggtgacaccggtcgagatgcaatctcaagatgagggaggtgaaatgacaaatgagaagctattaatgcatgaatgttccccaactgatgatgattttgagagatgtcagattcccactgattctgacattgaaagacttagagaggaagaagataatgaagaggacaatttccaagaggtgtctaacaaaaagaagaacagggctaagaaaacagaacttgcagtgacttcaaggatgaatctaagacaaagggagatggctgctaacccaataaccaaaagaactaagatactcacctagaagaagaacttggagcattaagctacaacaactaattaatccatttgctatatttcagttgttagattcgattgagttgaataatattactattgcctctaacttaaacttaggtagtacctctaaagagagaaaataatatagagactctaaaagcaaggaaattgttcaggctagactaggaaagctaaactggaaaaaagagatttaaaagacaaagacacaagaggaggtggtggagtcagagacagaagggtgagatgataacaagcaagaggaagaaaaagaggagataattatatgagaaatattgtaaaattgcatttttagatcagttatgctgatttaatgtatcacaataggagaaaaacaccttggtaggtctccgctgctgacatggttgttgtcagggttatggataccacataactaatagtagttgactaaatctcagcaggacccaccacataccatgtcctatacggaaacaacctgcggatataggaggagttccagataaggaaagacaaccagagttctatatggaaacgacaaagactactcggattgtatccatattggtttccctaattctacttgaacaaggggacacctatgggtataaatacaaggccccctaggaggagaggggagacgacgatacacacccacaatcaacagacacgggtaacatagacgtcacaaagctgtgagc

SEQ ID NO: 21089 - DNA, 266 bp, Oryza sativa
tttgtaacaatcagaaatcacaatgaatcagtgcagtcaatcatgatatggaagaaaataatctcattgtaaaccagagcctgtgcacctaacaagaagtatagtagtaggcgatataagatccacttggcaattttttgatgagcaatctaagagaggggacgagagagacgagaagcgggtgactaattagttgctagcctccacgctcatccactgcactcttcgcatccgtccaccgccgtcatcctcatttatcatttagt

SEQ ID NO: 21090 - DNA, 312 bp, Oryza sativa
ccaaagctttacaattgaacatagtttccaaatgactttttctctgatatgttaccttcattcttaaacagatgacatttttgaacatatgcaagctgtcaaatattaaaggaaaaggtttattctacaaccttgcgcttttaaccatggtttagaaattcaccctgtaactttctaaaccgttcatcctaccgtcataaactgaggtagtgatgtggttttggcttattcagtatagtcccccatccccatgccgttcccctattttcttcttgctcctctcctcactccccttccccactctgcttcaga

SEQ ID NO: 21091 - DNA, 1501 bp, Oryza sativa
aatgtccagacctccttgcgctagaggccgccgccaccagtgaccgctcgacagcgacgtcctctatgcggaccctagtcaggttttttgtgcggttgattgtttcagcaataagattgtttcatcctgatagatttactattgttgtttgtggtgccatggttccgtcaagttatccaaaagtatcaatacaatgaagtatttgactattgggtatactcaggaaaaggttgcagtatagagcatggagataggagtgcccacacagaagatggtggaggccaagctagtgactcaacaaacagtaactctgtgagaatcagctagctgccttattttatcttggtgaaactaacattttcgtttgatttaggttttcgggaagttcaacacaagtagttaagtgctaagaaaagtttcaagaagcacattgcaactagcttatatatttaagtgagcttttttagattgtggacgtttcttcgtatgtataagaacttatctagtgtccggatatatacttggtttgaatcgttttgtttgcctagttaatgcaagaacgtattgtacctactgttaacgatgaaatttggtaaatcatgcatcggatttggagttaaggccgaagcggatttgggaggaaatcgataacggaaacagggtatgaatcggcttcggaaccgcatcggctacagtgtgcatcggcagttaccgaataggacaaggcaagccgatgtagccaattccggcaagatgatattggaatcattgtcagattgagttgacgtgcttcatgatgattgccacgtacggatcgagtccgaagaaggcagttgtatctattaattaggaatagtttgttagtttccttttatctttaggaaagtgtgtttagtgtcctataaggactttatcttttccttttatctttaggaaagtttctttcttgtccgacaaggacttgtatcaacctatgggtataaatatgtacacccggggtcattgtaatctatcaatcgctacgatcaatacaattcggcgcatcgccaccctttttacttctacttttgtttttacgttccggcggaacttggcacccgatgcggagttgcatcgtcttcgatctccggcgaagggataagtccaatgttccgccgatccaggcaattgtatcgtctacgttggcgtcgttcaaggctgcatcagtacattcgacctcttggattgctttggtttggatgatatatttgcctacctatttatcatatgtctctgttaatctagttttagcatatcaatttagctctatcggctgcttctcattttagggtttctgccggtatcggctaaatcgcgttgctagattagattagcttagacatctaccaccctgaaaactcagtcaacggcttgattgtctagatattatatttcttttcatacttagtgctgcatcagttaagtttgatctactaagtcgtgcttagaaccataatttcta

SEQ ID NO: 21092 - DNA, 1501 bp, Oryza sativa
tctcgtcgtcctctacgtgtacatgtcctccaaagtcgcagccgaccatccaatctccggcgaggtcgccatcttggtccggccattgatgaggtcatcatgacgtcatcatcgttttttctttttcctgtttttctaatagattaaatcttaggaaattcataactaaatcatcgtaactcggttttgagtggttcaagttgctaaattcatctaaaatcgacatctacatgtttgtttactttatatatactgtttatttggtttttattagtctttttcttcgttttgcgtgttagcttgtcgtttccgtcgttgcgaaggttcgtgagtgcgtcgggagtgttcagaagattaattgaagaccgattattgcaaggcaagtcacacagatcctaaacacaatcctttgagcatgttgatcctatatttaaattctctatttatttcaactgtgcatttattttcgaatgtcactgggtggtgtgaatctattcctttgttatggcctgtttgcattgattactttattccttgataccttgggttattataacttgactagttgagctttatatattggttcagctagatattagatatgattgcttagtcatgattagaaatattagcacactattgggataacttatgactcactattatttaatgatggcttaatgatagttcacgatggtcaatcgtgattggttaattaattacttgccaactaaaacttgataatggtgggttgtgagcacatggttttgagagtcgtgctcatggcaattaaggaccggttcgcgagctactgttgtgaaacattaaccgtgccaaccacaagccagcgtgggcaacggctttaccttttgtataacatgattcattgcggagcaccagactgagaagtggcggagataagcccacgggggtcgctggggagtccatgccttgttttataagggggtgattatgatccaggaatggtgcactgtggtgagttgtgttgtgcagatggtattgtcacagcctctattcgggtactttccagtatcgcgacgcatggtagacatgatgttgaggctgtgtcttgtgggtacagtggtacacctctggccagagtaaaactattcgaatagccgtgcccgtggttatgggcgggttgagcaatgtttttcgtgattagtctcacacctctcacaataattatggatgttatacctggtaataatttgtttagctcctggtttggagttagatctgtacagccgggtatggttgttcaggatggttgggcctgtgcagcatgggtgtgctgttcagtgttgattaaaatttctaattaattactccactgttttacttctcttaaatgttttgctaaatgctgcttttgcaaatgagcctatattatgccatcctttggtatccttgtgcactcgcatatttgctgtgtggcttgttgagtatgtcatatgctcattcttgcaataatcaatca

SEQ ID NO: 21093 - DNA, 533 bp, Oryza sativa
caaaattggatctatagcaaagttatcttttttttgttttgtagcatcgaaagttcattgttcactttagtagaacataaattcctgccttttccctacatagcatttccatcgctccaactccctttctagttttctttgactgaaatcgacaaaaatggcaagacaattgacactatagggccaatttattcttgtccctattttgatgttcaatattaattttgcctctgctttttagggtttttgtttatgcccctggtttcttgaagcgaagccaagttttatctctactttagaaggagatgttagctgtgttaaatttttagcaaaaagacatccatacccttgcttgctactgtacattccgaactttggcagattcaaatcatcaaagaaaatctgacagattctagcgcagcaagaagtggcataagcaataaagcaagcaccagctccacatcttttcttcagctagcaagcaaccagcaactcctcacctcttcagcaagacagttgggcgttggcagcga

SEQ ID NO: 21094 - DNA, 409 bp, Oryza sativa
tcacaattttgttcaaacgcagttttttcagcagcagtattaatagcttcaggaatcacataagaatgagaaacttttctccaaatataaaattgcatcttactacaccattgagaaaaatccgttccatcgaaaacatgaggcttagttcaaaacctagcaggagtagccatggcaaaaactctaaatcgataaaaatccaaagcagaaaacagggctctgataccacttgtaggatcgaatcacaataactaagccacccggaggggggtgaatggttgatatatccaaaaaaccaaaaacttttagcggaaataaaagttaccctcgaattcgacagatcgcagtctgaccgaagttgctctgccggtctgaccgcctggttgctatcggtctgaccgcgattaga

SEQ ID NO: 21095 - DNA, 1501 bp, Oryza sativa
actccccagcgacccccgtgggcttatctccgccacttctcagtctggtaccctgcaatgaactatgctatacaaaaggtaaagccgttgcccatgctggcttgtggttagcacggttaatgtttcacaaccgaaactcgtgaaccggtccttaattgtcatgagcacgaccatcaaaaccatatgctcacaacccaccattatcaagttttagttggcaaattaattaatcaatcacgattgaccatcgtgagctacaattaaatatccatcaataagtaatagtaaaacattagttatcccaatcgtgtgctaatgtttctaagcatagctaagcaattatatctgtcggtgatatgggaccgggagtatcatgaccagaggcttgaggcagacgcaatcgcccacgtggcctggcaccttcggggacgtcgggcccgagggtgaggtgtccgccctcctcctgatttcccccgaggggggggtcgggttgcgcttgccccggccccgagggccgaggcaccccgaccccttaaagaagtctgcgccacatatatgggataagtgagcacagctgtgctcacctaacagcatttattacagtctggtcaagcgtgtcacgctgcatgtaacgcagtacagcacgctcttttatccggtctgtgaccagtcacagaccggtcagatcaagggttaggtggcgactggcggtctgacgcacgccttgccccatcccgtcaagacgaaagcctctaggcaactcgtctcaagccggagctagcgtgttatctcttagagatggcacgttagccctggttagatttataccaggcttcatcctaaccattacaggcaaggtgttacacgaagaagggcaaacatgcatcttgttaaactgacacatggtggacaagaatgaccagtctgacactggtcgcgtcagcaacgggcagccacgatcccacgttgcgcccgtctccgccgggagtggaggtaggtgtgggctgtcccatcgaagtgtcattcggacagcaaccataccaatctccgtccataaagagaagaaaagtccagtttggaaagaggagggtgcgtgtggtatccccttgaagtataaaaggaggaccttgcccatagagggagggggattctttccagattcagagcctagaacaagggagaggtcggcccacattttgtagctcttccacacacaaattcaccaaaacacaggagtagggtattacgcttcccagcggcccgaacctgtatacatcgtccgtgtctcgtgtttcttcctggcacgcgatctttccacacacagcgagagcttgagatctcaccctaagcccccggccgaaccggcaaaggggggcctgcgcggtctcccggtgaggagccacgagctccgtcatctggcgcgccaggtagggggctcagcgtgtgttttctgagctctcagactcttccgtgggcgccaagtttttcttgttcagcctaa

SEQ ID NO: 21096 - DNA, 342 bp, Oryza sativa
tttcattattatggcttctagatggatactatacgtatgtaatactattgtgtgctactaatgagacaaattggagataacttggtctcggaatatggtttctttgtttatttcatgtgtaggtgactcgatgcactagagggtttcctaagggttttaggacttctagtatgagtttggttcgttactttaggctgcctacctcgggtataaatagagggggagcgtgaggcttccggtattgctttagagagcaattgagttgagttttgagttagggttttgagtttagtcgaatttttttgtaaggagtgctgttggtgcattttgtaaacacagaga

SEQ ID NO: 21097 - DNA, 1501 bp, Oryza sativa
atagctaacctaacatgtctcatttactcgaaccttatttcagtcatcctatttactaggctgtaccccgcgggaacatcgtgaagagtactataatggtaagcatgcacgcaatatttataaaatgtggaaatgaagattgatctggacaaaatggctaattagttccctgatgcatatataaccaaaaagaaaaaacaacaccgtaccggtgatcgaatgtaggacaactgtccatgtagtgtagtatatactaagggtgtgtttttcacaccaaaattggtagtttggttgaaattggaatgatatgacggaaaagttggaagtttatgtgtgcagaaaagttttgatgtgatagcaaagtttaaaagtttgaagaaaaattttggaactaaacttggcgtaaatagcatcgaacatttggttgaattcgatgctatttagagaaaaggtacccaaaaggcataagtttaggcaaaataaacataaaagaacctaaaaatatatattgcgtaaagctgtgaaacaaaggagaaaagggacgatgagcatagcaagcagtaaatcagaaccaaccatgaaaattaaaaaacccattggagaaagagtgcagcatacatcagggcatcaaatctctctccactggggagtgggtaatggattttcctagagaaagttccctgctttcgataaaatctactaaagaataacaacagaagatcactgtacatgtctaacgggtactgcattaagaaaaattacaatgcatatgtgggaaacatgatttgataccatcccgtgaatatccaaaatgaatataggacttctcaatcacggtgaaaaacagcgtttcacaatgcaggtcattctagcattttccatatttatattgatgttacatttaatattaacatgaatatagaaaatgttagaatgacctatattgtgaaacaaaaggaagtacatgataatagagaaggatgcatgatctttccttttatccaaaataaacggctatcaaatgccactgataccagcacatcacaatttttttttgttctttttccatgagtgaaaattatgatcaatgaaagccaaaaattttgaaggaaaacaaaaggaaagatgcaaacgttagattaaactggaaagcaaaatgttgatacagagtcagttcagtgcctctaactgttagctttgagtggcgatttttggattaataccttaagttagtataaaagctttttttaacccaagtccaccacatttataattatgggcttgttcaaattgtagccaaaataaacattaccaagttttggcaatgtcaaaattttggcaagatggcaatattgccaaaattttggtattatttcttatgtattgatcaaatttggcaacaaactaaacatagccatttttaggtaactttgaaaaaaaatggtatggttgaaactaacatcaaaatgaacaacctctatgttcacagatctcatatcaa

SEQ ID NO: 21098 - DNA, 481 bp, Oryza sativa
tacctcaaagtatggctaatccatgtttttagcaataatcacattacttgatgtggtacagagttttttttggcaattattgataacaaaaaataatcatcaatgagaaatcattctgctaaactattacatttcaaacatcaccatttttagggctgtgctttgttaagatatacttcattggccaatatttcccaatctttttatactatttcagggctcagccgttttattgccaaaattaatattagcctttgttgtttatcttgtcattcattcttgtatatctcaccatttattgtttccatatcaaacaagaactcaaacatatctgccaagataatatctattaatagcctaaaaaaattttctatttcccttggctttatcctcatcgtttcctccacctacatgtacatctcaccatattctccccaatttccacaaaacaatttagagagaaaaatacagatcagaagaa

SEQ ID NO: 21099 - DNA, 455 bp, Oryza sativa
aaagagtatggcatagtcgtttaccatagtgcatcttgaaatcgattgaagaagaaaaaaaaagggcatagtcggttcatttctcattgtgatacagtgatcctgatttacctcattttataggcatgtttttcaaactactagacagtgcattttgtcaactttcttatatagaagttgttttaaattattagataaattattttttaatatttgaggtaataaccctcaattaatcatgtacctgcagttaatcttcgtccaccgcaagttctgtggttctgtggaatatattccaagtttgcaactgaaaaacttcatgagcactgactgcatttgcactgcagttcagtggatgcatcgacggagaatgaatacgcattccatgacagaactaaaacgcagggaaatacagagttacaaatcatatggcacgaaccgatacacatttcgtg

SEQ ID NO: 21100 - DNA, 1501 bp, Oryza sativa
tcagaattgacacgatgaattgggccaaaattcacaagtctgcggagtggagaagttcaggaggccacctgccgattttgggccaggatgggccggccctggttcggccgaacctcccctggcgccgttggatccaggttctggctggacggcgtggatcactccccaatgacggttggaaggcaattccgaccattccaactgccacaaccgtcattggcagcctatataaggacttcactctcttcaattcaacacacacctcaagcaatagctctctcatttctctcaagtttagtttagtagtatctagctggtggaattggaatagagtagaaatcaggagtccggaagcctttggaagagttcgggtatggctgtagtagcttttctcttctcttttgtaagctttgtacttttattggaatactcttctatatacatttatggtattgaaatagtttccgagtatatgagtacctactttatattatgttcatgttatactgaatatacgactagcttatctgggagatgctttggtgcgggtataatgtttgcttatgcaattactctatgtcatgacgatgatattagagtagtatctggtagtttagacgtggtgtctagattatgggatatcattatttggggttatatattgtggatgagaagtgggccgctaatggtgacagctcagtacggtattcctccgcgccggtatataatcctaaattaattccctggggagggtattcctccatatttagcccctgttgtatggtcatgacgggctgtcgtaaggaactcggcagtcaggggtggcttctcgaagtaccaggagggcatcggatagagggtattagctagtatatcagttaactagaatgtatgtatactatgtatattagaagtataggaatagattttctttctcttttctttcgacttagcttagatgatatattatgagaatgattagttaatgcttgtgtgtcactctacccttggattaccttaacccatgcttagaatatgattatcacaagtaatatataaattattagtcaagttttctctacatgatcttcccacgggataaaataaatacgatacccttaaaatactcttgggtgaaatgctataatggtatatccgtgcgcttgcggatgaactctgtaaccataatataccagaagtatttatgtgccattgctgggaattatatttctagtaatgtcattaagaaataccaacaagcatttctggcgccgttgccggggaagattcataatagagattacttgaactaaaactttatatttacctctgtgtaatcattttcctttgcaggctaaccttggttgtttttacttttgttgtgagaacagagtagtacatgactggtttcaacctgccggaagctgtctttcggagcgtcagaccacgagtcgttgctccgcagaaaactctaccaacagagaaaccagccataccagcg

SEQ ID NO: 21101 - DNA, 335 bp, Oryza sativa
tatatcgttaatatctacagccgatcgaatagatttagttcttctttacttattcatggcggccgatcgatacacagatgacatcggctcaaagataaatgatatgtcatcggcatctagctgatcagctatcatttatagatttaaccacggtttctttgcttctatttcttgttgattacaggatcaaatcaactggcacgctaacatatccgaaggcgagctttggacctgcactagagttaagcagatctcccaggccacgtgttttctgtcaacacgcttttggcacgcctggtgggacctctaagaagtcagacgtcagttcttcctca

SEQ ID NO: 21102 - DNA, 631 bp, Oryza sativa
aatcacatagaaccaaaggctaaatcacaaacatatttataaataaactcacatatacccatttttagttaatttgttatataaacttttcatttttagtacatttgtgataccagtcagctttcatgccctgtaaactcaataactattgatttttataaactcatgttatataaactgaattgttgttgatttttattgtaagttacagtgcgctgtaagagaatattaaaactgaaacctggacaaaaaaaacaatgaaatagtttgtaatctgtctatattactttgaactagagatatcaatgtcaaacataactagactgaaatcagaatatcaattaaatattgccatcaaatgtaaaaccaaatcaataaatcccaaatatctgcataacaaacaaatcacagtagtaaaaactcacagcacaaatcacactagataaactcacagcgggtatgtaagtgaaggggtagcgggagaagggtctcagtctacgagctccaggcggattctgggggcgaggccagagtcgattcctcccaaaatacttgcggggtgccctcccccatgtcaccctcgggtgagcgagggaagccttcagggcgagtcgggcgaacgcctcgacca

SEQ ID NO: 21103 - DNA, 661 bp, Oryza sativa
cgtctgaggaatgcttctttcttagctggtttaggaatatatgccttgcgcatataaatgatttttctcaacattccgatctacaagcagaaaacaattttagaaaaaataaaataaaacacttccaataataaacatttaattaattattggtttaaaataacaaaaaaaacctcatttaatttgcgataaaagagtttattgagagcatccagctttaagcattccgtcacctgtggcactgaaaagaagtactcattgaactataaaaacaaaacaatatacaaaggtaatattatttgacaactaaaaaaaaaaacaaacacaaataggtttggaagcccattttcaaagggcccatacacaacccgacccaatcaaatggcccagattgagcccaaataaaaaatttacatcaaatgaaagccgagattaagattaaagtcaatttaaaggcccaaaacaatatagaagtgactcaaatttagcccatcagcttaactaacaacagatacaaaacccaaaacactaacaaagatagagaatttggctaccaagaagaggagacaatcgcgtgacttgctctagaaaaaccaattaacaacaaaatacagcatccagatcgagaaaaaagcatggacatggagaagagtgagaaaga

SEQ ID NO: 21104 - DNA, 1047 bp, Oryza sativa
ccccccccccccccccggcactgctccttcccctgcgctctccaaacctcctcgccgcgcgaagcaccaccacgcctctggtgcgtctgccttccaacgccagctctcagcctctcaatcatatgctcgatccatccctaaatccttaattaggttagttaatcactaaacgatgcttcgataccatcccatttttatcgtagcatttatcaatccctaggatttatgcaatgtgttcgttgatttgcctaagccaggttggccaaactgcatattacattcttccgtgcatattagttcaaccattgcctttaatgcttgccttgctttcaattttgtatagctccgatctgacattcacaatttttttgtgcgttgaagactagcatatgcaaaattaatctgaagcacaagcccctttgctcccatctcatttgtagatcacttcacaaaattttcagtgaggaactccgtctgtagattaccctaaattattctcacaacagtatgtcgttggttgaattttcttactcccaatgtgtatattaattgttattatttccaggaccacaaattcttttcagttcaatttgaccaaaataaacgttcctactgtttttatgagttatcctgtcccacttgtagtgatattgcttgattgctgcataatttttttaatgagtacttgaagaaaacaagtggtgttgtttcagattcaggacatggtatatatttcagaatatgtatatatctaacttaaaacctcggattgccgcccacactgccggtaattgtacatatttcaaaggtgtactaatttccattcatgaataacttgccaaactcccattaagtgaagtcgtctaattgccgcccacactgccagcttcttatcctaacctgaaaattttagagatagctccatttcataaattgcctgaactttgattgtgaccacaaatgattgaatcatgatttctttctttttttttttttggccagtcacttgaattaggacctagcatacatattcagacaggaggtcta

SEQ ID NO: 21105 - DNA, 423 bp, Oryza sativa
ccccactaccgccccagggtccatggagacccccctaagcccccactaaaatttttcacgagatgtggtggctggagcttcgtcaggttggctggagggaaggctggaggttgaagacgatgttatttcgcgatttgggcttgtttcgaagagcagcccacgaccacgagcgcagtcttcaagttttgtctagcccactccaagcaaaggcccacggtggcagattccagccagcccatttggctactccccctcccggcctcccgcctccccaattccccaatcccactggccacctcctcctctcctaaatccctaaccctaggcgaataggcgcgggcggcgggcggcggccgagcaggcggtggcgtccggcgaggggccagacgggaggcgtgccaggcggtgccccggtggtccagt

SEQ ID NO: 21106 - DNA, 892 bp, Oryza sativa
aagtaagtgtgcctgacgtagtgtttattgacatttgggaatctgtacaaattgtgttgttttgggcttaagaacaatgggtagatacttcacattataatcatacttcacatttactaatcaaacggttcaatgtaaaagttactcatgctcaccaatttcataataagttgattactgaaatgttgatttcttctaatattttaatgttatttaaaattggcagaagaatgaattttaactctttccccttgtgcattgttcgtacttttgatctgcttttgctcctgaatttgatctttgaagttttcttgtacctgcaactttatcactcttctccatctccatctttttcttcttgaatagatttgttgcagagaagcttctttcttcggtggatctgagatttcctctaagataattgattctaaatagatctggattttgatctgcttgcgtttttttatctccatctttctcactcttctccatgtccatgcttttttctcgatctggatgctgtattttgttgttaattggtttttctagagcaagtcacgcgattgtctcctcttcttggtagccaaattctctatctttgttagtgttttgggttttgtatctgttgttagttaagctgatgggctaaatttgagtcacttctatattgttttgggcctttaaattgactttaatcttaatctcggctttcatttgatgtaaattttttatttgggctcaatctgggccatttgattgggtcgggttgtgtatgggccctttgaaaatgggcttccaaacctatttgtgtttgtttttttttttagttgtcaaataatattacctttgtatattgttttgtttttatagttcaatgagtacttcttttcag

SEQ ID NO: 21107 - DNA, 1501 bp, Oryza sativa
gtagagttaccaacccaagttaccaaccgagagtcccggttcatatgctgtaagggcttgtcgcccccccccccccgatctttacacccgattagtaacaccaactgggactaaacatcctaactttagtccaaagatcaatccctttgtatttggttttttcctcctccagcccaagccaagcttcaaaattcttctacaagaggggaggtcatgccaaaatttcttgtgaatttattttggtgattatatacaaatcagaggtatgtaaaaggttagcaacttcttcctccattgtttttgttgtcatattacatttggagctatgttttgtacacattattatctctaaaactttgttggaagttgatgagagagaaaatttgtgtagggaagaagaatatattgaaattttgtttatttacaattttataaaaaaaattataaaatagctaagaagaaatatatattgaaaattaatctaaaataatagaaaacaaactaaattgaaaactaaaagaagtacaacacattaaatattagtttaaaacttcaaaaataatttaaaaagaataatttgtgagattattttataattattgtatgaataatgatatgtcattactgtatgactatttagtggatttcactttcattgaataattttatgatttttttgcatttcatatagatggatcggcaatggatgtacgcggaccggtggttgaaagagtttattgacggcgtgcattattttttgagagtggcagaggctagcaagcataagggttttatttgttgtccatgcattaagtgcaagaaccagaaggattgtacagtaaggactattcatttccacttgtttgagtaggggttcatgcctagctataattgttggacatcacacgaagagataggggttcaaatggaagaagatgaagtggaagacaagaacattccggactgggttcagtacgctggatttgaaggaaatagaacgggtgaggtggacggggatgttgacgataatgacgctgcggatgatcttggtcagatgttgtaggatgctaagcaggattgtgaaagtgaaaaagatgcccataaattggagcatatgttagaagaccacagaacgtcgttgtaactaggttgcgaacaggggcataaaaagttgggtaccactctagaattcttgcaatggatggcaaaaaatagtgttactgacaaggcatttggcgatttattgaaactcgtcaagaacattcttccggagggaaacaaattgcctgagacaatatacaaggctaagaagatagtctgccctctaggactggaagttagaagatacacgcatgtccgaacgattgtatcctctatcgcggtgaggagtacgagaacctagaagcatgccctttttgtaaagtactacgatacaagattagacttgatgatccaggtgaagttgacgggcagccaacgaagaagagaattcctgctaagg

SEQ ID NO: 21108 - DNA, 587 bp, Oryza sativa
agtgatgtctagtgtaatgagttaatattattaatgctgttattaattgaagcattgtgcatatgtgtttcctcttgtattgcctccatatgattgctgtgaagctaccaagatttgtgtttgtcatgaagccgccattatgtatagtataatgcctcctttggttacacagttttcgctctcttataactgcgtacatatcaatttcatcttttatttctgtactcagtaatgaatatctgtggttgattcagtgtagttgatgataggaatgctggaatagtgcagtacattgtacagatgcaaatgcctgtgcattgtatagtgtcctcttctattacctgatcaaaagcaggaactttgagctctcttgctttgtttggatgtggtgagtgattgagtgccacttatttgtttttctgggactgaacacagatttttggtaagagtactaatctcaatgccttgtagcatgtttgtgttgccttcagcactgcgaatcgattactagtatatgaattttgagctgacacctgatgattttcatttttggcatgtaggcgctcattctctttagacaatcatca

SEQ ID NO: 21109 - DNA, 496 bp, Oryza sativa
cattttcccctttgacaggtttgcagcggtaaatctctcgccgtgcaagccaagaacacccatgacttcaagttcagagttccaactccacattatattgcttttgcaagaagtcttcagatcttcagagaaacattattacaaggttagctcatcaattcacctcacatggaccaccaccattgcagcagcaagggcaagtagagactgtagtagtagtagtcgaggaacagttcgcagccgagctggtcgcgacgcggttcacccaagtacagccatcaattgccgcttgccgagaagattccgccattgggagggggcccaagatctccatggcgccatcaagaacggcttttttttttgtgggagtaggaggagggagaagatacagacagatgtgcccctcgctcacgtgcccacctcatgtcccctcacatggcgtgtgcccgtggttgcatccgtcggatctccacttgctttagcagtagccagtaga

SEQ ID NO: 21110 - DNA, 1501 bp, Oryza sativa
ccctactcctgtgttttggtgaatttgtgtgtggaagagctacaaaatgtgggccgacctctcccttgttctaggctctgaatctggaaagaatccccctccctctatgggcaaggtcctccttttatacttcaaggggataccacacgcaccctcctctttccaaactggacttttcttctctttatggacggagattggtatggttgctgtccgaatgacacttcgatgggacagcccacacctacctccactcccggcggagacgggcgcaacgtgggatcgtggctgcccgttgctgacgcgaccagtgtcagactggtcattcttgtccaccatgtgtcagtttaacaagatgcatgtttgcccttcttcgtgtaacaccttgcctgtaatggttaggatgaagcctggtataaatctaaccagggctaacgtgccatctctaagagataacacgctagctccggcttgagacgagttgcctagaggctttcgtcttgacgggatggggcaaggcgtgcgtcagaccgccagtcgccacctaacccttgatctgaccggtctgtgactggtcacagaccggataaaagagcgtgctgtactgcgttacatgcagcgtgacacgcttgaccagactgtaataaatgctgttaggtgagcacagctgtgctcacttatcccatatatgtggcgcagacttctttaaggggtcggggtgcctcggccctcggggccggggcaagcgcaacccgacccccccctcgggggaaatcaggaggagggcggacacctcaccctcgggcccgacgtccccgaaggtgccaggccacgtgggcgattgcgtctgcctcaagcctctggtcatgatactcccggtcccatatcaccgacagtagcccccggcgttatgccagagcaatttcccttcccaagggaagcggtcaggtgtgacgccacccctaaagcctggtgacaggtgggaccggtctccgtagttgggcaaaatacccaacggtctcaatccatgcacattggtattggtaactttggttgtccataatgggcggtctattcaagactgccacaccacttgagcagcgcgcgaatctgggcgagcagattcgtctcgcccggagatacggcaacgccgcttcggtcggcgagcgtaattaacgcgcgcacgatacaatccgtttcgatcgccacaaccgcatatccacttcatgcgccgtaagcgggcgaatgggattagtggaagcgtgggcacgggaaacgagggagcgagatagcgagatatgagggagcgaggtagtgggcgcgagaaacgaggagccaggcccagcgatggcaagggtataaaagcatcgagaaaaggatttgcttccttcctttcgccattgttcctcttgccttcaccgcctgagctctaactctttctctgctacgccctactttcgccacacgcgctcgttctcaatcatctcttcctccaccgcca

SEQ ID NO: 21111 - DNA, 1501 bp, Oryza sativa
tttccaagtcaagagacaagacagacacttaatgcaaaacacttctccaccggagctaggtttttgggcccatgtggtaaccccttgaggtataaaagaaggttcaggcctagtaaaaagggggatggatctgggacgatccatttgacgctctagagcagtctctagccccggatgatcaacaccacattttactccaacaagaagatcttgtaatccttcactcaaggagcatagaacaggagtagggtattacgcttcttagcggcccgaacctgtataaacccttttggtctcatcgtctttgaggggcttgaccccctcaagatcacactgctttgctcaccgaatccttgaatctcacccgctgcccccggtcgaactcacaaaggagggcctcacggcctcccgctatagaaggtcactcctcgacacaaccctttatcttaatataaaatcttatcacaatataaactcccacagcttctaccaaacaatggattgataaaaagaaaatcatgatatcctcactactaattccctacctaaactcctaatgctctctcctaaaatttccaaaacatgctatggtattaaaaacaagagtttgaacgggaaccattggcaggtgtggtgaagttacatgagtatactcatagaatttaaatcttggtacccacaaataagttgcacaccagaccgagatggcacatgcggaattggcatgatcctttgagattgttatggatcctcgattttttcagcatgtcgttccatcgatttataaagtggtgctttgaagacggaacttatggcttgtgttgagggaatctatcatgccatgcaatgggcaatggacgatgcttcctatagttgtggaaacatattgtagtgggatgatcaatatgcggttttctaaggagttagaccgaccaatgccttttttttaaaagaggttgagttccttatggtcggaaataaaaaatttgtattaaaaaaggttcaagctagcaaattatgttagttgtgaagcaagctcaaagtttttgtgggtaactcttgtaaactcatctcacatgttgtgagggaggatttatcttccgattaataaatttcccgtttcaaaaaaaaattatggtataagttgcataaaatctcataaccccaggtattatgacacaaaatttcgcaaaacaacaactatttatcatttgagtttgatctgcgaaactcacaatcatatctcaaatttatgagttatttatccatcatataaatgttacatctatgtaagattttaatagagcatgtcaatttggttaacggcataactgctaagctttaagactataatacatatgattatgtgccacatcaaaatctaagtggttttgtgtaagttgaatcataatagactatgttttataaaatttactctcaatataaatttagtaaatcgcacttctgaatatatgaatgcggtgggtatgtcttgtgtaat

SEQ ID NO: 21112 - DNA, 241 bp, Oryza sativa
ctcgtgaattaactctcatttagcaataagtcttggaattattctatgtttaaaactctaaattagcatccaaatatccaatgtgacatggaataagtttactccctggatacaaacatacctttgcatctaaatacaaaagatttcttattggtgacaactgacaagcatatcctatcagatgaacgtcagtgacagtgactgtactcttgtactcttacaaccgccgtcttcattccag

SEQ ID NO: 21113 - DNA, 1473 bp, Oryza sativa
aaggtcaacaaaattggtactttgtgacatcttgtctcataggctcgtttgctattgcatatgtttaaggtgcccattaattagctagtgtgagatgggtggtggtcctgtcctttgatgatattacatccaccctttgttctgagtctattgctctcatttccactcatttttctctcgtaaaagtctccctgttgtagccattttggagtccttccatcatttttagaatacccacgctgtactctctctctctctctctctctctctctctctctctctctcctcattttcgtttttattgtttttgttcatgtgattcttatatgaaaacgtttgctttacgttcatgccattcgaccgtccctcttgtttataaaatcggccctgaattcgatatcggtaactaaacacggaagaacatcatacaagatcaaaacttgatgatgatatctatgcacgatatttagatcgagttcagtcgaaacctacatcttcatagcactaattatggacgatgattttcaaactagcatattacaatatatccaggtatcacaaccatcgatcggctcagtcgtcggctagtcgtttccacacctatgttactgtcactacgtggatataacatgtatgcttttctatttgcgagaagacttatgacagggtccgactcaacttctatcctatccttattacaattccaagttctaatttgtaattgattgcatattcatactaaacacaaactctatcttatcttttagaaagaataaaagaaatgtttctcatatgaacccactcataatatatactccctccatccaaaatgaatatttcgttggttttgtcaagataagttaattactcttggtcttggcaattaaaaaaaaatagatcttaaacttttggatgaaaagagtactactttaaataatgctaatggtggtatccaagtctgtctcaaacaccataaactggtatatatgtggggctataaggtatccacacgtgaataaccatgtaattgttattcaaccgtatgctttaatttagcccttctgaaaataggcccgtagaataaaaacatatgatctagcagcatatttcagtacggctgcattaaaagatggcattatatgcctaatcaactaactatactataaacttattgtttttgcttttgttgttatcttttataatatatgttgcaacgcacggcctttagcaagtttcctaaatgaatttacgtgtcacccgtattattgatggcatttcatcatgcgttgcacaagtagcagcataagtcggttgcaacctgtactgcagctatcggcctattcgcatttgttgaccaagtgggcatgcaaaatttcgcgttgctttctgggtgttttacagcgcggctccgtgtaccgcgcgaggaaagaaaaggtgggtgtgttccacttggtctgcaagggaggcagccga

SEQ ID NO: 21114 - DNA, 1501 bp, Oryza sativa
aacaactaagtgagtgcttctcaaacgacacggatgagacagtgcatctcgtccggtcggagtatgtgcaatgtatcagtctttgatagatttgagattggcacccggccacaactttaaaatggccacccgggcctagctgatcccgtcagccacagatgttccaaacatcgaaccccaagtccacaacagcaatttcacaaagcggtagtcaaacaaaactacgctaaggaatcactttacatccgcccatgaccgtgaacacggctgttcgaacagtttaataacctctgcagagggggcacactttacccacacgacattactaacccagatcacccagcccgtgcagaacagccacgtctggtgaccttgaggctttcataacaaggcatttcgagagccgacacaggtttaccatatgccgacgagaggggtcccagaccaacaacaggttaggtcccagaccatactgtgccaggaagcccaggggtcctctccgacaccaccctggtgaatccacttgtctccaggcatcaaggctcccctgattagctaattactcagccaggggtgtcccattccacccatgtggtcgtacttgttatatgtacggatgaaattccaaaggaaatcggtccttaagtgcaagagtgggaaaccgtgctcccggcacgtcccccggtctgcgatttttggaaattcatttggttcgcaagcaccgacccaggcgtcgggttttccaagtcttttgtaaaacctcaagttttacccatcgttggatattttaagtttgaggggaggtgttcccatgcacgtgcctgaaggcccgtgcatcgaagcacaacagtcgacaagggagttttaattgttcaataattcaaggagggtaattgcagcaattaggattggggccggtaggctttctcgcaagccgcggccaaattacttgtgttaaacctaatcatgcaatatttgcggaagagaaatacttagatttaaattataggtgcaagatgatcaaaggtgacttgccttgctcgagatcttgagcttgatcctcgaaatcctcgcactgcgggtcttcgggctccgaaactacacgcgaaacgggacaactcaacaaacggtaaaaataaagctctattattgacctctaagcgtgccattagatagatctcgatatttgaggaattttggaagttaaacggagtcaaacggatgtacggttgagaagatatggagtctctaagactaaaggatttactggactaaaagaaaaggatttattaacctcctttttggattagaaacgagatagggaagagatgtagactttgcgggcggcttgagcgcggcccgagaggagttggcgcggctcggccaaccaattgggctggcgcgggctcagaaggcggcccaacaaaaggaggcgtggagagagagagagatccgggtgagccggatccatcgtgcggggtcctggacgagcccacgagtc

SEQ ID NO: 21115 - DNA, 291 bp, Oryza sativa
atatatagaaatttctttaaaatatcaattatataaatttattaagtttgtaataatcaaaatttaattaattatgtgccaataatagctttttcgttcttcatcagtttcaaacaccatctaattaggctaggccgatgggtattccgcattgtaattgtcccccttagtcaggccgtctttcggcccatttatctcccactcccccgcgtccgtccctaatattgggccgcgcacgtgcgaagtcattgccgggccaattttcacgggttaggcccatttaagaagaga

SEQ ID NO: 21116 - DNA, 204 bp, Oryza sativa
ctcgataccatagcattgaaaaagtccatttttatacattcctcaatgatggattgagttccattcgtatctcttagtcgtaaaatcaattatagagcgtccccggccccaactatcaaatccagtgcaaattaagattctcagcggtttcattctacgtctcataacaatcagcatattgacatggttttccgttttcataga

SEQ ID NO: 21117 - DNA, 298 bp, Oryza sativa
atagatcctgaacagcatcgcccttttggctgtcagaatctttttttttcttcttattaatatcgatccggagaaggaatggaattatgagaactgctcgtctgtacactgccgggtccatgtctccatgacaatcatggatcggttgggccgatcagaataataaccgtgtgaactgtagtgtgcgtgatctgtgccccatctttcttatactggattagctgttgtctctttctccatgtccctgaattcagtgagtaaattaatttaccctaaaaatttgtcctttgtttgcaga

SEQ ID NO: 21118 - DNA, 401 bp, Oryza sativa
cacgcggatgaagttgggggcgtcgtggatgacctcgtcgctgtcgcctccagccccagcgtcggacatggcgccgggagatctcggacaaattcgaactagtggagtactccacttcaaaacttggatctggattctggaagaatcgaggtggccgccgaagaagccgccaccgccgccgcgagacaacgtcggcggcgcagcattgagccgtttcaatcgagaccgtcaaatgtagaatcgaacggctcacgtgagactgaaaagtctaaacgatcatgtggcacatccacgtgggccacgttggcggttggccccttcaataccaaagcaaagcaaaaggcacacagcccaacaaaccaacagggcaacacctaccgtagttgatcccgactccatgg

SEQ ID NO: 21119 - DNA, 287 bp, Oryza sativa
ggaattagtgctgtggacacacatgcatctttatatcttaatctactgtttcctccctcttaaacaaccttttaagtttaaaattggtttgatcaacttcataatctcaatctaaccattcacatttaaattttacttctctcatctccttaattccaatgaataattatgaaagcgtttatatttcagagatggaagagtactttaactacactgcatgtctgcatatatgtgtagtggatatcttcaattactgcaacaagaacgtacacgtgcgtactgctaga

SEQ ID NO: 21120 - DNA, 407 bp, Oryza sativa
cacgcggatgaagttgggggcgtcgtggatgacctcgtcgctgtcgcctccagccccagcgtcggacatggcgccgggagatctcggacaaattcgaactagtggagtactccacttcaaaacttggatctggattctggaagaatcgaggtggccgccgaagaagccgccaccgccgccgcgagacaacgtcggcggcgcagcattgagccgtttcaatcgagaccgtcaaatgtagaatcgaacggctcacgtgagactgaaaagtctaaacgatcatgtggcacatccacgtgggccacgttggcggttggccccttcaataccaaagcaaagcaaaaggcacacagcccaacaaaccaacagggcaacacctaccgtagttgatcccgactccatggctggct

SEQ ID NO: 21121 - DNA, 159 bp, Oryza sativa
ggacgacccgttcagggtggtgcggcgggagaagacgacgagatagccggccaaattgatgtatgatggtttttggtgtatggtatgaacaaaaaaaagagtacagggttcagatataaaagcagggactgtatcaggtgagcgtgccccaatggaaaa

SEQ ID NO: 21122 - DNA, 434 bp, Oryza sativa
tcgaccgcatcattgagagctgtcggccaatagaaaccctgacgaaaggctttgccaaccaaggtgcgcgaggcggagtgggctccgcattcgccttcatggatatcggcaagaagctcgacgccttgttcccgaggaatgcacttcaggaggattccgttagccgcgcgccgatagagggtccccttctaccagcacgtagcatttggagatgcgctggacgcgttcactcccttcgcggtcctcgggtagagtcttatctgtgaggtatacttggatctcagcgatccaagcaatcaatctaagggagctgggagcgctcccctcgggtcccgaggcctggactccgacgggcctcgggggccggtcaggcgcgtccgtctcccctaaggggtcgggtcgcgccgacggctgggcaagcctttcttcaaagg

SEQ ID NO: 21123 - DNA, 161 bp, Oryza sativa
cagcctcctccatccagtctctgggaatgagtggccgccgccctacctcgggcctgactcccctcgggggagggccacgtggcatcggggggcagcctcctccgactagtctttggggcaggagtggccaccaccccacctcgggcctgactcccctcagg

SEQ ID NO: 21124 - DNA, 595 bp, Oryza sativa
catattgtagaacatgataaagtcagtagcaaatcgtagacgtgtgataaagtcagtggtaaataatggattctctctagaaagatagtagagatgaaaagtgtaaaatatgtaagttaactaatttaaagtgaaatgtttaaaaaaaactaatttaaagtgaaagattagtcaaagggtggtacaaagtgaaacttcagcactaaaagacacgttaacgtatcaattatgaaaagaaagctgaatgaaaaaacaaaatataagtttaaaagttaatataagagaatgtcagcctttacgtgacgtgttgaatcgtccagattgtagagaaaggaggtaactcacatgctgtcgacgatttagatcacaactatggtatttgtatgatatgagaatcgttgatatcaggacatatacgagattgaaataaaagagacagagacaaggatttttatacaggttcggaccccttattcatcagaatcaggtaatagccctactcttgttggacgaaactggtgttgctcttattcattaaaatcacacaaatacaataattgagataacctatctagtcgtcgtcgacttggcggca

SEQ ID NO: 21125 - DNA, 1501 bp, Oryza sativa
tccgacgctagaaacggattcctggagtcgcgtagatgctctagctcgctcgaatcgaactcccgtcgcgccgtcgccgttaccctctttcctcgccgccggttgccgccgccgcaatccgccgccgtcgggctccttccggcgaatccaatccattggctcgtctcccctcgtcccgtgcaacctcccggtgtgctcgctttcgcctgtatcgccgtggttcgccccgctgctcgccgccgccgtccgccatccgttccggccggcgtcgtcgtcttcctcccgccggcccgcgtggctgccacaaaggcgccacgtcggcgccagctcggccacgggccaggtcggtttgacctcagtcaaccgctcctccgatccgttctcctgtacgcgcgtggtccacggagagccagccggctgcgcttgggcccgccgtctcccagtccacctggtgcaccatctgtgagccgcgtccgcaaacactagctcccccgcgccgcgtaaaccctctctcccgtgcaccgagtcactgactcgtgggctcgtccaggaccccgcacgatggatccggctcacccggatctctctctctctccacgcctccttttgttgggccgccttctgagcccgcgccagcccaattggttggccgagccgcgccaactcctctcgggccgcgctcaagccgcccgcaaagtctacatctcttccctatctcgtttctaatccaaaaaggaggttaataaatccttttcttttagtccagtaaatcctttagtcttagagactccatatcttctcaaccgtacatccgtttgactccgtttaacttccaaaattcctcaaatatcgagatctatctaatggcacgcttagaggtcaataatagagctttatttttaccgtttgttgagttgtcccgtttcgcgtgtagtttcggagcccgaagacccgcagtgcgaggatttcgaggatcaagctcaagatctcgagcaaggcaagtcacctttgatcatcttgcacctataatttaaatctaagtatttctcttccgcaaatattgcatgattaggtttaacacaagtaatttggccgcggcttgcgagaaagcctaccggccccaatcctaattgctgcaattaccctccttgaattattgaacaattaaaactcccttgtcgactgttgtgcttcgatgcacgggccttcaggcacgtgcatgggaacacctcccctcaaacttaaaatatccaacgatgggtaaaacttgaggttttacaaaagacttggaaaacccgacgcctgggtcggtgcttgcgaaccaaatgaatttccaaaaatcgcagaccgggggacgtgccgggagcacggtttcccactcttgcacttaaggaccgatttcctttggaatttcatccgtacatataacaagtacgaccacatgggtggaatgggacacccctggctgagtaattagctaatcaggggagccttgatgcct

SEQ ID NO: 21126 - DNA, 1002 bp, Oryza sativa
gagaatcacaaaccaagagtgataatgatctacaacaccgcaccaaagctcgatcccctccctcacgaatcgaatatggtggaggagacccacaagctcaaatgattcgatcggcgaaggataggagacacaaggggggaggcgataaggggatgcttgcacacaaattctctgcttttttttttgtgtgtgtctgtatttttggggctataatggaaggttgcgcgtaaagcaccactactgtcctgtgctttttcggtgggttaagcgttggcgctcgcaaatacgcatatttatcaccaggtcctcatgttcttggtttttgccgcatgtgattctcgtttttttttatgcttgcgaaacaggaggtgaaaaatctttgaatagaaaggagtatatgcggtcgttgatccatggcgttctatcctggaatcgcccactgtctatttttaacgaggttggagaaccacgttggttagcctacccatgattttgcggctagtaaagcgtgcacttgttttttttaatctccaaaaatgttgtatcgatgcatgcttttcaacttcatatttgcatatttcactccgaaaaacattgtgagacggacacaaaggtttcgaatatgtgatgagttccatcaaacgctcatatgcaaattgactatactggtaagatggctttatctttatagatcttcagtgatatgtagggcctattcattttgatgacattttcaaccttatcaaattttgataaagttgccaagtggctacatttagtttgctgccaaattttggtaactatataaaaaatcctcccaaaattttggcaagttaccaaaattttgacaactatgccaaaatttgttaaggttttttttggcatcaaagtgaacaggcccgtaattgtcttatggtttcttcactatctacctgtgatattttttttcttccttatgttctcattttgtcccttcaatttaatgtttttatttagtagcca

SEQ ID NO: 21127 - DNA, 936 bp, Oryza sativa
aagtttggattttggttaaattgaaaatgatgtgactgaaaagttgtgtgtgtatgacaggttgatgtgatggaaaatgactgaagtttggatccaaactttggatctaaacacagcctcatttcatctctcaaccacatatatatttcttccatctgtggttatcacctttaatttctacacgtacgtatcttcactccacagtccaccccattacttgtcattttttgtttttgcataacaagattatcgaataattatttcaataagaatatggtgggcgaattggccagtttgtagaaacatcagagtactgctaactgcagtgtagatcgaccgacttgacatgttacttcctttcaaggattcattagaaaagaacctacaaaaatctactattgaatcttctacagtctctagtttggcaacgccgcaggccattattttcgtcatctagtagcatgtgtattgctttgttactgtgtgttgtgattaatagcatccggacagtaccattctttccagctggtagatagtcagatagccatggacgtgtggaaataatcagatgtgtataggatcagtgagcagcgaccggcagttgggcgagtcgttggctccagcaacgacagggatatctgatgggactagtgcccctggaattcgttcatatacgaggacaatatacaggcttggcagattgcaacaaaactgtttgctgctgatcgaaatactgtcaatcaatgtctccatatgttatatagcgcttggggaatcgctcttaatcttgcgtttacttaagtctctgcaggcgcacgatcagtataaattaagagacgacagacgttgcctctgaatacaaaatcgatctcacgcgtagttagcatacatatctgcacccacaaagctaggcaagctagccgatcggcgcaaaga

SEQ ID NO: 21128 - DNA, 426 bp, Oryza sativa
gctgttgactttgatcggtgaatcgggtgacggctgctgctgctcttcagctttgttgttgactttgatctcaagtagccgctcaacgggctgtcggcagatcgggcaccgggtcgtctggtacctcaggaccttggcacactcgctgcacatacactgtaccagagtatacaaatgtcagggtttactggagatgctaaaaatgcatggaaatggctgacagtcagcaaaacagcaccgatttgtttgaaatagttttcagaatacgaaatgtgaaccaggtaagccataagcataaaaagtatggttttagaaacagaataactttgtagctttatttaacttgatcatggacccctaatgctgcacatgaactagtcaatacacaaatcggatacttaccatatgcctacatgggagaacggt

SEQ ID NO: 21129 - DNA, 357 bp, Oryza sativa
tttggatatcatgctcctttgttagcttgggttataacatgattagactttggctaggacttgcttaccatgcttagttcaactagcacacattggggatctcatttaaaacctagactataggtttatatgataatgttggtttaataccaccactctgatgttggttaaataaaatgaaccacatggtgggctgtgggtgcatggttttgctagtcgcacccatggcagttaaggaccggttcgcgggatgccctggaagaatttatcgtacttaccacaagccagcgtgggcaacggctgggcttgtagtgtagctttcctctagccgacgcatccaggcaagggtgggcgtga

SEQ ID NO: 21130 - DNA, 179 bp, Oryza sativa
aacgaaggacaacccacaaattatggaagtggtgtaataaatctggatcaactctgaatttatattgcaatcagttctgcgatctacacttatctatatgatcacacttatctatgtagtacgatttattttatctacaatctgaatggcctcgtaatttctggttcccaattttaagc

SEQ ID NO: 21131 - DNA, 208 bp, Oryza sativa
gatatcatttggctgaagctgatgaggccgcttgcttcttgtaacttgtacagtaggaaggagagtggcactgcgctagtgcgctgtgagcagaagagaacacgcatgcatcatgtgttttctttctgttgtagctgatttgagcaatattaactgcattgcaatgtattttctggagtaactttgtatgcaaccgtgggttccaaaa

SEQ ID NO: 21132 - DNA, 352 bp, Oryza sativa
tgatttaacttcattttaataagaatgttttcaaattactagccagtgcattttgtcacttttttatatagaagttgttttaaattataagataaatatttttttaatatttaaagtaataaccctcaattaatcatgtacctgcagttatctttcgtccaccgcaagttctgtggttctgtggaatatattccaagtttgcaactgaaaaacttcatgagcactgactgcatttgcactgcagttcagtggatgcatcgacggagaatgaatacgcattccatgacagaactaaaacgcagggaaatacagagttacaaatcatatggcacgaaccgatacacatttcgtg

SEQ ID NO: 21133 - DNA, 182 bp, Oryza sativa
acatcaacttaaatttgatctaaagtagagtaaattaagcaagtggtatccttctcaatttcattctacccctgcccctgaacttaacgagagtgacatctttatcgaaaccctcggtgatctattggcacttataaataaaaaccatatatagaattaaaggtgaattaagggttcgacca

SEQ ID NO: 21134 - DNA, 360 bp, Oryza sativa
ggcaacgggggaacccacgcgtcaggaaatagggaccagtggtcagtctagcgctctactactactacagtctgcgtgcacagctcagctgctgtgatttctcccacttttgcggctttgttcacagcgagctttcagcacgcttgggcctctttagttccccaagtttttttcccaaaaacattatatcgaatctttggatatatgcatgaagcattaaatatagataaaaagaaagactaattgcacagttatgaaggaaatcgcgagacgaatcttttaagcctaattagtccgtgattagccataagcgctacagtaaccacatgtgctaatgacggcttaattagtctcaaaaga

SEQ ID NO: 21135 - DNA, 361 bp, Oryza sativa
cattctctgacaaaaatactctagaattttgtcaaagcaccagtattacatgttaacctgtccaaaagctcagtaacaccaatcaactcccaaaatattgatgtggttgttgttttagaaaatttcacatggcaacgagaaaccctcccatttatctacctactctagggtgcctcaggcgtgtacacttgcagccaatagaaaacaataccgaggctcacctgcccggctagaacaaaatgcttccacatgaaggtgtcatgtcctggtgaattcagtgcttagctccaccccaacatacgtactcattgtcttaaagcctcccaaacaattctacacggagatcgataaggtgaaagga

SEQ ID NO: 21136 - DNA, 1501 bp, Oryza sativa
gagcaagcaaataaagaaggagatgagacataaggggtagcaactggtgtgacttttaaaaactatataattagaaacacgatgatgataaaatttggtctttcaaagtcctaagacaatgagatagctatttaataaattttaagtaaaatcatacttaaaaaaatatatgattttgtttgggtgctagccgcgcaattgcgcgggccacccagctagttctagtaaaaatgacctcaatccgctatcctaatccggtggtgcgccatgacgaactcaccacagcaattacatcgatcctgcaattacatttttcttgacaggatttaaaagagaaattaaaagagagaggtattttctcagcacaaaccttatgggccaatttcatggaatcaagaattctacccgcagattatgggccaaaaataaaagcccaagaaatttctttctgctgcttttatggctttcgttccttttcttgtcaaaatcagcggctccagactgaatatctgtcaggtaaaatcgcgccttctgaaatccacacgagaaaaatacctgcaggcttgtctgcgccaccgcttcgccgatgccaagatcggcaggatctcttgctgtgcgtcgcatgttagcattaggctttaccacacgatggctgcctctgaccaaacctgcatagctagctagcttcgtctcttcgttttatacaccaagttgcgccacgacgtcgacaggttcaggcttcagagagtgacagagaaaggaaagagcaagaaattaaccagctctcttccttttcgtacggattcagcgtgcacggatgaattcaggccgggaatatactcacacgatggctgagaccggtgttcagtcaaatgtggttcagaatcttggccatatcatattaaccgggggcaaaaaaggagtgcttcctagatctctagttgggagaggatctcatgcatgcatgttgtgtccttttcaatcgatctgattttcctaataataactagagaagctgtcatgagattccttatgtaaacagggggtgataattagcttgagtgatcaagaagattatcgtaattaattggatgcacgtacagtcaaggaataataaccaagctcatttggttgacagctatgcaagagcaatatactactaaagtcatgtattaatagctttgatgaatgcttctctagcttgctgatcagtcctactatgcgagtttgttttttggttaaatttaagctcagtgctgaggaaagactatatagcttgatactgttataatctgccagttcagcgttgaactggttaatgggtttagaaatctgaattaaaggtcagaaccaagttgaacacattcagcgcccagaatctgtgaactgagaagaattgcaacttgcaatgaagtgcctgtactacttcatcatcagttcatataatacgaaaagaacgaaagaaaaggtttccgttgttagatttgctatcgagaaatta

SEQ ID NO: 21137 - DNA, 1501 bp, Oryza sativa
gctaataaaagatatttttttaataaattaggtcttgttttgcaaagtgtacattgtattacctcaggactcacaggaagaaatatgaagtggatagtaaatgctttaactcaaaaacctattttacaggagcaggatcagataaagttgctgtaaagtaggagttttaagctttgaagatagggttaattctaatggtcgtgttggaggaggaaatttgaggtgtgagttgattctaatggtcgcgttggagaacgaaatttgtggtgtgggtgaaagtactatatttagtaggaaagcttaaagcagcatatttgttgggcctaatgcagcttatctagaaatcaataaagtggtcaaatgagagaacttatctaaataaaacgagttaaccaaatctaatatcataaagatttgacttacaacatgcatcctaaaatataatgacaagggttatccttcttcaaaccatatgtaggcttgcaataacttatttcttgagatgaattaattataggttatttagcaaagacaaacgagtgtctccttaaatgtggataagtgggctctctttctatttaaatcaatcataaaaaaattatgtaaaatcaaatataatatatgttacaccataaattgttgattatacctagccacaaaattaggacaaattcacttcatgcacacaatctgtactcccttgttcaataaatatttgatgcttagaaaaggtttgatcaaactttaatattctgatcattaattttatatcaaaattaatttatagaatctgataagtttatggtagtaagatagtgcttttcgaggaaaatttatatatactaaactttcagctaaaaatttaagaaattattggtggttggtatttaaaaaaaatgaccaaatcttatctcaagcatcaaatatttatgacaaaaggtaggaatgaaaatggttggaaagcaaacttaacaattttcataaccattgtcgtgaccttgggttacggtaaaacacaaattccccgcctatcttgagaattaactcgaatagaaatgcaaaatgtgtgagatgatattttgctattagttatgtcttgtcttgttgcagtattatgaccgacttatatggttccagaggtacatgtgaagttacaatcttacctttgagggtgcacaggaagttactgcaatacccctataatgctagaaaccctaagggtatagttgtacatttgtgtggtctctaaagcttcaggtgccagcttgcaagagtggttggagcagtccccatggtatcttcttgaggaatattcctagttcgatggcgtaaccttcaagcttcatctgccctgatcgactagtacttaccttcaaatgcttctttctagacatcggtcgtttagtatttacctgtcatattaagtcgagaagtgtttgccacaagcaaaaacctctttggttggtaaaagtcttgccattctactgtatcagtagatcca

SEQ ID NO: 21138 - DNA, 1501 bp, Oryza sativa
agtttgttacaagagataagggatatgattatatctttggctaatctattcttatccttctatctttgtatcatatctaactatatatctaacaataagatgacaaatcatccatacgataagtatgcaactgtattttggacgagataaaattttgaaacatgagaggtgccaaagatttagcgagaatatcgaaatcatgaatacagctagcggcaagcatgtttgctgccacaggtgtaaatcttatttacattttcatatcaccacttggctactgtttttactccttttttttttacggatatttactcctaaaattaatagaacgccaagctggtctttcgagaaaaaaaattctctactactactgctgagggcaagttttatagtagatgtgactaccacatccaatttcatgcatgaaatacataattaaattaagaggtgatatgtataataggttacctctaccacacaatccccaatatctctaatattctcatatgtttattgaaatttgtgtaggggttgcctcttgcatgagaggtgactatttatctctcatccttcttctctcctccacctcactatttagtcctatatggcatcttggggctttgtgcttgatgcccatagtacttgccctccattgatatgcatgctacaaaagcactggatttttaatcatatccttcaactgttatggacttattgtgatgtttggacagttgggtttccaaaacctcctattggtgttgtccaaactccaaagaggaggcccattttgaaactgttgcccggcaaggaaaagggaaagaaagtgaatcgaaaggaggagagccatcgactgagaaagttcctccaccctaggaaccaaccatgcagaggagcagaatcttaatttctcgatagcaaatctaacaacggaaaccttttctttcgttcttttcgtattatatgaactgatgatgaagtagtacaggcacttcattgcaagttgcaattcttctcagttcacagattctgggcgctgaatgtgttcaacttggttctgacctttaattcagatttctaaacccattaaccagttcaacgctgaactggcagattataacagtatcaagctatatagtctttcctcagcactgagcttaaatttaaccaaaaaacaaactcgcatagtaggactgatcagcaagctagagaagcattcatcaaagctattaatacatgactttagtagtatattgctcttgcatagctgtcaaccaaatgagcttggttattattccttgactgtacgtgcatccaattaattacgataatcttcttgatcactcaagctaattatcaccccctgtttacataaggaatctcatgacagcttctctagttattattaggaaaatcagatcgattgaaaaggacacaacatgcatgcatgagatcctctcccaactagagatctaggaagcactccttttttgcccccggttaa

SEQ ID NO: 21139 - DNA, 1354 bp, Oryza sativa
tgtgtgtatctctcgtcacatggcgaaagtggaaggggggagaacaaagtggcattccgttcagattaattaccacgcaaagctctttggcaaagtgatcaacgaaccatggcagagatgatcagatttccagcatgcatgcgaggcggccttaactttgtgtcgatagaagtttctcttgatcagcttttgctttgcgagacaagtgttttttgtgctttgttttgcatgccacaatgatgatgctgtgattatgtcagtcactctgtcagcgagtgaaccgcacttgtacttccactcgaaactactggcgtccagtgcactatgcattgccgcctcaatttactgctaacttccaacttccaagttccgaccatcatttctctgttctatgtacagtatgatcacgtaagattaaatgtgcgtgtactgtcgaaacaacgcaaagaaaaacatgcatattaactgctgtttaatcgagccaacaagagcataaatagtggtactctgttatgagaagtgcaacgcgacaagttgtgcatttgttgtacaaccggagctgttcacacatgtgaccagggtcacctttccaattcatacgtacctctcctacaaatctcgtgccaataatgcaaggttaagttagggccacgtacggacaacaaacatgacacgtcgacgaaatagtgttgttcttacaagttacaaccaatgcgatttacaattttcgagtgcatagttatctcatagtgtgagatttgttggaaaaagaatcacctaaatttgtagccattggatatcaaataatctccttgctccaccaaatacatgtatagcctctcctttaaaaactctatcccttcctccacttcctatatggttataccatacacttggccagttgttgttgtccggttggtgtcgtgcgtactctgtctcagtcactactttaaacgcgcacacacatccgacatcaatgggcacctctaatgtgggactaaatccaacacacatcctacatgaatgagcacctccaatatgggactaaatccaatagtctcttccgtcacgcattgaatccaacaatcttctccttacatcaacccatgtgaccccgaagacttgtgatctatagaaattgttccgggtaccaaacataggcttcaataccagttgttagaaaaccggcccaaaatcactatccgaaaccaaatgcggaagaaatgttataggagatccaaacacaataatacatgacatgtgagacacgatatttgttaacgaagttcaaccaaagcctatatctccggagtacttattacatgtgcttctccatgatccaacatattacagt

SEQ ID NO: 21140 - DNA, 921 bp, Oryza sativa
tgagggatctattgtatctggttttccggttgaaggacgaaaatcagattcgttgacaagttaagggacctcaagtgaacttattccaaactggagcaatcaaggtaaccgcgtaaggcgtcaagttttgggccgaagcgagcacggtgagcaggccaccccggtgctatcaaccacgcttggtcccgcgtgacggcgtgagcgagcctgtctgcttgcgacaggctcaaatctaacacacgaaggtcaagtgtagcactgttgctacctaggcctgtacaaaccgtgcgagtgcatgatactcccttaagaccctctactcttttgcctgatctccatctaaacctgtcctaacgtggatagccttggaatgtagtactacaattaatagatcgtactgtacgtgctctactccattgctagtatagagccccactacgttgctttatattaatagaagaaagcaatctaacccattaatcttatttaatcgaagggtttagatttatttatactaacaccttagttaacagtagtagaaatagaaaggggcattattgtctgaaaaaagtaggtgaggtagggtcaatgactaaacttttttcatttagctagaaaaaaaacataaataacaaagttactcttaatcattgtattattagtaaattattgatttacccttaataacgaacggttcaaattatttcaactggtagtataatctaaaccacgggcacatagacatagtatgtatacggagttggcaatggactctatagcaatttctacaggctacagagttgtagccgactataccacgggctccaataagttatatctgagatagatgagtggattaggtatgtcagggttacggataaggcataccctctatccttggatataagatatatactgata

SEQ ID NO: 21141 - DNA, 1501 bp, Oryza sativa
tgcagctggtagcagaacacagtcaagatcagcttggatcggtagtgtgtgtgtatcatctcaaaagctacggattggaaaataacagaaaaatactgtccatggatactgcaagcgcaggcaaggttaatgaacaagaccgcaaccggcaaattaagacagattgtagcacagaatgatcaaatactgaaatgattgaacaaccaaatcacaaaaaaattcaatttgatgctcttgtcgtcgtcgcacgagctcttagcttgactaaatcacactgtgatctgtgggccgttcaatcggtgtcccgacggtcaagatgtgatcgcctgcatcatcgtcgtcgagtatatatcagcaacaacctcaaccaaacatccacatggccactctaacccagctggaaaacagtcgacaagtaaaaataaactttatttaaaaaagatcagataaaagccactggataaactaataaataattcatacatgcatgtactatatatatatatatattactgttcatttgttgattataaatttaaaaataactttatttcaaaaagatcagacaaaaggcacgggataaactaataaagaactcacacctgcatgtcctatatgctatactactccatctcttgattataaaataacctgggtttgtcccccaaacgtactcgatcctaataaattaggacaatgtcattctaattttgtaaagtttgagatatgtcatcggtatctcaatgacatgtaggacccacataagtcaatgacatgtgggtcaggatggcatatctcaaattttacaaaattataatggtatggttctaatttttccaataatcaaaggttaacataaaccaaatggccactatacacacgaatcgattcagtcacctaccgcagcaaacaacaagccgagcagcctccaataattcatcccatacgtacctctcccctaaaaaaaccccaaatattacttcgattctagcccatgaggtcgacgacaacttaaaaagaaaaaaaaatgctcctgtatttttgttccagcttcatgcatgcacacacacagtagctcgtgctgactaagcggctgaccggtctgccccctgctgatgctaggaagctcccaaactcctaatctttcggtataaacacgcgcgtgaaaaaacacaacggatcagcgagcggctctgcaacgaagctccctaccatcccatggctgcgacagattgttttattacgcaaatggctttattattattattacacggattaattacccccctcgtgcccagtccaagctcaccctctcagtcaagccgaagcttaatcctcaccaacttccccgggttggtatatataccccgtctcctctcctaatcactagtaaacttgtagcttagccttgcaaggccaagcaggcagaggcagaagagcacaactccccccaaaggaggagtttgctcgatcgatcaccaagaacatcgagaggaagagg

SEQ ID NO: 21142 - DNA, 1501 bp, Oryza sativa
catgaagttcaacttccagaggagatgagaaagtgatcattcttttttgcattcgttctattgtactactgaatagctattagctatcctgtaaatggtatagagatcatcttctagtatttcattatttcaagcatgtaaaaattcggacatctagtaggattctctaggaaaaagaacccttgttgagcttcctgcctcttgaccagctctagctgataaatgtcggatgcagatgaatgtaaagtatggccttcaatgttttcatttttgtcgaattaatgaaagcagaaaatttgttgattcaatccctttgcagcaactcttcagaataacttttgttccattgttctatagatttgactaatagcggagtaaatttttcacaatgcggttactgatcttgtagtaatttactaacaaaataacctctatttttaaatatatgatattgttttcttttgaacataatgtttcactatttttaagaattatttattttcttgcattttattatgaaaggtatttaaagcattaattttttttactaaatttttaaataaatcgaaatggttagaagtcaatagctgcgaaagtaaggcctggtgccctggtttagttcctaaattatttttcccaaaaacgttacatcgaatatttggacatatgcgtggagcattaaatatagataaaaacaaaaactaattgcacagtttgcatagaaatcgcgagaagaatcttttgagcctaattagtccatgattagccataagtgctacaataacccacatgtgctaatgacggcttaattaggctcaaaagattcgtctgtggtttccaggcgagttatgaaattagttttttcattcatgtccgaaagccccttccgacatctgatcaaacattcgatgtgacaccttttcgcgaactaaatagggcctaatacttctgtcatgatgtgcaccttctgtttgatggctggaagcatgcaactggcccccacataactttccttttgaatttggggatgctagttggcgcagctctgcgtcaactttcccaagtcacacccgctgcgaggctgcgaccctctgtccccatctctcccgatgctaatgttaatagtatttttcctaattaatttagagttgaaagcttttcaaatttggaattaaaagtttcagattctggagtaagttttgaattttgatttgaaagttttggattttgagttgaccggcgaccgcacgatatacggagaccatgagctctttcccttccttatctggaggtgttcgctggaatcggaagtagcgcgcgtgcgctaatatggcaatttcgttcgaattttgaccggcgttaggtttcgctttacccgccactcccattttttttcccgcgctttctcgttcccgccaatccgactccgagtctctttacaactgcgtacgggccaagcaaagcgtaagcctcccgagctccatctcgacttggtcggtgc

SEQ ID NO: 21143 - DNA, 1501 bp, Oryza sativa
ttttttaataataaggttttaaatacatatttgtgaatagaaatatgcaggatccacatgaggttggctatccgcgcccactgtcaacgggcagatgcatgttaagaaactatcgtccatcggatatcacttgtattaatattgtggaaccaacattacgtgcgaatattaaaaacaataatttatatataaggtagtccggaaaaactagaccggactagctccatccattagagttcttgtcaaatatatgtatacaaagttagttataaagtactccctccgtcccattttaaatacaaccatgagtttccatgcccaacttaagtcgtccgttttatttgaaaatttttataattagtatttttgttgctatgagatgataaaacgcgaatagtactttatgtgtgacttatgtttttaattttttcaaaaaaaattcaaataagacagaagataaaagttgggcaggcttcactcaaatgggacgaagggagtaggacttaggccgtgtttagttcctcctccaaatctttttttgatgtatacggacgcacatttaaagtattaaacgtagactaataataaaacaaattacagattctgtttagaaactgcgagacgaatttattaaacctaattaatccgttattagcaaatgtttactgtagcaccacattgtcaaatcatggcgtaatttagctcaaaagattcatctcgcactttacatgcaaactgtgcaaatggttttttttcgtccatattaattgctccatacatatgtccaaacatttgatgtgacggaatttgtggaagtttgaaggaaactaaacacagccttaggtttcgtttgtttgtgctgttgaggggagcttctctcgtttatcgtgggcacacgcttttcaaactattaaatggtacggtttttcaaacactttctacgttgttttcttttaagaatcgaatatctcaattttcacgtttatatttgttaatatttaattaatcatgtgctaatcactattgtgttttccgtgctactgattatctcaatcaattaataatctttattgagtggcgtctcagtaaacttataatatgcatagtgcaaagtaaaattagtgtcggattctattctggacacactcttaaatatagaggcacacccatcggcctagctagttgaggattattgataacattgatatgtaatatacacttcggttgagcctgcatttttaaatatcgactctagatgtcccctgattaaatttagatctattgtttattcgcgtttgattacggattaccgatgatcttattggtgccattttttatataagaccacccaaagagtgtttccacaccacctctgccttccacacccttctgccatctctcatctctgcctcacggctcagacgacgcacttccttcctcgtattgccgcctcatactcagctagctgcacaaggctggttgtttagtgtaattaacaatc

SEQ ID NO: 21144 - DNA, 1501 bp, Oryza sativa
ctagccttttccacatggctaaatgggttagtacaggcagcaaacctatctgctatggcagtaatctttttcgtttttacaagtgtgcgaggccgcatccacgttaaacgactaaatgcaaaggacataactacacagctaaccagctaccactctatctataagaggtatcatccacctatacttcaaataagattttctcttaaactactcatctgatctatgatccgattacaccgttgtgttcataataattaaatctttacaacaatatctcacatgattatatttcgatgaaaaattacaaattacttttatgatatgtctaaattacttttagactttactgaatttacttcttagacatagaagtaacttagtgaaatctaaaagtaatttagatatattataggagtaacttataacaaaagaaagtaacttcaattacatgcacggggttgacgagagacgacgccaggtcccctccactctccatgtcatcggctgacacatagggtcagatccagccgctccgaccattgagaagcgacggttgcgggcgacgaccactgcatcagggagatggaatttgtccaatgaaaaaaggcataaattaaatttactttcttttgttataagttacttctataatatatgtaaattacttttagactttactgaatttacttttatatatcttagaagtaacttagtgaaatctaaaagtaatttagacatatcataaaagtaatttgtgatttttcatcaaaatataatcatgtgagatcttgttgtaaatatttaattattacgaacacaacggtataatcggattgtaaatcggatgagtaatttaagagaaaatcttattttaagcatagatgataggaatatttcccctacttgctaaatggaataatagcaaccaaaacttctaaagtacaagcacatgggtgtctctaattaagactaattggagaggcctctccaaatagatttaccgaaatgcaaacctttgtttgtacacgtgattagcaagaaccaaaccatgtttcaacctgtcacggttaacaaggccatctgaactgaaggcccaatacgtcagcgagggacggccttcttcttggctttacttcggcggcggtacagcccatgtgtatttctggggtttaggcccacagcccacttgaggccgtggatttttgctggacttcggcccattttgccgcctctcctttctcctccagcaagccacctgcacgcgcggcgttccggcggccacgctcgcgatcctcctcggttcctccgcctccgtcagcgacctcggaaggcggcggcgcgcgtcgtcgtgctgctctccgccgcgcgccacccggccttcccgcagctccggatcgcgtccccccagctgagcatggaagtgtgagtgctctctacttggcttcgattgggcttggaagtgtgggcggagagggctccgatctgatcgtgttcgatcgct

SEQ ID NO: 21145 - DNA, 171 bp, Oryza sativa
aattttatataaacatttaaaacatcattgggatagttaaatatttatgtcaaactgattaagagtggaatacttgcatataagatgctacacttactgctgctttcttgtccacatttttttatttccctactcatatataggtgtcactctattttcttgcttcacagg

SEQ ID NO: 21146 - DNA, 171 bp, Oryza sativa
ccttgcctactttcacatacgcgcggcgccgctggtgctggctggctggcgcgcgcaccggcgggcggagagcgaggtttttcgccggtgttttggttggcctccgccgttccgcgcggtggtggtggtggtggttgctgtggtagcgagggtacgctttggagacggaga

SEQ ID NO: 21147 - DNA, 944 bp, Oryza sativa
cccccccccccccccccccaaaaacgcgctcgcgcttccctgccgtccaaggacgccacacacggcgcggagctcgcggcgagacctttaatggcggcggtgtctcctcgcggtgcgtagggccgcccgcccgcccgccgcagccgccgagcattttaagtatcctgtctctgtctcctcgcttgctgtcttgctgattgatatgcatacggcgccggagatgaatggccgggctcggaggccggcggcggcggcgcacggcgccaaggcggcctccacgaagagcgacagagtatgcttctcaatctggcaaaaacctctctcgtttctccgtgtgctctgttctcccttcttttatggccaatgtgcggttattttcggttcccgcgatggattattgaggcgtcctcggtcgccggcgctcgcgggatcggaaggcggcgcctttgccgcctacttgaggccagctgttcgaactcggtgcttgatagttttttttttctttttaactctcgtttttggttcccaaggtgtgaaattctgtgcgcctattttgttgttttgcattggtggcgtaatgtggttgttagtgatttgttgcaccgtcgatgtgtttcctgtagtacgacggattattaaatgttgttgggaagaatacaaggacgaacagtgctgttttgatgttcttgcgagctacgttttggttggtggtgtagcgtgagaagatctcgccactgactcgcgggcgtcagttagctttcgagagctactccgatagggtatctcttgattgctcttgagcccgcatttcttccccttctttaaatcagccgctttatctctttatctttcggagaagaggaatctgttgctttgctttgcttcggttagcttctttcacagctaaacaacgccttctttttcctcttttgatgatgatactg

SEQ ID NO: 21148 - DNA, 241 bp, Oryza sativa
tgttttcttctctagcttggctagtctgataaacggacataatttcttctctctcttcagaagaaaaacggaagcgtttcagtatgattcggatctgaatcacacactctttgtcatgtgacagactgacaggttcgttgattaatactccaggggtaagcactaagcacgggtgcccagcctttgccttgcgttaccaccagcaattgacatttgacagcgatccacttagccacggcca

SEQ ID NO: 21149 - DNA, 469 bp, Oryza sativa
cattgtgaaacggaggaagtaactagcaccacggtggtgtgctagtcgacgggattcgaactcaggccgtgtttactttcatgcccaaaattattttcacgtatatggatacacatttgaagtattaaacgtagtctaataacaaaacaaattacataatcagcctgtaaactgcaagaagaaattattaagcctaattaatccatcattagcaaatgtttattatagcaccacattgtcaaatcatggcgtaattaggctcaaaatattcgtctcgcaatttacatgcaaactgtgcaattagtttttttttgtccacatttaatgatctatatatgtgttcaaacatttaatgggatgaaatttttggaagtttgaagggaactacaggcaacctcactcttcttaaaaaattctaatatgagagtcccttcttatgtatttattgttattgttttcttattacagc

SEQ ID NO: 21150 - DNA, 1501 bp, Oryza sativa
atcgactccgacgacgatgatcaagaaaagggggacaaggacttctccgggatgtgctgtctcgccaacaacgaggacttcatcaacctgtgtctcatggcacttgaggataaggatgactcatcggagcatcctgaggtatgtcttgatgatatcccttccttggatggttctctttgtgatgatttttgctcagataatgactctgttgatgatgaactaagcaaagaaagaatggcacacttgatgattgaaattagtgacaagtataggtcttctaagtataaaattgagaaactaaaatctgaaaatgatggaatggcgctagaaattgctaggcttagatccatgattcctgaggaggatacctgttctacttgtgcttcatatctttctaaaattaatctcctcaaggataagttgaaatcatgtgctttaggagctgggaattcttctagtgctagtgctgcttgctctacttgctatgaaatgaaagttgatatgggtttgcttgagatggaattgaaagaactaaaagaaaaatttgttcatgataggattggtaggtgtgaaaattgtcccattctcactagtgacaataatgaattaagacaacaagttgccatgcttaggaccaagaatgatttgttagaatcttttgctactaaggaacctattcattcttcatgtgctaattgtgctatcctggaaactgaactaaaagatgctaaaactgtcattgattctatcaaatctattgattcttgttcatcatgcatttctctgaaagttgatcttgagtctgctaagaaagagaactcatacctacaacaatctttagagaggtttgctcaaggaaagaaaaagttgaacatgatcctagaccaatccaaagtgtccataaacaatcaaggtataggctatgattttgctgagtctttgaggataggtacccatgagattttaggtgtcacagatgggatgatagaactagctcaaaaacctataaccttcaagtctgcaggtttcattggaaacattagttctagtacacccaaaacctcagaaccaaagatggtacctatgactagcaagtctaagcctgtagagttacctagacccaaaaatccaaaacaagttgagcacaagcaaaaccagaaacaaaccatgcctgtagagaaaaccaagtatgagtgcacctattgtgggaaagctggtcatttggtaggtttctgctttagaaaggctagaaaagagcgacaagaacgtcttaggactagaagagctactagagtccctgagaggttcgagtgtgcgtgtcattgtcgttcaagtggtgtatctcgctttcctcgccgagatgtgcaccctcgacgtgacctagcaaggttggggcaaaacagacatggtcatcttgcatataattctgctcataacactaaagatgcttgtactcctcgcatggttcagtactggattcctaagtcatttctcactaacc

SEQ ID NO: 21151 - DNA, 1501 bp, Oryza sativa
ggatgctccgatgagtcatccttatcctcaagtgccatgagacacaggttgatgaagtcctcgttgttggcgagacagcacatcccggagaagtccttgtcccccttttcttgatcatcgtcgtcggagtcgatgtcgctaagctgcacctcctcaagagccgccaagaccttgtgaatcgccttcttcatcaaatccttcttcccctttcgcccttgtccctcgggcttcttggtcgtcttgtcactcttcttctttaacttgggacaattcactcttatgtggttaggctctccacactcaaaacacacaaatggttcattggtttttcctctctttttatctctcacatttttgtaagctcttgagaattttctagcaaaaagagcaagatcatcttcagggatcttctctaattgctcctcagtgactgagtgtaaagcggcaagagagaagccaccacacacaaaagctgagtcattagaagaagtactaccagagggatcagctaccaaagccatggagtgtttgaggcctttccgatggaaaacatccatctcatgggtttttagctttgagtaaagcttgtccatggtaaggtcactcagaggagcactctctgtgatggaagtaactttcatttcccaaacaccataatcaagacaattcaaaagatgacgagcattatcattatcagaaaactcttttccaacagatcttaactttgaaacaatttctccaaaacgcttgaaataagaatcaatggactctcctgggtgcatctcaaatctttgatattctttatgaaattgattctgacgaaccaattgaatatcattgtttccctcatggaaattgcacaaagcagtccacatgtcatgagcagacttgtggtgttgaacacgattaaattcaccagaagaaattccaccaatgattgcatttcttgcacgataattaaaatcaacctgagccatatttgcaggcgtgatgtcagcatcatcgggcacagtgtaaggtgatttaaccttattccacacattatgcccttgcgactggaggtaggcctccattcgtgccttccaaatgacaaaattgtgtccatcgaaaacaaatggtttcgcagagtatttttcttccatagctgcgttcgttgccacggttaggttacaacgaacttaaccgggctctgataccaattgaaagaccaagaacagctatagaggggggtgaatatagcaattcaaatcttgcccccgaaaatactcatcaagccggatttctcaaaatccttactagaaccgcagctattagagaagccggatctagaaaagaagagagaaaaagaagagagaaggaattcccgaaactagaggaggaagagaaaatgaattcccgaaactagaagagaggtgaggaagagagagcaaaactcatcatcgcaaagttcaaattgcaagcggaatttaaattgcggaatttaaatggacaaggcaaaaat

SEQ ID NO: 21152 - DNA, 1028 bp, Oryza sativa
gccacccaatttatcatttaattttagttttaattactaatttagcagcaatttcgttttagtcccttgtgttttatataatttagtcgaaatagttcattagttgtacaagtaattatgtaatggtcctacagaccgctgatgttatgtgttaattaacataggtgtttattcaaataccctgtttcactaaatttattgtcttaataacatgtcttttgcattttatttcaagacatgctctactttctcgctttattaatttacaaaattctataaattttgtactttgatttagtaaattctcttaattatgtacaacatgattaatggaggatttaatgcatgttccacttcacattttgactcggaaattaatcacatgtcgatggagccctatactttggtcatatcgaccataacttaggcagcgagtatctcgcccatcatcaagtggtctacattttgagatgattacccgatggagtcctacaaattggccgcactggtcataacctaggcaacgagcaccttgcccatctcacagaggtctacatctcatgatgattacccacatgtgttattttccaagaataagttttgaaaaatgagattatttgaattttggttgagcacaaggtagtggagtcctaaacattggttgtggtatattcaacagaatatatttgcctggagaccgtgttttaggcagcaagtataacttgcccactattaagagatctactccactgtttaattacttggagattatccacattgtgccacctaatttcgaattctaactcaaattgtcaggtccattacctgcattttttttcgaaacattacaaaatatgaagtcttacatttcgcattgagattacaaccttaatatcatgtttttattaatttacctctgtaaattgataatgttaaccatgattgtagggacatggcaacaaaagagttcgacgaactcgccctcgatgggactaactatcccatatggtcttctgatatcaaaatca

SEQ ID NO: 21153 - DNA, 1501 bp, Oryza sativa; identical to SEQ ID NO: 20203

SEQ ID NO: 21154 - DNA, 290 bp, Oryza sativa
cccttactaaaaaagttgtgacggtttagttttttaatatactccaaaaaagatacaaatttttacatctgtgtgtcactagtcaggcactataaacctagcgaaatctgaagctgtatcccagcgtgaacttccccggtctcccggacaggcaggcggtacagtaatactcgtagaatggaaattaatcagaatatctgcagaaggcaaggggcaatctgcaaatctgccaaccgatggtgctttcgtggacgaggagccttccactcgcatccgctgcagcagacgaa

SEQ ID NO: 21155 - DNA, 1501 bp, Oryza sativa; identical to SEQ ID NO: 20195

SEQ ID NO: 21156 - DNA, 236 bp, Oryza sativa
cgctcccgaatgcggttctgaactgtctggcccagcctttgcagcgaggacattgggactcctcatcctccctgcatacgagcacattagagcacatgatactcaatggctcgtttgcaaagaaccaccaatataaaaagaagtgcaaaagaaggttgagattgattgggacccttggaggaaattaaaaagaaaaacacctgaaccaaatctggtgcttggcactgcaggcagca

SEQ ID NO: 21157 - DNA, 1501 bp, Oryza sativa
attcacggatgtaaagggtggcacgtgtgtgtggtggagactctactagtcagagaaagaaagtgtcaatttgttaaggtagtactcttctgcatataccacttggtgcccagatttgcagaaaacgatatgattaataaacattttacaggtcaaatttacaatgtgcaacgtggatataaatatgattcattggatcatgccattgtaacttcttcaatactaaaatataccactacaatttatggaattttagacatgcttaatttaataggtatttcaaatatgccactacatgtgtatttcttcgatgaaccaacttgtccatgtcttcttttttttttttcatcccctcctcctgttcatcttctgcaccattaccatcagagatggactcggccagttatcagcatggagctatagcttagagcagcactgcagcaggcagccaaatccatccaagcttgttgccgctgcctgttaaatgcatcgaatagctaagcactgacatatcactaatgcttatttttggttctaccatgattatggtttcatttcctctctgcgccacatagctactactattatttagctcgaaattaattaaatcttcctagctccaaatgcgtttagaagaattaattatactcagctctatatgtgcaaggttcatcgtcaaaattcaaatctgcaacccacaagtagccacgcaccatatggccaaatgtccccatgtccaaatcgttgaatatgcatccaacaacccctctacacgtgggtgcacatgcatgaagattgaagcctatccactaatgactagtccacgtaccggcccgctttgaaacttcgttatttacacacgttgctcgatgtattggtgtgctgtgtttttttttagaccaaattgctccgttcatatggtcctataaatgcacgcatatacgttacacaaatccaaatccatatccacacatcgcggtgcaaaaccaaaacccactgcagagaagaagcatcgatcaattcaagttaccaagtacgtactcctgtctctaccgtatgtgtctacctgtttaggttctttattatttgaatctacacatgaggagaggttccgttttttgattagtggcgtttggagtcatcgtttcgcttattcacggcatatttgtaaagaaaaataatttatgaataaaacttttatgtgtatgttcttagcgatttaaaagtaaaggctgaaaaataaacttcgataaaaaaaaccttgaaatcagctccaaatttaaggttaaaaatttaaattttaattaataagcataaacataagcgaaaagatgaggctctaattaaggtcccatttgcaacaattttaaagaacaaaatatgattcaacaagtaattaacatagaaaggtgtttctttgatgatctgaagatgcagtaatcatgaattaaccactcataatttgcaggcaacttggatcttctcgattgtttccttgcga

SEQ ID NO: 21158 - DNA, 380 bp, Oryza sativa
ctatagcattcttgacttaactcagacttgaaatttccaatgggatattctgtcttgcactgaaatggatcagtttcattatggtaggtgaatataatcagtgtagctaaggaaggtgttctatcatttagaaatgttaatgctaataatttcattcacacgttcaagataggttagctttattatcttctacagatgagttggaagatctctcttttaatctgatagtgccaatgaatatatttcatacattaatggcattggcatcagacatgttcattgtgtgtggaaaaactaagtttgctcctttctcctatctattttcttcttgatgtgtatgcagaataaacgagtttaatgatgctattcttttcattgaa

SEQ ID NO: 21159 - DNA, 1501 bp, Oryza sativa
tttcaaaaacgaatgtactatctgaccctaatccgttaaggtgagttaacggtgttaagctatggacaaattatctcttttgtccttgcttatttgaccatgttatcaattttgaagaattgaggtgaacaattcaatttgataaatttgatatcaattttgacagattgttgacacaattatagaagatttttaaaaaatttcaacagcatattatcgtattttgtgatccaaaattgcatttaagtaagcatatacacagttaaagtcaaatacaacaacaaattcatgtccaacaaattcaaggaagaatatacatagttaaagtcaaaaccaacaaccaaattcatgtccaacaaattcaaggaagcatatacacagttgtagctgaatccgcgctcccaccaccaccgcgcacaccagcaaccgccgacatcccgctgccaccatgtgccacagcagaagccacctcccaccgccaccatgcacagcagcagcagtcgagtcccgtcgccgccgcgctcagtagcagccacggccgcctcccaccgccgccacgcgcagcagcagtagccgagttccgccgccacgcgcagcagcagccgagtcccgccgctgccgcatcagcagcagccgcggctgcctcccaccaccaccacactcagcagcagccgcggccaagtcctgccgccgccccgctcagcagtagcctcccaccgctaccccgcgaagcagccgcaactgactcccaccgccgccatacgcaaccaccgtctgcgcggatcccctacctccctccacggcctgccaccgtcgccggtgctccctccctccacagccggcaccgcagcagatccatgcccctccctccctccacggtccgccgctgccaccggtgctccctccctctaccaaccggtgccaccgcttactaccgtgcgttgccgccgccactcgccgggggaaagagagaagggatacgagagagagagaatgatatgggatgggatacacagagatgtggataaggttggagggtatttcggtcactacgaaaatttattatatttatttttttaaaaaaatgattcttaacggtgttgtagaagcagggtcagacggggtgtttgttttcaaaaatcagggttaaatagtagggtcaatttgatagatagatttcataatagggttaaataagcaattgcctctcaaattaaaatttaaaacccaacaaattgtaaacatactgcctcaccagtcacaaattgtaaacatactaccacctcagcttgctaggcgtattatattagctggaatcgaactcttccacgaaacgaaacctccaaagtttttatacacacgccaaagcaaccatccgattacagtttacagattttaatttcgaaggagagagaaaaaaaaaagaagggagagctcgcagtcgcagcgccggcggagggagaagacacggcggcgatggcggcgcgggcggaggcggcgg

SEQ ID NO: 21160 - DNA, 1501 bp, Oryza sativa
caaattaattaatccctttagcctaatcaaacccggcaaaattcgaggcgagatcaaggtcgacagaaaggaaaatgaaaatgaaatggatcaaagcgcaccctgccgtggacgccatcgccacgacaggagagacagaggctcctcctccactggttctcctcctcatcgagcatggcggccgaggagggaggcatcccgtgagagacatggccgccgctaccttccttcttcttcttcttctcttcttgcttgcacgcgcttgcagagtaagaggaatactgaatggactatagtgaagcagagtagaagaggagcagtattgcttctgtttttggcttcgacctgtcaggcaaattttctggttcacctgacttcgacatcctgtttgtcccggaggttccagaggtttccaattttacagatatactttctccgtttcatagtgtaagtcttttttttttcggggacacaatcattctaacactacccacatttatattgatgctaatgaatattatatatatatatatatgtatgtctagatttattagcatcaatgtgaacgtgagaaatactagaatgacttacattgtgaaacagagagagtactatccttttttttactgtctgctgtattgtcaagcacaggtcaactcggagagagcattctttcttttgatgttaaaaatctgtgctgtctaacattcgaaacgtttgaaaccgaaatgcttattaaaactaccacagttagtaccagatcgatcattgaaaaatatataccgctaaggtactgcaattcctacaaaattctacggtagacttgtagtattactatttgatgaatgaacaaacgtagctactatgaatttatgaagtgccaaatttgatgttcaaacggggaactgattagccagattattgggacggcatcactgaaatggtgtggcccgtggttacagtgcctgagaagctagaaatggtcaaccgtccgcctactgaaattggtgtggcccgtggttatctgctttcacgaagaacgcatgatgctgtcacatttatatatagggttcttctttgggaagaaagagatactctgattcataaaatagaagtcgtttttgatttatacactaataaagcagctcaaaggcagctaatacctttcattcaaacagaaagagtgtagatggtacagtatcattgtattgtacgctctgcagctgcacacttgaagggtgttctttttgttttttgcagaaagaaatttaacttatttttattgaactccactagcagtaaacttgcgtgaatggtacaagcagcccatggaaaaaattgaaagttagtcatttggatcctcaaaggctagaggatatgcagaaggcgttcaaatgaggtccaaggattcctcaagcaaacagaagcaagaacccacttttcatatggaaaaacagagcatcagaaatagcgaatgacaatgtttcagacaacaaggttt

SEQ ID NO: 21161 - DNA, 1501 bp, Oryza sativa
aacatcaaaatgttattaaagttgcttgaagttttctcaaatcaatccagagggccaggaagtacctgaaacagatcggttgcttgtgtttctcaccaaaatgtctccctaaagcatgcccaatatcttgatcagttgccaattctccactattatttcctatccatttcctctgtgtctgtcatcacatgttcagcagagaagacaagcagaacaacatcacagcttagggggtgacattaaagaagtaatactactctccccacatgatgcatgcccatatccatttcatatgatatcaaatcatattacagcttcttccaagtgggcagctggggtcacctatgcaaatatcaaggaaatccctaggaccatacaaaatttggctagtttatgtaaaaacacagaggtgtggttttgtgctactagcaacagcatctcataagagacatgaacagcacaacacatcagggactgggataccataaactcccctccttcctcctacctccaggatcatggcctacctggctttcagctaatcagccacctaccaaataattccctagagaccaagtcataacaaaagggaacccttaattagtactaccactcaatcactcatggtgaataaaagacttacctagatgatgcctcagaatccaaatgatagcaccatcattctctgtcagtgtggacctttttgggaagatgaaataatcagaagatgaacatatagcttagctagatgttaatcatgcaggtccaatcaacatgaataacaaaacaaaggaaatggattaattagttcctcctcaccaaatcctcaacaaactttaactaacagcttggtactagtactgcaacacaaatgttcccttctctcctctacttccctgctggcctaccaatctaatccagtactacaaacaaagtcaaacaatccttcagtcttctcttcacctccaaccaccatgacagcaaaccatgaaacacaatctgaccaaaacacccctgcaccaccccaaattaattaaccaggctaatcatccattaagagactaagcaccaccactgaatcttcttccaagggtggtaatgcacactgtttcagagtttatcagagtttcagaagattcagagcaagggcaatcatggcaatatcagcttgagttgagagctccagttaaaccttccctatccaattccaactccctccctccctacacaagcaacaagagcagcacaccaacatccaagaacaagaagagcaagaagaggagaggagaggagttggaaggtagagagagacaagccatcattagccaccaaatgcaggcatgcatcatatagctgacaggacaagaatcagaggaagaagaagaggaggaggaggaggaggaggagacagctgctgccatgtcgtcgtatgaccagatgctcgcgccgcttcttggcgccggccggtcggcgtggacggcgcacgacggcggcggcggcg

SEQ ID NO: 21162 - DNA, 1501 bp, Oryza sativa
ggtggctcacccagaagcccttacagagaagttgcagctgctgctgctgcctctccaaggtccaggtacaggtcagctgggatgcagactccagataggaaggcctcttcatctgatggccgtgtcccagtgactccaggaaggagcaggttgaagcaaggaggcagaggctttgaacctgtacagttcttcacctcatctcgatctccatttgcaaattcagaaatgatgtgcacattgtgtgttagaggttttctgaataaagtgcatttgcattctgagttttttttctttttcaggctttagatgaagtgactgtacctccatttggtgattgggatgatgctaatgcggcatctggggagaagtacaccggcatttttaacagggttaggcgtgataagctgaccccaaactcttctgtcaagcagcaaccaccatcttctccttctggtggcagaagacaggaacataaagtgcaacaggtatctgtgtgctgtccctaactatacgacaaatcttttgtgacttatcccacataatccatatgggagcattactttgtagtatgattcttgctcaggttataagattacttatggagttatggtcaattctcccggcgactatggtgattttttcttggcatctttaggtgcatttgttttgtaatatgctagatttatgtgtacagatatatagcgaagtaacttaaagatgcattaggcagtccctcagtaagtaattctgctgtcccactaatggaatataataaggaccaatgaacatagtgaaaattttatatatcatggttttacttttcgattgcacttctggagttatgcattgtcccctgttctagttcaactctgtttctcacaaagccatgaattactatcgacactacaaaacatgcaaaaattcatttgaatatttgatcacccagaagtcataacagaggtatatacaagagatgcaaattgagttatgcagtttgtatatccatggaatgtttgacctttggctatgtacacctttgggtgtagatgccagaagtggtttgcttccattatctaaaaaagaaatgttttgcctaacaagtcttaatatttgatgctttcttatgtacttggcagattaaaatctgaacaatttcagttttctgcttttaaattcttttgattagttatatcattgggtctttcaaagtgataaactagattgatacaactgagttgggaaatctgaattcatcagcagaattttcagtgcaacactataatgaaaatgtaatcactgatctctttccctctcaggcctgctcatgctgcatcctgtgacgagattaagagctggacatcctgcactggacctgcccttttgttcttcttggtgacatataaaggcacatttgaatatttgaagagattcatataatggaaatactttgcctttgcttgaatataggtgcatagaaaatatagaatgcgatacaggtctg

SEQ ID NO: 21163 - DNA, 1501 bp, Oryza sativa
cttacgaaagtactagtaaaaacatttttaatttttataataagcatagaagagatagagatataatatccgttgtagcgacctttaggtcgtgtacaaaaaattctcttaaatccggatagctgataaagagaaaaaagaaggaaaaaaatacaccagaggtcccttaacttgtcatcaagctacaaaatcatcccccaaccacaaaactggatatatggcatcacttaactcacgaaaccgttcagtttaggtccttcggtggttttgaccccagggttgtccgacgtggcggctaagtcagcgtggatcccacatgtcaggaaggccacatcatcgccctctctcctctttctttctcctcatctctcccttcctcggttcctcctctttctcactcttctccatggcggtggtggctgcgaggcgggaggagggcggcgccgcggcagtggatgatgccgggggggaggggggcgatgacgggggagaagggagggcgttggtgtcgatggcggcagcgacgcgggagaagggtagggcattgccgcgtgggcaaggtcgaggatggagaccccggcggcggcgaggtgaacgacctcatggcatcgcacaagcatggcggcggcccgacggagctctgctgctgccaaagatgggcccgacaggcatgcatcggccgtcgtgggcgagcgctgggtggcggagctcaaggaagatgagggcgccgctgccaccgcctcctcgcccgccgctgcatcgtcgggcaccagatgtcctctctcgcctcgtagccgccgccgccgccttgtcgcccactgccgcttcgctgggtgccggatgtcctctcccgatttgcagccgccaccgcgtcgctgggcctcggatctcctctcccgcctcgcagccaccgccgccgccgcctcgtcgccaggcaccgcgtcgcccactaccggctctcctctcctgccttggcacgacgacctcctccccacccgccagcagccgtgcagagagaagcaaagtgacaaaagagaggggatgaagggagaggaggggaaagagagatggtgatgatagacatgtgggtcccacgctgactcagtcgccatgtcggacaaacctgggttcaaaaccaccaaaggacctaaagtgaacgattttgtgagttaagggatgtcatatatccggttttgcggttagagtacgattttgtaactcgatgacaagttgagggaccttcggtgtactttttccaaaaaaagaataagcccgcccaagaggttaatgggcccggcccaacttgatccgatgcgggctgcggccaccgactccgaataagacaacaagtccacgggagacttctcttcgccgtcgtgcacacgcgctcgatttcctcgtgtcccttctctctctcgatctccccctcgctttgctttccccaaatcgcgcagccgccatggaggagaagaagctgtccttctccatcccctccaaggcc

SEQ ID NO: 21164 - DNA, 1501 bp, Oryza sativa
ctagaaatactgataatagaaccagagttacctgaattgacagctaaaatagaactagcaaaggaggaattaatttgtagcacatcagtaggctgtggaatctcaggcaaaaaatcaacattgtcattcacattgtcctgaccctcatcccaattatcccaaccctgattctcttcctgatcaaaattctgcacattaccaaattgccaagctggaacatcctcaaaattaacattaggatacacaggaccttcacccatcggcagatcatcatcaagagggaaagcatcagcaaactcaccatttagggtataaacatagatagtccatgactggccgtttggagcatttggttgctcccaaacaacatactgtggcacagagtctaaatctttataccatactcttgccaaaaccctacccttgagagtatcagaatcataccaccagtccagctcaccaaaggttgaaatgacttgtttcacattatgcaaagtaacatagtccagcgggaaatcaagcaacatgacccaacctctatgattatagggagcattacgccaattcggaccctgattatgtctaacaaaacagacctcatgaaccgcatcataagcaatgggctcaccaagaactaaagcatcccgatgaacaggtgaactaatctggaataaagcgacagcattcggatgcgggaaggaagcaagcacacgaatattcctgacctgatcaagaaactccctaatctcagcacgatgctcatccgattgatcttcaggcaacggaggaaggaccagagccaagacgtactgctcatgactcatgattgagggagtgaagttaactgagtccactcgccggcgtcgatgaggcccagctgggtgcaaatgcagtccgggagggatgaatcggagaggatttggatgaaggttcgccattgaagacggagagctttctcgagaaaaggggttttccgcagcagcagagagtggaagacggggggacttaggcttgacaaccgattttttaacccagacttttcgaaccctaggggaaaaccgtttgaatggaccactacccaagggtttaggcccagcactgggagtaggcttaggaatcggatcagagggtttatcaacaaccttcgaaactttaggcccagagattggattctgagagttcggatctgatgagcttgcaatcagaaatttggaacatgaacgagaggaatcatgaacatggaagcggttaaaaaccttagagattggaatggaggatgaagcaacagtaacagactttgatttaacagacatagatttctttctcttaacaacagaccactcactgagctgctcagattcccaccgacgaaactcaaacctccaattaggaccaccatcacgccataagaaaaacctcatgtgataatcacggcaaatatatgatcggaggttgtaaatccacaaaccaacagatttgtcacgaacacagaaattgtaac

SEQ ID NO: 21165 - DNA, 1501 bp, Oryza sativa
cataaatgcctggattttactgtattactgctctagtaatatagaatataattggtgggcctaatttatgtttttaaaatggaggaatgcacatttccccgaagatgtccttgatggattgtaactttaaggtgttaatgagggttacataaacctgaaaacagagaagccaattgcttatggatgttgcaaaaaaggcaagtcttactccacatgtatgtttcatcttgcatttaacatgtgatgatgtccgcctgtttttctcttcttttggcatcagtaacttctgcttaaccataatcagcaacagctccatcaaacttaatctttttttctttggcaataatatcaatcttgatttttgcgaactatctcgtaaatgcatgcagttaaacctcctaactaatactccctctgtttcatattataagtcgttttgcctttttttttctagtcaaacttttttaggtttgaccaagtttatagaaaaaaaatagcaacatctacaagaccaaattagttttattataacattgaatatattttgataatatgtttgttttgtggtgaaaatgttgccatatttttctatacactcggtcaaacttaaaaagtttgactaggaaaaaaaagtcaaaatgacttataatatgaaacagaggaagttctcttctttttttttctttttttttttgggtgaggaactaatagttcaaatttggtttccattgttatcatcctgaactcatacagatctatccaaaattccttaccacaaatagcaacaatttcataaaattttttttgttttggtaataccatcaaatcttgaatttgttaagtatctcataaatgcacagattaaacctttcaacagtccaaccattatctatacaaaactaaggccctctttgtttaggcttataagccaacttataagtcgaaaagtctaagccaaaacaaacaagcagctttttcatttggcttttttaagccataagccactctaacactattaagccaaaagctaggttggagaagcttttttttggcttatatgagatagatgtatgactctaccattaaacttaggacattaaatccactggcttataaatcatataagccaataagctgacttaaaagtctaggccaataagcctaagcctaaacaaagagggcctaagtatctcataaatcctcggattaaaatcttctaataattcatgtcttcacctttatctatctaaaactaagtatctcgtaaattcacgaattaaaaccttctaatagtccatgttttcactgttatctatccaaaactaagtaccttgcaaattcacggattaaaaccttctaactgtgttttcactgttatatatccaaaactaagtatattgtaaattcatggattaaaaccttataacaattcattttttcaatgttatctatcacaaaggctcattaatatgtaccaattgaaccccatgcttcactttct

SEQ ID NO: 21166 - DNA, 672 bp, Oryza sativa
tgttgacaacagactgcagtaaatcagcatctagcacaaataaaagaggtgataatggatccccttgccttacaccccttttgcaataaaaattccttccaggaaccccatttagaagaactgaagaagatgctgaagaaaagatcaaatcaatccaattcaaccactttgaatcaaaacctttttgtctcatgatgtccaaaatagtagagtgctctatagtatcaaaagctttctcaaagtccaacttcaacagcactatctccctttttgattgttggcactggtgtaagtactcaaaagaccaagagagacaatcctgtattgtcctgcctttgatgaaaccatattggttttgatggatgagttctgtaattacagactgaagcctatcagcaagaacctttgttaaaagcttgagagccacactttggagagaaatcggtccgtagtcattaaccctctcaggtgttgatttcttgggaacaagagtaatgaaagatctatttaaactttccaaagccaagttaccttcacaaaactgagcacaaagggtgtaaaaatcctgcctaataataggtcaacaacttttaataaagcatccattaaaaccatctggaccgggtgctctatcagtaggcattcttttaacaacctcatcaatttcagaga

SEQ ID NO: 21167 - DNA, 1501 bp, Oryza sativa
tctaaccacaccgttcagttcaagctttggtttagtttgcattgcaggggattgtcttttctgtttggatttactagaatctacagacaacagacaacgaacactaccgcgtagaccaccaaaaaacgcctgattgactaacagcgtggaaaaaaaaaagtagcatggcattgcgtaaagcagacactttatcgaccggatcaagtgaacagcaatcaataaacaagctgaggaaactggaaaggcgttacctttgctggatctggtaaacgccacacctcacaattggattgagataacatgcagtcctaactagaaccgcaagttagtaacggcatcatatcatatcaatttatttttcagatgaagggtctatatatcgagagctacaataccattgttgtatcagctataccgtgttttttttttctgttgaacagtgctccaagaatccttgaatgtaatatcaacaaccatagtgtgactatttgagttgtagtcacgctaaaaactgcatagggaccaaatcccgaaatatcagccccagcaatggctttgctacttccggcagcatgaagctgaagcaacattggtggagggaaatggcacagtatcaaaaattgataggtatccactcccagcggcaacgggtgacaccggagcgtgccaccgcccacccctgcaccagaaaatagatgggtctgggagagatgaccaagcaagcttcaggtgaacgctggtgatagtgattccatgtaggctcgaatagtgagctggaggggataaatgaagagaaagaacataagccgatgactatttagtcgctgagctacacacgcgctccaaaagactgggcccgacggtagcgtgagagagtagccaatcgatgcagccatgaacggaaaaacgatggccgagatgaagttggcaaggtgacaatcgggcagagcgacgacttcgaggaagtaggagctcaccgtactgttcccgtgttccgccattgtgctcctccatagtattcaacgcaatagagcgcatcgcgtttgatggtgcttgtggtcgtcgcacttgcaagtctgggaagcttggctggttcctggagggcaaggttggagaggctcgtgctgctctccggcaccgggcgacacttgggcacgagcttgatagccctgagacggggtagtgtatgcttagtgttgtatcctctcccttgaacgctaggagccaccgtagcttcgtgtgaaaccatgtgtggttatagttcttttgtgatgggaaattgacaagtactggaagtgtaagaagtgtgtgcgtggactaacattggtcagattgcgacatctgtgccaagacaacggttgtttggttcatgtgtgtgcaggtgatcggggtcgatcttggtcaacggcggatcgggactagactcagggaggagttgaggtccaaagcgatcaaggatgccgggtgacaagattggacataaggttgcacacggtggacg

SEQ ID NO: 21168 - DNA, 1501 bp, Oryza sativa
tcggtaatggtgattgctgcataaaccgcacgatcaaaaaggggagagagctggagtagtggcaaacagtttgtcagcagtgaaactgccagaacacacaactactgaaccccccccccccccccaatttgattcaaaggatattcatagaaattttagagatagccctttgaattaaggaatggattctatagaatcctataaaatttctatgaattgtcttttcccatgcaagttttggagaaagtttaacatgaggtagaacctcatggaaagaattctttgaatctttatctctcctcgaatttctgtgttttttctgcggcccaatcaaacagtcattcctatgtttttcctgtgttttgcaatcctctgttttacacttgcattcctgttagaatcctatatttttcctatttctctgttttttcattcgtgtgattcaaaggagccctaaactttcacgagtacaggttgtgcaagctccgggcatcactgcgagttccttgcttttgcgacaaagttagggacgtgctcttgggtgacggtgctgaatctttcaattcaggccactaattgagcagtaattggtacgtgccgccccactcaactgagacaggccgatatgggggcaccctatactctcctagtcctaccatgcgagaccatctaggcgaagcgccggtgtgtggagtaggaagacgggcacacaaccaacacaaagcgagcgtgctaattgcctaattgtacgaagggcattgaatggtcgatgggcctcaagcaacgagcggctcagggtcggcttgtcgttgtaggtttgtaccgtagcattgcagcgccgaaacgattagtaaaagacgtgtgaactgacagtttcagaaaaacctgaatcttttaaactcatcgatcagcagaggttctgacaaccaggcatagtttagcattaacagtagtactaaccatgaaataaagcgctgctgtacagttcgtcaaaaagagaggaatttcgggtgtaaattaagtgcagaaaacgcgccatttcagagatggtctctgaacttttttgggggcgaagcgatcgagtgtgaagtgtgaaccgcgcgggcacgcaggcacatgcggtgcatgcacggtggcgcgcgcgcgggaaagagaaggcccgggccgcgccgttaaagcggtcgaaagcccaccacgatccgcgcccggaaaatggtgcggtgcgcccagccttgtcggctgccccgctccacataaaacccgacccatcccgtggcagcgtcgtctccgagacactcgcaggcagcggagagccgagccagttcactctctcacactccacactctgccactgccactctccagctgcagcgcagcagtgcgtgtctcctccccccgatggcctcgcggatcttgctccccatcctcctcttcctcctctgctcgcgtggcggcagcggggcgccggcggcgaggcggggaatgcgcgtgccgccgttgg

SEQ ID NO: 21169 - DNA, 1189 bp, Oryza sativa
gagcacagtcatgcatcgctcatcacagttacgggagtcacgcctgtgctcaacaaatgcatttgctcgcattgctcgcaaaaaaagaggttcgcgagaacatattagctggaaaggactccgaactgaactttcacgaggtacaaacagactggaaatcaattctctttttctctcacacacacacgcacacccccatcaacattctgtaaagaacagtgcaacggggcaccgtttcgtcgaaattcattcatctggatggagatcgtggttcgtgaatgcggtgcttaagctagcgaagcaaagttgccaccatgtgacatgccaagtgcgctccgaacctgtgcgtgcacggaagtttttttttttttaaaccagcgtgcacggaagttcagtacagcttcgcaacagactgatgctctgacaggcgaattggatgcaggatatggcagtgaccaggcagcagttcagcaccgctgtgtggcactccatgcaactctagagtctagaagtagtacagtttgttactgtcgatgatggaggggagtaataaacagttctgttcaggacgccatacgcccatacttgaggtggtttttgggaactagggactaaatttagtccctcgcacaaaagtacaagtccttatggtagggactaaaatttttgtgagaggaactaaactttagtccctcctttccaaacaccatctgagtcatgtgcagtgcaattcaccagctgtgtaatcccaccgtcccataaataccaactagcaccggatatgacacatcctagtacaacgaatctagatagatgtatgttcagattcgttatattagaatatatcatatctagtcctagattcactttttttttggacggagggagtatggtactatggttgagggtctgttttgatttcatcctaaaattttacaccatatcacatcaaacgtttgaacatctgtatgaagtattaaatatagactaaaaaataactaattgtacagattgtgactattttgcgagatgaacgttttaagcctaattgctctatgatttgacaatattgtgctacagtaaacatgtactaatggcggatttattaggcttaataaattcgtctcgtggtttactgacatatgttgtaattagttcttttattaatgtccgaacatcacatgcgaca

SEQ ID NO: 21170 - DNA, 232 bp, Oryza sativa
ctcctcctttgacgggcgcccctcctggccaacgcgcggacaagctccgcggcgaccaccactcctctcctcctcctcgctacggcggctgtcgagcggagtagcggcggcgccctctcctccacccccaacgacggtggcagcggtgtggcccaagcgacggcgcggatcgacctcgagctcccctctccccctcccctcttcttcaccccttccgatccttatccgcagt

SEQ ID NO: 21171 - DNA, 1501 bp, Oryza sativa
aagtagacttttccggctgggctgagaggagaggaggcggctcaggttgggccggcggaagagagaggaaggaaaggaaggaatgggccgaaaatggcccaagctgaggaggaggattttattactttcccaattaaaataatcacttaaatgatctttgaattattaaaaatacttccaatgctcaaataatttcaagaaaaatcctgaaaatacttggacactcaaagtacttaaaaaaattacaattagaccatttaatgattaatttaatatgtgggtaattactgaaatgctctttgtatgattaaaaattaggaattgagctccgaaaaatccgagaatattccagagagtataattaaccatggagaatttaataaaaattaaatccaaccatgctttatatttaggaaattttatttcccacatttaacttcacttgtaaattaatgaacatttaatataaattctaataataatttattaaataatttataaatcctgaaacaaaaatcaggatgtgacacgcgccgcctcccgccgctgcgccggcgtggccgtcttcgggcgcaccgagcggctgccgcgtggggcccggacgtcagccgcccacgccctcgggtgcggctgacgcgtgggacccacggcgccggccggtgtgagcccgggtgcgcccggtccatcgtcgaccgtggggctgccgcgtgggccccactcccgtggacccggtccgcgcgcccctcccctcggctgacgcaataaacctttttttatttaaaatttaaatgaagaaattcgcaaatattcatttaaagagcatataaacttcaaatggccataacttggccattggaactcggaattggaccgttcaagtctctaatttttccttaagaagtcaagaacccatttttgttttttgtttcagcttgttatgtggagtttattagagtaaaagcattttcttttccgttggtcgtgtagacgctgcagcttcggaatatccgctcttcgtggaggttgaagccgacgtttgggaaagcgagcaaggcaagtcacatcatccttgaacatattgaatcccagtttataaaattattttgatttaaattattgcattatcgcttcatttaaattcccgcgttatcactgttttatctagccatgcctatttacctttgttatgaccttattattgttattgttattatttccttgttcaccctagaataaacaaaaccccaactagtggacactctactcatggtaccactagtatgattttaggtagatgcttcgctggttaattaggcaacattaggtggttttacaactctagactgtgggattttctcatcacctggacactatggaatggtttgattattgtggaattggattcacaccgccccctctattcaaaatccccaaaatggttttaggctgggctcggggtgcatggttttgatagtagcacctcggccatatatggaccggt

SEQ ID NO: 21172 - DNA, 1501 bp, Oryza sativa
actgtttgcaggtttgatagggctaactcatatggtgttaaatgcttgctcaatcgcacaccttccaacagtggaagcctttgcaagattgataaatcttgaataccttttcatttgggactgcaaagagctggtttcacttatcgggatccaaggtctcgcatcgctcatgtcattgacaatcgctagctgtgacaagcttgttgaagattcatctattctgtcaccagaggatgctgattcatctggcctatctctgaatctcagtgaacttgatattgaccacccatcaatcttacttagagagccattgagaagcgtcactaccatcaagaggcttcaaatttctggtggacctaacctagcactcttacctgaggaatatctgttgcataactgtcatgcccttgaagaactagttctgactaatgcttctcatctgcaatgtttaccacaagcagtgacaaccttgacctccctgcagtccatgcatataaacaatgcagttaagattcagacacttccagatatgccagcatctcttaccagcctgcacatctatggctgcagctctgagctcaagaagagatgccaaaaacatgtaggccatgattgggttaagattgcacatatcagtgatgccgacattcgttgagatatgatacatgacatggaatgggatttggtacagcagagcatatgtgaacaatgcatggagttttctcaaacttttcagttctctgtcatcattacagcttacctttgtgattgttactaacattttgttagcctaaattgctaggaatgtactttgcattctcagttctggcaaagctacatatggattagaattttaatatcaaatataaccatctcggaactcacttctatgttaaatttcaaccagtactctacatgacaatgtaagataagtacctatttataatgatttttttcttaagaaaatatcctaataaaattgaaaaggacaaaaatgaaaaggtaaagtagtgaatcattataagagtacgtcacactttaaaaacagtaagagtaatactggcttagtggctttccggataaggttagctagacaagattgtttcacctaagttgcaggtgcatattgtgaaaattatatgtttaccatgaagatggttcatagattaatagctaaaatttagtctaacagtttaagttgattccatctgtggtgccatttattttctctcttgactggatcactaggttacctcaagcagtattttccgaaggtgatgacagttcattctgtactccctaatgcattccttacatctcttgtaggaattccattggaaccacagcttgagttcagttgcctggtgacagtaacacggagaagctattaattcttaatcttcataatccactgtgtacttcatttcacggactgtaatgtcaatttcataaaccagcagttaatttggcactctgccatggttttggtatagttcactct

SEQ ID NO: 21173 - DNA, 1501 bp, Oryza sativa
ttaaattgttcaatattttgttcctgcttttttttatcctctgtgagtacaattttcatcaatgttgttggccatgttactgcggattatcaagtacaatacatgacactattaagcatgccacctcagtgagcatttgtatgcatacatgtgtaatcttgagtaggcttcttttcatgtcatacaatcaaaactgtcaggaatcttgcctcagggaactgctggatcaattgttgactaatgtatgggcatcatctcagtaatgtggtggtgaataatcttgttagaaaaaaaagttaagagttattcaattgctatgagataggggtgattccgtatatgtcggaaatataatgttttttcgttatatcaacatagttaactgctaggtgctctggtgttcataatctcagtctacccaaatatgctccgtaattttacttaagccagaagagtagactatagtactacctcatacaaaaagggaattccaaagaagatgaccacaaagcctaggtgtcacctaagaaactcagtagcacctagtcaccctgagcggcccatgctcagcaatctaagctgggaggctgcataattagccaaaggcagtccaagtcagagcaaggcatggcagtctgggtaggcttcttgttaggctgggcaaccaactggatggcaagacgttcactgctcctctcacctccaccctcctggcattggctactgaatgtggtcctcaatctttgctggctggagttataagagagaggaagggcagctcccaggcagagaggaagggaatagaggtagaagagacaggtttgctctatgccccatacctccttactggcagggcagtcttgtctatggtcttaggttttcagttggcaacgtattgctggagaataattaaatcataattcccatcaacaaactaatcacctgacacatatttgtcgccttgtaatctcaacatatacattgctccgaactgtaatttttatcagacattcccccctgatttgttgttttctatttcttattttattgcttataaaagactgatgtcttcatcctcagggtacaaaagacctgaaaactgttgaagatccatttgattcccctacctacaacatacctgagaagccagtgacatttgctgaaggggcttcctacagtcttgtaatagttgcgggacttggaattgcagcagtggctggatatgctgttttcaaagaacttatatttgaaccaaaagagtaagttttctgcattaattgttaattcttttgacttaggcacttagctcaacaacaagtactacaatctttagtcccaggaagctgggtggactagaggtgaaacccaagtatagccaggagaaccaaaatgttggatctctaacttccacatattcctaatactactaggaatgataccggtgaaagaattatgtaaattcttatgtagttctggcacttggatgttggatcgccaactt

SEQ ID NO: 21174 - DNA, 210 bp, Oryza sativa
  unsure (1)..(210): unsure at all n locations
cgacgtcgtgtgtctttagtagtgtgtgtatgtttttttgtcgctantantctgtgcctgcgtctttatatggacgtcttatttattgtaggttatttatgatttgactatataataatataaaaaaaaaaaatgtgtagttttgagnacanttttgattancacttggtacccatttaccttctcttcaatatctgtacatagttaaca

SEQ ID NO: 21175 - DNA, 1501 bp, Oryza sativa
tgaaccaaaagagtaagttttctgcattaattgttaattcttttgacttaggcacttagctcaacaacaagtactacaatctttagtcccaggaagctgggtggactagaggtgaaacccaagtatagccaggagaaccaaaatgttggatctctaacttccacatattcctaatactactaggaatgataccggtgaaagaattatgtaaattcttatgtagttctggcacttggatgttggatcgccaacttcctcgtactcctatccaaacccaaatctttggatgcactccatgccttcagtggtctttttaccactttcttccatttcagtttttatccaacccctgcctctcctatttttcacatggcttaagattccacgatgaaccagttcctcaggaagcctccattttgaatgaaatcaaaggtactttaataatatagttgctcgcataattgtatggcttatgacagtaaaatacattcaagtctaaccagttatgataatttggtaagtcctacaaatatgcactgtgcaatggtctttcttcacattgtagcgttaatattttgtataatatggaaatagttcctttttatttattttttaaaaaactaatatcacacacacatttattaatccagatgtttctaggtttgtttatgaccctcacatgtagccacttacggtgccaaactttaaagaaacaatcagtaagctatggattttttttcttgtatgctgcagcagagtgccatggcacatttctgatttgatcctatgcaagtcacttagcaagttggcatgggtgttcttgttacttcctagtgaaagttctttttgtgcttcgaatctttttcttatgttaaatgcatatattattatatgcaatttgaaagagcttgcactgctgttaccattctacaggtacaagatttttggaaaagcgctagcaagagtacagaatgacagtcaggtttgtggacattagtgctattccacttccttcatacatatcatattttccccttggtacaacttcatgttttcacacgttttgtcaggttacagcaaaaattgggtatcctgttactggatatggcaatgaaagtagaaatcgtgcagctcggcagcgcattcctaacaaggtttggacagatgaggacggtgttgaacatgtggaggtagcatatattcttgcctctgttgttctgtctcttttaagtatgttgatttatttgccactcaagtttagtgtggactgtaacgccccgattttcgttcgggattaaaaaaaaaacatttaataatgcattttctagaaattaaataaaagataaatcaatttaatcaagtggaataatgggagaattaaatgtttttctgggcgtgacatggacacatgctccttgacattttattatatttatatggcatgggctaatggcttcatttaactgaggggagattgtgaatgataacatagcaagaggaa

SEQ ID NO: 21176 - DNA, 1501 bp, Oryza sativa
tgttcttttatattttcatgtgtacactagtaataatactggtcaattgcattatataaccaaaaaagttcttcacttcttcttatgcgcctttcctagataaaataaaatactgttcgcttgttctacctacttttagattataagactttttagcattatctatatttatatagatactaatgaatgtggataatgctagaaagtcttataatatgaaacgaatgaagtagtttgtttgattatgctagtttgtttgtcacagttcttctagtgttcaggacacccgcctgtagcatccgaaaagcatgaagtcctagagatacagttcagtaaagtgccactgccttcagactggcacaccttcctttaatttagttctagaaggggaaaaaaatagatttcacaattactgttgatttccacggccaatataaagtactacctctgtttcaagacaattgtatttctaccatttaaattttgttctaaaaaagttgtatttgtacaaaggtagaacccagccaattaatttgtgaatgctaatcaagtgagctaattgcttcggatcaccacattaaatatgtctgaaatttagttgaaatataattattttaggatgaaggtagtaaataaaatacagatggagtcagatgttcatatttagcctagtcatgccaatttaggtgataatttgaccagcttatcttacccaaaaaaaaaaaagtaaaaacgtgttactctctcatatagttccttttcactgcaagtgtaccccttcgtaaaaaaaaaccctaatcctagctacgaacctggacatatgcatatccagattcatagctaaggtttatctttttttttaacagagtagtatgcagccgtgctttgaagagagtacttgcttagcatctcaaccagggtttacgttaccaccggtaactgcgcggttaccgtgggggtacggtaatataaatgccacggttactgggcttaaattcaaataaatttaaaaaataaattttgcatggtttttcacggttaccgtggtaaccgtgcttaccgccgggacgcggtaaccccggactcagcagtttggaaaaccgtgatctcaacatgacaatgatttatttacagaaagattacctcgttgccatcatttctgtacgttctacttcgttttatatcatatgttgctttttacttttctctagtcgattttcttttaaaatttaatcaaatttataaaaaaactataacaatatttccaacccaaaacaaatatattatcaaaatatataaaatgttagttttgataaaactaattaacttggtattgtagatgttactatatttgttataaacttaatcaatcataaaagaagtttgaatggaaaaagtcaaaacaactaaaagtatgtaacgaagcgagcaatgattagtatcatctgtactgcatttaatttatcgtaaaattcactgatgtttcaacaatccaatccca

SEQ ID NO: 21177 - DNA, 1501 bp, Oryza sativa
gaaacaagcagttagcagtggcagaattgttgtaaggttcatgcctccacacttacctatccaatgtgtacatctctcatatttagaaatcatcctttgattacagaagttttgagttttgatcttccccagtagcacaactatctgagtctgatcatttctggtatcttaaatatggtgtagcatggaaggacctaatgttactttgttcagctgaaggccattaagatacatgcatacatcacaatttttataacactgcttaaacaatggtagaaacaagagcaagattaccagagttcggttcctgttttatttgaaatcttcttttatatggatcgtccgatgttctctggatatcttgaaaaaatgtattcgataacctttcataattcttttacttatttcaagccagagccagaggtaaaaaggccatacacgggctgacgggaagcaatctccaagttcttgaaaaacaagtagtacaatttttagttgaccattcattcccctgaccagcgatttgtgttttaccgtggtttagatgcattcatcttaaccactcaaatatttttagaagttaacgtcccagaaaaggtgagtttggcaaatttagggagatttggtagttctctctaattacgtattacctgttaaatatatcatgcatatttaaaaatcatacagttgacgtatgtgcacttgcaactattgggttagcgggttagttgtaggtttaatttaatttttaaaaagtttcaaggcgtgttcctaaatttatgtgcagtttcttcgtttgctaagttctttttctgtggaaattttattcggaagaacctgaccattttatgatgaaaaataagcttaatgatagcggcccgtacggatttttaaatacgttctctatatatataaaagcttgggctccgtttattgaacaactctaccgttacctatatttcagaattaagagtaatctgtgaatttcttttgggattattattattttaatggtacatcgtatgaatggtggtcgcgcggattttttttttctaaaatagggcggccctattttggcaaaaaaaaaaaaaacaggcggccaccatttttacaattttcaattaaaataataatattagaaaaaaattgcaatatgttctctgtaccgataagatgtacttcaatttcttcaaacacgtcgccccaccaacatttcaaaagtgaaacgacacttcgcagtttgcaggtaaaatgtcaacttttgcatgatcatgtttgtaactcgtccccaatgatcaggccacttccggacccctggtcatcttttatccacaatgagatcagaaatcccagtgcagattctcacttgctttgcaaaggtcgtgcaaattcagaggttcggtcacctcattactttatcattcatagaccagagccattctcacattgcacatactcctccgtagtacctgtatatgctggacacatattcttctttttt

SEQ ID NO: 21178 - DNA, 1501 bp, Oryza sativa
gttgttgctgcatctcataattcaaaaaaatggtgatgggagggaggaattgtacagggccatgatcgatcgcctgcagtgcaggaacgttcctggcgggccctgccggccggctgcggatcgatgtgtggccgcgtgcgtgatgcggtggccgagggcccccggcgagagagagagagagagaggagaagctaggccggccagctcaatgtcggttgctctgccaggtgggggcctagctaggcgcctgatcgacaccgggcatgtgtgcctgaccccgatgggcgccgcgcgcgccaaacccacccccccccccccccggtccgtgtcccgccccgcgcgcgatctgatccggcgtggcgcatgcagcgtgagcgagacgtgcagcaaccgacacacaaggcagtgcaaagccgtcgcgcggtgcctacctctcttcgccttgcgtttttgaagcacgaacacgcacgcacgcgccaatgcaccaccgacgggagccaagcagcgagcgagccccggcggtggcgaggggcggcgtgactcgcggggatcgaaatggtcgggctatcatcgcgccagtgcgctgagagcaagtttagtagtatagcccactacttattataagccaatgttaaagctaacatatataataggttagctttattttttcatcctctctctttatctctctatgaatttaatatatatttcttagaacttgtgtggagctagctcttacatgagagccaacactctccacttttatttatctctctcttccacgtaagtatttagcttgcttatagttcaccattatccttgctctgatgtccgctctgcgcgccccatcgcgcggtgacgcggtgcgtggacacttgcatttttcttgtgtgcaaatgttggcattggcactggaggatggacgggcgtgtgttagatattgatcggtgtcaccggtcgctgtctttgtctcactctccccgcacctgtagtgtaccggtgtcactgtcagatctagaagggaagatgcatggaaagagtccgtcatcatcaccccaaagtagggacccctctccgagatcgatccaccatgttacatgtaattgtgctacgagtagtagtctactggaagtactccctctgccctaaaataagtgcagccatagtttttttacttaactttaatcattcgtcttatttatttttttaaaaaaaaataaaaacataaatcacgaataaagtactattcatattttatcatattataacaacaaaaatactaattataaaaaattttaaataagacagatgattaaagttggacgcagaaactcatggctacacctattttgggatggaggtagtactactgattgcccttgaaaggtcagggcgattccgatatggatggccgtgccagctcaagattagcctttttctcatctgacgaatagagccaattgggggacctactgatgccttgtttagtttttaatttttt

SEQ ID NO: 21179 - DNA, 1501 bp, Oryza sativa
gaccaccgccaccgtttttttcaaacctcccccaaacaaaaagaagacgagcagtacagacgtactccctccgttcaaaaaaaaaaagataaaccttggtttccgtgtccaacgtttgaccgtccgtcttatttaaaaaaattatgaaaaaaattaaaaagacaagtcacacataaaatattaatcatgttttatcaattaacaacaatgaaaatacgaattataaaaaaatttcatataaaacgtacagtcaaaattggaaacgaaaactcaggttttacttttttataggatggagggagtacagtccatgacactaccactatctactgctagattggtagtggcaaccgtgtgctagtgcagcatatcatacgccatcacggtcgaagtagctattccctccgtactaaaataagtgtagttttacactattcacgtttaacgtttgaccgttcttcttatttgaaattttcttatgattagcatttctattgctattagatgataaaatatgaatagtactttatgtgtgactaaatatttttatttttttcataaaattttcaaataagacggacggtcaaacattgaacacagatatccacagctgcacttattttgggacggaggtactataggcgagcgagaccggaagcgacaagggccgcttagctcttggcccgagcagacgcagtgctagtagtactagcatcactgataaagaaatcgagcggcaatgaacggcgggtcgggtcgggcacgacccctgccatgccgtgtctgtcggtcggtcacaccggcaccttttgtttactggtccgtcctagctgtgagcccgtgcggccaatgccaagggcacatgcagcagcggaagcaaaagggtggacgggagagagatcagatgcggcatggcgtggccgtggcgtttgctcaccccccccccccccccacccacgccgtgtgcgccaccgaaccatcacgtagtacgcctccattaactagccaagccgagcagtaattatgttttgctcgatccatccatcaattcgatcctaccgctagacgcacggcgccggggcttttgccgttgcttgcaagcagccgcgaactcaactccacacccacccaccccatcgctcgccgcgcgggcgaacgatcagcgcttttttattagccgcggagggaggcagcacagcacagcagatgcaccaccacccgcatccgcgggaaagagacacagccgctttcgctcccgctgctccgctagcgagcctcgtcgctgccgctgagtgcgtgccatttatttccgtcccgccgcgccactccaaccagcaactcctcttcttcttcttcttcttcttcttcttcttcttcttcttttcttttgcctctcccaccgagcaactctgttcttccttcctcctgctgctcctcgtcatcgtccgcactagcgccggtgataatagaacgacaccgaacggggcggcggcggcagtaa

SEQ ID NO: 21180 - DNA, 1501 bp, Oryza sativa
gacataccaatttcctgaaaataacactgtcttgatccatactatattactatgtcgatcagttaaggtgtttgtgtcaatgttgaatgtgaccagctgaacatggactgatatagatggagaaactaaatgagatggatgaaaaatgaatctgatgaatgaatgaaaaactaaaagtgacagtatgctcaccgtagggagaggtggtggcggtgtgagccgaccccagctctccttcctgttcatcgcggcgcgagcagggaagcaggggcggctccggcgggagacagcggcgggaaacggcgggcgacaacgttcaagaggatcattctgcagcgagacgggcaatattcacgcaatttgaggtgcggttagggttagggggtggaggggagaggcggcggcgcgatggcgatgggcgaagcgggcgacgaggcggaggtttgagccggcggtgagggcgagggtgcggtggagacggcggtagcgatgcgattgttccgcggcggcgatggggagccgacgggagttagcgcgatggaaaaggagtggccccaaaaaatatcgaacttgcctggaccgtgggagattgggacatgggtgtgggggacggcgtgcgctaatccaatctatctattaatccaagtgctaatccaacttacaatgtgagacgttagatcgagggatccaatggttaggaaacttctgggtacacttttctgggtggatgtagaaaagaaacaactgatgttttttatattagtatagactactagcattggtgtgcttgttgaagatccggtggttgagctagtgggtgaaggcgtataagacaatgctgatgtagatcaacatggcggtgggcacgagcgtaaagagaggcacgacggcgccccacgcggtggcgttgccggcgccgcagccgatgtagacgagcttgacctacacaacaccgacgagcgtcatcatcaggaacccgcacacagagcccaccgccaacgcagagcaccatccggttcatcatcgtcgggaggaagaagatgacggggcagcctagttagtgcaccacgtatacaaaagtggtaaaaagtggagaagttctctctacgaaaatataagaagttatttaaataattaacaaatctaatagtggcaaatagttaaattccccgtaaacggataaaatgggagagagaccgtgagagcgagaggataaggatctcaaccaccacataggtcccgtaatgtacaacagtacaatcttttttgtttcttttttgaaaaaaaaaaataggagcttcagactggaattaattactgtcaagtgccactgtgatctagaatgtgctaatcaatgggattcagttccgctcaaaaatattttcttttattaagactttttattgttggcatcaaaatagcctaaacttctactttaatatttatttgaaataaagaataataattgtgaaaaaaaatagatttttttcacgagacatgt

SEQ ID NO: 21181 - DNA, 307 bp, Oryza sativa
cgcgtgggcgcgtaaataggagggagggggggaagagagccatgggggagggttcggagaggcctcgctcctcccgcgccgcgcgtgcgcgaaaccctagctttgaggtggaggtggtggtggaggaggaggaggaggatgaggaggaagcggctgtggctgcggctaggcgtgtcaagagggaggtcgcggatgacctgaacggggagcccgcggaggaggaggatgacgacgaggaggaggtggtggtggaggaggacgaggaggtggttgtcgcctccgacgaggagggcggcgacggggaggc

SEQ ID NO: 21182 - DNA, 1501 bp, Oryza sativa
aaagggttgaacctatttcatcaagattggaacaactacccatagccctagggtgaaatagatcgatttgagtgaatgcacaagagggagagtgatttaccggttggaggagatgaatcacaccaagaaactaccatctattggtgcaaatggaagaacacctcgtgcttcacctagggttccaagccatggatcaaaaactcaacaaaaacacaaaccaatccatggaatagagagaggaagcggaggagaatcacttacggtgtaaccgaagagaaatccacggtcaaaccgaggggatttggtggaggaaggagttagggtttgaggggaggtgagagagagagttttcgagttggggaaggaaaaaactgaatgggaggagatggagtcgggtaggggaagaagggagaagaaaaaggacaagaaaaaggacaaaagctgcctaggcccacctcggccggtcagaccggccctatgtggccggtcagaccgccgtacctggtcggtcagaccgcgcatatagcgccggtcagaccgccaggccccctgctggctgtgcacagtccttgcacaagccggcaacccacacaataaaattcaataaaaacttgatttttggagcaatttttgaaatgtgtgagtttttaaatattgctaaccacccataatatttgaagattatgatgatttgcaacaaaactcactcaagtgctaggaggtgaccttttatggtctataggggtttttggtcgaatttgattttcaaacaacttttgaaatatttgatttttgaaataggtttgaataccaaaaacattacaaactttcttctctaccaactttgttttgaaacatttctcaaattccttctcaatctcattttggccaaaactaagaatctagtttcttcaaaagagagccaaaagggcattttcattcaaaaatatcatttttcttgcaatgtgaggcttggaaaacatataggaaaccttttgaaacattttccaagtgatagttttcaaattacattgattttgcaaaagttttggtgaaggatatgcgtgcgggaggggaggaggtcgccgccgcttcgctccgcccgtggccctcctcgccggctgccacgtgctggcttggagagaggggagtcggcggcggcgttccaactcgaggagggaggcgtggtctggactagactggaggccgccggatccgcccgagaagcaagggcgggtgcgagcgagagtaacggtcagtttaacggtcagggagagcgaggttatgcgtgaccaggcccgatgtcaacgaggcccatagatccatgttaatttatcattccaattaaccctttttcgtttttttccattctagccagatcatgcaggtgtaaggctggaaaacatgggctgtgtttaggctatgtttagttagatccaaagtttggattttggttgaaattgaagatgatgtgattgaaaagttgtgtgtgtatgacagg

SEQ ID NO: 21183 - DNA, 1501 bp, Oryza sativa
agaccaggaagttcccaactcggcccaagcggagtgttggtggtggagcctctgttggtgggttcaggtttagtagaagcgacagttttgtgcagcggtttggggatgatgaccttattgcactgaagaagtttattgaggcgatgcagcgcaagaagccaaactttatccactactgggatcttgatcaggaaactcatgtgaagaattttttctggactgactcgaggtcccaggcacaataccgttattttggtgacgtcattacacttgacgtgatgtatttacagcattcgcgtgctagccttccattggccacaatccttggggtgaacaaccatggtcaccttgttctgcttggttgtggtctgctttgcagtgacaagaaggaaaactatgtttggctgttgaagaggtggttgggctgtatgaatggcaagccaccagaggcgatcacaaccacctattcagatgccgttgcagaagctgtggctgaggtgttgccaaatgcgaggcaccgtttctgtttttggcatatcttgaaaaaactccaagagaatgtcggacgcacaaatgagaaagaggcaatttccttgagattcaaggaggttgtttatgacacagtcacacttacagactttgagagagagtgggggcccatggttgagcagtacaagctcaaagacaatgactggttctctgctttgtacagctgccggaaacaatgggcacctggttatgtcaaccattcattttgggctggcacttctgctattaggaaggtcgagaaaccagatccatactttgatggcgtggtgacaactaaaactaccctaccagttttccttgagcaatacgagactactctgagagggaagctggaaagggaggcatatgatgatttgcgctcctattactctaggctcacttcgctgtcgggattaccctttgaggaacaactcatggagctctacacagtacctatgttccaagcattccaagacgagatcaaacaattaatacacgtgatttgtaaagaggtagacaggagtggaaattcaattacctacatggctagtgagttgatacagggaaagaaggtcaactatacagttgtctacaacagtgctgacaaggatgtctggtgcatttgtcgctcctttccgtcacgaggcatcctttgcagccatgctctctccgttcttaagcaagagaatgtgttaatgctgccatcaaagtatatcctcaatcgttggagaaaggattttagagtacttcatgcaactgcaagttccagttctatatcatctgatagagatttgagcattttcaatgatctctatgtccgtggccacgagtatttagaagatgtcattgacattggagccagagaacctgagctcaaagagtttgtgttgacagttatgaaggaagcgaaggacaaactagttaggcctgaccatattcatcaagctgatcagcgggttgatgtaaatatgtc

SEQ ID NO: 21184 - DNA, 782 bp, Oryza sativa
atatcttctctctaggcggtgaagcccaatcaagagagaccaagctatggtactacttgtaggatcgaaatgtcgactagagggggtgaataggcgatttaaaattaaataacacaaaatcaaaactaatctaagttgctaggctcggtgagggacaagtctaactaagcaactcagttatattttgcaatcctatggtgaaagggtctcaagtatgtctctaggaatgtaaattgcacaaatgtaaatgcgacaaataaataagacaaggagacaaaagatttttcaccgaggttcggaaaactcgccagttttctactccccgttgaggcgagcccaactccaccgctcaaccacgaagccaccgcacgcacccttcgtcaaggggtgggcaaggcagaagccgcccacggagaggactacccaagcctcgatcactcggggtagttcttccttcactccgaacgtggtgaactccaaaccactcacaaccggtaccaggcctcctccacaatcttctcggagaggtcaccgagcaactctgtagaatcgagatgtcgactagaggggggatgaatagacgatttaaaactaaatgacacctaatcaaaactaacctaagttgctaggcttggtgagggtcaactctaactaagcaactaagttatgttttgcaaacctagggtgatagtggctcaattatatctctaagaaagtaaatcacactcctatgtcaatgtttagcaatcctagggtgaaatgatctctagtatgtctctaga

SEQ ID NO: 21185 - DNA, 1318 bp, Oryza sativa
ccgcccgtcttgctgtgtgtgagggggagagaaagagagggggagagggagttgaggagaagtaatggtggagaggagataagagaagataaggttggagataaggttgctgaaattttgaagtggtggagagggagaggaggcaaatcagacttctagataaaaatgaacattaaatctaattttgtggtattaaatgaactaatgtgaaaaggttgtcaaaaacaaagttgtagagatcattgagatctaccaattttcttttggtcatttctccatccaagtttgattgagctatataaaatttgaattttaaaatataagaaattcaaataatattttgaatcaataaatgatttcaaattgaaaagttgtgatcaacaaagttgtataacttatcaagatctataacttttgttttggtcatttttctatatgactttgtttgaacaatttgaatttgaatttaaaattataacaacttcaaacaacattttaaaatactatatagtttataaaactataagagagatgtacattttgtgatcaatcttacaaaaatctttgtcggatgaaaaaaatgaccaaaataaaagttatatatcttgatgtgttatacaactttgttgttgatgactttttcagctgaaatcaattactgcttcaaaatattatttgaagttttgaaattcaaagttttaattgataaaataaagtcacaagaaaaaatggccaaaataatagcagtaagaacacaataacatgatagaggatgattttagaaacatttagaaaaaagaatcatctaatttggagtgcatatgagtgagatacactagtttcaaattttttaaattttatttttgtatatgcctccttaagtggcccgtatggaaaaatcgattttcccatacgggcgcttaagtgagccgcatgcaaaaatgagctcatttttgcatgcggccgtcttaagaggcccgtatgggaaaatcgattgttccatacgggccactaaaggggccgcatgcaaaaatgaccctcgatttttgcagacgccactagttatggtccgtttgcaaaaatcaaggggcctcgtacagaaaatacacttttgtagtagtggcggtgggggcggcagaggactgcggaggttggcggcggcccgactgctcccgtcggcggaggcggccttaggggctgctgcggaggacggtgatggctctcgtcgacactagcggccctaggggttgtggcgacggcggttccaggtggtggcggcggactagaggttgcgatggaggacgggggtggctcccga

SEQ ID NO: 21186 - DNA, 537 bp, Oryza sativa
atggcccgcggggagaggagagggagggggaaggagatgggccgagccggcctaagagggagagggagggaaaagggactttttagagcttttctttttataaaaccattttaactttgtttatttcttaataattattatttgtgctctgaaaattccactaaaatttatttacgcattttagacttttaggaaatatacaaaaatcctccaagccttatttgacttttaactttgcacattttaattgttggaggctttcacacggattttaattattctaggcataatttagaggatgtattttagagtcgttttgggacgtgacacttttccaggctagcgcttacacatgttttatagttgcaaaacctaactataataatccgcaaatctccatataacagcattaaacttcggatgaccatgtcttggtcatacgagctctgaatcgagccgttcaagtctcttaatgtttgttataacttaaagaaccatgtgctttgttttaatgtgttgttattgcttctttatagg

SEQ ID NO: 21187 - DNA, 163 bp, Oryza sativa
tggttaaaattatttctagagctctgaaaatttcactaaaaatcctgttaatgaatttcgacatgtagaactcaagaaaaattccacatgtcaattccgattattatttgcattaatttattagggttttctctcttgcttttacaccgatattttctctagg

SEQ ID NO: 21188 - DNA, 1501 bp, Oryza sativa
tgatgaaccctagacctaagtgatgaacagatgcaatactcaaaactaaaaatgaaatgtaaaactaaactaacacttgacataacgatgcaatctagaattcaacaaagcaaaatctaatagaacaatgcaacggctcaaattatctaggtaaagtataaatatttttgtgtggcaattttctggttatggaaagataaattacctaacgggcatccacgctctgataccaactgatgagggatgttaggtcccgatcttccaataggtactgataaacagtcgatttgggcagagtcgcgacacaactcgatccggcttctgaatgaacacgctactgagccccgcaatcgcagcaccacgtctcctctggttatcaaccgtgccgaaatctagttgacctcgccgagaaggctaatccctgcatgcgaatcgaagaacacaagcaagaacaagatagattgatttagcactcgaatttggggttccacaaaccgatctagcggcgaaactgttctcaacagaataatctaagataaacccgactttaaacgatgacggctactgaataaatgtgattagggacgtcctagggttttcgtagggcacacaccccattgggctaacgcacgacacaattacagagcccaaaactcaaaattagattcggactggatgaggtacgtggcttgttttgcagattcccggcagctcgttaggagttttgacatgggaccaaaaccatccgaaagtagactccataagctttccaacaagtactcatgggccccaaaattccttctagatcagcgcctaggtccgtttgaagttgatcattgtgtagtaacatttgttcaaatatataacaagtaaatctaatgtagaacatatgcacatttggttgactaatacataaggtagtcatggttatatccgaggtagttatatcctcatcatatggcccgctctgccccaaccctccatatccttcttgggccagctaccaccacatccgattcacaactgtcccataaataagctgcccaagtgtaattttaatcatgcgtatgtgatgctttcctgagtcaattccttgacactgcttacccccgtcccctactatagttaggtgcctaatgtttttctctctctctctcccttctaagcaaaataataatcatcttattctgggcatgcgatatcttctcatatatttattttttaaaagatatctatcaaccatggcttatgaattgactcatatttgcaaattgatatgtttactagtatctttttatgtatgatgaattatgtatggcgcaaaaattattactttattttaatatcatttttgttttttgtttgccttaatttattgattatactatatgtttatatgattacaacataaatatggtattttttgcgtttagttgttcttattgagacgagcatcttcgtcccatctttattttaatcctgcgtccgccactggtgccat

SEQ ID NO: 21189 - DNA, 1501 bp, Oryza sativa
gactactagttggttatccatgccgccaagtccacgacaactagataggttatcccaattattgtacttgtgtgatcaagatgaataaagagcaacaccggcttcggccaacaggatgtagggctattacctgtcagataaggggcccgaacctatataaaaatctctgtctccatctcttttacctcaatctcgcatataccctggtaccaacgatccccataccatccaaataccgtagtcgtgatctcaaacgtcgacaatggcaccagtggcggacgcaggattaaaataaagatgggacgaagatgctcgtctcaataagaacaactaaacgcaaaaaataccatatttatgttgtaatcatataaacatatagtataatcaataaattaaggcaaacaaaaaacaaaaatgatattaaaataaagtaataatttttgcgccatacataattcatcatacataaaaagatactagtaaacatatcaatttgcaaatatgagtcaattcataagccatggttgatagatatcttttaaaaaataaatatatgagaagatatcgcatgcccagaataagatgattattattttgcttagaagggagagagagagagaaaaacattaggcacctaactatagtaggggacgggggtaagcagtgtcaaggaattgactcaggaaagcatcacatacgcatgattaaaattacacttgggcagcttatttatgggacagttgtgaatcggatgtggtggtagctggcccaagaaggatatggagggttggggcagagcgggccatatgatgaggatataactacctcggatataaccatgactaccttatgtattagtcaaccaaatgtgcatatgttctacattagatttacttgttatatatttgaacaaatgttactacacaatgatcaacttcaaacggacctaggcgctgatctagaaggaattttggggcccatgagtacttgttggaaagcttatggagtctactttcggatggttttggtcccatgtcaaaactcctaacgagctgccgggaatctgcaaaacaagccacgtacctcatccagtccgaatctaattttgagttttgggctctgtaattgtgtcgtgcgttagcccaatggggtgtgtgccctacgaaaaccctaggacgtccctaatcacatttattcagtagccgtcatcgtttaaagtcgggtttatcttagattattctgttgagaacagtttcgccgctagatcggtttgtggaaccccaaattcgagtgctaaatcaatctatcttgttcttgcttgtgttcttcgattcgcatgcagggattagccttctcggcgaggtcaactagatttcggcacggttgataaccagaggagacgtggtgctgcgattgcggggctcagtagcgtgttcattcagaagccggatcgagttgtgtcgcgactctgcccaaatcgactgtttatcagtacctattg

SEQ ID NO: 21190 - DNA, 213 bp, Oryza sativa
gacgatcctgagcgttggatttacacagagatgatctataccgttccacgaggaatgaaagaatgagtgaaacaacttatttaagtatagggtaggtagatagaagatagatggagaggcagcgtgcgaaatcttacctccattaatcttcttgttagtggagtgggcgcacgtgctggctgagcagggcccaggtggcttccgcggcccaga

SEQ ID NO: 21191 - DNA, 232 bp, Oryza sativa
agcggcaaacgagcggaaaaagggtttttggttgcgagagcgagacgcacccgccgccgctgccgccgcacatctccctcgcatcgcaagctcaccggagaagcgcaagaagagagagagagagagagagagagagagggagggtaagaggaggaggaggaggggtaggcgagggagatgggcgccggggaaggggatgccgccgcgggcaacaaggagaagggcggcggcg

SEQ ID NO: 21192 - DNA, 1501 bp, Oryza sativa
gctcgctcgccgtgcgccccccgtgtcggtgtcggtgtcggcgccgggcaggcagctgttttcggggggggctacgggtgggttgggcggtcgccgcgtcgcgcggtgatcctcctgcttcgggccttcaacgcgaagccggcgagcttgggcgagtacttcttttgcctgggccagaacagcactgcgacggaaattcggcccatgcttgatgggctgggactggactgagacatacgtgcggcccatgtatattcgggccggaacggtattaccgcgtacgtgaggccgaacaggtttcggaaaagctaattcgtgtgtacgtgttggcggcgcgcacgccggcccactaaggcccatgcacgcacgagctgcgcttctctctttttttttctttcttttttagccgccgtttctttttttttttgctgttttttttcctgccgtacggataggagaaaaaaatcgtaattagtttagattagtttcatatttttactagggattagtttactagtaattttaaatattaactttaaaattttcaaatttagatatgaaaattttcaaatatcgagttgaaagtttttaaatatcaagttaaaagtttcaaaattttcaaatctagacttgaaagtttttgaatcgagttaaaacttttcaaatcttgagttgaaaagtttcaaatctcaagttgaaagttttcaaaattttcaaatatagacctgaaagttttcgaatctgagttgaatctcaaattgaaagttttcaaatctcaagttaaaagttttcaaaactttcaaatctggacttgaaagttttcgaatctgagttgaaagttttcaaatatgagttgaatgtcttcaaaatttgaatttaaaatttaaatctttaatcaaaagtttctaaatctaacttaaaaaatcgaaaagaacacgtaaatgaattaaaacatgccgaggagaagggacgtgaaaataggagaaaaatcaaggaaaaaaagagagaaacgtataagggggaagggcgtgggccgtgcgcacacgcgcaagtcaagaagccccaacaggtttggtccggaacgggaggccgacacgcgtgcggccatgtactatggcctgtgggcgtgtagctggctgtagccggttgcgacaactagctgttaacgaccaaatttggtaatcgtcatcggagatgaagattagactgaagcagaatccaaaacagagatcgtcctggaaacagagcgggaatcagctagatcagaatcggctgcggctttaattggcagagttcgagtcggacaaggttagcgattgagccgaatccgacaatgtgacacggtatacgttgtcaggttgagttaatgtgcttcatgaagattgccgtgcacggattgagtcctgagaaggcaactgtatctattaattaggatattttatgtaatttccttagagatatgtttgggcaaaagtctgccgcaaagacttgtggtatctta

SEQ ID NO: 21193 - DNA, 1501 bp, Oryza sativa
ccgcacgcagggcgtgtctcctacgaggccacgagggcagagggagcccatcatccgctcagccgaatcgccgatcggggacacgcgtacggcggaagatcccgtggcatttcgtggtagtaatcgaccaaccctaggcccgtttcgccggcagcttggtctataagttgctgctctgccctgctcggcctcatcatcccaagcggcacagcagcctcgagctgaactgaagcaggggaggggaggagaggagaggagagagcaacgcgttcaccgttgagagaagagaaggaagtaagacgagcgcaatgcgtcgcgtcacggtgctcgttctgctcctcgcctgcgcggcggcgcgcgccgccgccgccgtcgtcaccgacggtgagtgcctagcttgctcgctaactctgctcgataatcactgcgcaggctcagctctaatttcacttcaagcatccatttatgtagcatactgttaggaagttactgcggtttctgtataagctgttttgctgttctgatcgatcctatctatcagcggcaatgcggcatgtgccattagtgtctaaaagctcgtaatcaagctaagctgcctgccccgtgatgatttacgatcttggagtcatggagtgaatagtaggatagatcacccgggtccctccattatccatatactgacgaaatgtttcccccggtcgctgtcatagcatgaagccacgaactcgatcatgcgttgatcattggagtaccatatacagggtatactgtagtttggttaaccccacacggccaaatcgcattggggcatgcatgcataatcacaatctacatgttgcatggctggcaaagtaaactgaagtacacgtatagttaatctcctattaaggtgtcgtggtgtgcagcaccagatgccgaccgagcaaaagtagtagtagtacaactatacaagcattaaagcatatgcagctgcagcccatttgcaagaaactattcttgctttttagtactagtcgtgaacgtgttagatgcataatcagatatgttctctggtccagtgttctggactagtagtatgcaataatcagatctggagtatcatcgtctgccagcattaggcaacgtttgatgcgagagtgcttttgtgcgctctcttgatttggtttctcgtttgttttgccggccgcggccctggttgcgttgcatgtggtagatgggatggtagtgaatgcacctgggccctggccgagccagaggaactgacacggtcatacagccctactagctgccggagcccagaacatgcatgttacactaacatggaccctgtcagcttagcagtataccggtcgcagttccattaattaacagaacacgagatcagacagacagcctgcgtgcctgatctgatgctctgaatcgatctctgctaaccgcagcatcacctccaacaactttcttcagttgcaggctcgcagtgcagcggccgatttgaatatct

SEQ ID NO: 21194 - DNA, 1501 bp, Oryza sativa
tcgacgagagaggtttcgtgcccttgcttgctctcctcttactaaggatttctttctgcattgtttatatcatcatgtgataggttcgagggaaattggtgcgattaaaactgaaatggtattatgtttgctggataatttccaatgacatgttactttgagttcaataaattagtcaattccacgattctggtctcttgtgttcaacatgccatgccccatggtttcccaaatcttgaactttaaaacccaaacaagctgcggttgtgtagaactccttgatactttacttgtgaggggctagaatagattgcatatgtactaagcgtgagttctggagatcaaaacccctagaccataactctagcaaattggtcttagcacggtgaattgtcaaggggctaaagaaatatcccctaagatagtagtattttgtcagcatgtatgccaccaagtaattgcactactgcaaaaatcatgcttccttggtacaatagatatgagtacagaatagtgggttgcccttgattgaaagaaaccatgttattcttgtagcatcacatctccaaatatttgcttcgccttcttctgtggcttttagtcctatgctattgtgcctttgtaggttgccaccagtgaaaattcataaaaaaatccgcatttagtttgactaccaaacatcttatgataagtcggaacctctagctaaattagactattagggcaatttcatccccccattaatgggaactaggcgagcaccatataaaatttctacaaagatagttcaaaggttcttagtcaaaaaaaaaaaagttcagaggttcatcctacagatatttttcagagatcgtttaaatcttcaatatatactgtggtgcaaacttgataagtcactaagtcactttggaccaatttctctttttcaagaataaaagtttgcacaatttgaagggaaaataaaagaggcattgtacaactgccacaagaaatctgcgtgtgcactgtttgatttgttagtaatttacactttttcacatgtacaatcatagttagttgttacaatttgagatggtctcagagcaagtttatcttctcgtgagcaccgttgcttccccaccctaagtttcaatgaccagtaataagatattaatcagagacagaaacacggtcgtcgtcttgagtactatgatcttccgtccaagctgttcttgcatgatgtgttgtgctcaagctccccatggcatcagtcttctccatccttgaccgcatcttggagttcagagaagtccactacaatgttgttctccatggcgatctctttggtcaccttcttcttcagctccatgctgttcaattgccagaaaacctccacaccaactgcaagatccaactttgttagctctctattcttccatctttacaactgcaaaattgacttgtgaaatgactggacaatatatgctatctagtaccattggatcaacaatgccggtgccgt

SEQ ID NO: 21195 - DNA, 678 bp, Oryza sativa
attgaaagtttaaggtgaacgatgtctggtttttgagtttagagaggtaattcggtttaagtttcaattctaaatttaagtttcaaactttaaatttttgttgtagttaataagcaaaaaaaataatatatgtgtttggaagattataatatctatgttgatatgtgtttatacaacttttaattatctttatctgtgttgtccatcatttaactttatatggagcaaagtaaataatcttccaattcatggtttcactattttcttatgtgtagaaaagtattatcgtttgaactgacctactacggacaaaaggtcaaatcacaacggcattttgaactgattaatgactcttgatttgatttggcactgacactttgacaatggacatgcacattgacattagacactctaagggtccaattcataataggattctccatgagggtggatgtgttaaattgacaaaaaagcattgttttagctcgtctccgcgcttaggcgcctagcccattaggcattagcccaagcatctttctggattcaggagagctcttctctactccgttctctagcgtacaaaaagcatccgcgaggaagcgcatccatggtagcggcggtggtggcaacaccgacgagatcggaggctctgacccttcctccgcatggcatggcagt

SEQ ID NO: 21196 - DNA, 1501 bp, Oryza sativa
atttcatctcagttcttcttgcacgtaggcaggatgtcctgactacgcctaaagccaaatggaacacccccatgtttcttcccaacatgtggtcttggatgcctggtgaacccgaaagattgcttgcttgtagagcttttcagtccaggtgcacgccttggcactccctaccagctgcatcaatgtgcaggatcaccatcgacttcaccatcatgctgagaaccagccgatgcctctgttgatagcgtgacgtcgtcatcaccttcatcattttcgcgagctgtggtgtcaccatcaccactgccacttgctccccctaatggggaggattcacgaccaaaagcctccccaagcagaagaattgttcttcttctgtggtggcctgggaatgcttccctgtagtggagtatcgacctgccagtgcgcacaatgaagaccattgttatagatgggctatgtagagccctctcgctgatatcctcttccccttcactgactccgatcccgtcctccctggcacttaagcctgaacgaagcatgctgaacaagtccccaagatcacgctgctgctccattctgtgccagtctcgctgccgttcaggatccacctgagttggtctaacagtaggatggttctccctggcgtgtctcctcagttgaccgtatgcccccctgaactcgcaggactctttagtacatgctcgaaccttcacgttcaagtacttccgtgcatcataatcctttgtccaatggctgactggcccacgacacaacgggcaagacagttttatgggctgctggcactcgctgcattctggcgcagcagcagcactggcaccagaatcctttgaggactccttagaggccttgcggtactgatcaaagcaattggagtgtcggtagcttgtgtcgcacatgaaagggcggcagcccttctcatgcgacgagcagacgagcagaacagcgttgtgtgggtgatccatgcagaccgggcagcggacatcctcccattccgcagcctgcttcgcggcagcggcagcggcagcagcagcagactcctctgacctgcgagcacagcccttcccattggaggggtacggcgaaacacgagaccggcggcgctcgtatgacacggcacgggtgctcctgtcctttggcatagttacctcaagtcagtcagatgcaaaggtttgttggttttgtttgaaattctccgcaatccaaaggaaagcgctacagagaacaacaaggttgatttccaacttcaaactctgaaagagaatcaaagcgagaaagcatgagatgcttaatcagatcgcaaactagtacatctttgtagaaacaagggttatacatgacagaacacaaactaaatcatttttcctttttctttttttgcaaacatgttatatgactccggatccatcaagcaaatccccatccaaaatcagagaactcttatctatcgagagatggactcctcctttttctttttttgcaa

SEQ ID NO: 21197 - DNA, 250 bp, Oryza sativa
gtcaggggagatccacgcgagctgatctcttccgtggtggtaaagccctaactcgctcggatccatttcgcgctgattcgtgtcgctgaagccctaaccggccttcttgttctccttcttccgcagtgtgcgccgtgcgggacggggtcgggtcgttttctgtgacctgtagaatagggtagggtttgaggcttttgagcagaggcgcatccgccgcgtgggtgggtgggtgcggcggtggaggggagga

SEQ ID NO: 21198 - DNA, 1501 bp, Oryza sativa
gccaatttgtttacttatatatcttaggcaatccagttctcactgctacgggtgttaatcctattcctatcaatgaatttacagctacatctcgtcatctcctgctccgtttataaaagctaaccacatgaataatgttaatcacattgttctatttgcaattgagattagtgatggtccttttctttctgcttctacgtatctctactaatactgcaaaatctattaaaatcagatagtcgtctacatcttctcgcacatcttcatccgccacatgaaaaaaccatattgcctaaaagacaaaataaaagagtgtttctgcacgagaatcaacccataaaaaagtggatagataaaattcaaccccatcaaactaattgttagtatttcttttagtcctgttgaaaagcaggagcatagtaccagttggtgtaaaagataagttttgtaaaaattaattaatataaatatatagatatactcttttgagaaggaaacaacggtggtgactactgtgaatcactgaatctactgagccaaatttgctaattaggaaaacaagttaccacgaatttgtttttgttgatttcaaaggaaaaaaattataagtgtatatgtggaacgtttcgatggataactactgtaaactataatttactctgagcatctatacaaaaggaaaagcgtgtgacaaatccatttcgtagcttagctaatccaaccaatttccagttaaccgccgtctgaattcatttatccaagtcccaaacctggtgcaaccgtgcaaagtgtgcatgcagcgaatttggtggtgattcctctcgctccgagcctccgacgttaaccacaacctcccgtgggacagaaagtccgacaaatatacggtgcaaatcatatatattagaaactcaaaaattaccattaaattgaaaattaaatgtacgagaatcgtccatgtcaatataagtctcaataaaatttttactcataagtaaacttacgagtaaaatttttacccgtgataacgtagatgaatcttagacgtttatttttcgatttaatggtaggttttaagttttcaccgtatacatagttttcaccgtatattttcccatttctcaatcctgatcgacgacgtcggtatttgggcctcgtaactcaggttggaacacctactcatggttagagcacctaaccatggttaactcgctgcccctttaaaagcgcacccggactccgcccaatacgccccacacctctccactcctgtcctgtcatcttgtacactatcgcgttgctgatctcctcctcgactgcctcgtacgtgttcatcatctcttttaatttctccgtggtttttgcaccggcatttggatgctgcaagcatcaatggcagaaccgggtcgtaaatcgtaactagcgctgttatgttggcgttgctaattaacgtgactgtttacttttttttttgaaggtttcgcgcgaccggagacggccatgg

SEQ ID NO: 21199 - DNA, 1501 bp, Oryza sativa
cgtacattaatgaagaacataaaaatattatggcgtgcatatgaaaagatttatcgcgaaaagatgttataaatttttagtacataagaagtaaaaattcatcactgagtttatcctggttcaatgatttgccattgacattgtcaatttccgtaatatactacgactttactaaattgttctacaatatgccattgtattgcatttctttcaaaaatacctaaaatacccttataagaaggtttgaaaaaaatatgcctttttatacattatctttatactacatggaagtttgtgtataagtttttgtgtgcttttgttttttaatgtaaactagctaaatgcatgtgctttgctacagataaaatttatttttcatgaaatgttccacctgtcgtgttgctatggaaaacatttaccttaatttgattctatgcatcgatatccttagattgattgttattaatataaagaagctcagggggtgatttctaaaatttacaataggagtagctataaggtgacaaattcactattcccccactagatcctcttaaagtagcatagatcatctttcatatggtaaaaaaaatatttttgtgttgttatcttttgtgtaagcaatttcactatcataagccaaaaaaatttaaataaaaaataccaagaaaacttgaaagttatatacaaacttccaggttgtgtaagaaggctacactaaaatacgtagtttttcaaacttctactgagataaatcgattgttgacgtggtacatttttaagggtattttgggtgtctttgaaaatagtcagtccaatggtatattggagaccaattgatgaagccgtcggtatattatagaaaacatcaatatctatggcaaattattgaactgagacaaactcagtgacatggagtagattatccctaaaaattattatatgtctacaattaaaataatgttcattatatgatttgccacgatgatgtcattgaactacactaggattaaaaaaaataatggaaaggacttggtagctataaatgatacacactgctatggaacacatcttttacgtgaccaggcactccacctgtgactaaaggctttgaaaaatcgacgatcttcccagataggtcacaaaagttgatttttatagttacagcaggctatggttaagcggactacgtgagaaaattattttttacaggcaactatatgaagccaaccgactggaaaaaatattttcaacaaaaaaaaaacaatgtatgcagctgccttatgaatgacagttgccaaacccatatccatagatcaagacacaaattagagagagaacaattcacatgattggaaaatgaaacaaatcaagttgttccataataatttgtattcacaaatccaacccagattcacaagcatacataaacatcagaagcaggccagatcgggttcgaacatatttattctccccacacggatgaaggcacttgtagcag

SEQ ID NO: 21200 - DNA, 1501 bp, Oryza sativa
tgtgtatcctaatggccatctggtgtgatggacctgttctattcagatcatgcaacagtttattttcagtgctcagtgagtccctgtttgcaagcagccactaaatctttaacgatcgtctcatagtccccaatttcctcataatgtgacagttatggaagtgcttgtcatgtcttcatgaacttacttacagatgtcagcacagcgacgataaacagtaagataacatgccaaatttcaccggaaagactactggagcatgtgtacaactaacctactttttagactttttacccttacatttcacagcgccgacactgaaaagtacagaaaatgctaaaaccttattatttatttcaaggatcttttgaaaaaaatattccctaagctaaactaggcaaggacggaacgaatctggtttagattcattgttttatgttatgtctcatctttctctaggttttttttttaaggacgggggaagagttttagacatatgtacaaacattaaaaaaaacacaaaattgagatatcgtgtacgagcaatgtaaaacacaattataaatttgatgcattgaatagctcacaaagaagatgcagtggagtcgcatatttcattccaatgtcaagatcgagtgagtatatatcaaacatttcaacctaagattgacagtgttagaataacacaacccaaaacaataggctacagatgcaacctagcagctatcaaacggtctcatcttttcgcttatacgctaataagctaaaatttgaattttcaactttaaatttaaagttgatttggtttttatcatagtttattttttagcctttagattgctaagaacgtgtatataaaaattttattcacaaattattttttttccaaatataccgttacaatggccctaaaacattgcaacccaaatatataccacagaaacacctctattgctatgtctcaactcagatattgaacccaaaatatacctcacactcacagcacgtcagcacatctatcaccatgtctcaaacccaaaatatagcacaaagcacatctattatattgccatgtgagatctcaaatcagatattgaagctaattgccactccacccatcggtattggcgaagaaggccatattttagcctgcaagcaaatgcacacttcattttgttaaataaaaaaaattaagggtatcataaacaaagttacaagtaaacttgcagcttattagcaacatcgattctttttacatagagattcctcagcacggtcctcgagcagctcctgcgcaaccatcattgtgcaactcccactcagcgacgatgatatatttatgccaaaaaattacatcccggatttttctgggaaaaaaaataaataaataaacaatatatatttaaaattcaattcctttcaccactcgaagcgcctaccttggcaaaccctaagagcaagtataatagtctctctttgagagaggacccccgtgtcgctc

SEQ ID NO: 21201 - DNA, 1319 bp, Oryza sativa
agctggtgcagtcgcacgaccagcgtccgcgctttggccgcaagcggctgggaccatggatgacatcggcggtggtcgggaaaaaggggaaaggaagagggaaaggagggcttgacccttgccgaaacgggaaaaggaggagggagaggggagtgagacaggggatgcctctctcggccttggaagctagcggcgtggagcggcggggcggcagcgcggcagggcacgacgcaggcggcgccagggcttgacgcggcggcaaccgggcggctgcgcggcgcaggcgcggcagggctgacggcggcaacgaccggccggtcggccacgcgcgagcgcgggaaagagcgaaggcggtggcgggttttgggcggcgacggcggaaagcggcgtcggcgcgagagagagaaaacgagagagagagagagagacagcgaaagagaggaagaggacgagagagcgagagaacgtccgagagagggaagggagagagagacagcgctctctctctctctctcggtggtcacgtgcggcgcacgtggagttggagggagctgagaagagatgggccagcggcaggtttcggcccaaatcatcacgagggaggtaaaatagacttttgtagagaagactgatttggagtggattcgaattggggttttggattcgaattcaaatttgacattcgaactcgatggtttagggaggaatcaagggagactcgaggagaagtcaaggaagagattcaaaacggaaacttggatatttattttttttttttagtcggagcgaatattcggcaaggattcaaaggaagggattgactttcggaatttgattttggagactcgaatcggaagaggaattttcgaggtggaggattctgatttcgatgagagggaacaacgggattaaattgagatccttggcacaacttagactctcacacaaagaacgaaaattttcgcaattaggattttgccgagttagtttttttttaacgactcacgaaaagcggagcgttacaacctgccccgggcgtttgaaaacagagaggctcaccgcgcttgcctaggcacgtgccacaagtccgcatttaacagcctcacgccgtcacgcgcagccacgccacgcaaaagcggagatagatagatagatatgcgcgcgtgaagaggatagcgggggacgacgtgacgacgagccagacgccgggcggttggtgtgtataactgcccagattacgtgcatgacgtcgagcgcgcaagggccacggttcatgtgtttgcgagatcgcgaagccttcgattcgcccgacgcgcgcg

SEQ ID NO: 21202 - DNA, 1501 bp, Oryza sativa
ttggtatcgacggaagcaaatctacgcgtggatacatcggagttggcgatggagtcggtgaccagctagacagacaggaacaacttcaatcggtgtagcgccttccaccatgtgctcgctaaccatcttctccctctcgatcaccataatggctttggcctcacccacgcacgccgaccatggacaacctcgcctcatgcatgatgacgctttgttgtccctctgttccttccactgtggtctcccagggcaggagtattgagtaggcaggaagataaacggtatgacaagtagggtcaagactatttttttgactttttatactatttatctcttctatttagccagaaataaaaagttttatttatacagtgtacaacagtaaacaaccatattttttaagttttttcttcttaaaatttaactatagatatattcacaaactaaaaccgcgaggtaacaatgtccttgggcaaaattttccaaccatccctgttaaatttcttagtacggtatagcgaagcctgatgctgattgtaaatcaatcctttctcaaatctcaagccggcaggtttgccaattgatgattggtccacgtgtcattattcacttggcagataaatcagcatctaagagtaaaaaaaaatactgagacgagcagctggcgtactgtaaggaaatgaaaaataacagggttaccgcatgcagtgttctgctgctgtgttgcagctccgcatgcagacaacagaaaaatcaggatcaatcgagcggaaggagcccacatggctcacccttacattggttaaattactcatcatatagagagcgcgccattttcaaccttaccaaattttgataaggttgctaaaaaaagtaactacatttagtttgctgtcaaattttagtaactatataagaaatcctgccaaaattttggcaagtggcatagttggtaagctttttttttgcaacaaaggacttgttcactttgatgccatttttaaccttaccaaattttgttaagttgctaaaagtggctatatttagtttgctaccaaattttggtaactatataagaaatcctgctaaaattttggcaagttactaaaattttggcaactataccaaaatggtaaggttttttttggcatcaaagtaaacggtccagagttttggtttcaatgagcgtaataattgtaccctgcatttgcaataaaattgttgaaacaataatgcatctcatatatatttacacacttatctatactaatataaaaaacactagttcatcaaacacctctctttctaccgttagatctatttatccaaaggcttatatggaaagttaaatcaacctttaattagcgatcccacgtcgtgataagcagcagttgtagcgatcggtcaaaacgaaaaaataatttgtgttgccggccctagcccgtcggcgccgacgcctcctcctcgacgtcccctccattgctggcggcggagatgcaga

SEQ ID NO: 21203 - DNA, 1501 bp, Oryza sativa
aggtcactagcagtgagtgtttgaatgtttccctgtatttagataacagtgatacagttcagataatgaaattgttaaagacttagacaattcaatacaagaatcatcatgcaggtagaatgatatgcttaatctgcaggacagggtagatgagccaggagaatgactacatgaacatgaggaaggcaaatgaccaactgttcccttgccatgtgaaatggttatagaaaacaacacaacatactcaaaagaaatcaaccagattgtaagcaattctgtggacagtttaaacaaatacatcaagacagtctactaattgagaaattctaggcagaacataaattctgtggaaaacttgtaagcatactccctaagaagtgcctaaacatctgatcaagcagtttaagttctgaatctcagcctaaacatctggtcgagcagcttaagttctgaatctcacttctcatcacctttgcagttggcacaataataccatgttctatgtgctactcctaaatctgagccgaaccaaatcaaaactgcggaatctaaccagaagctttttctcctaggttccaatttgggataccacagatggatttggggaagaaaccgagcgcacctggtatgggcggtggccgaagttgagctcgtagacatcgttggcaacgtcgttgatgtcgaaggcctccaccacctcggcccgcgcgcccgacgccgccagcgagtacctctgcgggggagggcaggtggcgcaaaaaccctagccgccgttagacaggtgcgggcaagttcgcagtggggaaggtggagagggtgggttgggtgttagtaccatcccgccgatgccgctatagaactcgaggactttccatggcaccgcggtctccatcgtctccggcgatgatggcggcggcgttggcggcgccttgccggcttttgctggacttctgaaaggcttttcggccccccaactaaactgcggctcccatcccattaagaaaaaaaaaagtcaaattttaaatttttaaacttaattttaggattgattttgagattttttttaacgtaatttctttttcagcattggtttttaagttaccaagaacacatatataaaagttttaccaataaatttatttattttctaataaaccattttggcgaaacgatggggcccgcaagtcctcctggttgattttgacacgctggcagagccgaattacactggtctgcggcaccactagccacacccctctggcccacagcataccctcatcacgtgacccgatccagaccgtccatcacgcccgcacgaaccccgaggcgccccctacccgtcttcctcctatttcccctccccaccctaccccgtcgtctccgttcgcgcgcatccaggtcaaatcaaatcgagagagagcccccatctcgcctcgcctcgccgcctcctccctccccccattcccccgccgccgccgctgcgagcgccgcgacatgagag

SEQ ID NO: 21204 - DNA, 562 bp, Oryza sativa
agctggtgcagtcgcacgaccagcgtccgcgctttggccgcaagcggctgggaccatggatgacatcggcggtggtcgggaaaaaggggaaaggaagagggaaaggagggcttgacccttgccgaaacgggaaaaggaggagggagaggggagtgagacaggggatgcctctctcggccttggaagctagcggcgtggagcggcggggcggcagcgcggcagggcacgacgcaggcggcgccagggcttgacgcggcggcaaccgggcggctgcgcggcgcaggcgcggcagggctgacggcggcaacgaccggccggtcggccacgcgcgagcgcgggaaagagcgaaggcggtggcgggttttgggcggcgacggcggaaagcggcgtcggcgcgagagagagaaaacgagagagagagagagagacagcgaaagagaggaagaggacgagagagcgagagaacgtccgagagagggaagggagagagagacagcgctctctctctctctctcggtggtcacgtgcggcgcacgtggagttggagggagctgagaagaga

SEQ ID NO: 21205 - DNA, 1501 bp, Oryza sativa
ccggcctcactagcgggcgcggctgactaccccaaccggcggtagtcctcgcggagccaggcggagcagcggcagcgctgtttggagtgacaactcgccgaatctccctttctctctgagttcgccggcgccaaatcgatcttcaccaccgccgacgctttccccattgagcctgtgagcttctccggcgaggacggcgtccggtcgccctcctccctgggcaacgcagcagtgtggagtatggggatgacgacacatccctctcatcttctctctttctcccttgctgcacggctcgctagtgtgggccacttatgcaaaaactgacgacgaaccggtggcaaacttgggctacgcggtcttggcaaagctccgctggtggaggaggtggcaccgaatattctgttcggcgtactcaggctaaatgccacatgggagcattgtgaatggcctcatgaaaccagaccttgaaagccacaagcccacaacaccctgcccctcaatgcacttcattcaccgcacccacgttttcaccaaaacacctgactagatcactgacaccctgcagggttcacgctctgtacgatggatcgaccactgtaaaaatcaatctgccaaacagcgatccggccagccacactggtggagaaacttttttactcccggttggtacccttgtagtcctgggtttccaaccgggagtagtaatccgggactaaagatggacatctttaatcccggttgaaatagccgagactaaagatccatctttagttcagattggtaacaacaaccgggttggttgttgttatcaaccgagactgaacaggagtagtgggcagtccagatgatccccttttcttttttttcttttttattttctcccgaatcgagtggcatgcacatccccaaatcaaaccccaaatccccaaatcaaaataacatcccaactccacatcacaaattttaaagttacttatactcacaaatcaaatacatcacaaatcctaaaaaaagtacaaagcaaatcaaatacatcacagattatacatctcagatccatacaaatgtccaatgaattacaaaattatacatcttaataatcacagattatatataaaaaaaaaagctggctgcctcctcccgccgctcgtcgccgcgaggcgcggccccgctagccgccgccgtgggccccccttcccccccctcccgcggccacaggccgcctgctcggcgccgcccacctgcccgccgctggatgggagggaaggagggggagtagaggggaggaggaggcttggatcggatgtgaggaaattggagagggacgatcttatctctaaatagctggatgggagggaaggagggggagtagaggggaggaggaggaaggggagaaaggagaggaggagaggggaggggatgaggaggcttagatcggatctgagggaattggagagggacgatcttatctctaaatatttagtctggaacttaaccg

SEQ ID NO: 21206 - DNA, 1501 bp, Oryza sativa
gctaaaattttggctacgtttagtttgttgccaaattttaataagcacatataaaatcttgccaaaatttgataaccttgccaaaattttggcaacattactaaaatttggcaataccaaaatttgataaggttaaaaatggtagcaaagtgaacaagctcttcatctctggcggggcagagtttgggccctcactgatgcattataaatagttttgattttttttaaatcaaactttgtagagtttaatcaagtttgtacagagataaaataacatttcaacacaaaacatactattatcaaaattattcaatgttacatttaattaagttaatttgatgttgtagatattgttaaactccatagacttgatcaaattaaaaaagtttgactagaaagaaatattaaatcgacttacaatatgaacggatgaagtacagtagcaagaaaaccttaggatagataaaaggggaataatacttcttttatttggtttcctctctctcttcctcccttcctcccatttccatagttcctagcttatatggtgttgtctggactagcttatttattattatctatatacataccctatatcttattacaaagaaatacacactcttacacattccttaattaccatacactgaaggatgaacaccaaccatttatctgtgaccatatcaaaatcctagtaattaaaagcgtcgattaatcaatgcccacactaaaattctaacaaaaacggatctgtatatatataattatggataagtgcaccatactcctttcgtcctattttcatcatcacctaagcaaatagcgtagagaccaaggacaactaaacctttatcattctataattaattctcatcgattaaggtaatatgttgcttcgtatcacgtggattgtatcaagttttaaatattgcatgtagttgtaccaataggaattaatcttggttggttgcatgtagtatatttaatgatgcttatttactttttacatataaataagtaaagagatatttgtgaaagacttcaaaaaccgtaggtgatgatcaaactaggataaatggagtgtattttctcgatcgatgcctttttctttgagaactttcttgacggctacaaatcgtattctcttcatcctttaaaagccaattagaaaattgtggctggatccaacaagcaagggtttagtacaacaaaagcgattttgaaatatctttggtcgggttcagttaacaagcgtccggttttgaagccctataaaaagacatctcctttgaaattgcatctgccaaatcagccagcactagctaggtacactaaggcataatactcgacagtgtacacttttgctctaaacgggatgaagagccacatggcttccctcttgctgctgcccactgcagctccagcgtggcctaccgcctcctgctggcagcgcatgtgggttcatcctggcccttcgtttcctcatcggatgatgatacgt

SEQ ID NO: 21207 - DNA, 1501 bp, Oryza sativa
gaaatggtggtgctcaccgaaggctgaagagatggatggagagagaaagaggattcaagtcgacatgggtgctcattggagccggaagtagcaggacaccgttggccaccgttgctggccggatggagaggagaggccaaggcaggccaggggaggggagacggacggagaggccgccgtcgcccatggacgcccttgcccgtgagatctggagcccaccgcccgtgagatccggagcctgccaccaccatcatcgatgcctctcctcccaccgaatctggcggaggggaggccgagagagagagagagagactctcggtcttatccgcttgtcaccgcgcactctcctccccttatccgctcataagctcactgctcagtttttaaaaggtgtcagttttttaaaaggtggtcatgcgcatttaatggatggaaaggtaatgggggatgacgaatagaggatttagggccacaaagcgtgttttttgggtggaaagtttagggattcgatgcaggagagttgcgggaagcaagaatgaccttagataatggcatgacactagagcatggccgctgatttcaccgaagaagggaaatattttggtggaggcggctagggcttttctatgtggacgaggtgggacagagatgtatggactggagggaaactataaaactagcagggacaggcaattttttttaaagaaaatgaggacaggcaaatttttctggagctaaattctttagagttagtcccatataatcccttctttcataaagttaagacccaaagctgagatttggtgaagccacgtcatcatttaattatcgaccgttggattacatctcagtggtcctcattgcgttttggagcatgccctcggtcccttcgctccccaccgcatcgcctcctgtaccgtatcgcctcccccagcaacagcgactacggcggtgacagactctgtcgatggtgacagcgacggtggcggcggtcggggacgagcgcggcggaattggacgcggacgagggcggctgcggcggacgcggaagagggaggcggcagcggtcgagggcggcagtggacgaggacgaggcggctgtactcgacggtggcggcggcggacacggatgagggcggtggcagcggtcgagggcggcggtagtgacgacgacggcggccacggacaagggcagcagcacctttgcttctgttgctcgtgctgctatcatcggttcctctctcttggaagctcgcccactctactgctgcaggttaattggtgcccttttttttctttcgtttagccaacaagaggaaatcttcctccttggctaattcggttgtgctgctcattatcctcattgtttcttggttgatttttgcagacacacagaattgggggcagacctctgttgttcatcttaggtgagaatgaatttacagactttcctttttctgctgggcaacactagcaatctattctggcattatctctctct

SEQ ID NO: 21208 - DNA, 1501 bp, Oryza sativa
gtggttccagcgcgcggtaccgagcgagtctcgtgttattcggtattaatcccctaattttttccaactcatcttcttcattttccacgcgcacgcttttcaaactgctaaacggtgtattttttgcaaaaagtttctatactaaagttgctcgaaaaatcatattaatccatttttgaaaaaaaaaactaataattaatttatcacgtgctaatgtactgctccgttttccgtgcgggacatgtattcacaatttggaaaggacggagtggcagtctcgcgcatccgccatgcgggagagaggggccggtcccacgcatccaatatgcggagcgatccggttctgtattattcccctaatttttccaactcatctccttccttttccacacgcacgcttttcaaactactaaacggtgcatttttttgcaaaaagtttttatacgaaagttgcttaaaataattatattgatccatttttgaaaaaaaaactaataattaattaatcacgtgccaatatactgctccgtttttcctacgggacatgtattcacaatttgggagaagacgcgtgtgggagccacggtcccgtacatccaatatgcgggagcgctcggcatgcaaacttcctgcgggacaggtgcgataccgcatccccagcctatgggaccggtcgctcccgcgcatctaatatgcggattgggtatatttttgcaaattaatctcggacatgtatataaatgcaaaatatgaaaaataaaaatatattttcaaatttttttcggaactccaaaacatccagagctcttttgggaatctgttggatcagttttttttaaccaaaatccaaaaaaaataggattggggatggaatagatagactgttggtgatgcttacctactttcagtttggatgtcacagttaattgatcttgccattctgtgtgaaatttacatcatacaagttttcttttttaaacgtagcgttgatacaaatcatacaatgaaccatatgcagttaagactgttttcggtttatatgataagttcaatgtaccttattacggaattgcatctttcctagtgaccatgcatatagaactcatataataattaacataaactgtctacttttcgggctggcggaaaatcttgctgacaaatcaccatgggaagcttttcaaaatctcagaagaccctccatccaaaattctagtgcatgatttttcgccttttctggaacctaaacggcccccattgtttggtttattcgtagaatggtatatttacaaatgaaaagtaatttgtgaataaaacttttatgtacgtgttcttagcgatataaaagtaaaggctgaaaaataaattttgatgagaaaaaaatcgcaaagtttcaaatttaaagttgaaaatttaaattttggttgataaatataagtataaacgaaaagatgagaccgattatcttgtgcatgttagcgacaaatttaatgcttttaac

SEQ ID NO: 21209 - DNA, 276 bp, Oryza sativa
cacctaaccacatttattgcggtttggctgagcgtgtcacgccgcatgtaacgcagtgcagtgcactagtttatccagtcagtgaccagtcacagaccggtcagatcgcgggttaggtggcgacaggcgatctgacacacgccttgccccatcccgtcaggacgagggcttctaggcgctcgtccccagctggagctagcgtgttacctcccagagatggcacgttagtcctagtcagatatatgccaggcttcatcctaaccattgcaggcaaga

SEQ ID NO: 21210 - DNA, 1501 bp, Oryza sativa
ccatcccacacataccaatacaaaatcagaaatactataatacccacactttataaaataccaatgcaattattcatctccttatctactcccaatgcatttatcccttttcaaactccgatgcaatgattgcttaaaaatgaacttattttgggacaaacggcaggggcaaaaaataatcttacgtagacagctatgttcaaaaaccaacacattactgtctatacctaaaagtccaagattttcaaaacttgagaacatggtaattaaagtattagtggtagttggatgactgtagagaattttttttactttcaccctgccagttataattatgatatactatctatttcagggatggggcccttaaggattcacatcagaacacagacttaagtgactaatttgttacaccatcagacctttttttatgtgaatggaagtagtcatgacacagtgcagtttttatttcatcaactagatgactgttgagccgataagagtgaacgatgaccattcttgtcctcacaggctcacagccacatgatctggggctcaaaacatttaatggagtgatccttctcaaaccaaatactggactcatgttaaaggttttaaggggtttctatcatgtttttgattgttagttgagcaacactactacctaaaataatatgctgagaaattagctgtcatgacagttgatactgaaaagcaaaaacaactaatacttagccattcttgtagcaaaacctcattacatatttacaagaaaacccaatggatcaaaagagaatctcaagcatcttatgtctatcatctgaatattctgcatacattcagaaagcataattatatttcttctatacaaacaaaaatggtagggaaaatcaaagtcacattttattatacacgttggtctttggttttagtttttggccagaaattcctccttacaagcctaatttctcaacttcccctaaaaaggcctaattcctcgacacaaaccatccaattcaatcacctatcatttgcatttcatcagcacaagaccaagccacatctgtaaacacttgaaacgtcctcaccaaactttagcaagaacagagactgaccgtgcggaaatcccagtggccaacgataagccaaacgcaaggacgcattgccccttcaagcgtagccttttccaaggcagttcaagcagcgctgcaccctgaaaacatgtttaaaaaaaaatcaacaaacatccatagcagcatggtcacagcagcacagcaattcaaaggggcgtgaccaaaggtcaaggaaatctccgcaaaggacggccaacctagtcccgtcacaggtagggcagaggcacgggttgacgaacaccgggtcgtggagcggagaccactcgatcgtcgagctgcccctgcagagcctgcacgcgtaggtccccttcccctcgcaggcgccacacggcgccgcgaatttcctctgcgcgcaacagcagcgcagc

SEQ ID NO: 21211 - DNA, 1501 bp, Oryza sativa
tgtcaccgtgcattcagctcgtcaatctcgtctgtacgccgccctgacgttgatcattgcctcagctcgttgacaacgaggaagtcattccatccatcaccgccgccgctcacaccggcacacgcgtgtgctagtctcacgatgcagtcccacaccgacgaccgggagaggcgcggacgagacggttctgttcagtttgtggaaatcttaaaaaaataataattatacaacctctatcttgggccatgtttgtttcagtttaaaattattgtaatctagattatagaactagattaccataagttagattataatctgtttgttagttgttagtcacccaataatctaaaataagcacctttagagtggcttaccagattatagtaacttggcttataaattataataatatatcataataagctatctggtttttcagcttactcctaataatccatattataataatcctaagctgtattaaacagggcctaatttacttttttagatttcttagaatctgtacgacaaactaaattgttagaagaaacttctgatagctgaagattataggagaacctatagccattagaagcttccaaacaagatctacgacgcgcagcgggatgtccacaccgccttcccccccacgctcccgatcgtggaagcagcggtgacaagaaaaatggcctgttcactttgatgccaaaaaaaccttaccaaattttggcattacaaaaattttggcatagttgccaaaattttagcaggattttctatatagctaccaaaatttggcagcaatctaaatatagccacttttttagcaactttaccaaaatttgataagtttgaaaatagcatcaaactaaataggccaaaagaatagcgtgcggccggctgcctgccctcgtgccaccaacggggacaggggatcggatcgtacgtgccgcctccccctctccagcctccgcgaccggccgcggcgccttcgctgccgtgcacgcaccgtgccgtgcttgccttgcctgcttggtcggcgcggcgcggccatatcccccgcgccgcccgcacgcacgcccgggccgcgcgactccaccgccgctcgcgtttgaccgtaaccgaaagcgccgcgcgcgagtcgtggacccggcggatcgggccaaagaggcttttctgggctcacggaccgccgctgcgccgatacactacacacactgtttgacccgaccccatatcctcctcttgtctccgccgcgaaaccgcctgccccgggggtggacgtggaccgagccttcggtacaccacagcagcaaaacggatcgtacgcgacacggggacacgcaggcgcaggtccgtctaatcctacctgaggttgcagccttcggctaaaaagctctactgtttccacaccaacaaagcagagcctacacgctgacatgtccattgcttctgctcccgacagatcatcctcgcggcttagctgtggaccgggtgcatg

SEQ ID NO: 21212 - DNA, 1501 bp, Oryza sativa
ttaaataattgacgaagtaagcatagctcaactaaggccgtgtttagtttccccctattcccaactttccatcacatcatatcacatcaaaaattttcctacacatataaacttccaactttttttccaaactcccaactttcttcaaactttcaacttttttcaggaactaaacacaccctaattaagttcctcgtggttgatttgacacgggtggttgaactagtccaccacatgagctggttaaatttcttgtggttgaaccagtccacccggattcaaattttagatttgacacggatgcttgtattttcagctaattaagtttttttgttgttgaaccaatccaccgggttcaaatcctaaatttgacacgaatgctcgtattttttgactaattagtgtaatttcatcaatcttaagatatgccgacagtcttctaggggtaggttgcactagtagaatcagtccatccgggttcaaatcctaaatttgatactgatgctcatattttgagccaattattggtgacttcgtaaatatcaagatataccagcccagtcttccaaatatgctcagtgcaggtacaatagtagactataacccatctataaacacatatcgaggagagagaagaacaatggactacaatttataaccaactgcagcacggattcctagacacaatatgtgtataaaaggtgggaccatgtattaatagtgcaatatatgtttacaagggcaattgcaaatttaccactactttgaatcgttattgcaaaattaccactagaaaattacaaaaataccactagaactgttattcgacatccttcaatatttaaaaaaactggtggcaaatttacaaatgcccagtttataagtaaccattgtatgaattgactattaagttgactataagtgatttagagttactagttggctatactattaaacttgctctcaaagggctaattattagtgacttcgtcaatctcaagatatgccggcccagtcatttatggatggggtgcgcgttgtgagctcctgcgtttgtactgtgtttaataaaaaaataataataactgagaaataagggtctgttcgatttgatgccattttcaaccttaccaaattttggtaaagttgccaaaaagtgattacatttagtttgctgtcaaattttggtaactatataagaaatcctaccaaaattttggcaagttgccaaacaactatgtaaatttttggcaacttgctaaaattttaataatgacaaaacttagtaagttttttttggtatcaaagtgagcaggccctaatattgccatgtggggctcctctcctcatctcacgctgacacgcacgcacaaacgctaatgacgacccaatcagcagcagcagcctctctcctactaataatctccccaagattggatcatactctcatctcatcatagtctccgcccatccgccatcgctcgcagatctctctcgctct

SEQ ID NO: 21213 - DNA, 1501 bp, Oryza sativa
aaattttgcacggtttcatacagtttttcatggttaacacggtaaccatgcttaccgctagggccgagcgcgataacctcggccccggtggtttgtgaaacttctggtaagcacactgtcagtaagtgggttcatcagagtaacagtgagcctgcatacacttcaacgttgcatacgtggcgccccaccacaccacctcactggttcacttcactcacccaagtcaccacctcacctcaccaccacccacctcgtcttcttcttcgctaagcctaaaaagaaaaaaaaaaaaggtctccctcctttttcttctcttcaaccccctctccacgcacgcgctcccccccgcgcgctcgctaaccctagccatggccgcaccaccatccgaccactagccgcggcggccagcgacggcgaggcccccccaccccgtcctcctcctcctcctcatccgcttctctccggtccgtcccttcgttgactgccgctcggtttgcttccgagggttttcctctcccgctgctgctgcgagggagggtcgatccgttcctccgctgggcgtgcctgtgcgggtgctcctcctcctgcttcttccgcggactcctcctcctcgaaggtatatcctctcgaccgcctcggagtagtcgtcgcgggtaaagttgggggaatccacccggacgttgttgatttctgtgattttcttatggtgattatccctagctcgtttgaatttattttgggggaaattgtgttgtggcacgctgagaggctttctactccactgaatcggtgaatcatttaacctgattgcggatttgtcaagcttatgccgtagtgtgatagtgttaaccctccatggcatctcaagaaaagaaaagagagaaattggggatccgattgccttcccctctttgccccacaccacccaatatccccacgttatgtccgccactagctatatttttgttatttttaatagtttgtgccacacggtttttgagttgaggctcgttcttaagctatgaacagttttttcctatgaaccaatggaaaataggtagggatttatgcgcccatcaggaaaaaaaaagaattgcggactactagttttaagtgactagtggcactggatttctaaccttatgggagatcgaggagaataacttgtttctttaatagtatggcttcccttttttgatagataaggctaagtggggctgcagaaggttgcaatttcttggaagcctgttttccttatttgggcacagaaagatggaaagaatgtccttatgaaggctaagacatgcgaccacctcaattacttatctgtcgtactaaattatgatttgtgcaccatatagcttgtctaattttctctctacttgagtggtaatccagaaacattatcatcatcgttaatctctgcaaatcttaatgaacaaagtattttcgtaacagtacctctttagcttttttttttcaaatattagttctgagcaat

SEQ ID NO: 21214 - DNA, 1501 bp, Oryza sativa
atccagtgggttgtagaggtaattaagatagagagaaatggaagacatgattaactgtttattactagtgctactgatttcctatgcataaattcatattattttatatatacatatatatgacatatccccgtatgcgtgtttttcaaaaaatgtcgtactccccgtatctgggtaacatagactgtaaccatccaacctcgttgttgccttggcatgccaaataagaaatccaatataaaacccaaagcaccgagtagggaacaaaggagatcttcgatggaatagtttgccagtcaacttcaacctaagatgtacctgccagaccgcacgaaggcggcgactaaatgtgttacacatctcaggggacttgactgaaagtgctaaattccacgatcatcgcaattgctcaaaactcttactcgtgatcagctagcctcaggaagttgctagcttcacactttcatcttagctagaccaccaaaacacaaaggcctaagttaaacttaggaacaattaaagacatagaactaaatcataaatataaggccgaccagccaatagtagaagtttagcagaaagcttgtctacccttccacacaagcaaaccgactaggggtaggcccctagttagaatcatgctgaaaccctcaacctaagcaacaaaataatcaacaagcaagagtcggtacattatataaataatgtattggcaaagccacgatcaaacctatgcaagctctaaatcaaaggagggctatttgtggtttcattttcagcacaaagcaaattttgtttcataaacattttgcaacggaacttataacacaagttaaagcatgtacatgatataaaacattgtgatccacgtaagtaatttcaacaatataaatatcatatccacacttgcaccatcatgccatcataatcatcataagtatcataaactcccaatcccatggcctatttcacacatttaaaagaacaaaactatacttatggcgcacacactatgccgctcatgaccatgagcatggctaatcgattattttagactctcaagagtttgtaaaaaaccacatgatgtgaatcgctctaatttatctggtacccgtcggtatcaccacaccttgcctattgaatgcggcctagaggtcacaatgagggcattacatttcccaccagcacagatcctggtcttcacctgcggcatgacggattcgcaaccagttagtgccccagatcaagccgccatcatacttgcacagctcagctgccactgggcgagggatcggcagatctgcagagccatcattttcatcttctagtgaagtcatccctccaaggtgttagaaccctagctcacgattcacacaagcacacaagaacaagatgatacgaggaactcgattgatagatttctctctcgcgtccaaccggaccgagccaccgtcgccaacgccgccgccgagttccaagccaagttattacaactgttgtt

SEQ ID NO: 21215 - DNA, 1501 bp, Oryza sativa
gtaatcgacaagaacttaaacatccaccatacaaaggaaaagttcaagttcagatttttcttcttgttccatttctgttcgggagatttttttttttttttacgaatttgccagatcaagaatgcttgaggttggtgggtcgacaattaaccaagtgaaccttgaatgctcgtaactactcctcacaacaaagacagagaaattcagctgtttgtggggggtacatgtggacggctacttcagatctgtctcatgatagtactactagaactgctgctactactttcatttttggcgatcagatatcctgtcagttccgtgccaaattcatggtcctgaatcctgatagatgggccatcactaattacttcaccgtacgttgtagactagtattagtagtataatctttcggtgtcatgtggaaaggtcaaggcaagagagggacctgtcaccggtccgagatatgaatatacttcctccgtttcacaatgtaagtcattctagcattatctatatttatatggatgttaatgaatctagataaatatatatgtttagattcattaatctagattcattaacatcaatataaatgcgagaaatgttagaatgacttacattgtgaaatggagggagtactacgatgagagggtgattgattccatcgattttttcgcgttgtcttcctctaaaatcatgcaccgtgttgatcacatgtcgaaatcggcgcaggcgatcgttcgttttagggattctgattgtgatgatgctagcaataggctcgtcaggtgtagggtagtacggcgactcaccgcgggcgccgtgcgctgtggcacggcgaggatgccggagccgatgctggtcccgaccacgagcgcggcggcgccaaccacgctcccccgcttcgcgccaccgcccgaagacggcgcctctgccacgcccgccgccacatctccctccccctgaggcggcggccgcgcgtcgccgccgcgcgctcccgccgctctcacctcggagacggcccgggccctctcgccggtggctgcactactgccgcaccactggacgccgccgccgcgatggactctcctttccggcaagcatgtcgtggtcgtcactgggatgcaccggtacggggcgcggtggaatctagctgggcggtgctgcaagcgggcgcgcgtgatggcgccttgcatcggggaggtttcttgggtgtttgtgagctagagctgcggactggagggaatccccatggcggtatattcatcgtaggagtgacggagtgcgttgtcgagtgtcgaccacacgatcatgtggaatcttgagctccggtggtgggcggtggaagcggaatcttttgcagttgtggagcaggagcgcgcgcggacggacacggttgccgtgagactctggaccatgaaggctgattttgtttggagctatacatctccatcagtggtttgtggctgacaatatgtgaaaaataaacttcgaaaataga

SEQ ID NO: 21216 - DNA, 1501 bp, Oryza sativa
gccattgtgatagccaaggtcagtatatttgcctctgctacatgaacaaaataatttgttgatttggtggactaacatgatgctgtggattatcctcagaataactgcatgttaggcatgggaagtggccagccaaacagactggagagtctgagaattgctttcaggaaagcaggagaggaggccaaaggagctgctttggccagtgatgcattcttcccattcggtaagaacaaatgttgcattactggaaaatctggactctgataatttcctgaatttgtttgcacacaacattaacatagtggcaatcaaaacaaaatgataatgcaaacttcattaatagttggatttatgtttgagttatgacccaggcaaccagcatctgtaggttctgagccaattcatttgctgatcagtagtagttcaatttatgtttgatttatgaccaagctaccagcatatgtaggttctgaaacattcatttgctgatcagtagtagttgaatttatgtttgatttatgaccaagccaccagcatccgtaggttctgaatcatgaaatacttctcttttctttttaagaattacattttaccattgcaaccaccattaccatgttcaacgattacttccttgcacgttctgtcacacacactacaagaacagctttgcaatgttgtcacattttgtaagaatcacatttttcgtgttcgttgatgccttccttacaatgcaacgacagcttggaacgacgccgtggaggaggcgtgccagaacggcatcggcgtgatcgcggagccgagcggcagcatgagggacggcgacgccgtcgactgctgcaacaagtacggcgtctccctcctcttcaccggcgtcaggcacttcaggcactgagctagctagcctcatgaaccttgatcttcctgcaaaaaaaggaaaaaaaacatgggcatgtcagatcgatcgctctttctgtatcacaagagcatgcagatcgaccagcgtttgatcaccttgagaaaaactcttgacggcttgtactaggctgcctgccactggtgtgacagaatttgatcagcttgacattttgcaataagattcatggtgataataagattaggatgtctcgtactcattctaaaattctctatgcgagtttgcaagccgcacagcagcacaggtacccatcttttttatttgtcagcccagtgtgctaggctgctagctacacatacagaagcatcttgtacatgtaggtggcttgagcatgcatcggcggtgccatcgccggccggctcgccggagggacctcgcctccggcagcgccggcggtggctagcaggcaggtgccgttggtgcatccactgtccttggagcaccgatgttaaaactatataaaattttagaaattaatggttagagatatataagtttttagaaattataatggtgagatatataggtgtttgggttaggctgtgttctttcccatgggttccc

SEQ ID NO: 21217 - DNA, 613 bp, Oryza sativa
aaacattttgaaacggagggagtataatttttttaaggggggcaaatatgtgtgttctaaatgcttaaatgcatgcagcatgcttaacaacagttagttggctttggtgtttcaatgcctatattcttgtataataccattcgatataaaattcatacgtgtgaattttaaaatttagcactttgcacgccatattctagttgatgactatgttccgttgagatccttttgtactggtttattttagttccatccagaaatccatgtagatatgtttgatttgttgcgctgtttatattggttgaatgttttgaacagataaatttggtgccgttgttttttctattcccattattttctatgttctctcaaagagtagattcatgcagcatgctcaaagatgtatttcaatgtgtgagctaataacaagttcctatatcgaacagtgaacttatcatttgctgtttggcaaagttaggctttattctctgtaataagcttcttattatagtttattttgaaccatgattagatttattttgaacaaatcaattttggccctgtactcctgttgatttctatacgcccattgatttttgtgttttctcattct

SEQ ID NO: 21218 - DNA, 1501 bp, Oryza sativa
tcactgaaggagttaggcttacgatttttcacccctcgtgaggtatgtgcttattgacaacttcacataggtccacacccttccgtatctatgttttgtctcatagcatgcaatattcatgatttttcaggttgctaatctgcattcttttccatcgagtttccactttccgaatcacataagccttaggcaacagtaagttttaatccctaccttttactctgttggaactcaatgaacttcaggaacatcataatcgcaatatatataagaacatgaatgtgactttctagttttgaaaaccagaccgcactgcctgaattgtttgttatcgctaacttacctatggtggcaggtatgctatgctgggcaatagcctgagtgtagcagttgtggggcctttgctgcgttatctgtttgctgagacatagtgatgttcaatcagttggcacatgatgctacacaggacaaacacattgaccttcctttgcccgtgttatcaccctaaagccaggttggttcgtgggtatgattcgtgtactccccgaagctgatggttgtggttcaaaccttgcaacccaattggagtgaatttcccacagtggtgcaacttcaacttcatagggcttggggacttgtcgattcatcggtgggaagaagacagcgtgcatgatggcccggcatgtatcggtgaaactctgacgcgaatcttacctagtagagtagagaagcttcctcagcattttccctttgccccaggcataagttttaataataatgttgaatgtttgaggtgttacagcatttgactcatgcgcattgtgaaacgaggttattatggtttagaactgaacttcaacttcatgagctcaccattcgactgtctcaaatcagtttgctttcttgatctttctgcaaagaggcaatattttgacgacacatttgccccgtgtacctcagttaaacagtagatctgcattcgtttagctatagccaattcttgtgaaaaggaagtttgaacatttttttcgtgagaagtttctacccttaaattgataaattgaagtttctcaatccctttattttgttctacaatatgaacaaaatgttttgagaaagggtcaggactgctcgttaacacgtggatcctcagttccacatgtcaatgtgcagtgtgtgtacagcaccgttcgctaacacaggtcccacagacactcgggcctacatgtcagcgaagtgaaatgtttcaccatgatcgatgttaaattgttaatctaccagcagctccaaattcaagaatgtttgagttagaaaaacacaactgaaaaagggtctatcttttattttcaaacttaaatttagagctgattttaaggttttttcatcaaaatttaattttttagcctttacttttaattgctacgaatacttatataaaaattttatttacaaattactttttatttgcaaatatgccgttcacatgttctctgcttgctga

SEQ ID NO: 21219 - DNA, 1501 bp, Oryza sativa
tatcaaagagctacaaagtatcagccagcctctcccttgttatgggctcctaatctggaaaggtccagtccaagaaaaagctctctctcccccaaaatctatctccccttctctccgtgggcaaggtcctccttttatatcttaaggggataccacatgtcccatcccccttttttatggggacttaccctaccttttcataaatggacggagatctgcatggttgccgtttgagtcaccttctgatgggacggcccgcacctacctccactttcgccgggagcaggcgcgacgtagaatcatggctgtctgctggcgacatgaccggtgtcagaatggtcacaaatcggtcattcttgtcctccacgcgtcagcttaacaatctgcacgtcggccctccttcacactacattttgcctgtaatggttaggatgaagcctggcatatatctgatcagggctaacgtgccatctctgggaggtaacacgctagctccagctggggacgagcacctagaagccctcgtcctgacgggatggggcgaggcgtgcgtcagaccgcctgtcgccacctaatcccgcgatctgaccggtctgtgactggtcacagactggataaatgagtgcaatgcactacgttacatgcgtcgtgacacgctcagccaaaccgcaataaatgtggttaggtgagccccactgtgctcacctaccccatacacgcggagcgaaaacccacgaggggtcggggcgcctcggccctcggggccgaggggggtgcagcccgaccccctcggggggactaagaggagggcgaacacaccaccttcgggcccgacgtcccccgagggtgccaggccacgtgggcgactgtgtctgcctcaaacctctagtcatgatactcccgatcccatgtcaccgacagtagcccccggcgttatgccagggcgatcgccctcctcaagggaagcggtcgggcgtgacgccactcctaaggcccggtgacaggtgggaccggtctccacaattgggcagaaaaccaacggtcaaaaatcacgcacatcggcaatggtaactcggctgtcaataatgagcggtctcttcaagactgccacattactcgagtagcacacgaatctggacatggcgattcgtttcatctgaagatatggtaacgtcgcttcggttggcgagcgtaattaacgcgcgcacgatatgatctacctcgaccgccacaaccgcatatccacctcatgcgccgcaagcgggcgaatgggaatagtggaagcgtgggcgcgagaaacgagggggcgaaatagtgggcgcgagaaacgaggagccgggcacagcgttggcaagggtataaaggcactgaggaagggatttgtttccttcctttcgccattattccccttgtctttgccgcttgcgccctaactccttctttcctgcgccctaccctcgccacacgcgctcgctcttaatcttctcttcctccggcgcca

SEQ ID NO: 21220 - DNA, 1501 bp, Oryza sativa
tcaatgtgaaacatattgataagtatatgttaaatattgtaaaagtgatagatagatttgttaaaatatcgtgcaaatgatacgaggggtgatgattcaaggtttcaaacatgctgaacatgctgctacccagtcaagtgaaatgtccatgcatgtttggttttcaccttaatattgctatgttgtaggaagcaaacttatttagcaaactgtaagtttttattatactatgcaacaggtaggaaataataagaatacctggtgatcagagatcttgacaggcaccaggaagaagtcattgtccacctccatagcatcctttcccccagccaccacctctttccgcatcttggacaggcggggatcgtctttgtccctaatcttcgtctgcagcacaccatccttgaatagcttcacacaaagtagcgaaagagagagataatgccagaatagattgctagtgttgcccagcagaaaaaggaaagtctgtaaattcattctcacctaagatgaacaacagaggtctgcccccaattctgtgtgtctgcaaaaatcaaccaagaaacaatgaggataatgagcagcacaaccgaattagccaaggaggaagatttcctcttgttggctaaacgaaagaaaaaaaagggcaccaattaacctgcagcagtagagtgggcgagcttccaagagagaggaaccgatgatagcagcacgagcaacagaagcaaaggtgctgctgcccttgtccgtggccgccgtcgtcgtcactaccgccgccctcgaccgctgccaccgccctcatccgtgtccgccgccgccaccgtcgagtacagccgcctcgtcctcgtccactgccgccctcgaccgctgccgcctccctcttccgcgtccgccgcagccgccctcgtccgcgtccaattccgccgcgctcgtccccgaccgccgccaccgtcgctgtcaccatcgacagagtctgtcaccgccgtagtcgctgttgctgggggaggcgatacggtacaggaggcgatgcggtggggagcgaagggaccgagggcatgctccaaaacgcaatgaggaccactgagatgtaatccaacggtcgataattaaatgatgacgtggcttcaccaaatctcagctttgggtcttaactttatgaaagaagggattatatgggactaactctaaagaatttagctccagaaaaatttgcctgtcctcattttctttaaaaaaaattgcctgtccctgctagttttatagtttccctccagtccatacatctctgtcccacctcgtccacatagaaaagccctagccgcctccaccaaaatatttcccttcttcggtgaaatcagcggccatgctctagtgtcatgccattatctaaggtcattcttgcttcccgcaactctcctgcatcgaatccctaaactttccacccaaaaaacacgctttgtggccctaaatcctctattcgtcatcccccattacctttcca

SEQ ID NO: 21221 - DNA, 1501 bp, Oryza sativa
cagcttcatccttgacttgaacctagcaacgaatatagagtggtcatcattgacatatatgtcatgttgcacttggaacaaatgaaaaggggtagatgaagttagaaatctgcataccataaagggctttcttctgacaagcccacttcgagttctagagcatgaactgtcactgtaatccatctggatgctttctctgacaagcccacttcttgttcttgaacatgacccctctttggaacccacaatgatgtttcctctaacaaacctgcttggagttgcagaatatgaaccattactggcagccacagtagtgtttcccctaacaagcccacttcgtgttttagaggatgaaccttcactgaaattcataatgtcacctcccctaacaagcccacttcttgttttagaggatgaaccttgatttaaacccacaatgccatctcccctagcaagcccacttcgtgtttagaacatgatccctcattggaatccaaagtggcatttcttctaacaagcccacttcgtgttttagaacataaatctcccacgttggaatccacaacgccatttgccccagcaagctcacttcgtgttgtagaatatgaaccttcattggatctcacattggtgtttcccctaataagcccacttcttgttttagaaagcgaaacctcattggactctacagtgctgtttatcctaacaagcccacttcttgttttagaaaacagaacctcattggactctatagtgttgtttaacctaacaagcccactgcatgttctagaacatgaactgttgctgtaatccataatgtttttcccctgacacttggtgttctagaacatgtgaactcctgtggaggttacttcagttcacaaggacctgttcaatcacaacaaaatataaataaataaaatttcctgaagccacagaagagaacaataaattcattccataaaatcaaaatagtctgatgatgacgatgatgcccgattatttgtcaggcccaatgttttcaatttgtccgactaatcgcgattagtgtcctggccggtactaaggtggcttgattctaaccacgattagttggaaagtcactcgattagttgttattagtcactattagtcatcctagtcagtattgaggcgactagactgtctttccaatttaaacacattgctcagaactaatatttgaaaaaaaaaagctaaagaggtactgttacgaaaatactttgttcattaagatttgcagagattaacgatgatgataatgtttctggattaccactcaagtagagagaaaattagacaagctatatggtgcacaaatcataatttagtacgacagataagtaattgaggtggtcgcatgtcttagccttcataaggacattctttccatctttctgtgcccaaataaggaaaacaggcttccaagaaattgcaaccttctgcagccccacttagccttatctatcaaaaaagggaagcc

SEQ ID NO: 21222 - DNA, 1359 bp, Oryza sativa
ctctcagtttcaattttacttgtcgtttcaatttactggttctagtattcaaaattttgtcaaaatatttatcattttcatattccaagcactttaaagatgtttttccctactattcatcaatatatccatactaatactactcctcacattattttaggtaaaattggttaggatttaattaacttagcatacctcctgtttaatttgagatttatgtataacgataaataaattgaaatgaagggaatactaattaacggactagagagatatcttcatggatggatgtttttttctgaaacaaattcatggatggatgtggattattcgtgctacccacggttggttggtccctttcataattaaggagcttaactctctctatatatagtcgcagttcttactattacattaccacttctttatagggattttctaagatccatgttttactttagactatgtgtatatatgatgacaatatattggtgcgtgattgtgctctgacgatcgaatagctcaataagtcttctcgtaacattgtacaagtgcaagcgctggtcacatacatgcacgcacaacctacccctacctctgtcatgactcatgaggacatccaaggaaatagggtcgtcacatctcgagattaacaaagtcactacatatgccttattattaacgggtatgttgtctagctatcatcgaaaaaataattagccataagtacaagcacttacgttgaatctaggacttgaatatggatagataagttttatcacaagaaaatctaagtagttgagaactacgcttaatccaaatcaaaatagacgcatacgtacgtctaaacagattgaaggcctgaacttaattatatggcccagtctaagatcaattgaaaccaaatgatcgagcaaggcgcgcgcggttacaccacgtatagaacctaaccgtgcatgtgttttatagtaggacttgatggattaatttttctcttgtcggtgcgtggaattatccggagattatatccacgtgcaaactaatacctaaccaccagccagtccccaacaatatactcccttcgtttcaaaatatttgacatcgttgactttttagcacgtatttgaccattcatcttatttaaaaaatttaagtaattatttattcttttcatatcatttgattcattgttaaatatactttcatgtacacatatagttttacatatttcacaaatttttttaaataagacgaacggtcaaacatgtactaaaatattaatggtgtcaaacattttgaaacggagagagtatatcagctggccaaatgacaacagatcatcgtcgactttataacagc

SEQ ID NO: 21223 - DNA, 721 bp, Oryza sativa
taaccattacaggcaaaatgtagtgtgaaggagggccgacgtgcagattgttaagctgacgcgtggaggacaagaatgaccgatttgtgaccattctgacaccggtcatgtcgccagcagacagccatgattctacgtcgcgcctgctcccggcgaaagtggaggtaggtgcgggccgtcccatcagaaggtgactcaaacggcaaccatgcagatctccgtccatttatgaaaaggtagggtaagtccccataaaaaagggggatgggacatgtggtatccccttaagatataaaaggaggaccttgcccacggagagaaggggagatagattttgggggagagagagctttttcttggactggacctttccagattaggagcccataacaagggagaggctggctgatactttgtagctctttgatacacagatctcccaaaaacacaggagtagggtattacgcttctcagcggcccgaacctgtatacatcgccagtgtcttctgtgcttcctgtctcacgaaccttccacatacagattgggagtttagagtttcacccagggtccccggccgaactggcaaaggggggccagcgcggtctcccggtgaggagccccacgctccgtcatctggcgcgccaggtaggggactctgcgagtgatcttcagagctcttgcgctctttcgtgtgcaccaagcttttcctgttcagcctca

SEQ ID NO: 21224 - DNA, 1501 bp, Oryza sativa
gacgccacactgtcgagaggcttcatgagcgtttgttccgaacagaattaaacatattcccgaatattaattagacgttcgacctgatgattctagctttcgtctacatgtacattgtcaaaactaaagcaagtccgaagaccattactcctcttactcctctcctctgtttcatattataaatcgtttaacctttttcctagttaaagttcgctatgtttgactaaatttataaaataaattagtaacatctataacaccaaattagttttattaaattcaacattgaatatattttgataatatgtttgttttgtattgaaagattattatatttttctacaaatttggtaaaacttaaagatgtttgattaagaacataaatcaaacgacttataatacgaaacggacgaagtagctagctagcaggctatatattgatctactagctacctctgtttttttagtaatcgacagtaaataatattgaataaacacacaaaatttaaccactaatttttttccttcagaatttataaaaacatgtgattctgcaccactgcattaaaataaaattcaaaatgattctaacagtatgtgctttagtgtacaaaatagaataaattagtgttcataaaagtttggataggagaatcctctgttttcaaatagtcagtgatttataattaatgcaagtgttaatatttgcattgtgaaaaatatcattttgtttgttgtagaaacaatacaatgatgcatgcaatattaaggacaatttaaatgcaggagtaaaatttttattaaagacaaagttatatgaaggaaaataaaatggtaggggatcaaaaaccatttttatgccattatatttttaataactttaaggaatacacagtattaaaaaataattatcaaatgttattgtttcccatgttagatatgtctagaacgactactaagatagtattaaatacagagatataaaggaagtctccaaactttttgtttgaattacaaacccaagggctaaagtttattacctgcatgttaattgaaggaaaaatatctgcctcgtactgcactgataacgtacagtggattgagaaaatattaattttggattcatctactagatttactagctcttacaagaggattttcagtaataagttagcactggtacttaactagcgaataacttcgcaaaattctgctagtttaatttattttcaaacaaggattctctctccaacttgtcaacaaaatagcactatatagctgacgaactcttacgttacaacattatagtcgcagggtcatcttcttcttttcccctttcgaaggcattgtcactttgtcagccttctgctagcctttggacttcaaatccagcaaccatctgaaaagttaaatggcaagtaattcagaaacagaaaagcatatctgctttgttaattagtttgttctggtgatcgtagtgcgcgtgtgcgtcgatgttata

SEQ ID NO: 21225 - DNA, 1501 bp, Oryza sativa
cttcaccgttcattctcgcccagttcgtcgtctcgcggtgccgcctccgtcgtgggcatcgctgcggcgtgttccacgccgtcctcgtctccgtgcagccgctgccggctgccctcgtcgcctcctcgccggccccggtcgtcgtcgtcgtcgtcctctcgtcgttcccggtcgtcgtggcgttcgtccctccgtcgagccgttctcgtccgtcgtccgcatccgtcaagcaagccgcggcagccccgtcctcgtcttcgtcctcggctccgcgtcgtcaagccttgtccaaggatcgccgccgaagtcgttccctcaccgttcgcctccgtcgtccccgagctgtcttcgccgcgcccgttcgtcgttgtcgttcccacgcctcgtcgcgtggtggtaaggatccgtcctctcgcttccccgccctcgtcctttcggtgtcgccccgtacccgttgtgcggttgtcgacaccgatacccgtgtaccggtgtcggtagtcgttcgcttgtgggtgtggtgaccgtgttagtgtgcccgctcggtagccgcgtggtttctacgtgtgcagcccgtgtggtgtctagtggagtccgtttgttggccactcgcctcggttgacacacggggtccgcttccgtcgacccgtggaccgtctctgtgtactcggtctaccgtggtcctttaggttgacatgtggggtccgcatgtcaacagcgcagccttcctgtctcttccaggctagcgcttacacatgttttataattgcaaagcttaattataataatccgcaaatctccatataacagcactaaacttcggatgatcatatcttggtcatacgaactccgaatcgacccgttcaagtctcttaatgtttgttataacctaaagaaccctgtgctttctttttatgtattgttattgcttctttttaggcttgtagctttgcttgtgtgtttcgcgtagtcttcgtcgttccggaggttcccgaagcgtggttcgtggtcgtcgctgaaggttcggaaggccgttctctctgagcaaggcaagtcacatcatctttgaacatattgaatcccaatttataaaattatgttgatttaaattattgcattatcgctttatttaaattcccgcgttatcactgttttatctagccatgcctatttacctttgttatgaccttattattgttattgttattatttccttgttcaccctagagtaaacaaaaccccaactagtggacactctactcatggcaccactagtttaattttaggtagatgcttcgcaatttaattaggtaacattaggtggttttacaactctagactttgggaatattcatatcatttggacactatggaatggttggcttatggtggaattggacatacacctctcttcctctttcaaaacccctaaaacctgttttccggtggggtttgggtgcatgccagttgtgggaagtagcaccccggccactataaggattaa

SEQ ID NO: 21226 - DNA, 1501 bp, Oryza sativa
ttaaatataggatcaacatgctcaaaggaattgtgtttgggatctatgtgacttgccttgcaatattcggtcttcaattaatcttcttgaacacttccgacgcactcacgatccttcgaaacgacaagctaacacataaaacaaggaaaaagactaataaaaaccaaataaacaatacatataaagtaaataaacatgtagatcatgattttagatgaattatgagacttgaacggcctcattccgatttcatataaattacttatgaattttataagatttaattccaattaaacctattaaagaaaaaactattccaaattaattaaacaatttacaaatgatttataattaagaaaagattaaagcaacattcagaaaagattaggttatatttagtagatggcatatattaaaaagaaataatatgccactgaaaaaagagaacggatagaagtctcaccgaaccaaagcgatcagagagaaagggtcgacaatgacggtccggctacaacacacggagatgacaacgctagacaaatcacggattagattatgttggattaagaccctagggaaaaacctacaccggtgaacggcataggggcagcggttgccggcgaaccacggcacaataatgcaaacggagggcaccgggaggaagagcacgagacgacggtccttaccaacacttacgcgatgacggacagcgacggaagatggccggcgacgagcttcgaagggcggcgaggtactgtccacggcggcgacgactttccggcgatgtgcggcaacaacggaggggtggccgggcttcacttcgcagctgcgaatccaatggaggcgacggcaaagcttggcgacgacggaaggagcagcagtggcctcgccggagatcaaaatgcggcggcgagcttcgggttgacagtgtcagcggcgctctggcgatcttcggcggaaacggaggacgggacgaggacggcgacgacctcgcgatgctgatgaaggagacggcgaccgacggcgacgaccgaagcgacggctaggggcggctggagcggcgccggcgcttggagagagaagaagagcgcggggagagcgattccgacgacggcggaagatggaacttgaggggataggtagaggacgacgagggggtcctttatataggcacaggagctcgggttcgggcccaaatcgacgggaaaaactcgggaaagtttaggatcttcgccggaaaaaggaaagattgatccgcgaaattggaaaggatttccatagaaattttggggatttcttggggaaaaggaagaggagattgagaggattccattcccacaactaatttggaaaaaggagcaacggagaggccggatttggaaggaggaggcggcggcaactgtgcacgggctggagacagtcggctctgtctaggggttgaagacaacactgtagcgagagggacgaaaagcagacttgtctgcgggctgagaggaaggga

SEQ ID NO: 21227 - DNA, 1501 bp, Oryza sativa
ctcgcgcccactatttcgccccctcgtttctcgcgcccacgcttccactattcccattcgcccgcttgcggcgcatgaggtggatatgcggttgtggcggtcgaggtagatcatatcgtgcgcgcgttaattacgctcgccaaccgaagcgacgttaccatatcttcagatgaaacgaatcgccatgtccagattcgtgtgctactcgagtaatgtggcagtcttgaagagaccgctcattattgacagccgagttaccattgccgatgtgcgtgatttttgaccgttggttttctgcccaattgtggagaccggtcccacctgtcaccgggccttaggagtggcgtcacgcccgaccgcttcccttgaggagggcgatcgccctggcataacgccgggggctactgtcggtgacatgggatcgggagtatcatgactagaggtttgaggcagacacagtcgcccacgtggcctggcaccctcgggggacgtcgggcccgaaggtggtgtgttcgccctcctcttagtccccccgagggggtcgggctgcacccccctcggccccgagggccgaggcgccccgacccctcgtgggttttcgctccgcgtgtatggggtaggtgagcacagtggggctcacctaaccacatttattgcggtttggctgagcgtgtcacgacgcatgtaacgtagtgcattgcactcatttatccagtctgtgaccagtcacagaccggtcagatcgcgggattaggtggcgacaggcggtctgacgcacgcctcgccccatcccgtcaggacgagggcttctaggtgctcgtccccagctggagctagcgtgttacctcccagagatggcacgttagccctgatcagatatatgccaggcttcatcctaaccattacaggcaaaatgtagtgtgaaggagggccgacgtgcagattgttaagctgacgcgtggaggacaagaatgaccgatttgtgaccattctgacaccggtcatgtcgccagcagacagccatgattctacgtcgcgcctgctcccggcgaaagtggaggtaggtgcgggccgtcccatcagaaggtgactcaaacggcaaccatgcagatctccgtccatttatgaaaaggtagggtaagtccccataaaaaagggggatgggacatgtggtatccccttaagatataaaaggaggaccttgcccacggagagaaggggagatagattttgggggagagagagctttttcttggactggacctttccagattaggagcccataacaagggagaggctggctgatactttgtagctctttgatacacagatctcccaaaaacacaggagtagggtattacgcttctcagcggcccgaacctgtatacatcgccggtgtcttctgtgcttcctgtctcgcgaaccttccacatacagattgggagtttagagtttcacccagggtccccggccgaactggcaaaggggggccagcgcggtc

SEQ ID NO: 21228 - DNA, 1501 bp, Oryza sativa
aaaggatatattttagggtcgttttgggacgcgacaaagagcgtgccaactggtttgatcacagaaaatatagttagcttcacgatagccgatcgctcgataagccgatgacgtattgtttaatacctagccgatacgctcaaaccagatcggctgtatgtttatgataaaacagatagggcaaaactctaaatatgttctatccgctataatattgtccttttattttttgtcagtcaattttggacaatactataaagagccgattatccaatacttagagcaaagtagataaagtaccggatattactccaattaaccttatgtaaacaaatcaatctcagatacaatgatgtaatcaagattgattaagacttgatatatttagatagagtgatctctctatataagtggcatatatatatatatatatatatatatatatatatatatatatatatatatatagaactactatacagcaccctaaggtgctaagtattaaacagcacctgatacagcctccaaccccaaccccacccacccacgctcccaccaggtccatagtacgcagttaaaatttaactcacagacgaccaattttaatcccacccttgcacgccctcccctcactcccatagtccgggtaaattttttacttgatgttatccaacttcttattagttctatatatagttaaaatttaactcatcgacgaccaatctcgatcccacccctgcacccctacccccactccaatagtccgagtaaatttttaactcgcgcaccactaagagccacccccacaccaccctgtcaacgctcctgcccaaacaatagtaatttttttactcacaccaatagctctatttataccatccataaccatctcactgtatccaaacccccattcatactcccgtcctcttccatttttttcggatctgagaaattggggattcagcggcgacgggtgaccggtctgctcgtcggggcgatggtgtggaggccgagctccgagtggtggcgaggagatccatcagtgaggggtggcgtcatcatacacagcgcgtgtgtagcatcacgaagcaaaatagcgcgactctgagcgcttccttcccacaccacatccggattttccgttttttctctgttccgcttatccaggtaccaaggcccgtatatatatctttaccaccccttccatcacaagtaaaaaaatttctgattcaacataacactgagtaaaaaaattacttctatctctaccctaatttgaactgggagttaaaaaatcactctcgagtaaaatatttttcacattcactgagtaaaaaaattacttctatctctaccctaatttgaactgggagttaaaaaaatcactctcgagtaaaatatttttcacatcagatcagttaatagtaaaatttttactcatgtatttttttatcactttccggtgtgttcataataatacttttattcatgtctatttaag

SEQ ID NO: 21229 - DNA, 1501 bp, Oryza sativa
tcttctttgaaacatgcatgaaatcggattcgcttgaagcaggtggcaatgctatttcaactctgtgcacatgtgtgaaaggacaaagaaaatatcatttcaatggtgattcttcttagattgaaccaaagtatcaaatcattttaaaacagaaaactcccagccagccactgagatctacaaacatcaacaggaaaaaaaaatccaaatcatctgcatctatgactcagctgcatctgccatctctgtcgccacgcgctgccctctatgacaaaaaggataacaattgacaagcaaagcatacccggaactagaagccagcaaccgactgatgcggatttctctgattttgtttacacttcagttcacctaaaaaagtcctaagcagtaagctactagttgaatggagatttctctgtttcaagacagtgtgtacttgttaacgacaaaattgctccaagcaatatttgccttcccatcaatatacaactagaagcatttttagcgatctattccaattcgaacattttgctgcaagtatcatatcaagtatcatatgattcagcacacacacacccctcacctctggtacaaacatccccagtgaatgaacaaaaatgcatagaaaaaagagagagtattagcttactttgatttcaatttggatgtgatatgacgagccccatccacaggttggggattcaacaaaccctagaaaatacaaaaatgaagagatgttaaaatcgaaatcaggaaatcgatgaaaaaggagtgataacaatccggcccaggtggggttggccgaggcccaataacttaagattggctggaccccaacagttcataggcacacccactcggggaaaggcccaatctccctaaaagactagtccaataggggaagggtgactctcccttttaaggtggcttcctcctctcaagctaagcaaggtgggattattctggccggaccccaacagttcataagcacacccactcggggaaaggcccaatctccctaaaagactagtccaataggggaagggtgactctctcttttaaggtggcttcttcctcccaagctaagcaaggtgggattattcagaggctcacacggtcgctgcccgactttagcgtctttgctagcgggtaatagtagagaatgtcctcatcattcccacccccttaacaagggcccaactctgataccaaatgataataatccggcccaggtggggttggccgaggcctaataacttaaggttgcccggaccccaacagttcataggcgcactcactcgggaaaatgcccaatctccctaaaagactagtctaataagggaagggtggctctcccttttaaggtggattcctcctcccaagctaagcaaggtgggattattcagaggctcacacggtcgccgcccgactttagcgtctttgccagtgggtaatagtggaggatgtcctcatcaaggaggaatgagagaaaggggtatca

SEQ ID NO: 21230 - DNA, 1501 bp, Oryza sativa
gtactcagcaagccatgggaaataagtgtttaatgcaggcttcaaggaaaggctgatgtttttgtaattaatttttatttgaactcttttctgaaacaactaagtgagtgcttctcaaacgacacggatgagacagtgcgtctcatccggtcggagtatgtgcaatgtatcagtctttagaatttaaacaaggttggcacccggccaacagctttttcaacggccacccgggccaacaacttttcaaacggccacccgggcctagctgatcccatcagctgcagatttttcaaacaccgaaccccttttcacacagcaatttcacaagcagtagtcaaaccaaactacgctaggaatcacctcacatccgcccatgaccgtgggcacggctgttcgaacagtttgttaacctctgcagagggggtacactttacccgcacgacattactaacccggatcacccagcccgtggggatcagccacgtcgggagacctccaagctttcatgacaaggcatttccaaagccgacacaggtttaccatacgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgtttggatgaaattccaaggaatcggtccttaagtgcgagagcgggaaaccgtacacccagtacgtttcccggtccgcggttttggaaatttatttagttcgcaaagaccgacccaggtgtcgggttttccaagtcttttgtaaaactccagttttacccaagttattactcagattttaagtttgaaggcgaccgtcgatactggcacagggtgcacgaatatcgaggcgcaactggatggttacaaggggacatggtatagcaattaacaatggaaggatcaaatgcaacaagttaggtaggtctgccaatctgccttgcagacggaacaacagattaagtgcaatcctatcaatgcataatattttgcaagcaatataattagatttcaaatataggctcaagatgttcaaaggtggcttgccttgctcgagatctagagcttgatcctcgaaatcctcgcactgcgggtcttcgggctccgaaactacacgcgaaacgggacaactcaacaaacggcgaaaatgaaaccctaataatgacctctaagcgtgccattagatagatctcgagatttgaggaattttggaagttgaacggagtcaaacggatctaaggttaggaagatattgaatttctaagattattggattttttggtctaaaggaaaaggatttaattaaatccttttttggaaaagaaaagaaaagaaaagagggagggattatagacttttcctcgggcggctaaggcgcggcccaagggaat

SEQ ID NO: 21231 - DNA, 1501 bp, Oryza sativa
gagaggaggagcgggtggcggcggagcacctcggcgcggaggtggcggcggaggaggcggatggcctcctgcagctgctcggcgcgggaggcggcgaggcccgaggagagcgcggcggaggagaagtcggagggggagaaggacggggagaggaacgcggagaggaccgggtcggaggcgaaggcgtcgagcggggaggcgggatcggaagaggtcgtcggggagggcggcgacgggaaggaggaggaggcggcggcgatgaggtccttggaggtcggcgagaggagtagccgcggcgtcgctggcgcggccatggcgcgcgcggtggccgccggcgaccgcgggtgttggtggtggatctgagaagcggtgggagagatggggtagagatctgaggagagtggtctctcgaactcgctgcttgtttggtcgtttggatttggctggaatgggccaaatttttggagtagctcgaatttccagcccatactagtaaatgggccgatattgacgactaaagagacaaggcatttgatgggctggaaattgattttagtttaggcccatctagtgagatgggccatttggcgggcctcttatacaaggccttgatgggctgtaaagtttggcctgcttggttgaacccatatgctccaatccaacggacttgaggcctgttcactttgatgaaaaaaaaaacttactaaattttgatattaccaaaattttagtatagttgtcaaaattttaacaatatttcttatatagttaccaaaatttggcagcaaactaaatgtagccactgttttggtaactttactaaaaattggtaagattgcgcggctcggagattccggtgctcgtgctgtgtcggctcggtagcttccgctatccgctccggcggcggcagcgaaaacagggtgacgcaggcaactgcgtgacgatgcctacgccggcgtgatcgccgtgacatggcttggccggtgcggctgcgttgcatggtccgagatccgagcgaatgaagatgccggtgatcaggcggtgactgccatctcgagtcagactatgataagcttcacggttttgctactgggcaacgattgcccggggcgatcagggccgctccgccgccccccccccccccccaccacgtgggttcttttttttttttgcatcgcattactttcctatacacctaaagtttagagacccagagtttataagtcaaaagtttatatatccgattcaaatttgaatttgaattcaaatattttttacatacagtatttctatacatctaaagtttataggcctaaagtttaagtcagaagtttatatacccgtttcaaatttgaatttgagttatatccgattcaaatttgaacttgaattcaaatattttttatatatagtacttctatacatttaaagtttatagatccaaagtttataagtcaaaagtttacatacccgattcaaatttgaatttgaattcaaatat

SEQ ID NO: 21232 - DNA, 1501 bp, Oryza sativa
ggcaacggcttcggcgtcaagcgccgccggtggcgcggcggcgtcctgcgtgggggcggccggcgtcgtggtgatgccgagacgggcgagaagcgccaggatctcggggggaagttgcgccgcgggagccggagtggaagccggtggcggcgggatggcggtcgtcgaaggcgcggtcgtcggaggaaccggtggaggcaccgtggaggagtcgtcggaaggagaccgaggataacaggggcgagggccgcccgggccacggtcgcggcacgatcggtggcgtcgccagcgacggcggtggtcagggtgtcgtcgtcctgaccagagggagccttgaaggaggagcggacggcatcggcgatgattttgatggtgtcatcaaggacggcgtcggcagtgagggaggagggaggagaagccatggcggcggcagggtgcgccggccggcggctggggtggagaggaggcggaagcgagaaggaacctaatctgaggacgcccccgtcgatcaaccccaggccaggaacgtcccctcttggccacgtccgtgtgtccagtgccagcgcatgtgccatgctgtatgaccactcccggtccacaccaaccatactcccgtgaaaccgcgagagtcagctctgataccattttgtaacgacccgcctttcccaggctaggcccacttacatctggtagctttcataggtcataagactgtcctcacagaccaacacaagtcttttctacgcactttgtcctcactcatgcgcactcgggaagaattttctggtcggtcacccatccttaaattgctccagaccaagcacgcttaacctcagagttctttagagatcggcttccgaaaaagaagttgcaatttgttgatatgagtattctagtaatcctattaagccctagaccgggatgttacaccctcaccccttacaaagaatctcgtcccgagattcggaacggctagaaagaaaagggcattggtcaactgcagtctatcttattccataactatgataattattctaaggctttaaagaaaactactgctgctttgagactggtggctgagctgtaacacttgaagatgcaactggcactacattggctcctgtgacgacaaagatgtcgatggggtctacttatggaggccaagtcaagtggatcgagggacatgaagatgatggtcgaactaaagtgtccagctgtcaagatggaatgaagtttggatcctagcttagaacctaaaccaccaaattgactttgaagaatagttagtagggtagaacgtttgttgcttgcttgtgtgtaggtaaggttgcattcccatcattggtgtagttcaatgatgagcgtgtaactatattaggttgcttgcttaatcaacttaaacaatataatggtttacacacactagatcaatgttaacatggttaaggtcttgtctttagtgtcacccctctccttctatcttctccaaacctatagcaga

SEQ ID NO: 21233 - DNA, 1501 bp, Oryza sativa
gtaagctattagatagactataaatgatgttttaaattttgaagttagtagtgggctgtattattaaacttgctcttagagggaagcttaaggggtggctaatgggcgggtgaccaccccaggcgatcaccccccatcctcctatacgttactctccctcccttcctcctccccttcttctcttcctactacaccataaatttaaaaaaaataaaaaaataaagttggaaaaatttatgtatagaaaatactatatataaaaaatatttgaatttaaattcaaatttgaaacaggtatgtaaacttttaacttataaactttgggcctataaactaatatttgaattcaaattcaaatttgaatcgggtatgtaaacttttgacttataaactttggatctataaactttaaatgtatagaagtactatatataaaaaatatttgaattcaagttcaaatttgaatcggatataactcaaattcaaatttgaaacgggtatataaacttctgacttaaactttaggcctataaactttagatgtatagaaatactgtatgtaaaaaatatttgaattcaaattcaaatttgaatcggatatataaacttttgacttataaactctgggtctctaaactttaggtgtataggaaagtaatgcgatgcaaaaaaaaaaaagaacccacgtggtggggggggggggggggcggcggagcggccctgatcgccccgggcaatcgttgcccagtagcaaaaccgtgaagcttatcatagtctgactcgagatggcagtcaccgcctgatcaccggcatcttcattcgctcggatctcggaccatgcaacgcagccgcaccggccaagccatgtcacggcgatcacgccggcgtaggcatcgtcacgcagttgcctgcgtcaccctgttttcgctgccgccgccggagcggatagcggaagctaccgagccgacacagcacgagcaccggaatctccgagccgcgcaatcttaccaatttttagtaaagttaccaaaacagtggctacatttagtttgctgccaaattttggtaactatataagaaatattgttaaaattttgacaactatactaaaattttggtaatatcaaaatttagtaagttttttttttcatcaaagtgaacaggcctcaagtccgttggattggagcatatgggttcaaccaagcaggccaaactttacagcccatcaaggccttgtataagaggcccgccaaatggcccatctcactagatgggcctaaactaaaatcaatttccagcccatcaaatgccttgtctctttagtcgtcaatatcggcccatttactagtatgggctggaaattcgagctactccaaaaatttggcccattccagccaaatccaaacgaccaaacaagcagcgagttcgagagaccactctcctcagatctctaccccatctctcccaccgcttctcagatccaccaccaacacccgcggtc

SEQ ID NO: 21234 - DNA, 1501 bp, Oryza sativa
tctagttaggccactctctgaagccgggaagctgagaatgacaagggacatggccgagctggagctcgctgttggtcagaatctgtttccagtggagcagctaggcgcaccgtaccgggcgctgcgtgcattcaggcctgtcctattcctggagacgtctcagcttgagaaatctccactccttcaggacttgccccctagtgtgatcctccaccacctatattctcgaggacctgatgagttacagtctccattgcagcgtaacaagctcacgccgctgcagtattctctctggcttgattcccagggcgaggatcagatctggaaaggggtgaaagcaaccttggatgactacgagatgaaggtcaggtctcgcggagataaggagttcagccctgtgtaccctctcatgcttcagattggatctgcattgtctcaggccaagggctaaacctgtgttcagttcaacccagcatcacatatgtttgtatcatcatcatgtaggcattgggtacttgagagatcgattgagctttggaatagtttatacaaatgaaatagcatttgcatttgttttttttatggaaataaaggtgttcaaagtacagactctttctcctagctcctattatgttgtgaagtgtgtgatatgattgatcattgtacatctattagtcctgttgttccatctgcctgcttgactacaagcatgggaattttgcatgcgcggcacgctgatcacttgccagttgtatgtatgatctttggtgctaaatcacccgaaatgaaggaattttacctactcatgtgagaactcccagagattccaaagtccaatttgggttctttaaaaaaaattccgtgtaaggcataatgcaattgtttttgtgcagtttttgaggtgtgcaatcggaaaacatatcaatatcgccgttgtgaattttcttttctatttccttgcatctccttaagatttgtgctttatttctctccgtccatgatagtagatggtagtgacagtggacatgtccctaaaatacaagagttagttaaagagggactgaggctcccattggttgctcattttgcctaataagccaatagatagaaaataaaaaataatttataattaaaacttttatagatttgtacgtagcgacttaaaagccaacattaacagaaattacgttaaaagcatctcaaaatcaactaaatcaagttcaaaaatttaaattttggtttattctttgacggtttaggccaaacgatgaggctctgagggagttacacgattttataaacttaataacattaattatttatttcttatattacagattttcagtatatttaacaaggatccgtactcactgcctagtaaacaaaagggatgaaaaatgtatgagcaacataaatatagaaacaaaatgaacatgagtcaaagctactccatcttcatgtcccaatccccaagcaatggatcgatcattcctctctctct

SEQ ID NO: 21235 - DNA, 1501 bp, Oryza sativa
taccctggctggtcctggacaggggtttaatgcacattcagcttagaaattctggttcgtgaatttctgggcgtgacagtggagccggagcttcgctagatcgttattccgctgctattttctcttttcatttgtaagtatgtaacgttgtattattgatgaatctgtatattaaattgtcagcttgtgtacctcggctgattcctggacgagggttttatgcacaaattagttcggaaattactagtgaatttctgggcgtgacaagttggtaccataataaatggcgtcgtcgtcgtctccatgtgttgccgccggttcaccgtcgtcatctattcctctccgatcgctttggttcggtgagacgtctatccgtgttccctcggtttagtttttaatctctcgtttgtgtcgtcgagtagccgccgccgtgccacgcttagctgctgccctagcgtcgccactgcactagccgcctagtcgtcgctgtgccgctccctgctacagccgtgctgctgctgctcgtgcgtgacaagtcgctgccgtcccgctaccgtagccaccatctgccgtcgctgtgtgtcgtcgtcgctgtgatgtcgccctaacccgagccgcgtgtctccgccgagtcaccgccgcctggccgagccaagtcgccctagtgccgccgtgtcgcagctgtgtgccgctttaacctagccgccgctttaaccgttgctcggtagtcaagttgtctagccgtaggtgcatccctaaattcctaccggcctatcgtttgccgtaccggggctttaccgtgaatcgtttctagcccaccggtttagccgcagccattgttgagtcgttcgctcgttcgttcgaacgaggtgttacccgtgcttcgttcgtttgtccgtgttgagtcgtcctttagtttagagccgtttagagccgccggttccgttcgccggtttcggttgatcatttgggtaatcccgtgtcacgtagaattgactcgttgagtcggtatctcgtgaggctcgcttgccagatcaatctaagccatccgttgaatcttggtcaactctatgtcaagattaatcttagccctccaaaatcgatataaatatgttctctcttttcagtggcatattatttctttttaatatatatcatctaccaaatataatctaatctatttccagaggttgctttaatgttttatctcagttataaatcatttgtaaatgatttaattaatgtggaatagtctttttctttaataggtttaattggaattaaatcttataaaattcgtaactagttcatatgaaatcggaatgaggccgttcaagtctcataattaatctaaaatcatgatctacatgtttgtttactttatatgtactgtttatttggagtttcttagtctttttccacgttttgcgtgttagcttgtcgtttccatcgtttcgaaagtccgtgagtgcgtcgggagtattcaagaagattaattgaa

SEQ ID NO: 21236 - DNA, 1501 bp, Oryza sativa
tctgtgagccgccccgtgcactcggtccaccgcaaaccctagccgctgacgcaataaacccctttttccttttcaaaaataattcattattgcgtcataattcaattaaaacccatataagtgatttaatccgatttaatctttgaaaattcataactaattcatcttagctcggatttagttggttcaagtctctaattttttctaaaattaagatctacatgttaaaaatatccacatgtactgttcatgcttgtttatgtgctgtttggtgattttgctcctttctgtttagattccgacgtttccggagagtccatttttgcaggagaagaatttgaagagttccaaggccagcaaggcaagtcacacagatcccaaacatccctttgagcatgttgatcccgtttaaagctattgtttctattcaactattgcatttattttcgaatgtcgttgggtggaattaacctattgattgttatagtccttttgttcttgattactttattccttgataccttaggttattataacttgactagttgggctttatatattggttcagctagatattagatacgattgcttagccatgcttagaaacattagcacactattgggataacttatgactcactattatttaatgatggcttaatgatagctcatgatggtcaatcgtgattgattaattaattaatttgccaactaaaatctgataatgatgggttgtgaacacatggttttgatggtcgtgctcatgacaattaagaaccggttcacgagtttcggttgtgaaacattaaccgtgccaaccacaagccagcgtgggcaacggctttaccttttgtatagcatggttcattgcggagcaccagactgagaagtggcggagataagcccacgggggtcgctggggagtccataccttgtttataaggggtgattatgctccaggaatggtgcactgtggtggattgtgttgtgcgaggggtactgtcacagcccctttctgaggtaccgtggtggtattgaggcgcatggtgacatgttgtggggctgtgtcttgtgggtacagtggtacacctctggccagagtaaaactattcgaatagccgtgcccgcggttatgggcgggtctaacaatgtctttcgtgattagtttcacacttctcaccataataaaagatgctataactggtaataatttgattagctcctggtttggaatggtatattcctggtttggagatagaactgtgcaaccgggatgattgttaagaatggttgggcctatgcaacagggtatgttgtatagcattggattaatattgtttaattactacttaactactttattaaattctgaaatgtttattaaatgctgtttatgcaaatgaaaccctactatgccatcctttgttatcctgtgcacttgcatatttgctgcgtggcttgttgagtatgtcatatactcaccttgcaatcattcatcaga

SEQ ID NO: 21237 - DNA, 1501 bp, Oryza sativa
cttgggttataacatgattagactttggactaggaattgcttagccatgcttagttcaactagcacacagtggggatctcatttaaaacctagactataggtttatatgataatgttggtttaataccaccgctctggtgttggttaaataaaatgaaccacatggtgggctgtgggtgcatggttttgctagtcgcacccatggcagttaaggaccggttcgcgggatgccctggaagaatttatcgtacttaccacaagccagcgtgggcaacggctgggcttgtagtgtagctttcctctagtcgacgcatccaggcaagggtgggcgtgatggagcggggcgggccctgcgacggcctctgtcgcttccggattcacctaggcacgagaggggactgcccgtcgcccgctggggacgggggtgaaacctgaggtgtggtgtgcttggctagagggggttatgcgaagggtcctgtcacggcctctttccggtatgtcgtggtggcatgtcggcgcacggaaacgtgtcgtggggctgtgtcttgtgggtacagttgtacacctctgatcagagtaaaactattcgaatagccgtgcccgcggttatgggcggtcaaccagattcaccgtgattagtctcaccctagtgtaatctgttgaacttggatagtttaggtggatggttgggcctgtcgcaacgtgggttagcgttggacagcggatgtttaatactgcttaattattacaaccgttttcgcattcaattcctgtttataaatgctagtttttatgcaaatgaaccactctagctcttctttgttaattccctgcatcatacccctattccggtatgacttgctgagtacagtgggtagtactcagtcttgctctacttttcccccaacctcagagctcgagtatgtgtccgatggcgggttctccgaggagtaggcttcgtccgtgccgtcgaggatgcctgtggagtggtgttcccgctgcagttcaagtcaaggcttagctcccgtttcttttgttttccgctgcatttctgtaagacctttataatgtttgtaagacgtggatctgtatgtcaacattgtcgtttgtgtaccccggctggtcctggacgggggttttaatacacattctgcttggaattctattcgggaatttctgggcgtgacatctgtcatcccaccacctaaagtcactacatctttatgtcatgcttctcagttaggtcgtcatgttcgtcttccttttcccactagctctagtcgggccaaggcaaattttgatttagtgcattgtgatttgtggacatcacctattcctagtgtgtctggttttaagtattatcttgtcattcttgatgattgctcacattatgtgtggacctttccacttcgctttaaatccgacacattctccacattatctcatttttttgcctttgtgaagacacagtttgccacgaccattcacagcatccaatgtg

SEQ ID NO: 21238 - DNA, 1501 bp, Oryza sativa
tttaataaatggaattgcatttcatgaataatttaaattggaaaaggttttaaaagtctcttttggctttgggccgaaagtcggcccaaaaccttctctctctctctctccccggcccaagccggcccgcagtcgcccgcccgtgcgcgcgttcgccgctgacaggtggggcccgcctgtcagggtcgtcgtcttcctcccgacgaaaccctagacgcgccgcgccgccgccgccattccaaatccggccgcccctttccgtttccggtgaaatcaattgaggagaaaggatccccgtgatccactctatcttttcccttttggaaacatcgtctaaatcgctttggaaatccgtggattcgagttcaattcggatcgatctctctcctccgaaccctaaaccttctatcgcgtcgccggtcgccgtgggccttcgccgccgcctccttgcccctataaaaggacccccggtgtctccgctacccgtcgccaccctcgccttcgtctctcttcgcccgtagagccctagccccgtgggacctcgcgccgccgtcgtcgccgtcgctccagccgtgcgtcgtcgtcgctctagtcgtcgccgttgctcgggaaggccgccgtcgtggtcgccgtcgcgtcgccgtcctcgtccgcccctccatcgttgctgtagaccgccggagcaccgccatcgtcgtcaagccgaaggttgccgccgcttcttcctcgacgccgtcgccgtccgttgatcttccgccgccgttttggtcaccggtgagttcgccgcgtcgctttctacgtgctggtgccctccgttcgtgccgtcgcgccgtcgttcgccggcgagcttgcacgcccgagccgccgccggtggtgacgtcaccgctgacgtcatcgtcgtcgtcccccgtggtccggtcgtggaccgatggatcttggccgtcagttttggatggatggatctcggccgttcgtttctgtgagccgccccgtgcactcggtccaccgcaaaccctagccgctgacgcaataaacccctttttccttttcaaaaataattcattattgcgtcataattcaattaaaacccatataagtgatttaatccgatttaatctttgaaaattcataactaattcatcttagctcggatttagttggttcaagtctctaattttttctaaaattaagatctacatgttaaaaatatccacatgtactgttcatgcttgtttatgtgctgtttggtgattttgctcctttctgtttagattccgacgtttccggagagtccatttttgcaggagaagaatttgaagagttccaaggccagcaaggcaagtcacacagatcccaaacatccctttgagcatgttgatcccgtttaaagctattgtttctattcaactattgcatttattttcgaatgtcgttgggtggaattaacctattgattgttatagtccttttgttcttgattactttattccttgatacctta

SEQ ID NO: 21239 - DNA, 822 bp, Oryza sativa
caagccgagcaatgtaccaaagtcagtgtctaattcttaaatttgctcaacaactaaaatgtggaatggttggcctgggttggcttaggacgagctaggacccagggtagggttgccagttcggtccgaatcatcgtaggccttgggttaaggcaggttcgtgtgggttcacggccttgattaataatattggatagttctaggatcgtgtttacaaaatggccttgagcaactaaatgtctttaaatgctgtttactgcaaccctaaccctctatattataattcccttgtactcccttgcatttattctgcatttgtgggtgtgtcttgttgagtacggtggttgtactcagtcttgctcaattttcccaagcccagatgaggagttccttgaagatgaaggctttggtgtctagctcgtgcctgccgtcaagcgcctgtggtcgtcgccctagtcttccgctgtttttcgttgtctttgagtgtgctgggccgttgttgcccgtgtaataattttatatacgcttccgcttgttaaactctgaattgtatcaacttttggtgtaccttgcctcctgggacaaggattaatgcacgcacgtaaggaatgcccgttgggttatttccggtcgtgacaagttggtatcagagccttccttgaccctaggacgagccgtagatcccaagccttagctatattttcaaaaataaaaatcctttattatttgtgaaaacccgctattctctctttgtcttgctgcttcatttatcgtcaaaatctgatcttttaaatgttgtttttcttttgttttgtttgtaga

SEQ ID NO: 21240 - DNA, 1501 bp, Oryza sativa
atggcatagtagggtttcatttgcataaacagcatttaataaacatttcagaatttaataaagtagttaagtagtaattaaacaatattaatccaatgctatacaacataccctgttgcataggcccaaccattcttaacaatcatcccggttgcacagttctatctccaaaccaggaatataccattccaaaccaggagctaatcaaattattaccagttatagcatcttttattatggtgagaagtgtgaaactaatcacgaaagacattgttagacccgcccataaccgcgggcacggctattcgaatagttttactctggccagaggtgtaccactgtacccacaagacacagccccacaacatgtcaccatgcgcctcaataccaccacggtacctcagaaaggggctgtgacagtacccctcgcacaacacaatccaccacagtgcaccattcctggagcataatcaccccttataaacaaggtatggactccccagcgacccccgtgggcttatctccgccacttctcagtctggtgctccgcaatgaaccatgctatacaaaaggtaaagccgttgcccacgctggcttgtggttggcacggttaatgtttcacaaccgaaactcgtgaaccggttcttaattgtcatgagcacgaccatcaaaaccatgtgttcacaacccatcattatcagattttagttggcaaattaattaattaatcaatcacgattgaccatcatgagctatcattaagccatcattaaataatagtgagtcataagttatcccaatagtgtgctaatgtttctaagcatggctaagcaatcgtatctaatatctagctgaaccaatatataaagcccaactagtcaagttataataacctaaggtatcaaggaataaagtaatcaagaacaaaaggactataacaatcaataggttaattccacccaacgacattcgaaaataaatgcaatagttgaatagaaacaatagctttaaacgggatcaacatgctcaaagggatgtttgggatctgtgtgacttgccttgctggccttggaactcttcaaattcttctcctgcaaaaatggactctccggaaacgtcggaatctaaacagaaaggagcaaaatcaccaaacagcacataaacaagcatgaacagtacatgtggatatttttaacatgtagatcttaattttagaaaaaattagagacttgaaccaactaaatccgagctaagatgaattagttatgaattttcaaagattaaatcggattaaatcacttatatgggttttaattgaattatgacgcaataatgaattatttttgaaaaggaaaaaggggtttattgcgtcagcggctagggtttgcggtggaccgagtgcacggggcggctcacagaaacgaacggccgagatccatccatccaaaactgacggccaagatccatcggtccacgaccggaccacgggggacgacgacga

SEQ ID NO: 21241 - DNA, 1501 bp, Oryza sativa
accaaattttggctactatagttcaaattcaatgctagaaaatttggtagtgccaaaactttccaccaagattttggtagagtaaaaattgactttaaatcaaataagcccgtcttcagcagcagccatcggaaggcacggctagctccacctccgaaggtaagctcgtagattcccagcccgtgaacagaaatagccactaataattttgataggcactaaaataagcaaataatagaagcttagttggtgttctgaattatagccacctgcggcgatacaaagataaattcaaagtcttggacgatttatataatgcacgacatgacagcctagtagggcattataatgcacaaattggcactcttgcatatattttttttccattttttctatggacgtccttaggagaggaaacttgctggaattgtttgtttaggtgaaaccatacatgctgctgttggtttggtttaattcggttgctgcagtgggcggatgtttatcttctccttctgatctggtgctaggctgatgcctgctgtgatacctcagctgacatatggggcttacactgagcatctttagcaacttgccagcttacactgagcagttgaccacttgttgtttgattgtatgatgtgattatttgaaatttgaagcgcgtcaactaacatgatgtatctaatgcacccattgtcttaaacaacccacccacttttttctaatggaacaaacagctcacttgcttcttctcattccattatcagtctccttcaactccaactcatctttgtgccttggatggttttttccaaagacttaactcaaccagctacaccatacgctcattcctcaacccaccattaattgtcctccaatcctttctgttctgccaatactccattgatctctgagctttgagccatggcggagttactatcggctcttttgcctgccctcctgaagaaagcaggtgagtctctcggcacagagtttagtttcatcgggggtattgaacgacggcgttcggagctgtataccttgctgcttgccgtcaaccaagtgatcaatgatgccgaggatcaggcatccaagaagcctgctgtgaagtcttggatcgcaaagctgaagctggctgcctgtgatgctgatgacgcccttgatgagctgcactacgaggagctccgctgcgaagcgctccgtcgtgggcataaaatcaatactggcgtaagggctttcttctcttctcattataatcctttactgttcaagtataggataggaaagagactccagcagatagtcgagcggattgatcagcttgtttcgcaaatgaatcgatttgggttcctaaattgctccatgccagtggatgagaggatgcaaacctattcctacgtcgacgagcaggaagttattggaagggacaaagaaagagatgaaattgtccatatgcttctaagtgccgagaccgacgaattgctaatacttcctattgttg

SEQ ID NO: 21242 - DNA, 1501 bp, Oryza sativa
cttgccttgctctgttcgattaagcaagtttgagtcttacttacctgggagctacgaaaccatttgttgctgcttttatcaagtcagacattgtttaatcgaatgaattgcatcactctgtttggaggaactttggcatcattcctctcatgttcagaaattttgcaggtatctacgctgaaacattgttgaaacagaatgtgtcttaagtgaatgaagtgcattgcatttctctgctccgaacgtatatcttgacctgctgggatcaaggcctttttgtaacaatgtacaaattgtggatatactgatattgattggagttccactgctcaacactgattgtgtgatttcgaggaattccctctttcttgtcggagttgccaaatatatttctacctctgacccaaaggatatggggttctgtgtagcatctgataaacaataggtggtgcatacttctttccaccaagtgaaccaaacaaaggtgtgctccctgatacatttttttataatttcccccaatatatttccctagagttatcgtaattttgtttatatgcatccattttcagcatattcaggtatgccagtgtttgtggattcatcctgcttctgaatcttgtgctgtttcttagatctggagacctggagttctgaagacttaccatgaatctttcgctggggacctggagctggagccgtgcaagcccgagttcgtgagggggctacgctatgattcgctgcttctcgcaggccatgaccgacgccgtggtgcgcaacgcccacgtgaatgctacggccggggtctttactatagtggaattttacagttcttgagaaagtaccttgaggtacctaaattttacactaaaatttttggtgccttgaggtacttagtacctagagatatcaaattttacactagaaatatggtacatctaggtatcttatgaaggatagtaaaattacccataataccatgtaagccatccgagggcgaggacgatgcagacagcgtgggagatgaggctaagctgctagagaaatcatggcgcatgcagaaggggcttcatgtgggcatgctgcagggtcactagcctcagtgagggatttagtccttttcttggtgtgcggtgatagtattaagtattcaatctttaacttgttttgttcaatcagggcatgattctccatggtttagattgaaggggatggagtatggcgtcggattttagagattgatcgcctgatgcactactgcacgagcagtggtgagaatttatttgttgctgtactccctttcttattgtgttgtgtgtggactaacgatccacaatctccgcctggtttcccccaattagggcatggttttacacgagctactttgttttatttgaacgggaaccaatattgtttgaatatgctttattttaaagagagaagaatgtgcgttacagatcattgaatcacaatatatttcttacgaataatcaataatatt

SEQ ID NO: 21243 - DNA, 1501 bp, Oryza sativa
agtcagaatgaggccgttcaagtctcataattcatctaaaaatatgatctacatgtttgtttactttttatgtattgtttatttggtttttattagtctttttcctcgttttgcgtgatagcttgtcgtttccgtcgttgcgaaggttcgcgagtgcgccggaagtattcaagaagattaattgaagaccgattattgcaaggcaagtcacacagatcctaaacacaatcctttgagcatgttgatcctatatttaaattctctatttatttcaactgtgcatttattttcgaatgtcattgggtggaattaacctattctttgttatggcccttttgttcttgattactttattccttgataccttgggtgattataattggactagttgagctttatatatattggttcaactagatattagctatgattgcttagccatgcttagaaacattagcacatatttgggataactaatgtttcactatcacttatggttatatttaatggtagctcacgatggtcaaccgtgattggttaattaattacttgccaactaaaacttgataatggtgggttgtgagcacatggttttgagagtcgtgctcatgacaattaaggaccggttcgcgagctactgttgtgaaacattaaccgtgccaaccacaagccagcgtgggcaacggctttatcttttgtatagcatggttcattgcggagcaccagactgagaagtggcggaaataagcccacgggggtcgctggggagtccatgccttgttttataagggggtgattatgatccaggaatggtgcgctgcggtggattgtgttatgcaaggggtactgtcacagcccctttccgaggtaccgtggtggtactgaggcacatggtgacatgatgtggggctgtgtcttgtgggtacagtggtacacctctggccagagtaaaactattcgaatagccgtgcccgcggttatgggcgagttgagcaatgtttttcgtgattagtcccacacctctcaccataattatagatgttataactggtaataatttgcttagctcctggtttggagttagatctgttcagccgggtatggttgttcagaatggttgggcctgtgcagcatgggtgtgctgttcagtgttggttaaaatttctgattaattactccactgttttacttctcttaaatgttttgctaaatgctgcttttgcaaatgagccgatattatgccatcctttggtatccttgtgcacttgcatatttgctgtgtggcttgctgagtatgtcatatgctcaccttgcaataatcaatcaacctcagttgaagaaaaaggatccagaaggagaagacgtttggcttataccccagttgagctgcctgtgggagtggagccggagcttcgctagattttattttccgctgcagttttcttcttggtgaggactaagtgcctcttaagtaagtatttatcggtttagttaatttgat

SEQ ID NO: 21244 - DNA, 1501 bp, Oryza sativa
tgcaattatgcgtgttatactttagcttgccttttccccctccattcttgatgcgaagatgcgcgaacctttgccaccttctctaataaagtaatatgtgtgtcatactgtcattttttatattgacgctgtttagctgaaagatgaaactacctcgaagtttcatcgtgttgctgctaaggagatgtttcagtggagggggattctgctattactgggtttatgcaatgatttataattccggcgaatgatcatttctcttttgcataaacccaacgaacattcactgtgattgcagcataaaccctgggaacgtccgctggggctttgacatacatgacttacaatgtacctcatagttgattctgtgttgcattggcttttactgttttacattttgcaattttaactgaaaaaatgcaatgctatcaattctttgggtacatgagttggtgtatatgttctgttcatgaacaatttgggatatgaagcacgaattcagacacatatggataataggacaccgctttaatgttatttttttaaaaaatgaaattctgggagctttggacttcatcaaaggaggtgccgatcataggactatagcctgtctgcctgtgcggacaatatttacatgtttgttctttacctgttgatctatgcgtaaattttaaaatataacatgattatttgaaattcacaaggcgtcacctagcatgatggatgcaatcttttttttttcttctaattcttcaacgaaccacatattgtcctccctctttatgtgccccttacaccaacttgttatgtactgtgtctttcctcctcctgtagattctaaatactagaccttctgccgactctccactgctctctcatctcttccgttttgtccatattcctttaaactctgagcttggagccatggctgagctactctcagctcttctacctgcccttctgaagaaagctggcgagtctctctccacagagtttagtttcattgggggtattgaacaccggcgttcagagctgtataccttgctgcttgccatcaaccaagtgatctatggtgccgaggagcaggcatccaagaagcctgctgtgaagtcctggatcaccaagctgaagctggctgcctgtgatgctgatgatgccctcgatgagctgcactacgaggcgcttcgcagcgaggcactccgtcgtgggcataaaatcaacagtggcgtaagggctttcttctcttctcattataatcctttactgttcaagtataggataggaaagaaactccagcagatagttgaacagattgatcagcttgtttcgcaaatgaatcaatttgggttcctaaattgccccatgccagaggatgagaggatgcagacctattcctacgtcgacgagcaggaagttattggaagggacaaagaaagagatgaaatcatccatatgcttctaagtgccaagagtgacaaattgctaatacttcctattgttg

SEQ ID NO: 21245 - DNA, 1501 bp, Oryza sativa
attttcgcggggagagtgggggaaaagtggaggaggtggaggggatcgattccacgcgctcgtggggcggggtgaagcgcgggaaccgcggcgtcgtggggcgaaaccggcggccatgacggccattggggtgacgggaggttagggaagaagatgacaggtgggacgagagagaggggaaaacgggcgagggaggtaaagcagacttgagggagagagagagccgagcgggccgagggaggaggccggcccgagagggagagaaaaggggcgcgcgggccgcgggagggaaggaagacttgggccgaaaaaggcccaaagagaggaagggggattttaattgtttttctttttattttaattgatgcaatgatctttgtgctattaaaactatttctcgagctccgaaaattcacggaaaattccggagagtacattagggcgcaaagaatattacaaaatattcccggccaatgatttttaaaggaaaatttcaaatttcctctataattccacttgattaaattggtttaacttttatttaatttctagaaaatgtattattaattgatttttattcccgaacgaaaatcggggcgttacaaatctaccccccttacaggaatctcgtcccgagattctgggatggctagaaagaaagctggagctggcgggcggtttgactgatcggacggatccgcatactgcactgccccctttctgtctcgaactgactgattgactgattgtccagacttgcacgactgaactgattgattcaacttttctgttcctttgctttgcaagactggactgactggttctacttcaactgacccagacagggctgtggatgcttaaggaacttacttatcttggactgaattgttgaggttagcaattttgataacctgacaattcaccatgctgactcgaagaggatgaagttgttcctgaagcttgcatctgacctttgtaactcattgatcctacgtccgcttgaacgggttctgactcgagtgacacgtaattccaggaaacctgcttgacctgtctttcgtctgaaccgcaactgtcctcactgttgcttctctaagctaagctgttgacctggcctcaccggtgtccctcagaattccatcaagtgacctaggaccggcgtaattctgcatgacaccttgcaattggctccttcaactgaaacagcgacgaggtgagccagaactcatctctgcgacctaccccccttacaggagtagtcatacatttcgcctgactgggaacaattgaactgctggcataactgtcccgcttctagcctgacttcggtgtcgtatgcctaaatagattgcatacccactgatcacttaacagatcaaactcaaaagtccttctcttgacatgacattacacttcgtcgatcgtcctttgctgactcttcctgggtttacggactataggccctgcaattgttttcccaaaaatactacaatctgaacga

SEQ ID NO: 21246 - DNA, 349 bp, Oryza sativa
atccttgtaagagcggtcctttctaactacagtgatgccacactggccgcattaatagtaacagcgatgggggtaataacagagagtcgtatctatccagccatcactccttaggcttagagcaggtacaatagcaggctataagccagctgcaaacatattttaaggagataaatgaggagaaagaagtgcagcgggctacagatttgtagccagctgtagcacggactccaagacatagtgtgtgtatgacaggtgggaccaggtactaatagtgtagtatataactattgtatgaatgagctattagattggctatagatgaattggagctattagttggctatac

SEQ ID NO: 21247 - DNA, 1501 bp, Oryza sativa
tgccgagagactcacctgctttcttcaggagggcaggcaaaagagccgatagtaactccgccatggctcaaagctcagagatcaatggagtattggcagaacagaaaggattggaggacaattaatggtgggttgaggaatgagcgtatggtgtagctggttgagttaagtctttggaaaaaaccatccaaggcacaaagatgagttggagttgaaggagactgataatggaatgagaagaagcaagtgagctgtttgttccattagaaaaaagtgggtgggttgtttaagacaatgggtgcattagatacatcatgttagttgacgcgcttcaaatttcaaataatcacatcatacaatcaaacaacaagtggtcaactgctcagtgtaagctggcaagttgctaaagatgctcagtgtaagccccatatgtcagctgaggtatcacagcaggcatcagcctagcaccagatcagaaggagaagataaacatccgcccactgcagcaaccgaattaaaccaaaccaacagcagcatgtatggtttcacctaaacaaacaattccagcaagtttcctctcctaaggacgtccatagaaaaaatggaaaaaaaatatatgcaagagtgccaatttgtgcattataatgccctactaggctgtcatgtcgtgcattatataaatcgtccaagactttgaatttatctttgtatcgccgcaggtggctataattcagaacaccaactaagcttctattatttgcttattttagtgcctatcaaaattattagtggctatttctgttcacgggctgggaatctacgagcttaccttcggaggtggagctagccgtgccttccgatggctgctgctgaagacgggcttatttgatttaaagtcaatttttactctaccaaaatcttggtggaaagttttggcactaccaaattttctagcattgaatttgaactatagtagccaaaatttggtatcaaaccaaacatgcatgtgtcgctgtttaagttaccaaaattttagtaggataaaaattggcatcaaacgaaacaagcccgatatctcttcgactgtatagctgtgccggatcgagacaaattcctctgctccgtgaagtttcttgcgcccgcatccggctgtcttatgggagagcagcttccgccacaccggccaacaccgggttttggccgccggcagagtgtgagggggattgggtggaggcaaccaaagcggagacaatattgagcacgcgcagtccgtgttagataagttagttattggagataaggtttatattatcacatttaaccatttgatcttatatctataatacggattgatctcaggttgttgagagtgatccgttccctctgtaatgcgccacggcaaaggcttttcctgcctatatcaacaaaggtgcggcccctatcagggttcagcgcttccccctattattccctgatatggtatcagagcaaaccgatctac

SEQ ID NO: 21248 - DNA, 1501 bp, Oryza sativa
cggctgaacagatctaactccaaaccaggagctaagcaaattattaccagttataacatctataattatggtgagaggtgtgggactaatcacgaaaaacattgctcaactcgcccataaccgcgggcacggctattcgaatagttttactctggccagaggtgtaccactgtacccacaagacacagccccacatcatgtcaccatgtgcctcagtaccaccacggtacctcggaaaggggctgtgacagtaccccttgcataacacaatccaccgcagcgcaccattcctggatcataatcacccccttataaaacaaggcatggactccccagcgacccccgtgggcttatttccgccacttctcagtctggtgctccgcaatgaaccatgctatacaaaagataaagccgttgcccacgctggcttgtggttggcacggttaatgtttcacaacagtagctcgcgaaccggtccttaattgtcatgagcacgactctcaaaaccatgtgctcacaacccaccattatcaagttttagttggcaagtaattaattaaccaatcacggttgaccatcgtgagctaccattaaatataaccataagtgatagtgaaacattagttatcccaaatatgtgctaatgtttctaagcatggctaagcaatcatagctaatatctagttgaaccaatatatataaagctcaactagtccaattataatcacccaaggtatcaaggaataaagtaatcaagaacaaaagggccataacaaagaataggttaattccacccaatgacattcgaaaataaatgcacagttgaaataaatagagaatttaaatataggatcaacatgctcaaaggattgtgtttaggatctgtgtgacttgccttgcaataatcggtcttcaattaatcttcttgaatacttccggcgcactcgcgaaccttcgcaacgacggaaacgacaagctatcacgcaaaacgaggaaaaagactaataaaaaccaaataaacaatacataaaaagtaaacaaacatgtagatcatatttttagatgaattatgagacttgaacggcctcattctgacttcaaatgaatttattaagaattttacaagattaaatctatttaaagcccatttaaaaagaattaaataaatttaattcaatttatggacaattttaatatgtagatctttattttaaacaacttttgcaacttgaaccacattaaactgagttaagatgaattagatatgaatttttaaagattaaatcggattaaaacacttaaatcggtttaaattgaattatgacgcaataatgaattatttttgaaaaggaaaaggggattattgcgtcagcggctagggtttcggtggaccgggcgcacgggcggcggttcacgcgaacggacggccgagatcgaaccaatccaaaacggacggccgagatcgatcgggtccacggcggctcacggcggacgactccga

SEQ ID NO: 21249 - DNA, 750 bp, Oryza sativa
tccgccgctactttggtcaccggtgagttcgccgtgccgtccgctacccgtaggtgccctccgttcgcgctgtcgtgccgtcgtatgccggcgagcatgcacgcccgagccgccgccggtggtgacgtcaccgctgacgtcatcgtcgtcgtctcccgtggtccggccgtggaccggtcgatctcggtcgtccgttttggatgaatcgatctcggccgttcgtttccgtgagccgccgccgtgcacccggtccaccgcgaaccctagccgctgacgcaataattcccttttccttttcaaaaataattcattattgcgtcataattcaattaaaatctaaataaatgatttaatccgatttaatctttgaaaattcataactaatccatcttagctcggatttagttggttcaagtctctaaatttttctaaaattgagatctacatgttaaaaatatccacatgtaatgttcatgcttgtttatgtgctgttttggtgtttttgctcttttctgtttagattccgatgtttccggagagttcgttttcgcaggagaagaatttgaagagttccaaggccagcaaggcaagtcacacagatcccaaacaaccctttgagcatgttgatcccgtttaaagctattgtttctattcaactattgtatttattttcgaatgtcattgggtggaattaacctattgtttgttatagcccttttgttcttgattactttattccttgataccttg

SEQ ID NO: 21250 - DNA, 1501 bp, Oryza sativa
ttcgatctcgattccatcgagtttccaaaccgaattgaccggagattccaaaagagaaaaggaagaggagatcgagaagatcatttcccctctaaagatttcaccggagaaggaaagaatcgagcggatttggaaggagaaggcggcggcggcgcgctagggttcgcgggcggcggcggcgacgcgaggaagacggatccgacaagcggggcccacctgtcagcgaccgaacgcgcgcgcgcggctgcggactgggccggctgggccgaggagggagagaagagaggttttgggccggctttcggcccaaagccaaaagaagacttttaaaacctttttcaatttaaattatttcttaaatgcaattccatttattaaaaatacttccttagctcaaataaatcccagaaaaatctaggaattatagaattaagcaaagtatttaatgaaattttatctagcccaattttatattgagatttaacaaattaaaattagatcttctcttataagcttttaaaatcatttctaataattccttttaaacaacaatttataatttaaggatttttaaacaagaaaagctcttaacaattataattagatcattaatgatcaaataattactgaactgttctttgtattattaagagttgagctctgaaaaatccgagaaaatttcagagagttgacttaatcatggagaatttaataaaaattaaatccatccatgctttatatttaggaaattttatttcccacattttacttcacttgtaaattaaagaacatttaacaaaaattctattaataatttattaaataatttataaatcctgaaacgaaaatcaggatgtgacagtttgcttggtttttattagagtttttcctcgttttgcgtgccaacgtgtagttcccgacgtttcggaagatcgcggtcgcaaggataagagttcggaagattgtttgaagaagcaaggcaagtcacacattccccttgagcatgttgatcctaatttacaaatcttttactgtttgcaaataaatatgcatgttttgctaattacacgggatcagggtttacctatctgctcgcttgtgccatgtttacttgatatctatcatttgtcaaccttgggtaataaatcgactagctcatgttacttatgtgacccagctagaactatatgcttagcgatgcttatttagcactagctcagttgatgggataattacagtattagacctttttagtatcagagtgagctgcgtgctcgagacatctggccatgcttcatggtcgtaattatccaactaaaatgcgactgaatagtgggctgtgggtgcatggttttgctggtcgcacccatggcagttaaggaccggttcgcgggatgccctggaagaacttatcgtacttaccacaagccagcgtgggcaacggctgggcttgtagtgtagctttcctctagtcgacgcatccaggcaagggtgggcgtga

SEQ ID NO: 21251 - DNA, 760 bp, Oryza sativa
ccatcgtgaactatcattaagccatcattaaataatagtgaattataagttatcccaatagtgtgctaatgtttctaagcatggctaagcaatcgtatctaatatctagctgaaccaatatataaagcccaactagtcaagttataataacccaaggtatcaaggaataaagtaatcaagaacaaaagggctataacaaacaataggttaattccacccaatgacattcgaaaataaatacaatagttgaatagaaacaatagctttaaacgggatcaacatgctcaaagggttgtttgggatctgtgtgacttgccttgctggccttggaactcttcaaattcttctcctgcgaaaacgaactctccggaaacatcggaatctaaacagaaaagagcaaaaacaccaaaacagcacataaacaagcatgaacattacatgtggatatttttaacatgtagatctcaattttagaaaaatttagagacttgaaccaactaaatccgagctaagatggattagttatgaattttcaaagattaaatcggattaaatcatttatttagattttaattgaattatgacgcaataatgaattatttttgaaaaggaaaagggaattattgcgtcagcggctagggttcgcggtggaccgggtgcacggcggcggctcacggaaacgaacggccgagatcgattcatccaaaacggacgaccgagatcgaccggtccacggccggaccacgggagacgacgacga

SEQ ID NO: 21252 - DNA, 1501 bp, Oryza sativa
ctttaaaggcagtatcaatggtattcggatgaaaagagtgatggaatatttgaaagtgacatcatataaagaatcttgggaactcctctaaaccttggaagccgttagaggatggtaagcggaaatttacaccctagtggtgcgatcatggatcaattacatttttccttagttcaagacagccagtataagctccaggaatcatctcaatgtttctcagaagttgaaaaagaaattgttccatacctgggtcagaagtatacagagtcaagtccagaaatgtgtagttagcagggtatatggcatagaatcccttttaacgaatcatctttaccgaagataggaaagcgaagtggttatgatcaaaaagcagaaactctcggcagtatcaaagtcaatttccggcagtcgttcagattgtagtatttttgggaaaacaattgcagggcctatagtccgtaaacccaggaagagtcagcaaaggacgatcgacgaagtgtaatgtcatgtcaagagaaggacttttgagtttgatctgttaagtgatcagtgggtatgcaatctatttaggcatacgacaccgaagtcaggctagaagcgggacagttatgccagcagttcaattgttcccagtcaggcgaaatgtatgactactcctgtaaggggggtaggtcgcagagatgagttctggctcacctcgtcgctgtttcagttgaaggagccaattgcaaggtgtcatgcagaattacgccggtcctaggtcacttgatggaattctgagggacaccggtgaggccaggtcaacagcttagcttagagaagcaacagtgaggacagttgcggttcagacgaaagacaggtcaagcaggtttcctggaattacgtgtcactcgagtcagaacccgttcaagcggacgtaggatcaatgagttacaaaggtcagatgcaagcttcaggaacaacttcatcctcttcgagtcagcatggtgaattgtcaggttatcaaaattgctaacctcaacaattcagtccaagataagtaagttccttaagcatccacagccctgtctgggtcagttgaagtagaaccagtcagtccagtcttgcaaagcaaaggaacagaaaagttgaatcaatcagttcagtcgtgcaagtctggacaatcagtcaatcagtcagttcgagacagaaagggggcagtgcagtatgcggatccgtccgatcagtcaaaccgcccgccagctccagctttctttctagccatcccagaatctcgggacgagattcctgtaaggggggtagatttgtaacgccccgattttcgttcgggaataaaaatcaattaataatacattttctagaaattaaataaaagttaaaccaatttaatcaagtggaattatagaggaaatttgaaattttcctttaaaaatcattggccgggaatattttgtaatattctttgcgccctaatgtactctccggaattttccgtgaattt

SEQ ID NO: 21253 - DNA, 329 bp, Oryza sativa
cttgagtgattattcaacttctttggctaacgtggttatctattttttttcttgcgcattactttcagcccaccgccagctccaccacaaacccgactacagcttgacaggtcttgttgctacggcaccgatacacctcgttctatggttgcagacttgtgggttgccatcccattctatgggcaaggtaagaattggtaagagcttgtgagacaggcttcgagtgaactgagagtgagcgccttgcaaaagctacatcccaatagccgtagggcttaaattacctcatatgttgttttgttgctcttgttttattaaccatggcaggt

SEQ ID NO: 21254 - DNA, 1501 bp, Oryza sativa
ctacgatgattcagaccgaactggcaacccgaccctgggtcccagctcgtcccaagccaacccaggccaaccattccacattttagttgttaagcaggttttaagaattaaaacactaacttgggtacattgctcggcttgcccataaccgagggcgcggctattcgaatagattatactctgatcagaggtgtacatctttacccacaagacacatcttcctcacgtgtaaccacgtgccacataccaccacggtatacggacggaagacgtgacatagtttccaacccatcctagccatagacaagagtaccgacccaaccccacctacggccggaacctccgggacaggtaggcaggactgagcccctagcagcaggacaccggccctgtgccatgacatctcgactaccgggctgcagctcgtgtagccttcatttgccctagagatgtccatcgacccctgacttcgtctatctccttccgtgtacttttgtttataaccagactgagccacaaaataagccttacccactagacatgtggaagtacggtagtgctttgcaacagaggcccgaagaccggtccttatatggccgaggtgctactatcaaaaccatgcaccccgagcccagcctaaaaccattttgaggattttgaatagagggggaggtgtgaatccaattccacaataatccaaccattccatagtgtccaggtgatatgaatatcccaaagtttagagttgtaaaaccacctaatgttgcctaattaaccagcgaagcatctacctaaaataatactagtggtaccatgagtagagtgtccactagttggggttttgtttattctagggtgaacaaggaaataataacaataacaataataaggtcataacaaaggtaaataggcatggctagataaaacagtgataacgcgggaatttaaataaagcggtaatgcaataatttaaatcaaaataattttataaactgggattcaatatgttcaaggatgatgtgacttgccttgctcgctttcccaaacgtcggcttcaacctccacgaagagcggatcttccgaagctgcagcgtctacacgaccaatggaaaagaaaaggcttttactctaataaactccatgtaacaagtaggaacaaagtacaaaaatgggttcttgacttcttaaggaaaaattagagacttgaacggtccaattccgagttcaaatggccaagttatggtcatttgaagtttatatgctctttaaatgaatatttgcgaatttcttcatttaaattttaattttaaaagggtttattgtgtcagccgaggggagggggcgtgcggaccgggtccacgggagtggggcccacgcggcagcctcacggtccacggtggaccgggcgcacccgggctcgcaccggccggcgccgtgggtcccacgcgtcagccgcacccgaggtcgcgggcggctgacggccgggccccacgcggcggcc

SEQ ID NO: 21255 - DNA, 1501 bp, Oryza sativa
catccgatgctgctgtagtatctctataagcaattggttctggttaatcaggtgttggaccactgccacacaactggtgtctggtgcttcattcactcgggagcttgaggtaccaatgtcctgacttctgaccttattgcctttctcattgtcagccatctgttgcaaaggtttggagagggagagagggaaaacaaaggggagagacagattggaaactaaggataggaccttaacagatctaagtcttttgctgttatgatgtatgttaggcttattctgcaagttgattaagcaaacaacctagcatggttacatcacaacccactgatgcaaaccacgcgctacacacacaagcaaggaaacacacgacaaacgaaacactagagggtggcttaggttctgcgacgggttctccaagatcttcactccttcacagctggcttcactgcttcctttgcttcgctagcggatccaacagtcttccggagcttcggcaaacaactgacgacatcttcttcttcgcaaagctgaccatctagtactagttgaaatttgaagaaggaagaaaagagtaaaccttttgcaaataacattaggggaaggagaaaaagaggaactttcgcaaatagttttatttataaaatatgtccttaggttttatccacttggcttatcctacagtcgagatggctctgataccaacttgtcacgaccggaaatcacccaacaggcgttcccgacgtgcgtgtattattccttgtcccaggaggcaaggtacaccaaaagttgatacaatacagagtttaacaagcggaagcgtatatagaattattacatgggcaacgaaggcccagcacactcaaagacaacaaaaaaaaaacagcggaagactagggcgacgaccacaggcacttgacggcaggcacgagctagacaccaaagccttcatcttcaaggagctcctcttctggacttgggaaaaattgagcaagactgagtacaaccaccgtactcaacaagacacacccacaaatgcagaataaatgcaaggggggtacaaggagataataatataggggttaagttttgcagtaaacggcatttaaaagtcacttagttgcccaaagctattttgtaaagacgatcctagagctatacaatattattaatcaaggccgtgaaccctcacgaacctgccttaacccaaggcctacgatgattcggaccgaactggcaacccgacctgggttccagctcgtcccaagccaacccaggccaaccattccatattttagttgttgagcaaattttaagaattaaaacactgacttgggtacattgctaggcttgcccatatccgagggctcggctattcgaatagattatactctgatcagaggtgtacatctttacccacaagacacatcttcctcacgtgcaaacacgtgccacataccaccacggtatacagacggaagacgtgacatagtttccaacc

SEQ ID NO: 21256 - DNA, 1501 bp, Oryza sativa
cattcacccgggcagtaccaagatgtacttagacttgaaggagaaatactggtgggtcagcatgaagcgggaaattgcagagtttgtggctctatgtgatgtgtgccagcgtgtcaaggcagaacaccaacgaccggctggacttctccagcctctccaagtgccggaatggaaatgggatgaaattgggatggatttcatcaccggccttccaaaaacccaaggtggatatgactctatatgggtaatagtggatcgattaaccaaggtagctcgattcattcctgtgaagaccacctatggagggaacaaactagcggagctctacttcgctaggatcgtgagtctccatggtattcccaagaaaatcgtatctgataggggaagccaattcacctctcacttttggaagaagctccaagaagagctgggtactcgattgaatttcagcaccgcctatcacccgcagacagatggacagaccgagcgtctaaatcagatcctagaagatatgcttcgcgcatgtgtcctggacttcgggaagacttgggataagagtctcccctatgctgagttctcctacaataacagctatcaagccagcatacaaatggcaccttatgaagcgttgtacgggcgcaaatgccggacaccgctattgtgggaccaagttggagaaagccaagtgttcgggactgatatcctgagagaagctgaagctaaagtcagaatcattcgggataatctaaaggtggcacagtctcggcagaaaagttatgccgataaccgacgccgtgatctggaattcgcagtggatgactttgtgtatcttcgggtcacgccattgcgaggtgtgcacaggtttcagacgaaagggaagcttgcacctcggtatgtgggtcccttccgtatcatcgctcgacgcggagaagttgcttaccagctggagttgcccgcctccttgggcaacgtgcatgatgtgttccatgtgtcgcaactcaagaaatgtcttcgagtgccatccgagcaggccgactcagagcaaattgaagttcgcgaagacttgacctatgtggagaagccagtgaaaatcctggacgccatggagcgcaggaccaggaaccgggtaatccgtttttgcaaggtccagtggagcaaccacgccgaagaagaagctacttgggagcgcgaagacgagctgaaggcagcccatcccgatctcttcgccagttcttccgaatctcggggccgagattccgtttaaggggggtaggtttgtcgcgtcccaaatcgactctaaaatctatcctcgaaattgtgcaaagaataattaaaattcatgtgaaagcctccaacaattaaaatgtgcaaagataaaagtcaaatgaggcttggaggatttttgtatatttcctaaaagcctaaaatgcttaaataaattttagtggaattttcagagcacaaataataattgaaaagaaataaacaaagttaaaaaggt

SEQ ID NO: 21257 - DNA, 1501 bp, Oryza sativa
gcccagatgaggagctccttgaagatgaaggctttggtgtctagctcgtgcctgccgtcaagtgcctgtggtcgtcgccctagtcttccgctgtttctcgtttgtctttgtgtgttgggccttcgctgcccgtgtaataattttatttacgcttccgcttgttaaactctgaattgtatcaacttttggtgtaccttgcctcctgggacaaggattaatgcacgcacgtaaggaatgcccgttgggttatttccggtcgtgacaagttggtatcagagcctcccttgaccctaggacgagccgtagatcccaagccttagcaatattttcaaaaataaaaatcctttattatttgtgaaaacccgctattctctctttgtcttgctgcttcacttaccatcaaaatctgatcttttaaatgttgcttttcttttgtttgtagatggccggcagcgttacccgtcgtggtttggacatgactggcttcgtcttggagctgcggggcatgtgcgtggtcttggggtatccacatggagtggattaccaggccaggccgctcccggagcaggagggtgaggatgcagagcctcacgctggttgggaggtcactgcagtgatcctctccggctctcccgagcggacttcgctggcagtcaccgcgggtggggactccttccccgccgcttgccagaacgccgctctcctcgccatcggcacccttcaccagcgctacccggacgagttgcagcactcgccctaccgctaccaccctcgtcgcggaggagcccgcgacttcgccaccttccgagacgccagctcggaggatgacgctaccgtcgtgcacctggcacgcatggtggaggcatacgacgcagctcgtatcgacttccatcagatggtgcgtcgtggcatggtggagaacaacatgaagatcctggagctgcgtcaggagaacctgcagctcaagaaggacctcgacgcgttggaggcgcagctgcaccagctcaagatcgcccagggagaggtcagccgtcccaagcgtcgccgcgtctgccgcagccagaagatcaccgcccgcaagagcacctccaggccagagcttgtccgtcagtccctggcgtggacctgcttcgtcgagacccctcgtgccgagcctgcgcccgtggttccccaggagggggaagcctccggcgttggtagctcggagggtgcgctgttgctcaccttccgtcctggcccgtcgcagcggtagacgagcagttagtaggcttgcgcgtgtgtttttcctcgtttgtcttcttgagttgtgtggggcatggttacgccggtgtgtggtgtaactatgtcggagcctgtctttttttgtttgcctaagcaacttgaacattaatgaaccaatttaatagcagtgataaatttaagaataatggtagtcgtgggtggttagttttaatcgtcagctctcctcctctgtttgctggttctgtgtggggttttcaga

SEQ ID NO: 21258 - DNA, 1501 bp, Oryza sativa
ctctctccctcggattcgtccggattcatcccgcgaagttcgccggcgtcttcaatggcgcccgagatctccgcgcgcggtttcctctctccccggccgcgctctccccctcccgttgctatatattcgatccccgtgcttcgctcttccgtttccgccgctcgccgctcgctctcgccgtcggtttcgtgcccgcgccgtgctcctctctctccgccgtcgccgccgaccttcggttcgccgccgccgtcgctccggtcttcctcccggctcggcgccacctccctcggcatcgccgcatcgccgtcgacctcgtccgcgcctccgtttcgctcgccgaccgtcggagcgccgccgtcatcgtcatcccgagccgcgccgccgtcttcctccgctccgtccgccgtttccgccgccttcgctgcctcggggtgagccgaagaccgtccccttcgtttcccccttccctcctctctctcgggcgccgctccgccgcgccgatggtcgccggcggtgaccatcggggcgcgggcgcgccgctcccgtcggccgtgccggcgaggccgccctcgggcgcgccctcgcggctgccaagtgggcccggccgtcagccgcccgcgcccgcgggtgcggctgacgcgtgggacccacggcgccgaccgccgccagccgcgtgcgcccggtccaccgtggaccgtggggctgacgcgtgggcccccaccccccgtggacccggtccgcgcgccccgctccctcggctgacgcaataaacatgatttttaattaaaatttaaatgaagaaattcgcaaatatccatttaaagagcatataaacttcaaatggccatatcttggccatttgaactcggaattggaccgttcaagtctctaatttttccttaagaagtcaagaacccatttttgtgctttgttcctgcttgttgtttggagtttattagagtaaaagccttttcttttccgttggtcgtgtagacgctgcagcttcggaagatccgctcttcgtggaagttgaagccgtcgtttgggaaagcgagcaaggcaagtcacatcatccttgaacatattgaatcccagtttgtaaaattatgttgatttaaattattgcattatcgctttatttaaattcccgcgttatcactgttttatttagccatgcctatttacctttgttatgaccatattattattgtcattgttattactaccttgttcaccctagaataaacaaaaccccaactagtggacactctatttatggttccactagtatgaatttaggtagatgcttcgctgattaataggacaacattaggtggttttacaactttagactttgggaaatattcatatcacctggacactatggaattgttggtttatggtggaattggacatacacctctcttcccctttcaaaacccctaaaacctgttttcggtggggtttgggtgcatgccagttgtgggaagtagcaccccgg

SEQ ID NO: 21259 - DNA, 1501 bp, Oryza sativa
tagtgcattaaaaaaatattactcaagaggtaatgtgtttaaggatttgcaagggataacaattattactcagaagttgccgcacacatgtatctagaaagtgcctctattttcttatatagacattttataaaatacctcttggtttcaagagataattcgctaaaaacacttataagacatcatttaaaatgcatctacacatctttcgccctttcaaaattgctggtagggtacccaacccaattttcaccttctctccatccacctttgcactcctatgaagtcctcacaagtcttcaccagagttttcaatttcaaaattttggaaattgtttggcctacattatttgaaattttgactgattttgaatgaatttgaataaaatttaaccaaattcacaaaaaatgcaaaaaaaaaaaatttgggtgaaatgtgggcttgccatgggggggggcgaaattaccgaaaattcagaaatattggaaattttgaaccgaaatttcgaaaatattggaaatttcaaaccgaaactttaaaccctggtcttcacacatatctacaagtcttccttaactctcctcggcgttcacccatctccaccaattttagcctatcccgttgagtctttgactgtcttcattggtttatacctatcttgctagaaaaactaatatttttagggttaattgaatccacgccattataaattttactgttttgaaatataccattacaatttacctatttggagtcatgccattataatttgataggtatttaaattgtgtcactacttacccttcgatacattgaaattaaattttggactggattgccctttcttcttcctccattcatcccattctctcctggtgcctctcttcgttggttcgtcctatctcttccccactgatgagctcgacgagttccgagcgacccagtggatgcggcagctatggcaaagcaccctagccaggatgagtatgacgacctcgttggtggtcggatgcatggggggttgatctcgttggtggaaattacagctctcgacgagatctacaattttataggtgataactttttcatttgaaatcttttagatattcaaatctatgatttaaatctcagttaggtaggctcaaatggaacgatatgcattttctaacagaattgatgcgtaggtgagttggtaaaggagagcacgcgtgaaataaatagataggatgatagattaatatttgaacttttaatttggtacgtagaactaatgccacatatggagtggtgacaataatttttattataacgatgtgaagtgttgcaatataatttattaccactaaataaaaatagttgcaataacctattaccacgttatttcttaccatggctagcaatgattttaaaattgtggcaacatgtatctattgtcataattttaatattgatgccacgatttttttcgtggcaacaaatgatttttctagtagtgagagt

SEQ ID NO: 21260 - DNA, 1501 bp, Oryza sativa
caagagattcaagtactttcttcgcaagagtggctatggcaaagggaggaaggatgatgataagggaaagaggcaatcaaagagagcatgcttcaattgtggcgaatatggccacttcattgccgattgtcccaagtcaaatgaagctaaggctaagggaggcaagaagaagccgaagcgtgctcatgtggcggaggcacacatggcggaagtgtggtactccggagatgaagaagatcccgatcacgaggtcaagctcaagcccaagtcaaaagacaaggttgaaggagaaggtggtgttgctaccgtcgccttcaagtcatcctcttcaagcaaggagcatcttttcaacaacttaagtgatgacgacgacgactcctaccactactcttgcttcatggcccaaggccgcaaggtgatgactcaaaagccctctcaaacttctcttgatgttgattccagtgatgaggaaagtgataatgaattagatgatgtacttaagagctttagcaaacccgctatgcaacatttggctaagtgaatgagagctttagatagtaaagaacaatcactcgaaaggtaagaagaattgcttattcttgagaagaaaagaaaccttgccttagaggagagcttaactaaagaatgtgctaaaaatgaacaacttgctaatgagcttaatttggctaatggttctttagctagccttagggatgtcaatgaaattcttcaagaaaaatttgttaatttagacaaaagtcataaagatcttgaagttcaatttgacactctttggaatagcacctctcaaccaaatgtggtttctaattcttctaaccctactactagcaatggttgtgctaggtgttacaatattgatttgaactcttatgctactaatattgatgctatgcaagctcttaagaaagagaatgaaaggttgagcacattggtgaaatatggatgcatgaagacataccattcaaaagatgccctttacaagaccatcaccgctcatcctaacaagaatggacacggctcgggttttcgggtggaagtcatgtgtctaagcgtgtgatggtaaatgggaaagaatgcttgatgtttgtgagagaaggtacgtaaagcaccacaagcaagtgaggtgactagtcttgtgagctgccagggacccggaacatccggacaaaccgggagaaacttccgggtgggagtctctgtctctcaaaaattcccaccaggaagttccgggccaatggccgtgcacacgatatgaccggaagttccggtcacaatgccaggaggttccggccagagggtttttactatgattcatatgtaatttccaaaaattcagagggcaaagtggttgcctattttaatgggaattacaatgatgagtaccgcacttgtgtgtgggtgacaaaggctttggtaactaacatcaagggacccaaacttagacaagtttgggttcctaaatcccaagcttgatttcttt

SEQ ID NO: 21261 - DNA, 1501 bp, Oryza sativa
tgtagtattgaagtatcaattagtaatatagacaggttggattttcagatgattatgtggcatatcatgcattaacgaaaaaactattactcagcagtcgtattatgcttaaaattttcactattcaagattatcagtttacactcattactgctttcagcatgtttgcagagctgatacttcgaggctatctatcttctgttgtacagtgaagtttagtagtaattaagaaagtgtaagtcataattttttgaagttctctatttccattagctaaagctagcttcctctgtcgaagtatattgtagctgcacatatatgttaaactgattcatactagtcagctaaggatgcatatcttcctgccatgcatgtctgtttcatggcaaaagatatgcaagaagtaaatgagaagaagcagggcacgaccttgtcctcccactagtagacgaatttggctggatttggaatgtggttggatttggctgttaactgggttgtaagttttgtgttgtattggatgtttgtcgggttgtgttggatgctaattgtgctttgacctttgtgctatatgggttgttattgtgtttcattgttggccctctatgggcttagccgatactaatgtaaatgaatacaacatgacgggcagaaaatggtgtggtataatatttgggcctatatgggcttttgcaatggacatggcccatttattatttgatattaaagcaaatggatataatagaattgtgttgacaatatgctacaacatggatggactaggctaaaatctagtcgggtttgccattgggctaaacccataaacaaggtgctaaatacatgaattttaatgggtcatcagctattttatgacgttttttaggctagataatgaaaaatatgagcgtcacaaagctatgacgacggaaggattgtcactagattaatagaaaaaaatctttcgtcatagaacgctattagagatgcatgatatgtcatagcctgaattttcgtttcaggatttataaattatttaataaattattaatagaatttatattaaatgttcattaatttacaagtgaagttaaatgtgggaaataaaatttcctaaatataaagcatggttggatttaatttttgttaaattctccatgattaattatactctctggaattttctcggatttttcagagctcaattcctaattttaataatataaagaatatttcagtaattattcatattaaattaatcatttaatgagctggtttcaattttgttaaatacttagagtgtccaagtatgttcaagatttttcttggaattatttgagtattgaaagtatttttaacaattgaaagatcatctcattggttaatttatttggaaaagcaataaaatcttccttcctagtcttgggccgaattcagcccattctctcccttcctctcagcccggccgaaagtctgtttgtggtccctgccgctacagtactcc

SEQ ID NO: 21262 - DNA, 1501 bp, Oryza sativa
gtaaacacagaaatgaccgtttgattggactgcaggaatcagatgaaagagatagactcaaggaaagttttccaagaggttagagtggatgttaaattttgacaaaattagatatatagcatcaaaagttcacgtttttggttttataacaccgaaagataccagctcactataatagcacccaaagttcgcatcgttcccatttttaacacttccgtcaattctcgatcgttttctatccgctttgatcgctattgacataaccacacacgcaatatgacgtttctacccctcacaagtacatgtataatgcatggcaatgaggggtaaaaaggtcatatcgtgtgagtggctgagtcaataacgatcaaggcggatagaaaacgatcgagaattgacgaaagtgttaaaaatggaaaggggtgaactttcgatgctatataaccaattttgtcttaaattttctatgtttttcctctagaatcgtaggaatacgaaagtttcctacgtttttccttttctcattcctatgaatcaaaggcataaatagtgtaggatttcaattcctttctttttcctatatttttcctccaattcaaaggaggcctgaacaagacgcatggtacatttatcgtcgatccattgcaattctcgctgcatacaaaatgattaacttaaacatatgccataactacaagattaaatcaaaattaataggtgccaagaatttatcgtcatatcaccaccaccaaataataaattaaattcatatacatatgtcacttactttcaaaagaaccatgtataatctctaattacattactgtttggtgcaggtcatgtcgaaaatttatattactctcatattaataggagacccatatttatcaaagcatattaccttcccaaaattaaaaaaaaccaacaaaaatatatcacatacttataaaacttagtgtataatttctaaattactctaaattaataggtaacctagatttatcaaaaacatatgacagctgcacgtagtgaattggtatcctatagtagtcttggacagaaagaagggcaaaaacacaatcgaagaaaaaaaggggtcatttttttatctcctatcagccattcaaaatgctttcaaagatgcaaaacaaggtgcctattagaaaaatggataatggacgaacaacttatagtatgtgaaaacatgtttagcaactaaaattaaataatggaagaacatattcctgtatggaccagtcattgaaaacttatttgtcaactaggagagtgacaaagggctccgtgaagtgagcgtaacttaattggttaagtttcttatggtgaaaccagtccatctgggtttaaattctaggcttgacacatgtgctcatatttacggctaattgttttttttaatggtacacgacgtatccctcaacaacgaggcacccgtagtgacttcatcgacatcaagatatgacaacctagtcttccagagatg

SEQ ID NO: 21263 - DNA, 1501 bp, Oryza sativa
ctatgtcttttgatcaggatttttcttcctttcgtatgaaatccaggagtccatgaatttcgttcgtacgttaattccacgcacgagctcatgcaaaagacagggggaaaaaacagtgtcgcacatacgaaacaaagtgtttccctacaaacaaagacttctttgatcccgtcactttgaagtctatatacggtggcaaatgcaaacgcatgaactgacgtgttagcaattggcagtatctccaaagtgaattggagatcatactttttcttctctgtctaatcgatccgtggcatcaaaagcagccccttgaccgatttgagataccacatcgctctctcgtggttaatatctaataaaattataatactatgagaaatatttataaaagattagctcatatgttagaataattgggctaggcccaatttataatattaaatctcaaaggcccataataaatgttgaggataataataccacctcaggatttaagcgagaaatatctcaacctaaatagggagttattagaggctccctgttgactagttgaggtgggggtcggaatgccacacgcgcgcgcgcgcgccgggccgtgggcgaggcgtggctggcggcgtgcgtcacgtcgctatccttttgcagccactaacctacgttcccacgattccctccgcaacagcgcgtccacgttctttctcctgatagataaggaggccgcgagtccgatcttgcgcgcacgagagattggaaggagtagtgcctccgaaaccacaccttcgcctgagatctgcaccgggtaggcgggtgatcaggttttggggagtgcggaaggagtagtgcctccgaaaccacaccttcgcctgagatctgcaccgggtaggcgggtgatcaggtttttggggagtgcctcccgcacgactgctcatcgccatgtctggagttgctgccgccactgctggcggaggtggtacgccgccgccgacaggagctggatctggatccggagctggtgcgccaggaggaggtgccgtgaacgactacaacaacggaggcaattctgcctcaccatccagcggagggccattctcggggtataatcttctcctcctgctactgctgttagcgctattcctgttcccattgttagcgctatactatgtgcgctatgttcgctatgttcttgttcctgttctacatgatgcctctagcatgttatcgagcatgttatcgcgttactggtatgttcctgttcctgacattcatgatgcgcatagtatgctactggttatgttaagatcaccctacactgcttatgccatgatcattgtttcattttcttggattaaaatatgccgattaatgactatatttccaacaatccaaaaacctgataggtcattttcggtagttggctttgctgctgcactgaaaccacatgcttttgatggttcaaactataagagatggaaagcacgtgcactattgtggttgacagcga

SEQ ID NO: 21264 - DNA, 1501 bp, Oryza sativa
aacttccacctctcccccacctatccctctcttttgcaagagtttgccgaccaggagaggggtggtgtctggtgggagaggagcaagacgacagcgacggtgacttagatcctcaccggcgagatccacgtgggaggtcgaaggaggagacgcgcgtggtggagaggggatggagcgatgcaacccttcagttgccaaggaatggtggacatagtgcagcatcgacagcggtgcttgggcaaaacgcaacacgatggctcccaatctctctagcacggtggctgatggcatggaggccaagctccatggcagcaatgctgcctcgtcaagctcatgtgtcctcctgcgtcaccatagccttcccgagctcctgttgttgcattgtcgaggttctccgtccctaagccgctttcagcgtcgacgcgcaaaggggctccccagttgacggcgtcaaggagggctcgatttggctattgtcgctctaattcgccctccgccatcgctgcctcctggcccacctcgctcctccttggcgagcttcgccgccggttctccatctcataacatatacccatcccccccccctctcgtcggccaactaccacggctcccggcgtcgctgaccattgacgaggcaacaaagctcgagctcgcgggagaaagtggtgcctcatgctccccctaccttctcccgagccttccttggcctccacttaggggtgtaagtggctaatccgcaaaacccacttatatgctaaattaaaccgcgaacctgcttatttgacctataagtgggttcgcggctgacccacttacacccctacctccacttgctccttccccgctggccaccgctaggaggaagagaagggacaggtggaaagaccagagatgtggtcatgtggagaagagaggagagagggagattagaggaagaatatagaagcctgacatgtgggcccacgtggatcccttgttgtcttagtcgggttgattgtaatcaattcgtcacgtcaaccaaaccgaccactcataccgccatgggacctaatttaatctggtgttgctagttttggatggttaagatatccaatatattgcagtgcagggaacgatttgaacttgtcgaaaacatgagggatgtagaatggactttattcattcgtacaatgcagtaacacacgcacggcctggtccaacggcataagagaatcgttgtcaaataaaatcatgagatgccattttcattatcttaatttaccatttattacttgtaaatcatgagatcgttcagatccgatgccgcgagagccccgaagtcatagatatgtccatcagatacctccgtcgtgtagccatcgacttcaaaaggcagaaaaaactttgaatgagctttcaccaatatgcagtcagattatgggcacctgataatgacgtaaagcaatgacacgctctattatttacgcatgcagaccagtcgctgtaggcggtacattacaat

SEQ ID NO: 21265 - DNA, 1501 bp, Oryza sativa
gaaaattatgggtacgttgcggacggtggtttttcagacttcaatttaaattcgctcatgaccgttgaacttcgcgcggcgttgtcgatgactctttgtctctacggttttcacaccgggatcgaccagatgataacgacaacaattccgacatcagaagtcgcgattgataacatgagctcatttaagcagaagtcgggggctactgtttgggttacggataaggtataccctctatccttggatgtacagtgggtaccgatacggcatacccacgcgtatacggatagtttccgtatacgataaggaaatctgtcacgtgatagaaacaaaatatacggatgggaggagtcctactcggacgagactgagtctttaccatatcgtgaggggtcctatatctccgagtcctacttggagatcaactgacccgcggtatataagggaccccctgggcaggacctaagacatcgaatattactgccaacacaccccccacactctacagagccggagcgcgtaggagccaagtcgctgggagatctagtcagaccaacttgactacgctcttgtcggtatcatcgagttctgttattccctttgtaccctatggtttccatcatataatcccgtaccaactggattagtgctattaccttccaaggggcctgaaccagtatagtataatccttgtcttctgtttgcttgatgtcgtattacgtagatcctcgtaccaacggaccccaataccctctatattcggtctatgggtatcccccatcgacaaaaacctttgatggattgtaaaaaacattgatggagtaactaatgacaattaatcatgtataagatgtaaaaattacttcctgataacatggaagttacttcataacatgtaataatttacttttcaattaataaaatatttgaatatattcaatatggatcttgttttgtcacatattttgagtggagtacaatgatgcaaatagatcttaaaaacaatatgtgatttaaaagatataagttattaaaaaggttaaaaaaacacactctattgtatcttttaagttgaagggggatttatactggatggagtggtagctggataagacaaaccagtgaccggtagctgtttagtcacgcccttataaataacctaagattcatagtatactatagcgtataacgatcggaaatcctaatcggcgattgatcgcctgggacggggggtagcgatcaatccccctcccctccctccctccacctagtttccttttttggcaccgcattactttcctattttagtaaatttatgcacctaaagtttatatacaccttaagtttacacatctaaagtttatacaccttaagtttacacatctaaagtttagagaccaaaagtttataagtcaaaagtttttatatccgattcaaatttgaatttgaattcaatttttttatatatagtatttctatacatctaaagtttacacaccta

SEQ ID NO: 21266 - DNA, 1501 bp, Oryza sativa
tgatctaaaagtagtggagtattcattttgatgatctctacctttctctcttctttgttcttccaccgctggagaagtgatcttcagatctagtttacaacgcctttagtcctaggttacaaaccgagactccgatgagcattttttaagtaccggttgaaataactgggactaaagattcatctttagtcacagttggtggtgctaccaactttagtccagattggtgttaccaaccgggactaaagttctttttctttctttttctattgttctttgctgcttgcatctattgattttgagccgaaatcaccgacgccgtcaccccaaatccccacaaatcatccacaatttataggcccatctataaaatcatccacaaatcactggcccatccacaaaatcttcccaaatctaaaaaaatctataataaaatctaaaaacaaatcagtcatagccagcagacgggggtgaggaggaggagggccccgcccggccgccgccgccgcctcctccaccgggctgccacccggccaccctcccatcctatcgcctcccctcccgccggatctggcagaggggaggccgccgcctcgtgcgccgttgcccgcctctcccgccggctcctctcccgcccgatccgacgcaagggagggtgtcgccgtggagatgggagagggagaggggaaggggaggaggggatcagacgagaggggagggggaggaggagtggaggaggaggagaagaaggcgtgaagaggggaggaggaggaggaggaggggataaggcgttgttgccgatgccgagataaggaagagagagagagggggagagagagtgagagatgccaatgacgtgggagagagatatctaatcccggttaccaaccgggattaaagatataattttttttgtcccggttggtaacgaaactagactaaagatggacttttgaaccaggactaaagatgaattagtcccagtttgttgaaaccgggactaatgtgattgtggagattatggatatcccatatctacacggcgatgatatttgggctgaatataggataccgaatatagatagaatatcttatttgtatctcgggtttgtttctcaacttgtacatcaaggaaataccttgagacttagtcggttacgactgtattttatctgtatctgcatattccgttagggatatagattatcttttgtaacacggactccctcccatatataaggggggtccgggtgcctctaggggcagaggttgattttctccaaattatacaatcaataagacactcggcggattcatccccggacaggagtagggtattacttcttgaataagaaggcctgaacctgtataaatcttttgtctccaaacccatacacttctccagcttgatagccacccccttttattattgccgaaatctagtttcgacagttggcgcgccaggtaggggttgcgtcaagcttttcgccgatcagtgcaa

SEQ ID NO: 21267 - DNA, 1501 bp, Oryza sativa
attaagtccatttccagtaaaatgtatcatttttatgttttcaagagtatcacataaataataaggtatttaattgatgattaaaatatcttatacaacgttgtttcaactttgttgtttcgtacatagtacatgcaagagataaatagtgttaaaaacagtggagacataatttcatccagatgaaactcatttcatctcttacttccttaatttcttacaacatcattaacattgctgacatagtaacctatttaatgagaataaaactcccactaaaaatagcccaaaacaaaatataaggatttatatttagcaagctaactttaaaaaaatagtctatgtgtaatacgaaacacccccaaccattcttgcataacagaaacacactcacatgtttaaatcagtgacgaagctatacagtgtttgggggtgcacatgaacctctaaattcctaatttctcacttaaaaagactacaatatacagtgttgtaataaaatgttctagattttcaatgatagtatacccccttgtcttcccccttatcttgatgctagcttcgcccctgctttctgcaaccccccctccccattagggccaatgaacctgtgaagttcaattttcgaattttgctttggcaatatgagcccgggcaatactcaatccaattttcgtctagggcactgcctgctggcaatgatgcgaacgatcgagcgtgggtggagtcaaagcctttagtacgacgtgggggcatgggccgaggcatgcatggcccgttggcctgggaataggatgataagcacgtgtgctttcattggtcttggtgccaatctaaaatacgacgataaaaataaatggagaaagtatatagaattattattgaggtatatgcatgtacgcaagtatcggttctaaatatggcttgacgaggcctaccaggtcgtataccaaattctatatggaatcaagctttatacatatggcagaggacttaagtagataaggaaagagttccgataagaaaagaaaaacagtcctactcgagcattataaatttataagatttactcggatcgtatctatatttgcctccctaattctatccagacaatggagcatccaagggtgtaaatataaaacccccagaactagagaggacacaccgagactaaaacaatacaagtcaacataaagctacaaaagtcaacacatatgaccacacaagaactatatgatccacaagtgccacaaaagcctatataagttcaatcgcacactctatatatgctaatgtaaggtcctcatcagtggcgaagccagcgatgccatcaaagtccggatgattaatagtgtttttcggtgatcgattaatctttatagatgtcaatggctattgatagtaaagatggtaccggcgaaacccgggcagtcgcccgacctgcccgagagatggctccgccactaggcctcatactttggcctaccagttgaaggtggtt

SEQ ID NO: 21268 - DNA, 1501 bp, Oryza sativa
catagaccgaatatagagggtattggggtccgttggtacgaggatctacgtaatacgacatcaagcaaacagaagacaaggattatactatactggttcaggccccttggaaggtaatagcactaatccagttggtacgggattatatgatggaaaccatagggtacaaagggaataacagaactcgatgataccgacaagagcgtagtcaagttggtctgactagatctcccagcgacttggctcctacgcgctccggctctgtagagtgtggggggtgtgttggcagtaatattcgatgtcttaggtcctgcccagggggtcccttatataccgcgggtcagttgatctccaagtaggactcggagatataggacccctcacgatatggtaaagactcagtctcgtccgagtaggactcctcccatccgtatattttgtttctatcacgtgacagatttccttatcgtatacggaaactatccgtatacgcgtgggtatgccgtatcggtacccactgtacatccaaggatagagggtataccttatccgtaacccaaacagtagcccccgacttctgcttaaatgagctcatgttatcaatcgcgacttctgatgtcggaattgttgtcgttatcatctggtcgatcccggtgtgaaaaccgtagagacaaagagtcatcgacaacgccgcgcgaagttcaacggtcatgagcgaatttaaattgaagtctgaaaaaccaccgtccgcaacgtacccataattttctggcagcaatctctctcctttccttggaatacgcaccatcgggagtgcgcttatttaaaggaaatttgggaatccatttgaagtccgtttgccagaaagctctcctgccctctagcgctcttcgtcttctccgttccccgtaaagaaaaccctagctcatttccttcatccagttatccggcgatcctctggcagcgatggatcttgagaagtcaacttcgaccaccgcgtccatgaagaagctgtaggacgacggtgccctccccggtcgcgggaccatgcaaagggaggctggaggtacagaacctgaaaccatcttgggccgcatggatgtagtcgaagattatatttcttgcggttttcttcctccgccttccgagtttcttcttctcgccttgaacttctatggcctttctttgcttcacctaaaccccaactccatcgcctttctgagcatcttctctcatatttgcgaggcctacattggggtagtgcccttccttgatctcttccgcttttattatgagctgcgctggatggaatccaacagggtgtctgtatgcgtcggattccgacttcgggatgacctgaagtcgcgttacatccccttccagtgcccctcttctcgcagcaaatggcagacgagatggttctatctccagatagaaaactcagatcccgtcctcgtggtccctaaggaccagccagaaaaaaatcccagagtggcccgcc

SEQ ID NO: 21269 - DNA, 1501 bp, Oryza sativa
ttaggaaattttatttcccgcatttaacttctcttataaattaatgaatatttaatataaattctaataataatttattaaataatttataaattctaaaacgaaaatcaggatgtgacagtgatctagtgaaaacattgtcctcgggactagccatccatctccatcctattcaatgggtttactaaacagtcgtaattataggtccaaatgagaagactaacaaactggaggttaatttaatgttgacgtacggatcatatatcgaacctcgttgtatgcattgaacttgatcggcttccttcgattcgaacttttatgacttacttctgttcgagcaattgtaaaagatgagtgaccattgaccagttttcactcatcctataattgatgttacagtatcagtgtattatccatatctttctgatccttaataagaaaaggttaattagattcgtgctattataattttcatgattttaaaatatatcattataattcatctatttaaaaccatacgattataatttgacaagtattcgaaatataccactgcttaccccttcaacacattgaaagagaattttggacaaaattacccatttcttcttccttaatccatcccattctccttccaatcttcctcccatctctctcggatctgctcgactcgtcgcttgtgttgcagatggctgctgcttcgcgtggaggtggcaggggccggtgttagggaggatgcgaacgtggtagctcacgcatgcccccgtggagggtgaatcgcttagggaagcccggggaggagctagttgtgcccaggaggacttcagtagctttaattcttctgtgctgtggggttaactagtggcggaatagattgcatttactagatgcttaatcgcaagaaaatggcaggcatccgtgctttggaagtggtagcgaaatactgaaatagcagctggggtagtggaacgggaaaaaaaaataaatagtgattccactgctgcaccgtggacgatggacgttggtggcgacgggccacctggcagggctcagaagcaggaagcggggcttccgctgcagctccggcgattgcacgctgtaacgaggtcgcgcgtggagaccgggccacggtagaccaccaccggtgccgccagatttcctggccgacttcatttcttgctcatgtgcatctttatccagctgcataactctcattgtattccggaagctcgtaacatggggcctgataagtcccaatttacagtttcttctccgctaataaaaccaactccctcaactcgttcaaaaaaatgagattctgtataataagttgttgatattcaataactcctcgtaaaaaataatcagagaaatctaaacatttatcgatccatccataaggcagatcggcagcaactcctccgatgcgaaagtaattatgcatcattcgcatacatgtagcagcttcaaatagatcatatattaattttctctctctaaa

SEQ ID NO: 21270 - DNA, 390 bp, Oryza sativa
ttcatcatgactacagaaatgaacaatgttgctacatcttgtaataatttgtggttttcaattgaacaaaacatccatcaaatgatatctacagcaatatattttgcacttctgagcacacaataggtttgagtgtattcgagtcatggtcattgatttaagctttttatttcactacataaccattgatttgagtgtatctaaggagttctgtttccacaagtactttatgttaatggtgtctccttatgctttggccatccaaactcattactgttgtttaatatttttagtggttagtggtgtccaaatctttctttgtgtacatcatactatgtttttgtagtctattaaacttccatcctatcatctgacttgttatattccagg

SEQ ID NO: 21271 - DNA, 1501 bp, Oryza sativa
gaaggctaatggataagccgagtcgagtaataaaacattgttgaaattgccgttttgccagttgaggtaaatcttggctctcttcggtatttcaagcaagacgacatgtcggttgaagattacaagaccttgatgggaagcaattttgaagacgtcattgacaagcgtttgaagacttcgaaggagatgaagacacttcaagacggtgttttcagagagcaattaatgggagatagcttgaagaaatacttcccgagcatttggtaagatgcttaggaagtcctatggccggtaattggattatcgccctgagataacatgttctatgcttttaggttcacgtatgttcaccaaaaaggcaggggggcatgtgtttacacccaaatttggcacctatggacgaaatagggaaaaattgccaaagtttggaaagtgccgggtttccttcacagggccggtcagaccgcaggtatatgggcggtctgaccagctatagggccggtctgaccgcaggtatgtaggcggtcagaccgtcagggtccgagtccgagtctgttttcgtcggatctcgggtttccttgctcgggaaggcatgtttcgtgtttcctttggtttctatcccgagttggacatggagaagggcctgtagagggcaagaccaacccctatttaagggacaaggtccggttcattgtaaaacccctgaatacaatctacttgaatcgttattttactatgttttctattttaccctagtttagtccatctttgtcggtttgcgccgtaaaccgtccgccgccgctgcgagagtgcgacacctctttgtaggtttgtcctgaaaaccttccgttttgcccacgagacgggtagctatcctcatatcgatctaaatcggcctagaggctgattttgatctctaaatcggctccgctagccggtttagcttttccttttgcaaaacccatcttgatttggccctttggctagatcgtggtggttggcgactccatatcaccgcaaggcgtttaggtgttgcgatcgtgcttgtcgacttgtcaaaaaagttgccaacacataccacatagtttgcacggtttatatggagttggtatggttgatggctctgattgctttgatgtttgaccaaatctctttctacgagataatcttggtctttttgaatcactagtttgattatcaaatagttgaccggctaatcctttcttgtacttagctataagcatctcaaaagtgagcttcggctttttggtcttttgggaactagatgactcatcctttgcaactttatgatctccggcctttgccgaggatccccaataattacacttttccctttctttttgccaacatcaatagaactaatagggagaggatcactaacaattccggtcttaggcatagatgtaaccgaaatagtttcacaagtgaccgatgaagtatcaattggcctttgctccatcaaacttgcatctttgaaata

SEQ ID NO: 21272 - DNA, 187 bp, Oryza sativa
ccggccctttataaaaggtagggtaagtccccccaaaaagagggagatggtgcatgtggtatccccttaagatataaaaggaggaccttgcccacttagagggggggactggactggacttttccagattcggaacccagaacaagggagaggctggctcatactttgtagctccttcatacacaga

SEQ ID NO: 21273 - DNA, 1501 bp, Oryza sativa
aacggtattcggatccggccggtctccgactccgataaggagtcgggatcgtcggcatgccgccggccaatgagggggacgcggcggtggcggatggtggatggcagcggtggaggtggtggtggatgggagatggcggtggaggcgagtggcagcggcggaaaaggtggaggtggcggctgcatcggcggtgcccccacggcggcgcccccatggcggcgtcggcggcttcgccacggcggtgtccgcggcggcgaactggcggcggtcggcggcgaaccggcggcgaactggcggcggacgacggcggcagacaaggtggaggaggcggcgccgactcggcggcatcatggcggcggcggcggcacaaactgcaggggcggttagggttaaccctaacccccacgcccctccagcgcccccttttcccctcgggcccaatgggccggttgcactgtagcgggggtgggctgaatcctattgatttcggcccaccacccatttaccccttaaatttagtttttattttttattttcagcagcaatttcactttagtccctatattttatgtaatttagtcgaaacagttcatcagttgtacaaacaattatgtaatggtcctatagaccactgatgttatgtgtttattaacataggtgtttatttaaataccttgtttcactaaatttatttgttgtcttaataacatgccttttgcatattatttcaagacacgctctactttctctataaattttgtattttgatttagcaaattctcttaattatgtccaacataattaatggaggatttaatgcatgttccacttcacactttaacttggaaattaatcacatgtcgatggagtcctatactttggtcatatcgaccataacttaggcagcgagtatctcgcccatcataaagtggtctatattttgagatgattacccgatggagccctagaaattggccgcactggtcataacttaggcagcgagcacctcgcccatctcacagaggtctacatctcacgatgattacccacatgtgttcttttccaagaatatgttttgagaaatgagattatttgaaatttggttgaacacaaggtagtggagttctaaacattggctacggtatattcaccataatatatttgcctggagaccgtattttaggcagcaagtataccttgcccactattaagagatctactccactgtttaattacttgaagattatccacattgtgccacctaatttcgaattctaactaaaaattgtcaggtccataacctacatctttcgaaacattacagaatatgaagttttacatttcgcattgagattacaaccttaatatcatgtttttattaatttacctctgtaaattgataatgttaaccatgattgtagggacatggaaacaaaagagttcgacgaactcgccctcgatgggactaactatcccatatgggtttctgatatcaaaatca

SEQ ID NO: 21274 - DNA, 1501 bp, Oryza sativa
cctactcctgtgttttggggggatctgtgtatgaaggagctacaaagtatgagccagcctctcccttgttctgggttccgaatctggaaaagtccagtccagtccccccctctaagtgggcaaggtcctccttttatatcttaaggggataccacatgcaccatctccctcctttctgtggggacttaccctaccttttcataaatggacggagatttgtatagttgccgtccgaatgaccttctgataggacggcccatacctacctccacttccgccgaaagcaggtgcgacgtgggattatggctgtctgctgacgacatgaccagtgtcagactggtcacaaattgctcattcctgtccaccacgcgtcagtttagcaatctacatgttggcccttcttcacacaacatcttgcctgtaatggttaggatgaagcctggcatatatctaaccaggactaacgtgccatctctaggaggtaacacgctagctccagctggggacgagcgcctagaagccctcgtcctgacgggatggggcgaggcgtgcgtcagatcgcctgtcgccacctaacccgcgatctgaccggtctgtgactggtcacagaccggataaacgagtgcactgcacttcgttacatgccgcgtgacacgctcagccaaaccgcaataaatgtggttaggtgagccccggtgtgctcacctaacccatacacgcggagcaaaaacccacgaggggtcggggcgcctcggccctcggggccgaggcgggtgcggtccgaccccctcggggggactaagaggagggcgaacacatcaccctcgggcccgacgtcccccgagggtgccaggccacgtgggcgattgtgtctgcctcaaacctctagtcatgatactcctgatcccatgtcaccgacagtagcccccggcgttatgccagggcgatcgccctctttaagggaagcggtcgggcgtgacgccactcctaaggcctggtgacaggtgggaccggtctccacaattgggcagaaacccaacggtcacaaatcacgcacatcggcaatggtaactctactatcaataatgagcggtctcttcaagactgccacattactcgagtagcacacgaatctggacatggcgattcgtttcgtctggagatatggtaacgtcgctttggtcggcgagcgtaattaacgcgcgcacgatatgatctatctcgactgccacaaccgcatatccacctcatgcgccgcaagcgggcgaatgggattagtggaagcgtgggcgcgagaaacgagggggcgaaatagtgggcgcgagaagcgaggagccgggcacagcgttggcaagagtataaaggcactgaggaaaggatctgtttccttcctttcgccatcatttcccttgtcttcgccgcttgcgccctaactccttctttcctgtgctctactttcgccacacgcgctcgctctcaatcttctcttcctccggcgcca

SEQ ID NO: 21275 - DNA, 1501 bp, Oryza sativa
gataacaatgatatgtaagtaaatatgtatttgtattttctttaaaatgtaatattacagttatatataactaaaattacatttgtaaatttagttgatatgacgtttaagtgcactgtaattttgataacaatggtatataagtaaatatgtatttgttattttcttcaaattgtaaaattagagtcatatataaataaaattacatttgtaaattcagttgatatggcatgtaagtgcattgtaattttgataacaatgatgtgtaagtaaatatgcattttttattttctttttgtagttcgttggatgtaaatctaagggtagaaaaaaattaggtgatttcttgttaaaaatcacccgacaaatggatagtcagtcccgcgattttgctatagatttgtcgtgtgattttttctctcagatttgtcattttttaggccattcaatgtgtgccaaaattcgtgcgcatatattgggctgggaagcgcgaacccgcataggattctgttgggccgcgtgtaccagcgtcgatcggtcagtctcgctttttttacgctctgaaaaattgacatgcgtgttgttctctctccttctctctcgtttgaaaccaaaatacaaaattataatcctatataactaaaattacatttgtaatttagttgatatgacatgtaaatgcactgtaatttttataacaatcatatgtaagtaaaaatgtatttgtattttctctaaaatgtaaaattacagtcatatataactaaaattacatttataaatttagttgatatgacatgtaaatgcactgtaattttgataacaatgatatgtaagtaaatatgtatttgtattttctttaaaatgtaaaattacagttatatataactaaaattacatttgtaaatttagttgatatgacatttaagtgcactgtaattttgataacaatgatatataagtaaatatgtatttgttattttctttaaattgtaaaattacagtcctatataactaaaattacatttgtaaattcagttgatatggcatgcaagtgcattgtaattttgataacaatgatgtgtaagtaaatatgtattttttattttctttttgtagtttgttagatgtaaatctaagggtagaaaaaaattaggtgatttcttgttaaaaatcacccgacaaatggatagtcagtccctctaaaattcttgtcttcgcgtccttctacttttaggtctcgtgcgctacctcgtttatattgccgaaatcttgtttcgacagttggcgcgccaggtagggggctgtcgagtttcctgtcgatgagtgcgatggaaccaatctccgacgttaccgatttcgtcaagcatgtttttttttcgtctcggattcaatccagccgaagggattaatctcggcgatttcatcgatttaattttcaatattattggctttgccgtttagtagtcggattgttttctaactgcagattagttttagc

SEQ ID NO: 21276 - DNA, 603 bp, Oryza sativa
ccgcccattagcatttccgccacatggcatctcagtgtcgccaccgtcgatgagggagatgggcatacatgcatggtatatcggtttgcactttttatttcagcgaaaatttctgtagcaccaaaatacgaaatttcatgatttttggcattttagaccaaaattatttgaaatttcgactgaatttgaatagactttgatcaaacttaacaaaaaaaatttgacatattttaaaattccggtcgatataatgacttgtcggtggggttcgaaatttcagaattttccgaaattttgaaccaaaatcgctatcactagtcatgcgagcacgaagaattagggaacaattcaatatgaattcgggttaaacccatttatgcccaaaaataccagtccaatccaaacccttttttcttttttttttttgcctcagtccaaaccgctccggtccgttagctcactcaacccatctccacccaaataaagcccacccgtagtgaaaagggtaaaatccagaagaacaccacgcacaagcacaaccttgaaaatctgaagagcacacgaagccctaattaaccaaaacctccgccgccgccgccatgg

SEQ ID NO: 21277 - DNA, 1501 bp, Oryza sativa
gagcatgatgtccgcgggtcggagatcgaccatcagacgtccgaaccgtgaggaagacgacgtatcttagcaagtgcatcgtgttgctttcagctagcctttcatggcatcaatgctactccatggctagttgtgtagactccagtggcaggcaagagagacggaccggagaaagcaacagtagttcacaccgtagtaccgtaccatggtgtaggacacggcgtaatgtgtaaacatagaaaatgccgtggatcaacaaactttacagtcgtatatgtgaagaaaatttaagcgaaaaaagtatatctgagacccttcatcttatcgccgagttacaaaatcgtccccgaaaaaaaaaatagaaatatgacatcgttcaactcacgaaaccgagtcactctaaatccttaaatagttttgtccgacgcaacagctgtgtcaaagtgggaaccatatgtcagtaactactttctcttctctctctcctctagtactctccttcttgggcacgggccacgtggagaagggcaggcatgaggggcatggtcggcggccggtgaggcaggagcacggccgacgacgggtgggaagaaccggagacgcgcgacgacgtcctgctcctgtcagtaccttcccctttcttccctgtgctcttcttcctcctcccatctcacgctctctcgaatcctctcgcccctctcatcatctccccggtaagaaggcaagtcgtccatatctttgtgtctccttcagcatgagctcgcatcaaccccataggaaaccctcccattcctctttcccggcggctcggcatgaaacatgttccaccactcgcgtcatcccaagctcgggaaaaatttctcccggcgaccttcgtggaccttcatcgtctcgtcatatcaccgttgcccctcacctctcaacatctactaataacgctagccacagcaccgtaccagcatcgcctcccttcggaatagccgagccatgcccgccatgtcctccccacatcatcctccctaaacacaaccattagtgacacctgcacagcaatctccgtttggttgtgatcggacatgagggcaacggcggcacagatcgatctgtccccggttctccctacccttcgccagctgtgctcttccccgccggccatcggtcgcgcccgccgcgtcagcccttctgcccatcaactatcgccaaagaaggggatgactgggggagagagaaggggaagtagccactgacctgtgggcccatgtgggttccacactgattcagttgtcatgtcaaacaaaaccgcctatggacttagagtgatttagttttataagttgactgatgtcatatatatggtttttggttcatggatgattttataaataaatcgtcgacaagataaggggtctcaggtatactttttccaattaaagcagcaggccgagacctcacgctgggctggattgtctcgcctaaggcttgggctgggcaaacttcccgc

SEQ ID NO: 21278 - DNA, 1501 bp, Oryza sativa
agactcaaggaaagttttccaagaggttagagtggatgttaaattttgacaaaattagatatatagcatcaaaagttcacgtttttggttttataacaccgaaagataccagctcactataatagcacccaaagttcgcatcgttcccatttttaacacttccgtcaattctcgatcgttttctatccgctttgatcgctattgacataaccacacacgcaatatgacgtttctacccctcacaagtacatgtataatgcatggcaatgaggggtaaaaaggtcatatcgtgtgagtggctgagtcaataacgatcaaggcggatagaaaacgatcgagaattgacgaaagtgttaaaaatggaaaggggtgaactttagatgctattaaagtgaaccgttatctgttggagctaaaaaaaggtgaactttcgatgctatataaccaattttgtcttaaattttctatgtttttcctctagaatcgtaggaatacgaaagtttcctacgtttttccttttctcattcctatgaatcaaaggcataaatagtgtaggatttcaattcctttctttttcctatatttttcctccaattcaaaggaggcctgaacaagacgcatggtacatttatcgtcgatccattgcaattctcgctgcatacaaaatgattaacttaaacatatgccataactacaagattaaatcaaaattaataggtgccaagaatttatcgtcatatcaccaccaccaaataataaattaaattcatatacatatgtcacttactttcaaaagaaccatgtataatctctaattacattactgtttggtgcaggtcatgtcgaaaatttatattactctcatattaataggagacccatatttatcaaagcatattaccttcccaaaattaaaaaaaaccaacaaaaatatatcacatacttataaaacttagtgtataatttctaaattactctaaattaataggtaacctagatttatcaaaaacatatgacagctgcacgtagtgaattggtatcctatagtagtcttggacagaaagaagggcaaaaacacaatcgaagaaaaaaaggggtcatttttttatctcctatcagccattcaaaatgctttcaaagatgcaaaacaaggtgcctattagaaaaatggataatggacgaacaacttatagtatgtgaaaacatgtttagcaactaaaattaaataatggaagaacatattcctgtatggaccagtcattgaaaacttatttgtcaactaggagagtgacaaagggctccgtgaagtgagcgtaacttaattggttaagtttcttatggtgaaaccagtccatctgggtttaaattctaggcttgacacatgtgctcatatttacggctaattgttttttttaatggtacacgacgtatccctcaacaacgaggcacccgtagtgacttcatcgacatcaagatatgacaacctagtcttccagagatg

SEQ ID NO: 21279 - DNA, 697 bp, Oryza sativa
acccccattggcgggcgatcgatagcccattagggctgcccgccatgtggtgctggacaaggtcttaatcccacgtgtgataacacatttacatccatgagtgttcagcagaaagtggattcggcgaacacaacttttgttagagaatagttttttttatccagcatctacatccaaatggatatatgcaacaatttaaattgagaacttagcactgcaaataactcaatttgaaattcgctcatatgaagattttaactcagaaccttagggtgttactcaggtcactgcaaccactaggctacatcccccctttttcagatgtgcgaacacaattgctattccatataagctcaatcttctatctcccattgctatgcgcttgaaacaccaattcgcttggatagctaacacaacctgacacagagaaaaatggattagcctcaaacggtaatatttttacaatacacatcgtttaacggttcgagaagcatgctaatgaaaaagaactaagttgcagtctttagttgtggaaaagaacgagcccaaggtgttgagatcaattctaaataaaattccagccacagcacgaatgtaaacctaagttctgacagtcaaaaagaaaaactaaacaggaaggctgcttaaaacatgcatcatatgctagttagcaaaaccgtatgtacagaacatgttc

SEQ ID NO: 21280 - DNA, 1501 bp, Oryza sativa
tgcaatatatctagatttctcagtaccaaatacttgataatctttccaatatatgtatataataatcttcctgcaagaatttctattaaataataaaaaagtaatttatgggcaaattattattgtatcaaatttcaaaattttctacctatcttcataggcggatgttttttttttgcagtcggcttctacatattttcgcaggcggatcaatctagctaacgtccacctgtgaaaataatcttcgcaggcggacggacgccccgcctgcgaagatcgatgatcttcaccgtcgtttgcttacaagcagaggtcggccctgcctgcgaaaaccgatttccactgccggcgataatgcgttttctagtagtgcctgcatttacttgcaacctgaattcctcaaaggcgatgagaaatgcatctagtcctttaggacacggctacagggagttaccaaaagtagtacagtgtgtatccacttgttacccttcttactaaaagcagtagcacctgccacttgcatcctcgtaacccatctaaatttcaaaaaacaagtttctcttaaattacttatcttatctacgatccgattacaccgttgtgttcgttacaattaaatctgtacaacgagatcttaatgattatattatgaagaaaaaagtatttatgtttgtaaattacttttattatatactaagttacttttatcatatatataaattacttttagatttgattcataatgttacgtggtgattacttttattattgtttttagtcaattccataatttctgctgattaatttagtttctagatagagttatgtttttatacctacaacatatttacttctaatgacatgacaaagttactttctttttttcttaagttacttataaatatatgtaagttacttttagactttattgaatttacttttaatatgtctaagaagtaatttagtgaaatctaaaagtaatttagatatattataaaagtaatttgcaatttttcatcgtaatatgatcatgtgatatcttgttgtaaagattacattgcaacgaacataatggtgtaaccggattgtagatcggataagtaatttgagagacaattttatgagaagggaaaaagacatggatgtctaacactctgatgcttctctcaaattctaaactctaatgtttctcgactaaatcggatggccgtgctaggcgtcgctgcgtaagaccagatcaaaggcctctcgttatagattttacgagtcctttaatgtactctacattaccacgttttgaattgtacatcgtcgatccatctatattccaaaagaaaaaagaaagacgagaagcttaattaatgcatatactaataagttatatccaccatgattgatgttttaattacttaggttgatgcataaaatctaatatattatttgtgtcagggttacggataaggtataccctctacccttggatatacgctatgcggcaata

SEQ ID NO: 21281 - DNA, 1501 bp, Oryza sativa
aaatattaaacgtagactattaataaaacccatccataatcttggactaatttgcgagacgaatctaatgagcctaattaatccatgattagcctatgtgatgctacagtaaacattctctaattatagattaattaggcttaaaaaatttgtctcgtgaattagcttttatttatgtaattagttttgtaagcagtatatatttaatactctaaattagtgtctaaagacagggacttaagttaagtccctggatgtaaacaccacctaaatgttggcagtttgacattcagtgcatttcaataaatagccggtgtggtatgtaagtacataaccaactagtagaagattttaatgcacatgacgggtctataattcaattttttgcagaccggaaaaacaataacgttacagcaaaatatgatggttagtcctaaatacatctaattattatcaaacgcaataatcttcaaccacatatgctaagttattttaagctataattacccatggttatagtcactaatcacagcgtccaatagtcacaaatgaggataaagaagatggaagcagcaacatgtaacaggcaaagataagcatttcactccactttgcagcaaagtcaatccatgaacatcagtacatcacataggtcatgtttagaaggctggatatttttatgagtttctgtagaagactgagcaggttcaactaaaacctaacttgccaagtgccaactcaggcaacgtaatcatcaacaacaagtcgcatgtggtgatttcatcaatcttaagatatgtcggctctgttttcaaaggtgtttataggggtagcgcgtttataggagtaaatgtgcacgtgcatataggcgtatgcgtttgtgtttcgaaaaaaaaaagttaatccataaatatgatataggtcatgttcgaaaggctagatacttttatgagtttctgcagaagattgagcaagttcaactgaaacctaactcgacaagtgccaaccaaggtaacgtaaccatcgacaacaagtcgcttgtggtgatttcatcaattttaagatacgccggctcggttttcggaggtgttcgtaggggtagcttgtttataggagtgagtgtgcacgtatgtgtaggcgtatgtatttgtgttttgaaaaaaaaaagttaatccataaatatgatgatataggtcatgtttagaagtctggatatttttatgagtttctctagaagattgagcaggttctactgaatcccaacttgcaaggtgccaaaccttgatgattttatttataaaggtatcagttccaggctacttcttggattccagttcataaaccgtttgtcctgaatccctgaccttcagacaaatcagaaggtgccaatgcagaagagacactaaatcttggtttgttttcatcacctccaagaaacagaaaattctcctataaaaccgaagtgatcactctcctcccgagctcgaaggagcaacaatgg

SEQ ID NO: 21282 - DNA, 1501 bp, Oryza sativa
acaaaaatatcatacatgttatgtgcaagatctcggtgctagtcagccaaaccacggttaaatacatgttttatataagttataccgtagttacaatacagttacagtacaactatacttcaattataatataatttaatctcgaagttttacacttaaaaaatctacggcagttttttacacactccaatattactcttgtatagtacctagatgtactaacttgtaacgaaataaagagtgttgtctgtctatttaaaattggatacacgaatttcattgaaattggcatggaggcgggtaatcttggtgttgtggtcttgcggtggattgtaacttgtaagaaaatggggatagtcgtctatttatttgaaactgggtacataaatttcgttaaatttggcaccaaggcagataaaatgagtgaatgtatgcctttttgggaatttgaatgaatctttcgtcagatttatagtttgacaatttcagttaaaatttatctccctcggttacaaatttcatcaattgtttatgtatcgaatctttaattaaattgtattattccatcattttactttaaatgatatctctctaggccacaactttcattacatcattgtctcgatttttatgtacatatagaaattgtagtgtgctagcacatatatgtacataaaaattgagattatgaacttggagctagaaacttgaaacttaaccctttcagattatcatcagccgactaatcacaagcgtcttataagaatctttataagaatctctagctctctatttaggttattatcattgttgtcgtgatcgtcgatagcccatcctaactacgcatgttttctttgtttatacaatataaatatgttttttttccaatagatgcagcagagtcatgacctatgaaattgatgatacggcacggtaagattttattcgcaacaaataagtcgataaaacaacaagcccatcttaaaaataaatccaaagaaacccaacccaaaagaagggaaggtcaggcgatgggcccaaacacgagccaaacaggcccatgagcccttgtacggcccatatgcaggtgatcagcccaccatggaacggcccacgtagcccaccgcctctcctcgccaccgactcaattcacccaaaggtcccaaaccgtcacaaaatagttaaaccaattccacgattccgtattcttcctcacgacctcaaaaacccaaaccaatctactccgccgccgccgccgcgatggtgttcgtccgcgcgccggacgggaggacccaccacgtcgacctcgacccctccaccgccacgctcgccgacctcacggcctccgcctcccgcgtctgcggcggcgtcccgccggagcagctgcggctctacctcgcccaccgccgcctcctcccggccgagccgtccccgctgctgtcctccctccgggtctcggcctcctcctccctgctactccacctccccctgctcggaggga

SEQ ID NO: 21283 - DNA, 1501 bp, Oryza sativa
ccatgaggtcctttctcaatctgttgtttgtcttctcccattaccacgagtgctaaaagcctttgtattgtcacctctgcaacttctgatacctgtagtctgtacaattcttccatatatccagcaataagactaggattttgtcccatagcgaaggagcgccgtgccctcccgtatgcaacaaattttagaataatcttgatgaaaccaaggcccagtaatgttgatatgatgatatctggcaattcttcggtttttttttgtgtagtagtacaacacaaggaagaaggtccaaatctgtcgagcaagcatcgctattgattcaaaattcccaccttcatttccattatgaacggcagtcaatattgaacttgtattcatcccaaccattggcagcagcgctgcccatagtagcagacagaatgcgcggttgtcaacgcattccaaaccgtgaaacaagttgtagtacttgtctctgccgacgtaggagacaacataggagaggattggtaggactagagtggatgctcccagaaaaagatagcggttcaaagcaatatgccggtaacgacggccataagagccagctcccacaaggatcaccaccaagaatgcattggcgacgaagagcgcattcgtcgtcagtacatctttgtttatgcgctctatcaagtcgtttgagcggaagccacatgtggtagacgacattatagcttttatagatcttgcaaccttgttgtgacaatctggtttacatatattgcacattcattagggttagactggaaaaagagttagcttataattaagaaattaaccacaaagttatattttttgtgtccctatttattctcacatgtttgaagctcttacctgacctatatggaacaaatcactaaaataaacaaaaaagaaaaggaaaaaagaagaatgtcccaaaaataccaccttgaatttcaatgttagaaatattccactctaaaacatgttctccttgatttatgccatcatagacttgacattaggtcaaaaatattttttgtagctctcccaacgttaaatttaactggacagtgtaattaaatgaaagaaatcaggtttggggtggcatatatatttttagctatgatattctgggtgacatatatcaaatctatgtattatataccaaaagtccactaaacttcctataaacgctccaaagttgtcacgtagcgcttcaacaagcattcctaggcccgccatgtggcattctacaatcccaccatcgattttatgtcgcgtcccaaatcgaccctaaaatagatcctctaaattatgcctagaataattaaaatacttatgaaatccttcaaaaattaaaatgtgcaaagttaaaagtcaaataaggcttggaggatttttgtatatttcctaaaagcctaaaatgtgtaaataaattttagtggaattttcagagcacaaataataattattaagaaataaacaaagttaaaatgat

SEQ ID NO: 21284 - DNA, 1501 bp, Oryza sativa
tgtgggtgtgtcttgttgagtacggtggttgtactcagtcttgcttaatttttcccaaacccagaagaggagcccctggatgatgaaggctttggtgtttagctcgtgcttgccgtcaaacgcctgtggtcgtcgccctagtcttccgctgtttcccgtttgtctttgtgtgagctgggccttcgccgcccatgtaataattaactatttacgcttccgcttgttaaactctgaattgtatcaacttttggtgtaccttgcctcctgggacaaggaataatacacgcacgtaaggaacgcccgttgggttatttccggtcgtgacattttagaaggactggatctatgtcaaaatcgcgtgcacaagggcgtctcgggaccaatcagacatgcgaaaaattgtgcgcaaggacgttgtgggcccaatcgtggaagcgcgcaaaggcgcgtatgaaaaatgggcttaatcgctggcctgatcgctgcatgtggcaaggggcacatggaaacgtgcaagcccaaataattcacgcacgtctcagataagagggacactttggcgtaagaaaaaagaaaaaggttttgacagaaacataaaattaaaaacaaaacataaaaataaaaacgattcaaacacgatgacgtgccgaaattccggtgaaaacatcttcaatttttataatagtagattgaagttttaaaatttttataaaatatctataagatggtaatatgaaaccattgtaaaaaaagagaataaaatattttctctcactattaccaatccttgaactcaggatctcttggacaaatcatttttgtcttcaataaactaaccaacttaacccgtgtcattaattgtatatttgtgccttgagtattgtttaacaaacttaccaaattattttgcaaaaaatgtattatttaacagtttgaaaagcgtgctaatgaaaaacaaggaagttgatgtttggtgttgaagaaaagaacagagcctcagaaatatctctacagagttttaaatatttgattaaaatgcctttacatattgttgacggtcgttatcgatcagtttcgatcgtcaatattaccaaaatagaagagaactagtgatgcttgcaatgcataaatatgttagaataataatattccactagtattaggtatactaaccttttgcagagaatgacactaaagtggaggagaatcgacatcaacatggaagataaatcagtctgacgatgtcgagaatcagacttatgcatgaatgggccaagaactcagaattaacacgtcaaactgggccaaaattcataagtctacaaaaaggagcaacagaggtggccgccagccgaaaggtgggctggttgggccggcccctagttcgaccgaacctccctcgcctccgttggatccaggttttggctggacggttgagatgaagccccaatgacggttggagggtattaccgaccattccaaccgtcacaaccgtcatagt

SEQ ID NO: 21285 - DNA, 1501 bp, Oryza sativa
gagataagatggtcacaaaatcagtttcccagtagcacatgcagtgcatacgaaatcagaggatttgagaaatttgtcagtgatcaaatgatgaccaatagagttgccaataatttttctcatcatcccgataccggggtgcccaagtcgatcatgccaagtgtggaatgcatcaacattttgaaaaattactttgtacgcaacatgtgcaatgggcttaatgtatgtatagtacaacccgatgtgagagatggaattttctcgcaaatgcgtttgccatatccgttttgtttggttaagagaagaaattcttctcgattatccatatgggtttcaatgtgaaacccattttgacggatatctctataacttagtagggtacgggttgaatcaggatacaataaagcatcctcgattgtaatttgtgtacccattaggagtgtaataattgctctttctgagccaactatcacagtatcgcgcccagcgatagtcaaactttgccttctctctttttgagagtttgaaagtatttgatctccctaagtatagagtttatggtaccactgtccacaagacataattcctctccaatcggagcgatatccttagacatctataatgaaagaagaattgcatgattaagaattctttatccaatatatatacatagatacaataattaaaacatcaaatacatagtatgacgtttacatatgttaatagtacatactctaatgactaacaagccatacaaccttacaatacaagggagttcgtacttatttacttattacaaccaatattatttggcaaacttataggatatcaatatactgtttcaagcacactgagataagggcagcttcatctccaagtgggacgcatcgagatcattgcaaatctccaagtgggtccgttgagcagtattcgatgaacatatcatccatcgtagagagtggagcgacatcttctgggagaacattgaggttgctctctggttcagcaggagcctggtgagaacttgcaacctcagggtgctcttcatgtgtaatattgaagtgtgcttcaaatcttgggttctcagaagattttttgtccttgagggatttttggtacaagaggataagatgtttcgggatgcggcagtctttagcgacatgagtgtcagatccacacctgttgcaatgcttgttgccattgctacgaggttgtggtgccttacccttcccttttcctttctttcgacccttgaatttgcgcctgttgttgttgcgtttgcgctttccagtcagattcttatgattattcgaagaatttcccttgaatcctttcttattctcagcattattctgtacattgaagtgcacctcaggtagtggagcagagcccggtgggcgctgttgggcattctttaaagaaagctcatggtgtctttctgcctgagtcaatgtatgtataagcagagaatgtttccagaaattgttagcgcgatactgtt

SEQ ID NO: 21286 - DNA, 1099 bp, Oryza sativa
agttaaaaaattctcttggttgttttgtgctaaggttatttgagaaagagtgataaatgccataggtatatatgtttagtgttaatttttcaacctatgtgcttattaagatgttgcattataaatcgtatgaaatcatgaatttagattgttgattcaagcttaattgtaaaatctttggttcatggttatactttaatgcatgcttgttatattatagatggatttatcttctttttattgcaacacatgacttgatatgctatatgtatgctaagctcttgaacattaatgaacataattcctattcttgatgaaatcattgtaaaaagggggagaagtaatgtgaaaatttttggatttttggagaagcaaggcgaatttttggagagttgttgagaagagcatgtttttggttcaattgggaatttctttctttttaaaaagggggagaagttttcttttggatttttgagcacgatgtgtacatttgtacgaagtgtgctttttaccacttttgtttttatttttccaaacaccaaaacattttttatgggtttgccaatgtgttcattaagggggagattgtaaaatcaaaggtgtttttgattattattctttgatgaacaattgggcattggagattattggttttgttatttggaatgtattcacgaagtggttttggagatgattagattcacaggtgatcgcaggattcattatttcatgtgaccggtcagaccgggctctggtagccggtcggaccggcggtatgcgcgcggtcagaccggctagcccgcggtatgaccggccgacactgtgtctgtttcggttcgggttgtttgtttggatatccgtgattatttcatgattatgacttctagatggatactatactatgtaatactgttgtttgctactaatgagtcaagttggagatagcttggtctcggaatatagtttctttgtttgttccatgtgtaggtgactcgatgtctcgggagagtatttgcggtgatggatcgggagtcggcttagggatgaggcgacgtccgtggtggttagagatcatgcgggatacttaggctagagttga

SEQ ID NO: 21287 - DNA, 445 bp, Oryza sativa
cagtgatttgctggtttcacattggttagatttgtttcaactaatttggtacttctgtagccttgtaatttacgaatctagtattaatattttcttaagtattagcctgttccttgatattatgctgttgagaaagtatgcaatagataacaaaaacaagtaggtgtgttgaggatgctcaagagtaatacagccacttcaataattctgatattatcaggacatcatcaataattctgcgcctacaaatcttcaaagaaaattttaatataatgcgtatgattttttaaatacgaatattgattgctatttaaagatatttatattatatggtaattattatttgaaggtttataataaaggcctccgtttttagtttcacgctgggccttcagaatctcaggaccggccctgctcatgatccttacaccgtgtatcctgtaga

SEQ ID NO: 21288 - DNA, 1501 bp, Oryza sativa
tcctccctgcctcctccgcgccctccctcttgtcacctcaccctcttctcgggggctccgacgccggcctattacctccttgctccactgctcctcgccgtcggtaatgatacgcccttgcgttgattagcaaaatgcgaatagctgctgctgctgctagtgtttcttgattgatttgtttgactttatgcaggcggatgccttgaactgttatgggcttgtgccattatgctcatgatgtaaaaagtaatatatttgtgtactgctgatggtgtatgaatgcttttagatgtattttcattttcttcctattaaatggtgctaccgatcctcttgatatgctgatgaattgcaatggtgtttgagtaaacggctaggggtactgtcttttacccccaggctgtgtcggttagtggtcatgaaagatccaatgtcatgttatatttttttataaaatactgaatgctataacaaaagaaaatgaaattaattttatgcactaattttttagtctcacggaatacatactgtgcagtcatgaatgtttcaaacccagctgccaaacatgttcttagttttcagctcctccaacctcaagggtattatagacattttcaaccaaactaaccagggaatgctgctcaatctaacggtaggggtatgtaggggatccaatcaaaaattcaagggtggaatcgagtaagtttcaggggcatgtaagggattgaataacttttcaggggcacacaaggaatttactctattatatacggtacatatacgaatgtaagggaacaaacggccaaaatcatcgcacgtagcactggcagcttcctttctttaatgaatattctgtgagaaattttacgattctcgagagataccaagagaatatcctatgtgtgtactccctccgtttcgaaatgtttgacgccgttgactttttatcacatgtttgaccattcgtcttattcaaaaaatttaaataattattaattattttcctatcatttgattcattgttaaatatatttttatgtaggcatataattttacatatgcacaaaattttttgaataagacgaacggtcaaatatatgctaaaaagtcagcggtgtcaaacatttcgaaacggagggagtacgttgtgagtttttcgctcagtcagattaccttgatgatcctggcatcgtctactctgcagcgttggtgtgtaaaataatgaatggtggaaactggaaagtaactcctctggcattgccggccatctgcacggcgcccccgtgtctcctgctacgcatacgatcggcccgtgcgagccttagccgtaactaattgggccgtttctcgcgaatcgcgggaagtttgcccagcccaagccttaggcgagacaatccagcccagcgtgaggtctcggcctgctgctttaattggaaaaagtatacctgagaccccttatcttgtcgacgatttatttataaaatcatccatgaaccaaaaa

SEQ ID NO: 21289 - DNA, 1501 bp, Oryza sativa
cctttgctgtaactttttttttcaaactaaatagaacatgtcttttgttactttaataagaaacaagataaaggaactaacttccactgcagaatgctagccagttactttttagtgctacacagtaatgatggcaattatttgaaaacaaaagtaacagtaagatggggggtaaaaaataatttgattggacctgactagatatatatttttttagataatgaatttttattaatccggtctctgtattcatgagggatatacatagccatgactagatatgtatgtatactcgcagggccatctgggagaggtggtgttcgtggagctgccggaggcgggggcgaaggtgagccagggaggtgcattcggcaacgtggagagtgtgaaggccaccagcgacatcaactcccccatctccggtgaggtcgtcgaggttaacgacaagctctctgagacacccggcctggtatgtactcccaccgtctcaaagagagtataacctccgttaaaaaaaatcaacttttgaaaataaatctaaacatacatttgtgcatattcattctcagaagttactttttttaacatagggcatattaacaataacgctgtaaaattacatgtgtctcttttttttttcaagactggtagcatgtccctgtttaaaggtgttagtttaattaaccggaatgtctctttgttaatttaattcattagtactctccacaaactagaattacaaattcttttttgcgagacaattttcaaaccctaatgctactgccaatggtggtgacagattaactcaagcccgtacgaggacgggtggatgatcaaggtgaagccgagcagcccgtcggagctggacgccctgctggacccggccaagtacaccaagcactgcgaggaggaagacgctcactaggctcttcctctctgttttttttcttcccattttgtcactccgacctaatttctccctgttgcaacaactgctctgtatccgtatacgattaataactgaatcttcaggctttgccatgtgttcagttggttctctgaacttctggtgggtctatctatttatctatgcttaattagtcacttcaagccagtggtctgtggaaaaaaaaaacaatgaaaaaaaaattggccatctatctgctcaggagcaaattataacggcttatctatgtattagaaaaggaaacagcaagttcttgacatgtacaaatcggtacgtgttaatttctagttttagaaatattaaataaaaaactaaattaaggatgcatgacaagttaacttggtacttgttgattttaaaatacttaaaaaaaattaattttaagtactgtaacttagtaatacttagtacttactattaattcttaatttaaaaatatttaattatgaaacatagaaagtaaccgaagattgaacatattgttagtagagtgacattcacagttgacttccaataacacatcaaaatttagga

SEQ ID NO: 21290 - DNA, 1501 bp, Oryza sativa
aacattgatcaacttattatctaatggcataataatatttcatagtattaaacaggaggaaacaaagtccaatctcacttttacatcatactagcttcttgctagtagtaactccttagcaacctaatccatttaattgactactttgagaaaaacacacaaaaagtctatgagcgtgtttccttttgtcaagtttcgtgtatttttgatattaagagtctaaccaccaaagtgtacttgaataaaaagtcgtccaattaagctgctatattcaactaatccattcaaattttggagtttgaatcagaccgactcacactggcccatatatgcataccgcataaatttctcaccaatcaaatgtcagaaatacttcaataggttttgaaagtttgaaacaacaaaccgtgtatacatttcatccccacacacattgattgcacgcagctgacaaattcattgagcattgcaccaacgagttgaaaatttcaaatccaaggaactgatcagttcgtccgtagtaagtactagagctactgctaattaattactacatgatgcagactttatcaaattaatattgactgtatgctcacatgaacatgtgagtactatacatggccaatcatatagagacaaccatggtaaagatagcttttgtatttttagccaaaccttcaatatttttagaactgcatgatttggtctgaaatttgaccgatttaaggtgctacaccaaataaaaaatgacacaaaatgtggattagactgagtaattaaattaagatggtttggtttgatcgggtcggttggacctgttgagccgtagcgtcctgccggccgtccaacagcctgtcatgtcggccattgcttccgattaatttgtcttaggctacatcattaccagcttaatgcttagctacttctcattttcagtgaacatgattttcgacggatgcataaacgagtacgtattttatactccctccattccaaaatataaggcacaaccaattttcttagatgttcctgtaaaatcaaatgtgtttttgattattattctgtgatgaacaattgagcattggagattagtggttttggagatgattggattcacaggtgatcgcaggattcattatttcatgtgaccggtcagaccgggctctggtagccggtcggaccggcggtatgcgcgtggtcaggtggtctgaccggccgacactgtgtcggtttcggtttcgggttgtttgtttggatatccatgattatttcataattatgacttctagatggatactatactatgtaatactgttgtttgctactaatgagtcaagttggagatagcttggtctcggaatatggtttctttgtttgttccatgtgtaggtgactcgatgtctcgggagagtatttgcggtgatggatcgggagtcggcttggggataaggcgacgtccgtggtggtcagagatcatgcgggatacttaggctagagttga

SEQ ID NO: 21291 - DNA, 1501 bp, Oryza sativa
tagtacaatatttgatttttaaaactcaaaccatcgacgatttctcaaattgattagtttattaaaaaaatacaaaagtaattatatgtctatatttgacttaattaggaagcaagatatcataaacttaatgtgttttacaaacttattccaacataaaatttttaatgatcaaaatattaaaagcttgaccaaacattatcataaacattaaatatttatgttggagatggtaggattatatcgaaaccagtcggcgcacatgtatacaagtaattcgataattattgttgtacataaataaatcatactccctttgttcttaatatttacacttgtcttgtaaattgtacagtttttttttaatgaagtgagcgtatctcaactggttagattccttgtggtggaatcaatctacttggatttaaattataaatttaacacgggtgcttccttgataacttcataatatttttttcacgaatgcgcaaaaggattgcacgtcaatatatttgacacgggtgcttccttgatccactctctctttagtctcagtggttctggagtccatccattcatagagccatatgtggcatttagctggcgtcgctgtttctggggatttgttgggagtgtagcatggctcggtgccttccgccgcttggagtctgtttttagccgccgtagtttctctaagtttcttttgctttttctcccttctcctaacataagtcggtctgggcgattgcgttgtgtgtaacttcgtaatctcgacatatgctggccccctcgacacgccggcgtaacgacggcaaggggttccggccggcgactgtggcgtgggctgcgcgcatttctcgaagcggcaagacgtacgtactacctccatatttgatatcgatcatgaattacatcagagatcagtgacacgccatggcagtatggcacgcacggatcgatccgtcaacgccccaactgcagttaggtggcgcgatagtaacaagcataaatcgaacccttttagttacttttatttctctcctttttcttctaatctcctcattcttcttaattcttaagatatactcctactagaagaagaagaagaagcagtacagtgattactgtcttactgaagcatcagagcccatcactctctccctttctctctgaaaactctgtaaactaaactgatctgcgaattaaagttaaattacaagcgtttttgcgcggtggcacttcactgtcacacatgatgaccccgctcacatcatcacttagcaaagctgaccgttaaaacgcaatttcccatcgatcgtgcaacgatatatataccacctgccaccccttcttctcctctccacccccctctctgcttccctccacactgcctcgccaaccaaccaccgctacacacgaggcggcgcgtggccggagagcgagaaaaggcgacgtacccatcgatagcgagaaattaagttgccggagaggaggaggatga

SEQ ID NO: 21292 - DNA, 1501 bp, Oryza sativa
tgtaaattcgggcaggataagtccactttacattcgttgtatttccgtcgagtttaaatcgtatccctaaacgcgataccggatacataaaatcgggttaaattagattcaatggtattatgatggctggttccactgatgtgtcagtattcagaaaaagaaaatatgactatattccgtgcaacctgatacgacgttaatatcatatcagattgcatctgttaatgaatggagagggataattcacttgtactttaatatatcattttctttttgaatctgtaatagttggcttttaaacataatatttgataatatgtcttatttaaaatattaaaatatgcaaaaaaaaagaaataaagtccatttaacgataaatctcataacaaaataaataatatatttatatagtttttttataagacagatgatcaaatgtaatgtttaaaagtcattacagttatacactcagagtgttaaatgttgatacatttagaagtcattacattatggtctatttggctgctactttcatggttgcaccgtaaccggtatgaacagtgtcacactcaccgtgtgcagccgtagccttagccgttgcagccggcttgctgaaccctccctatatttggaagtcgagagcatttcgcatatgctgatctaaccaactgatggatcccctcttatcacaggaaagtgcaaaatagtgttttgccgatgagagcaaccaatggtgggtgggccaggccaatcaagaaatggagatgtacaaccacatgctgctaccacactagccagcaacacctcaccttgttacattgtagatatatatgacacgcgtgtctcacgcacattttgtctctatttgtacttacccaaaaacagttaagctcatctcaggtacacatgttcatcatttaatcaccaccaaaactaggtatcaacactgtgaccgacaatacatttcatatcaccagttaattaagctagcatacgtgtaagacaattagcctccaaatccacaaaacctagctctctgctcttctgtaggagtgggctcactacacataatatctgattcagggttttcaatttcgattttggccgaaatttcagtactttctccgggctaataatacttatcgttttaaataagggtgaggtcaaactttataatctttgattatgaatcatttttaaaatatttatctttcacatatagtgactaatggtgactatatgtatagattagtcttaaaaagtagagaaaaccccctgtatatccttgagaattcatccactcccttatgtactcctaaattttgcctcatcccttatatacctctgagtttttattttgatctcctctatgcccattaattccgttagttgaccgtgagttgaccgttaaatgttattaaaattgactatattacccctctcttatacttatgtgctagtttaatgacaaaaacacaattattatatgaaaaaagatctg

SEQ ID NO: 21293 - DNA, 1501 bp, Oryza sativa
tttgattgatgcctctcagatcctctaaatctctaattgttcttaatcatgtacttatcttgatatcttccattgtgattccactgacaggcagtagacaacaatctaatttgccatcttattcttgcccaagagataagatgacaaagggttacaaagattccttcttgctacttaagctgctctgctgttcagtgattaacagcaagttcgaacacgtggacagagattcagttgatgacgtgcaagaaacagtcactcccacctgcaagtgattgccattttttccccttaaaaaaagtagtaatctttgtaccgttagcatgtgtgattctcattatattcccttcaaaaaagtaagaataacctgccttttgttcccaaccaaaactgcctggttaaaaacaggaaaagagcaaacctgctatgcatttaccacgagttagtaattaaacactttaaaacaccagctaattaatcaatgtactgtaagtttgtaacacccctaacctcaaattaaccacccaaaaacaacgtatgcaacaaaaactgtaaaccagcacaaaaaacactcaaattgaccacacctcccgaaaatcaaagctgatcaaaccaaacaagtgcatatataaacaccaccaccatcacccatatgcaaaagaaccactccctctaatccaaatatttcttgcaaaattacatttttttagcttgttcttccttgtgtcacaaacatttccatagaccatttcatttgattagcactccaaatagacacattctttttcaaaccaaagtgcatctcaccacctccaatccaaatcattcttgcaaaaaaattacatccttttttagcttgttcttccttctaacacaaacatttcaataaatcatttgattaccactcaaaaaaaaaagacacattcttcatcactcccaagcctctaactaatccagtaattaacactgtaagtagtaaatcatttgattagaactctagattagtaaaaaaaacacatcttttatcactctcccttggcctccatccaatctagaagaaagagggaggcgaggtcggcagcgcaatcacacgggcgtgagaccgccacgtgtccggtgaggccaccggcaccacccggtcacccgtccgcatcgtcgccggtcgccgccggtcaccgccaccggataaataccaaccacccctcctcctcttcccccatttcttcccccttcctcttctccttcctcctcctcagatcaagaaaccgtgtcctagaaaccatcgagatcgccctctcccccctcggatcgcggcctctcgcgcggatcgatcgctgctcggtttcttgattttttttttatttttttttctccggtgaccggagaggcggtggtgtttggatcgggaggggagagatggtggcggaggcggaggtgatgcatcagcccgtgccggtgttggaggtgccgtaccaccggtgcgtcgccaagggtgtcgagg

SEQ ID NO: 21294 - DNA, 1501 bp, Oryza sativa
gtatatgcattaagtttctgtcatcacctttgacaggccaacaacggaacctttcattttaaaatagtttttgttggttacaaagtggcactataaattaattgttctatgtagctttctaaatacttttttcccttttggtctgtgtggtttgacttggcttgatctctgtccttgattaaaaggttggtgttgagtgtttcagcttcatacatcgatatttgtatgtctggcatagttcaaatagagatgaattattgatgcagggtagctcctggctatggtggacctagaaaaattcacctgtaggatctgttataatttattcctcaagtactatggtaatggtctagggatcactcccacctattggtggtccatttagtattatttgcactcaaatgaactagaaggggtcaatgggtcagcctgatctggtccacttgcatccctagctaaactatcatattaggtaggcaatttcttataaatgtataggatgatttaactgaacactcagtagctgctactcatccattgcggctttcattggttactgatgttgccacagcaatcaattaggcgcagatctgttccattattacctgcttgatgttctgttacatatgttttgcaggcacacagccataagttggtgttccatgagcttataagagtgatgccattattggcatgtttctatagcatctagcatctcccaatgttatgcatgtactgggctcccttaaaagatggaaattcagaagtctgatcatcatgagcagaatcttacttcaccaagagggctaatccataaagtgctgcgtcgcacaagtagcaggcgttctccaactgcagcagaccataacccttctcctgtattcctggagacaagcaattcaaaattcttaaagcaaaaggatattgatgatgccatcaaggatccagagaaggcaggcacacacgacaacagaattgaagatgagaagtctgatttgttagggtatgaaatttgttctgggaagcttacattggataacaaagccaaaagtgcatcaggtgaacagtctggatcagggtccagtagcaattgctttgatgctagactcactactgaagccttggtatggggttctaatatccttaagctcgaggacattgtatctgtgagtttttagctcattgactttattctgtaaattgcgttggtatgtttctgagtttcactgcaagtccacatcatgtgagagcaattctaagatcttttcaactttaacattgcaggtatcatatcattccgggctccgtcacttcactgtgcatgcatgccctcttgaaaaaagatccagtggactttcctgctttatgaagcctagaaaaattcaaaaggacttacgtttcctatccacttctccacacgaggcttttcggtgggttaatggttttgcagatcaacaatgctatgtaaatctattacctcaccccatggcatctagcaaga

SEQ ID NO: 21295 - DNA, 908 bp, Oryza sativa
tatatatatatatatatatatatatatatatatatatatatgtgtgtgtgtgtgtgtgtgtgtgtgtgtgtgtgtaacacatatataaatatgtacaatgttagaaagtcttataatatgaaacggaggtagtacctttttttttcaccgctttttttcttttgtagtaagtttatagtacatcggaaagtgtatatgtcctattctgattcggaagcaaagtttccattagaccttgtggttagctctatcaatctgtagcaatattaggacacttgggattgacccctgaaaacttttttttttaaaaaaaaaacctttcaaagcatctgtgtttcttttcgttgataggcgcttagccagattgtcaatactttgggtctgtttgatacagctccaactcataaatttagcttcaggagttgggtctggagtggagttgtggagctgcctaaacccagctccacaactctagttcattttgtgagagagctccacccaactccactcccagttttgatggagctgaaactgtttggctgagctccaactccaggaggggtggagctagagttggagctgtgccagacagaccctttgtaaaccatgccaacaccgaggcctatttggccatttacgaagcccaacacccagatctcagtaaaacttacaaagcaagcccatttagtttaggaataagttcactttaggtttctaagtcatcgtcaagtctaaaattcatccataaaccgcaatatcagatatgttgcatccatcaactatcgaagtcagtagttttttagttgaaagatgcttctatctaatattgtggtgcagggacaaatttaagactcggcgacaaattaagggacttcaagtgaacttattcctttagttagatggcagta

SEQ ID NO: 21296 - DNA, 167 bp, Oryza sativa
ttggatccttatccattcactgaagggtaaaacagtaaataaatatttcataaaaagaaatttctatttctctttgtatatttttaacccaaaaccgtgggacccatctaacggggttaaaagtgagggcaaacggtgggttcgtgttcaaaaagatagggcaaaaa

SEQ ID NO: 21297 - DNA, 1501 bp, Oryza sativa
tggagttatatatcacatattaatctatttatttaattttttataactatttaaattacatgtaaataataatgtaaataataaggggaagttggctcgaaagttttagagtccactctcgtgatgttgccactcgtacgtgagctagcttagctatatattgcgcacatgtgcagcaaccaaacctagctgctacgagcaaggcaaagcagagccgtcagttgcggtcagtttccctgtcacctccaggcgtccaggaacatacacacacatcaaggtagtggtggccatggccgcgtgcaggtgcagcagccgcctctccctgcagctgcctcctccgtgcttgctcatcgtcctcgtcgccggtaagtgtatcgtatcttgcatgcatgcgtacgtgtgtgtgatgtgtgtcactgtggctgacacggcggctgggatgtgttgttgttgttggttttggtgcagcggcggcgatggtggcggcggcggcgacaggggcgagggcggcgtgggtggactacccgtcgggggtgccgtgcggggagacgatcccggtggagcagtgcgacccgggcgacgcggcggcgaacagcgcgtgcatggacgtgtgccactacggcggatgccggcgcggcggcgagtgcgtctccctcggcttcggccgcggccggggatgccactgcaagtgctagcagctgaactgagctgagctgatctctgatctgaactgaactgatatgctaatcaggttgagcaaagtagtagaagcagtaattaggagagaataaattaatgagcgctaagctgctgtttgtagatgctcgcttagctactgtcccgttgctggctgccttgctagttttcccgcccttttttgttcctctgttttttcctgatcttcgtgttttgcatgagttggtagcacattaggtttgcttttgtccgcgctgcctctctgtacaaaagcctaaggcgtgagctttgaaaaatgaaatcgccaggtgccttttgttttcttgcacctgtcttttgcctcctttttacaacaagctcgtgctaccaagtaccagttggatctaaacaaacaggagaaaataatcactggattgtacttgcggatccggagtgttcttttggttgccagaagcatgtgtacttccgttacaatgtttgtggtcaagagtttcataatccatgttctagagacaggaattctctaggacgcatcaactattcgaaggtgtgtatgattctccaggacgaaataaagtaagcaccattctgttcttcgggaccaacattgtcacacaccatccactctctgagactcggtatcaaatattcgcttgctaaagcaagatacttcctccgtttcagtaatatgaatagatttattaacattaatatgaatattgaaaatattagaataacttatattgtgaaacggagagtagtactactacaagatgtgcgcattcctgtgagaatataacaggca

SEQ ID NO: 21298 - DNA, 1501 bp, Oryza sativa
acatgcttaagagttgatgaggcagacatcacagctctgattataaaataatgcacatgattctattcatctagacataccttgaatataggttccacttttccgtggaaaactttgctagatctaccatgtccagatcgaggattcaagatgacaagtatctttgggggagaccggcatttaacacatggatcaaacatattatcaaatggaatgagttcagatgaatgcttcttgctagatgccatggggtgaggtaatagatttacatagcattgttgatctgcaaaaccattaacccaccgaaaagcctcgtgtggagaagtggataggaaacgtaagtccttttgaatttttctaggcttcataaagcaggaaagtccactggatcttttttcaagagggcatgcatgcacagtgaagtgacggagcccggaatgatatgatacctgcaatgttaaagttgaaaagatcttagaattgctctcacatgatgtggacttgcagtgaaactcagaaacataccaacgcaatttacagaataaagtcaatgagctaaaaactcacagatacaatgtcctcgagcttaaggatattagaaccccataccaaggcttcagtagtgagtctagcatcaaagcaattgctactggaccctgatccagactgttcacctgatgcacttttggctttgttatccaatgtaagcttcccagaacaaatttcataccctaacaaatcagacttctcatcttcaattctgttgtcgtgtgtgcctgccttctctggatccttgatggcatcatcaatatccttttgctttaagaattttgaattgcttgtctccaggaatacaggagaagggttatggtctgctgcagttggagaacgcctgctacttgtgcgacgcagcactttatggattagccctcttggtgaagtaagattctgctcatgatgatcagacttctgaatttccatcttttaagggagcccagtacatgcataacattgggagatgctagatgctatagaaacatgccaataatggcatcactcttataagctcatggaacaccaacttatggctgtgtgcctgcaaaacatatgtaacagaacatcaagcaggtaataatggaacagatctgcgcctaattgattgctgtggcaacatcagtaaccaatgaaagccgcaatggatgagtagcagctactgagtgttcagttaaatcatcctatacatttataagaaattgcctacctaatatgatagtttagctagggatgcaagtggaccagatcaggctgacccattgaccccttctagttcatttgagtgcaaataatactaaatggaccaccaataggtgggagtgatccctagaccattaccatagtacttgaggaataaattataacagatcctacaggtgaatttttctaggtccaccatagccaggagctaccctgcatcaataattcatctctatttgaactatgc

SEQ ID NO: 21299 - DNA, 1501 bp, Oryza sativa
atccatgtattgggtttgttgttttgttagtatattgtgaagtactccctccgtcccaaaataagtgcagttttacactattcatgtttaacgtttgaccgttcgtcttatttgaaaatattttatgattagtatttttattactattagatgataaaacatgaatagtattttatgtatgactaaatatttttaaatttttcaaataagacggacggtcaaacgttgaacacggatatctatgactgcacttattttaggacggaggtagtagatgtgacaggcactgacactacaactcaactttacatatagaaaactatacatagtgtagtatgtccaactactattcagagaccttgcccatgcacgatatgggcacggggtctgcgagctagggctcatctggggtcaagcgaatcaacacggtcggcctttgtatggcccctaattcaaaagggttaggccggccattttgtcatctcatcgtgtacacaagtataagatagtacgtactactgtttaacaaaataattaccgtacatacaaaattttgaattagcactcataagtttagcatttaatttgtaaggagtaccacacattattcggataagtttgatataatgtgcaatgagatgatcgattgtgatgcatgacttcgttaagcgtaagttataccgacttagtattttggaagctctcatatgggttgaaacgtgaatattggggtgagtgcgcttgcgtgtatgagcataatggtttaattatatcgcgttttgcaaaaaaaaaaaaatgaaaatcctaaatgtagcaaatgttgactgtgtatcgacaataacccattccctctggcctggtgtggccttcgtctgaaccaggcgacgacgacatgatcgatcagccagccaaaaagcccaaaacccttgccattttcaagcttctcccatctccactacgtgtaaacgccgcatacgcacacagaccagaagctaccgccgagcgccgatcgcgcaggcatgcatgagctatttcccgagaaagccaaagctgtgagcgcccgtagctccagggcttctgcagcagcaagtagcttgtgactaggtttcagccacttgtagcgaaggattagaccacacatgacatgcatgagaatgcagagagctaggcgcaccgcactggagcgccgatttgatcgattcgtctctctgctccttaatttgcgtgtgttttggtccgttgctccggcgtcgtcttcgccttcgcctgcatgcgtggcagcatggctgcatgggtaagtgcatgcacgcagagagctagcggccggcactacagtaacgcgtgggtagccatggcgtgtaacgttttctcatgcgttagattattcgtatagttagtttagtcgtactagccgtagtagtagtagtagatgtgccgtgcgtgaagcggtcaagtgatcggccagagacgtgacatctcgtcgcactctcgatcacctgca

SEQ ID NO: 21300 - DNA, 1501 bp, Oryza sativa
ttcactgaaaatgagaagtagctaagcattaagctggtaatgatgtagcctaagacaaattaatcggaagcaatggccgacatgacaggctgttggacggccggcaggacgctacggctcaacaggtccaaccgacccgatcaaaccaaaccatcttaatttaattactcagtctaatccacattttgtgtcattttttatttggtgtagcaccttaaatcggtcaaatttcagaccaaatcatgcagttctaaaaatattgaaggtttggctaaaaatacaaaagctatctttaccatggttgtctctatatgattggccatgtatagtactcacatgttcatgtgagcatacagtcaatattaatttgataaagtctgcatcatgtagtaattaattagcagtagctctagtacttactacggacgaactgatcagttccttggatttgaaattttcaactcgttggtgcaatgctcaatgaatttgtcagctgcgtgcaatcaatgtgtgtggggatgaaatgtatacacggtttgttgtttcaaactttcaaaacctattgaagtatttctgacatttgattggtgagaaatttatgcggtatgcatatatgggccagtgtgagtcggtctgattcaaactccaaaatttgaatggattagttgaatatagcagcttaattggacgactttttattcaagtacactttggtggttagactcttaatatcaaaaatacacgaaacttgacaaaaggaaacacgctcatagactttttgtgtgtttttctcaaagtagtcaattaaatggattaggttgctaaggagttactactagcaagaagctagtatgatgtaaaagtgagattggactttgtttcctcctgtttaatactatgaaatattattatgccattagataataagttgatcaatgttattatcctctaaaaagacaatgatataaaagaaatttgcagattatgcctgagcttatgctattgtactccagtggtgcacaatgtgagatagacttaaatcttgtttagggcaagttatgaatttatttttgggctgggctgtgggctgggcctggcctactgactggtacttatcattcttgatatgttgacatactcatgtgttttgcatagtattcatttattgctaatcccattgcattgcattatctttttcacaatggtagttagattgcgttgtcatatgatgtactcctgtaacgttttcagattttgcacctattgctttcaggtgtggcttgtaggatacaatgaggaatgcatacctacacccaacataaaacattaaaattggaaagaaaccaaaggaagactagaaaaaaaaacttttattagtgaaccaaaaacaataatattaaggcagtgggaagaagaaatcttatcctgtctaactgttacgtattcttgtgcatatgacaataagttaattacatatatatacacaattagtataatgctg

SEQ ID NO: 21301 - DNA, 1501 bp, Oryza sativa
aatttctcccgttttcttagaccgaccttttgattaatcttttcttgagttctgcaatgccgatgcagacacgcaacttgtttaattcgtgcctgaattgaagcctagtggctagcaggcagctgcaagcaagcttccaattcagcacaagtcttcaattcagaacaagtcttcagaacttaacaaccatccttggcaagctagcaagctagtagatgcatataaccttaattggccatgaaaaaagtctaatcaaaggtggtccatgaataataattccaaagtttatcaagcacgcaggctgctctccatgctagctcggattattccaactttgccttgatattgaatagactgtgcacttgcttttgctttctttgcaatttgccatactgctagctccagctatatttgctcatttttaattgaagcctttgatacatgctggagtattaatgaattaaactagctagcattggggggctacaacttagttaattagtagttacatgtgatccctactttatatgtagatacttagatgatcagtgttagatactaatattactcatgctgtgtacttgagtaccactttgtttgattagtgttggagtacagacagaatattcatcatggaaagtaggtaggaggagtacatgggagaaaataaattcaagggttgtcaggcccaacagagattgcatatttagtagaggacttaattagttttttttaagtaagagcacttaactatagataatttgaccatgccaaaaaagcttgcactaataattaatgtacttccctaaaaaagtttgccccagtaatattagtagtagtattagtatttgatagagatgctccaactatgtagcagatcaaaatagcagttttaatttatagatcatgtgcatcaattcatatagccatcattctttatgggtattatactccaacttgtaagtgtgatacttaccttaatctgcagtaatgatggtgccgtgtgtatatacacatctcctcctatattagtcaaagatttgtgtctatgcaatgtatttgtacatctctggaatggttggggcaggatcatcttgacactgatcaatgtccccttgttcgtttgtttatttggatgcaatgtttctttctttccaactcttttgtgcgtgtttggacatgatttagtaaaagctgatgatgcaatatggaccattcaaatcaatcaaggaatttggattatgagagagatgatcatagaagccggggttggtccattcctctagctttcgccatttttccttttcgtaagctagaacatcactgttaggaccatcttgggttactatgataatgtaagagcaaatagtagctaccagactaagatccaatttttcaattaattattaattaattaaccaaaatattaatggggatagacctagtgtaatgacaaaattaattgtactggtgaatgaggagatgacaagctatataggta

SEQ ID NO: 21302 - DNA, 1501 bp, Oryza sativa
catatatgcataccgcataaatttctcaccaatcaaatgtcagaaatacttcaataggttttgaaagtttgaaacaacaaaccgtgtatacatttcatccccacacacattgattgcacgcagctgacaaattcattgagcattgcaccaacgagttgaaaatttcaaatccaaggaactgatcagttcgtccgtagtaagtactagagctactgctaattaattactacatgatgcagactttatcaaattaatattgactgtatgctcacatgaacatgtgagtactatacatggccaatcatatagagacaaccatggtaaagatagcttttgtatttttagccaaaccttcaatatttttagaactgcatgatttggtctgaaatttgaccgatttaaggtgctacaccaaataaaaaatgacacaaaatgtggattagactgagtaattaaattaagatggtttggtttgatcgggtcggttggacctgttgagccgtagcgtcctgccggccgtccaacagcctgtcatgtcggccattgcttccgattaatttgtcttaggctacatcattaccagcttaatgcttagctacttctcattttcagtgaacatgattttcgacggatgcataaacgagtacgtattttatactccctccattccaaaatataaggcacaaccaattttcttagatgttcctgtaaaatcaaatgtgtttttgattattattctgtgatgaacaattgagcattggagattagtggttttggagatgattggattcacaggtgatcgcaggattcattatttcatgtgaccggtcagaccgggctctggtagccggtcggaccggcggtatgcgcgtggtcaggtggtctgaccggccgacactgtgtcggtttcggtttcgggttgtttgtttggatatccatgattatttcataattatgacttctagatggatactatactatgtaatactgttgtttgctactaatgagtcaagttggagatagcttggtctcggaatatggtttctttgtttgttccatgtgtaggtgactcgatgtctcgggagagtatttgcggtgatggaccaggagtcggcttggggataaggcgacgtccgtggtggtcagagatcatgcgggatacttaggctagagttgatgcacgtggttgatagagattccatatggcatatgatggagttattgtgtgcgtatgggatgcggagtcaaatttggaaggagtccaaatttggtacgattggttatgtaaagtttctttcttgtactagagggtttcctaatgtgtttaggactcttagtatgagtttggttcgtggctttagcctgcctacctcatgtataaatagagggggagcgtgaggcttcccggtatcgcttttgagagcaattgagttgagttttgagttagggtttcgagtttagtcgaaatttttgtaaggagtgctgttggtgcactttgtaa

SEQ ID NO: 21303 - DNA, 1208 bp, Oryza sativa
gttgtcgtttccgtcgttgcaaaggttcgtaagtgcgcggaaagtattcaagaagattaattgaagaccgattattgcaaggcaagtcacacagatcctaaacacaatcctttgagcatgttgatcctatatttaaattctctatttatttcaactgtgcatttattttcgaatgtcactgggtggtgtgaatctattcctttgttatggcctgtttgcattgattactttattccttgataccttgggttattataacttgactagttgagctatatatattggttcagctagatattagatatgattgcttagccatgcttagaaacattagcacactattgggattacttatgactcattattatttaatgatggcttaatgatagttcacgatggtcaatcgtgattggttaattaattacttgccaactaaaacttgataatggtgggttgtgagcacatggttttgagagtcgtgctcatgacaattaaggaccggttcgcgagctactgttgtgaaacattaaccgtgccaaccacaagccagcgtgggcaacggctttaccttttgtatagcatgattcattgcggagcaccagactgagaagtggcggagataagcccacgggggtcgctggggagtccatgccttgtttataagggggtgattatgatccaggaaaggtgcgctgtggtggattgtgttgtgcaaggggtattgtcacaactcctttccgaggtaccgtggtggtattgaggcacatggtgacatgttgtggggctgtgtcttgtgggtacagtggtacacctctggccagagtaaaactattcgaatagccgtgcccgcggttatgggcgggttgagcaatgtttttcgtgattagtctcacacctctcacaataattatggatgttatacctggtaataatttgcttagctcctggtttggagttagatctgtacagccgggtatggttgttcaggatggttgggcctgtgcagcatgggtgtgttgttcagtgttgattaaaatttctgattaattactccactgttttatttctcttaaatgttttgctaaatgctgcttttgcaaatgagcctatattatgccatcctttggtatccttgtgcacttgcatatttgctgtgtggcttgttgagtatgtcatatgctcattcttgcaataatcaatcaacctca

SEQ ID NO: 21304 - DNA, 1501 bp, Oryza sativa
tacaagtgtcatctgaaacaaatgtgcaaaaggcgtatgagcagtttgatagtataatctgcttcatccatggcttcttttttggcggtatttttcaatttggaggtttaatgtcagccaaccatgtctatttttgttctcctgttttttgtgaggaattcctatcttttatttgaggaccatagcatccatatcttgataaactttattcctctattcaagtatgccacgtgtccaaacatcaccacaagaaggacaaaatagttgcctttgcacaaaccacatggagaggagaaaagggaaaataattgtgactcaaattcttggagcattgggggctgtaggctgtaattctagccattcacataggatagatgccaaaactcatgtaagagcaggtacaatagcaagctataaactagctataaatatattttaaagagataaagaagagagagaagagtagcgggctacagatctgtagctagctacagcatggactcaaaaacataacgtatatattacaggtgagactatgcattaatagtatatagtaagcaactattatatgaattggctactatattggctgtacatgatttggagctagtagtgagctatactattagacttgctctaaagcatacaacacctaactacttttttgcatgtacctaaaatgtttggatatgtatcctaaggctcatatgcaccatttaaaagaggctttaacaccaaactaataaaaagttaatacgccatttaagggtcacaggtaaaaagattcttctgagaaggtctaaaacgagtattttctaatgtagtctgggaaggcatagatggaattacaacaataccatcaacattagttgcggatcgagaaaaaaatagtttattggtgttactctaaacttaatatccctcggtacacgatgtcatattttcgttttataggccatttaacaatggattttctcggagttcatcgggtctattgatccaatagatctaatttacatctcctccttctcgagggtagtagaataaaagactttggattttgatcaacaatgaaaatgcacaaaactcctagatatctcaaaaatggattgagatccagtgcagttgttattgctactgcgcataatctgatccctctatttcttgatccaatgatccaaatcgtttgctacagtgaatcagcactagttcttgcagcaacgctacagtactttgctacagtattctaatgcatctgggccatatgtttcaaatctagtggtgctggtgtgactgtgtaacttgcagtcacaatatcacactagctactgcacctgaaccgaatccctccaaaatctatctgaagcggtgtggaatggacacacaatttataatgaaaagtctgatgggcaaacgcgctcaccacatactccctccgtttcatattataagactttctagcattacccacattcatatggatattaatgaatctatacat

SEQ ID NO: 21305 - DNA, 1501 bp, Oryza sativa
aactccactccagacccaactcctgaagctaaatttatgagttggagctgtatcaaacagacccaaagtattgacaatctggctaagcgcctatcaacgaaaagaaacacagatgctttgaaaggttttttttttaaaaaaaaaagttttcaggggtcaatcccaagtgtcctaatattgctacagattgatagagctaaccacaaggtctaatggaaactttgcttccgaatcagaataggacatatacactttccgatgtactataaacttactacaaaagaaaaaaagcggtgaaaaaaaaaggtactaccctccgtttcatattataagactttctaacattgtacatatttatatatgtgtgacacacacacacacacacacacacacacacacacatatatatatatatatatatatatatatatatatatatatatatatatatatatatatatatatatatatatataaaagtatgtatgtatgtatgtatatatgtatagattcattaatatccatatgaatgtgggtaatgctagaaagtcttataatatgaaacggagggagtatgtggtgagcgcgtttgcccatcagacttttcattataaattgtgtgtccattccacaccgcttcagatagattttggagggattcggttcaggtgcagtagctagtgtgatattgtgactgcaagttacacagtcacaccagcaccactagatttgaaacatatggcccagatgcattagaatactgtagcaaagtactgtagcgttgctgcaagaactagtgctgattcactgtagcaaacgatttggatcattggatcaagaaatagagggatcagattatgcgcagtagcaataacaactgcactggatctcaatccatttttgagatatctaggagttttgtgcattttcattgttgatcaaaatccaaagtcttttattctactaccctcgagaaggaggagatgtaaattagatctattggatcaatagacccgatgaactccgagaaaatccattgttaaatggcctataaaacgaaaatatgacatcgtgtaccgagggatattaagtttagagtaacaccaataaactatttttttctcgatccgcaactaatgttgatggtattgttgtaattccatctatgccttcccagactacattagaaaatactcgttttagaccttctcagaagaatctttttacctgtgacccttaaatggcgtattaactttttattagtttggtgttaaagcctcttttaaatggtgcatatgagccttaggatacatatccaaacattttaggtacatgcaaaaaagtagttaggtgttgtatgctttagagcaagtctaatagtatagctcactactagctccaaatcatgtacagccaatatagtagccaattcatataatagttgcttactatatactattaatgcatagtctcacctgtaatatatacgttatgtttttga

SEQ ID NO: 21306 - DNA, 1501 bp, Oryza sativa
accgccgcgtcggctccgctccggccgccgaccccttctgcaccgttgggttcggggggttgccgggttgggggaaggcggctcctcctcgccggcgctgctcggttcgattcggagggggaggagaccagccgcgagcactgtagtggcgatgtgacgccccttcccttaccagtaaccagtactcactttgtgcctctgtttatctattattcagtttcactagatgttaatttgagaggtagggcgctaggcctgtaaaattttacccaataaggtcagttgatattttttttattcacttcatgtagtgattaaccctaacacgatcctagttgatggctgggcatgggcagaactgcacaagtagtgcttggagttggcaagggaattttatagagggattctgcgaaatcgagtgaaaggaatagttatgtttgcatcgtactttgattggtacaatcggctctctcttcaaagtttttatcgattattacccccttattgcagtgcctcacttggtcatagctatcttttgttcatttattagataagtgatgtcccagcattgtcgtttcagacattctgtaagtattccactgtctacctctccaatacacaatcacttgattttgagttctctatggttcccggcagttgacttcacagatctagtagtgctatgctttacacttacagctgctgtgcaatagatttttgttttggctcctactattgtgaactcaacgaaatagtttccatcaaatagaaagtgaaatacaggggtcaaataatttcaagggaaataaaagatattggagttcagtactttttgcagtaacaataacctgtcagggttgcatgacagaagtcatattccctgaagggctgaatggggagatgaatcttccctgattttcatatactcttaggctttataataatgatagcctctgaataaacccttcaaaatgttaagtttgactaggatagtgattgacagcatcgatgtaagtgaatgattattttgtttttgaacaatctttcatgcatcacatccagcttgcactgtcatcatgtaaacgttatttaggtcagtagtcaagttgttaagggcatgtaagtttgtttcattattgtttaaagtaggctttagcatatactgcaagttatgtctggtgaagcaataataatttatttgatgtgacgtgtgtaaaatatgataaggaggattaccgtgtgaaactcaagctaacatagttttttcagtttgttttatactttatatgtgggacccaaactagtaatattgaacttatttctacatgcttcaatacataacaactctatacaacaatgacttccatatatttattattcatttgtaagccagttagtcctaaaagaaacaaggaaatatgtggagctattttgatcactgattcctctgattctgttctttttcctttttttctttaccccctgtgggtaattatatata

SEQ ID NO: 21307 - DNA, 1501 bp, Oryza sativa
gccaattttaaatggcatataagggaactggttaaattctagtggcatataagagattctctctattatttgcacgctgctgcgattagctgattagctccagtttatgtgtccgaaactctgaataatattaatcgtagaagagatgtactattttctgttcttgttgcttgaacctactaactgggacaagcgtcttggtttggcatccaaatagagaagtacagaaacgaagctacgtgcaggcagctcagagtgtggtgcaaccctttgtctaatggctctgaaacttctgatggggacttgtgcttggttggagtgcaacacatttacagattaaaccaatcctaattataatacatttttgtgctagctatacacagttctctagcacttacctgatcaaatatactagtagtatacaatatatagtagtagaaaactagaacgatttgtacgttgacccagacagagagagatgccgggcagtgtgtgcaggaatcaggaggcaggagggatgttccttgtaaggcagcaaccagcatagtttagctttggtcatctgtcctaaatgggatttgtcggctaaatcacaggcgtttatccccttccgtcgtctatgcacaacactacacgctcgtgcaaaagcaggatagcttgacttgaagctgtggcacttcctctggcattgcttcagatgttcttctctgcttttcttttctggaactagctgggtatcgtagcttgtgttcagagacaagtacaggacgtgtatacgtatacatcatctatggccagtgatggcaacattgtaactccctttttcttcgagacaaccacgtacttgtgtaatgactatgttatattctaacatttgttgacaactttgtaaaatctaaatatagtataattgtagcataattacactgtagtttacatgcaactataatataatacaagttatactttagttaaacgtaagttacaatataattatactatatttattcttgacaagttttttgttcgatgatggatgtaatagcaaaatcgaggttaaatccttgaacagcggggcaggccgaaagaagcccagcaataccatgctccttgttcgatgggcccaaactccagcctgcatcaccatgtaacggcccatttatgtaaggcccaaaaactagtagaagtgttcaaaggcccataaagctagcccggaaacagcccatgaacagagcgaattattattactctctctgtcccgtaatataagggattttagatttttacttgcaacgtttgaccactcgtcttatttaaaaaaatttaaaattattatttattttatttgtgacttactttattatctacagtaatttaagcacaacttttcattttttatatttgtaaaaaaaattgaataagacaagtggttaaacgttgcaatcaaaaactcaaaatcccttatattgtgacggagggagtattagttttcaattaaaaa

SEQ ID NO: 21308 - DNA, 1501 bp, Oryza sativa
acttccattaaccttttagcagcacctacccaacaagtgaagctaggaccaactgttgacaacaatacttcaacgaccacaatgaaagatagccggccaatttggttgtccctgtgagcacttgtacgccataatacaggttccttgatgccgtcagattatagatgcatgtactcaaatacgcatcatctgtaaacaggaaaagaccgtgagtgtaactgaagatagcaatcttgtaaaaaaaaaagtgtaataatacgtcagagatttcaaatactgatatcagattgataccacttgattggcgaggaaaatgaagtgctggaatctgggccaggatttaagtaaaagcagataaaagtcacaagcatatctgggcaggactaaaatcatatattccaacttgcatatcggcttccagtgtcccaaggtatttttatcttgggcatctcatccatactcaaataagagcctgacccatgtgataatcagaactactagtttccttctcattaggttaaagtgccaacatttcgcttgtacatcatggttccagcaaagattccctacagtttcacaaaaggtaccatcacctaaagcacacacttgagtgttactgtcattacagggcagtacaaagtgaccaaaccacaaaagaatttatcagtcagaagtccatttcaccttaatgtgctcaattacatgtagaattgccaccgttgctctggttgtcttgtctcatgattaggcgagcgcaccgatgctgtagtgcactaggaaactctttctgatatccgttagtgttaggtggtgaaaaaactttatttacagcgtgcaaaatccttcttccatgaccatagcacacatggcaccccagcaatccatctggttccagtaagaaataacagaatggtacaatgggaaaaatacttaaactttaaagctgattacttggtagaaatcaaggaatcagattttattcactttgtcaaaataccagctaaaaaatatcacatatgagggaatgaattctcttccatgtcccctacagggatgaccgccaattgaaatcggatctataaaagtaaaacggaaaaggaaaaaatagtaaagcttccatttcttttggtttctaatattggtaggaaaagggtaagtaatgtaaagtagaagtgggggaattgtgagttgttgatagttattcccatgccagaggagtccagccaagaacgaaagctatacacaaatactcactaggcaacatggagagacatggctcccatgttatcccgtgcaacccctgttccccacttgtgccctcccgttgcacatggcctcataaccaacccttcctcccctcctctcctatagttaacattgccatgggaccccattcctatacagaacaattatcaccaccttccttttcccaactcctctgtaccctagacttctgcattggaacagtgctctgttctaagcattgtatagcaatatctct

SEQ ID NO: 21309 - DNA, 1073 bp, Oryza sativa
atcaactatcaaatttgaaatccgccccgaaaaaaaattgtctgattcaacctaaaaaaaagagtgtgtaagagattcatattgctttttgctttttcctcatcgtctcgtccgcgatttcgccggagttttcgccggcgctttgggaagccgccacggggttatatttacaaccgtattaccgcctttgaagtgagatgttgcctgctcgccggggccccgaaaacaggtcacgtcgccgtcacgccgaaaattcacctagtaatttccgaacttatttgtgcataaaatcctcgtccaggaatcagccgaggtacacaaactgacaatttaatatacagattcatcaaattaactaaaccgataaatacttacttaagaggcacttagtcctcaccatgaagaaaactgcagcggaaaataaaatctagcgaagctccagctccactcccacaggcagctcagctggggtataagccaaacgtcttctcctcctagatcctttttcttcaactgaggttgattgattattgcaagaatgagcatatgacatactcaacaagccacacagcaaatatgcaagtgcacaaggataccaaaggatggcataatataggctcatttgcaaaagcagcatttagcaaaacatttaagagaaataaaacagtggagtaattaatcagaaattttaatcaacactgaacaacacacccatgctgcacaggcccaaccatcctgaacaaccatacccggctgtacagatctaactccaaaccaggagctaagcaaattattaccaggtataacatccataattattgtgagaggtgtgagactaatcacgaaaaacattgctcaacccgcccataaccgcgggcacggctattcgaatagttttactctggccagaggtgtaccactgtacccacaagacacagccccacaacatgtcaccatgtgcctcaataccaccacggtacctcggaaaggagttgtgacaataccccttgcacaacacaatccaccacagcgcacctttcctggatcataatcacccccttataaacaaggca

SEQ ID NO: 21310 - DNA, 190 bp, Oryza sativa
aatgagctcagcctagggctttagaaaaattttagttggagtttattcgacagtcagtcgggaatttattgggggttatgcactgatgaatcccctaatgattttggtaaaaatcattaagttaaggtggatacacatcttgtcatatgatcaaatggtttcgcgaaaaatcaataatcagacaacaaga

SEQ ID NO: 21311 - DNA, 1501 bp, Oryza sativa
tttccccctttgcagtatcatggtgatacttcggggcatggcgacatgtgtggaatcgtgtcttgtgggtacagttgtacacctctggccagagtaaaactattcgaatagccgtgcccgcggttatgggcgatcaaccagattcaccgtgattagtctcacccctagtttagcttaatgaactggtgtagttcaggtggttggttgggcctgttgcaacgtggtgtagcgttggacagtgtttggttaatattgattaattactacaactgttttactgctttcaactactgcttttaaatgctagctttatgcaaaagaacctctagcctcctttggttatatcctgcatcatacctcctctaccggtatgacttgctgagtacagtgggtagtactcagtcttgctctcttttcccccacaccagagctgaagattttcctagttggagctgttttgtcaaatttggtttcgtcgctgccgtcaaggattgtctgtggagtggagtcgcccgctgctgaagtcaagcttcccggtttagctcgcttttatcttttccgctgcatttgtaatcttttctatttttgtaagacgtggatctgtatgtcaacaattgtcgtttgtgtaccctggctggtcctggacagggattcaatgcacattcagcttagaaattctggttcgagaatttctgggcgtgacaagttggtatcagagccgaccttgaccgtaggacaagccaactggaaaccctaagagccctctgaaccccttttcatatgcatatgcccttttgcacttggaatttgttttgggaaaatttggagttttgcctctttggtttgcgggaaaaatcttggtcgttcattcggatcggatttttttttaaaaaaaaaatgagctcagcctagggctttagaaaaattttagttggagtttattcgacagtcagtcgggaatttattgggggttatgcattaggtcgtgtctatattcggtgggggcaatgttatgcgcatcattttccatgcaactagtctatgcattaatttattgtttagttgcattagtgtctttatttgagttcatgaaaaatattctatgcataaaaatcatcatgctcggttatttatttgagtcttcttttgctttgtttaatttggatttgagcatgagttggttcctatcccttgtctactttagatgtcagtcctatccctcgtttgcaagcgccgcctcgagcttcagagtcgccgcccttagctttatcgccttcttagtctgtttgcttgctagttttcgtgtttaggtttgttgcttgtgggttagtcggcggtcgatatcatgtgtcagtggtatgactgcctcaattaggagtttcgtgcctctttttcagtgttttaatcaagattaagataattgcacttaaattcataagcaagattagtttctgagcccctgttttcttccttttctcatatttctacctatcccctcaga

SEQ ID NO: 21312 - DNA, 1501 bp, Oryza sativa
tatcccttctgtaactgttcatcaacttgcttcttgacttccgccaactcgttggctcccattctgtaaggcctcttgtggatcggtgcagttccaggtaccaagtcaatccggaactcgatatccctttttggtggcattgttgtcagatcatccggaaaaacctctggatactctctgactatgggaatatcctccagcttcttagtggttttctccactgctacctcttgttcttcaccagcagcctggtttaaactaatccctggcttctgcggcactggagactggaagattaccacctctccttttgcattggtcaacttgatggtgcggctggcgcaatcaatcactcctctgtgccttgccaaccaatccattccaagtatgacatctaggtccttggattcgagaagaatgaggttggctggaaaaatcaacccttgaatttcaactgtcacagatgggcagtagtgagttgtggtcatgccacctccaggagtatgaactcgcattggtatcttaagcttcactaaagataacccatgtgcaccagcaaaacgcttggaaataaaggaatgggttgcaccagaatcaaacaatattactgccggtgtcgagttgacggggaatgtgcccaatataacctctggtgctgactgcgcctcctctgcagatgcatgattaacacgggcctgaacgaacttgggtccggcacgtcttggcttcgggcactttccaaccgtgtgtccgggtttgttacaattgaagcagagttcgggtttttctcccaacctcttgggctgttctgtcagagctggctgaactgattgagctggaatctttagtgaactcggagtagggttgaggctgtgctgctcactattgttgtgactgtcactatggtggttcttgttgaagttacccgggtggtagggacggtgctgccggataatcatggtggaaggtccaccgtgatgtcccatcgtgaaacgaggcttctgactcttcccctggggagtcctgaactgagctgccttcctcttacggtttattttgttacagtgctcctcctgacggatagccttatccaccagcttctcaaagtcctcataatctctagagatcaactggttagtcaattcatcatcaagaccagacaaaaacttctcctgcctctcggcatcggtacgcacgtcctcaggggcatagcgcgcgaggcggttgaactcatgcaaatactctataactgttctggttccttgttgcagggaacggaactctctcttcttttgtgccacgattccctcgggaacctgggctttattgaaactatgacaaaactctgtccaagtaacctctgccccagctggacgggtcaccatgtagttgtcccaccaaatagaagcgggaccttgtagctggtgtgtagcaaaagcaaccttctcctgctcgttgcattgcaaaagattcagcttcttctcaacggcatgaagccagt

SEQ ID NO: 21313 - DNA, 369 bp, Oryza sativa
  unsure (1)..(369): unsure at all n locations
attgattgattatcctctcgctnnnnnnnnnnnnnnnnnnnnnnnnnnnnnnnnnnnnnnnnnnnnnnnnnnnnnattttaaacaacttttgcaacttgaaccacattaaactgagttaagatgaattagttatgaatttttaaagattaaatcggattaaaacctttatatggattttaattgaattatgacgcaataatgaattatttttgaaaaggaaaagaaggattattgcgtcagcggctagggtttcggtggaccgggcgcacgggcgacggttcacgggaacggacggccgagatcaaccctatccaaaacggacggctgagatcgatcggtccacgaccggctcacgggaaaagggacga

SEQ ID NO: 21314 - DNA, 1501 bp, Oryza sativa
cgccttgtgtagggatacggattctaggcctctggaccacagtgggaacgtccgaacgtgaattggttaaggctgtgtttagttcacgctaaaattgaaagtttagtcgaaattgtaacgatgtaataaaaaatttaaaaatttatgtgtgcaggaaagttttgatgtgataaaaaagttaaaagttcaaagaaaaattttagatctaaacacggcctaaccatcgttggcatggaagttgaaccgctcgtatactgtatacttcgactctgtaatgtgtatagtgttataactcacggcaacaagcttgagaaaatggaacaccaaatgtaaagatggcagaaaatggaacaccaaatgtaaagatggcttaattaacgggttgtgcatctgtaactccagaggtgctaagcgttaattatcaaccatgacgggaatgcacatgccttgccttgcgttgtggtccatattcccccggttcagtagtagaagatcacaaatttatttactgttcaaaatacacagccgatggcccccgctggagacgcacgcgtgacgcaagcggcgtgcacgcaagaaattttatgggaggagagtggtacggatgctgaagggaaaaatttctcatacgaattggcacgcttctcgaggctgccgctctgcgtgacgccatcctcccgtcgtggaacacggtttcgacagggcatggccgtcctttcgacagtgcagagcatgtactcctccgtagtagcagatccgtcgaaaacgaaaacggaaaaaaaaaaagaatgagtatctgttgcactgacccgtgggtcccactccatcgtatatgcttctaatcggcgtagctacagaggtggcaaaggagtagtagggtaccaagatactggtatactatggctgtgttgagatccaaagtttggatccaaagtttggatccaaacttcagtcctttttcatcacatcaacctgtcatacacacataacttttcagtcacatcatcttcaatttcaaccaaaatccaaactttgcgtgaactaaacacagcctactagtatcccaaatgggtttatatcatgtactataatgacactgttattatagacaccaacatgtgaggcaataggagagtagaagtgtgggacccacacacctacgctagtgacattatggtagaggatactcatataccccaaacactaccaagacaccaacacgaagagagtacgaacgctagtagggcgttcccagcgcgccttcatggtgttcgaactgaataatcaacaccatgttctccacacaggaaaacccgtgaagatcgatcgtgtagtcaaaactgatcgcccgttctttagcttgaaaaacctgtaaaaagcacatgcacaaatgactgggaagaggagagagagagagatagagtgtgtgtgtgtgtatgaaagctgtggaaggaatcgacagcggttgaagccaccttgacgagtgaagtcaacggggaaa

SEQ ID NO: 21315 - DNA, 1501 bp, Oryza sativa
gcccatcgaacaaggagcatggtattgctgggcttctttcggcctgccccgctgttcaaggatttaacctcgattttgctattacatccatcatcgaacaaaaaacttgtcaagaataaatatagtataattatattgtaacttacgtttaactaaagtataacttgtattatattatagttgcatgtaaactacagtgtaattatgctacaattatactatatttagattttacaaagttgtcaacaaatgttagaatataacatagtcattacacaagtacgtggttgtctcgaagaaaaagggagttacaatgttgccatcactggccatagatgatgtatacgtatacacgtcctgtacttgtctctgaacacaagctacgatacccagctagttccagaaaagaaaagcagagaagaacatctgaagcaatgccagaggaagtgccacagcttcaagtcaagctatcctgcttttgcacgagcgtgtagtgttgtgcatagacgacggaaggggataaacgcctgtgatttagccgacaaatcccatttaggacagatgaccaaagctaaactatgctggttgctgccttacaaggaacatccctcctgcctcctgattcctgcacacactgcccggcatctctctctgtctgggtcaacgtacaaatcgttctagttttctactactatatattgtatactactagtatatttgatcaggtaagtgctagagaactgtgtatagctagcacaaaaatgtattataattaggattggtttaatctgtaaatgtgttgcactccaaccaagcacaagtccccatcagaagtttcagagccattagacaaagggttgcaccacactctgagctgcctgcacgtagcttcgtttctgtacttctctatttggatgccaaaccaagacgcttgtcccagttagtaggttcaagcaacaagaacagaaaatagtacatctcttctacgattaatattattcagagtttcggacacataaactggagctaatcagctaatcgcagcagcgtgcaaataatagagagaatctcttatatgccactagaatttaaccagttcccttatatgccatttaaaattggcttctctcttatatgccactagttcaagtttttccacccttttatgccactcccaccactatagtgttagttgactgttagtcaaaggttagttttttcataaatgaccaatatgccctctcaactaaaaaatgtgtaaacttcaaaaaaatcataactaatttattttaaatcctttttggatgaacaaaattttatcagaaccagtgaaaaatgctctttatattaaaaatattgttggaaaactgcatgtttcatgcttacattgaaaatttatttgtgatggtaatggctaaaattgcatgtgatgcataaaaaatcaattttcatatgttgtatccagtatagctatattagtactaaaatacctattattaag

SEQ ID NO: 21316 - DNA, 1501 bp, Oryza sativa
tcaaagcattctgctaataagctcgctaacgcggccacaaaatccgtcgctgacagatcatcagaagcaaccaaaaacccacattaatcgcggcgactccgctcagatcgatcgatcgatcgctgcgcccaccgtgatggccaccacaccagccgtcgtcgtctcctagctccacacctcccccttgaccaccgccaccgccaccggccggccgggccatgcacggcgaccggccggatcgaccaagccgacgccaccaaccaaatccatcccggtcatatctctgtcgcctcctcggacccccaagctccatcacatggtggttgtcattactgtcactcgatgaaaccccatccattgctgcggacacttatataagaataaaaaaaattttggatgcacttaatagtttagtgagaagggacgtgtggtttcaacccagaggtccctattcaatccccaacacgcttacatatttttctttaaaaaaaaatggagaggcgtctctaccctccatatctccattttttaaggaggatggaaattttattaaataaataagcaagaacaattagcaataaagtaggtactaaataagttgagtaattaatagggaatataattgcatagaacatgaacggttgagattaagcatgagagagatcgaatggctcatcttagcttcacgcatgttgagcttgtggctgtaactttatagaaagagaggatttgtgtcgtcagtgtaagtgtactgctggtaattgcacagtttaattaccagctaatgcatggctgggtggttaatcagctagatctctctggttttgagctagctgatcagtgatcagtgtagcagcggcaaattaataaatgggatgaaaaagcttttgcattgcatgcatcatttcgtacctcacctagacgatcaatggtggttgtgagacatcctggatcttgaaggaaatataactgtcctgtgtcacatataatggcgtttcagctgtaatctaatccaatggagctacctaagctaccacgtatacatgtacctatagctcacattatgagtgatcgatttatctaaaatccaataattagcccatccaaaaagggccataattgtttcaatttcagtgtaatctattggattccagggatgttggaataatggaataagaaggtgagctcaaaacggatttcctgtacatgtttaacaagtgtatttgttgtaacctaacactggcgagtgagtgaatgagtgagtgagtaaggtgggccccacatgccagtcactcacccccaggctctgctttctgctcctgcataataatcaattttttaatcagtcaccagttcatctcaacatctcatcctaatttgtctttgcatttttttttgcagtttacacccccaccaaatctgaaatccccacacgcagcaatatataaggctacaatacagagccccaaacgccacacaaagtctcctcctttcttcttct

SEQ ID NO: 21317 - DNA, 1501 bp, Oryza sativa
taaaggagtagtagtaggagtgagaggaggaggcagacaagaccacattataacagctgtaatgtgggcccttccggagagcgaaagaggtgcagaacgtgcccggcgattaacgcggacccccccccccccccaacacccccccactcccagacccaaccccactaggtggcccacacgcttacgccactgacatgtggggcccacatgcgcatgggcccacgtgtcatgtcagccgcgttggtggtatccgcgtgccaatggttcaggggcagaggagtataaaaatggccatgcattggcatgttgtgggttaatccctccctttccaggtaataaatggccatgtggcccttttttttaatgattaggcaaaaaatcttggtgattaaattaagttaaccaccccaattattatgccccggcttaagttaatgtatgggcaagaccgggattggcatttcgtttcacatgggagattaattttagaattgggcccaaaagggagttgaatttgagctttgctatggtcacaacagtgcatcacttctatattgtttactggtattttctccattagcctcaacagttagaaattcaaataaatattgagcctgatgtaaatgaacaagtaggtacaagaattgggaatttcaaaatggtttttccatgctcccttcgaaacaagagttcgagtaacgcctgtgatctcactgtatatttattcgtgcatatgtatctactctattcgtgataaatagggatgtgcatgtacagttaggaagtaagagttgcccatactttcaatgtgaattttcttgcaaatgcatgcatcatgtagtatatcatgcattcatatataataaaatatatagatggtgaatggtgtagtactcattaaataatgtgtacaaatgtaggtatctctacgtcatgtcttcaagcggcatttttggatttacactatcaatccatatctccatattgcctataaaaaaatactatgtctccataaaccaatgtagtagaaatttgactgacaacttcattgaattaccttcccttaattcacaatgtagaaatttacacaactatatataaatttaattctactatacacgtaaaactttgagttgttttggtaaaaaaaaatgagttgtcattgatttcactatttcttttgtagtagaattcatcattggtgtattacttcacacaacaaataaatgaaagaagttattatgtatgtaatggaaaccatgggatgcttctctggtttgaccattggtttgtatgtcggtttgtgtatgcatacgtttgtgacataactctagctagctgttgacagtaagaccaaaactatctttaaggagaagtttttgtagccgaacgtttgagcctgatacttcacggtgcaataccaacaggggaagcacttatccttttttgtgtaccttcaatcacattcttcatttttggcaccttaattctctaaggaagg

SEQ ID NO: 21318 - DNA, 214 bp, Oryza sativa
gtattatgaggtaccatgaggtaccaaattctacactaaatttttggtacctcatggtacctcctcaaggaccgtagaattgctcatctaatattgtcttctcttttttttggggggggtgtctttgcagtgcaataatttcaataaaccagaggtactcgtactcctataatatatcttatatacccaaatgttcttcgctggcaagaggcta

SEQ ID NO: 21319 - DNA, 1501 bp, Oryza sativa
tatggggttgggttttaatatgcatgtgatgtgaatggttcgacttctctggtttggttgaacttttgggtgagtttcatttttttttgtgagaaaagctttggatgaacttattgttgcatacaacttaattagtaaataatatcagtaaacatttcactagtcaaatttatgatatatcggactacaaaatgcagaacaaaacatcaactttgttttttagcatgggtgcgacggatgaaagtgaaacaacgttagaaaactgggagtataactgttgctaacaagtggacagcgtacggacgaaagggtcagcagtggtcaaattaaccgattactgtagctagccgtcaaaccaccccaaatttgaccgccgaaaaatctaaccattccctctgaccaccatgcatgtacgtaaatacgtgcacacaccatccccgaaacacatccaaaagccgaccttttcatcgaaatgaatagcgatcggtcgagtgagacgcgcgcgctacagtgcaagtacttcgtagcttttttcttaccgtcggttactgtggtatacgtataccgggcacatactggtactactgagttggagtataattttacatattgttttcatactatattcactgttaccgtgcttatcttaatttggctagggtaaggatttgcattcttgatgaaaaccgatctggatttcacataatccagacttctctaacgaggtaaaaaaacaaaaatcgctttttcatgttaaattcaaaaaattcaagctggactataaattttcgacaaaaaattatcgatttcatctctttttcatttttatcaatgtctttggtgaattccaaagatacacctcgtgagcggtttttatccagtatcaggatcgtgaaccctattccctctcccccgattgtccccggtaataaggcaaactaagagcaggtacaatagcaggctataagctagctataaacatatttaaaggagataaaagagtagagagaagagcagtgggctatagatttgtagccagctgtagcacggactcctagacacaatgtgtatatgacaggtggaaccaggtattaatagtatagtatgtaactattgtatgaattggctactaaattgactatagataatttataatccctccgtttcataatgtaaatcattctagcattttctatattcatattgatgttaaatgaatctagacatatatatctatttatattcattaacattaatatgaatgtagaaaatgctaaaatgatttacattgtaaaacggaggaagtagccggtagttggctacactattaaacttgctctaaccgagcgcaaagcctggaagaaaaaaaaaacaccgagccatcgctcggtccgcatccgcgcgcaagtgtgggagcagccgcggccgcccgcccgcccgcccgcgcgcgcgcgtgtgccgcatgggcaaattttccctctcacccgcacgtatgcacgca

SEQ ID NO: 21320 - DNA, 1501 bp, Oryza sativa
tgaaccattggcacgcggataccaccaacgcggctgacatgacacgtgggcccatgcgcatgtgggccccacatgtcagtggcgtaagcgtgtgggccacctagtggggttgggtctgggagtgggggggtgttgggggggggggggggtccgcgttaatcgccgggcacgttctgcacctctttcgctctccggaagggcccacattacagctgttataatgtggtcttgtctgcctcctcctctcactcctactactactcctttaattattatttttttgtttttctccaattctcctaactaattttgttcccacatgtaaacttttttttttggttttttggggatttaattttgcctttgtaatgatttttttggctgttgctgatgctgctgcaaagtagtaaaaccaatcttggtgtaattgtttttctgctgccccttggatcctccaatggtccttggtttagtactggtcatcagtgcaaacaattgcttctaactcagatgaattttatatttttcatctcaaaagaaaaggtattgatgagagtagaaatggtgaggtaaaataaaaagggtaattttgaggataatttatgactaaatttccagtgtgaaaaatactcctccagcttagtacagtagatcatgaatcacagaatccaatatattcccccatggggattgaggtagaggagtttttgtagaggtatttgtgctcctctcccttttattacaagcctccacctttctctctcatcccacagtttcctacccctcctttcttcttcaccagtttgtctctctctctctctctctctctctctctctctctctctgtcctttcggttttaactagcattaggcaggtggttaggaggggaggtaaagctcaaagctccctcccctgacagcgcagcatcttgtttgttttatctcccacatcatctccctcatcatcatcatcatctcctcttcttgcaagcacccacaacaacacaaactctctttcttcatctttctctctcctcctcctctctttgttgtactctactcaacatttctcaactttcacttcttcttcttcttcttcctttctctcttcacagctatcatattctcctcctgcttgctgctgctgctgctggctgtttctctctcatccatccaccctattatttattcaaggctaagtgatggtatcttaattcttttttcctctctgcctcctcttcttcctcctcctctctctctcccttgctgttgcaggagtataatttttatttttgccaggcttcttcctgtactggtgtttccttgtttcctccctttcttgtgcttcttcttcttcctcatcttcttttttttttgggttttctctctcctgccatccttttcacctctactagctctcctgatgtactgatcattccatcacctccattccccagtggtaacactcgtgggggaggaggaggaggaggaggtagtagca

SEQ ID NO: 21321 - DNA, 752 bp, Oryza sativa
tgctccatgcttgaacaggctgatattgccctgtataatctttttgctgtgtttttggagtttgtcttgtcaaaaaggcagtgctcaaatggttggttggaacggctaccatgatgtggggaacgatagaaatgggcttaaaaatttcatccatgagtgtgctgtcatttttcttttttcaccgagagagagaaggaagcattgcttttcagatagtaacatcttcttgtcttatttttggtagtgagggttcatgttcttctccatatgctaactgttggaatgagctggatctacaggaatatttaacttataaagattagggactgagtgcatgtgaccattattggccgttgacgtgctggatttattttttttttgttcatcattagtttcaaagattcctctccccgagtagctattggttatgcctttgtgttctctttccatgaattatgtgtgacatgtgagaaaagaatcagtgattcactctttcagaaattggatggacgtgtagaattaataaggcggcttgtcatgttccctttatcattctctctgtcaaaaaaaaaacggtgctactgatctttcgattgacgtatccttgtctgaattttacgcttttttttctcatgtggtccatgaaaaaaaaattattttggtgctaaacttagctatcaatgttttggccaactcactaaatttcttgcatatatatcctcttttgcatattgattcagattccttctttg

SEQ ID NO: 21322 - DNA, 1501 bp, Oryza sativa
agcatcttcggctttggcatactcattggctttttcaaacatctgtttgaccgtcttgggaggtttgcgtccgaacttgtcgactaggtcctcgtggcgaatgcctttagtaaaggcggcaatgatgacgtcgtcggtgatgtcggagatcttgttgcgttgctcagagaagcgtcgaatgtaatctcgaagagattctccagacttctgaacgatgttgtagagatcgaagtgtgtgccgggccgttcaaaagtaccttggaagttggcgatgaagtggtcgcgtagctctgcccatgatccgatcgtgtcgcggggtagcccgtgaagccatgaccaggcagaatccgctagggccacaggtagatagttcgtcatggctttgctgtcccctcctgctgcgcggattgcgagaccatagacggtgagccaagactcagggttagtggtgccgtcatattttttgattccagtcggcttaaagccggctggccaatccactcgacgtagatcgcttgtgaaggcagcaactccgtccacgttgtcgtcgtagcgatccggtgaatgatggcctcttgctgtgcggcgctggttgatggtgtcgcgaagatcgatgggacgtcttcgatgtggggagtgtggtcgttcaattcggcgctccctatatcgctcgggaggcgagcgaacggaccgttcatcatgtcccctgctcctgcgactagattcggcgccggcaatgctgaggcttggctggtgatagtcttgagatcgaagatgagggactcggctaccagtcggggtgcgggtgcttgcagagttggctgggaccgaggcagcgatcatggtcttcgtctggttcaagatgttgactacatgatcagcttggttgagtgcgtcttccttgaggagggtgtcgaggagagtgattgctgcaaccgcgttctgttggggggtgcgaaagaccgctatcccatcgacgtcttgttgcccaatgagctctctcgcttgccacccagattccaaggcgcgttgtcgtcgatcttcagcctcctttgcaatccgttcgcgatcttgttgctcacgctgtagtcgttctcgctcttgtcgctgtcgctcttcctccaatcggcgacgttcagcttcttgccgtgcgcgatcttggtccgcttctcgggcttggcgctgttcctccgtttcgttgtcagccatgaatacgccgaagaagaggggcgtgtagttatccttatagctgtcgtcgaagttgtcgaggtcgccgtggtcgtagtggtagccgaaatcgtcgtagtcgaggatctcggttggtcgagaactgacgccgggggagctgaggtagccatccaactcttccgtcgagactgtcccgagaggttggagtataacgccaacctccctggatctagatcggatcggggccgaagccggagctcgcctagatcttcgagtgggagatgtcttgactgtgaagacagcggccaaatca

SEQ ID NO: 21323 - DNA, 1501 bp, Oryza sativa
gcccaatgctataatcagcgtggtctgttgtgatctctagggacttaggcactttttgctttggcaatttgtgtttacgatggtgtggcctaatgctgttaaaatcctttttaacgcgattcaataattctttggaattattatgatgcgcataaaaaggtgcctgacagaaaggtgttataccatttttttgtaagctttattaggctgcaaaagctgtttgggttgatttgagatgactggtttattaatagtcattcttttagcatgttatatgcttattttggttatggtaagggtcacagcctaggctattggactcattaattaccatgattttctatcctgtttggtgggtcattttatgagatttttactcggattcctatcaaacatgtctatttttggacctttgagtgtttatcactcggcccttcttgtattttttgtccttgatacattcaagttgagaagcagtcggctgggtatcttactaagtaccatgcgtgcttcgctataaaaccactcggttcttgactatatgtttagtttttcaactaatcacatagtcaggggctacacctaattaggtgcatctactcgatgcaccatgttttattttcgcccttcacagtttttgatttttagtactcggcaagctggagcaagttgaattgaagcactcggactactgttttttgtttcgagaaggctattttgtcaactacgaaggtctcgggggctactgtggagattatggatatcccatatcgacatgacggttgtaatttagtcggatatacggtaccaaatatagatggaatatctctatgaatactcgggttaggttctaaacttgtatgtcaaggaaatacccgggatcttagtcggttacgattgtattttatctataatcccatattccgttaggatatggactgtattttgtaaagcggactccttcccttatataaggagggtccgtgtgcctcttggaaggcgattctttttcccagtctatacaattaataacacactcggcggaatcatccccggacaggagtagggtattacttcttgaataagaaggcctgaacctgtataaaatttcttgtctccaaacccatccactttcctagcttgacagccacccccttttattattgctgaaatcttgcttcgacacagctttagaaaatagatttacaaatactagatggaaggacctagcctatgttgtgcatgaaactggttgcccatttgaataattaatttcccatatatgatttttcatttggaggattgattgcggtacatatgcaatgaagtttatggtgctctggaacccaagagttcgggttaatttctatttgctccatacgagataaattgcaaacatgtgctagcaaatgacatgtaccttcctaagcagaatagtgaaacagaaacaaaggaactttgtttacttatgtgatccaaatattcgtagtaatatgtcggg

SEQ ID NO: 21324 - DNA, 1501 bp, Oryza sativa
aagttcaaagaaaaaagttgaaagtttatgtatgtaggaaagttttgatgtgatagaaaagttagaattttgaagaaaaagttgggacctaaaaccggccgaaatatgcaagtagtagttcctactttcacacaaccaatatggttcattccatgatgggaattcagaaatatttcctgtcaagctctcgctgagcagtgagcaccagcacgatgggaaaaagtggagtagcatttcgccgccggctttcatagatctttttttatctttttgaactttttaattttttaattttaaaactaaatatttccaagacttattttcaagatttgaacggtgtgacagtgttatttggtcacactgttctaatatagacaaaatgtctagattttgtaaataagtttcagaagtgtttattttttaaaataaaaaaattaaaaagtacaaaaagtaatttaaaaaaaatcctttcacgataccggcttgcggcttcacggaccgaatcaatcggaggtagccagtttggccactttggcgggagtgcgattaaaacctgtttgacgacgtcaactctccggcgtgccggcttaaggtagggctcatgtgtaaaagaaaaagaaaaaaaaactcaggtcgcctgcacgatgggaaagggtatccttgtaattgatacaggattcggcgtttgagtttggactctgcactctgccgcgcacgtcgtatgaatattggagcttaatcaggtcccagggattcaaacgcgtaccactattggttccgataaagatgttctacccaattggctccttgaggattccaaaacaaagaaattgtttactggagtacttcttgcgttgttcaaattatgctagactatagtaggaacaaagaacaaagaacaaaaatatgtctatgaatagttccacgcttttcaatgcttcaaagtcaagcctcaatgaggttaaaattttctattatcaaaatccaaactaactggaaagcaccaccggtgatatggggagcatcgaaagcaaatcgaagtaatttggttggggtttttacccaccaaaatttaaatcttggtgcgcatacaagttagcaatattagaaatttggtcttgtttagtttcaaactttttcttcaaacttacaacttttttatcacataaaactttcctacacacaaactttcaacttttctatcacaccattccaatttcaataaacttttaattttagtgtgaactaaacatacctttatcgttggcttctctttttaaacgtgtgttacttttttttaagatcttgttgttcatattattagatctttaaacgtgtgttactgtgttaggggatttattcatgagtgtattagtgtgatattacatgtgtagtagtttgtgtacgttaattggaaaaaaaacgaaactattcttaaaacaaattcgaattgccggtaacggcgaccagagcaaaactcacgcaagcgaagtttcaaatt

SEQ ID NO: 21325 - DNA, 1501 bp, Oryza sativa
actagctacgattttatccctctaattcatctctgaatatgttaaaaaatatgtaagcaacatccatatctcaaacatagagaaattgttggtagaaactaattaatcaagcacgcaatatgcacaatgataggtccaattcggagcccacatatataacacggctataacactgtacaacgagctgctatctctgtctcaggttataagatattttgactttggtcagaatcaaactacttaatgtattcaactattgattggatgaaactaatttagtactgtaaatattactatatttatctataaacttaatcaaacttaaaatagtttgactttgatcaaagttaaaatgttttataacctgaaacggagggagaagtaactttcagagcatgccaatcaactcctccgtgatgaacgggcagctcctactcaggtggtagaaaccatcagtggctaacaccgccattagattgtctggaaagctgacaaaatctaagcaagcctttatgaggccatgggccatggcaatggtactggtcaaccaacgccatgatggacgccactgtgcccacgtcaatgtacttgcacaacttgctctcgcatatcagcttgagcctctccatgccgtacacttcggctgcgacaagcagacgctggcatatggcttcttcctcctcctttctcatctccggcaacgagtcggtgtacacgaagaagagcagcgtcctgaacacctgcggctccatgtcgtcgatgcggacgacgcatgcggcgtcgccctctttcatcgcgccgaagagctccgccttgaaaaccttggaccgcgccgcgagcacgcaccggtgcgcggcgaatctcaccccgccgccgccgccgacctcgaacgccacatccgcgtccttccctgcacgaattaggatttaggagttcgccgaggtgatggtgcaggtcgggcaatcggggaggcttattagcgacgacaaggctttggggcgccgccgtgtcatcgttgacgacgacgacgacgacgtcgcagcggaggtgaaggaatcgttcttcatatacctcgacttctccaagacttccctctcgatgaacttgcagcaactccgccactccggtcagcgtagttcttgagacacgtcgacggacaaggcggcggcactgggtcagaaatgcccgacatattactacgaatatttggatcacataagtaaacaaagttcctttgtttctgtttcactattctgcttaggaaggtacatgtcatttgctagcacatgtttgcaatttatctcgtatggagcaaatagaaattaacccgaactcttgggttccagagcaccataaacttcattgcatatgtaccgcaatcaatcctccaaatgaaaaatcatatatgggaaattaattattcaaatgggcaaccagtttcatgcacaacataggctaggtccttccatctagtatttgtaaatctattttctaaagctgt

SEQ ID NO: 21326 - DNA, 1501 bp, Oryza sativa
agggatgattgggatggtgggacactgttaaaaaagacatatacaagtcggcactataggtgtcagatcagctaaaaccgaaacatatagtgcttttccccttcaaaagatgaaaaaaaataaaacggcacctttaatacgctatagttgtcggttctatagaagaaccgccacctatactataggtgccgattctttttataaagatactagtatctttaatatattataggtgtcggttaattaaaaacgacaccctatcaaacgagccaagccgaattgagagacagcctctttttttcttttatcgcacggggaggcgaggaataaaacgccgagtgggaggtaagggagcgtccttatccacttgctcccctctcgtcctctcacccaccgctctctctttctcacaccctctcccctctgtgccggctctctctccttctctaccgcagtgtctcggtcgctagcacgcggtggtagcatgcaacagcgtgcagcggtgggagggaggcggtggtagcagcggcgggtggcgccctcccctccgctagatctggcaggaggggaggcaacggcagcggcggcgccccacgggtggcggcgggaggagaggcggcaacggcgggcggcgccctcccctccgccagatccggtgggaggggaggcagcggcagcggcgacaggctcccatccgccagatccgacagttccggcgagctcccatgtgtagttgttgattgtgtgatccatcaattattgattgtgtgatgctgatgtgtagtcttttttagatttttggatgattttttgggttgctttgatgcatcggctcgggtaaatttgtctttgcaaattgtataacttaaagatgccagttctaaaaccgccacctttaagtgttctaatatgtgtcttcttcatggtgtcgtttggaaaaaccggcactctttgtgggtttccatccggtacggatgaccttttctccgtggtagttgggagtaattaattaacgtgaacgtgtcgccgagtagtgaacaatctagtcacagttagttccgcgtgtacgcatgcatgtgccagcatgcatggacggtctggaagtcggtcttgtttttcctttagctatacttagagtgaagtgcttcagtggtctctaagcttgtgcgaatgtatcatctaggtatctaaattcttaaaatgtatttttatgtctctaaacttgtcttaggtgtcatataggtccaaacgggtaccgacccactccatccgctgacgtggcatgccacggtagcgcctacgtgtcagtggggactcacatgtcagtcatatttataaatatatgatatgataacaatatttacagaaagaaccttacatgttttaaacttactctaatcaaattctatacgtgctaatggagcggagcccacctatcataggcacagggagaacacagcagcagccgcagagttcgccggccggcgttccttcacgacga

SEQ ID NO: 21327 - DNA, 1501 bp, Oryza sativa
aatctattactcaagtcgagaggaaacatgggtattcctatttttttttgtctagtttcatgaaggctaaaagttcttttctaaatatgggctactggattattaataatggtgaacaagttagattctgggaggataagtggttagttatggttccgcttaatgtctgttttaggagagcattagttggtcagaacttgattatatggtattattttgtgtgttttaattgtgcatgttaatttaacagaggaggatgatatatttagttggaatcttcatcaaagtggtcaattttcagttcgatctatgtatttggctctaattaataatgggtatatagagagaaataagtttatttggaaacttaagataccacttaagattaaaagttttatgtggtatctctttatggggattgttttaaaaaaaagacaacttggctagaaggaattggaatggtaatttgagatgttgttttttataaaaaataaatcgatttaccatcttttcctggattatcattttgccaaatttctttcgaaatctatacaattcgcgtttggattatatcctccatataatatatctcatatatttaggaattggtttgtgggtgttaataaaaagaccaatgaacttaatcttgttggagattccgctgtatgttgagctctctggcttactagaaataaaattatttttgatatatcaccttcaaaatcttatttggttcttttctgggcaatatattggctccgggaaagggctcaattataaaagcatgatgatcatatcaaactaataagagatatgtgtcgtaaacttgagtcgacaatcatgcagctttttatcaacttcgggtggagattcaccaagagaattcaatagttgtggggtctttaccttgtttgatttttattagtttgcttttacttttgtttttgttactttagttatatactcattgggtgagttcatttttgtgtaaatcttataataattggctatagttcttgcgcaaatgccaggatgtcattccattattataaaaaaaaacaattaatccgagtccgacttgattccggagcccgatcgatcgatgtccgaactgtctcttctaatcgagacgttatatatatcatgctaatcctgcctgccacgacacccttcgtctacataagtgagcaagatagattagccagaagctaatcccactctaatcggtggcatgcatatatatcgattattgcatcactatatatatataggcgcctcaccgtccggagcgcgcaccgcggcgctgccggcgtcgtccgcccatgccgccgccgcccgccgcgtcgtgcggcctacacggccaccaccgccgccgccgcagaacttctccgtctccaccggcgtcgccactcgccgcgtcgtgccttcacggccaccacctccaccgcctcctcagaactgctccgtctccaccgccgtcgccgcccgccgcgtcgtgcct

SEQ ID NO: 21328 - DNA, 1501 bp, Oryza sativa
gccacgtaacggctgccaccaccggagagacataacaggaggagaggggtgtgaaagggtagtttagtggcatattgcataaatacatgaaaaaaataaagggtagtgaggggtgtgaaagggtagtttagtggcatattgcataaatacatgaaaaaaataaagggtagtgggtcttttgggatggagtggagcggtggactggcaaaaacctagctccacaatttagtgaagcaactctgcttattccgctaaaaaaaacgataaaaaaaaagaatctatactgtttggcataactccatgtcagtgttatggataaggcatacccaagttttgggttaagctcggtggggcctactatataccaggtcctatacgaaatcatgcctcgtatacgaaaggtgttctagataaggaagaagaagcagagttcaagttgaaaactacaaggactaagcggattgtatccatacttatcttcctagttatatttgggaaaggggatatctgtgggtataaatacaagaccccttagggagagacaaggacacgcacaatcataatagacacaatacatgccgccagacatcgacatcggagatgagaatcctagacataccccatttggtgccacagaggccgacaagaggaatctagcgttatctcttatctcaccgagttcatattcgagggagaatagtaccctgtcgtcgactacgtgtggtgttccatgccgctaagtcgataacgactagataggttatcccaaatattagacttgtgtgaatctgatgaataagagcaacaccggcttcggtcaacaggagtagggctattaccttacagataagaggcccggacctatataaaaatctatgtctcccgtctttttacctcaatctcgcgtatatcctggtacgaacgatctcccatactcgcaaataccgtagtcacgatctactccgtcgacactccagttctaggtaagttaaagttgggagctagagcagtgtcaaacgttctcgtatggctccactctttaattcgttctatatatccgcacatatacaggcacgtggatatagattagccccaatcgttttctctattcagcatcagctaataccaaaatttgaattttaaaacttaactttgaagttaactttgaagttaattttgaaggtttttcatcgaagtttatttttcagcattagcgcttaagtcgctaaaaatataaagttttatctataaattattattattttgccaatacgccgtatgacatattatccatgtttggccaagatggacttgtacataactacgtaccgaatcagtatcctctactttcaaagtcacattttatcactgacatatgagctgacaaatcctttatctacatatcaatgataaataaacggtaaggtcttaggtggtgtttacatccagggacttaactttagtccctgtctttagacactaatttagagtattaaatata

SEQ ID NO: 21329 - DNA, 1501 bp, Oryza sativa
ggattatcattttgccaaatttctttcgaaatctatacaattcgcgtttggattatatcctccatataatatatctcatatatttaggaattggtttgtgggtgttaataaaaagaccaatgaacttaatcttgttggagattccgctgtatgttgagctctctggcttactagaaataaaattatttttgatatatcaccttcaaaatcttatttggttcttttctgggcaatatattggctccgggaaagggctcaattataaaagcatgatgatcatatcaaactaataagagatatgtgtcgtaaacttgagtcgacaatcatgcagctttttatcaacttcgggtggagattcaccaagagaattcaatagttgtggggtctttaccttgtttgatttttattagtttgcttttacttttgtttttgttactttagttatatactcattgggtgagttcatttttgtgtaaatcttataataattggctatagttcttgcgcaaatgccaggatgtcattccattattataaaaaaaaacaattaatccgagtccgacttgattccggagcccgatcgatcgatgtccgaactgtctcttctaatcgagacgttatatatatcatgctaatcctgcctgccacgacacccttcgtctacataagtgagcaagatagattagccagaagctaatcccactctaatcggtggcatgcatatatatcgattattgcatcactatatatatataggcgcctcaccgtccggagcgcgcaccgcggcgctgccggcgtcgtccgcccatgccgccgccgcccgccgcgtcgtgcggcctacacggccaccaccgccgccgccgcagaacttctccgtctccaccggcgtcgccactcgccgcgtcgtgccttcacggccaccacctccaccgcctcctcagaactgctccgtctccaccgccgtcgccgcccgccgcgtcgtgcctacacggccaccaccaccacctccgccgccgccgccgccgccgcagatcaactactccgtctcgaccgccgccgccgccaggtcgagcgggcaccacgtgttccggatccgcgactactccctcctcgaggcgatcacccccaacggcaagagcatcaagtccacctcgttcgcggtgggcggccatagctggcacgtcgagtactaccccaacggctacgacgccgatcacaccgactacgtctccgtcttcctcgtcctcgaagacgacatcgccgccgccggcggcgcgggcgagccggtgaacgtgcagcttcgcttccgcttcgtcgacgcgtcgtccaaccccggtcggccgtggacgccgccgccgccgccgccgccgtctgaattagccgacatgcgtggcgagaaggtgcgcgacttcgacggacaagggaatggatggggcaccgtggcgttcaagaagaaggagaagctggagagggaagggctcatcgtggaggatgggctggc

SEQ ID NO: 21330 - DNA, 1501 bp, Oryza sativa
atgatatctaggcaagttaaggatttactattgtactattcaaaatctggatgacaacctggactctttgggggagctagagattatgtaagaaactgcagctgttaggaattccaacaaacgtagtcttgaactgtttgggggacttgaagattctgcggaaagttgcagctgctagaagctctcccaaataggccctctaactcccttcaaatataggtccgatctgattcatatttctcgatccccaaatattaaaactggtgcaaaataactttctcggtggttttcactgatgtggcttgttgacctagtccaaccggctaagtcagcatgtgggacccaaatatcatcctctctctcattcccttcttcctcctctctttctccccttatctctctcccctttctctttccaattcgggccttcctccctgctcggctcatcatgtttctcttctccacactggtggtggtgatggcaactggcaagtcacgaggggcgaggggggtagcggcggctggtgacgagcactccccctcccccgctctctctatctctctcccaacccagggcaggcatgtccctggggctttgcggccagcacgcctgcatagggcccccaattttcagggcctccttggcccaaaactccaacactatatatgtatatagatgtagcccaataagtaatttggtagcccaattagccctgaaaatctgttatttgtttcttcttttgtttacgttgttccgccttcgatcgcggcatcgcacagaaaacgaaatgacgcctcgcctctctctctctctccgttcacatcctgcacattgccgcggtgtcatcgctaagtcctgacgccatgtcgtcgtcgccgcctggaggatagaactgagaaactgacgcctgtcgcctgtgacccatcgtcggcgagcctacctgcctatgcctgcctactccctccgtcccaaaaaaaagacaaaccctggtttccgtgtccaacgtttgaccgtccgtcttatttgaaaaaattatgaaaaaattaaaaagataagtcacgcataaagtattaatcatgttttgtcatctaacaacaatgaaaatactaattataaaaaaatttcatataagacagacagtcaaacgttggcacgaaacccagggtttgcctttttttgggacggagggagtaagtccttgccggctgcagcgcctgacggcctgagtgccgacgcccctgtcccctatgcctagtcggctactggctggtcgcctactctaatcagcaatctggtaatgtaatccactaatccctattctctaattttagtgtatcatgtatagattattaggcttttaggttcatctactgtatacattaaatcaatttttttctttacatagttacatcctgtattttaattttgaagacatgtcttgaaaaatcggaataggaaatatgactccgactatgaaaagcgtaataagaaaaaaaagaa

SEQ ID NO: 21331 - DNA, 771 bp, Oryza sativa
  unsure (1)..(771): unsure at all n locations
ttgacagagcgtatattagagaaatcataatgaactgcacatatcgctgaaattaaatggaacattactctagtttcgtcaatgcgaccaagtgaggtgccatgtcagttttcaaaaatcattggcatctagtagctgatataaaaatattgaattgcaatatatacagaacaagaacaacaagaaaccacaactttgttaataggaaagcttgatacaataagtaaattaatacacaagcactggattgaggatctcataccttacaacaattaattagttacagagtggcaatatttgaccatatagacaggatgaaaaccctttgaaagttgacagctcgagttatggttgagatgcaatacaacagagttcagattgtgataacttctattctacttggtggatttccatgttctttaccttaatagagggcttaaggaaccctgtacatcttcatagttatttgcattccttgatttggcctctaaagactgaaaaagttagctgtatccaaattgaacaattttgtgaaaataaaaaaaataacgaaattaagataaagcatgaacctacctcctaaatatcaagccaatcctatctgaatgtgaatgtacaccatgcgatgagggatttgaataggtagcctaaaactgcattagcaaattacttaggtatcctagtttcctccttcctcacattntctcccttgttccctgattcctcctgttgctgcctgctcagactcccaactcagctccatcttgcagc

SEQ ID NO: 21332 - DNA, 262 bp, Oryza sativa
tcctgcagcccacccatgtcaatattatgcaaatgaaacatcctactgaaatagctattattcggttttaaatttttgaagaggactttactaaattgttctttcatctaggacagcgatgatatctgatcattctcaattgttcttgatcttcagacaagtgaaaaatcgtaggtcagttttgaaggacatatttcctcttgcaaaatacctattcctgtctagagggccaatccactatcctcagctcaggaaaacataa

SEQ ID NO: 21333 - DNA, 638 bp, Oryza sativa
tcctgcagcccacccatgtcaatattatgcaaatgaaacatcctactgaaatagctattattcggttttaaatttttgaagaggactttactaaattgttctttcatctaggacagcgatgatatctgatcattctcaattgttcttgatcttcagacaagtgaaaaatcgtaggtcagttttgaaggacatatttcctcttgcaaaatacctattcctgtctagagggccaatccactatcctcagctcaggaaaacataatggatgaagctgtcaattgttccactgagaaacaaacacaagataagataatagggaacattcatactgcattgatctctgctctgagttctgagcaagaggtaatccttatgaactttcttatttgatttatttctgagatgtgcttattaaatttttgcatggtggtattggtaatgttatattgactatcaggtcaatcttgacgcttcttgaattgaatcaatgcaaaaagaggatatttatttttgctctttgtatcatggagaattagtagacatttcatgttcagatattatagtcatatctttggaatggcaagacaaacctataccctttttaagtgctaagctatacataattatttttatgttac

SEQ ID NO: 21334 - DNA, 1501 bp, Oryza sativa
gccaactcctcccaccaccgccgccatacgtcgtcaaatgtggcgttgactttctaaagatcatctcatatggtttggttaaaggtggctctgagatctgcatatccatcgacggggttggtacttattgctttgacactgtgaaacacacttggattgaagtgggcaagtggatgctacccttccaaggcaagtttgagtatgtccacgagctcaagctctggtttggcttcactcccaacgatggccactttgctgttgctgacctctctgccatggacgagtacctgcaaccacagatacgccactgctggaacgaacttgatgagtcactcatccaaggatggaagcagatacgggaccctcagcttgtcaacctggggtctgccaagttctgcattgcaaggttctttcacactggtgactttggcgatggattgagtggccagaatgtttctgtcctgactggtgtagagtttacccatgccaatgttgaccatgagaatattggattgatcaagcacaaatcgagatgtcacaagtctagctgcggtgaggagaccatcacggcagttttctgattaatttaagggctgactccccatcctttgaataattttctgtctctctctttaagagaacttgtgtctcgtcctaattttactttagcataataaaaatgatacttcctccgtttcataatgtaagactttctagcattgtccacatttatatatatgctaatgaatctaagcacacatatatgtttagatttattgacatctatatgaatacaggtaatgctagaaagtcttacattatgaaacagaggttatgaaacagaggtagtaccttcgttgtccgcatgttgtaattgtctcctgcacttaagtaactgtaccatttactactactagtaactactataaacttactcttaatttatgtgttgtctactgcaatggtaaaattcgtttcaaatgctttcttggttttggttggagcggaaaccaagaaggaatggtaatcttgtgtgcttcctctgtcccaaaataagttaaccgtgcgggacttttccagaggaagagaggatgatacgtgatgcggtgtatattccttttctgaaaaaagtctaagttatactacggttaatttcaactttttcatattctatcttgatcttaaaaaatatatttggaaattatcgtgacctcagttttcatcttctttcatagactttgattttctaaagaaaattggtttcttaattctaaagatgccagtacgtcactgttcattttgtagttaactctggtacatgtttatgtgaaattttgattattcagcagttgaaaggaatggaggattgctttgtgatttataatcacctgtgctgctacttgtgctgcagtcaatagtctgatgggaaaaatggaattgaaccactgcaagtgcaagatatactgaaatcaaatcagtgggtaaagtctgacaagttatc

SEQ ID NO: 21335 - DNA, 215 bp, Oryza sativa
agctcgtcataagaacggtcgaagacaacaaactcataaatcagacggtatggtaacttattcacggcagcctcgaagagatcaatgcagtagccagtgacaccttggtcagttacattcacaaaagctctaaagccatgtttcagtggcacagcaatcttgagtttcttatgataaacttcaggcaaacatcctaagttcctcctcactccagc

SEQ ID NO: 21336 - DNA, 1501 bp, Oryza sativa
ctctatcttctctctccttcctcaccttcggctatcttcttgggtagccagcgagctcccttgtcttggctggttaggtggagatgtggcgcggcagggacccaggagcttgctgtcaccaaaggaggacaaggcgcacaagatgagggttttgtgctcgcggtggatgttgataaggaggagcgccattgtcaacagtgaggtcaagtgaaacgggtcgcggagccgcgaatgagcgccattgccagtagcaagcctcttttcctcaagtccacccttccctcctccacaccgccgcatccccgcttcatcgttgtgcctcggtccatggactctcctcgtcatcctccttaggacacttctgcagtcgacaatgtctgccgcaacccccaacctcacgtgacacggccatacttgggcaccatccggtcagcgagctcctccttcagagggctcagcgaggctcagtgctcgacgagtaggagctcgccgtttgtccaacaagatgccggaggtgagagagaagggggagagaagatagagaggaggtggagaaggaataagatgacgggacaaccttgttggcgtgctatatatgcaaaagtggcaaagaattaagaagttctctctcttcaatggcaaaaaaataaatgcaattctaagaggggcatttagataattgacaaacctaatagttgcaaatagttaaattcccccgttattaaagggagagttcaatgatggggtagggtacaggggaaacacatgaattcggaatttatgtaagggttaattggatccacgctattgcagatatgtcaattcagataaatggcattacaaatcgtatatacgtagtcatgccatttgaatttgcataaaattagatccatcatcgttcccactcagggatgacggagacgcgatgacccgggacgcaaggctggtggacctgcaagcagccaaggacacatagcttcgctgccgccacacccgactattatggcgactactctcggccagggagagaagggattttttttgcgacttacatgtggggcccatgctaactcaggtaggttgaccatgccacgtcagcgaaaccggccttatatgctactggaggacctaattcaacccggttttgcaagttgggaggtcaaagatattgcggttcggggatgcgatttaaactcgattaatagactaggaacgtcatgtggacttaatccaataggaaaaactttggttccaaacaggccgaaaaagacatctggcccaactagtaacggcccattatgtcacaagtgcaggtgtgcaacacctctccgtgctcccccctttcgtcttcgtcttcatatatccatccactcaacccaacccaagctggctggcaaaaccctagaactcgttccccccctttcgccttaaaccttcttctcttttagtaccctcgggaagccaaaagcacctcgtcggcggcggcggcgggtggtggcca

SEQ ID NO: 21337 - DNA, 1501 bp, Oryza sativa
gacaaggaaaccacttattgagaatccaataagccctcccacagatgcacagaatccgtttaagcttatcatgtcagcagcaagatgagggtgcactatactgttttcagcaacacaggcatctatagttacatcggctattgccacactagcacttccggccatcaatgccaacaacgcgaacaatacatgaagcttgctgtggagagataatacaagcatcgcgactactcccatgaagcctgcaattcctcagcaaacagggaggcataatcaataaaaataattccataacctgtaactgaataacagtcgcacttaatcaaaggaacattatgttgaggaaataacagtagaaaaaaacatatcatcagacttgtcagtactaaataagtcaccgggaacatgaaactatgccacgttcctcgtcccgggaacgccgttcccgttctgggaacacgggaataacctcgtttccccccatgttaaaacataaaaaatgtagcgtcccatgttccttgacccatcgatccgggaacttttatgacataggtactaatgctaccgtgctacggcaacagctgatatatttgagttagacagcaaggctgtttatagtaatgcacctacataactgcattgatccatccaaattaggtaatggacaaaatttgctccttcaacccttttatgtagttcaatgatccaaaatattaataactcaatggaaaactgttctatgaacttcggcctaaataattaacactcctcagctaaagcctagtaatgaaaagagatagtgtcccaaggagcatatcgaaactcgatacgcttccttgctacaatttcagcatctaatcatcagacatcactactctcaggtcctaaaatttcagtttgcgattcatgattaaccagtaactcgtttttttttaacaaaagatgattaaccagaagttttccattgcaatcatcatcagcagcagcaaaatgggaagcgtgaagtactgttaccacctgcgatgacgaagtaagggcggcggcggtagccggcgatggggaggacgtcggtgaggaggccccagagcggcttgaccatccacgggatggaggtcaccccctggtacacctgcgccgccgacggctgcacccgctgcacgtccttccagtagtagtccgacgccacccgcatgacgccgccgccgagcccctggctggcgccgtacgtcgccaccacgcccgccacgaagctccagtgcagctccctccccagcatcctgaaccaccccaccggcgaccacgcgccgccgccctccgccgcatcgacggcgaggaggacattggcctcctcttgcctgctgctgctcctcccccccttcccctcctcctcggcgcggaggtcgtcggcggcggcggtggccggcgacatcttcttgcgcaaagatctctcgcctggttttacccgaattgctccggcttgaatctggagctcggattccag

SEQ ID NO: 21338 - DNA, 1501 bp, Oryza sativa
ggaaatttttcaagaggttgggctcttgctaaatttcctccaaaatctacacacaacgagtcatttcataggattttaataggatttagaaagtttcaattctttaaatcaaagggccaaatagaaaaattttctataggatttaagtcctacgagattcctatataaattctttgattcgaagggactctaaaacatagtatgaactatcagtagaaactagttttcacttttcagaacttgatggtaagcctcccgtgaaaagaaatggaaaagatgaagtgcatgggggttcaaatctatgatgcaaggataggagccacagacccgaactaaatttgaaaatatattgtctatttattttttctcagaaatattcgggattcaattttttttgcacaaatataccgtcggtatcgctcaacggatatgcgaaaatgacgtgggcgtgacaacgctgacaatgtcgcacgacgacggcgcaaaaccactcgttctcgcgcagcgctggcgtgagaccgagcggtctcgcacaacaaaacagattatcatttcaaaatggcttaattagtgattaattagcctgattagcgaattaataaattattaatcaatcactatctattattaattaatcaataatcatgacaattaatcactaatcaatcaattctcaaaacggtttcgctgtttggccgtgcgagacctctagcattgtcacgtccacgtcattctcgcgcagtggttaagtgatatcgatagtatatttgtgctaaataatttgaatcccgaatatttctgagaaaaaacaaatgaacaatatatttcaaatttaattcccactaaccctacaactgagctaagaacgttcaaacaaatatggcttccagcatatttggaggcagcagaggtcggcgccaagccgccaactgtgttggcactgagatctcatgacgtaccgaaagttgccacctcggacacaatctcagcgtcaagaaagcttaagtgattcagacacgatgccactacatctaattcgtttcccgaaagttgccaccttggacaatacaccaatagattgaactaggagtgtttttcccttaccccaaaattcttcttctcaatgtatgtcaccgcgaactaaaagcgcacaacgcgaactcaactggagcttccgacggcagtagaatccagcaccagccagagctcacccaccacgcaagccgcacaattaggaatatctgattgaaaataagaatcaatttgcacaattaggaatatctgattgaaaataagaatcaatttgccacaatggcagtgtttggtttggttcataaataattctttcgtgtttggttcataaataattctttcgattttacatgcgtactggtctcctcctggagcagagtgtagacgcggctcaacacctgttgtgctcgtgacttcgtaacaaacgtagcctaaactgcagtttgttcagctcaatcacaacatttta

SEQ ID NO: 21339 - DNA, 1501 bp, Oryza sativa
cgggttgaattaggtcctccagtagcatataaggccggtttcgctgacgtggcatggtcaacctacctgagttagcatgggccccacatgtaagtcgcaaaaaaaatcccttctctccctggccgagagtagtcgccataatagtcgggtgtggcggcagcgaagctatgtgtccttggctgcttgcaggtccaccagccttgcgtcccgggtcatcgcgtctccgtcatccctgagtgggaacgatgatggatctaattttatgcaaattcaaatggcatgactacgtatatacgatttgtaatgccatttatctgaattgacatatctgcaatagcgtggatccaattaacccttacataaattccgaattcatgtgtttcccctgtaccctaccccatcattgaactctccctttaataacgggggaatttaactatttgcaactattaggtttgtcaattatctaaatgcccctcttagaattgcatttatttttttgccattgaagagagagaacttcttaattctttgccacttttgcatatatagcacgccaacaaggttgtcccgtcatcttattccttctccacctcctctctatcttctctcccccttctctctcacctccggcatcttgttggacaaacggcgagctcctactcgtcgagcactgagcctcgctgagccctctgaaggaggagctcgctgaccggatggtgcccaagtatggccgtgtcacgtgaggttgggggttgcggcagacattgtcgactgcagaagtgtcctaaggaggatgacgaggagagtccatggaccgaggcacaacgatgaagcggggatgcggcggtgtggaggagggaagggtggacttgaggaaaagaggcttgctactggcaatggcgctcattcgcggctccgcgacccgtttcacttgacctcactgttgacaatggcgctcctccttatcaacatccaccgcgagcacaaaaccctcatcttgtgcgccttgtcctcctttggtgacagcaagctcctgggtccctgccgcgccacatctccacctaaccagccaagacaagggagctcgctggctacccaagaagatagccgaaggtgaggaaggagagagaagatagagaggagggggagaaggaagaagatgacggggcggctttgttggcgtgccacgtatgtaaaagtggcaaaaaaaattaagaagttgtttctctctaagggcataaaattaagtgcaatttttagaggggcatttggataattgacaaacctaatagtggcaaatagttaaattccccttaataaccctctagggccagattctcaaattctcatcactcgaggggttaaaatgtaaaagagcgaaaaactcccgcgcgccaaatcgtgatggaaccctaaactccaccgctcccatctcgtctcgatcccctccatttcaaatccacactccgcctcccctctccggccgccgccggcgaga

SEQ ID NO: 21340 - DNA, 1501 bp, Oryza sativa
tcacttgattcaattatatatcgatataaggattatatatcgttgatatctacagccgatcgagtagatttagttctgatttgtttacttaacaattgccgatcgatttacacatgacatcggctcaaagataaatgatatgtcatcggcatctagccgatcggctatcatttatggatttaatcacggtttctttgtctttgtttcttgttgattgcaggatcaaatcaactggcacgctcatacatccgaaggcgagttttggacctgcactggagttaagcagatctcccaggcctcgtgttttctatcaacaactggtctgcttggattgggtcattcactaagctccattccagctgccaatatcaaagtggcttttacagagtcagaatggaaaaaactaagtttctgtgaagaaatgctactcgtcccatggctttgaagaaatgctactcgtcccatggcttactactgcggcaaccaccagtccctcaagcaagctctgcttctggtgctggccaacttcctactcctgcccaggcaatcttgtcatttgtgcaagctaacccatcagttactctagcaagcgctacttctaggcaaattcctacctctgctgcttaagcaacatcaccatccgtgcaagttatgccttctgcacgtccaacaatacctgctcatggccaatttgcaccctcaatttctcaaggaagcttttctactatgcaaaatctgccgaaaaatttccaataggctattatctatgcatagtcatgcttcagtccacttggttgagaaaggtactatcaacagactgatgcaactcactaatcaactggagagacgggcagtgcttcaatgtaaaaactcaactggagagacggtacccgcatatctgctgcgatgcattcatgaagcgtgaaacatgggaaaagcttggtctcgttgatcaatttgaaatccccaaggctctttacatctcatcttgtgacggtaatgtatacttcttcaacaacgtcggaggctttattgtggcaaatttaagccattggcaagagtctctgcttttatcttgtggtgcactgaaactagatgctatagcgtgatttcacttgatacatattatctagtcttatatcgcattatttcacttgatgtgagtgtactcaactagttgttgcttctgtactctaactactgttaaatatttctactagttatggactaatggtgtactctaacttctgttaaatatttctactagttatggactaatggtagataattcatgtgtgcacatttggtgctactgtgtttttattcactcttttcctattttaggaggatgtttcatgttcatttgctgtatcggggtaaataaataggatcatataagaggagttgtttgaataattagaacagaaattgacagagatcatagatcatatgagaggagttgtttgaatatgagagggagttgtttgaatctgaatagagg

SEQ ID NO: 21341 - DNA, 1501 bp, Oryza sativa
actgccgagcgaaccatccatgcagacttcacgatgccatacacagagtctggtgtgtcaatgcttgtactcatggagaatgactctaaatcaacaatcgaatgggtattcttgaagccactaacaagggagctttgggttgccactgtgatcttcttcttattcaccggcatagttatttggatgattgaacgtcccagaaatctggagtaccaaggatcaagctcaagacagttcagcactgctctctatttctctttctccactttgacattttctcatggttagtacttagagctccaaattgcaggctatatttgattcactataagtggcttaatttagtttcttgcagtagttcttaaataacctattgtctttgttacaggtcacattattaaaagtcctttgtcaaaaattgttgtggtaatctggtgcttcgtggtgctggttcttgtgcagagctacacagctagcttgtcatccatactaactgcgaagaagctccggccctcggagacagatcttgaacagatcctgtttgatggtgattatgttggataccaacggggatcctttgtggaatcctttttgataaaacaaggtttcagtaaaagaaggctaagaccctacacaaagaaacaagaatatgctgaagctttgaggaaggggtccatgaatggaggtgtgtctgctattgtcgatgagatcccatatttaacctcttttctttcggaccgtcgttacgagaaagaattccagatgcttagccgcatatataagacgcctggatttggttttgtaagcctctcactctcactctattgcttccatttttttagataatgaaaatggattacatcttcggcttccatggattatttgcattgagaatgagtttatttgcttctgtcataagacacagccataagtttgataaaaaaaaagtgaagataaaaataaatgagaatgagacataaagtgatggggcaaatccccaactcccatttattatttactagcgttattgactctattgcttccatggattcgctcttcagccttcaagagatatactacattctggacaaaatatgctggactaattggcattgtgcttttttgctttcaggcgtttcctcctggttttccattggtgcataatctttcaactgccatattggatgttacgggtggggatgaaggttcacggatcgaagcaaaatggtttggcacaacggctgcccctccaagctatgcaattcctaacacagattcgacacctcttacattgcagagtttctctggtcttttcatcatcactggatgtatctcagctctcatgctgatgataagcatttctaagtcagttcttgccaattacaccagaattagagattctgaagtgcgaagtcccgatgcggatggtggaaatggaggtcgcgaagaacgtaactcagcacaaaacgtcatgggtgatggctatgtggatgatcgacct

SEQ ID NO: 21342 - DNA, 1501 bp, Oryza sativa
ccagacctttcagaggccatcttgagcttaacggaagaacctgaaaggttgaagattgaaaagacatggttcatggattcgtccttggattattatggcagtcacagcaaaggctcatcacgtatcagttttcagagcttccaaggtcttttcatcattgtcgggtgccttttaggtgctgtgctgttgataaactttagcaagtttctatatgacaaatgcaaagagatgagaggcttcggttcagaccgtgtccatagtggcgagagagttgtttgttacggtgaagctcaaccacaaccaccgcagattgtcatggtcgatcgacgatcctgtgcctgctgataccctccagattaggactgaaaacaaataaagagtgtgaacagttatctgcaccaactatcccaactcccaaggcactagaatggctctgaagctagaaaaaagttcacttgttttggcctgcttgttgcatggccttgcttaactgtgtaagcctcttctgttggttttaattagtcaattgaaagctattctaaaactctagatttgcaataattgtaatgataattgtaatgtagcacaaacatgctgaacgatgttcagttgatgtttttcttttcttgggacaaaactcaattgtaagctattctaaaagaactctagattgacaatgattgtaatatagcacaaacacgacgaacgaagtttttcttgggcaagagtcaactgtaagctattctaaaactcacagctaatgtcagtgctactttgtaacgagaaactttgtatttaggctgtgtttagttcagcgcaaagtttggattttggttgaaattggagatgatgtgactgaaaagttgtatatgtatgacaggctgatgtaatggaaaaggactgaagtttgaatccaaactttggatctaaacacagccttaccttgacacaatgccactgaatcttgcaaactaaacttgtgcattcttttccgcgccattacatttctcctggttttctttggtctctgtggaactaaaaatttgtagcagctcggtcagtgactcatgtcaatgtaaaccgggagaactatacagatctctgtcatgtcagtagacctgaacattgaactagtagccaagtttctggaaggagaagaaatttaaaagggacacacgcggtttgatgctatacaagcctagtggaagtggaactcaattgactcaaaccatgcaggtcgtgcagtgcaactgtgcaagcttaattaattagatcccaatgatttggtcatatgatgcccgaataagccctaattaagcgcttgcagagaaaaacaagattgaatgatctacgacttgtatcgtgctcctatgactatatgagctatgaaccattctgtaccaacttgtgtgtcattatacccttggagtcaagtcaaatgattgactgttgctgatacagttctgaattctgatatctccatggaccatggaaaaaaaaa

SEQ ID NO: 21343 - DNA, 1501 bp, Oryza sativa
attaccggtcgaaccaccagcccccccttatatcgaatcatgctgtgtattgggtgggtggtgtggattcactcaatacacgggtggaactattcacacatgtataatatacacaggcagccaaacgaggcctaaatctttatttttttcttagttaatcttattcagcgatgctgctcgatatgaatgcatgctctcacttaacttcagagttagctagttagctgtaatggactagctagtgggtgtatatattactagtacatattgtcatactgacaagcagcttgctagtaggaaattaaaccgaatagaagctgtctcacaaacagccgcgatgaaaaagacaaatccttaccttggagattacccggaaacgttaattactcgatcagcctttgtttcaagagcttctggtagctagctagcttgttgcagaacctccaactctctcgtataaatagttcagagtctcacttaaattatagaatccagaaaatgcaataagttggaagaccctacttcttcagttcataaccagttggctacttgctacttatcagaatcttaatattctcaaacaagaccttgacacacttgtacaacgattaggtacagatgctacaatgttatttccatgtatgagcggcggtgtatgcgggttatttctctgtaagatcggtatagattcactcaatatgtgttgcattgttcggtcataatgaatgcatatagagagacaaagcactcatatgaaacaaaacaataaatatatataacataaacatattgttattcgatcctagcaggcttgatacggtatactattcaacatagagccattagacacggttaagtcaatagtcatcgatctctacatcgtgtctatcgggcaacaatcacatacattatattaaactataaaaagtacccgtcggttgcaacgggtaaatgctattttaattttattgttgttatatatacggtttagctaggataaaattcactatgggaacccacttggatattctttttagaaaatcataaagtctgtatttaatcttaagttagcatgcaagtttttttaaaaaaagaaaattcttatacgactcattttgtattttccaaaagcaaatgagcttaaaatctaacttaaacacggatctatatttctaaaagcgaacgaacttaaaaaccaactcaaacacgtatgacatgccaaaataccggtaaaaatatcttcaatttttataatagtagaggtagagaagagatatgcatatattcttttttgaaaccatattatatatgcatatagcagtatataagtactaccatcatgtaggagtatttgccaggcgtacagctagcagctagcgagtggcaccaaccagtgtagtagtgtacacagccactgccactgagatggagcctagaggcttatttggctccaggagggaagcagcctcctctgctgctacctgcagccgtcgtcgtagtc

SEQ ID NO: 21344 - DNA, 557 bp, Oryza sativa
actatgtaaatatatcaccacaattcattacattctgagctcaacaaacacaaacattcagtagcctttctgtctttcttttcccagctagatattgtacttatgccttcttaatcttgtgagagaaattatcccttcttaagtaatcttcacactatatatcgtatctctccagtattatattaattatactagtaacacggacaaacagtgacagatccaaggctccatccaaccaaaccaaagcagcatctctccctgacgacggccggactcgctgtcagcgtagacagtgccatgtctcccggaccaaccgtgtcacgtcaacgccaagtcaacatagtataagaccccgggaataactgaattttactaattgaataatcttgcaaggtgaaattgattagtctgctagtctcacgataatggggaacatcccagctaaggcctgtttggctgtttgtgtttcgatgtggaataggccccaaacccgtccttccgtggaatgcagcccacgcctggatcaattcccacatccagcccaaatatgcatttag

SEQ ID NO: 21345 - DNA, 1501 bp, Oryza sativa
ggctagacacagatttttgaagatacaaagcggagagtatctatctatgcaaatagtggagctagggtggtgttattctctaattaagatatagatttttttctcgattttcgttagcatgctttttaaactgctaaatgtgtttttcgtgcaaaaactttttatatagaagttgttttaaaatatcatataaacacatcttttaagtttgtaataattaaaaattatttaatcatacgttaatggttttctcgttttactagacctaactataattcatcttcaccaatttcaaacacatattcgcctctgccaacttcgcaaagtggctaatcaaaatgcagtgacagttcaatgtgcctccttgaaatgagggattggcaaagaaatattggagaaattatttttctatagaacctttgaaggatatgaagatttctataggattgtgctcatatggttaattatatatgaaaataaagaagatgttggatctattgtgaaacttttctctctttttttttttaatttagcgatgccgcaagagtagccttcttaccttctccactaatatcagtacataaatgcacttcttttctttattagtgaaagagatagtcttcctgctttcttattcgaatttttttctataatatatgtaatcaaagggctcctttctccgtttcatgtgctcttaatttctgcatggttgaaaaaacatgtactactttaattcatttttctttttcttacagcgcagtgcagtatgtgccaactatggataggatttgcttgcatgcaaggtagcagggataataatttacacatgcacatgtgtgtgcaagcagtaaccacagctcccaacgaaaataaaatccatggattcttgggtatcatgtgcacttagccaggcaccagctggctgattacactataattatcatttttcctgaaaaaaaaggacctggaaaacttaaataaatccctactgacataagttggcctattcatgcatggtcagtctgcagaaccttaaaactgttcttgcacggttatcatatccacaatctaatatgcccattggatatgctatttaacattcaacagaaatttcgaaaaaaaaaatatgtcaaattttttgaccatgtggatgctctttgagatgcgtacagacaggcaaagaccacaacaacactaggctaccgcacctttttttttaagtacaatgtaaatggagatttgctatatatatttaacatttgacagaaattttaggggaaaaaactgtcgactttttgggtgcggggatgtgctttgagatacgtacagacatgcaaagcccaccgcgacactaagctacgcacaacacctttttctaagtacaatgtaaattgcatgcaacatatacaatgtaaattgtattataatttcgtgcaagttgtaatataattacattataattataaactatagcatagttatatatttagcaaagtttttt

SEQ ID NO: 21346 - DNA, 1501 bp, Oryza sativa
aggctccgctagcggagaaagacaacgtgggtgggagaggtgatcctccaaatctattgtggtgtcgttattgttgagaaggtgggtgatggatctcaacttctagtagatgactcggaatcgccgcctatttatcgtgagttttattcacccatatatacgtagaagatgctttatagtaacgttggtttttttccatttttgcaactgagtcgtaatctagttgcatttatcagccaagctacactatttatggtgttatcttctgccaatttgaagacgttgaattgcttggagaagacggtgatgccaagctgtagttttcttcataaaataggtgtcaaatcagtttatacacgtagggcctatccagattatagccaaaataaaccttaccaaattctggcaatgccaaaattttagcaagttggcaatattgccaaatatctagtagaatttgttatgtatttactaaatttggaaaaaaaaaattaagcgtagataattttttttgataatttttataaaaaatggtataactaaaaatagcataaatctaaacagccccgtagtgattgaatcaatacaaacatgtagttttggacccttgttaactagatccatagctttgtgataacatttcaaaatatatgtttattttgaaaagaggtaatatcctttgggtatgactttgtgtctttttaatagtatatgttccattggagtatataatattttttgctagggaatggtatatgtttttttatcttgtagaagtatatactacttttttttctttcttgtagaaatacatactactttatctcgtagaagtatgtactacttaatttgtatgctcttcttcaggtatttactactttttctctagctgtatatacttaatccatcgtacatgattttttaagttttcagtatatactaaatcgatcggttaaagagtatgtactgatttttcaagtatccagtgtgtattaaatcgatcggttaaggattatatactgaattttcaagtatgcagtatatattaaatcgatcggttagggagtagtatgtactgtttttacaagtatatatccagtacactgaatcccttgttgaaccagtatatgctacttttcttacgggatctggtatgtagtacagccatcgttgatacagtagaatgtatatacaggaaacttaggcctctcacagtgcagcttaccatcattctatttcatacaggatgaagatctggatcaagttttttattcccacagtgcaaatagcctcacgagtgacttacttcttctttcaacccttgtaactttccatttcagccctcacgtgtttatcaatttacaaagaaatccaaattttatagtaaccaccctaaaatcgagagaagaatataaatctccacccatactactttacccaaatcccccaactactcctccctcacggtcacgccggctctctcccctcttctgtccgcagg

SEQ ID NO: 21347 - DNA, 275 bp, Oryza sativa
accttcttttgtgagaaatgcttgattcaattgttgatgagctgagaacggactagttggaatctgtatattagccgcatgatgtcttaaacgtccttcatggctgagtatctcaggattcactatcgtagaaagaaaactaaataactgcaaggatgaagactcacaatgacactccttttcgaaaaagaaagaaaactaaataactgcaaggacaatgattcacaactgaagaaattatactgggttattgaattcaatttcgtatacagaga

SEQ ID NO: 21348 - DNA, 1501 bp, Oryza sativa
tgatgaaaattccatctaaagatatcagaagaaatattcaactagatatgtacaatagaagcacacgactcatgccaataaacaagattctgaccaactaaagatcttctaaaagaagcattaagcagaacagaacccatgacagtggcaatagaaaacgatttccttcggacaatagcgtataaagatggatatttatccttgaaggccaagttgcctaaccatttatcttctcaaaatctaatttatttcccattgttgacaatccaagaatccatatttaagaaagtactttttacattcataggtccaaccaaaaatgggagttaccgtttcttgccaacttgggttatagactcattataaagatattttatcttcaataagtcttgccaaactcattcctcattaattagcttaatcaaccatttacttaaaagacatttattatgtatttccaaattatgtatcccaagaccccccgggtcattgggttggcaaacaatatcccacctagtcctagtgagtcaatactttttcttatgatcatcccttgccaaaagaaccacgatgtataataatcaatttttcgaagaacccctttcggtatctaaaaaaaatcataaacatggctaaactcaaaagtacagcattaatcaaaaccaatctaccaccaatagacatatgcttgcctttccaactattaaactttttttctcaattctttcttcaataactttccaatctttattagaaagcttcctaaaatgcattggaattcctagatatttaataggaaaagaacctatcagacagccaaagatattagaatattgatcataacattccttcgcctgaccaaaacaaaataatttactcttgtaaaaatttatttttaagctagataacttttcaaatacaggtaaagtcaatttcagattctttgcctgttgcaagtcatgctccaaaaagatgatggtatcatcagcatattgcaaaagacaaaccatcatcaacaagatgaccgtaactaatcgcatctacaaaaatcaaccatccattttcccataccgttccttaagaggagcgcaagcaaaaactattttcgcaggtatgcaaaaatgagtctattttcgcagccgggcatcttaaggagcattttcgcaagtgggcctcttaagtggtccgcatgcaaaaatacccctcttatacatagattttttttctcccctccactgtcctttccctctcaccaattcaaattttttttcaactcctatcccctctctctcttcctctcctcttattattctctcctctctctctctcattctctatcccctctctctctcttcctctcctcttattattctctcctctctctctctcattctctcccctagtctcctctctcactctctcctctcactctctctctctcttcatctccaagcatgagtggacgctgacgaggaggcgggtggcggtagggagcgaccgc

SEQ ID NO: 21349 - DNA, 1501 bp, Oryza sativa
tgtgagttcttttggacttgtaagaaggctcctctggtgccccctagtttgtgctctacggcttccagttcagcttgcaccgtattgtgtggattagtcccggattgcggttctatgattgctcaatttgacaagtcggagtccaagaggcttcggatcgtgctcaccctcaccacttggtcgcatccaaccttggcaggtttaaagctagttatttcggatcgtggttctgtgattgctcagtgtgacgggtcggaatccaggaggcttcagatcgttctcaccctcaccacttggtcgtatccgaccttggcaggtataaagctagttatcttcttgctgctcacagctagttaccctcttgtgtttcggtttacactggcactctctatcttgaacctactgccgtgaagatcaagccacccctcgcgagtgtgttcgcatcaagacccatgttattcaatacaagcgcacacactattgtatgaaagaatctatttcgtaactagtactacagatttggttttcccatgtggccaaaatcaatttttgcttgcggacggatagcctgcatgcatccaaacgtatgttaaagatgatttgtgcatgcggacggcgcaaccgcatgccaatgatctgattttcgcatgtgggcgcttaagccgaccgcatgcggaaacaaaaaaaatcacgaaaaaaataaaattccagaaaaaaagccccaccatggctcgagctcgccgcagccgccaccgatgttcctgtcgtcagtcgaatccatggctgacatatccaccatcccgcaaccttcggccactgggatagaagaagacgagggagagagagtgaggagaggcggtgaggtttgtggggttggaggccgagcccgtcgacaccggatctggacctcccgagggcggcgctacccgatccactgccctcgctgcccgccgtcgctgcctatcgtcaccacaactgcaaccggttccgagggcggcgccaccggatccgccgccagccatcgcggtcgctccctaccgccacccgcctcctcgtcagcgtccactcatgcttggagatgaagagagagagagagtgagaggagagagtgagagaggagactaggggagagaatgagagagagagaggagagaataataagaggagaggaagagagagagaggggatagagaatgagagagagagaggagagaataataagaggagaggaagagagagaggggataggagttgaaaaaaaatttgaattggtgagagggaaaggacagtggaggggagaaaaaaaatctatgtataagaggggtatttttgcatgcggaccacttaagaggcccacttgcgaaaatgctccttaagatgcccggctgcgaaaatagactcatttttgcatacctgcgaaaatagtttttgcttgcgctcctcttaaggaacggtatgggaaaatggatggttgatttttgtagatgcgattagttacggt

SEQ ID NO: 21350 - DNA, 1501 bp, Oryza sativa
gtgtgcgagagatgaggtggccaagtaatttcccacctcggccatctttctcttatgcagacgctcgatgtaatctttttcctcctgaggtgtcttattctttagtaccgcactatcctccgatatccgcacagtgtgggccgtctcgcaaaccatcgttggatttacgtaaccgattgaggcccccgttttttgagcgtctacccattgtgacctgaggaaatttggaagttagaataagtaacaattatattggcacacattgggtaataacgaagtacatgcaatgcttacaggcaccacgcgccgacgagattgatatccattttatccatcttaaggaatgcgtggaggtccttgaaactgaaggcgaagtttgcattaggtccatccttgaaagcgcctcccgggacatgcacagtaatcatcccgagacctaactcacttgccctcaagtaccactcatgcatcaacctcattggccatgggagttcacacatcaagttgaacggcaaaaacggcttgccatattcatactccttaggcacttcatcggaggtccaagattgcattttgtcagcaagacctacaacgctcttctgtgcgtccgaatactgatcaggtccaactggctttagcggaccccctcgacccttgaaagattgcaaaaccatccgtgtctcatactctgccattttctccttagtgtacgtggatactataacgggtatgagcttgcgggcttcacaggtttttggctgctcctttgatgtatctggctgtggaggtggcacatgttcgtcaaggggtgggacaagataggactgaggagcaggagacggctgccgaggtagggtagttggggagttaggtgctacttgttgtggaggtggagagggacctctaactggtgatatctgtgggagtggagatccgggtggggtagtgcagatcggaggggacggtggtgcaggaggtgcagccgtaattggcaccaatggagctggtgtcatcaacgtgaactgtccagtgaggatgatgtcacgacgatgccagagtatgaactggttaaccgcatccccgagaagttcaatcccctctggtgttgggatgtcaagctccaacgacatctggtcgccatgaacacgtgcgacctgaacccttgcatagtccaccagaattgagctattatggaactgtctccccgatatagccaatccagacgcaacctcctttgtttttcccgctctccctatcggaacgacaaggttgcacggtgtcggaccagttatactatctaccgggtaggttgtattttcaaccgactcgacagagcttgggatctgtgtcgactgcgaaccatgaggaaccaggtcagggaaggcttgaggatgttgtgcggcaagactgtagaactgttgggtgacttgttgtgtgacttgatctgtgatttcctggcgcatcttggccttgtaggcgtcgcgcttcttgtaactttggg

SEQ ID NO: 21351 - DNA, 1076 bp, Oryza sativa
gcccactgtaggcgaccgcttgcgatggtcggggggcatataagcccccagcccgaccgaccgttgctaagaatttctagcggtttctctctcctaaacatccacaaattagtggggaaggttttcgacctcaaatctttgattgggttccatataaaaggtgtagagctcgttctcctccttcatttgcttccatttttttcagttttcatcggtggaatacgaagaaacttgcacttttataaatggagaatagtgtaggcacctttttgtttttttattttttaagcaaatacatattgcaatcttttacatgtttataaaagtaattagcacctaagtttaaacgttgggtttgcctctattaatttattttcattcggatgaaaaaggacgaatatttttattttttagaaatggatagacagtattctattaatgcttaaaattgatgtgcggttgtttaaatagtctgttcaactttaaattactacgtgattagttccctccaatttaaatacgttcgtgtttgaatcggtcatggatgtattaatggcaagctttattataggtcatggatcggacatggatgtacaacacgaaaagagctcatccaacgttcttgaaggaagcagccaaatttgttgagctcgcaaaggcacatgctgcgagcgagaatttgaggagcattttttgcccatgcaaagtttgtaagaacgagatcttgctgcaagatctgaatgaagtattgtcgcacatcgtagaacgaggatttaagaagggatacaagatatggacttttcatggggaagccggtggtcgtaacgaagagttagatgatttctgttttgatgatgcagaaaattttataatcgaagacatgtctcagtgaaacatccgggaatacggtggctcaggtatagagaatgaaggtattgatttcgatctggaagatatgttgcggcacgttgaaccagagatcctaactggtacaagacgagggttggacaattgggaagcgttggaaaaagcagcgaaggagcttttgtatgacgaagccaaaggatgcgacaagg

SEQ ID NO: 21352 - DNA, 1501 bp, Oryza sativa
aattatattatagtttaatatataatttgtttttcatttattttaatatttggtagtatgcatgtctcctctcgttatgagtatataagaatatttcgaatgaatgaaaacgaacaaaagcactgcatgataaataacagaaacttagcacatcgcggcccaaacgaaaatgagaaactttatgagcttggcattccgatatagtgccagtgacctcttggtttcatttcagttgtgtcctttctaaagtctgtgatggacacgatactgccctcagtttccatcaattcccattgtatgcattcggcctcttgcacatcttgtcacattcttccagaacaattgtttaaaatgataagcatacattttaatttaaagaaggttaaagatattcttgattcgatatacatgctccgatattcgtttcaaaaaaaaaatcgtttcaaaaaaagatatacatgctccgatatttctttcaaaataggtttggcaaagcatagaactaaatatacattttttaaaaaattaaaatgttcaaacttacacctcttcactttggtgtctgtgtagtctgtaactctgtatgaataataagtcaacttaagattttacggaagcacttaatttgttaggaggattgcttcaacggcaaaaatgaagctactagatccatccaatagctttgctggaagatatcttttgcacaaacctcgttgagatcttcaccagaaattatgaaatcatgatatgttcagttgattaccatataatagtaattaacttaattctatagggatacaaatgggacccggatccattgtctttaggcgctaaaggcagagatgctgtctagcactacaaaagaaaacagtgatttgtatttattcactgtagcaacagcgtagagcaggaaactgaactgtaccatgctactgtttattttgtacatcgatcttgctggttcactccaaagtcatggtactaatacacatctgatttcaccttgcgatatatatatttgtctgttcactgttcagagacgctgcgacaaagaatctttgctctaataagatactcactctgtcccatataaaatcaaaccctagcatctcaatgtaaaattaggagagagggaaaatgaccaaaatacctcttattattaaaaaaatagtaatgatgataggatgataaagggtattggagaaattaaatttctcattttacgtgctgatagtagataggatggtagaagttggtttttcgtgggataaaattcaaactccagaggttgattttttttttttttgggacggagtgaatagaaatttactgatggcaaagccaatttggtgaaagactgttacatatataggagaaccaatttgacagtacgtgatcaataatcactttagtgttgaccagttctaattaattatctgagacatggttttcatctttcttctcacatatcaaactatgcaggtatgcagttccaatgagc

SEQ ID NO: 21353 - DNA, 526 bp, Oryza sativa
tctattcaaatactgcatttattttcgaatgtcattgggtggaattaacctattgtttgttatagccctttttgatcttgattactttattccttgataccttgggttattataacttgactagttgagctctatatattggttcagctagatattaggtgtgattgcttagccatgcttagaaacattagcacactattgggataacttatgattcactattaattaattaatgatggcttaatgatagttcacgatggtcaatcgtgattggttaattaattaatgtgccaactaaaacctgataatggtgggttgtgagcacatggttttgagagtcgtgctcatgacaattaaggaccggttcacgagtttcggttgtgaaacattaaccgtgccaaccacaagccagcatgggcaacggctttatcttttgtacagcatggttcattgcggggcaccagactgagaagtggtggagataagcccacgggggtcgctggggagtccatgccttgtttataag

SEQ ID NO: 21354 - DNA, 1501 bp, Oryza sativa
ctcccccccttctcaacccccttttctgccgaattcccgatccttcagtttggggttggcgtgcgcaagaaaatagccacggaatctgggtgaattttggctgctcttgtggtgcgtgctgagccctagctagggttaggggaaagccgcagaatcatttgatctggtaccctgtgtaggtagctaaatctatagcttagacgagggagttgagcggttttgagctaagcttaccttttacttgattgccttcgaggcttagcggagtccaggagatgattagaccgagagggctactcatagaaacaatctaacaagtagaagcatattcgttcttatatagaagatttgtctagtgctagctgcagcggggactgctgcaaattcatgtggacacaaagtggcagctgaagggtggccatggagctggtggcagggaattcgtcttatgcaataggggtggataatatttcattttgatccgtgctctctgtccgcttttaagcttggattgtaatgtccagctgatctagttctatattaattggtggttttacttttcttgtcattaccttaaccaacccttgaaggcagggtcctagaaaaaaaaaattcagtatgactcagctttttggtcatctgtgtatgatgccatgggtcttacccatgttcctctagagaaagtgatgtgtgcctttttggaaaaatgatacagtatgtagtttgggaggagggggttttgatgggaaagtactacagtctttatttgggcatgcttcttagcaagtgcatgtaagtcatacatgggaatgtcaagagaatttttcttgaaaccaggcacgggtgggcattgatctaacatggtacacttgcttttcctagcattgttgaacattgactcattttgatttaggatcagcttacttatagcttagaagcaagcttggaaatcagtttgtgcattgccaaagcggaatcacgtttcatttgaagttggctaatttcaattttggaaaagaaaaaagttggagtagttttgaactgaggcaatgagcacaatgaaagaattttttaccacagtagacagtacttgataagtgatagcgccagcataatcaattgctgaaactctttaaccatgccttagtacttggctttacattttttgaatgaagatatatatgtgtttccatgcataaaagcattgttgatagtcttgtgggcatgtatcttataggttgggtcattagggtttgcttattgttataactttctgtcattgatttcagatttttaatggaagaggtgtttaggctgtcttgtaaccagtcctctgttggcccagcctatcaatgtgaaaactgataaacctaagtttaacttaggatgaattgatcataattatatgctccattttttcaatttcattgaaaagacatgtgattgaatacatttcatatttattaacacaaacaataacttttacttttctcttggcaca

SEQ ID NO: 21355 - DNA, 393 bp, Oryza sativa
ctcctcccctcacgcaaaacaaagctcgtattattgcatgattaattaagtattaactatttttttaaaaaaatgaattaatatgattttttaaaacaactttcaaaagtttttacataaatcacaccgtttagcagtttgaaaagcatgcgtgtgcaaaacgagagagatgggttgagaaaatagggggagagggaacacaacctaagcatatatttagttattttagttattcagtccaagtagtgctcttatgatattctttattatcgaacaagtacattactttgagatttagcgagaaagccaacagtaaaaacgggagataactcgttggagcgtggtgtaatagtataaatgtggggtctaaatgttagtggtagaggtgagata

SEQ ID NO: 21356 - DNA, 1501 bp, Oryza sativa
ttccacacgttggttggctagccttgttcctccatcagcttcatctccacttctaaaaagtgttgatttcacaataagaaaaagaaaatccagttcaagctctggtttaatttgcttatgaacggccaaggcaacccacgagcaatggcaatattatattggcgatatacaacaaaatgattattattgttttgtatgattcatacagtccaaattatcacccatctatccgtaattactatatttgatctactggttgatcgatgacatcttgtatgtgatattggtatgcataatgtacgtagttgtagaattataatgcacaatcaaacatcataaatattagttgcaaaattacaatatatgatcaaacatattgtaaatcttacttaaaagtgactaattcaatagaaaataaattgagggatcatgcgtgatagaaagattatgcgataatttaaaccatcaaagtatcattaaaaaatatagtggcttggtatcctcttagtgtagtagttgtgctgacgagccaaatgtaacactgcaacaaaaacctcatatagaggtacttttgtagaggagttttgcaaattgtttctaagatcaaaagttttatagtgtagagacactttatagaggcactttaaaaattgcctagaaaacttttactctagagacattttcagctcagtttattagattttatcttgtaaaggcattcttttggcactgtaaaatgcgcctgatatgtaaaggcattttcttgagacattttaaactatgtagagacattttaaactatgtagagacattttttagaatgataatgtgtactaaaggactaaatataagtaactaaagacacaaacaaccaagtaataacatggagttgagttggctagtgcattgaagacaaaaatggtttgtccaagagatcttaagtttcaaggcttgataaaagcaaggaaactattttattctccttttttgcctggtttcatatgtttgtggtacaatttaatgtctctagaaaatgcctctaccatcttatagacattttataaaatgcttctaccatcttatagacattttataaaatgactcttcgtttgtagagacaattcaccataagacacttattagacattttttaaaatgtctctatagtattgtaaaggcatttgaaaagtgcctctataatactagaaaaatatctctacaaagcatttttcttagtgtaacctggtattctgcctcggtgttactacttcgattcatgcgtttatcctattcatgtgattttcctatcctgcgaagcaaaggggccctaaatctttctctcttgcacaatcctatatgccttctaggaactttttgcaaccttcaaaatattttttctcgtaatctatttatttgatctagaatctaattgcatcttggaaaaagtacgaattacccctcccgaactatcgcggtcatccgaattaccccttgaaccaca

SEQ ID NO: 21357 - DNA, 1501 bp, Oryza sativa
aaagttgtcaccgctctaccgagccaccaaagcttatctcaccggaggaccaccgctactacatcgtcatcattgcaaaccacagcaaccgccaagcagccatagcttatcttgccgaagagtcgttgccacaacggcattgtctctgcaagacatgacctccgccgagctgccatcaaagcctattttgtcagggatccgccgcctccacgccatcgacactggcctaacaccacctcccccacccctctcggtgccgctattgcgctcaacattgctcatagcacgccaccgagccgagcaatcaacatccgccacccactgagccaccaccagacacacataactatatccctgactgaatcacaatcgatgaatcgagcaagaggcatgctcaattctgaaggtctgattagttcaacacaaatcagtttgtatttgattacattgctacgtgattcgaaagcgttacatatgtttttttttcgtgggctggtcggcggtatttgaacatggagtttttgaaagatgacaagtgattttaaatgaaagacattgctggtgattgctggacctaaattatcaaggtcctgtcactggtggagaaaccatctttcgtcggtcggccgatttccacaatagtcccggatgcaataaaaaccagggctaaagatgatctttagtcctggttcaaaagggaaacgggcatatttgatctttagtcccggtttgtgttaccaaccgggactaaagatcatctttagtcccggttcgaatgctgtcaggacctatcagacccccccgggatctttagtcccggttggtatcccggtgatctttagccccggttggtgttaccaaccgggactaaagatcttaataccaaccgggactaatgatcccggtgatctttagccccggttggtgctaccaaccgggactaaagtcccacccctatatatatgtcttcttcctcctccagctgcccgagcaagcttcaaaattacttcaaaaaagaggggaggtcatgccaaaatttctattgaatttattttggtgattacatacaaatcggaggtgcctaaaaggtttgcaacttcatcctccaatgtttttttttgtcatactacatttgcacctatattttgcacacttttttttgtctccaaaatttagttgtaagttgatgagagagaaaatgtgtgtggggaagaaagaatatatagaaatttagttcatttgctaaacaaggttttataaaatagttgagaaggaaaactctagtgaaagttaatcttaaataatagaaaacaaactaaaatgaaaattaaaagaagtaaaacacattaaaattagtttaaaactttacaaatagtttttaagaattatttggtgtaatattttatgatttttgtatgaataaagatatcttataattattgtatgactctcattattgtaagaataattatttgtgtgcggtttttttgactcatgtaga

SEQ ID NO: 21358 - DNA, 1501 bp, Oryza sativa
tagatagaaactgcaatttgccggtattctggagtcatattcttcatcagattgcaaaagaataattaagaaacgcgagacaaaggaatatgtgtcgaatgcatcttaggtagttcctagtggaatccgtttcctatcgaatttctggcctaggttaaaatggagacttattagctttgagcgtgcctggaatcaatagggaaaatatataaggttgggtgtggcatattcttggtggtttttcctatgtttgcttctgaacaatgggtgttttgacagggaaagtaatttcctccccactattatgagagttttgcactttggtaacatatgagcaaattgtccagcaatgcttaaattgtgttggtttcataaatgaacatattgccacagcatcagtctgtacaatttcacccctcccacttcatgttcataaaaaacaatcattcaattgttttgttctatgaattcaatgtcatgttagcaatctgatattggtttccttagccacttatcgtgccccacttttttttttatcaaacaccgtatttgcaattagtagttcataaattaaaatagagaaagtcctgtccaccatctctcaataatataggtcggacgaatgataccaatgtggccaatattttagagctttgacaactaatatctggagagatgcaccaaattgggatcatggaaataaagctcttgactttatcacaaagcaagccttcatgcataatacaattttaattgttttcacatttaatctaatttactacttcaaggatgtattttcgaccatagaataaatttactatttcacgagaactcgttttcagtcatggataagaggttatcaacattactccctatgtttcatattataaatcatcttgtttatcctatgttcttagcgtattaatttcattaaatcgaccattgaatagtactgttatagtatatttgttttgtaataaatattgctaatttttttataaagtttgacttaaagaaatactccaaataatttataatacgaaacggagagaatactgatcgcctggtttttgtgcaactaatatgtgtaaggtatcagagaatagtatccggatatgtttcagtatattttttccgtcaacggttggatggatgaataacatttgaagtagtatcatgcaacaaaaaatgccttaaaaactgaatcgcattacctctttgcttaagctgagacaaaaaggaaattccatgcttttggaatcctactcacatgggttcccaacaaattaccactagcacacacaaatccaaaactctcccctatataaagggcactcgccaacctcacattcgccattgccaacctcctcctcccttccccccaattcgatcgatcgctcgcttcgcagcagcagcagcagagctggctagcgacaaggtacacgcgaacggcgacgccgccgatgccggcggcggcggcgaggaggaggtggtggtgagc

SEQ ID NO: 21359 - DNA, 1501 bp, Oryza sativa
aaaattctccagtcaattataattagcatatgaatgatagtaaattaaatgttaaaaactctaattaatatatgaaattgccacttgcgtgatttaaaacttttaaaaatcctctagtcaattataattagcatatgaatgctagtaaattaaatgttaaaaactctaattaacatacatatgaaattgccacctgtgtgatttaaaacttttaaaaattgtaagtatcacatataactagcatatacatgatttaaacttgttgaaacctctaataatcgtgcgtaattaatatatgccatacatcaattgatttatatggataatcaatacatccaaaatagtttacatcgtgtacacaataattacggcacgtactttctcctcactattgttccctccttgtgatcgctgcgtgagtaaggggtgtcttcatttgataggaggatgctagggtcaatcgtcaccgtgaaagggggttgcccatccaactgatcgtaatcctcgtcagtcttgtcctcaactccgacgatttttcttttgcctgggagaaccacttgacgcttaggctcatcaggccctctgcccttctttcctttgctagacatgtccttcacgaaaaagacttgcgttacatcattggcaaggacaaaaggttcgtccgagtatccaaccttgttaaggtcaacagttgtcatcccactgtcatcaatcattacgcctccaccagtcaacctaacccattggcaccggaacagaggaaccttgagaggaccatagtcaagttcccatatgtcctcgatagcaccgtaatacgtggcagttgttccatcgtgtcccatggcatcgacacgaacaacgctgttttaggtttgtgaacttcttctccttcgtgcttattattcgcttgatattcgtggagtatccagacggtacctttatgctctccaagcattcaaacatactttccttctctgccttgctaagagtgtagctggctggactcaagtaatggcttcctttctcctttggttccgggtgaaggtcgccgcgttgttccatatgcttcagatcattacgtgcttccagtgtatctttcgactttccgtatacacctaggaagccaagaaggtttacgcaaaggttcttagtgaggtgcatcacgtcgattgcgtggcgtacgtccaagaattcccaatatggtaactcccaaaatatagagttctttttccacatcgccgcgtgaccatcttcgctctctatatgctggcttccaggcccctttccgaacactactttaagatctttaaccatagcaaacactgttttcccgctgcgatgtttaggcttcgtacggtggtcggccttatgttcgaagtgcttgcctttcttccgtaccgggtggtttgctgcaaggaatcgacgatgacccatgtatacaaccttcctacagtgcttaagatacgtactttctgtttcatccatacagtgagtgcaagcc

SEQ ID NO: 21360 - DNA, 416 bp, Oryza sativa
ctgcctatctggcgccgtcctcctgccaccgtggcacacgcgaaccgatgtggcaggaggagggcgccagcatggctggcgccgccgcctccattcctgtttccctatatggagttgcaacggtgtcatttttattttattttttcggatgttttttcacactcaggatcacgatacaaccaaccacaaaaaaaaattaaactcaaactaccacttagctaagtctgaaaatatctagcataccacttagtctactttgcaccttcaataaaattagaccgtaactcttttagtaaaaccctttgatcagcatgttaaacataatgcactctaccactgtatgaaattaattaatctaattcaaaatataaccacataaaatgacatattaaaacctccaaattccgcttgcaaga

SEQ ID NO: 21361 - DNA, 1501 bp, Oryza sativa
tgtgttgtattttacaaattcatgaatctggtccaaatttaaggaccgcccggctaccatgtattttactcaaaggtaatatattaacaatttcaagtgtacaaaatagattcaaatttaagaacatggtgttcgtatctaaaataactttgggatgaaatttgaacacatggtagctagcacaactttattcaataaaataaatatgaaactaacctcattttcttcccatttatctctttttagcatgctccttgctagtaagatcacctcttaccggtgttctctttaattttacgcatccttgtgtgcctatctacaaagatgtggacgtgctcaatgaactccacatgtttctcaagaattaaaccggtctttagcagcaattaattaaactacttttatgttgtccccacgagaaactgatgcatgttttagttcagaactgcaccttgactaatgtattccccccgtctctaaatatttgatgccgttgacttttttaaacatgtttgaccattcatattattaaaaaacttttgtgaaatatgtaaaactatatgtatacataaaagcatatttaacaatgaatcaaatgataggaaatgaattaataattacttaaattttttgaataagacgaaaggtcaaacatatttaaaaaaattaacggcatcaaatatatttaaggatggacggagcataaattcacgtatcatacaacaaaataatgtatgcataaagtgtcccattcatttccttgataaccatgtggatgcaaaactattgctcttgaaaggactaggtgagtcagatgtgtgggctggcccacgtgctgagcatgacggcccacgtgaaagcccatccagcaacacacaagccagctgaaaaaggcctagaagggcagcctacactaccgactactccgtccgtttcatattgtaaattattttggttttatctgactatgtttatagaaaaatataacaatatttataacactaaattagttttattaaatatataattaaatatatttttatagtgtgttcttttttttttgctggaaatgctatatatgaaagagtacttaccagatgtagtggatgtttgccatttgggctgaatggctgctacatcattatcatccatcatgtatgtatgtctttatttgaggtcttgttcagttaaaccgggattgaggtagatttgaaatgaagttattccacacctatcctctcttaattctatccaatcgcttttatattgggattaatagaacaaagcccggaaagagatctttgacttgttgattaactcttgggtttcctccagaagcaaattaattaacgcccagccagaagcagcctagaaccgacaaggacacatgacgttccaagcaaagaggagttcagccttcaggtggatcatttcattgaccattaaattaattacttattatgattgctcacggcaaatataatcagcctgtagatagctt

SEQ ID NO: 21362 - DNA, 1501 bp, Oryza sativa
tcggaagagctgaaagtctggtcgttgattccactaggcccaacaagtcttggatagcctgcccggcccatcgctgtaagacccaataaaggaataggtccactttaagtccctcgtcgtcccatctagtttaggcagggaatcacatcacttcaggttccccatgctgcaagcaatttactgacttgtaaacgatatgcagatgtggattcctccatcctctgatataaagtgcaacaaatgatgcttacatcaaaacatggggagaaagatctacaacatatggtatgcatgcagttttacatccctgaaaacaaacagtagtagctggcaggccgacctagctcccaattacttgatcagtgagtgagaccagaaggtaggaattacaatcatatttcttcttggattccaattactaatttatatctcaatttatcatgctcagtgaaaaaaacctacatgatcaatcagtggagaaaaagtacagccatgtttgatgtatctacatctctgactaggtttcaatgagaaccagctgaagccattgtccaggtaattaacaaagtgcaactgcacactaacaacagcagtgcactcttgtttctttttttatttttattttttgttttgagaactaacactaactccacgacatgtgacaatctggtcaagtgatgtggcactagtatgtattattaaccgggaaggagtaagtaattaaacctgctacaatcaaagcactaacccctctgacctctgtccccaagctgactgaataagagcagtccacccgaatcactgaattttcagcaatttaatgtcatactctagaagaaggttcatcctggcatgtgtccttttctccatgacaacacatgcgctctctttgatttggatactaacaaggatttcgggctgctttacggacagattttcgtctagatccaaccacgttttccaggcaagtttaacaatcatccttcactttcgatgacgctttattaggttcaacatgttaaacaagttataagcttcataaagtgaaggatcatctattagtactttcttcagcgacgcttacatggttttttttttaagaacttaggtcgaattatctaaaaaaaaaaagaacttcggtcgaaatccataacatctggttaaatttaggtttgttcagtctaatcagcatagtttagagcaagtttaatagtatagcccactgctagctccaaatcatttataaccaatctaatagtcaattcatataataattgcttactatactattaatatatggtcccacctgtcatacacacaatgcgtcttggagtccgtgctacagttggctacagatatgtagcccgctacttttctctctcatctttatcttattaaaatatgtttatagctggctaatagcctgctattgtacctgctcttagcacgttgaccttggtaagcgcaaaaccttgcctcttaaattatgggggctgctata

SEQ ID NO: 21363 - DNA, 275 bp, Oryza sativa
cttgagaggggtatcgaaccgaccaccgctaaatggccggatcgatcgaaattctggtactatgctcacggtggaacgcttaacccagttgatggctccctagtcttcagcgatcagaggctgccagtcgactaacggatgcagtggaagcctcttctcagggcacgttccgacctgacagtgagaaggacgagctatcactcgccctgcagactcccgatcatctaggacgaacacgagggaaaggggtgatccttggaagattggattcaagg

SEQ ID NO: 21364 - DNA, 1443 bp, Oryza sativa
caatactcaaatagtaatatgctcatgtcgcacggccgcagggcagtacaggtggcgactaggcgagcactgtccccacccctttcccctcctcccctctaccccgccactgagcggccaccggaggggctcttttcctcctctcatggtcatgtcggcctaaggctctgccactattgaagaaataatctttgctgggtcgactaattttcacaatagtctcggttctaataagaaccgggaataaagattgtttttagtctcggataaaaaatttgtcagaggcttgtcaggggccgagaatctttagtcctggttaataactaccaaccgggactaaagatcaccacttttttcctggttgatagtaccaacccgaagtaaagattatttagatctttaatcccgattggtaacaccaactgggagtaaatatttctctcccatatctgatcggttaagtatcagacaagactttcctcctcaccgagatatttagataagatcggatcattcccctctcctcctacccctcaggtccccttactcctcctcctcctcctccccttcctccccttcatcctcctcccctcccctctcctccccctcctcccctcccatccggcagccgacggggtcgcgcgcggtggcaggcagtggggcaacacccggcggggccgtgcacggggccgcaggcggcaggcgctggccgtggcaagcggtggccgtggcgggtggcaacgcgccagcctttctttttttttgataatttatgattcaccgagatgtataatctctttgtttagaatttgtgatttattgcatggatctgagatgtataatctgtgatgtatttgatttttgtgtaattttttaggatttgtgatgtatttgatttgtgtgtaaaagtaacttaggatttgtgatgtgaattatttaggatgttacaatgatttgaggatttggggtttgatttggggatatacatgacactcgatttgggagaaaatacagggattaactctggcaagtagcaaagaaacaatcaaaaaaaaaagaaaagtggaccaaccggaactgccgctaccctctcgttattcccggttggtaacatcaactgggactaaagatacaactttactcccgattatttcacccggaactaaagatgggcatctttagtcccagattcgtagccccggttggaaaaccgggactacaggggttcccaaccgggattacaaacggtttctccagtggtggctaagaccgaaggaagacctttaagtttcagtcatcggtggctagatttggcatcattggggctagacctagtcccctcactgccagatcgttctggtgccccagccgacaagtttaagcggcggtgaggaggagagtagaaaccagggctgcactgcgataaggggtggcgtggcaaca

SEQ ID NO: 21365 - DNA, 268 bp, Oryza sativa
gcggcgcgcttggtgaggatgacgcgggggtcgccgccgtgggggtcctcgaagaggcagaccagcacggtggcgtagcccttgggggcggcaaggtaggccggccgggcggcggcggcgggggcgcccaccgaggaggagagctcgccggagctgaggaggaggtggcgtgtgaggtgggcaagccgccgggacggtggtgacgcggaggaggagaaacccatggcaatgtaagtcggggcgaagaggcgggcgaggagaggcctca

SEQ ID NO: 21366 - DNA, 1144 bp, Oryza sativa
acattgcctgtgtgggatggaagtgaaacaatggtcgatacaaagaggatcggtagttagtcgatctagtgtaaatcatactgaattgcaggaagtggcagtatgctgtgctgccagagcagcagctatatagtgcatgttgcaggtcaaattctgttatagtattgagttgatatgagatatttgtaatattttagcttttgagccccagtcttaatatgctgaatggtttatgtgtactgcatctgcatgcctcagattgttcagagaaacagaaagtgtgaagcattagcgaatgagtcaatcacagaagtcatgtgattttttttaccttgttcttagcatgtgttagatagtgctaataaaagtagaaaccaatatgatgatcgatggattttgattcattcagagacaataattcaataaagagataatgaaaatatgcttgctagttcatttgatctctgtttgccattttatcgcttgtttgtgtattgctgatatgccaatgccatatcacatttctagtcccaaggcgttatataactgacttgtgagaatataagtttacgtgcatggccaactgcgaatgtcttggttttcaactaataacaaccaaaagttcttgcatactttggtgcttcatctggttattgctgttttcttgacaaataatactctaaataactactcaaacacatgtgtccatccaagttcatctaaattaccttttttagtcacctgagcttggtacaacttgtcatctcttccccaagaacaggtgctctttcactctagtaaagtcaggccacttacctgtttcttacactaaattattatggttgctatctgatataagctgtgtgagtttttggaaccctgcctttgtgcatcaaatttccctttgtaatatcaagtaatctataactgtagtcccatgctcagaccccaccgttttctgtccttagaggagagatttccaattaacatctcactcttatattaaaatactgataaaactatttgctctatatggctttaattgagtaattattgatttccaagataacacattctttgacacattcaatagaaatgcaaactatccagaactcatagtacagtcattttgtagaacggactc

SEQ ID NO: 21367 - DNA, 1501 bp, Oryza sativa
tatttggacaaaaaaatttgaatatttaatatttaatctcgtatctgctagataataaaaaataaataataaccctttcatccaggctcaaacacaccacctgcaggttgtaaagtctagacactaaccaactcattaccatggataattttgaatgtcaatacacagttttttttttatattgtaactctgcaaacatgcgtcatgtggtaatcagaagtgggttggccctgcacagcacttcatttgttgggccgaatggatgactgacagctggccttcatgcctgtgatcgatcgtgtgtatccgcgacagggacctgtgattttcgtcccatacgcgatctcttctgattttctgatcttgccgcgatcacagatcgagccgcgccaccggccaacgcttgacccggcacctggctaccccacgcggccacgccctgacgcccacgctgccacgcacgaccagcaggcaggagcccccacaccggcaagcccacgccgccgccttggccgctgctgcagcctggagcgtgtgccgccgccgcgaggagccgtcgtcgagtcgatcagccgattagccgtccgcaccaacaattttaggttatctatttgtgtacttttttagttactgattttatatgttttaagatgttttattaatatatcatgataaattttttggtgatttggtctattatattatatatacttacattatatatattagaattattagatttactgtgtttaaaaaaaatagatcggaccacccatatcctaaatcctaaatccaccactgatgagcaatggatgctaggagctgaaacaagccgtcgtctccttccttctgtctcctatccagccccaggtccaaaatgttaatctctcatttagtgatttagacatttttattccctatttacgttggttaatcgttaaatgccaagagtactgttcactacaaattggttggcttgatttaatttgttttatgctagcgagagaatacggagatcacaaatgtcagaccttcatatgatttataattcttacgactaacttgaatcaatttaaatgagagaagatataagaaccataaagattaaggtggatcgaaatgatagatataagtaccgcaaagatgaagctaccttttaccagttgtatattgaacttctgctatgaaacttgagtagtattaacataataagtttatgtatccatctttatgcccttctcaaatctcccaatcaacttctcgttgttcttatttaagtcagaattggtcagtggatcaattgctagtgccagcgttaagactttacatagtgtttattcaattaattatgtgaataatagtcagagaaaaaatgatttttgtgacttgggaaatactgttcatactttatgcacattttggacatgtttttgtaaagttgatgaaaataatgttaattaccaggttcatgttttttctcttattacttcagcataccata

SEQ ID NO: 21368 - DNA, 1501 bp, Oryza sativa
ttgtggagcatatggcttacactgttcctagtctatgtggcatgggaacaacggcaaaatgtggtgacccattgtaaatgccctaatgcgtcctacatctggacaaaagcagaggcgttgaaagcgtctttgggctctgggtacagctgtggaggggatatgtggtaccaaaaataatcgatgtgtcactctgcattttcaatagatgatggatgaaaatatagtaattatttcctctgtttcacaatgtaaaactttttagcattgtccacattcatatagatgctaatgaatctatatatataataatgtctagattcattagcatctatatgaatataggtaatgctagaaagtcttatattgtgaaacggagggagtatttaagacaaacccccaaattaaatattagagagttattaagtggattaaaaagttcttatagcatgttaagagaattttttttaaaaaaaatataatatttaggagcttggcaaatgtgaccgtattaatggaaatccatatggtttgtttggtaacttgaggaaaaaatgattgggagtttatataagggaattgatgctaatattagtaaaggtaatggtaattagtaggagtttagaactttagatcgagactatatcttattcatgtttggcaaaaaaatctgcataaccattgattttgagcagctgcctacatgttgcatgtagtctttgtcctcaaaccaaaaacagactccccgaaactaatggacgatctttttgctaatcaaaacttacgcacataaccgttggcaactgactttgagccaaaacggaagaaagcgtcagagaacgctttttcgcgaatgcaaaacgcgaacactaggggagacctgataacaaataaattaaaggggtgaaaccttaaactcaagccggctagctcaccatgttatgaagctagccgaaaaacccctagacgtttctcaaagcgcaagagaaaaactgaattgtaaatcagtcactcgtccaaatgtagccgcttctcaaagcgcaagagaaaaactgaattgtaaatcagtcactcgcccaaatatagccgcagaacgcaaggaacaaccaacggcaacctagcgggaaacacctagcatgcatcggatgaacacgctagccgtcggacgaacacgtccactgttgctgtgagacaagatgagagacactaccagatcggttccccactatccgcgaatgaaagagtaagacgtgaatgagcaagcctcatatggcgagaaaagcacatagaggtgttggaagaccgaaactgacgccctcatatgtacataaaaaatgggcatatataagatttttctcacctttccaacatctgatatgggtctacaaataaaaaccaacatatataaccccttatatgtgttggtttattaaaaatattgacaccacaataatatgtgctattctttttaataaactagcacttatgagagggtaatagatgt

SEQ ID NO: 21369 - DNA, 1501 bp, Oryza sativa
acacgtcctacgatcgtgagagcgccctgaaatacaccttgtcgaaactagatttcggcaataatgaaagggggtggctatcaagctaggaaagtgtatgggtttgaagacaaaggatttatacaggttcaggccttcttataaaagaagtaataccctactcctgtccggggatgaatccgacgagtgtattattgattgtatgatttggagaaaatccaacctctgccactagaggcacccggaccccccttatatatggggaagagtccgttttacaaaagataatctatatccctaacggaatatgcaaatacagatgaaatatagtcgtaaccgactaagtctcagggtgtttccttgatacacaagttaagaaacaaacccgagatacaaataagatattctatctacattaggtatcctgtacctagtccaaataccgtcgccgtgtagatatgggatatccataatctccacagtagcccccgagacctttgcagtcatccatcgtagccatctcaaaaataatccgagtgcttcaaacttttcatgccaaggcccgccgagtagcgaagacgaagactgtaaagggcgaaaaggtaaagaatatggtgcatcgaatagatgcacctaattaggtgtagcccccaactatgtgattagttaacaaactaaacatatagttgagaacaaaataatagcacaaccatgcatcatatgacaaaagcatatgcggcgcctaaagaggcattctagccgactgctttttagccacaacaaaagaaatccgagtggttaacactctaaaaggttcacgaatgaacacacttgacaggcatccgaataaaaactctaaagattacccaccaggtattataaaaattatggtaatgaataagtctaacagcctaggctatgactatttaccataatgaaaataggtatataacataccaaggaagtgactatgataaaaacaagtcattccaaattaacccagacagcttttgtagcctaataaagctaacaaaaagcagtataacacctttctgtcgggcaccttttaatttgcattgcaataattccaaagaattatatgaccgcataaaaaggattttatcagcattgggctgaacactattgtgcgcataatattgccaaagcaaaatatgcctaagtccctaaggaacacaatgggccacgctgttaaaagtattgggctgaagtactgttcaggcctaggcccatttgcacctccgatacccttaacaagaaatcccgagatccaagcgacgcttcgtcttccccgccggaactctcgccattttccccactccttgctacagtgcagaactgcgccggcgaactagggttcaccactccactcaaatccaccttcgaaaagtgcatcaaaacccttcccgtgatccaccgcctcaatccctcacttctccccagccatccctcgaatcaaatcagcgcattcgggtaaaatcga

SEQ ID NO: 21370 - DNA, 1501 bp, Oryza sativa
ttccttcttcactctagcctcagatcaaaaacttttgaccctagggatacttttttataagaatttatctttccaattgaaccgaaagtattctccagcaaattaccagtatttttagtgtcttttagtcgtgacactttttattatgtctatcaataaattacatgaactttgagagtgttgtagtaattttttcctaattcgtatggcatggcctaataaaaaaagctcattaagcacataaagctcaacatgcaagcatatagtatttatatctataatttatttcattctaaaaccaaacatacacatgctaaataatcattctcaaatcattttcataatatttcgatccaaatcatttcatcgtttctccaatatataacaaatatcccacaacaaagtgtggggcatcatcttttgtgagacatagcagaccatacatggctttggtctggacaactgtcggtgaacaactttgaagagctgcaatgccgaccaatggaccaaagagaggccacaccgacacatagtagtgtacaacgagggatttgcatactttgtcgctccacgaaatagattttgattatttatcatacttatccacatctttgacgcgcttcaacatggggccactgctacaaaatcctaatgggtgtcagttggaaacccacataagtgtcgaattcttcaaccagcatctcgcaagcagcactgatgatgaggaaccaaatgtgtggtttaaaaacgacacctttatggttccactaataaaaaaccaactcgatacgtcggctcaattagctcctcatcacccctgagatccatcaacaaccaagaacacagaatcaacattcaagaacaaaatcaatgtccacatatcaacaataaaaatccaagaacatagagaggaggctatctaaggagagaaggccactgtcgccgctgctcaccatgggctaagtccgatgttgagcgtcccgtgaggagagggcatcatcgcttgtcgagggacccacctccgtcatctagcaggtcaccctcgatccgtcgtgccaaggttagttggcaagctagatggcggtagctcgccatcgcgccagctacatcggagataagaagcgatagggacagtggagaccagggatggctgctgctgaggaggtgaggagtgatggagaggaggaaggaggacgagtacagcggagttgaggggtggtggcagcagcagagatgaggggccgcgatggtgagcaagagagggagcgcggagaagctgatagaggtgagcaagagagataggctggactttagacgcgaggtcatccatatataaaaattaaccgggccggctcgatcgattgtcaactgactaactgaagagagtgtcggtttttttgtagaactgacatctattaccctctcataagtgctagtttattaaaaagaatagcacatattattgtggtgtcaatatttttaataaaccaacacatataag

SEQ ID NO: 21371 - DNA, 1501 bp, Oryza sativa
tatttatctacaaacttaatcaacttgaaatggagggagtaacagtgaggctccagacaaattgaagcgcagccgaaaggaatttaatacacagaaggaaacttgggtgcatatgtcaattcagagattagtaattaattaggagtagtacatttccatctaaatcttgaagcgaacaagtaatattattcaagcatcaagaggggttacgcataccgatagctgaatgcaggacaaattaagctttgtcacgttgagtagactcccaagcaaactggacatggattctaattcgacttctacaagttgcatacattgtttccaaagttggtcgtggacgaaaacattttacagatcgacgcatcaacgaggaaacccattcgatcaaccaaaaacacgctgaaatcatgtatcgaaaacttgagccgaagggaggtaagctttggcgccgtgacacacaatgcatcatcaggcacctgcagaccacgtcgggagcagccatcaatggccaaactcctgagcgcattgccagtgatctcgtcgaactcgaagatgcaggagttgagctccatggcttccaagaccgggcaccacgaacggatggtgtagccgaagccgcggtccagaacaaggcgagagagacgcaatgatttcagtcggtgggagaagacgacggcgccgaggattggaagcttgaggtcataaccaacgccgatggtgatctcgagctcgacgggtcggtagaaccggacgccgcggttgatccatcgctcgatctgtcgcacgtcgggctgtgagtgtgatttgatgtcgcgttgctgtacacctcccctgacgtgccatgagctgggtagacgaagccggaacctgtcgaggaacggggcgtcgtggttgaggagcaggttggttgcgaagctctcgaacttgtcccacctcacgctgccggtggtcgacgacgtgaactcgtcgccgacgatgtcgaggcatggcatggagcgccacaggtcgcgccaccgccgcgacagcgcgcatgtctgcacggcgtgtcgcgccgggagcaacgacatgattgcgtggaggaggcagtcgggtagcgcgctcaggcggtcgccgccatcctcgccggcgtgcggctggcttgtcattgtcgtcgcctcgccggcgtatttgtttcttcctttctcgtcgcggagatgcagaatttgcagactacgcgcgttaccggccggctagcttggcgccttaattaagatcgccaaaagacgctagtgtgcttcggcctttctcggcgcgaaaccgtgagaccgagtcggatttgcgtcgcccggcccaggtatcgcaggcccaattcatgtccgaatttgtttgggctgtgactctgggacacgtcctacgatcgtgagagcgccctgaaatacaccttgtcgaaactagatttcggcaataatgaaagggggtggctatcaagctaggaaagtgtatgggtttgaagacaaaggat

SEQ ID NO: 21372 - DNA, 1501 bp, Oryza sativa
ggcataatagggttccatttgcacaaacagcctttaataaacatttcagaatttaataaaacagttaagtaataattaatcaatattaatccaacgctatacaacataccctgttgcataggcccaaccattctgaacaaccatcccggctgcacagttctatctccaaaccaggaatatatcattccaaaccaggagctaatcaaattattaccaattaaagcaccttttattatgatgagaagtgtgagactaatcacgaaagacattgttagacccgcccataaccgcgggcacggctattcgaatagttttactctgatcagaggtgtaccactgtacccacaagacacagccccacatcatgtcaccatgtgcctcaataccaccatggtacctcggaaaggagctgtgacattacctctcgcacaacacaatccactacagcgcacctttcctggatcataatcacccccttataaacaaggcatggactccccagcgacccctgtgggcttatctccgccacttctcagtctggtgctccgcaatgaaccatgctatacaaaagataaagccgttgcccacgctggcttgtggttggcacggttaatgtttcacaactgaaactcgtgaaccggtccttaattgtcatgagcacgactctcaaaaccatgtgctcacaacccaccattatcaggttttagttggcatgtaattaattaaccaatcacgattgaccatcgtgaactatcattaagccatcattaaataatagtgagtcaaaagttatcccaatagtgtgctaatgtttctaagcatggctaagcagtcatatctaatatctagctaaaccaatatatatagcccaactagtcaagttataataacccaaggtatcaaggaataaagtaatcaagaacaaaagggctataacaaacaataggttaattccacccaatgacattcgaaaatagatgcaatagttgaatagaaacaatagctttaaataggatcaacatgctcaaagggttgtttgggatctgtgtgacttgccttgctggccttggaactcttcaaattcttctcctgcaaaaacggactctccggaaacgtcggaatctaaacagaaaagagcaaaaacaccaaaacagcacataaacaagcatgaacagtacatgtggatatttttaacatgtagatctcaattttagaaaaaattagagacttgaaccaactaaatccgagttaagatgaattagttatgaatttttgaagatttaatcggattaaaacacttatattgattttaattgaattatgacgcaataatgaattgtttttgaaaaggaaaaagggatttattgcgtcagcggctagggtttgcggtggaccgggtgcactgcggcggttcactggaacggacggccgagatcgatccatccaaaatggacggccgagatcgaacggtccacgaccggctcacggcaaacggccacga

SEQ ID NO: 21373 - DNA, 1501 bp, Oryza sativa
gacaaaattcaggttaaggagcttcaactccctggtcgtcgttttacttgggcaggggaaggtgcaaacccaacttaaaccaagatcgaccgtgcttttgtcacaactgactgggatttaatgtttgagggttccaatttgtatcctttgtcttcagcatgttcagatcatgcgcctctccttctggtaggaaatgagaaatgatcgaaattcccaagcttcagatttgaatctttttggctcaaaattcctgggttcttggaagcagtgcaagactcatggcaacggccgatccttgccactaattgcctagctattttccgcatcaaacttcgacgtctcgctcgagatttaaagggatggagtcggagccaagtgggtgacattaagttacaacttgcggttgcatctgaagtggtctttcagctggacgtagctcaggaaactaggaccttgtcagacgatgagcgcctcctggtgtctaacctcaaaaataggattctggctttatcagttctaaacaaaatccagatcagacaacgctctaggcagacctggatcaaagagggagatgttaattcaaaattttttcacatcaaggccaattccagaagaagaaaaaattttattcaatccttgcacacgccatctgggattgcaatttcagcacaagacaaagaagaggaactgctgcgtttcttcaaggaaagaattggaactcgttttcaaagaacgtcagggattaactggaacatgatggatttgctctccctggaccttggcgatttagaataagacatcacagaagaagaactgaagaaaactgttttctcaatgccacccgagaaggctccggggccggatgggttcattggtgcttttttcaaatcagcgtgggagatcattaaagaagatttgttatcggcagtaagatcgttttttgatcttaacactttgcggctaaaggaactaaactcagccttcatttgtctccttcccaaaaaagaagatgctttgggagctgaacagtatcgaccgataagcctaatccatagtttctctaagataatttccaaaattttggcaaacaggctagcgccaagactgtgtgagcttgtctcccccaaccagagtgccttcgttcgaaaaagggctatccatgataatttcgtcttcgtaaaaaacatggtacaatatttacatagaacgaagaaaacgagtctgtttatcaaaattgacatcgccaaagcttttgacacggtttgttggccctaccttcttgatgtgcttcatcagtttggatttggaactcgttggctaaactggatttccaatttacttgcaacctcttcctcccaagtgcttctcaatggatctccggggcaatcaataaaccatgtccgaggccttagacaaggggatccgctctcgccgatgttgttcatcctagcaatggaaccttttcatcgaattcttaaggcggctgaaaatgcatcacttc

SEQ ID NO: 21374 - DNA, 311 bp, Oryza sativa
tagtgcaccacattcaacacgatgcaatgcaaggattcgatttccatccatcgattaattaccagctattataattataaatatcttaagtgcgggccctgtatgcatgcatccaaaaatcaattagatttggccaggttgttgttggagctggagtactgtttctgggttataaacaagatggacctaggtcaacccggaaattaaaaacaatcgatcgttcactcaatctggttagccatatatattgattaattgatatatacgttgccccaacactatcatacatgagtctgtaaaatccccacagc

SEQ ID NO: 21375 - DNA, 1501 bp, Oryza sativa
aaaaaaaatacatagggaatagaactagcaatagaactatgaaaatataaaaggctttccaagcaatctacagtcccactctgcatatgactgtagaaagatttacaaaattcagaaaacaaaaggcaaaaccactacctaattttggtataatctgaaaattagtcaaaaaaaaagtatgcattgtactttttaagtccctatgattaaggcatagttctatttctcaacttcaaacttcaacttcctcgttgtccgttagcaagcttttcaaactgttaaatgatatttttttgcaaaaaatttatatatagaagttatttaaaaaaaatcaaataaacctaattttcaagtttataattattgatacttaattaatcatgtgctaatgtgatttctcgttttgcatgcgtcaaaaatatcaaaacaaagagattgaacgcaacctaaattagcattggttacaacaattaattctataggttagcacacttgtatgtaaaaaactgtgcatgaaaaaagaaaaggctaaattctaagatgattttcataataatacgtagagcttttattttaatttaaaattaaaaactcataacatagcacaccaatagaaattaagggaaagattagagggtcaaggaaaaataatgaaccacactagagaagatggcacaaataataattatgtaaatttagtttgacatctaaatgtaaattttgcaacaatttttttcattatgaatcaaaaataaatctagattttcttttatctagacttcgagctaattttattctctaaacatttaaaagaatctatgctaaataaaaatatatatatatttgttttaggaaatactataaaaaataaaaatttatttatttattatatattataataagaaaaatatagtcaaatatatattttggagatggtataatttaaaaaatgttaagaattattttaaaaaattgtcttttctaacacagaaaagaaaacacatgccgtgtttagttctatttcaaaatttatttttaagtatacggacacacatttgaagtattaaatgtacaccgataacaaaataaattatagattccgcttgtaaactgcgaggtaaatctattaagcctaattaatccgtcattaataaatgtttactgcagcaccacattgtcaaatcatgacgtaattaggctcaaaagattcgtctcataatttacatacaaactgtgcaattgttttttttcacatttaatacttcatgcaaatatcaaatatttgatgtgacggaaaagttggaagtttgaagagaactaatcatagccataattttgtaaaataatttgctagaagaaaaaaccaaaaatggtaggatggactagtcttggactatgctcctccatgtcccggcctcccgggcgacacagagaagaaaaaacgaaacagccgagatggagaacgcaccggccaccaccacctcctccacccaagacggcg

SEQ ID NO: 21376 - DNA, 1501 bp, Oryza sativa
tttaggtgatgcaagctgattccataaaagtttaaaatcccgcggaaaaatttcgaggtcggaagagcgaagccgccatagaagaaatgcgagaagactacgatctcatgtgtatcgggggtcggaaaagcctcaccgcacgctggccgccacccgatgatctccttggctgggagaacgccgtgcgccaccatctccttcaggttctcttccgttacgtcggacgccgcccattggccttcgaagctttccttctcttccgccatcgattttacccgaatgcgctgatttgattcgagggatggctggggagaagtgagggattgaggcggtggatcacgggaagggttttgatgcacttttcgaaggtggatttgagtggagtggtgaaccctagttcgccggcgcagttctgcactgtagcaaggagtggggaaaatggcgagagttccggcggggaagacgaagcgtcgcttggatctcgggatttcttgttaagggtatcggaggtgcaaatgggcctaggcctgaacagtacttcagcccaatacttttaacagcgtggcccattgtgttccttagggacttaggcatattttgctttggcaatattatgcgcacaatagtgttcagcccaatgctgataaaatcctttttatgcggtcatataattctttggaattattgcaatgcaaattaaaaggtgcccgacagaaaggtgttatactgctttttgttagctttattaggctacaaaagctgtctgggttaatttggaatgacttgtttttatcatagtcacttccttggtatgttatatacctattttcattatggtaaatagtcatagcctaggctgttagacttattcattaccataatttttataatacctggtgggtaatctttagagtttttattcggatgcctgtcaagtgtgttcattcgtgaaccttttagagtgttaaccactcggatttcttttgttgtggctaaaaagcagtcggctagaatgcctctttaggcgccgcatatgcttttgtcatatgatgcatggttgtgctattattttgttctcaactatatgtttagtttgttaactaatcacatagttgggggctacacctaattaggtgcatctattcgatgcaccatattctttaccttttcgccctttacagtcttcgtcttcgctactcggcgggccttggcatgaaaagtttgaagcactcggattatttttgagatggctacgatggatgactgcaaaggtctcgggggctactgtggagattatggatatcccatatctacacggcgacggtatttggactaggtacaggatacctaatgtagatagaatatcttatttgtatctcgggtttgtttcttaacttgtgtatcaaggaaacaccctgagacttagtcggttacgactatatttcatctgtatttgcatattccgttagggatatagattatcttttgtaaaacggactct

SEQ ID NO: 21377 - DNA, 778 bp, Oryza sativa
cctctttagattctaactttttttctttaaacttttaactttttcgtcatatcaaactttcctacacacataaacttttctacacacgtaaatttttaatttttccatcacatcgttccaattttttaaaacttttaattttaacgtgaaactaaacacagccatagtgcaatgaatcatgctcattaattcggtgggcaagatatcactacagtgcagtgtatcctacgcagacaggtaactgtcacgagtagaacccagagcccagagcccgtcgccccgtcccactcactaaatcatgcacatacctatttaaaaattgaactctttaaatatctaactaataaataatttattataaactaaattttaattgataaaaataatatcatcggttgttatttacattcagttttactcctatatgattattttgtttgtcaaaaatattatactatgtgagaaatttaaactcgaatattaattttaaaataatactaagtttataacaagttacagtacgttttactgaatacctcttatgttccaaaatagacaaatctcgtccgaagaaggagcgaggatacacatcatcaacgtatcatcatcgtcatcctcatacacccccatgcctatatatgccgacgccaccccgttcgtctacctccccacctcacctcctccattcttcacttccttcgattcctctgcttttaatcggcgctctcctctgctttctacctagctagctactagcattctagttgtcgctcactca

SEQ ID NO: 21378 - DNA, 764 bp, Oryza sativa
gtctgtcatttgtaccggtcactgccagtgggccccgttgaagcagtggctttttaaaatatttctggaattaaaatcgaccggaaatggtgtgcttatgttgtttttttttggtagcaaattgtgtgcttttcttttcgtttacctgtatatttttttaaaaaaaaccttaaaaaattctgtgaaagaaacgtgtgcaaaaccataggagcggcaggttgatcagcacacggttttataaagtttccaatagctgagtaggaaaaagcgatcaacttttagctaaataattttattttatttttcattatagagaattcttcaatgttaatttctgaagattaattcaagtaatgaaactaccaacctattttttcattcgacaatctttattcatggttgtatatgtggtggtggtcggactctaatttggtaatgacattttagtcatgcaagttttacaatcttatcttatctcatatagtgaaagcaacaaacctttttttacgaggatgtgccacattatcaaaaatatattagtcatcggataaatagttcggataataatagtcattagatcaaaagagtgtatgtattaaaaaaatatattgtcctagccaagtatggatactttgtgaacaaattaacttatatcaaaaccttattaagagctaaagtaaactaataggccatatataaaagttcttaaacagtataaaaagttgtgcagagtgcgactaacggaaaaaaactaagatcaattt

SEQ ID NO: 21379 - DNA, 1501 bp, Oryza sativa
gaagaggagcggagagcacctcagagtaaaggcgcttaaatccctgagcacctgctttcggcgaaccatgaccttgaagggacagagcgagcgcagcagcagcgccggacccgggattgagcagatctgcattgagaaccttgcctgtgctgacctcaaccaaatcttgaaccgaatcccctggagaggagacagcccaaggtgcagtcgccggcctagggagcactggagacgtggtctgacccggggggaaaagctctagggttggggaagctaaggacgctggtggatctgagggagaggagaaaaacagggagggcgacagggacagggatgagcgatgacgacgatggcgggggtgagtgtctggacttaaaggatctggtcatgatgtggatgtgggggagaaaggggagaaggagagagagagggagctcaccggaggtggccgccggaaccgaagaggccgccggcgcgggtgcgtctagtcgcctaacctgtcgcgagagcatcctaactcgtctttcctttcaagagtagaagtatgacctgtaaacttgatcaaagtttaaacgatttataaactgaaacggagagagtagctctatctatcatatcactaagcttccagcttttgttttctcttgtgtagttttttatattgccattatattttttttcttatgtcccaaaatatatttattttttcatatttcttggataatatccttttactgatatactatactttttgagacctacttcataatgtcatactcaattgttctccaattttattacaggagaagcattctgacaactctacaaatgttccgacgtttcacaaactgactaccttgtgcttcgatgcatgtgatctggacaaaaatctagatatattgttgagttttctggagaatgctcctcatatggagaaagcaatattgcagaactgcaaggtactagttttctcttatttctgtttgtcttgttactctccattttgttggctacttggtttatcttctcacggtgttcgtgtgtgatgctctcacagattccaaataattcgagaaagaggaaaataatggcaagggcaaataggaccctgatttctcccgagcacgaaaacgtgacagttttggcgtttcagtacttttaagcttatcaagatcgcatataaaaacgacaatatcaaagatgtgattgaacttttactgtgcaattcgacagaacttgagaacagcacaatcatcctcacaagacattaaattgtttgagttgtattcgcgtgcagcttgttggtatgtcacttttgaattgttttttaccaattgtatgcccaaatgtatacaaatatatagcaaaattgtttgtttatccgacatgaagtgtcctgggtggttacattatcatccattgtgggttggataaacgagagtgatgacatcggaattcctgttccgccccactgcatttggtccggtccattagttagatt

SEQ ID NO: 21380 - DNA, 408 bp, Oryza sativa
gaaaggggtgaaaaaatcgaatatctcaatcgatcagttggtgagtagggccgggcgccgttgctgacttgccgtgatacagaaatattcctgctttacttttttccgaagggaaagaaagccaagaatcaaatggccaaatgaaccagcttgctataacaccctatatctcgtttgaagcctataattgttatggtgttggcccatatatataatgcagttgtcatgcaatggtggtgatttagtacaacattggaaatttaagaggatgatcagggtctctgcttataaatcaaaggatgattatatgataatctaaagcgttaagtcaccattcaaaaatgattatatgaccactactagaaaaacgatttttcatggcgttggtctatgattttcgctggcaga

SEQ ID NO: 21381 - DNA, 1501 bp, Oryza sativa
gcagctggacaagagcggcatcttacaaagggaagaggtagagagatgcatccgggaggtgatggatggtgacaggaaggaggactacaggaggaatgctacaaggttgatgaagaaagctaaggagtcaatgcaggaaggagggagctctgacaagaatattgctgaatttgctgcgaagtattcaaattgacaaaaattattgctgaaatctcaagcacctagctatcagagatattctagttctgacttctgaatacaattggtttttcttcctagagaagttcatggaggtcaaggtgctgatgttttccacgagtcagcagaagtaaattaagtttacagtgtgtgtaaaatggtaatttatactacttacaatttttattttataattgaagtgtcgttaacttatgtcctcgtcgagggcaacaagctaccttagagatatcacgataacaaatgaattatgtaagctttacatactttgagagtaccgggcatagcttgcttaccaaattacagaacatatatatgtgcatgcatcaatttcctctgataccggaaaaactgttatttatcctctcctctcaattctttctactaaaattcggcattacaacaatatatctctcttattaattacaagtttctatagtatataaagcaaaaaaaaaaataaagcgcaatgaaaaactcaagtaaataatatggttaaaaaggatgagacttcaatcctccatatcttccctatcgcacaaaaccatcaaccagagcactaccagtttatttaaaactgttactgaaattaatatcattctcagtttaatataacaatactaatatactattccaggtggtttattatatggtttagttaagatgaaattcactgtgggagttcacttagatatatatatttttagaaaatcatgagctgcagttaggagtccgattgtctcaagttagcatgcgattttttttaaacaaatttcttatatgattccttctatattaccaaaagtgaacggtcttaaaaaccgactcaaatacggatatgtattttcaaaagcaaacgaacttaaaaactgactcttacacggatgacgtaaaaaaaaccgataaaaatattttcaatttttataatagagatagtgattgtccactggtcggcccaagcacacctctaagagcaattgttttgtttgacagaaggacttcaagggcaggaatcccggtgagcaacttctcttcgaccacgcgaacacctatccattctgtgaggctgtgatagtcatagtccctggacaaagcgagtctccatttcgcctacaaacttgtcgtcgtcaagcgcgccagcacaaccaaaattaacttgcgcgccactctgcctctcaacccttcaaacacctagtataaagctcatcgtcgccgcgagcgagcttgctacctccaagtcaaatcaccaagtgattcgaacccatggcgagcatgaatgatcaac

SEQ ID NO: 21382 - DNA, 1492 bp, Oryza sativa
atgcagcgatgtttgaaagagcagaataacatgcacgcggtagaattggggaggtgaggagggggaggcatatcggtgggcaaacggtcacatcaatggctgtggagagcgaaaggattgttgtgtcaacgtgtgagaggaaatgtagagatatatagcttctgcgcaagagccaagcttagacttatgtatgcacgcgttgtgacctgccttgactgtttttaccatcggttaattaagaaaacaagcaccactgtctattttttatcatgaacaaataggagtatttttatatcacaatgaattcattaataaaccggcctgaatagtatcattaataaaactgagaatgatataatttccagaaacaacattaaataatccggcaatgacaatgaggctccggttgatggttctgtgcgatagggtagttacgcaagattgaagtctcaacatttttaaccatattatttacatgagtttttccttgtgctattttttagctttgtatagtatggaaacttgtactccctccgtattttaatgtataacgccgttgacttttcgactaacgtttgaccattagttttattcaaaattttcgtgcaaatatgacaatatttatatcatgcttaaagaacatttgatgatgaatctagtcacaataaaataaatgacaattgcataaattctttgaataagacgaatggtcaaacgttggataaaaagtcaacggcgtcatacattaaaatatggaggtagtaattagtaggagagagatatttttgtaatggcgagttctaatagaaaggatggattaagtggagaacataaataacagtttgtccggtggaggaaaataaaatgcacatgtattctgtaatttagaaagacataaccccatgtgctcccaaagtatggaaaccttaaagaattattttttttatcccgatatgtctatgctagcttgttgtcctcgacgaagacataagctaattacacttcaggtcaagtttggcgtagctctagatacgagatttcttaaatatggtcgtacctgcaaatctatggatcggtgattacgtaaataatatttagattaatcatttgttcctattttagatgaaataagaaattttaaaacagtataatttgatatagaaacttcaaattcagaagggatttggggtctggagttatgctagacatgaccttcattatgaaataaaaattgtaagtaatataaagtaccattttacacagtccgtaaacttaatttacttctgctgaattatggaaaacatcagctcctcgacctccatgaacttttctaggaaaaaaattattcataagctagaacatctctaggctaatagccattctcactggatttttgtcatttcgaatacttcgcagcaaattcagcaatattcttgtcagaccttcctccttcctgcattgcctctttagctttcttcatcaaccttgcagc

SEQ ID NO: 21383 - DNA, 289 bp, Oryza sativa
ataagaaaattcagctagagaactaatggggaaaattcacaaagaggaaaaatggggattgaaaagagtcgatttgagttgaatcaggtatcaccaacataagagagggaggcacacggctgggaggcctagctgctgagtctatccccttccaatggcggcaacactagaggactcacagagcagcgacaaagatggaggctcagtgtcggcggaaggcttgaccaccgtggctcgacggggtggcatcgccagcggagccctggaccactgaggcaccgattgcagg

SEQ ID NO: 21384 - DNA, 574 bp, Oryza sativa
aggtgactatgattggcaaatttcctcatgacattagagactaatattgcacgatgataatagtaataaatatcatgctatgatgatatcaaatgaagaaaatattagttgatcggttgatgcgctgtctttgttgttttgtggaataaatttcctgcagattgtcatgcaatcagacatgctcattcttgaatattgaagctacttagtttctatttccgtttgtcgtgctccagatttatgaataaaatatgccgaatgccgtattgttactcgtgatttggaagaaattatctgattctgtttatgaagccatctttgtccaaacatctttttttctgtcgcgggaacagtgaaactagccttagagcataagcaatgggtgtcttggagccgttcccctagctcacggcgtcgccgtaccgtttgcttttcggcctgagccgtccccccgcgtaggcgcgcgtttgctcgcggggggatgcgttcctcagtcgcttttggctgagccacggcgccaggctacgcgttggacgcgcggtggctagacgtgtgtctcgtggacacagctccg

SEQ ID NO: 21385 - DNA, 1428 bp, Oryza sativa
ttttttctgttaggcttgatttttttttttttggcaaaatggaatttaatccagccttgttatggttgataggagatacccgttttataaaattttacgaggtatttcgtagcaactaggaagcataatatttagatcagcctataaattgtattttgtatagtagttacagatcagccctgaacattactgcccagagctgcaaggcaccatcgttgtccggtagcacacatcacccttttatgtgctaaaaatcaaaagcgtcccagaatccagttgccgtgacagagttgaagttttcagtggtcacggcatgtttagtgtaggttagctaggggtacatggcccacacgtcagatctaggtaaaggatatatccaaaggttgttagagataagtataaattaatacactgtacgtgcataacaacaagctttacatctccaaatagtccaattacttgttggattcttagctcacttgtcctgttagtgtggcaaatgatttgtgccttccctgtgtggaccattcatgacctctgtccatatactagctagtacagtataatttaggaattgataccttgtaatccaattggaatggcatctatcatactatatcaaatactccctccgttttaaaatgtttgacaccgttgactttttagcacgtgtttgaccgttcgtcttattaaaaaaatttgtgaaatatgtaaaactatatgtgtacatgaaagtatatttaacaatgaatcaaatgatatgaaaagaataaataattatttaaataagacgaatggttaaacacgtattaaaaagtcaacggtgtcaaatattttgaaatggagggagtattatgaaataataacaactggcatgatttatgtaatactagtgctaaagcatgcatgcatgtatcacagctagctagctcttctttgcatgcgacatcgtccaattgaaaacaaagataccctttggccaaaagctcatggccacaaattaaaacaaaacaaaggaacatgttcatatctttgcatgatcttgaaagttcaaaccctctcagccttgctctgcttgcaccactgcaaaagaacagagcacacattacaaagcaaaccgaaaaaacgacaaaaaaaaaaaacaacggcactatttgaaacatagaaatattattttatcaaagatagatttaaaaccgagcctctacatctaaactagatatacacagccaaataaataatgcaaaaatctgacactacatatttctgccattgtaaaactatttctagtgaaacatccgaaacacgtatatatgacatcaatttctaagataagtgaaaaattgtttacatctccggtatccaccgatcaatatatttatttggagagtgatattggttgctcaccttgttaatataatatggcag

SEQ ID NO: 21386 - DNA, 1501 bp, Oryza sativa
caagatgttgacgacgtggtcggattgattgagctcgttttggttgaggagggtgtcgagaagggtgatcgcggcaacggcattctgttgaggggtgcggaaaaccggtgtcccttcgacatcctgttggccgatgagatcacgcgctcggcgcccagcttccaaagctcgctgacgtcgatcctcagcctccttcgcggtccgctcacggtcctgctgctcacgccgtagccgttcttgttcttgtggttgatgctcttcctccagtcggtgacgttcttcggtctcccgggcttggcgttgctcctccgtctcattattggccatgaaaacgccaaagtagagaggggtgtagttgtcatctaggcttccgtcgaagtcgtcgaagtcgtcgaagtcgttgtagcgagaactaaattcgtcgtactccacgatgtcagtaggacgtgagtcgacggtgggagagctgttgtagtcatccagctgatccgtcgaaaccgtgccgagtggttggaggatgacgccgacttccctgaagctaggcgaaatcggcgttgaagccgacttccgcctaggcctacgggatgaagacgctgtcgtggtgaagacggccgctaaatcgtcggggagcttcatcaggactggtgggtaagccccatcatcttgatctggtgtcgttgaagaagatgcgatctcggccgagtggtttgaagccgactcggttaagatggtcttgaagtagctttcagccgcgttcgggaatccaaacgggaccgaaatccggttctctcccgaccggtctgattccgagtcgaggagagaaatcttgccgaagttgttggtgatgaagtcgaggctgtcgaaccgaaacgtctgcccgggagggaaaacgaggtcgtcgatgccggagatggaacccattgcactgatcggcgaaaagcttgacgctacccctacccggcgcgccaactgtcgaaactagatttcggcaataatgaaagggggtggctatcaagctaggaaagtgtatgggtttgaagacaaaggatttatacaggttcaggccttcttataaaagaagtaataccctactcctgtccggggatgaatccgccgagtgtattattgattgtatgatttggagaaaatccaacctctgccactagaggcacccggaccccccttatatatggggaagagtccgttttacaaaagataatctatatccctaacggaatatgcaaatacagatgaaatatagtcgtaaccgactaagtctcagggtgtttccttgatacacaagttaagaaacaaacccgagatacaaataagatattctatctacattaggtatcctgtacctagtccaaataccgtcgccgtatagatatgggatatccataatctccacacacctcctcgtcagtcccccgccgtgagcgtcgcgactcgaaaccctaccgtctttcgcgatctcgcggcagcgacacgcatctgacta

SEQ ID NO: 21387 - DNA, 268 bp, Oryza sativa
atcggagggactaacttgtttcaaacatacttgccaaaatttttttgtccgacgatataaaatttacatatctctcgtcccatgtcaatacactccatatgtatagcaacgtaacaatgtaatatgtcattacacttcatatctaataatactagtcttaagtgctcttgtattatttttttttttttgaaaaaaaaatcccattatcttagaaaaaagaaaaaggtaacttatctgacttgcccttgcaggtttcacgcagcaacca

SEQ ID NO: 21388 - DNA, 169 bp, Oryza sativa
ggttcattagtggacataattagtaccaccttgtaagtagtaaaccatgtgccctactatataacaatcccctaagcagcactgcttttagttgtcccctcctcatttgcttcttcttcttcttcctcctctttgtttcacacttgtggtttgtggttgccaactttgt

SEQ ID NO: 21389 - DNA, 520 bp, Oryza sativa
tcaataactatcacttggttatcctcccgcatgtcgcgaatgtcaagggaggaggagtgaagcagtactaggtgggggagaggggagggatggagggatagttgaatggcatttgcgggtaatttctctacaagtcaatgggtacttctgaaattgggacagagttggagttgtggagcgaccaaaataccgctccacatagctagttcactttgtaggagcgatctggtttactccgctccacttttttttttttggagctggaccgtttggttgggctccagctagatcagaggtgaatctaggagctgtagctgcaccaagcaggccctagaagaacatcgtaggagaaaatctcatttactatcccacaaattgacaaaaattctaatcccttatataaggaatttatgaactacataaataactaatcaagcatgtaaataagcatatgataacttacagatgcactaggttgactttgaccagacgatctagtctcctcttcaaccctcaacta

SEQ ID NO: 21390 - DNA, 1501 bp, Oryza sativa
tggctatccccttgccgctcggccggaaaaccgcacgctgcttgcttgctttcgtaagcaagaatatggccccgtttggacctgccgatgacacaaagatttagtacgtacacacaaaataggaaaagctattagccacctctgtatcaaaagttttaattacttcaaacctaaaaatgaatttatctgatattttaaaacatcttctgtatcagcagttttcgaacgaaatataccattcaacggttgtttggaaaacgtgtaaacagaaaccgaggtgaaatctgtaaattaataaaaaaagaatggggcctatgtatccataaatatggattgagacggtgttttgattttgatcaaagtcaaactgttttaagtttgactaaatttatagataaaaatattaatatttataatactaaattagtgtcatctatctatctattatatactaaaagtctattaaacttcctataaacgctctcaagccaccacatgacacttctgcaaacgctcatataccgccacgtggcaatacctaatctcaccgtcaattttcacttaaatcggtggacctgataatttagcccattagattagattagatgtattttatttaagaggaaactaataccttcctgttcaccggaaaaagaaaaaaaaacacacaagtactccgtaggtatgtacgtacgtgagacttaaaaaacaatgaatcttattaccgtttatcttattgttcaccggaaaaagaaaacaaaaacacaagtatgttcattcgtaagactaaaaaacaatgaatcttacctactgtttatcgaaagaaaaaaattacgcacagacttagtactataaaaaacaataaagcgaacaaaacatacgtaggaccattaaaaaattgattatcctttctactatttaaagataaaatctattcctcaatataaatttaagtaaatgtcaccatcgattttcatttaaattggtgaatctaatattttagaccattatattagatgtattttattttaaaaactaataccccatgtaggtatacgggagacctatataactgttaagctaaaaaatacataagtagtccgtacgtacatacgacttgaaaaaaagaaatgaagcttacctactgtccatcggaacaaagaaaaatctatgcacggtggtctattgaaatactattttcaaaatccttcctatacaaacaataaaacaaaaaaatgtgtatcattcggaaaggatcgatggtcttatgaatagtattatctactatttaaagataaatatattactctacaaatttgcataaatatacgtagttaaactaaatttatattataaatatgaaatatcccatcaatgatttttattcgttctatcttaacatacgaggctgatatatataatatttaatgctatgataattttttattttacatcatattctagagtgtctcgacgaatacacaacgctaatttaaatcta

SEQ ID NO: 21391 - DNA, 823 bp, Oryza sativa
agaatgcagaaaaaatgactgagttgtgcttgtatttgtagaggatgaagttgtagcgttgcggcagcaagtttgcaatgtctgcaaatgtaacggctataactgctactctattattttagtgcatgtgcctgaaatcactatacatatattgtattttatttctttcctgctggcagtagcactactgtattttatttctttcctgctggcagtagcactactgcttggttattgttgttatctatccccacaatggtttctactagattggatgagtgcatttattgcttattgactactttattagtacattgtggatgcccttaggacacacgaactttgtactaaagtggtgaccagatcacgtcaactaacaaaagtttcattgtttgttactctatctgtctcaaaatataaaatatgtcccatccaaccaaattcgcttatattttaggatgaagggagtatccaagtatgtcacattttatttggcacctatcacagtcacacctcactccacacagttcgtatgatttttttaactcatatccatgatgaaatgtggcaaacatggttcgaacccaagacctctatctttattcaaaaccttctttccatcttattggtatttcttaacggctttactagaaatataattcccagcaatggcacacaaatacttctggtatattatggttgcagagtttatccgcaagcacacggatataccattgtagcatttcacccgagagtattccaagggtatcgtatttattttatcccgtgggaagatcaagtagagagaactcgactaataatt

SEQ ID NO: 21392 - DNA, 957 bp, Oryza sativa
ggaacggcgtcgatggggatggagttgtggtcatggcagtcgcgacggcgggccggcacagcaccgagatggcactgttggggaagcaaagagatggcgcaaggaactccgggagggttacgacgagttggttagagagagaaaggccgatgacgacgcatggtacacgcagcatcgagggtggtaggacgatggagaagagagaaagcgagggtggtgacaacgtttaacgcgataaggggaaggggacgagggttcaccaacggccacgaatttcgctccggtgatccggtggtgagtgggagtcggtggcgcacgggggcgtgggtcatgatcacggcaccggggcggcacggacagggtcgcgatgaggcggcgacgaccgttgttcggtcgacggaggacaaggagacggagtgcgtttgtcgagcggcggcacccggcggcaaacttgacgctgaggtggcaatggcgcggtggcggtggggagcgaaaatgggagagatagagaaggatggctcgagctttataggcacgaggagaggcggtttgggagagggaaccgacatcgagggcggtcaaggagcggtggctggttccggcgctagcggccaaaggggtggcaggtgatggtggcggctgtggtcaggggaaaagcgaaaaggggaaggaaaggagctttgctccttgccgatttgggcgagcagagggagaagggagagcgcgtgagagaggcgcattctctcgggctttcggccttggacgcacgcgggcagcccgggacatggaagccgaggtgacgccagcaaccccatggtgacgacggtgggcagtgtggagtggagcggggacaggacggtcgtcggcgcaggcgatgaccagagggagtgacaccgatgtccttccggtcggccacggcaggggagcgcgcgggataccacgggcggcggcgaaaat

SEQ ID NO: 21393 - DNA, 1501 bp, Oryza sativa
actgaacctcggcaaccacttcgaaataaactggatcaccggaactgacggaatctaaacgacaaacaaagcacacaggtgatacaagcaataagtctactgaaatagcaaaataaacaaattttaatggattctatactttttaacggattcactgcaatttgaatggattaaaacggagctcggattattaagttctgaattttaaaagatgagctgcgttattactaataaccgaaaaaaccttagtcaattattacacattattgcccatagataaatagatcaatggaattatacctccggtaagaaagcctcaagaattagtgactcaacgagtcaacttatcgtgccatggggccatcccaacggtcaaccgaaccggcgaacggaatcggcggcttggaatgacaacaaaaaactagacacagtttacggtagagactcggtacggcaaacgataggccggtatgagtttagggctgcacctaaggctttgctattcggctaccgagctacgacacaacggcaaactacgacggcgacgcgggagagtggcggcggcgcctagaacaacggcggcggcggctcggctcggcttgggatcggctagcggcagcgacggcggcggctaaggcggcggcgtggcaacaggaggtggcgcggcagcggcggcaaggcgacgacagcgccagggcacggacggcagcggcggctcgggctaaacaactacggtttccacaatgacgctaaaaagaaacaacacctaaaacagagaattacggataggttcctcaccaaactgaggcgatcggcgagaaggaaacgacgacgatggtccaacggcaacacgcgaaggcgacaacgacgttggatcaaaacctaggacgaaaacaaataagaaatggataggtaatggcgatagccatgacacggagatggtgaaacggattaccagtgatgcaagggcgacgacggcgacaatggggaggcggcggctacaggaggtggctggcggctagagctaggactccaacaaaatgaagaacagggaaaaacgaaggggtatggtggcttatataggggtggagataaaataggtggggccggaggggagaggaggggagtcggcaggggagagggagaggagaccgactcggtatggcagaggggaggcacgcgcggccgaggtggaggggcggcggccgagtgggagagggggaggggaggaaaaaaattggagaaggagaataggattaggactttcccaaaaaggaaaacaaatgcggtgtcgttttaggaaaagaacgaaaacggtcccgcgaacgataacggacatggcgaaccatgcaaaacgaaaccgtggacagagaggggagtgaatcgggcacgattcacgaccaaaggcggggaaaaactattattacttcaaaacttgacaaatttttaattaaccacattaactccgatgctctttaacttcctctttaagtcctgttag

SEQ ID NO: 21394 - DNA, 1501 bp, Oryza sativa
  unsure (1)..(1501): unsure at all n locations
agaaaaaaagtcaaacgacttacaatatgaaactgggtaattaaagcaggaaaaaaaatctcggcgcggcgacttaccgaactttgccggtcgccggacgaggctcgccaccggcttgtagaagtcggcgtagacgagctttgtcgtcggatacttgccgcgcatgcgctccacagcctcccggagcagccagttgtggtactgagccagcccgttgagccgccggaggcaccccgtccgacgatcatacgccgccgccgccgacgacgcgttggctgccgcgtacttggtcagctccatcnggcatgcaccccgccggcggcgtccctgtcaccaccacgtacctcgctccttcctccactagcctctgcacacacacagacacactcgtagtcttagtcggcgccggcggcgacaaatgcgagcaaatgcaatggacattgggcaatggtgtttgtgtttttactgttttagttacctcgacgcctcggcagatggctcgcacgacctccggcacgaaggacttggcctgctcgaggctcttgccgccggagaggaggtacctgtagtcgctgcctccgaactcgccgacgacgaacagcgccgtcgcgaggcgctccgtcgcggtggcgttgccggcgcgcctcaggaggctccggagccacccgatctgcacgcggagggagctctggaacggcggcacgctcgcgttgttgcgccggatgaagaacccgacgtccagcgccgtgccgccgacgatggcgaagttggcgccgccgccgccgccgaagtcgttcgcctccttcgccaggaacggcggcacgagtgggagccctagcgcctccgctgccgcgcgccattgccaaaacagcatcaatcacacagcaacgagaaattaatcaacaacggcggcgacggcgacggcaactgcgtagaacacgtaccgatgaagtcgatgggaaggcggccgtcggaggggcggccggtggggcggcggaagaaggtgtcgccgtagggggagtggttgaaggggatggacgggaggccggcggactggaggacgaagttgccggtgtcggagtaggagctcccgaagctgaagatggagttgaaccgtggagggaacgggtcgccggaggcggccgcgccatggaggaggaagcacaagacgacggcggcggcggccgtcagcagcggattcatgaggtaactgaagcaaaatgggagtgggtaatttgcttgcggtctgaacattgaggtatagatgaccaaatggaccccgtccgggtacaatcaagtgtcacatcccgatccggcaccgccgtacaacggcacctaacaggagcatgccgtaggaaaaacggcgcgaaccgcttcctacgaaaccgcgatctcaatagcaatcccacgacaatagcgctggtacccacggtgacaaatatgaataattgtaattcttaaaataaatagaggacttattttccttaacttagattatagc

SEQ ID NO: 21395 - DNA, 1501 bp, Oryza sativa
aaaattcatttttaacaccaaccgggactaaagatggagcccttttagtcccggttggtaccaccaaccgggattaaagatggagccgggctagatctggttgctcctttattttttttcttttcttcattgtttttaatatattgatttcaccccatccccgaatcccaaatcaatcatccccgaatcgtaaaatctcaaatcaattatcacctccaaatcctcaaatcgatcatctccaaatacatcacaaaatcttaaaaaaattacatcacatgttctacaaaattcatcacaaatatatcacgtattcacatcacacacaaatcaaatacatctcagatccgaataacaaattttcaaaaaaaaaagaaacaacccaaatagatatttagtcccggttggacaaccgaaactaaagaaaatataggggtccactacctgccctcttttgaaccgggactaaaaatgctctttagtcccggtgtttaatacaacccggactattgtgaaatttggccaaccgaccaaagatggtttctccagtagcgctaccccggtcccaccttccctaatccacaacaataagccctcctcgaatccctctctaatcagtcgatgacatgtgggcccatacccgtggaagaaactgattaaaatcttgtttaagatatggtgtcactgacgtgtggtctctatggccaccatggcatggtcaactataaccccggccccacatgtcaataccacatgcccttttccttagagaaaataatttcaaataggaatattaacccgtagacccctgctgtcagtgattctaacgtctcccagaagggtaatttcggaaaattagtttaaaatgacttgagagattatttctgtgaagagaaatatgaattaaaatttgaaaactcataggtaattcaaataaagtccaaatcaagtgaaacttgtctctaaaattttgtaaattcaagctgtagaacccaaataggaaataacataaactaggtaattaaatatccgtactaaaaataatgttaactccaagtaatgggaataaagattaacatgtaaattgcaaaagacactaccatgagacatgaggaactcttgttttacgaatcatgatgaagatgaaatcttttcacaacatttcagatatgcaatccggtttcataccaatactgtaactgttataaaataaataagtcacatgcatgaggatctagtacagatataaaataagggaaacagctctaacattactgtatctatgttcagaatttcattgtattagcatttgctcgacgagatcatcagtaattagtaagtgtgaacatggtgagcaaagcgtacattatcttactacgaagctagcgtacgttcactgacgagcttacatacagagtaacttctctgctacgcagacatccctgtctacaacatcacacaagcacgggatgtacaaattaattacttaatctaagctctccta

SEQ ID NO: 21396 - DNA, 1501 bp, Oryza sativa
cttgtcgctccacctttgtggtacttcggtatccgtgctctctgagcgcgtataccaactattccacatacaccgttgtttgtcgataattgaggaaatgggttcgagaagccttgaaaacccgacatgtggtgtcagtgtgtttgaaaataaaataaattgtgaaaactcgcgatacaggggttgtgcctgtgtggcgttgtcccgtatttgcatataaggaccaattcatgtgggaaattcatccgagcatataacaagtgcgaccacacgggtagaatgagacgctcttggttgagtaaatagcaaaccagggaagccttgatgccaagagacaagtggattcaccggggtggtgtcgaggagaaccactgggcttcctggcacggtatggtctaggacctaacctgttgttggtttgggacccctctcgttggcatatggcgactctgtatcggttttcgaaatgccttgtcatgaaagccttaaggtctcccgacgtggctgatctccacgggctgggtgatccgagttagtaatgttgtgtgggtaaagtgtaccccatctgcagaggttaactaactgttcgagcagccgtgcccacggtcatgtgctgatttgaggtgtttcccgttgcgtagttttgtttgcatgtgctttctgaaaagttgttgtggatgggaatcgttaccagaatcaacctatgtggcagatggatgacctgaatggtcagaaacggatctatatgattcagatgtctacgggcattatagactaggcttcccgagtggaagcagattgttgtgctgctgggcaacatgactctgggagtccgagaaaatgaaaaggctctaggagccgattaataagagaaatggctctgggagccaagaagtaatgatacgacccgggaggtcagtacattaccatttgagttgttgaaaagcatctcttaagtcgaatcgagacgcaagtctcttttcgacccaaacctgaaaagaaataaatcacctaatgatttcaaataaaaaatttgcataacaaccttgcctctcttccaagctgaagttgaagaagaagtaaagtgaagattagggttacgtcttggttcccagccatcgcctgtggtgttgggtgttagtccattggttccactgctgctactgttgttggtgtttgcctcgtatgtcgtcggttctattctcgggctgtcctgagctataatctaagttaaggaaaataagtcctctatttattttaagaattacaattattcatatttgtcaccgtgggtaccagcgctattgtcgtgggattgctattgagatcgcggtttcgtaggaagcggttcgcgccgtttttcctacggcatgctcctgttaggtgccgttgtacggcggtgccggatcgggatgtgacacttgattgtacccggacggggtccatttggtcatctatacctcaatgttcagaccgcaagcaaattacccactcccatttt

SEQ ID NO: 21397 - DNA, 1501 bp, Oryza sativa
agatctaatctccaaaccaggagctaagcaaattattaccaggtataacatctataattattgtgagaggtgtgggactaatcacgaaaaacattgctcaactcgcccataaccgcgggcacggctattcgaatagttttactctggccagaggtgtaccactgtacccacaagacacagccccacatcatgtcaccatgtgcctcagtaccaccacggtacctcggaaaggggctgtgacagtaccccttgcataacacaatccaccgcagcgcaccattcctggatcataatcaccccctcaaaaaccagaggcatggactccccagcgacccccgtgggcttatctccgccacttctcagtctggtgctccgcaatgaaccatgttatacaaaaggtaaagccgttgcccacgctggcttgtggttggcacggttaatgtttcacaacagtagctcgcgaaccggtccttaattgtcatgagcacgactctcaaaaccatgtgctcacaacccaccattatcaagttttagttggcaagtaattaattaaccaatcacgattgaccatcatgagctaccattaaaccatccttaaataatgagtcataagttatcccaatagtgtgctaatgtttctaagcatggctaagcaatcatatctaatatctagctgaaccaatatatatagctcaactagtcaagttataatcacccaaggtatcaaggaataaagtaatcaatgtaaacaggccataacaaaggaataggttcacaccacccagtgacattcgaaaataaatgcacagttgaaataaatagagaatttaaatataggatcaacatgctcaaaggattgtgtttaggatctgtgtgacttgccttgcaataatcggtcttcaattaatcttcttgaatacttccggcgcactcgcgaaccttcgcaacgacggaaacgacaagctaacacgcaaaacgaagaaaaagactaataaaaaccaaataaacaatacatgaaaagtaaacaaacatgtagatcataattttagatgaattatgagacttgaacggcctcattctgacttcatatgaatttattacgaattttacaagattaaatctaattaaagcccatttaaaaagaattaaataaatttaattcaatttatggacaattttaatatgtagatctttattttatataattttttgcaacttgaaccacattaaactgagttacagtgaattagttatgaattttcaaagattaaatcggattaaaacacttatatggattttaatggaattatgacgcaataatgaattatttttgaaaaggaaaagaggattattgcgtcagcgggtcgggttcacggtgaactgggcgcacggcggcggctcacggaaacgaacggccgagatcgaccctatccaaaacggacggccgagatcgattggtccacgaccggctcacggcagacggcgacgatgacgtcagcaa

SEQ ID NO: 21398 - DNA, 166 bp, Oryza sativa
tcaatctactatctcatctccctttctctgcttttcccatcttctctgctcgtcgccaccacggggcgacggccgacttggcagccgcgtcctcgccctcccacgttccactcgtatcccattagatcacttcccggagctcgtgacaacttggtatcagagacta

SEQ ID NO: 21399 - DNA, 1501 bp, Oryza sativa
caccataccccttcgtttttccctgttcttcattttgttggagtcctagctctagccgccagccacctcctgtagccgccgcctccccattgtcgccgtcgtcgcccttgcatcactggtaatccgtttcaccatctccgtgtcatggctatcgccattacctatccatttcttatttgttttcgtcctaggttttgatccaacgtcgttgtcgccttcgcgtgttgccgttggaccatcgtcgtcgtttccttctcgccgatcgcctcagtttggtgaggaacctatccgtaattctctgttttaggtgttgtttctttttagcgtcattgtggaaaccgtagttgtttagcccgagccgccgctgccgtccgtgccctggcgctgtcgtcgccttgccgccgctgccgcgccacctcctgttgccacgccgccgccttagccgccgccgtcgctgccgctagccgatcccaagccgagccgagccgccgccgccgttgttctaggcgccgccgccactctcccgcgtcgccgtcgtagtttgccgttgtgtcgtagctcggtagccgaatagcaaagccttaggtgcagccctaaactcataccggcctatcgtttgccgtaccgagtctctaccgtaaactgtgtctagttttttgttgtcattccaagccgccgattccgttcgccggttcggttgaccgttgggatggccccatggcacgataagttgactcgttgagtcactaattcttgaggctttcttaccggaggtataattccattgatctatttatctatgggcaataatgtgtaataattgactaaggttttttcggttattagtaataacgcagctcatcttttaaaattcagaacttaataatccgagctccgttttaatccattcaaattgcagtgaatccgttaaaaagtatagaatccattaaaatttgtttattttgctatttcagtagacttattgcttgtatcacctgtgtgctttgtttgtcgtttagattccgtcagttccggtgatccagtttatttcgaagtggttgccgaggttcagtcagctcaagagcaaggcaagtcatacatacatcattgattatattgagcctattttacaaaatcccctgctttctattaaaattgcattgttttagaatgtcatgtggtatggatgccttttattctcagcctgatgaatatcttgtgcctttgataacttgggttatatttgatttattataatttagtccttaattactttatgtacaccaccatggttatggtttaattaaattaaaatttgctttaatggtgggtcgtgggtacatgcatgattttctggaagtcgtgcccatgacaattaaggaccggtttctcgggaatccctagaagatatactcgtactcaccacaggccagatgagctccaggctaaatctagagtataacttaaactagataacataccatggcaagggtagaggcga

SEQ ID NO: 21400 - DNA, 188 bp, Oryza sativa
atgtgtttatgcaaataaaacttgcttatgctaaaaagaaccatactatgccttccttgattatatgccttgcaagtagggtgttaggcttgtcttggtgcttgccagtacattatttctaataatatactgactcttgctgttgaattaacttttgcttgcaggatttagacttagtctttgagtga

SEQ ID NO: 21401 - DNA, 1501 bp, Oryza sativa
attgtcatctgctccggcagcataaagcactgtcgagtagacttgaaggaattcttctgggtcggtgctcccatcatacttttcaatagctccgggtcggaatctctcaggccatcggacatcacgtagggaacgacttaaagccctacacccagcactgggagcggtgggttgtcggtggtcgcgtgaccttctggatgtctgtctgacgatgaagaggacgcggatgatgatgatgatgacgatgggtcgcttggttccggcgtacgattacgaggatgacgacctggatctcgggaatcctgtcgtcgtctctcgctgttgtcttgtcacatcttgatttttgtttcaggatttataaattatttaataaattaataatataatttatattaaatgttctttaatttacaagtgaagttaaatgtgggaaataaaatttcttaaatctaaagcatggatggatttaatttttattaaattctccatgattaagtcaactctctgaaatattctcggatttttcggagctcaattcctaaatgatacaaagaacagttcagtaattatttgatcattaatgatctaatgatatttgttaagagcttttcttgtttaaaatccttaaattataaattgttgtttaaaaggaataattagaaaagatcttaaaagcctaaaagagaagatctaattttaatttgctaaatctcaacataaaattgggctagataaaatttcattaaatactttgcttaattctataattcctagatttttctgggatttatttgagctaaggaagtatttttaataaatggaattgcatttcatgaataatttaaattgaaaaaggtttttaaaagtcttcttttggctttgggccgaaagtcggcccaaaaccgctccctctctctcctcggcccagtccggcccagtccgctgagccgccgctcttctctctcggtgtcgctgacaggcgggacccacctgtcagggtcgtcgtcctcctcgcgccgccgccgccgcccgaaaccctagcgcaagccgccgccgtctccttccaaattcggccgatcctttccttctccggccgaatcttttgaggggaaatgatctcctcgatctcctcttccttttctcttatagaaactccggtcaatttcgtttggaaatcgacggacttgagttcgattcggatcgatctctctcctccgaacccttgctttcctccgccgtcgctgaagaccgccggagcaccgtcgccgccgtcgacccgatcttctccggcgctttttcctcgtcgccggcgccgtccgttgcttctccgccgcttctttggtcaccggtgagttcgccgcgtcgcgctctacgtcctggtgctcttcgtttgcgccgccgcgccgtcgttcaccggcgagcatgcgttgccgagccaccgccggtgctgacgtcatcgctgacgtcgttgctgacgtcatcgtcgccgtctgccgtgagc

SEQ ID NO: 21402 - DNA, 1501 bp, Oryza sativa
ccccagacctggctgatttgacggcaaccaactaggcgcaccttgacttgtattcccctccgggcgagccaatggggttgtacttgaaatgttgtggggttggttgagctgctgaaggaaagcttggagctgcgactgcagagccgaagccccttctgccattgtttgtggcacttggccaggtggctgatggtgcacttgggcagcgaccggctgagcttgcacttgcatgtgaggggccggatccgctgctgcgggcgatggctacccggcgaagtacattggcgcttgcgcgacttgtggcggaaggtgctaggtcggcacttgcggatggacttggagtgggacatatcctgtcgaatactggaggattggggcccacgtgagcttggttcgccttgccgcctcgtatgcttgttgttgttcttgcatttggcaaagcatgtcttggagccgtgccatgttctgccgcatggcttccatgtcggcttcggtttgtgcttcggggtcagggttgacttggacctgcccagcagcgagcggagctgaggccgctgccagctgcgatggggcggcttggggcaccagcagttggcttgtcgaaaggatctccgccctggtctggagtgcccttgccgccgcagccgccttcgccacgttggccacgttcgacacctgcacagaggcggcaagggccgaaggcagtagtgatggcgcagatgcggaagcagatggcgctcctccatcttcggccacgggcgccgaaggctctgcttcctcttcggcagccatgtccactccggcgtcgctttcctttcgccttgtaaccttctccttcacgaccttcttctgtggcattcgctctcagatgtttcgctcggaggtccccacggtcggcgccagctgttgtcgaaacgacaaccacataagtcggaagacgtggttactcaacagtggttggaaagaaacgaagtgtgttaattttagaattttttactccggatccccccattacatggccccaggggactatttatagccccattacaggttcttactactagggtttaggttatacaggggaatttacatggttgcccttacgaaagggacatttacagacaagaagcagaggaatgcacattaacagatggcgaactccgcttttctcggtgatggcgatcgtgatggcgattagccatgatgcctccctcgccgccgagtgggtgggatttccaccctggtaatgagatcagggatcagtgtcgtcgtctccatggtactccggtgcactcttcttctttctattgctttcatcctttcaaattggtggtggacgtcccccgttccacttttcgtcttgaggagtcctctgttgccattgctcttagagcttgtttgggaggttcccctgctggattttttgtttcgcatctcaatgatcggtgttacaatttctgtgttcgtgacaaatctgttggtttgtggatttacaacctcc

SEQ ID NO: 21403 - DNA, 1501 bp, Oryza sativa
ggtgtaaattcagcggataaatgcagagctgtcaggcaagctgttgatgatagtagttgctcagttttttgtttacaggaaaccaagaaggaaagttttgatactgcttatgttaagaagttagctccgaaacgctttgattctttctctttctctccttccgttggagcttctggaggtatcttggtctgttgggttgttgcaatctttgctgctaatgttatttgtatcacccggtctgctgtgattgtaaagttctttccaaaacactctgctgagtcctggactcttgtttcagtctatggcccgtgtgttgatcctgatagatccctctttgcccagtggttgtttgatttgcaaattcctgacaatgaaaattggatcctcttgggtgactttaacttttacagatctgttgagaacaaaaatagggcaggttgggatatgaatgacatgatgattttcaataatataatcagtaatcttggtctccttgagttgcctttgaaaggtaggtcttacacgtggagtaatatgcagaattcacctctcttggagcaacttgactggttctttacgactgtttcttggactgcttcctatccaagcaccttggtaaagcctttggctagatctatttctgatcatgtcccatgtgtggtccaaatagaaacttcaatcccaaagtctaatctcattaggtttgagaatttctggatagagcatgagggtttctttcagttgatttcttcaatctggtctaatcatgggactggtttggatgctgctaagaatataacatcaaaatttaaatctcttagaaaaggtctcaaaaaatggagtaaaggcttgtccaagttgtcctcactcatagcaaactgtaatctggtcatagcctttattgataatcttgaggagataagagatttgaccttggctgaatggaatctcagattcattgttaaaaggaaagttttgcagtacctgagatataagcaaatgtactggcagaaaagatgcactataaggtgggcaacttttggtggtgagaatactaaattttttcatgcagcggctactgagaggtacagaaagaacttaataactcacttgcagacagatgatggaagagttttaacccagcacaatgaaaaggcgcagataatttttcaaacttttcagcagagaatgggagtgtctttgctacctgttatgcactttgacctgtagagtttggtttctcacaatgatagtcttacccacttgtctgaaaacttctccatctctgaaattgatgaggttgttaaaagaatgcctactgatagagcacccggtccagatggttttaatggatgctttattaaaagttgttgacctattattaggcaggatttttacaccctttgtgctcagttttgtgaaggtaacttggctttggaaagtttaaatagatctttcattactcttgttcccaagaaatcaacacctgagagggttaatg

SEQ ID NO: 21404 - DNA, 539 bp, Oryza sativa
aagatggcaacccaaggttagtgtgcagataggcttacagactggatcaagaagaattcacacaaagaccttgtaattgtgtcgtgctctaagctcaaggggtggacgccctaaggctaaccctaggttgtcgttaatcatatttattcagtagccatcattgtttagagtcaggtttttcttagattatttccaacattacaatttcatcgctagttaggtttgtagaacccaacttcgagtgcataatcattcatctgcaactgagttgcaatctctcttagttttgtttgtgttattcggtttacatgtagggattagccttctcaatgaggtaaattggattttagcatgtttgattaccataagagatgtggtgctgcgattgtagagtttggattgtgttgatcagaaaccggatcatgcgcgtcaagttttcgtcaaatagagagttatcagtacctattagaagatcaggacctatttcctcatcagagtcagtctcaaggactacatatgccattaggaatagcaaatta

SEQ ID NO: 21405 - DNA, 1501 bp, Oryza sativa
ctggtagcctggaggaggaggaggaggagagagaggataaggcagccgcgtggtggagcatggaggcaagacgacggtagcgcgacacctggaccacaccttcgagaaagctcgtgtcggcgcacctcccgctcgtggcggcggcgccgctggtggacgcgctgcgcgcatcgcttgccgagccgcttatgctcctcgacctcgcccgccgcctcccgctccggctccaccggcgaggcttcgtcggagcgcggaggcgaagtcatcgtccgcctgcgagacgtggagaagatgaacagctcgtgcggggcgttgtcggagcgcggaggcggagtcgtcgtcgccgccgctggccatgtcggtagggagctgagttgacgaggcatggaaattatctgaagagagagcgacaaacagatggggctcgggtggatgagcgctatcccgtccccacgggataccgtggtttagtttttctctttctatttacttctaaaacatcaatataaatatatatatgtctagattcattaacatcaatataaatatggaaaatgctagaatgatttacattgtgaatcggaggaagtactttattaataactgtatccaactctaaaactctctatattttgggatggagggagtagttattattttgggatgtaggaggtagtttatacaactgattatctattggctcttgttttaattacttcctgttcctgtagcactagaagattttgggccaaaagaaagaaaaacatcatctttggccactacctgcatctccacgtcgccgtctccatcagatcattattcctttctccttcctgtcccttgtcgccggattgcaacaacgagtgcattttcttgtgaatcgcatcggcgttgtttgcaccccgcgattccccaatccatccatccagtcccccccctcgctggaatcgtgggtgtggggtgggttctgaggattcgaggcggcaggtcgcctccgaggattcccccttcgagttcgaggtcccttgttttcttgcgaggattgggggcctgatttagagggcgttgtcggtcggtctcggttttgcatttcttccagctcgggaccgacgaccctgggcgattcccgaggaggagtgagttccactctgatttcttggtgtagcgcggaaagttggcttttttgggtcgaattgttggtagtctcgctgcaattggtaggcgtcaagctgaaatttcccgtcaatttgccgcttcccgtgatgaatttgacgattttgcaggaaaattttgggctttctgaaccttggggttaaagatcgtcggcatgcctaaagtcgggagcttgatcctgtctggtgatcattcttgaatcgaatgcggtttgggcggcctcgtggattgggaaatttcagggtgaagtcttcgattcgaggccttcccgtgcacgctaagagaggagatcctcagcttcgagcatccatggggttcctcagccttg

SEQ ID NO: 21406 - DNA, 1501 bp, Oryza sativa
acccatctatacagaagcactgatacttcagctacatttttggcagacaaatggcatcacctcatggtgaccctgcgcggcggcgtagtgcagcggcgagttgcggccgccgaaagtggagtaccgggcgagccgcgggttgtactcgagcagcgcgcgcgcctcctgcaggtcgccgtcgcgggccgccgagacgagccgctcgccggaagccgagcacccaaatgagttgcccacaaggctgaggaaccccatggatgctcgaagctgaggatctcctctcttagcgtgcacgggaaggcctcgaatcgaagacttcaccctgaaatttcccaatccacgaggccgcccaaaccgcattcgattcaagaatgatcaccagacaggatcaagctcccgactttaggcatgccgacgatctttaaccccaaggttcagaaagcccaaaattttcctgcaaaatcgtcaaattcatcacgggaagcggcaaattgacgggaaatttcagcttgacgcctaccaattgcagcgagactaccaacaattcgacccaaaaaagccaactttccgcgctacaccaagaaatcagagtggaactcactcctcctcgggaatcgcccagggtcgtcggtcccgagctggaagaaatgcaaaaccgagaccgaccgacaacgccctctaaatcaggcccccaatcctcgcaagaaaacaagggacctcgaactcgaagggggaatcctcggaggcgacctgccgcctcgaatcctcagaacccaccccacacccacgattccagcgaggggggggactggatggatggattggggaatcgcggggtgcaaacaacgccgatgcgattcacaagaaaatgcactcgttgttgcaatccggcgacaagggacaggaaggagaaaggaataatgatctgatggagacggcgacgtggagatgcaggtagtggccaaagatgatgtttttctttcttttggcccaaaatcttctagtgctacaggaacaggaagtaattaaaacaagagccaatagataatcagttgtataaactacctcctacatcccaaaataataactactccctccatcccaaaatatagagagttttagagttggatacagttattaataaagtacttcctccgattcacaatgtaaatcattctagcattttccatatttatattgatgttaatgaatctagacatatatatatttatattgatgttttagaagtaaatagaaagagaaaaactaaaccacggtatcccgtggggacgggatagcgctcatccacccgagccccatctgtttgtcgctctctcttcagataatttccatgcctcgtcaactcagctccctaccgacatggccagcggcggcgacgacgactccgcctccgcgctccgacaacgccccgcacgagctgttcatcttctccacgtctcgcaggcggacgatgacttcgcctccgcgctccgacgaagcc

SEQ ID NO: 21407 - DNA, 1168 bp, Oryza sativa
ggaggaggtcgccgggtgagcgttggtcgaggaagcggcgaggagcgccatggcggtgccggctggccggtggccttttgtgagctcgtcgaggaggagctgtgcatgggccttggcgaaaggtggggaacgggacttgcagcggcaggagggagggaaggttgtcgaacttgtcgttgaggctgccaatgagcatgaggacgagggagcggtccttgatggactcgccgacgtcggcaaggttgtcagtgaggaccttgagccggcggcagtagtcacctatggagagatcaccttgctggagatgatggacctcagcggtgaggttgacagcgcgccgctcgccattgtcgaggaagtgcagctcgagatcacgccaaactgagcgggtggtcgtggtgggagagatgacttcctgcatgagagtggcagagattgaaccgtaaagccatccgagaacgacgcaatccatctgcgtccagtcggcttggttgaggcgaggaacatcggagaagacatgctcggtgagagcaaacttgccgagcgccacaacgaagagaccacgcctatgggagcagttgtcggtgtcgaggttgagggtgacggggacgagcgccttcacgttgaggacggcgatggcttgattgtgaagcgtggcgatggcgtcggtgtcgatagtcagcggtggcacgacggcgtcctatgacggggcggccagcgtgatgttgaaggcaaggcgagcaagggccgccagaacttcagggggaaggagcgccacgggcgtcgtcgggggcgcgaacgtcagcggaggcgcggtcctcgtcggcggaggtgcggttgtcactggagccagcggaggaaccgtggaggagacggcgtcgttggtggctggggtgtcgtaggctcttcggaccttccattataattgagagatgaaatgaataattcaagtcattaaacaagcataatgaaatatcctacgcctcgagagaggaatattggagacattactggtcctttagcctgccagtcaacttcagcctgagatgtgcccgtcaaaccactcgaaggcggtgaccagatgtgttacacattcaggagacttgacaaaaatggctaaagatctacaacatctcaaatattcttaactcatactcatgtgaatcta

SEQ ID NO: 21408 - DNA, 355 bp, Oryza sativa
gcagcaggcatctcgtcggttcgaccggagttcgatctcggtcagaccgacgttcatcaggcggttcgaccagcgcaacaccttcggttagaccgcaatccatcgaatttgagggtaacttttatttccgctataagttttggtttttgggtatatcaaccattcacccccctctggttggcttagttcttgtgattcgatcctacaagtggtatcagagccttgttttcttttttggatttttatcgatctagagtttttgccatggctactcccgctaggttttcaactaagcctcatgttttcaatggaaccgatttttctcattggtgtagtaggatgcaatcttatatta

SEQ ID NO: 21409 - DNA, 808 bp, Oryza sativa
aactgatttatttgaggtatcaaatttagttattaaattgtaccgaaattactgtgtgttgtatatgttaattagagcctacatgaattttccaatgattttatcttgcacagattattttagataattagcaagacttattttcctttcctaaatgtatgtaaatgtttttaaaacttttatatttagactcttcttaacctgaggtgatgttgatatgttagaattttagtttacctcatttcataagctccttaactatttatgcataagtttactctagtattaaattaagagaatgcttataaaggtaattaaggtggaatataccctatatgagttaatttatttgttcacttccatgttcatgactagtcttcagatggatgaccaaattagttttgtagggcttgacattgttcttgttgatatattttaaggtgtattatggttcctatgtattattttccattagttagcactaggccctaatggtttagttgtttgtctggattgcaattatattcatgagacctattatgaaatgcaaatcgaaaatccaaatgcatatgaaggactcaagtcaaaatatgatttatgcgagtatgcatgctttcacttgggttgcatccaagtcctaggttaaagatgaaaaagttttaatttgctctcaaattttattcatgcaagagttggatcaacttcacctaggtttaaaatggaaatttttggtttacaaaattgaagaacttccctttcaactagttttgatggaaattccttaatcctagaattcaggtatgttaca

SEQ ID NO: 21410 - DNA, 387 bp, Oryza sativa
gcccgtcaccgatgagtgtcatcggtgtcgggctccaaagaaggcccgattgagatggccttaatgcccgtcaccgatgactcttatcggtgtcaggcttctatttgtgcccgttagagattagtgtgcgcccgttagagatgacatttttttggcccgattgagatatactttgcacactatatatactccagcagtccgttgtctgtagtttatcccactgttcactattttggtgggaggttgaagggggcgaatttttgtaatttttttgcaaacaaaaacaggaaaaatcataaaagtaagtaaaaggtactaaacatttcctgttaatttagtagtacttatgttatgagatgttaactaatattgtgttcattgttcagc

SEQ ID NO: 21411 - DNA, 1501 bp, Oryza sativa
tctcccatgcctgcccctaccatcatcgccggagtccgcgtcgcggggcggcgccgctcctggccgccgccaccgcggcggcacctgctcccagcgcctcttcctcgggcgcaccgcccgcatatgcgggatgagagagagaggaagagaaagacaggagagagggtgagagtgaggaagagaaagagtgagaggggaaaataccagagatgggagagagaggagagaagaagagatgaaaaattttgaagtggataggagggaaaaaattgtttagatgtgaaatatttttacatgcggaccacttaaagagtccgcatgtgaaaatagatttttgcatgcggctctttaagaggaccacatgtgaaaatagttattaaaaaattaatttaaaaatataagaatttcgaattgaattttataatgctaaatgaattcatatgaaaaaattgtcaaaaacaaacttgtagaactcattgagatctaccaattttcttttggtcatttcttcatccaagtttgattgaactatataaaatttaaattttaaaatataagaaattcaaataattttttgggtagtaaatgatttcaaatggaaaaattgtcgataacaaagttgtataacttatcaagatctacaccttttgttttggtctttttttatgtgactttgtttgaacaatttaaatttgaatttcaaaatatgataacttcaaacaacattttcaaatactaaatgatttcaactgaaaaagttatcaacaacaaagttgtataactcattaagacatacaacttttattttagtcatttcttcatctgacaaagtgataataatattgttcacaaagtttataaaactatatgagagatatgtaaattttgtgaacaatgttagtatcactttattgaatgaagaaatgaccaaaataaaagttgtatgtcttaatgagttctacaagttttatgttcatgactttttcagctgaaattatttactacttcaaaatattatttgaagttttaaaattcaaaatttaaatttataaaacaaagtcataagaaaaatggccaaaataatagtagtaagaatacaataacatgacagagcatgattttagaaacatttagaaaaaaaatcatccaatttaaagtttatatgagtgtcggtgacatggggccgggggtatcgtgactagaggcttgggtagccgcggtcacccacgtggcccgaccccctcgggggggtcgggcccgaggatgacgtggccacccctccctctgtctccccgaggggtcggaccgctcccgtttcggccccgagggctggggcgccctcgttttggccccgagggctggggcgccccgaccccctgtggttttggcgccatgtgtgtgggttaggtgagcacagcggggctcacctaatcacatttatagcaggttggacgagcgcgccacgccgcatttaatgcggcgcagcgcacgcttatccggt

SEQ ID NO: 21412 - DNA, 313 bp, Oryza sativa
gtttttgaccggaatgaaaaagttcaaaaagcaccacaacaagatttttggacatattagagtgtattgggtgcgttcgtggcaaaaactcacttcgtgattcgcgcggtgaacttttgtcaattaatgccaatgttggcacacgagggtgcgatgtttttgaccggaataaaaaagttcaaaaaagccaaaacatgatgtttggacatattggagtgtattgggtgcgttcgtgtcaaaaactcacttcgtggttcgcgcgacgaacttttgtcaattaatgccaatattggtgtatattggcccacatagg

SEQ ID NO: 21413 - DNA, 490 bp, Oryza sativa
aatggtcatctgaagggagaggtatggaagagatcaaaatcaaattttagaggtataggaggaagtaagcagggacgtagaagggattagctgaaatttcagaggtatagaagggattttctcttaattttagcggtgttaacctattaataggtagaaacaggatttttaaaatatttatatatgaatttggaaataaacacttagataagtactggagatatattttttatgtattaataatatattatgactgttttcttggtattgatacaatttcatatattaaatcagttacatctattaaattggcaaacattttttaaaacaatgataataattcgtggtagcaatatacaaatttatatataaccgggacaaagtgatttttgtctgaatctgggagacattctatcatttaggatattaaagtttgtgctctatttcaccgcggacatattttttattataaggtaatttatggtgacta

SEQ ID NO: 21414 - DNA, 275 bp, Oryza sativa
ccaatatgatattttcactgtcctcttatgcagggaacacgttttatagtaaatgtgactgttagaaggatatgcaatgaatattcttgctggtacaattcatgtcgaatatgctataaaacttcaaaaccatatggctctagctacagatgctccagctgttctaacatcggaataccagatccaaggttcataatagaacacgctctgtcttcctacatctttagcaattatcatccacacattgctatggccatatccatttttcatgcagg

SEQ ID NO: 21415 - DNA, 353 bp, Oryza sativa
aattcctgcagccccaatcagtttttgctcttgaaaatgtaagggttggcaatgcctaaaacttgccagaaaatatttggttaattgggccttgtcccaaatagtggcggttttggtccctggatccttggcttcttcaccaaggatggtctacttatgtcattataaatcctttgaaaaaccgttcgttggtcttgacctgatgtatgctaacaagttatcaggctgtcatgatagcaaaacacactctgaaattaaagaacttccatataatcatgtagttataatgttcacctgtatgcattaaattttagctagagaagtgcactgactcttgaatctgactaacaata

SEQ ID NO: 21416 - DNA, 185 bp, Oryza sativa
aagtttgtagaaaaaaatagtaacatttgtaacccaagaagaattattatgaaaatatatttaattattgatttgatgaaactaatttagtattataaatattactatatttgtctataaacatagtcaaacttaaaacagttcaattttaaccatagtcaaaatatcttataacctgaaataga

SEQ ID NO: 21417 - DNA, 613 bp, Oryza sativa
accttacgacatgcaacaattaagaaatctgcatcttcatcacacttttgtaactgtgcccacagacgaagccaatatgttgccttgaaaatgacctgcatataagtaatagtaggtgatttgtcaaaaaccctatcattcctatcagccacagtgcccaacacaaggcagaagctccaacaagtatcagtttgctctttttgtttatgactccctgaagccaatcatcaaaaatatgagatatgctagtaggaatatataaaccaaaagaaaactgaactgccctccaaataaactttgcaaaatgataatcaatgaacagatgttggatagtctcattttcgtacaaaagcaacatcttaaattaccagtccaattcggtcttgctaaataatccttggttaacacacctcctttaagcaaataccacataaagatcttgatcttaaccggcatcttgagtttccaaattaacttatttctgtcaatgtaaccattattaattaaggctaagtacattgatctaactgagaattggccattctgatgatagttccatctaaaataatcaaaagtattattcaattgaatatgaccaatagatgcacacaat

SEQ ID NO: 21418 - DNA, 1501 bp, Oryza sativa
gctgtctgagctgcaacctaagttaaggtaaataagtcatctatttattttaaggattgctatgattcatatttgtcaccgtgggtaccagcactatgtcctgggactggtaccgagatcgcggtttcgtaggaagcggttcacgccgttttccctacgacacgctcctgtcaggtgccgttgtacggcggtatcagattggggtgtgacagctagtttgtaataattagctgtagctctttcgagtaaaggccgggatgctatttcattccattatctaaagaaaagtttatccgtttggtaatattgtagtacgagttaagggtgtgttcggaggtgggtgttgggaaccatctcccatgcatgaaaaacggagctatccattaacacgtgattaattaagtatttgttaacttttttaaaaaatggattaatttgattatttttaaacaactttcatataaaaacttttttaaaaaagcacactatttagtagtttgaaaaacatgcacgtgaaaaacgagaagaggggttgggaaactatagtagtaggactcaattatccgtacaagtagcgtgtgatgcaagggaggaatagcgtgctgggataaaggccggcgaagcagacggctggccaagcccaagcagctagcgtgcgtagcgtaacaacgacgtcgttcgtccaaggcgccgcgcgctggcagggcgcagcacagcgaccggcaacgtgtacaggcgcgaggctgatcgaggcggcgccggattgggccacacacacgcttgcatatcatcgtatcgtgggccatcacgtggcggcggcgccatcgatcctgcagagccgcggcccgcgattcacctgggctagccgcgaaccaccccgtgaactagcggcaccgtcctgcccaggccgccgcgccgcgtgcacagcttgcgcgaaagaacgagcgcatcgcaccatgcgcgcgcgtggggcgcctctccacgagcgacggctgatgagtcgcccacagtcccacatgcatatccctcccctacccgccggccgccaccctgcgtgccacgcttgtatggagatttgataatttgacacttccgttttcagagtctcttcttgtgatgctgtcgtaaacctggcgacgatcgactacgcatagcagggtcgttttagtgcttacgtggttagcatgtggtttctgtcattttttttactttattccttcttaatatatttggatggtccccttggccttaaaaaaaagaaaaaaatatttaatatcctaatctacatttatttactatgatctcacaagtcactctcaaaaattaccaattaaagcaagtcgacaacgataaaagtgccaaattatcaaatttcttgtagcaacggatatttgatacgcagcccagctgattgtatccatggtttgttaccaaatggaacagctcctcattccacagaccacagcacagtatatatgttcaagagagagagccacaaagg

SEQ ID NO: 21419 - DNA, 1501 bp, Oryza sativa
agctcgccatgcgctcttgctctgtcccggaggccgcctctcgtcgccagccaatctcggtgccgctccgtccaatccgacgccggaaacggattccttgaaccccggagatgctcccacccctttgaatcgaaccctcgtcgtctcgtcgtgttttcccctttttgctctccggtggttgccgcgccgcaatccatcgtcgtcggctcctctcccgtcgattcctctcgctgccacgctcccggggatccccttgacctccccctggctgccccaaggccgtcggtcttctcccttgtctccgcgccgtgtcgccgcttccgccgccgcataacgctgccgtgcgtgcgccgccggtgaccatcgggtcccgcgtcaccgcgtgcgcgtcgcaacaccataccggttcggctaagcccgagcccgcgcacccttcgctcttctcgcgcgcggccacgtcggcgtgccggcgagattggccgccgccgccggccgtcgtcgcgcgtcctcttcctgatccgagccgtggaatgagttccccttctcctcctcctgccgccagtgctagccgccccttccggctcgccgccgttcgccggatcccgccgcgcgccgtgggccgtccaatgagccgcccggcctcctccctcgcccgtgccaacgtggctgtccacgaggacgccacatctacctgcccggccccgcggagaccggtcaaaggtctcccggtccaccgatccaacgcgccgccttgcgtgcaccccgctcgcgtgagccgtgtcgtcgccttgtgggtcccgcctcgcgcccgactcggtggaccgcgtccatcggcttgcgtcgcgtgggccgcgcctcgttcggccttgggccgcctccctcccgcgcgccggcccgctcgcctcggccgcgcccgcgcatctcttcgggccgcgccccttcgctcggcccaagtccaattaacatccctccatccttttctttttccagggatttaataaatcctttttcctttgtcccataaatcaattccttattccaaaattccataaaccatttcctttggtcccgcatgacagtgactgtcaataatattcttgagaatattatttctacaaattccataaaccatttctcctattccagaaactccaattaaacttccaaaattcatatcacccaattcgcaactccgattgactccgctcaacttccagtattcccataaaattgagatctatttaatggcactactaattagtctaaataggatctttcttttggtcttttgtttaggttttcgattgtttgcgtatagttgcggttaccggattttcgtcgatcgcgggttttcttgaagattcgtgaagcttcgtgaagactttgagcaaggcaattcaccctttgatcaattgcccctataactaaaaagtcattattattttgtttgcaacttgcattattagaatcacacacttaacttgcttggcctcggtttgcg

SEQ ID NO: 21420 - DNA, 518 bp, Oryza sativa
tattgtatatactggtcctcttctcttttaaaagattattagagtatatagttagttttagtgctgttttggtctcagtatatacctggagtttctcatgtactcactaaatttgccccttgacctacctcatcaatggaatatttactggttgcaattacttgattccttcatttatattagaattgatcttagcatcatatttggcaatgtcacaatgaactagaagtgattggattcttatatagcagcagtaactatttgatcctagttaagctagtggtgccgggttttgacaatagatggcccttgatcctaattaagtgtagaaataggcagtctgagattgttagtttgcatagttaccgcagggtccaaatattctggagattccaaacaactattttgaaactgtccaaatatacacttcttttttttaaaaaaatgcatttcttgggcaatttacactacaggtttgccttatacttgaccggtgtgctaattttgtctttacctac

SEQ ID NO: 21421 - DNA, 1501 bp, Oryza sativa
aaatatttaaaaaaatagtcacacataaagtactattcatgttttatcatctaataacaataaaaatactaatcataatcttttttcaaataagacgaacggtcaatcgttggatatgaacagtgctaaaactgcacttattttgggccagagggagtatgagttaaaaagaacatatatcgcttaaagtgaagcatcacagattctccacaggacagcaacacagaactaacaacatccaatttcatacccttgcgcacaaaccaaaaatagcccaaccaaaagtagccctaatcgagagccgcccaaaaaagaaaaaaaaatcacatcccgtcacgagatgagctttcctacggttcctcaactagaaccggctgacggatcgaaccacataagcaacgaaaccgacggaatcaaagtggagatgggtttctagggttccgaaagcggaggggatcgagggtcgtggacactcaacgcatgaggtgaaacttcaaggtgcatggagttacctgcgcgggaagggtgcgagcgacgatggcgtgtggacttggcaccggcaagtccccgccgcggcggccgcggcggtggcggtggcggcggcgctctaggggcgaggagacctccgctcccgagcgatacgagggggaggagagtgacgcggccagcgtggtggtcgagcggagccgatatatattgggccgctggtttcacgcgtggcctcggatgggcctagcggatgctatccatgaatttccgtgggcttcacggcccaacaggttgcctatttttcttttggaataagttcattttgcctccttcaactcatgtccgacgtcctgctgctcctgtcgctccactgaggtcccgccgccgccgctcccgctgcctcgccgttccggcgaggtcccgtcgctccggcgagctcccgccatccgcctcgccgctctcttcatctcgctcgtcgtcgagaataaagagggaggagatgagtaactgacatgtaggctcaaaatttcttttcctttctatttaggtttctttttactttagtgctacgtaagcgccacgtcgatgcacataggataaagaccaagtcaacccgtcacgtaagtgctaggtaagagaaaaccgcctccgaaaccaccgagggagtcgatttgcaacggtctggttttacggttgaggggtgcgattcaaccagacgcatgagtcgagggagataaagtagacttattacttttcttttctcttgaccccctgggcgaagcaactgccaagtgggccctcacctcgtcgtccccgccgcgtccgggcgcgtcgcgtcgggcgcacgcacgcaccaaccgaccatcacggcgccaccgcggccacgtggcgttctgtacttatacccccctctcccgcgatctcactttcccctcatctccgctccattcccccctcccgtgtcgcagcgagaagcatccatcggaattctcgtcgaccaccgcaaccgcca

SEQ ID NO: 21422 - DNA, 1501 bp, Oryza sativa
tgcatcgacgtggcgcttacgtagcactaaagtaaaaagaaacctaaatagaaaggaaaagaaattttgagcctacatgtcagttactcatctcctccctctttattctcgacgacgagcgagatgaagagagcggcgaggcggatggcgggagctcgccggagcgacgggacctcgccggaacggcgaggcagcgggagcggcggcggcgggacctcagtggagcgacaggagcagcaggacgtcggacatgagttgaaggaggcaaaatgaacttattccaaaagaaaaataggcaacctgttgggccgtgaagcccacggaaattcatggatagcatccgctaggcccatccgaggccacgcgtgaaaccagcggcccaatatatatcggctccgctcgaccaccacgctggccgcgtcactctcctccccctcgtatcgctcgggagcggaggtctcctcgcccctagagcgccgccgccaccgccaccgccgcggccgccgcggcggggacttgccggtgccaagtccacacgccatcgtcgctcgcacccttcccgcgcaggtaactccatgcaccttgaagtttcacctcatgcgttgagtgtccacgaccctcgatcccctccgctttcggaaccctagaaacccatctccactttgattccgtcggtttcgttgcttatgtggttcgatccgtcagccggttctagttgaggaaccgtaggaaagctcatctcgtgacgggatgtgatttttttttcttttttgggcggctctcgattagggctacttttggttgggctatttttggtttgtgcgcaagggtatgaaattggatgttgttagttctgtgttgctgtcctgtggagaatctgtgatgcttcactttaagcgatatatgttctttttaactcatactccctctggcccaaaataagtgcagttttagcactgttcatatccaacgattgaccgttcgtcttatttgaaaaaagattatgattagtatttttattgttattagatgataaaacatgaatagtactttatgtgtgactatttttttaaatattttttataaaattttcaaataagacggatggtcaaaacgccgagcacgcatatttatggctgcacttattttgggacggaggtagtactgattaaacctgaaaggtccgaggttgggttaaggattactgcaataggtaagaatctccaaagtcgatactgtggactattatggctgtttcatgttgtgtcgatcagcttcagatttctgacacctagctctttactactatgtggatgaaatgaattcagaactgcactcttagtaaaaagcttgaaaagcttcttgaattagcttgtagcaagtcatagtttatggtctgaaggtgtaacatttatcttttggtcctcttgcattcatgtagaaatatatttagggaagagctataattggttcctttcttacttcagggatttgttcacga

SEQ ID NO: 21423 - DNA, 174 bp, Oryza sativa
gcagccgtgggcctccgtcgccgctcgctagcccctttataaggacccccagtgtctcttctacccgccgccacctttgccttagcccgccgtcgtctctagcgccgcctccgcgtagccctagtcgccgccgtcgttgccgtcggttcagccgcgccgcgccgccgttgcagc

SEQ ID NO: 21424 - DNA, 773 bp, Oryza sativa
cctccccttcctcttctcctcccctctccttcctcctcctcccctctactccgtcttccatcagccggccggcggccggcggcggcagcgcgtggggaggcgggcggttggcgtggggaggcgggcggctcggccgcgtgcgtggaggcgggcggcggcgcgcggggaggcgggcggcggcgtggcgcggccgcgcgtgggcaggcggccgacgtgcgccagcggcggccgcggccgggcgccggctcattttttttaataatttgtggatgtataattttttagattttttgattcattgcatcgcatggatctaagatgtataatttgtataatctgtgatgtatttaatttgtgtgtagttttttaggatttgtgatatagttgatctgtgtgtaggatttgtgatgtatttgatttgtgtgtataagtaactttaatatttgggatgttgatttggggatgtgcatcccattagattcgggagaaaatatatagattaacactagccattagcaaaatcaacaacaaaataaaataaaaaaaatctcgaggaactgtcgtgaactgtcgcttcccaacaccaaccgggactaaagatcgatctttagtccgggttatttgaaccaggactaaagataacgatctttagtcccggattcgtagttccggtaggaaaaccgggactacaaagggttctaaaccgggagtaaagaatatttctccaccggtgcccccttggatgtgaatagcaaaaatgagttactagacaa

SEQ ID NO: 21425 - DNA, 1501 bp, Oryza sativa
gatcatagcacggttggcataaaaccattgtttcgctttcccaaggagggaaaacggaaacagtcgcagcttgacagtgtcagaactgacccccttcatcgtgtatgagttgcagatctctaggaactgttgcagatgactattggcatcctcattaagcttgccgcagaacgggctagccagagccatcgtgatgaggctggacttcagattcaaatccacatctcccatgttgatttgcagcccagtggccacgttgtcagcagagggagcaacgaattcactgagggtcttgtcagccataatcttgaaagttggtggcgctggtatgattggtttctttgtcgggtgagttttctgcggagcgacaactcgcggcttgacgcttcgaaagaaatccaatggattttctttgaagttttctggcaagttgaaagcagtcatgcactaccctgtttccacaataaaagtgaaaacaaccaaggtttgcctgcaaaggacagtgattatacaaaggtaaatataaagttttagtaatggtaatctcttttataaatcttccccggcaacggtgctagaaatacttgttagtatttcttaacgacatcactagaaatataattctcaacaatggcacagaaatactcctggtatattatggttacagagtttatccgcaagcgcacggatataccattgttgcatttcacccgaaagtattccaaggatttcgtatttgtttaatcccgtggaagattatagtacagaaaaccgtacaaataatttatatattacttgtaataaccatagtctaagtaggggttaatataattcatagggtagaatgacacacaattataagactactcattcttatattaaactatctaagctaagttgaaagaaaaatagaaaagaatatatacctatacttctagtatacatattatacatacatcctagctataagattaattagctaataccctctttccgatgcccttctggtacttcgagaagccacccctgactgccaagttccttatgatagcccgtcatgaccatacaaacggggataaatacggagaagtaccctccccaggaaattaacttaggactatatacacgcgcggaggaatacccgtactgagctatcactatcagcagcccacctctcttaaaccataaagctgcttgacagattaaagttttccatgttgcatgaatgtaaggtaacctaaatgatcacaaatgaaaaataaaaaggtaaacagaggagcatatataataattgtgacatcctgaccaattaggatatggcttctgtggccactgatttttaatttctaaattactttgtttatgtttggcaaatctgaatgtaccaaggcaagataatgcgacttcactgaaaactctccattttgggttaaattccaaatgaaacttatcttgatcctcagtaagcactaggctagcggtttgtggaagaaggttattc

SEQ ID NO: 21426 - DNA, 275 bp, Oryza sativa
ctcgcccataaccgcgggcacggctattcgaatagttttactctggccagaggtgtaccactgtacccacaagacacagccccacatcatgtcaccatgtgcctcagtaccaccacggtacctcggaaaggggctgtgacagtaccccttgcataacacaatccatcgcagcgcaccattcctggatcataatcacccccttataaacaaggcatggactccccagcgacccccgtgggcttatctccgccacttctcagtctggtgctctgcaa

SEQ ID NO: 21427 - DNA, 426 bp, Oryza sativa
aaaaatataaacgtttgccgcatcagactattatagtaatgagtttgttgtgtgatgtgttatttatcacaaaatttatttttagataaagaaataaaaaatatgtatttattttttaaaagaaagtcataaaaatgataatcattcttacaaagataggactaccaatgctcacaataatttttttatgaatgctccagatcaaaaatatccattgtcctattagaatttcaaataaaaattttaatttattacatttgttttatcttcaaaatttatatcaaaaatttctgcaccaattatttactctcattagtttcataaatcatttttcaagcttatgttcaaacctaaagcatcaagggaaaaaagatatttgcaaccaaacataatagtgaaatgaaggaaaatataacagtaggggca

SEQ ID NO: 21428 - DNA, 1501 bp, Oryza sativa
aattatgtgctaatccaccgctatgttttccatacgtggagcctccagtaaagaacacagcctaaagtagccggtagaatcaccaccactaataccagataaagaaatattgtaaccatcattttgtttaaaatgtggaaataaatatctcattcacggattctcaggattcacttgccgtatattcttgtcatttacaaattctaattttttagataaatgaatcattaaaccacacaaaacaagatctacctagccacaaacacacgattttcagtgacgccttcaaccatctccgctctgggccagcgcactgctcctgctcgaaggcctatcgttgccaccgctcaccactcagcgggggttcctagggtggctgctagctggcgcgtgtgcgccagcagcgagcacttctctcctataacttctctatattagttaatacttaacactaataacgggtaattagagaagattcttaagatttttctttcttttttgggatatttttttactaacagattgaaaatttttaagtcagatttgaaaactttcgatttaagatttaaattttaaagtcaacatttgaaaactttcagctcgagatttgaaaacattcaacttagattcaaaaactttcaactcaagattcgaaaactttcaagtccagatttaaaaaatttgacaactttcaacttgagatttgaaaattttcaactcgagatttgaaaactttcaagtctacatttgaaatatgggtaaattggaaccatgctattataaatttgcaaggtttgagatatgccatcggtatctcaataacatgtaggacccacatgagtcaaagacatgtgggtcaggttggcatatctcaaattttgcaaaattataatggcatggttccaattttcccttaaaatatttgaaaactttcaactcgagatttgaagattttaaagttaagatttaaaaattactagtaaactaatcattagtaaaaatagaaaactaatctaatctaaactaattacgattttttcccctattcatacggcaggaatagcgaacagcaaaaaaaaaaagaataaaagaagaaaatggcggcgtcaaaaaaataaagaaaaaaacagagaagaggcgcgcgcgtgggccttgtgggccagaagtacgcgccggcaacgcgcgcgcgccaattagcgattccgggttcctatcgcgcgcgtacgcgttagcagtttagctggcacgcacgctagctgggcccgtccatgcacggttctcatcaaatgtacatgttgggtaactccttgtaaaaaagttatatatttttttttatttttttctgagcgagttgggctgatattaaatattcgatgcaatttattgttttgcattagcatgctaatatgttacacatttactatttttcaatattaatatagtaatggccccattgctatcacaacagagtcgcccatattgcgtgataccagattaaata

SEQ ID NO: 21429 - DNA, 1501 bp, Oryza sativa
gcagaggatgtaagtctctatactatgtactagaccgcttcacatgtttatgatattaatatattgtttatcttcaatgcatgcagttgccaagattagaacgtcgaacaagctttgacgatacaggcatcacaaatgtccagcatgatctgtgccacttcatccactctgagtgctgtcatgtgaaaggagatttcttcgacccagatggtgccctagcgacaagtgacgaattcaaggatcttctggagtggaacactgctatgccataatatgactagatggcgtatttgaagtcacaatgtaaaaaatattgtaatatatatattttggtaacacttttgagttatacaatatatgtagatttctcaataccaaatgcttgataatcttccaatatatgtacataataatctacctacaagaatttctattaacggacaaattattattaaatttcaaaatttcctacctattttcgcaggcggctatttttttttgcaggcggccgctttctattttcgcaggcgaaccggactagccaatgtccgcctgcgaaaatccgcctgcgaaaattatcttcgcaggcggacggccgctccgcatgagaagaccggcgatcttcatagtcgtttgtttacaggcggacggccgccccgcttgcgaagaccctttttggccgcttgcgataatgctttttctaatagtgcgtatcacttgatttctacagccatgcatggcaattaattaattaagtagcatttctaattagctaatttgtcttcattttaatttgatcgaacccaccaagttgccattgcatgcggcatacatgtatatatacttatacatatgcttgtacacgtcatgactatctatctatctctatctctatctatatatctatatcatcgttagttattttgtttcatgtatagctaccttttccagatatgcggacaccagtacatgcatcgtgcttatattttataattacttttctacaaaagaaaacgcatatgcacatatacgtatactacgcgcgcgcacatgatacatgcatgcatatgcagctagctagccatggatatccggccggtttcctggtgtatagcatatagctagtagagcagatgaatggatagagctagtgatatattgctcgatccctaatcatacgccgcgcgggggaaacacgtcggtttcgccgggtttctccacgacgcgcgcgtacttttgcgtgcggggcgggcgctgggctgggcgggacgtccgcatcggtcgatatggaagagtcgaagagaacgcgcgtgttgctcggagttttcttcttgcatcattgcgagacaacgacaagagcacaaggaacgggagaagaagtgtaagggaaggaaaaaaaattgagaggggagacagggacccccagaagtgttacgctgcgactggtacggcttggggtttcctccgtgagaccgtgacgtcggctccgctgcttccgtcg

SEQ ID NO: 21430 - DNA, 1501 bp, Oryza sativa
aagtacttgggctcaaaacttgtgtcacaagttgagtttaaagctggggattcacaattctaggccagccttatgaaggtcaagcgtgactttttacattttggcaaattcattatgagagatggtgcccaaattaatcaggtttgggaagacaagtggttgggagaagcaccattgcgataacaatatccttgcctatacaatatagttaggaataaataggatactgtagcaaaagtgctacaaaattaccctccgaatgtatcttggtgaagggatcttattgggccaaaattagtggcatggaataaccttcttccacaaaccgctagcctagtgcttactgaggatcaagataagtttcatttggaatttaacccaaaatggagagttttcagtgaagtcgcattatcttgccttggtacattcagatttgccaaacataaacaaagtaatttagaaattaaaaatcagtggccacagaagccatatcctaattggtcaggatgtcacaattattatatatgctcctctgtttacctttttatttttcatttgtgatcatttaggttaccttacattcatgcaacatggaaaactttaatctgtcaagcagctttatggtttaagagaggtgggctgctgatagtgatagctcagtacgggtattcctccgcgcgtgtatatagtcctaagttaatttcctggggagggtacttctccgtatttatccccgtttgtatggtcatgacgggctatcataaggaacttggcagtcaggggtggcttctcgaagtaccagaagggcatcggaaagagggtattagctaattaatcttatagctaggatgtatgtataatatgtatactagaagtataggtatatattcttttctatttttctttcaacttagcttagatagtttaatataagaatgagtagtcttataattgtgtgtcattctaccctatgaattatattaacccctacttagactatggttattacaagtaatatataaattatttgtacggttttctgtactataatcttccacgggattaaacaaatacgaaatccttggaatactttcgggtgaaatgcaacaatggtatatccgtgcgcttgcggataaactctgtaaccataatataccaggagtatttctgtgccattgttgagaattatatttctagtgatgtcgttaagaaatactaacaagtatttctagcaccgttgccggggaagatttataaaagagattaccattactaaaactttatatttacctttgtataatcactgtcctttgcaggcaaaccttggttgttttcacttttattgtggaaacagggtagtgcatgactgctttcaacttgccagaaaacttcaaagaaaatccattggatttctttcgaagcgtcaagccgcgagttgtcgctccgcagaaaactcacccgacaaagaaaccaatcataccagcgccaccaactttcaaga

SEQ ID NO: 21431 - DNA, 501 bp, Oryza sativa
tgatgtcgaggtcgagttcccggctgctccggccctattgagtatggatgctatggtttcgtcgatgaggcgaacgtaggtaggagatagaggtacatcaaaccataagagaatgtgtgtagatgcaattttgtgtttaaaaagtactttctccccgtacaacagtgacataggacatgtcgcagcaaggcgaaccgatgtcgacgaccactactgggactacatcgagccggaatcctaggacccaaaataagattcctaaggaagtctacaccataacagaggtggacgatcttgggtatccgacggctccgacgaaagctgtcaaaaagttccatacgatatgcagagtcctagggaggcggaacttcactattctgaaggaccacatcgatctggtccctcaagaagaaaaagaagaggcatggaggcagttcaaggaaagcttccgataccctgcagaggccgagctatgactgaagcggcaggctatccgcaaga

SEQ ID NO: 21432 - DNA, 397 bp, Oryza sativa
gtcaacaactcgcttagtggttcgtccggcgagcttttgtcaattaatcccaatattagtctatattggcccacacaggtacgatgtttttgctagatatgaaaagttcaaaaaaggccaaaatatgatttttggacatattggagtgtattgggtgcgttcgtggcaaaaactcacttcgtgattcgcgcggcgaacttttgtcaattaatgccaatgttggcacacaagggtgcgatgtttttgaccggaataaaaaagttcaaaaaagccaaaacatgatttttggacatattggagtgtattgggtgcgttcgtgtcaaaaactcacttcgtggttcgcgcggcgaacttttgtcaattaatgccaatattggtatatattggcccacacagg

SEQ ID NO: 21433 - DNA, 621 bp, Oryza sativa
taagaagtaaagaacccatttttgtgctttgttcctgcttgttgtttggagtttattagagtaaaagtctttttctttttccgttggtcgtgtagacgccgcagcttcggaagatccgctcttcgtggaagttgaagccgtcgtttgggaaagcgagcaaggcaagtcacatcatccttgagcatattgaatcccagtttataaaattattttgatttaaattaatgcattaccgctttatttaaattcccgcgttatcactgttttatttagccatgcctatttacctttgttatgaccatattattattgtcattgttattattattaccttgttcaccctagacaaacaaaacctcaactagtggacactctactcatggtatccctagtttgactttaggtagatgcttcgcaatttaattaggcaacattaggtggttttataattttagactttgggaattctcatctcatttggacactatggaattgttggattatggtggaattggacatacacctctcttcctctttcaaaacccctaaaacctgttttcggtggggtttgggtgcatgccagttatgggaagtagcaccccggccactataaggactaaa

SEQ ID NO: 21434 - DNA, 844 bp, Oryza sativa
ctcgctcagatgtgtgaaagaggaagtgcatagtaagagatgagagtgaaagaggaaggtgagaaagagataaggcgtaagggagagataaagagtggaggggaggaagagataagggtgaggattgagtactaactactctgcgcgcggagagaacgagggaagagagagatacgtgggaaactgatttgtagtcccggttggtataaacaaccgggactaaaaatattaggaaacctgccacgtcgtgccaataaataaaccgggacaaaagatgatctttagtcccggttggtaacactaaccgggactaaagatcattgcacttttaaaccgggactaaaaatgctttttagtcccggttttttaagcatccggaactattgttgtttttgggcaaccgaccaaagatgatttctccaccagtgccccctccctcccccgagcagtttacaagcggtttaggtcctacgcggcaatccagtgaacaattcttttattaaaaaaatcaatagggcgcacctgttagatctctttcatctctctcttcccctctcacccctctctctctctcgcacgctcattgcccgcaacacgaagcagacggtggccaacatggaaggtgctgcacatccagatcgaggagagcattggccgtgttgagacggtggttgtcttcggcgagctactgtagtgccgttgagacagtggtcgttggcggcgagacatagggcctctacctgatccaagacgagatgcccccacccccgcccgtcgctgtcctccgcgcccgagctgcatctacccccctccccccggtcccacgccctgcgtccaccgtagt

SEQ ID NO: 21435 - DNA, 1501 bp, Oryza sativa
ggcatatcacctgacatcctgataaaacatgacaaatagtctcacgtttaatcatttaatcattcgataattaccctattacaacttatactacattgccgtgtactaatttacaactattagtaacaaacaactagtttaataatccaaataaaatataacacctttgtacatattttaacacacaacatatcaataatatgtactaactaagaactaatttaaccgtacaattacttaaatacctctaccaacatttagcaataacaaatgtatgctaaccatacatactaacatcgaacaatgcgaaacaattaacaactcttaaaccaattttttattaaactttcatatgcattgtacttagggattactaatgtataccttaacttcactgctggagggcgtcgccaaccctttcctcccggccggcgcctcctcggcctcctctccggcctgctatcccctaccctcgctccctccggcgctcacggcgacgatgtggcgactctcggcggcggctggcgatgtggtcctcaaacaaatcgaacaagcatcacgggctggggggacggggctttaaaccggcctgtcgaacgcccattgttcgacagggtcggtggagggacctgtcgaacgcccccggttcgacaggcctggcggcgcggggtggtgggccctgtcgaactccctccgttcgacaggtgaccgtgtcgaacgccagccgttcgacagggctctatcgactgctcgtcgttcgataggtgccctatcgaattgcacccgttcgacagggacctactttcgcgattttccccggttggccactacttttgcgattttccataaaaataatattaattctcaaaaaaattcgccgctatggaccagccgtccatgctcctctttgctttgtctcactctgcttcagttcttctggataaggagcagggatagaaggggtaagagtgtccgtggacttagtctatggcaatggacttggtctatggagcattgagcactttgggctggttactgtgctttcctgctgcttgtctcttttcttcccgttcagagaacgggtttgcgtcgcccactgcctcatcgacatctacgcgtctccgacatcggcatcgactctacttcgacttcatcgtttagcccgacgcatcttcggcttgatcacccgttcaggcgcccggcaacaacgacttctgcaaccgatcgtcatcgagcacgcgtctacgccatcaagcttatggttgccgctgcgtcgccctcttgggccacagtgccgctgcctatggtccacacctccactggttgttgcagtgctgagaggtgccctcctctcagcatagctacatcatcggtggacttctcgtcgctgcatcgacatggagctgtagctgtattgtcctctcggaccgcagtttcgccgctctcgtcgtcatcatcgtcgcctgcgcatcgacatcctcgtcgtccgcactggtcatcg

SEQ ID NO: 21436 - DNA, 1501 bp, Oryza sativa
attttaacttctgcccagtgaatcttgacatgacgtgaatcacaacatattgctgattagttcagttcatagtccagaaaccaaatagtggagtaagagccatatacagttgctggtgatgttaatgggccatggaggcccatattcacccacggtggcagcagtggcctgacccacatcatgtaagtacatgatggtaatgggccatagaggcccatacgtacccacattggcagcagtgtcctggcccacatcagtacagtaatcctcgtgcagaacaatcgaatggcccggactcccggttaaaaggatgcactcacaacatctcaaatggcagtgcgatgcactgtgcgctggtgtgtccatatcgacgtgtcgtcgagatctcgttccattgccctccaataatacgaactccactcctgtagccgttgtaggacgtcctccaaggctccaaatccacaacctccggccactattgaaagccgtacctcatccatgccacgaacagctactcacgtgtactactagtactactcctatctttctctccttttttttctgttgccctcacgcacacgatgacacgaataatcgtgaatcatggtgatggagccaagtgtcatcaccgctaataatggcgagatgatcgataaccaactcccgtttccaactttccatgtactagtaaacgccatcgacaaaggcacaagcataaccaccggcactgcgatgctacgcgacgcgacgcagtgcagccgtgcagcgcgttttgctaccaaccatagggtttagtgtgcgtgtccggaccagaaaatatccaacacatcgatcacctatccaccattagctcgattggagatcgcgcaaggcgagacgcgattaaatgacgaagcctttggacgtcctgctcgtacgcaacagaggactagtagaagaagcttaagagcatcccagcagatcatttaaatttggacttctatatttctatttgaatggtcatccaaaaaagattcctcctctatacctttacccactccaataaatcatccatattacagcattcatatcacactattctatattttactaatattttttaactacccatatatatctaatgattttttaagaggcatatatttacaatggtttgaataggtgttggttcgatttaattgcagttaccactttgagaacactgtgtaccacctttaatcctcttttaaaaccacatcagccacatttaccttatcctctcgctaaaaacaaaacaaaacaaaacaaaatccaccaaatccatcgctcctgggagaccaacagatagtgagaggcgggcggaggagcgacggaggggatgcggcaggatggcgcggccgacgggggcagggcgccatgggcggaggtacagcggtgcaggtggcagggtggcgcggcgacacggacggagtcgcgatgggcaacgcaagcgaagaagcagcgacgccggttgatttgcagt

SEQ ID NO: 21437 - DNA, 1501 bp, Oryza sativa
tggaccatgtcgcgggagctctcggactcgagcaccatgacgacgggggtgcacgtcggcgagagctcggcgaggaggctcctccggcagagcgggcaggtggagtgggagaggagccaggtgtcgatgcactcgaggtggaacgcgtggctgcacttgggcagcagccggagctggtcgtcggcggcgaactcgcacaggcagacagcgcagtcgaacgggtccttgccatcctcgccgccgacgccgacgacgttccggtacaggaacaccgggagcgcgtcgatgaaggcctggtcgacgccggcgtcgtggaggtggaacagctgctgcagctgcccctcgaacgccgtcgcgctctcggcgtcctccctcgccctccgctgccggtgcagccgcagcaggtgccgcaccagcaggtgcagcagcccgcacacgaagaacacgatcgccaagacggccacgatgaacacgatgctcgggcttatcttgttctccacgccgtcaatccccgacgccgacgacgccgccgccgccggagtctgcggcggcgacggctgccacgtcgaattgctcattcttcaaatacgctctacgatccaaagatgaattttcttgggagaagagacgatttctagcttgttttgcgatgagctaggggtaggagaaggatcttggtgttggcatggcagccattggcgatgaagaaggacagaggacacacagcagcaggtgatggcgatggaagaaaaagaaaagaaaaagaggagcagtagcagttgcaggtttagggggaagggaagctttgtgtgtgagaagtcgtaggcgaattagtactaaaatgtgcaaggagggattaacttagcttattaatcaatgggcaagaaatggggtagctttaggtgtgtttaggtgaagggttagcaaccaaagcatgaggcgacatgcaaaggtgtgggtcactgtaatgtgaggtcatttggattgcaacaatagccagagaaaaaaacaaaaatgggtattaaaaagaattaatctgtggcatcgctgttcttgtagctgattcgctagcaagtgtagtaccacaggtaattagtaagctgtttttatgtgagcatctgttttttcgtcctcgacatttaatttctttgctggttttgtcggtgtcatgatgttgtttttttttttgaggtgttttgatcgagtaactaaacttggggcttatttttaatcttcattgacttttgcaggattaacaaattgccggcgcgtgtgatgtgtgatgcatacgccggccatcagtgtcccgttcaacgtgtagtacttgtgtggaggattctggccgtttttctttttgtagcctcgtgtactttcttcttgcactcaggttgcattgactggctattgttctacacccttccggctcctgctaccactacgttgtacagtattactactacatgcggtcgtgaaaagaaaatttttaggtattacatcggat

SEQ ID NO: 21438 - DNA, 1501 bp, Oryza sativa
ttactactcgctctacaatactccctccgtcctacaatataagagattttaagtttttactggtaacgtttaactactcgtcttattcaaactttttttcaaatgtaaaaaacaaaaagttatgcttaaagtaccgtagataataaagtaagtcacaaataaaataaataataatttcaaaaaattttaaataagatgagtggtcaaacgttgaaagtaaaaaatcaaaatcccttatattatgggacgaagcgagtagaattttagtactactagtactccactgctgtataaacagttactgaattactgatcatacgatggttcgatttgatttttagtagtagtactaaaatttttcccaaaatcatcacattttagacacatgcatgaagcattaaatataaataaatgaacaaactaagtgcacagttaggatgaaaatcgtgaatcttttgaggctaatttgtccatgattaaccataagtgctatagtaacctacatgtgctaataacggattaactaggttcaaaagattcgtctcgcggtttatagtgaattatgaaattatttttttattcgcatttaaaaaatatccgatgtaatacctaaaaattttcttttcacgaccgcatgtagtagtaatactgtacaacgtagtggtagcaggagccggaagggtgtagaacaatagccagtcaatgcaacctgagtgcaagaagaaagtacacgaggctacaaaaagaaaaacggccagaatcctccacacaagtactacacgttgaacgggacactgatggccggcgtatgcatcacacatcacacgcgccggcaatttgttaatcctgcaaaagtcaatgaagattaaaaataagccccaagtttagttactcgatcaaaacacctcaaaaaaaaaaacaacatcatgacaccgacaaaaccagcaaagaaattaaatgtcgaggacgaaaaaacagatgctcacataaaaacagcttactaattacctgtggtactacacttgctagcgaatcagctacaagaacagcgatgccacagattaattctttttaatacccatttttgtttttttctctggctattgttgcaatccaaatgacctcacattacagtgacccacacctttgcatgtcgcctcatgctttggttgctaacccttcacctaaacacacctaaagctaccccatttcttgcccattgattaataagctaagttaatccctccttgcacattttagtactaattcgcctacgacttctcacacacaaagcttcccttccccctaaacctgcaactgctactgctcctctttttcttttctttttcttccatcgccatcacctgctgctgtgtgtcctctgtccttcttcatcgccaatggctgccatgccaacaccaagatccttctcctacccctagctcatcgcaaaacaagctagaaatcgtctcttctcccaagaaaattcatctttggatcg

SEQ ID NO: 21439 - DNA, 1501 bp, Oryza sativa
tcgtcggcgtcggggattgacggcgtggagaacaagataagcccgagcatcgtgttcatcgtggccgtcttggcgatcgtgttcttcgtgtgcgggctgctgcacctgctggtgcggcacctgctgcggctgcaccggcagcggagggcgagggaggacgccgagagcgcgacggcgttcgaggggcagctgcagcagctgttccacctccacgacgccggcgtcgaccaggccttcatcgacgcgctcccggtgttcctgtaccggaacgtcgtcggcgtcggcggcgaggatggcaaggacccgttcgactgcgctgtctgcctgtgcgagttcgccgccgacgaccagctccggctgctgcccaagtgcagccacgcgttccacctcgagtgcatcgacacctggctcctctcccactccacctgcccgctctgccggaggagcctcctcgccgagctctcgccgacgtgcacccccgtcgtcatggtgctcgagtccgagagctcccgcgacatggtccacgccgccgacgatgagccagccgacgtcggtggcgaagacgcgccgggagcggaggaggtggtcgaggtgaagcttgggaagttcatgtgcgtcgaaggcaacgtcttcttcaacgtcaacgccatcgccggcgaaggggatagagccggcacgagcagcaacggcaatggcgacgccaatgccaaggctggtggtctcgggcaaagacggtgccattccatgggatcctacgagtacgtcatggacgcgcacgcctccctccgcgtgtccatcaagccgccgaggaagaagccggcggcggcggcctccaagtcgcgccgccgcggcgccatgtcggagtgcgagttcggcgcctccaagcgcggcgagtcctcgctccgcctgccgccgttccgcgcgacgccgcgcaagaaccccgacgacgacgcggccgcggccgccggcgcgaagctcgccaaggacagcttctccgtgtccaagatctggatggtgccgtccaagaaagagcccggcgccgccgccgagaggcgcgcggtgtcgttccggtggccggcggcgaaggactgggacgtcgaggccgggagctgcggcgggaacagcgccgtgtcgtcggtggcggcggaggagcgcccgtcgttcgcgaggaggacgctgctctgggtcgtcggaggcagcaggcagctcagcagagtcgggagctgttcatgatcaccatttcgatcatcaaatctcaaaatgaaaccaaaaaaaaaaaagatgattcttttgttcagttcttttaccccctccttttgcttgctaggttattggtagcgaactagcgattgcatccaacagcaagagaaattgtaaaacccatatgctacgaagagaagaaattttcctttcatttttaactgcatttgagattttgagtccgggttggtttcaattttcagcaaagtgactccctgatcattactcgaaagaaaacatt

SEQ ID NO: 21440 - DNA, 152 bp, Oryza sativa
gatcttttggtctaaagcgtgctcttgtagggagagagtgcaacgtcgtcggcaactgcattgcattgtccatggatttgtttatagaatatatcttgagctgtgctggctttcgctttcttttacattgcctttctcttttttcttgcagt

SEQ ID NO: 21441 - DNA, 1501 bp, Oryza sativa
tggcataatagggctccatttgcaaaagcagcatttagcaaacatttgagaatttaaaacagttaagtatttaaacaatattaatccaacactatacaacataccctgttgtataggcccatccattctgaacaaccatcccggctgcacagttctatctccaaaccaggaatataccattccaaaccaggagctaatcaaattattaccagttatagcatcttctattatggtgagaagggtgagactaatcacgaaagacattgttcgacccgcccataaccgcgggcacggctattcgaatagttttactctgatcagaggtgtaccactgtacccacaagacacaaccccacatcatgtcaccatgtgcctcaataccaccacggtacctcggaaaggagttgtgacaatacccctcgcataacacaatccattgcagcgcaccttcctggatcataatcacccccttataaacaaggcatggactccccagcgacccccgtgagcttatctccgccacttctcagtctggtgccccgcaatgaaccatgctatacaaaagataaagccgttgcccatgctggcttgtggttggcacgataaatgtttcacaaccgaaactcgtgaaccggtccttaattgtcatgagcacgaccagcaaaaccatgtgctcacaacccaccattatcaggctttagttggcacattaattaattaactaaccacgattgaccatcgtgaactatcaataagccatcatgaaataatagtgaatcataagttatcccaaaagtgagctaatgtttctaagcagggctaagcaattatacctaatatctagttgaaccaatataaataaagttcaaccagtcaaattattataacccaaggtatcaaggaataaggtaaacaagaacaaaagggctataacaaacaataggttatttccacccaatgacattcgaaaataaatgcaatagttgaaaagaaataatagctttaaataggatcaacatgctcaaagggttgtttgggatctgtgtgacttgccttgctggccttggaactcttcaaactcttctccggcgaaaacggactctccggaaacgacggaatctaagcagaaaagaacaaaattaccaaaacaacacataaacaagcatgaacagtacgtgtggatatttttaatgtgtagatctcaattttagaaaaatttagagacttgaaccaactaaatcggagctaagatgaattagttatgaatttttaaagattaaatcggattaaaaacacttatatcggtttaaattgaattatgacgcaataatgaattatttttgaaaaggaaaaagggatttattgcgtcagcgggctagggtttcggtggaccgggcgcacgggcggcggttcacgcgaacggacggccgagattcgatccaatccaaacggacggccgagatcgatcgggtccacggcggctcacggcggacgaccctga

SEQ ID NO: 21442 - DNA, 257 bp, Oryza sativa
agtgttgaaaagaaaatctaagtttaattaataaattccaatataaaatggggccagataaaatttcattaaatactttgcttaattctataattcctagatttttctgggatttatttgagctaagaaagtatttttaataaatggaattgcatttaagaaataatttaaattgaaaaaaaggttttaaaagttctcttttggctttgggccgaaagtcggcccaaaactctctctctctctcccccggcccaagt

SEQ ID NO: 21443 - DNA, 1501 bp, Oryza sativa
gaccctgagcggctgacgatgaccagtgcggacgacgaggatgtcgatgcgcaggcgacgatgatgacgacgagagcggcgaaactgcggtccgagaggacaatacagctacagctccatgtcgatgcagcgacgagaagtccaccgatgatgtagctatgctgagaggagggcacctctcagcactgcaacaaccagtggaggtgtggaccataggcagcggcactgtggcccaagagggcgacgcagcggcaaccataagcttgatggcgtagacgcgtgctcgatgacgatcggttgcagaagtcgttgttgccgggcgcctgaacgggtgatcaagccgaagatgcgtcgggctaaacgatgaagtcgaagtagagtcgatgccgatgtcggagacgcgtagatgtcgatgaggcagtgggcgacgcaaacccgttctctgaacgggaagaaaagagacaagcagcaggaaagcacagtaaccagcccaaagtgctcaatgctccatagaccaagtccattgccatagactaagtccacggacactcttaccccttctatccctgctccttatccagaagaactgaagcagagtgagacaaagcaaagaggagcatggacggctggtccatagcggcgaatttttttgagaattaatattatttttatggaaaatcgcaaaagtagtggccaaccggggaaaatcgcgaaagtaggtccctgtcgaacgggtgcaattcgatagggcacctatcgaacgacgagcagtcgatagagccctgtcgaacggctggcgttcgacacggtcacctgtcgaacggagggagttcgacagggcccaccaccccgcgccgccaggcctgtcgaaccgggggcgttcgacaggtccctccaccgaccctgtcgaacaatgggcgttcgacaggccggtttaaagccccgtccccccagcccgtgatgcttgttcgatttgtttgaggaccacatcgccagccgccgccgagagtcgccacatcgtcgccgtgagcgccggagggagcgagggtaggggatagcaggccggagaggaggccgaggaggcgccggccgggaggaaagggttggcgacgccctccagcagtgaagttaaggtatacattagtaatccctaagtacaatgcatatgaaagtttaataaaaaattggtttaagagttgttaattgtttcgcattgttcgatgttagtatgtatggttagcatacatttgttattgctaaatgttggtagaggtatttaagtaattgtacggttaaattagttcttagttagtacatattattgatatgttgtgtgttaaaatatgtacaaaggtgttatattttatttggattattaaactagttgtttgttactaatagttgtaaattagtacacggcaatgtagtataagttgtaatagggtaattatcgaatgattaaatgattaaacgtgagactatttgtcatgttttatcagga

SEQ ID NO: 21444 - DNA, 389 bp, Oryza sativa
tcgaacggtttataatattggacgtaccgatttaagtgaaaatcaagtaatatatgctttgctttttttgatagaatttctaatatttgctctaatttattagagcaccacgtgatagcttgagagcattttaagaaattttaaaggacttaacacatgtaattacaatattaaccgcttaatatatatgtatggggcatatggtaatatttgttccagcttcgtcgatgtttatatacacgtagagagaaagtaattatatggcaagcaagccattagatgtctaattaatagcaattaattttgacacctatttacagttattcatagtagctcttacatattcatattatgactttgagtatccgtcgatccccaattgtccacca

SEQ ID NO: 21445 - DNA, 1501 bp, Oryza sativa
cggtcaggcattgtagtcagagtcacctcagccgcacaaagtaaatttaagatatgaggttgattattccttcggttgctctggaattgaagcttttatgttctgcatctcttttgaattttggaatattatttataattctctcaattgccaaatatttctctacagctacttttcttcgaacaagaaattgatggaggttatggactagctccgcaggtacttttgagtttcatggttgatgtgttctgtggttttgtaatcatttgccatggattaccacatgccaatcttttatgttttttatgaatgaatagtggaaagactggaggagtctcaaaataactttaagggaaattgaatttgtcatcaccatcacaagtctaattttcaatagaaacttaaagatgtagatgtgctaaagcaaatgcgaccattagcctgtcacctccaaagcaactaatcctgacctcctgtcatcaactgacaaccctcctccctgtaacaatcatgaaaagagctgtgcctgtgcaaagctcgaattccagctgaacttggcaaacttgagctttttgaactataagaaattttatcgtgtctaagaattacattgtatgctttatttttattctgtgcaattgttgaccaaattttgcatatagaaatcttgccaacaacaatcttcatggtcctattcctgcaaacatgttcttgcactgctcgaaacaaatttagcctgttgtgatgcaattctttgttctgaaacagagtgaaacacaaattcatctaaaaccagcataaaaaaggaatttcattaagtccatgcatgtttcctacattcataaagaaaaagccgggttgactttctttacaatggatacaacctacgttgattgtattacataagtttcaaaattgcaaacactactttcaggcatccaagctgaggtgaatcacatgagacaaaatggcagtcttgctttcaatgaaagccttgttgctggtatatttcttcattttgccagtgcaagacccacactggtcttccagaccacggaatggtagtgcatcaatagggctgcagcagggtgacacaccagcaccacggttattggattcaggagtttgccaagaagcagcaattaaatgattagcttccacctttaattttgctggcaggtagtctgtcgacggcttcttttttccagttatggcaatgtagctattcttatcaattcctcccctttctgctattgcctgattgtgcaggtgttatcccaggcttcatggacaactccgtcgccttgaggaaatgagcctcctccatccctccatatgtatttcctcctctgctctgtactgctttgctctgcctcatgcttgctgtcatgtggatgtgctgctgctgaccaatactagcttattgcagttttccttttttgttcaggccattgcattgcctctgaatcttactttttttgcggggcctctgaatcttact

SEQ ID NO: 21446 - DNA, 1022 bp, Oryza sativa
tttatggcagcagatgtatcagacaaaagtatttatccaaaaacattttggctgctgcaaaaacaaaatctggggcctcccatttttggcaaggggtgatggaggttagaaaaagtttcttcaatttttgttccaagagaccaggaaatggagataacatccttttttgggaagataactggttaggaggaaaacctttggcagaacaatttcctttttttgtatagagtaactcagaaccaattcattactttggcaaaagttaaaaaaaaaagggtggggttgcatgactttcagaagaaatgtgattggagatgcacttgctgactggaacaaagttaagtcttcttgtgatgagataactctgaacaatcaaagagatgtgacagtttggactctggcaaagaaatggaatgtttagtgttaaatccttttatagagctctaaagttgcaggggactgtttccatgattgggagttcacacaaattttttttttggaaaattaaagtccccttgaagtgaggatttttctgtggttgctgcttaaagagaatgttttaacaaaagataatttgataaaaaggggttggaggaagggtaatgatctgtgtcagttttgtgaacagaaagaaacaattcaacatttattttttgactgtcctctggtgagattcacctggactgttgtgatttgtgcttttggtatgaaccagattaaagacatgagacatatgttaagttcctggattcaaccttgtgacaaattacaaaacaactaatgctagttggtgtggcagctgtactttgggccacttggaaagcaagaaatggcttgttttgatcaaaggcctgtgcactgaggtctagctggctttcgtttgtctttgtttcttttgtgagcacctaggggttctatccttctggttctaagactctgtttttgtaagaacttctgcgtttctttaatgaaaattggagggttctgccctttgctcaaaaaaaaaaaaacattgagatttg

SEQ ID NO: 21447 - DNA, 1501 bp, Oryza sativa
actttcccctctctctctccctcggattcgctcggattcattcccgaaatcctcgccggcgtcatcaatggagccgagatctccgcgcccgtttcctccctctccggccgctctctctcactcccgacgctatataattgttccccgtgcctctctcctccgtttccgccgctcgctgctcgctctccccgtcggattcgtgctcgcgccgttgtactctctctccaccgtcgccgccgagctccggttcgccgccgtcgtcgctccggacttcctcccgtctcggcgtcacctccatcggcttcgccgcgtcgtcgtcgacctcgtccgccccttcatttcgcccgccgaccgccggagcaccgtcgtcctcgccgtcccgaaccgcgccgccgctttcctccgcttcggccgccgttcccgtcgtcgccgtcgacccggggtgagccgaggaccgcctctttcgcttccctcgcctctccgctctctcggccgccgctccgtcgcgccgttggtcgccggcggtgaccatcggggcgcgggcgcgccgtctcccgtcggccgtgccggcgaggccgccttcgggcgcgccccgcggctgccaggtgggcccggccgtcagccgcccgcgcccacgggtgcggctgacgcgtgggacccacagcgccggccggcgtcagccgcgtgcacccggtccaccgtggaccgagaggctgacgcgtgggccccactcccgtggacccggtccgcgcgccctctctcccggctgacgcaataaacgagtttttaattaaaatttaaatgaagaaattcgcaaatatccatttaaagagcatataaacttcaaatggccataacttggccatttgaactcggaattggaccgttcaagtctctaatttttccttaagaagtcaagaacccatttttgtgctttgtttctgctgttatgtggaatttattagagtaaaagccttttcttttccgttggtcgtgtagacgctgcagcttcggaagatccgctcttcgtggaagttgaagccgtcggttgggaaagcgagcaaggcaagtcacatcatctttgaacatattgaatcccagtttgtaaaattatgttgatttaaattattgcattatcgctttatttaaattcccgcgttatcactgttttatttagccatgcctatttacctttgttatgaccatattattattgttattgttattattattaccttgttcaccctagattaaacaaaacctcaactagtggacactctactcatggcaccactagtttaaatttaggtagatgcttcgcaatttaattaggtaacattaggcggttttacaagtatagactttgggaaatattcatatcacctggatactctggaattgttggattattgtggaattggattcacaccgccccctctattcaaaatccccaaaagtggttttaggctgggctcggggtgcatggttttgatagtagcac

SEQ ID NO: 21448 - DNA, 808 bp, Oryza sativa
tttttttgtatagagtaactcagaaccaattcattactttggcaaaagttaaaaaaaaaagggtggggttgcatgactttcagaagaaatgtgattggagatgcacttgctgactggaacaaagttaagtcttcttgtgatgagataactctgaacaatcaaagagatgtgacagtttggactctggcaaagaaatggaatgtttagtgttaaatccttttatagagctctaaagttgcaggggactgtttccatgattgggagttcacacaaattttttttttggaaaattaaagtccccttgaagtgaggatttttctgtggttgctgcttaaagagaatgttttaacaaaagataatttgataaaaaggggttggaggaagggtaatgatctgtgtcagttttgtgaacagaaagaaacaattcaacatttattttttgactgtcctctggtgagattcacctggactgttgtgatttgtgcttttggtatgaaccagattaaagacatgagacatatgttaagttcctggattcaaccttgtgacaaattacaaaacaactaatgctagttggtgtggcagctgtactttgggccacttggaaagcaagaaatggcttgttttgatcaaaggcctgtgcactgaggtctagctggctttcgtttgtctttgtttcttttgtgagcacctaggggttctatccttctggttctaagactctgtttttgtaagaacttctgcgtttctttaatgaaaattggagggttctgccctttgctcaaaaaaaaaaaaacattgagatttg

SEQ ID NO: 21449 - DNA, 1501 bp, Oryza sativa
gtcacgcccggaatttctatccaaaattccaaacgcttacatgtgtgtgaaccctcgtccaggaatcagccgaggcacacaataacaaattgataatagagtacaaatattactctaattaataagcgaatataatgtcattacagaggtagatagttcctctcaatcaataaagttctagcagcggaaattaaataaacggcgcagacggctccactccacaggcagcttgaccaaggctacacctaatcctccacaccatcagcctcattgtagaactcttcctctgatgaatgattgcaaggtgagtatatgacatactcagcaagccacgcagcaaatatgcaagtgcacaggataacaaaggatggcataatagggttccatttgcaaaagcagcatttagcaaacatttgagaatttgataaaacagttaagtaataattaagcaatattaatccaacgctatacaacataccctgttgtataggcccaaccattctgaacaaccaccccggctgcacagttctatctccaaaccaggaatgtaccattccaaaccaggagctaatcaaattattaccagtttaagcatcttttacaatgatgagaggtgtgagactaatcacgaaagacattgttagacccgcccataaccgcgggcacggctattcgaatagttttactctgatcagaggtgtaccactgtacccacaagacacaaccccacatcatgtcaccatgtgcctcaataccaccacggtatctcggaaaggagttgtgacaatacccctcgcataacacaattcactacagcgcaccttcctggatcataatcacccccttataaacaaggcatggactccccagcgacccccgtgggcttatctccgccacttctcagtctggtgccccgcaatgaaccatgctatacaaaagataaagccgttgcccatgctggcttgtggttggcacgataaatgtttcacaaccgaaactcgtgaaccggtccttaattgccatgagcacgaccatcaaaaccatgtgctcacaacccaccattaccaggttttagttggcacattaattaattaactaatcacgattgaccatcgtgaactatcaataagccatcatgaaataatagtgagtcattagttatcccataagtgtactaatgtttctaagcagggctaagcaattatatctaatatctagttgaaccaatataaataaagctcaactagtcaaattaatataacccaaggtatcaaggaataaggtaatcagtgtacaaaagggccataacaaagaataggtcaattccacccaatgacattcgaaaatagatgcaatagttgaatagaaacaatagctttaaataggatcaacatgctcaaagggttgtttgggatctgtgtgacttgccttgctggccttggaactcttcaaactcttcttctgcgaaaacggactctccggaaacgacggaatctaagca

SEQ ID NO: 21450 - DNA, 350 bp, Oryza sativa
attcacctggactgttgtgatttgtgcttttggtatgaaccagattaaagacatgagacatatgttaagttcctggattcaaccttgtgacaaattacaaaacaactaatgctagttggtgtggcagctgtactttgggccacttggaaagcaagaaatggcttgttttgatcaaaggcctgtgcactgaggtctagctggctttcgtttgtctttgtttcttttgtgagcacctaggggttctatccttctggttctaagactctgtttttgtaagaacttctgcgtttctttaatgaaaattggagggttctgccctttgctcaaaaaaaaaaaaacattgagatttg

SEQ ID NO: 21451 - DNA, 369 bp, Oryza sativa
gcatgaacagtacatgtggattttttttaatgtgtagatctcaattttagaaaaatttagagacttgaaccaactaaatcggagctaagatgaattagttatgaatttttaaagattaaatcggattaaaacacttaaatcggtttaaattgaattatgacgcaataatgaattatttttgaaaaggaaaaggggatttattgcgtcagcgggctagggtttggtggaccggcgcatgggcggcggttcacacgaacggacggccgagattgatccgatccaaatcggacggccgagatcgatcgggtccacggtggttcacggcgaacggccctgatgacgccagcaatgacgtcaccgacggcggcg

SEQ ID NO: 21452 - DNA, 315 bp, Oryza sativa
aaagaatcccatttgttggaatggattaggtaatgtgaaaaactaagaaaaacccgatcaccgctacacaaatagaaaaacaaagatgtgtgtttttattatgctagctctagattttcaatgtttacatcacaagcaatcccgtactgagccaatactgcaactaacatataaatgcacttaatcgaaaagaaaaacatgttctctgaaccgcacagaattcaacgcatactgagggttagatcgcatacacagaatcacagatacacatggactttccttatcaatttgtctagtcctagcatttttttcagg

SEQ ID NO: 21453 - DNA, 1501 bp, Oryza sativa
ggggcaggtccagtgcgagcaagcgttgatgacgaaggctctcaaggcggcggcaacaccttcttcaccgctacttccgacgccgaggccgactttgtctcaggatgcggcatcgacatcaacacaaccaccacctgaagttgaggtacctgttcgttctggtcaacctccggttcgtgataattcggatgtgcaggggagacgctcttgggtgccaaagatggatttcccaaaattcgatggcacagatgtttgtgtttgggtggataattgtgagacttattttgcgctgtatcaaatcacagaagggtttaaggtttcagcagcttctctgaatatgattggtgatgcagcacattggtatcaggcttggaaacaggagaggggttggcctacttgggagcaattacgtgaggctgtactgaatgagtttgagatcaatatcaaacgtgctaagatggaagaattgctgttgttgactcaaacaggaacagtctctgaatatcgctctaagtttctgcagctggtatatcatattcggctgtatgatcctgctactagtggtttatttttggtgtcccgttttgtgatgggtctgaaagatgaattgagatgctttgtggctgctcaagaacctgaaacagtgcatcaagctgcccgagttgctttagcttttgaggtgccttttgcaatcggaaagtggccttcaagaaggatgtggggaatgtgaaatttggggataaaggaaaagttcctgtgggggatttgtggaaggctcaacagcttaaagagtataggagaactcatggactgtgctttaaatgcggtgaaaaatatagtcctgctcatacttgtggaaagacagagggtgctcagttaaaaactatggaagtttcttcttctgatgatgtgttaactgatgaaattttggatgtggtcactgcttttgaacagttaccggatgataacatgttattatctttgcaagcagtggctggtactagtgctactcattccttgcaattgagagcacttgctgggaatcaagttgttatcattttggtggattcaggcagttctcatagttttatcaatgcagatctctgttcgaaactgaatctatccactgatccaattcctgtttccacagtgaaggtggctaatggtgaaactttacagtgtgaggctcaggtttctgaattttcttggtggatacaggggtgcacatttgtttcttcattgaaagttttatccatgggggggcatgatatagttttgggtatggattggctttctaagttcagtcctatgacttgcaattgggctgacaggtggttggagttcacttatcaaggcaagttggttaaacttcagggtattcagtctcatcaactgcagtatctttctgaagtatcttctgaccaaatgatgaaatggcaagtgggtaatgatatttgggctttagctgtggtcgactgtctttcctctccattgtgtgatt

SEQ ID NO: 21454 - DNA, 1501 bp, Oryza sativa
aagttggtatcagagcctctttgaccctaggttatgccaaatggttacccatagaagccctctgaaaaatattggaaaagtagaactgttctcctccctttctcttttaattaaaccaaactaatggcacatgcacttcttaaatctcttttaatggttctcattcgaaaatttattccagtattattagtactgtacatccattactgtactaatggctcatttttcagcaaaagttttacaatattgttttatttaatcctgctgcaataaaataaatttaacaagttgattttataactttcttttgaaacctgttgttaaaaagtacaaaatttgtaactttgttttcaactatttcaaattatcttgcaagtttggtttactttatttacttaccttttactttgatttctaaactttattcaaattaatccaaaaacttgtgctattaattggatagatgtcttaactctctcctttcacttgtctttagatgccgcgctacaagcctgagtacctgtttggtgttgaagggtttgtccaggagttgcgtactatgtcctttgtcattggatttggaactgcccctttttatgcccagattcgtcatgatcgtcatgaagagaggtgccgtgtcaaagtcaccttaaacagtaatagtgaagatattccatcagtgatgttcgaagctggaggaagaaattatatccatgcatgtcaggaagtggcaaggatcgccataggagagctccgtgaccgctacagtgatcagttggccgatactgagtatcgctaccatcctcgccaaccacagggaagtgaccgtggcagttaccttgagactgaaggaattgagaatgatgctaccacaaggcatttggttgagatgctgtgggctatggatgaaagtcgtgcggagactgtgttagcggctcaagatcgtgaagaccggaatcgtggtaagatttgcaagctagaagacaaggtggatcgcttggagaaggaattagccgcattgaagggagaagcaccgccgcagaaggccaggattcgtctcaccgcaaggaagagaactttgtttgtccctcgttatcaattggcgccaaagatccgcgtggtggagaaagaagttgccccagcaaatcctccggtcatcatcataagtagtgatgaagaagaagaatctaagcgcaaccattccaagattgagtgggtagcaacccaagatgatgaagacgagccttcaattgacctccgatgcttggaagaactagagtgacttgttaagtcgttgtcttagattgttgtgttagtttgcttgcttaaagtttgcttgtgtgtgtctcgcatgtgatttacatcagtggtgggatgtaattgcatgtgtttgtttgcttctgagtgttaggaagttggtgagtttagtggtgtgagagtcttcagtttgtaataatgaaactcagttaagatcaataaaagttaaagtaattctctgtcc

SEQ ID NO: 21455 - DNA, 1150 bp, Oryza sativa
agagaagaaatggttaaaattctaatgtcaattttcgatgcagtatcaattagcatctgccagtcaatcaatatccattttgatacctgaaggttgtcgtggcatgcgacttcagattgcttgttctttcatgccttatacagtgtgatctgtggctgtaatgttttaggagctctgttgtagggaaaatataggatgtgatatctagtttgtccgccagaagttcaggaccatattgtttcgagttctgaactcacaaacttatgctccctattgtcattttggtacctattctgccagaagctgacgatgatgtgtgtgttattatggtcccgttcgaaagtgatgatcagatacaattgatcatgctccatgcttctagaaatacgatctttttttaaaaaatctgcattacattacatagatcacttgtttctagctattttgttaaatttacttctcaaaatataaattaatcatgttaagtaagtagataactcattttatttcatccttgtttcatcttacttcctccatccaaaaaacctaacctagctgtacatgaaacacaatgggcctgttcggcagccctatacagcggctgtgcagccgcaacagctgcagctgctacgattgttctctatatttcattgtagtggctggctgtaaattagaactaccgaacaggctcaatgtagtatgatgaactaaattatgtcatatcttcaattatattagttttttttttgacggaagtagtaaacggaacctatatcctgttacttttgcttgacctgatgtaatggacgtagaaggctggaataatacagtagttgactgactcggtctcctgatcggcccgggctggtccggtccaacccaaccggcccggtagccacccactccgtaacggaaaaaaaaaacaagaaaagggaaaaaaaaccggatcggcttcctttcctcttctcttccgtgcccctccgccgcacgcgttccccatccccaccaaagcttcttcccccgagaggcggcgaaatccccaaatccgaacaagccaaagccatcgtcgagctccttcacccaccgatcgattcgatctgaccgcgccgccgcaagggaggaggaggaggaggacgacgagcagcagcca

SEQ ID NO: 21456 - DNA, 957 bp, Oryza sativa
agctaccacaaccccaatgcaaatttccaattccccatcacaacaatgatacagacagcaaaacaccaaggccacacacacccatgcatccactcctacctactctaactacagtactttcttaagataatgggagatgtttctcacaacagtattagtagtagtgtaagtggagtactacagtactcgccattagcaagagaagagatttgcctttgccaaattagagcatgttttttctgcactgcacaggtaaagtatatattcatgcagtgggggcaaagctgcaagctaagccaaaaacatccgtaatcactgttagtatcacggagtggtgggcccgggctaatcagacctgtaatctgacatgcggacctccctctcccctcccccatcattaatgctcctaactctgaaacggaaggagaggcgtttatgacgatgatcattggtatcatcggctttggtgggccccaccaccattccaccgtgggccccacggatcagcacactactatgccttctctctcacgcacacaccgtgtcatgggatggcatggcacaggacatggcaatggcaatgtgcacagccagccacacagtgacagacacacacagggttggttgatcaaaccgaggcgaaacggacaaggcgacgcagagagagacagagagagagagagagagagagagagagagactcaacaagcaacatacaggagatggatggccgccgtctccgttccgacctcgccgtcgccgtcgccgtcgtcgtcctcctcctcggacatcatggcgagcactcactcacactcgcaacagctaggcagagatacggagggaagatatagcagatatggattttcccattgctcatgatgctctcgaaccacctctcgtctcgcatgatctcaacaccccaagacaagaacacaacaaagaggacacgacaaacgt

SEQ ID NO: 21457 - DNA, 1501 bp, Oryza sativa
aatgccttatcaatatttggtagattttttaaaagtagaaaattctacagttactaatgtataagttaatttggtaaggtagcatcgataaggatgtgtttagtttgttgccttattaaaattaatttggtaatgttaaaaattggtatgtttgaaagtggtaacaaaagtgaacacgttctaactgatgaactggggccaatgtgattgcacgtaacaagggttggaccgaaactaacgataatgattcttcgtaacagggcagtgggcacagacgcacagtgcattcactagtgttaaaatatctgtaaggtgattcatggtttcattcagatatgcagtgaatcagaacaatgttgcaaacaatttgcctgtgcctgtgaaagggcatgtagcctagtagttacaagagcctcggtagcatctgaggtcctggattcgactcctataggagcgaatttttcagggtttaacggaaactttgtcaatatctccaggattgatgctcataggggtagggtttcatattaatataatagaaaaactccccataggatgctcataggggtagggtttcatattaatataatagaaaaactccccatgggaggggtagggttttcatgggaacggagcgaattttccaccttcccggcctgaagtatcagaagttcagaacacacatggaagctgattggaaattggaaagaaaacaaagaaaggaatcctttataacaattgatacccccctctcacgatccagagtccatatatatcaatatccttttcacacaaaataaaatgtacacacagcgaggatgcaggaaactgctggaattatcagcctacacaaaccaaatatcagtaacaaaccttttctccccaatcagaacatccacgagaacatttaggagctaaactcattattcattcatgtcttcctccacgtacaacagtcagatattaaacaggtaagacagagagaagaagacacaggaaatagtcataaagcttatcaagtaatcaacttttacaatatattggtcaaaacaattatctatatcccaataatctatatagaattattcattgttcaaaactgtaatagttaacgactgaattgatgtctgatgtctctgtgcattgcttcaatgatttatcaatccacacacaaaaccaaaaaataatcacttgccaaagctagcatatccaccagaaatgaaagaacgaaaaactaacactaacatccatccatcgactaccacaagaaaaaaatcttataaagaacctgcttttgttgtacctatctgactatgacagcaccaagatgaacacaaccaaatgaacctgtacagcaaacaacagccatgaaatttctgtggtcaaggcattcagcacattgcttcttctatacaagaatacccagatcaagattaagaacaacctatggcacaagaaatcaagcggcaatcacaaaaaagaaagaccagacaatccaata

SEQ ID NO: 21458 - DNA, 1501 bp, Oryza sativa
ttgtgacactgattttgataattgaaaaacacgttatatcgtgcattacggttcaagtataattcaaacttgcgtcaatataaggttgtgttcagcacaaggagattgatatgaaaattctttaattttccacacacacgcttttcaaccgccaaacgacatttttaaaaaaaaataatattcatattaattattttaaaattttaaatagttaatatttaattaatcatatgctaatgatttactacatccgtcccattataagtgcagttatggttttccgtgtccaacatttaaccgttcgtcttatttggaaattttttatgattgttagtgttgttgttattagatgacaaaaatgaataatattatatgtgtgtttaatttttctatatttttttaaaaaataagataaacggttaaacgttggatacgaaaactcacaagtatatttcaactagaaaaaaatgcccgtgcgttgcaacggatgaagtatattttaatcttgttattgttatatggttaagttaaaatgaaattcattgtgggagttcgcttggatatatatatatttaaaaaatcattagctgtagttaggggtttgatcgtttcaagttagcatgtgagttttttaaaaacaaatttcttatatgattccttctatattaccaaaagtgaacaatcttgaaaaccgattcaaatacgaatatgtatttccaaaagcaaacgaacttaaaaactgactcatacacggatgacgtaccaaaataccggcaaaaacatcttcaattttcataataactagaaaaatgcccgtgcgttgcaacgggtgaagtctattttaatcttattattgatatatggtttagttaatatgaaattcactgtgagagtttgcttagatatatatatttttagaaaatcataagctgcagttaggagtccaatcgtctcaagttggcatgcgatttttttttaaacagatttcttatatgattccttttgtatttaccaaaagtgaacgatattaaaaaccgactcaaatatgaatatgtattttcaaaagcaaacgaacttaaaaatggctcatacacgatacacgaatgacgtaccaaaataccggcaaaaacatcttcaacttttataatagtagagatagagatatagattaaaaccaaaacataaaattaaaactgactcaaacacggatgacgaattataaaaacatctttaatttttataaccgactcaaacacagataataagatgtgaaaagatcttcaatttttataataagtacggatagtgattgggacggaggtggtaactcgttttacctatctttctcaatctatcctattcgattctcgtcatcggcgcatcgcctttttctccaccgcttcacttccccactagccacaaggcccacaacccaacaaccttccactgatccacacacagccgcgaggagagagaaagagagaggagagagagatggcgg

SEQ ID NO: 21459 - DNA, 1501 bp, Oryza sativa
gttacgtgcaatcacattggccccagttcatcagttagaacgtgttcacttttgttaccactttcaaacataccaatttttaacattaccaaattaattttaataaggcaacaaactaaacacatccttatcgatgctaccttaccaaattaacttatacattagtaactgtagaattttctacttttaaaaaatctaccaaatattgataaggcattaaatttagggcatgttcagattgtagccaaaataaaccttaccaaattttggcaggatttcttatgtatttatcaaatttggcaacaaactaaacatagatattttttgaaaactttaaaaaaaatggtatggttgaaaatagcatcaataacagcccctaaatacaaccatcaaaatgtgtcaaaattggcagggttaaaagtggatgtaaactgaacaaacccttttactattttggccgccggttgttgggccgagctgcttcatgggccgtgcacaccggagaaggagatgatggactgatggctagttggacaaacctgagccgtccgatgcagatggacggtggatggagtggggggaaccacacgccgctgacgtagctacatgaagtcatcagactccagccgatccgcccacacatgcgcgacgcgcgtcccacgcagccatcaccggctcaccgccgccgtcgcctcgtcgccgccggcccggccgccgcctcccctcgagctcgtcgtctcgaggagcgctcgggttccggtcgcctcctcgtagggaggaggaggatcggaggaggaggggtttcacgccatggtgcagcaccagtatgtcccgcgcaagcggcgggccgagcgctcgttggcgccggcggcgccggcggcgatcttcaacgtggaggcggaggagggcagggccggcgatgtccccttgcacaagcgcgtcaaggaggagctgcagctgcagccgccgccgccgtcactgcaggtagattagattgaatttttatttttatttttttgttttttggttcctcgtcgtggctacgtgattgcggaatacttagcctgttccctattctaaggaaatggtgttatggatttctccattgagaatactaatatattttatccggattaggagtgagatcagcaggaactatttcgtacggtcagcgaaaattaccaccagaaatatcttacagaaatcacttataacgatacccaaaaaaataaaacattgacacgggttgtaaatatttgtgctccttgctttaatctggatatccaggccaacgtgcttcttgatggagattgtcaatccaattaattaggcactcaagggtaattggagattagtgaggagggatattatattggttaagctttgcgtgagagatgctattattacctttttattttgtttctttttcttttcagctctggcaacaaatggatttatttccgaacaaacaaaaaaaaaacatcctaattgagttgctagc

SEQ ID NO: 21460 - DNA, 801 bp, Oryza sativa
agatcgaaaagacaggggaagacggatcctgaaagcttcacattgaaaaggttagatcgcatttgatcgaaatgccagggggcgatcaaatgacaactctagtggtgcgaatcctgtgtttggtcgctccgtgcaagaaattgcactgtaaccgctggaagaaatgctctgcatgcaccttattaaaagaaaaaaaaatatatcagtttttgcctctgtagtttgccacctgtgtcaggtagtaccactccaatatgtgcacttaccaacaatagtttctcaaatgctcagtgacaaaaaggaaaggaatgatatacgacaatcaatctccaaaagtactatcataaagttatcaatatttttaaacttattctaatataaaattggttttcggaatttctaaagttcaaccgagtctattaaacgtcgtattgaccagagggagtagcaatctgtgataaacaagaggaacagaaaaattaaattgtctgtcaggcttggccttctgtgtgttctttttggtacaaacaccatgaaaaaaaattaggtggataggacgttaaagtgattatctgattccaatttttgtggatgggacatcaggtggataggacactgttctatgatcagattcaccatctagagttttaggcaattgtgccttgtgaatgattatcggttccaattctttcagacctctggcttcatcagttccaattgaggcagttctgttcgacattgatgggaccttgtgcgactcagatcctcttcatcatgtggccttccaagaaatgcttcttg

SEQ ID NO: 21461 - DNA, 1501 bp, Oryza sativa
ttatttacctggctctctctccccctcccctttgatctctttaggctgcacatttatttactaaatagatattgcacgtatattcgctactatagaaaaggcaataggtgtcggttgggaaccccacagacacctagaaagcgacactgatgtgaagagaaaatatgtgccggttctggtgtctgtttagaatcgacacctttaaggtgccacgaataaaaaaaaagacagctcgatgagccgagcaattccccttcatcccaactaatccaagaacattcaagcacacaaagaaccctaagaatatccaacaacatctgctgttgccccctccactccagtcgctgccaacgcctcctctcccctactctggcggaggggaggacgtcgccatgccaccgcctcccctcctgccggatctggcggaggggagggtgtcgccactaccatggatgggtgtgttggatggagtaggaggagaggagaaggaagaagaggagaagccttacttattttttaattaggtgtaggtatatggtaaaatctatttggagagacctctcgcttttaccacgtccatatatagatatagatgtataaaaaaaaaggggtcaatccgtttccctgtgaatgtttacaagccgttgggtacggctgcctctgcctttacaggactaaattaaggaagaggatacggtttccatggagaaaggttgtgcttttttccgagctcttggcgtttctcctgtgggaagaatgaataatcgatgccggcttgcagggccccatttctgttattagtcaaggctattgatcattctacttaactagctagacatttatatagataattagatattgccaatggctgtggttgattgaactctccagttaagcgcatgtacaatggtgcttattaatatactatctctgttgtcatggaagtaaatttgatagttaacatgaaagaaagagaaatattgttgctacgcatgacagcaactcagagtcagctcttagtatttctctatataggctacatgactatagaggctgcttatagagaaatgccctatctgtaggctacatgactctatccgttaagatttagatataatttaatgtcattaaatttacttgcataataagagactctgataacaagtatactttaatatgattttacatatatatactagctagatgcttgtcacattcgctgttcagtctgtgagtgagtttagtgtacgttcgtacgtcttttatgcgattgagtgaaaaagaaataccgtagagggcagactaatatcaagttactaccttgcaagcttgcatccgacgtgcaaaattgattttgtgataatattttgaaaattcaaacaaatgaattgactaatataaagttaaaaagttattttagaattactgttctgagaaacttatgtacagagaatttttacaaaaatcgcatagcttattatttggaaagtgtgggtgataa

SEQ ID NO: 21462 - DNA, 437 bp, Oryza sativa
ctatttctcctccctcatctcttgaggctgattgaatagtctctctcatcgcaaaaccggtataacaccaccattttaaaaaatcagttgtgaaagaacatgtagcctagtggttgcagtgacctgagtagcacccaaggtcctgagttcaaatctccatagaagtgaattccagattggattatttgagagctaagctgttcctaatttaaaagtctaaaaaaattttagaaaaccggtgcaagtcaactctttcggttcggtttgactcactgagccagcatcttcttccttagagctagcaagtgggacccatatatcagtgacttccacctcatcgtattttctaccttgcctcttaggccgggagggcgacggcggagttaatatgtcaatggacggaccagtgtaggtcaaataaaattgttttgtttaga

SEQ ID NO: 21463 - DNA, 1501 bp, Oryza sativa
tcgaggacagctttagctgctttcttgtaggcaagtgaagttgcagcaactttcttctcatctccttgggccatcccgagagcagcaaaggcgaacattctccgcttccacgtggcagcttcaacttcatccttttttgctggtggggcagcagccacaacggagtcggcggcctcgttgatggcctgagttgcctcatccaagcgcttatcgacaggggcgaggagggccttgttgaagctcttctcgacgggggcgtcgcattccacttgcactaacacggccgatgccgcgatggctgcaaggagtagggcgacggctttggccattgctaatgaactggacagggatctttcaatgttggaagatgttgctactgcgcgcggatttgctgtgtgagtttgtagggatcatcggggctttaaatagggaaacacgtaccatgataacctaaggccaagagagcttcatggtccaaaattgattggttgcatgcatgtgtgccaagtgttcggtccgtagtgcatgctatcctttgtcttgactgagcctgcaagatccaaatctggacttccacaaccccgatatgaaatttatatgtacgcaagatgttaagggcagaaaacccattgtccggttggcaataggtacgcgaatgagcatgaacgacgtgtcgaggggtgttgtcaaagaaaaacaaaggtaagaaccactttggcaacaaattcgacaaggtcatcagcgattcttatacgagtctacgcaacggtcactaaagttccaatagcatgtgaagctataaacatatcattcaggttcctaggcatcaaacttcgccaatgttacttacggtgtgtttgtgaggaggggaaaagagaatatacgcaaaaaagggtgagtcatcagcgtatgattagttgagtgttaattattttataccttaaaaattgattagtaggattttttaaccaacttttgtaccgaattgtcttgcgaaaaacacaccgtttagcagttcgagaagcgtgcgcgcggcgaacgagggattttttttctccggatgccaaaaacgcagccttagagcgtatatagcaaaggagaagtaaatgtcgaggacatcgatggtgaatatgccacgttactcgctaagggttacgacgaagcagtcgtatttgagataggaagtgctttgcacttggacggcgccgggtatgatgctcttgttctagttttagccgctcatatggtacttatggcggaaaaaaagacatggcgggttgtcgtaagtcctagaaagaattcggatgaaaaattcatgcccgttttactgaagggcacgccgaatagggagctacgtacataaatatttctttggctaactctttgaataggtccagcggctgaaacaaggaggctagcgcagttgtgcttttgattcaaggcggtttgcaacctatctaaatgcaagatgcctaggaagcgggatatttgacatggaggt

SEQ ID NO: 21464 - DNA, 1501 bp, Oryza sativa
atcgccgacattggtagacgaccggacacgtaccgagtatcaacggttatttatgtaataaatgtcgtgcaatcaattctactcattccattctctccatttgtaagagcaccagggggaaaaaaataatccggtgccatctaacatttctagttcaaaatgtcgatccttggcacttggcggaacttttttttttccatgaaatcctttgaatgattctttaaacaaaagtatggagtaaaaatatcttatgtaagaaataacataaaccggaccagcttgcgtgcatcaacgcttcgatatatgcacacatataagactgttgttgggcggctgttatttgccgagattccatgtaaaataaccataggacttgtgacgagatctttcggtttgcccaaaacctccatgtcaaatatcccgcttcctaggcatcttgcatttagataggttgcaaaccgccttgaatcaaaagcacaactgcgctagcctccttgtttcagccgctggacctattcaaagagttagccaaagaaatatttatgtacgtagctccctattcggcgtgcccttcagtaaaacgggcatgaatttttcatccgaattctttctaggacttacgacaacccgccatgtctttttttccgccataagtaccatatgagcggctaaaactagaacaagagcatcatacccggcgccgtccaagtgcaaagcacttcctatctcaaatacgactgcttcgtcgtaacccttagcgagtaacgtggcatattcaccatcgatgtcctcgacatttacttctcctttgctatatacgctctaaggctgcgtttttggcatccggagaaaaaaaatccctcgttcgccgcgcgcacgcttctcgaactgctaaacggtgtgtttttcgcaagacaattcggtacaaaagttggttaaaaaatcctactaatcaatttttaaggtataaaataattaacactcaactaatcatacgctgatgactcacccttttttgcgtatattctcttttcccctcctcacaaacacaccgtaagtaacattggcgaagtttgatgcctaggaacctgaatgatatgtttatagcttcacatgctattggaactttagtgaccgttgcgtagactcgtataagaatcgctgatgaccttgtcgaatttgttgccaaagtggttcttacctttgtttttctttgacaacacccctcgacacgtcgttcatgctcattcgcgtacctattgccaaccggacaatgggttttctgcccttaacatcttgcgtacatataaatttcatatcggggttgtggaagtccagatttggatcttgcaggctcagtcaagacaaaggatagcatgcactacggaccgaacacttggcacacatgcatgcaaccaatcaattttggaccatgaagctctcttggccttaggttatcatggtacgtgtttccctatttaaagccccgatgatccctaca

SEQ ID NO: 21465 - DNA, 1501 bp, Oryza sativa
cgatgtttttcagttcaaactgctaggtcaataggtttgtgaaatgaattgtgaaaactagctttatgcaaataaaccaagccatccttggacccctgtgtgcattaaattcatcttgtagtggtgacttgctgagtacgtatgtactcacccttgcttaattaaatcttttagaaaggagttggcgtcgattagatttatgccatgctgttgtcaagtacgtgttgaagatgatggattagggaccataggttcaccagttgttgcttatggagttcgatggaccgccgctgcttcgcttccactcttatctattgctttggtattttggattgtaagtgaccatgcttggtctatttcgggacccaatgaggttacccttatattattattgtagaaacatttgtaaacgatgtcagttgtgatgttattatgtgctatgcgtgtaccacctactgatccagggagttttccctacctaacacatgggattaccggtgtataaaaccgggggtccctacagacatggtacttgagctagacgactacaggacctaaggacccttgcgaccaccattaagatctaggattggtttagtatagcccattaccctttagacaattatttgcgaaaaattattttgataaaagcatagattcttactgctcttccctatcccaagtatttttgaaaaatgtatttatcaaatctcaactcacctcaatattcaaataatcctatgcagcctataaggattaagaatgaagagatagataatataatagagtcaacccaaatactaaccgatcaaagaccttagatgcatgctgtagacgatgtattgagcatgatccgcttcatgttacgaattttcattatatgaggcagcgttgtattgattgcgttgattgtgcagtagcctttaggatatttagttgcccatttcccttccctgttatgctcaccaagcgtatgaaacacatcacccaaataattaaaactacctattaatcagccccttcttttaggaatcaattttatttctcccggtggattttctctccccttccctactgagccgaccggcctcaacccactgccaccatgtgccaagcctccatccccctcctgtgagtgaaaagaaacagagacagagcaaaggaaaaaggcagagaaagaagtgagacagagacagagacagagcagagaaggatcgagagtaacagaaagaaaatagaaatctatacctacttaaaaaattcgtaaggtttccgatcgtccgtttcgtccgtcacaaaaaaaatccttcctacgcgcgcgtgcgatctatcccgcttcaacccttatccgatggtaaaaaaaaaacgaagaaagaaaaaggtcacggtggcaacctcggtactggccttcacagcctacccccgtgcgccttaatccgagtacgcatcaaatttggacccaaatcctagaaaaaacactactacaagaagacaagaacag

SEQ ID NO: 21466 - DNA, 1501 bp, Oryza sativa
tttcctttattatattaataatttaaaatattgtggtttgactgcactcattttagtgttagagtatagagatagtatcgtattatacccagttgttatggtacatagaattagtttctatcaatatatttttagagttaattgagattaaagtcttgtgcgcttagctacacatgctcccgaggcggcatacaatggcataaagattgtcatagggcgttgctagttggcgcgtctgcgccactacggcagatcgcacgcgttgcggatgtgcttgggactaagggcctgttttgtagagctccaacttcaatttagctttaggagttgggtctggagtggagtcgtggagctgcctaaacccagctccacctctctaattcattttgtgagagagctccacccagctccgctcccattttaggtggagctaaaactgtttggctgagctccagctgagaggtggaaccggagttgtgccaaacaagccttaagcctggtgcataatgcttaagtgctattcgcaataagtttttataatagaataaaaaataaatagttgagtctagagttttcaaatctggacataactaatattttaaaattctgaaagttttaaaaattaatttaaagattttaaattttgagttaacagtttttaaatttaatttgaaacttttgaatagaatttttttgaatttcgagttgttagtttcaaaatttggagtgaaagttttaaaatagggagatcttttgaaaattgatttgaaagttttaaatttaaatcgacaacagactatgtatgtaaatttaaaactttcaactcctctacaattcctattgatgttgttgaatcaaagcagtccttcaagtcttaacacatactccgtccattccaagaaaaagccaacttctgactatgaatctgtatataacgtatttccagatttatagctagaagttactattttgttttaatagaacagagggtgtaagtttgataaaataaggatacaaaccaagcaatcacatcattgtacttgaactatgagtggaattgattaaatctatagttcaagttacatgtaatactcctttgaaacgttagattctaaaaacgcaggattaaaatgtaatggctttttaattctataggaaaaatcatagaaattgtgcaaagtagccatttagatgcctcacaggataggtaggggaaatttaagattatgcgttgatttgttagagagagaaagaaagaaagtgcgttgaaacttttcaaataaggagtaggcctcttttgaggaaagaggatatatatgcctcttgttagagtaacggtacaatagacaaaattagctagcgatagtgtgtccacggtagtaaatgtggtgaggtgacagagaaacgagtggagagagagaggtagcgagcgactaagtggtgtttacatccaacgactttagtccctgtctttagacactaatttagagtattaaatata

SEQ ID NO: 21467 - DNA, 1501 bp, Oryza sativa
tttctgaaattcgtatcaaaatgaatacaactccaaatgaggtgattcagttctgttagattggcaaaatcatgtacttagtttttataaaataaaatatggcacttacggtacccaaaacatatctaaaatttgaaataactaataactactatagcatatcacttagcttgaaaaatttataataaacatatcacttagcttgaaaaatttataataaaatcattttaactctaaaagttatgaaaccaattttgttgtacacctaagaacattaccttcactgcagcaagccaacaattcataaatcatggacctaaaatgcacctaaaggataatagagcttaattaatctagtgctagtattaaactttgaaaattaataactctcaaatgcaaaatgataaaataaaaattctttcacctaaattcatcttagaccagcactaaccacactagtaaactcatacattttagagcattttagatttttgcatgttttggcatttatcgttaccgttatttcttttagatggcaaaatcgttatcgatgaggggtccgacatgaactttatctgaacaaggaggatgataatgggctctgccgaaagatgaaggaccctaaatggacttgtacagagggttgaagtattgggcctggtcagaaaataggggaacttcgatagacttttactgagaaattaatttctctggcctagaaagaaaaggcaggtaagctagacttctatagaaggattaatgtctgggcttgaacagggaagtagagggggtcgaatatactttttagagggaagatggtgcacaggtaggaatagtcctatttttatttttcttttcctttactagcaaaatgcccgtgcttcgctacggtgtattgaactaaaaatatttgtttttaagcgaagttattttcccactgttttggtatttttttgctcgctagaaaaagtctcaaatgatagagagaaatatagtacctcataataaattattattcaatagtgcgttgcaacgggaaaaattaatattattaacttagtaaagtaataaaaaaagagcatccacgttagctcttatagtctagaaattctcatattaatattatttaattttagtctaaatttaaattctatatcatgacaaataaacaattacatttttagtcgaaaaataaatcaatatcttgagaaaactctagccaaatttttagttaattcagtttagttggaattaaattaataagcagtaataaataattaaaatggtactaatgctatttctgaaaatacaaagatgcttaaaattactgagagagaaaacactaattttatcccatcccaaacttacaggcccatttggaggcccaatagtgcggcggcccaatgtgagaggagccgaaggcgtccgatcgaatggacggtctagattgatcccaacctataaaaatatctgcagccaaaaccctaaccctaaatttcat

SEQ ID NO: 21468 - DNA, 1501 bp, Oryza sativa
tagactacttacaaaactaattacataaataaaagctaattcacaagacaaattttttaagcctaattaacctataattagagaatgtttactgtagcatcacataggctaatcatggattaattaggcttattagattcgtctcgcaaattagtccaagattatggatgggttttattaatagtctacgtttaatatttataattaattttcaaacatccaatgtgatagggacttaaaagttttagtcccatgtaaacagggccttagtcccatctaaacagagcctaaatagccactgacgacacactctctccaagacgtgagaagcggcaccaggcctgctgctactggccaacgtgattgtggggtccacatgaggcgatgcgagaccggcaaggcatctaaacggagcttggaggcgaagcgttcgacggcgatacgatagaagctagcagagagctcgttgctggtgatgagagctgcgtcgctcgaggagatggccggctgccacggtttgtggagccccaccggcgacgctgagatttgatatctctgggacggggagcacgggagcgaaaagacatcgacatgtccaagacgacaagaacgagagaaacgagcaaagaaatcaagagccaaccaagagggaggaggagatgcacccgagatcgccggtggtgtcctgctcaacaccgggcgacggccgacggtcttgtcctttctttgagacttggagcattcttgtcctggccatggaaggaaggccgctggcctcccaagcaactcgcttggttttgctctgctttgagaacaagtgggcagaaaaatggtgaagaacattggaagaagaagatataataaaaaaattcataaaaacatgtgggttattgatgcaatagctaactattgtatgcactagctcttatcaagttaactctaatgctgacatagatgtttttggagccaactgttggctgcactattgcccttgctcttagaatcccttaaaaatttagaggcaaatcctatgaaattcctataaagcaagcctaccatccaaaggttctcataggattttatttccaatggattcaattccttcaaatttcccaaggagccctaagacaaccggtgcatgattactacggccgagtttagttctaaactttttcttcaaacttttaacttttccatcacattcaaactttcatatacatacaaacttccaacttttccgtcacatcattttaatttcaaccaaacttctaattttaaggtgaacttaacacatcctatgtatatctccgaggcatgcatgcatttactacttcactacttaactgtagtgtcttccaatggattcaatgccctaggaagcatatcagaatcctaataaatactttcagagatcctttggctgtgtttagttcagcgcaaagtttggattttggttgaaattggagatgatgtgattgaaaagttgtgtgtgtatgacagg

SEQ ID NO: 21469 - DNA, 946 bp, Oryza sativa
ctctcagctttccattattattaactaattctttgacatgaccagcagttctgttaatagtcaaggctatagcttagacatagatattgccgttggctagaacttggttgattgcaacctccaggcgcgttcactttaattatgaattatcatagtcacagtacttaacatgctactaaatgatgtgccttgtcctaaaactttgttcggcagtattttcttaaaaaacaatattaaatcaacttgttaaactttttttaacatagtacaaacacaaatactcacaacacgcgtatactcaccctatgaatgcacacatgcacacatcatccctgtatgcacctccggaagactacaccggtatatcttgagattgacgaagtaatcacaggtgtatcactatcgacggatacatcacctataaaaaaataattagccacaaataaaagtactcgtgtcaaatcttaaacttgaaccaggtgagttggttccttaaaaaaacttaaccagttgagctattaatcagtttgttaactttataataactaatttgtttgtctctcgaaaccgtgatgaactcgaataaggatcgactgcagctatagtagggactccaacttaagcagtcggaatcatttttcaccttgatacgaccacggttaaaatctgtgccacatcggttctaaagagtatttgctacggtgttcgctacaggaaacatccagctacagtatttgtcagaaaagttccaaggaaaatcttggccgttactttccaatccaccggtgcctatatgacagcttaagttgcagtgggtatcccaattcgatgaactctcccactacttgacgagcaccccaatagaataaatgaaaaaaatgtaattgctgtcagggttacgaataaggtataccctctacccttggatatacgctatacggcaata

SEQ ID NO: 21470 - DNA, 652 bp, Oryza sativa
caccccccatactcaatctatctataccttctatataattagtacccactacttttaaatcttaacatgtaacgactagagatgaaattggtacatatttttcgtcagttcggaccttgtttttaaaacaaataggttcgttagatagttccaaatattttcggatatagaaacaaattctgagtattttctcagaatagaaccgaatacagtaaggacactatccatcggaattgaaaaacggtcggaaagtatcctggatttttctctagatatccgtagaccgcaagtattaattaattaaaaaacacatagatatacataactttatcatatgaagttagatgaatacaaactttacatcaaaattgtagagctcgacgagagatctacaactttgttgctgaagactttattatttgagatcatttagggggtctaaatattcattacaaaatatcatatctgcttttacaaaatctgtaatgtacaattcaaatgacatttgatggaaacaaactctatatgaaagttgtagagttgaatgggatagtttatgacatttataatttaaaatatttaaagtgtaaaaacttgaaacggaataaagtgaataacattttcaatctatacaacaagaacatacatgata

SEQ ID NO: 21471 - DNA, 875 bp, Oryza sativa
tgttttgaaaataaaagaaaccaaaagaattatgtagtatatggctagtatttgttggcggtaggtttacacacagatcctctcatctgtacggcccattacatgcctgggcaacgtgggccgtcagaacgaagtcatctcaattgggcctaaatttttgccgttgtaatgtactcgtcggggtgcatattcctatagcccgtcaccgatgactcttatcggtgtcgggcttctatttctgcccgttagagattagtgtgcgcccgttagagatgacattttttttgcccgattgagatatactttgcacactatatatactccagcagtccgttgtctgtagttatcccactgttcactattttggtgggaggttgaaggaggcgaatttttgtaatttttttgcaaacaaaaataggaaaatcataaaagtaagtaaaacgtgttggcaacttttttttgacaagttgacaagcacgatcgaagcaccttaagccttgcggtgatcctaaagtcgccaaccacctcgatctagcaaagagctaaacctagatgggttttgataactaaaccggctagcggagccgatttctagataactacccgtctcgtgggcaaaacggaaggttttcaggacaaacctacaaagaggtgtcgcactctcgcagcggcggcggacggtttacggcgcaaatcgataaagatggacaaactaagagaaaactaaaagcaatatgaaaaacgattcgattgattgattgtagattggtttttacaatgaaccggccatgtcccttatatagaggttggtcttgccctctacaggccctcctccacgtctaactcggggtagaaaccaaaggaaaccagaaaca

SEQ ID NO: 21472 - DNA, 210 bp, Oryza sativa
agttctgttcaagatagtcaagtgcagttttcctaagcctttagattagatttttacagtacaaaacatatatcttcttaccaatgcttattttttcgtgaaaagaattgcacgtcaatataaatgcttatgtcaattgcccatttacgtttcgatattttgtgttgaaataaattgtgcaatgctttatcttctgcagataacagctaa

SEQ ID NO: 21473 - DNA, 1501 bp, Oryza sativa
tcttaaatgaaatttgcccacccaaaaactgaaattacatgagaggcttaattaaggactccattatagaacttattgatcacctttttagtctaaatcaacttcttagcactaggtgaagccgtggttcctgtacatcgtacatgctttaccaagacgaacaccgtaaggagcaaggagtttagatacttaccacagctgtcgatgttgggactttttgtatttcccttggccatcgtcattggagaagtggcgctgcagagtaggtcctggggaaccagaggcactcagatggagatgcagaagataaggcggcaagtgaaattccgcgtgcatcgccgtcaggtcgagccatacctcccgaatccgaatcagccccaccatcgccggatccagaacaggtaggaggaggtgatgccgcagtagtgttggggatgggaatgaggaggaataggatggggtgtggctagggcagggggaggtggaagcggagaaaggggaggtatggattcctttgcttcccactgcaggctcttcttcttacctctccggtccccattgatgtggtggagattgggaggagacatagcggctttggagatgggactagcacacaatctagcacctccgcctcccggtcccgggagtgggggcggcgtagcgaccagggaaggggaggcggcctcccgagacggtgtcgcaacagatccaggtagcaggggtgaaaatgaaaaatggtaatactagggaggtggaaggatcttattgcgaaagattttgccaatcaatgaatccaacagctcacatcatctgtaggggcaatcggacggcctatgtttttctgatgacgtggcgcaatctggtggcgaaaaactttagtttttttcactactttagatttcaaattaaagtaattaaatcactataatttgttcggttggttcatagatgataaaacaattaacacaaaaaattttaattaaaaattaggtattcgggaaatatatctttccattgcaacgcacgggcataatgactagttttttttaacatgaaaagtacatttcattcattaagaagatcatctgactaaatcattagccacgagaaaatatgttttcttcaactaggaggtcataggttcaagtcctagttcttctcacacatatatatactagggtttggggaaaggggtgagggttgcaaaaacaacccctaaacttctagttttcagagcgcggttcaattttccgttttttcgcttcttcatatagaatattgttttcttaagaggtcctctaagtaaaagcgcacaacattagaactaaggaccagggatctataacaaattatcaagtaaatgaagggtgtttttgcaaaatcaccaacgacgacacggacgtgcgggagctcacgaaaaccacccgccatccagcgcctcgctgacgcgtcggcacgcgcaggtggccacgccagctcaaaaatctccaggagccgcaaa

SEQ ID NO: 21474 - DNA, 1501 bp, Oryza sativa
gaacttccggataacacttaggaaaatttctttcatcagaccggaacttccggacttggaagacaagaagttccggacctgcatttttggacagatggagtatttgcaaaaataactcctagggaaactttgacacttggttcacgctaagagcacttgacatatctcagagcatcacctggaatccctcttaatagtacggtttatcctaaaaactcgattgcaataaataaactatcatatacacttctcgagttccggtccgctttgattttatacttttggggggtctccaagcatccaccttccacaccttggactaatgcatctgaaagtagctcaataaactcattaatctcttaaccacatttgtcattaatcaccaatacccactagggggattaatgcacttccaatgtcttccatagatgccatgatttctgcagcattggaaatggaattagtcttatgataaagaagtattacactaataggggattgttcaatgtattaaatttataataccatatagttggttagttttgaggtcccattcagtgttttagattcatattaaaatctataccttgattgatgagaaccacaccagggaatgtgtgggtaaccaaaagaacaggcacacaaaaataaaattagcattggggcattgggaccatgaatatagtgttggtttcatggttcaagctgaaagcgcacgatatggtgggaggtagtgaggcacaattcaatttccataaacttgcatacaggcttccaagggaacaaagaaattgatttgtttgatcagatcaagcaagctaatagctagacctagaccgggaccaaatcaaaggccctgtcagccataaaagtagaaaataaaaactactctaacatggaaaagcttactctgataaacataagcagcacgaatctaaatactgatggcaagctgaaaaaggaaaaatcaacctcatgatgaaacaatcatgtataatatcagtgtgtcgctttgctggttcctgggctgggtagcgacacgcattggcaggaagtattccttccagtcgcagtcgctccccctgaccgcgcgcagtttccagccacgtctgagtttgccgagagtatttccttttaaggaaagccaactcctgcttatttccagagaacacaagcaagcagccaatatatgtagagcatcttacaattctaattgtatttggaagaaagtatatgaacaacaagcatgtgttgattctgtccttcaagttgtttcaatgttcattgctcatatattgttttcgtaatgtacggactggtaatttaaagtataggattaatgatctgtctatgctgataagctgattaggctaaaagaatgagaacatgtagcttgcggtccacacgatggttattatccaagctgaatatgcaggggaaggcaacattttacaacatgcaacaaaggtcggcctctctcagttcagacagcatccaaaag

SEQ ID NO: 21475 - DNA, 161 bp, Oryza sativa
cacctacagtacaaaaaaatcactaaccttcgaggaaccaatgacaatttaaagaaggaagaatgctctctcataggctctgactcagactcatccatctacttgaaaacatatgcggaaagacattagctgaacacattaattaacatgtagagacaaaa

SEQ ID NO: 21476 - DNA, 370 bp, Oryza sativa
cagcccccagccctcattcctccccccacaaatccagtaaaaaaagaagaaaggggaggagaagagaagaaggggcgaagccctgccggattcagacgccgatttcaggtaatattcatagatcctatatgtgactattgagttaaatactgtgtattttttaaaaactttgtttgaataaatgcattatatttttagggttttagttgtactaatctagaagtgcgtattgtagatatcggtaactacgtagatctgctagtttggaatcagtactttaccgttgcattggcatacacaagaagatattacgttgtagatgtttattgcatgaaagagtaatatgatctagttattttgttgacagata

SEQ ID NO: 21477 - DNA, 1501 bp, Oryza sativa
tcctctaagagcaggtttaagagcaagtttaataggatagccaactactaactccaaatcatctagagccaatataatagccaattcatacaatggttgcttactatactattaatacccggtcctacctgtcatacactcgttacgttttggagtccgtactgtagctggctacatatctgtagcccgctgctattctctctctttctttatctctttaaaatatatttatagctggcttatagcccgctattgtacctgctctaatagtatcgccagctacaggctataaatgtgtaccatgtcatcttatagctagagagtacaatagtaagctgttgacacgttaaacaagtaatatctttattaattttttaatcacctcaatctctttcttctttacccttccctctctcactccgctgcaagactgacaaaaagcaatgcacaggcgcctaggagctcgtgtgcactggcgactaaggccctgtttagatgggactaaaacttttaagtccctattacatcggatgtttgaaaattaattataaatattaaacgtagactattaataaaacctatccataatcttggactaatttgcgagacgaatctaatgagcctaattaatccatgattagcctatgtgatgctacagtaaacattctctaattatagattaattaggcttaaaaaatttgtctcgtgaattagcttttatttatgtaattagttttgtaagtagtttatatttaatactctaaattagtgtctaaagacagggactaaagttaagtccctggatgtaaacaccacctaatttaccgtccgctcgcaccctctttcctcccttctctcgtccatgtcatcatccaatctgacgtgtagctcatatcgccggctcaatctaccttattaaacctgctctaggagcaaggataataatatagccaacttcctactattagcctatcttaaagccaacatatataatagattagctataaggttggtacaatttttttctcctctctctatctctcacttatacatttaatgtatttgtcttggagcttgtgataagctagctcttgtatgagagccaacatccttaatttttcactacctctcttatccatctaagtttatagtaggcttataggtcactattatacttgctctaagggcacccacaatggttatctataggttctctacaagagatctatgtcaacatatttttctacttggaatgtattaaataaagagagagagcaaagctatctactaacttagagatagtctatagagaaaaacaaggcaatgcatgagagagctatagataccaatgtagacatactattattaagatggtttactattaatcgagtatattgttaagatgtacatgttttatagagagcaccttactttaccattgcgggtgctctaagacaccgctgccttcgtccgctccggtcgcagccggcggcgccacaac

SEQ ID NO: 21478 - DNA, 1481 bp, Oryza sativa
atgcagtgtatggatgaattggatgtatggatgcaatggatgcagtagatgttttttgcattgtagtagttggatgatctagatattgctatgcagaggatgaattttgcatgatttttggtggaaatgccatgttggatgtatttgtgatgtaatggccaatgatgattgctcaagaacagaccctatacacttgtgatttttggggttttttcaataagaacagaccatctacacttgttcattttattttggggggggtggcagtatgggatgttttgcaaaatggatgcattttttggccggcctcactcttgttcttgtttaggtttaaatgtgggtttttaatgcataataacagaccatatatacttgtgatttttgggttttttcaataagaacagaccgtctacacttgttcattttatttgggggggggggagtggcagtatgggatcattttatatggctgttttttttttttgcataaggacagaccctctacacttgttcttatatggttgtttgataatgtgacaccttgaaaaccttaaatcagtaaaaatcaagtctaatttgatatattaacaaataggtagaaccgagtctaatttgatgaattagcataggatttagggtttagttttagatttattttttggagcctacttaggagtttatccaacagactttaatttaaaaaatctgagtcacattgtttgatcaaatttgctttcggcctaggtcttcccaagccggcccaaacttaggttggcccatcttcggcaaaccgagtcaattcgatggcccgcaagccgagcagctgagcgcggcccacttatgcggggacggtccgatgcacttccgcggcccattttgcgcagcgtaatcggcaacggcggcccaacgttgccgatatctgagccgtccgatctaatggacgtctctgatattccccgctcggatgaagcgccgaccgagagagaggggcaaaaccctagctcccaaatccctctctccccatcccatttctctcccgcgacgagcgtgtggaacgacggcgaaggcggcgatgacggtccggctaggcggccgcgcaaacggcaacgagcgccgagcggcctagacctcgtcggcaggaggggcgacgccaaggacaatggaggggtgctccaggacagcgcgcgcacagggaacccaatgtgactgtgaggaggtgaaggtgcggtggtgccgcttcccgggaagctctggtgagcttaggggcttcaagtctgttaagtaacccgaacccatagtttaattgatttggattttaactcttatggttcttaccctaaattagggttcttcgaatttagggaattttgtcgggaaatttcaatgtattttattccctcttttcgagttaggggagttttaatatcgtttatcctcttttaattttgggaacttcaacttggtggttcggccgaacctcc

SEQ ID NO: 21479 - DNA, 159 bp, Oryza sativa
atgtgactaaaaagttgtgtgtgtatgacagattgatgggatggaaaaaaaaaagaaagtttggatctaaacacagtcaatatagtttattttgaatatccaaattcattgtactagaatatgtcacatccacccaaaatctcttaatatatattaagg

SEQ ID NO: 21480 - DNA, 805 bp, Oryza sativa
ggcaaccgtgcaacgagactcgcctgctaacattgtccaagcagcagggcaaaccagccaagctgccagaccagccatcattcaccattacgactgtagaaataccagtaccaatgtactactgcaagtacgtataggattagtcgctagagaggtatagtgaggtaggtgcgccactccggccggagcagcatggagagagcttttgattataggatacagtgtttgaagttgttgctactccggcgcaattcatcagcaggccactgccaacaggcaacaggccagcactcactttggccctgttgttttcactttttcaggggtgtactcctactccgttggattaataccgtgtattatttgtatttgatccatgcttttaaaattacagtatgtttttttaaaaaaatattcttttctaccacattgttcagaccgtctgttctaaattatttatcaagtttattttttaaaaaaataatgtatttttatagttaagtagataattcactataatactagtaatgcgaataacgtatttcaaaatgatggaaaattggcaatgtcattataacttagtatctatctatctatctatctatctatctattattatatactaaaagtccattaaacttcctacaaacgctcctaagccgccacttggtgctctaataaattagagaaatcaaagaaattctaagaaaaaagcaaaacatctagccattgattttcacttaaattggtggacccgatattttagaccattagattaaatctattaaaatctttcctactaata

SEQ ID NO: 21481 - DNA, 529 bp, Oryza sativa
gccgtgctcgcagttatcgagcattgggactcacaatggcatcttggttagaaacataattccaaattttattaaataatgttgcattataaacatcatagactttctacttctacattttcagcctttctgcaagtaaacctagctctatacaaatattaccatttcatgcattcattattgattaatataatagcttgctgagtacgttgtactcacccttgcttcaaccccactttttcagagtctatttgatgttcttaccgaagctgggagttcaatcatacaagttagtctcattctaacttagttctcaagtatagattagatagatggtttaagtctatagccaaacattagagttaagtcattctatagcttttgctgtaatagttagccacaaccttgtaaatacccttatattttataaagaaatctcctttgaaaccttaatcaaatgtatgtaatgaagatatagattgttgaacctgtatcaatctaccgatccagggcttgatacagttaaaca

SEQ ID NO: 21482 - DNA, 1501 bp, Oryza sativa
tacccggttgcacagatctatctccaaactagaaatgtaccattccaaaccaggagctaaattaattaccatcaattatcacgttattattaatgagtagtgtgggactaatcacgaaagatattgttagacccgcccaaaaccgcgggcacggctattcaaatagttttactctggctagaggtgtaccactgtacccacaagacacaacccaccgtcatgtcaccgcatccgtgcagacacgtcaccatggcgagtgattgtgacaagacccctcgcataactcaactcaaagcagtgcaccgttcctggatcataatcacccccttaaacaaggcatggactccccagcgatccccatgggcttatctccgccacttcttagtctggtgctccgcaatgagccttgttatacaaagtgtctagccgttgcccactctggcttgtggttggcacggttaatgtttcacaaccgaaactcgtgaaccggtccttaattgtcatgagcacgaccatcgaaaccatgtgctcacaacccaccattatcaagttttagttggcacattaattaattaaccaatcacgattaaccatcgtgagctatcattaaatatctatcattaagtaatagtgaaacattagtcatcccaatcgtgtgctaatgtttctaagcatggctaagcaattatgtctaacatctagctgaaccaatatataaagttcaactagtcaaattataataacccaaggtatcaaggaatagagtaatcaatgcaaattggccatacaaaggaataattcacaccacccggtgacattcgaaaataaatgcacagttgaaataaatagagaatttaaatataggatcaacatgctcaaaggaattgtgtttgggatctgtgtaacttgccttgcaataatgggtcttcaattaatcttcttgaacacttccgacgcactcgcgaaccttcgaaacgacgaaaacgacaagctaaaacgcaaaacgaggaaaaagactaataaaaccaaataaacaaaacaaacatgtagatcatgattttagatgaattatgagtcttgaacggcctcattctgacttcatatgaattaattacgaattttacaagatttaatctaattaaagcccatttaaaaaggattaaataaatttaattcaatttatggataattttaatatgtagatctttattttatagaacttttgcaacttgaaccacattaaaccgagttacaatgaattagttatgaatttttaaagattaaaccggattaaagcatttatatggattttaattgaattatgacgcaataaagaattatttttgaaaggaaaaagggatttattgcgccatcaaagacggtccacggtagaccgggtgcacagaggcggtctgcgaaaccaatggccgagatctaatctaagccaaacggacggccgagatcgatccggtccaccacgggtctacggctgactaagcac

SEQ ID NO: 21483 - DNA, 1501 bp, Oryza sativa
ttaaagggtgtgtttatgtcgaaactagatttcggcaataataaaagggggtggctatcaagctggaaaagtgtatgagtttggagacaaaggatttatacaggttcaggccttcttattcaagaagtaataccctactcctgtccggggatgaatccgccgagtgtattattgattgtatgatttggagaaaatcaacctctgcccctagaggcacccggaccccccttatatatgggaaggagtccgtgttacaaaagataatctatatccctaacggaatatacagatacagataaaatacagtcgtaaccgactaagtctcaaggtgtttccttgatgtacaagttaagaaacaaacccgagatacaaataagatattctacctatattcggtatcctatattcagtccaaataccatcgccgtgtagatatgggatatccataatctccacagtagcccccgagacctttgcagtcaaccatcatagccttctcaaagataataatccgagtgcttcaaatttttcatgctaaggcctgccgagtagcgaagacgaagactgtaaagggcgaaaaaataaagaatatggtgcatcgaatagatgcacctaattaggtgtagcccccaactatgtgattagttaacaaactaaacatatagttgagaacaaaataatagcacaatcgtgcatcatatgacaaaagcagacgcggcgcctaaagaggcattcttgccgactgctttttggtcataataaaaggaatccgagtggttaacactctaaaaggtccacgaatgaacatacttgacaggcatccgaataaaaaactctaaagattacccaccaagtattataaaaattatggtaatgaacaagtctaatagcctaggctatgactatttaccataatgaaaacaggcatataacataccaaggaaatgactatggtaaaaacaagccattccaagttaacccagacagcttttgtagcctaaaaaagcttacaaaaacagcataacgcctttctgtcgggcaccttttaatttgcattgcaataattccaaagaattatatgaccgcataaaaaaggattttatcagcattgggcaacactattgtgcgcataaattgccaaagcaaaaaatgcctaagtctctaaggaacacaatgggccacgctgtcaaaagtattgggctgaggtactgttcaggcctaagcccattcgcacctccgatacccttaacaagaaatcccgagattgaagcgacgcttcgtcttccccgccggaactctcgccattttccccaatccctgctacagtacagagctgcgccggcaaactagggttcaccattccactcgaatccaccttcaaaaagttcatcaaaatccttcccgtgatccaccgcctcaatccctcacctctccccagccatccctcgaatcaaatcagcgcattcgggtaaaatcgatggcagaagaaaaagaaagcttt

SEQ ID NO: 21484 - DNA, 851 bp, Oryza sativa
tgctgggaaacatcgtacaaacgtgttacggctaaaagacactctaaaaaaatggtaatttgttagaagatacttttggctcaattggagaaatgaattcttcaaaaggacgagaaaacccctaagatcgaaagcttttgatctgaggatggagtgaataaggaatacgatatatgctagtgatgtacttgaagtgatggcaaatttagagttgcgtaatttctaaacttttattttaacgccttgtttgaagtatgtggtactaaatacattctcgtctttcttaaaaaattatctcttcaattgattcgaaattgttctctggcaaaccaccagttttttggatgtcttttagtcatgacacgttttttcgatgtctatcagcaagttagacaagttttaggtgttatgtagcaaaattttccaaccaaaataaattcaaggttgcactatataaattataaattgacttccttttaatcatgtacttcctccgtttcacaatgtaagactttttagcattgttcacattcatatggatgttaatgaatccaatcacatatacatgtctagattcattaacatccatatgaatgtatgaatgtggacaatgctagaaactcttacattatgaaatggagggagtatttaagttagggatttggttgagaagttaacatgcctctaaattatgggtcaaatacggaccataaatattaacggtaattactataatataaaaatttataattatggtaaaatttggaaacgtcggtaaacagagaaatcattttcatttctttattcatataatttactattttcatttttatttttgttctgtaagtaac

SEQ ID NO: 21485 - DNA, 1414 bp, Oryza sativa
caaaaaatgtctacgtttagtttgtttccaaaattagcaaatacataggaaatcctgccaaaatttggtaaggtttattttagctacaatctaaacatgccctaaattattaaaaaaataaaatttgcatttatttaatttttaaagcaacttctataaattcttttttgcaagaaacgctaatgagaaccgaggaagaagccaacccgctcttcacttttgaacataccctatgtatggttaatgctaatttatcctctcgtgagatcacattaccttaatcgttttaagcccttagattattcatatatgctatgaaatgtccttcttctctcttgaaaccatggacatcatctcatctatattatttttaccaaaccatcccaattattttaaacatttggatcactgatctattatcactcttatcttattgatctacactatcttaatatttctagcattggaggatctacggaagatgtaattttgtgtaaagcacatgaagttaatttgtctagatacaaagcaaattcattttgtgcttcaacttgttatcatacaattttccaattaatgggaagatgcgatattttgtagtatctctagtattttaaacaaaattaaaaataatgcttctgcgtgtgagtgggttttcttcctagtggtttaaatacttgcgaaaattcaaaaaacaagataagtcattgtgtgacatgtcctttggtaaatttctaaggtcaaaatgactttatacacggagacaaacaagacaataaaaagtgctgttgtatttacaattgaatttgttttttttctccatgtgggtaacgaatctaaccttctatatttttgtgaatagatatatgatcacttatatgttttctaaggccttttcatcttgcttttgaggcactagctgatttctcggctgctcgctactgtgaaaattttgaggcaaagatcctgtttagatctcaccctaaaatttttcaccctatcatatcgaacgtttaaaaacctgcatgaagtattcaatataggctaaaaaataattaattgtacagattgcgactaatttgcgagacaaatcttttaagcctaattgctccatgatttgacaatgtggtgctacagtaaacatttgctaatgacggattaattagacttaataaattcgtctcgtggtttactaacaaattctataattaggttttttttattagtgctcgaacatcctatacgataccctatataatattcaatgtgacaggtcaaaactttacccccatgaacacccccaaagttgcaaagacctcatctcacacagtcaccgactcacagtactcgtacttgtcagttgtcaatctcgacacggaggaagaaggtagctgataccttggcgcgctatcca

SEQ ID NO: 21486 - DNA, 1501 bp, Oryza sativa
ggcaaggggttaatcgagacccagctctttggagctcctcaacggagagtaggatcgcaagatccgaacttcaaaaaaaaatcgctcttgtctctttctgtgatgtttctgtgaatgattctgtgatatatcctctgcttagaatacctgtgcaccatcttgtgaagattggcttagtctcctgtttcgaaatttgaatttcatctctgttttgttacccggaagttcttgtcttagaacaccggaagttccgggcctggcaggccggaagttccggagttccttaccaggaagttccgggtctgtttgaattttaccgttgcgatttgtttttaagatttcagggacaacctattcacccccccctctaggcttcatcagcgcgttcagtgcgaccgccgctgtggaagccgtcgttgtcgaggacggcaacacctggaagctctcgcgtgggggaggacatggggccgagggatggagaggagggcgaggtcgaagcagtcttcctcggcagtccgctcctctcagcccgcgtcgagaaaggcggcaagccgcagcggagcggcgggcagccatgccagggattgctttttcttttctttttttttgcgcgatggcagattgacgaataacgagcagtctcgttcgtttttgtccctccgcggttgctcgtaaatgggctgaatgggccgtcctcgccacgctcgtgcgatgcggaacgaaggaagcagcagcgccgtgagatgccgatcggatgatggatcgacgctggatgtccctctgacattgtgcgcctaacgtcagacgatctgcttcccgtaatctcgtatactcatgggcacaatacagtgacaaaacaatcgcaatttggccgagtttagtttcaaactttttcttcaaacttcaaaatttttcgtcacatcaaaactttcctacacacataaactttcaactttttcatcgtatcgtttcaatttcgaccaaactttcaattttatcgtgaactaaactgtggagattatggatatcccatatctacacggcgatggtatttggactgaatataggataccgaatataggtagaatatcttatttgtatctcgggtttgtttcttaacttgtacatcaaggaaacaccttgagacttagtcggttacgactgtattttatctgtatctgtatattccgttagggatatagattatcttttgtaacacggactccttcccatatataaggggggtccgggtgcctctaggggcagaggttgattttctccaaatcatacaatcaataatacactcggcggattcatccccggacaggagtagggtattacttcttgaataagaaggcctgaacctgtataaatcctttgtctccaaacccatacacttttccagctagatagccacccccttttattattgccgaaatctagtttcgacagttggcgcgccaggtaggggtagcgtcaagcttttcgccgatcagtgcaa

SEQ ID NO: 21487 - DNA, 1501 bp, Oryza sativa
agtcatgtgatatcttattataaagatttaattataacaaatccaacgatataattagtttgaaattcagataaatagtttgagagaaaaaaaatttttaagtttaaaatatgcttgcatgcacgctcagacttgctatgcacctgctgctcgtttggactgaggcgtccgatttttttctttcgtgtcggacagctgatggtaagcatttgccacaaaataattattatcatcttgtagtttgaatcatcctaataaatacaatgcatgcatccaatataattagggaacatgagagtggaggatttaaaaaagtaataatttaatggagaaggggttatagttaattgactacatgcatgcatgccttatattatagaacataaaaaaaagtggttgtgtcttatattatgaaatggagggagtactattttgtaggcatcagaagcgctcgctgcttactccagtaattgccacgtgtgctatagccatggtaaaaagttaatagatacaacaagtagttgcaatatagtctattatttatttattctatattctctcacattctacatcatatcttcattttgtatggtgtagaaagcatgcatcgggtcccacatttttagagagtgtgtgacgctagcgactaattagtcgccgagtgatcctctctcatcagctttttggctaggctgtgtttagtttctgaaattgggagaaatttgaggaaagttggtagtttggaaaaaaagttaagagtttatgtgagtaaaaaagttttgaatacatgtgatgtgatgtgatggaaagttgagagtttggagaaagtttagtgcgaactcagtctttatgtgagattaactcagtctttgaatttgttatcaccggctcttcagcccctattatacttgttctagcacacacgctacaaaggtccatacgacatgaaccactctcacacagacttgtgcacatcaaagccagagaaatttggaaaaaaaaagctatataggtccatcgtttgatcgttttattcaacacgtatgtatatgtacttcaaataaatgaggcacaccgttattcctagagatagaaccagtttgtgtgggaatcagcacctataaccaagccacatgtttttttttaagaaatataccaagggtgtgtttagttttttgggtataaattttttgaagtatacgaacgcacatttgaagtattaaacgtagactaataacaaaataaattacagattccgcctgtaaactgcgagatgaatttattaagcctagttaatcattaacaaatatttactatagcatcacattgtcaaatcatggcataattaggctcaaaagattcgtctcgcaatttacatgcaaactgtgtgattggtttttttttcacatttaatgttccatacatgtgtccaaacatttgatatgatttttttggccaaaatattttagtatctaaacaaggcccaagccaaatgtttaac

SEQ ID NO: 21488 - DNA, 639 bp, Oryza sativa
gtatggatcttctagcattatcaggatataacgagcagatgtaaatatcaggcattatgtaaaccgtaaacaagcatgatttatacggaagaaaatagagcgagcccccagcgttaaactgttctcggcctaacaccgaaaacactcgtataatagatattgtataaaaaacatgctctaggtaaacataacatggatctgacaatgctgtatgatctgaatataggtacggtaaattgcatataaaatattgcatacctttgtagatacatgccggatgtatctacaaaattagtagatcaatttaataatcaatcttactaattacctctgatgatgtagatggataatctgattagatttttggcggcgacgtggtttcaaagtaatcaatcgggccaaggcctcacgatcgacaacattgaactgttgttctccgcggcggtgacgtcttgaagcttgatcgatctcgtcggatcgaatagttgatgacgatggttccgatctcgtcggaaggcaaactccggtcgggttagacctccccacagccgaagtcgtcgagtagcttgttgtcggagaatccatctcttaaacccatctcgtcgaaatcctgaagcaccaaagtcccctacctggcgc

SEQ ID NO: 21489 - DNA, 1501 bp, Oryza sativa
gagaagtttgcatctaacagtgacgacacgctatcaatggttgggatttaatccctcgatccgatggctgggatgggcgtccgatttttttctcctgatcggacgtccgatccgtagttctctccttattttgctggtctttgggttaggggtggttatgccttatattttggaatggagggagtactactaaggccattcccaacccaatgactaggatgatgtacatagtattaaataagctgccatctaggatggaaaatgatgtggcaagtgaataaatgaggaaagaagaaaagaagagttcaagtagaagtacaatctaaaaataactgaaattcagaattaaaaataggcaatattggaggaaggtccatataggaaccgaatacgagattaatcaaaattcggaataaaaataaaataaaatccaaaaattagcaaaaaaaaagaagaagtgtccaagtaggaaaataatttaaaaataactggaattcagaattaaaaataagaaatattgaaagaagagtccataccagaatccaatacgaaaataaaattcagaataaaaaataaacgaattgaaattagagaaataaaagaaacgaagagttaaagtaggaatacaatttaaagttacctgaaattcggaattaaatataaagcaatattaaaataagagtacatataagaacccaacagtagatcaactaaaattcagaataaaaaaaataaaattcaaaattaggcaaattaaaaagagagttaaagtagtaatataattttgaaataattgaaattgaaaataaaaaataaaaatatcaaaagagcacaatacgaaaaataaaataaattctaaaattagataaagaaaaataagctttcaactaggaatacaatttatgaataactaaaattggtgataaaaaaaataaagactattaaaagaaaagaccatctaaaacatatgacgagataaattaagtaacaggcctataagggagtagagtggcggcgattgatgggacatctaaaaactattaataaaacaccaaatagaaaatcctaatgacggttaaaagtaaggatgacgggtaggtcgtgaagcaatcggtcaaggcggttggcgggacttctagaaagtaaaaaaataaaccccaatgataatcatatttgatttttaaaatctcaattacgataaaaatgagaggcagcgggcggatcatataggagtataatgggagagccgtcgatggttggcgggtcttctataaagtaaaaaagaattccaacgatagttatatttgatttttacaatcccaatgacaataaagagtatgcggcagacaggtcatagagaagtatagtggcagcgtttgacgggatttctaaatattataaaaaataaaaccgaacaagacaataaactctaaaactacaaggtctaatttttaaaggctcggaacttctaaaaagtaaaaaaaaacaatgataatcacaa

SEQ ID NO: 21490 - DNA, 1501 bp, Oryza sativa
gtttcctcaactggtccaagcttcccaatatcctcgagcatgagatccaagcaatgagcagcacatccattccaaaatattgatggtctttttgctgtcaatagacttgctgcagttgtgttgacgctagcattatcagtcaccacttggacaacatgttgttcccctatctcttctatgtacctgtccacaagttcaaagatatatttgtcatctttcctgtcacctgagcattccactgaatctaagaagagtaccccatgagcactatgcacaactaaattcatcactcccctacccttcctatctgtccatgcatctgtcatgatagaacaacctgtgagctcccatgattccttgtgctccttgaatccatccatcaccttttccttccttttctgtaagaacgatccactcatctcatagggactaggccctttcagacttctaccaaattgtccaatggcctctaacatatgagcaaagctaggaagggttactgtgttgtgtggaatactagcttcatagaaccactgacatatgtactcacaagttctattcctcctctcttctcttttctgagttgtcaatgctgtttgaaccttattgcttagcttaattactctttgtgtcatactggcagattcttctatagaaggaggcttgtagtacttgtcaatagtatgaccacctgctacagatctagagctactagatcctgttgtctcctttggcttcaccacaagaacattattgccatgatctgaaccttcactgccactttcacaatctgaattttctatgtcaacttcagctctggccacttccttttctttgtttttctgttccttttcactagtcttcttggtaagcaaatcaaacatctcttgctgcactggacttggaactttctgacacttagtagtattgaaacctttaattccagcaagatggtacttaattcttgtaattccagcagtgcagaccttgtcacaatacttgcaccgtaggtgatgtttcttggttatgtctgggcagaaacagtgagcccatgcaggatcatctgagttgataccagcttgttttggtccagcttctactgagacagaggcagcactggacggattacctatacaaaaagcaaacttagcccacattaatgctagcgtcaaagctgcctaagcatcaaaataatgcaaactgatatagcacgtattatcattaccacctaaacaggcaaaacaagcaaacgagagatctcagggagtaagaaaatgtcgcgtcccaaatcgactctaaaatctatcctcgaaattgtgcaaaagaataattaaaattcaatgtgaaagccttcaacaattaaaatgtgcaaagataaaagtcaaatgaggcttggaggatttttgtatatttcctaaaagcctaaaatgcttaaataaattttagtggaattttcagagcacaaataataattgaaaagaaatgaacaaagttaaaaagg

SEQ ID NO: 21491 - DNA, 541 bp, Oryza sativa
tcttctctccctccgatccggtgttgcgccatcgtgacggagcagcggcagacggggctcctgccggcggaggaagaaacttaacggcggccgccttgtggaagaagccgaaccgccgccgaccggccccttcccgtggcctttcccgcattatgggggcccccaaagaaaccttaccgccgccgggggccttgcacttgatccgtgggaaaaaaagaaaaaaaagaaaagcttacttatgggttccattcctgtttctccccttccttgccatgttggcatgccacgtgggtaaaagtggtaaaataattaaaatggcatttcttaagaggggaaaaatgtgcaaacctaaaaggggcatttggataattgtccaatctaaaagtggcaaatagttaaatttcccatgtccgcctagaaaaatgtaaagggaaattttgctacaccgcgccagtggacaccgtgccgattaaaataataattttcggttgagaaggagacagaaatcgcgtgaaatattaaaaatgcccttgggcccaca

SEQ ID NO: 21492 - DNA, 1501 bp, Oryza sativa
tgtatacctccaaaatttgattttgatcccttgcatacctgtaacatacccgaattctaggattaaggaatttctatcaaaactagttgaaaggaaagttcttcaattttgtaaaccaaaaatttccattttaaacctaggtgaagttgatctaactcttgcatgataaaattttagaacaaattaaaacctttgcatctctaacctaggacaaaaatataaatttatgtgtaagcatgcatactctcatagacatgtttgacttgagtccttcatatgcatttggatttggattgcatttggattttcgatttgcatttcataataggtctcatgaatattaactaagatctagataaacaactaaaccattagggcctagtgctagctagaggaagttaaaatagaaaccatacaccttaaaatacatcaacaaggccaatgtcaagccccacaaaactattttggtcatccatctgaagactagtcatgaacatggaagtgaccaaataaattatatcatatagggtatattctatcttaatcatctctataagcattctcttaatttaatactaaagtaaacttatgcataataggtaaggagcttatgacctgtgtaatgtaaattgtaattctaacatatcaacatcacctcaggttaatgagagtccaaatataacttttataaacatttacatgcatttaggaaagggaaacatatataagacataagtcttgcgaattatctaaaataattcgtgcaagataaaatcatgagaaaattcatgtaggctctactcaacacatacaactcactgtaattttggtatgattcaataactaaatttggtacctcaaataaatcagtcaaactaataaaaactagattaactgtagttcttaatcggctaaaaccatactttgtctaaaagtgcatttaactgcataaaagtgtataagtaaaataatttattcaaatactaggtcatttataatgaataaaaataatttttccagaatttatcttctctgtttaggtctcctaaaaattcgaactagtttccaaagaacccatattcctctaatttctgtaagtaatctatccataatttttgagtgcaaccaaagaaaatagaaactaggtacatacacctacctccagtaaaatcaacactagttaatctgatcaacacattaagtattgaagctacaaaattagaggagaaaataattccggaaattcgtccaaaaaccaagctcacccatgtttctgcctacacatctctcttccacctagtttacctcgacctgggcccccttgtcagtccctccggcttgcctttcctctgtgcaacttccctagccagaaacactgagagggagagatcgagcgccgaccggctctggacgccgcgcgacgcgtggccacgacgtgtcgacgccctaaaaacgctgagctccatctctgcctctcccagacgcgtcgccactcttcacc

SEQ ID NO: 21493 - DNA, 1019 bp, Oryza sativa
gcatctccggtgtgctcgctgagtactgtggttgtactcattcttgctctatctttctcccccattcagtaagagaagctttggagaagaagtcttaggtggagtcctggcttataccccagttgagcgcctgtgaagatggagccgtaggcccgctagtccgctgctgtttatttttgattgtcaggcctgaagcgcctctgtaataatgtaaatattatcgatataataaagatgtgtcttttatatcatgtttgtgtggtgtaccccggcttttcctgggacggggattgatacactagcgttcgggaaaaggcaattttcccggtcgcgacaaaaaccatgcacccacagcccaccattcagtcgcattttagttggataattacgaccatgaagcatggccagatgtctcgagcacgcagctcattctgatactaaaaaggtctaatactgtaattatcccatcaactgagttagtggtaattaaggatggctaagcatacaattctagctaggtcacataagtaacatgagctagtcgatttattacccaaggttgacaaaggacagatatcaagtaaacatggcacaagcaagcagataggtaatacccgaatcccatgtaattagcaagacatgcatgtttatttgcaaacggtaaaacatttataaattgggattaacatgctcaaggggaatgtgtgacttgccttgcttcttcaaaacaatcttccgaactcttttcctcacgatcgcggacttccgaaacgacggattctacacgctggcacacaaaacgaggaaaaactctaataaaaaccaaggaaacagtacataaaaagtaaacaaacatgtagagctcaattttagatgaattttgcaagttgaacggctcaattcggagttccaatgaattagatatgaattttagaagttttgagccatttaaatgaatttctagaattaaatacgatttatgacacaattaataattattcttccaaaggagaagggga

SEQ ID NO: 21494 - DNA, 1501 bp, Oryza sativa
cgaaacaaccttgatacttagggtctgtttgttagagctctaattcataaatttaactccagcttcacatctctagtttattttgtgagagaattttatctaactccgctcccattttaggtgaagcaatggagctggagctacccttatagttccgtgaaatatatttattatttaaatattggctaaagctagagttagtgattgtgacgcagctccaaacccagtagcgaaacagcctcaatgcataatacagttctgtaaaatttatttaaaatttaaattttggctggagcttgggggtagtggtcggttgctgtgaattgggatgatctgatgcgtgtgaaaagggaagggactgatcaatggaaggaaggaggcatggtgagaacgagtcaattgttgggcagatggtgctaggagtacacttctactaccactgcctgcctactccatgtgcacgcctgccccaggcgaccgcatcccaacaccggcccacccccacgcgaccaccaccacacgcatccaactcgggaccacccacccagcgacccaaggacccaaaggccaggccacacccagccccgatctaccctgcactgcactgctcctaccagtacaacggaaagatgagagggatttgcactattactactgtacattaggatactagcagcagctccttcatgttcctacagcttcgccaataaatacccaacagtgccctagtacatgtatatgtacgtcgtacacccctgtgtccaagtaagtactcttgctgtattaaatcctaggccctccatcaggaaatgttacaaacattttaggcctccttttaattggagaaaaacaaaggaattaaaatcctacactattcatgcctttgatttgtaggaatgagaaaaggaaaaacgtaggaaatttcttattcctacaattctagagcaaaaacgtcggaaagttaacatccactctaacctcttggaaaactttccttagtctatctctatcatgtcattcctgtatttttcctgcggtctaatcaaacggtcattcctatatttttcctgtgttttgtaatcctatgttttacacttgcaatcctattaaaatcccgtatttttcctattcctccgtttttttcaattctgcaattcaaaggggccctaagcatggagaaagtaccaaaatataaccaaatataaattttagagttttttcaatcgtatatttgtcttttacttcccttgtcttaaaatacgtgataagacatatattattattatgaatttagacataaatctgctaaatttataatattttgatgtatccactattctatactaaattgctttatttttgaacgaaaagagtaaagttctagctttatcctttaaacctgatatgtactataaaagttttatccaagtcagtcagaggccatgggaataggcttcaccgctaacaaaaacaagcagatgtgtggaagggtgtactacca

SEQ ID NO: 21495 - DNA, 1001 bp, Oryza sativa
atatatacatatatatatatatatattaacatccctaaatttaaccattttctaatcttgcatcatgtcggttcttatattcttattaaccctcgtaaacctaggaaattataattagaggaacttttttaaaaaaactaactcacataaaacctctccttttatttaatttattttgtggttttcatttaaaattatcttgggttatttcttgatttgattttaatttaaaaacctcccttcgactaaaatttccttatttaaatttagtttgaaaaccctttttaatgttatgaattgtggtccaagaaaccctccaatttagctcttaaacctaaaccaaagcaattccaattttattggaattaattgttaaaccatccctttgatctcaaacctattcttaatatttgatccaaatatctgaaatttctccttttgatctagccgccaatttaatccccatggcttgatttccttttcggcacaagaatagtttattacaaatattgtgaataattgctcttgtgctaagaaaatagttttcaattatatcctttcatccaaaagttgtaaaacctcatttagctcataattaattttctcatccaaaattacctattagcctcaaataattatatcctccaaaattaatgccaaataatttgaggctaaaatcctatttatttctctccatctattttatcccacattctcaaattcaattttaggaattcatctatctctccctcctatttgagtgcatcaatataaattccaccatattctatttccaaaaatattgcactcaaataaactagaaaaatatctctttcagaaattatatccaaatataatttcctttcaaacttttctattcaaatctcctttaaattctatccctacaaaatttcctaaaaggtcctatcttttttgggccgaaaccccctcagccggcccatccctttttcctctcctttctctcctctttccggcccagt

SEQ ID NO: 21496 - DNA, 1501 bp, Oryza sativa
aaatgaaagcgattataaactacatctactttagttacattggccaactggccaaataaatatatagaacagcggaagcttgtctacccaatctacaagcacaccgactaggggtttaccccattaagttcaagtcctagaagaagcagtcgattacccgcatcactcaaagactaaatctaaaacctgcaagcaaaaggttaattcaatagcaagagtcagtacattattagaaataatgtactggcaagcaccaagacaagcctaagaccctacttgcaaggcatataatcaaggaaggcataatatggttctttttagcataaagcaagttttatttgcataaaacatttctaaatcaggtttactttcaaataaatttcagcaagctagtacttgacatattgggcatcaaggtaggcattaatcatgtataaatgtacacctcattgccatccatggcagcaaggagatcattctcaaatctcatcacaatttgaaggtaaatttcagcatttagaagaataaacacaagtctatactcaatacatatccacacgccgctcatgaccgcgagcacggctaatcgattagtttttactctgcagagtttgtacacttttcccacatgatgcgaagtaataatcatgcaagagcatggcacgcgatacataagtacccgatttattacccacaacaaagcttttccaaaattcatgatttagccttacaccagcacgatacgtgttactccatcctaagccatacacgttatatgacctagaaccgttaagtggcgggcccacgccttaaacttaacgccgtggtggcggacacaacgggaacccaccacgtggcacaataccgttgtattggacacgcttagtcacctaaactaccacttcggggtaaataggaagctcctctgaattatacgaactcatacacaccggcctaccagaatgtaaggctaaaccataaataatttactaagcttgggctatcccatactagcacatgtggttgcactgtatacgaaatgaactgacgttgagtgaagtccttaggtcggtttgggcacactctccccctatcggtacacaactaatcaccatatgtgcaccacttgaggcccaaacctaaaatccatgttttccatcattttatttatcaaaatcacaagtattaaagttctgtccagattatttcaaaatcaatttttcatatttgtaatgagcccataatgacaaggaagaccattctaagcatggctaagcattatagtaacctagtgaggttagtcatattgttcctaaggttaggaatgagggatatggatatatgtggggtcaaggtgaatgcaaacaataggagtttgtctaacaagtttaacaaaattttaatttattagtgtacaatcgacatgcaagatttgcaaacattttcaataacctccaaaacataggttcaaagtgatcaaagagagggaggtgggacttgc

SEQ ID NO: 21497 - DNA, 281 bp, Oryza sativa
tgaaggtttcgattccggtcaaaaacatcgcaccctcgtgtgccaacattggcattaattgacgaaagttcgccgcgcgaatcacgaagtgagtttttgccacgaacgcacccaataactccaacatgtccaaaaatcatgttttggcattttttaaactttttgattccggtcaaaaacatcgcaccctcgtgtgccaatattcacattaattgagaaaagttcaccgtgcgaatcacgaagtgagttttttccacgtacgcacgcaatacactccaata

SEQ ID NO: 21498 - DNA, 1501 bp, Oryza sativa
tatatgacctagaaccgttaagtggcgggcccacgccttaaacttaacgccgtggtggcggacacaacgggaacccaccacgtggcacaataccgttgtattggacacgcttagtcacctaaactaccacttcggggtaaataggaagctcctctgaattatacgaactcatacacaccggcctaccagaatgtaaggctaaaccataaataatttactaagcttgggctatcccatactagcacatgtggttgcactgtatacgaaatgaactgacgttgagtgaagtccttaggtcggtttgggcacactctccccctatcggtacacaactaatcaccatatgtgcaccacttgaggcccaaacctaaaatccatgttttccatcattttatttatcaaaatcacaagtattaaagttctgtccagattatttcaaaatcaatttttcatatttgtaatgagcccataatgacaaggaagaccattctaagcatggctaagcattatagtaacctagtgaggttagtcatattgttcctaaggttaggaatgagggatatggatatatgtggggtcaaggtgaatgcaaacaataggagtttgtctaacaagtttaacaaaattttaatttattagtgtacaatcgacatgcaagatttgcaaacattttcaataacctccaaaacataggttcaaagtgatcaaagagagggaggtgggacttgccttgaatcaggaaaatgtcagcacctaaatcacttcttcaccgtttaagcaatcatctatacaaagtacacgttatgcaattaaacaccgaaatatgcgaaaaatccaaaatgctctaaaatggatgatttgtgcacagtgaataggtactggtctaaaattaatttaggtgaaagaatttctattttatctcattttatttgggagttatgaattttagaagtttcgtcggtatagtgtaggatttacttaggtactattgtgaaatgctgttgtaaggtgattcttattaagtttatgtttgctggggtgaagatatgtgttttctaagactaacacatttggtttcataatttttagagttaatatgaattctttatgtattttacaaattataacgtgttataggtgtatagtgttctataggttcatggctttagaggtttaggtctagaacttgcctcatctagctagtgatgtataaaatgagtattttagttaactaatctaaccttagttcataggcttatggtctttattatcatggttcatattttataaactaggggagctctagtccatgttagcaatttattatatcaacctagaaattattatatgagctaagtgctttaagttttggtggatgggaatggaactatgaattcactggtctaacaagttttatttgggtttcattatagctagagtgtatttctatgtacatttatatatatacatattgctcaatcgatactatgtgattagaacc

SEQ ID NO: 21499 - DNA, 1501 bp, Oryza sativa
ggtcccacatgcagccccaagggtcagaatctcgtcattaggtgggtgtggaatagtgtagccaacccaatcgggcttcattaagtccacctgaactttggcattgccggctagcagctgcgtcccatgcactcgggtctccggggtaggctagaatgcttgaccctctgcggcaggaattgcaaatcctggtgtcaccctagcgaatagggtacacgatgtgggttcctgcgatagattcattagtgtccatagtatatgttgcaatgtattatggtgctaatacaatatatgcgttattaagttgtttttaccgttatgtggtccaccgcagcggggccttcaggctgttctgctagagcctcagttgatgcacagttgctactcctctgcgtggggcttacttgtactatgggaccgggagtggcattggtcgacctatccctgatgcgtgcctccatccgagcctccatacctaacagctcggcagtgagctcttctctaagctcttctttaagctccacccgaagttgggccttaatgcgtacagctttctgcaccttggaaagcttgtgcttcttgtactgccacgcgtattggggaaacccaaacttccatggagcattggagccaatgccccttgttcgtccacggtgtttttcatttcccaacgctttcgtgaggatgtcatcctcgcgtttttgtgagcagacctcttaggaggcatgtctctcagcattcagttcgacctggggtacagttaggacgcgttagacgaagaatacgatacaacataatgaaacttattctatgtgttcaacttacgattttctggtacaccgcttgatctttgggatttgggaacgaaagaattccgtcactattcttcttcacccttgcccttgcctagttccttgcccgctagaccgggatatcagcaagcacttgcggggtgttagattccgctgcagcttcatcctccttgtcccattctgcctgtttccccgcgtagcctccggtgccaagccggtgcgggtgaagtttccttgcctgcagttcacggtaggcctggctttttgcccgagactctttcgttgatttggcggcatggaactcatcccacatagttcgggtgattgtaacgcctcgattttcgctcgggattaaaaatcattcaataatgcattttctagaaattaaataaaagttaaatcaatttaatcaagtgaaataatgggagaatttaaaattttcccttaaaaatcattggccgggaatattttgtaatattctttgtgccttcaaatactctccggatttttcccgtgaattttcggagctcaagaaataattttaaagtcacaaagttcatttaatcaatttaaataaaaagaaaaggaaataatcttccccttcctccctttcgggctcggcccaaattccccccccctctcttttggacccggccgccctccacttcccctctctcagcccgtcggcc

SEQ ID NO: 21500 - DNA, 1140 bp, Oryza sativa
aggttacaggtttacaaatacaacatcaaccccgcaagcagctgccccagggtaaaagattacccgcctcccatccaggacgaccctgactgttctacgagtaaagactgatgagatctaggaaccacggaataccttcgggcggtggctggttggtcgcgggcggcgtctcaccgtcgccctccggcgacggctcgcgccgccgcgcttcgggcgtgcattgcggaggaaccggaggactggagaagaaagccctagtttcttcgtggcgaactggtagcgatgagtagcagactgtgacattatgggcctgtggcctttcaatgggccacatgcctccctccattcatagcccgttttgttgggcctgttcgtgtcctcttgttggcctagtaacggcgacccaaatgtctatgcgaattatttgcatcttagttctaaaaaaaaagaagaattatttgcatcttcgagctccacatcaacgtgatggaacaaaatgcagagtctagacaggaatacgattgctcggacggcaatggcgtctagagggagtagatcacgagttcacgaccaacgaagcttgatcttgtaaagccaaagtcgtcagctttggcctgttctgtattgcggtcaggcgacggcaacgtatatgatatcggacaaggaatcgcagaacgaatttaagcgtgtggttgtaaatctgcggcacaactgttcttaaacctctgggcgccacgggcctgagccaaccacatacaactcacactcgtttccactttccaggcagtaacagcgtgttgctcccagcctccaactagaggttagaacctaatttattcccttcggtaatatttcctacacttcgtgcgccttaattatggttgtcaattttctcagtatgaacatattataggactttagaggcgataagcatgcacagtagatcgaatcaactttaattttgagtcccccgcccaaaaaaaaaaaaactttaattttgagtcatgctcgttcaagaaaatgcacgggaatcgtatggctgacctactgcattcttccctccgtttgactgacatgtattgagttatgcttttttgattgcagctaagcagcgaactgtgaaacacagcatgcttgtag

SEQ ID NO: 21501 - DNA, 151 bp, Oryza sativa
ataatatgaaatggagggagtacttaatgggcactgcagaaatgataagttatgatatggtaaagtgcaattgcaacatctagattctagaaggtattttcatgatgtttcgccaggcataaaataagttgtatgtctgtacatattttgc

SEQ ID NO: 21502 - DNA, 1501 bp, Oryza sativa
aaattgatgcgtagatgagttggtcatggagagcgtgcgtgaggtagagatcttggatttgaatcctggtcatgacaagatatcaaaagaaaatagttaggatgagaaattaatattgaaacatttaatttggtacgtagaactaatgccacacatggagtggtggcaatagttatttattgcaacgatgtgaagtgttgcaatatatatattttgccacatccattttatggcaatatcaaattttattacaactaaataaaaatcattgcaataacctattaccacgctacttattaccacagctagcaacgattttaagattgtggcaaaatgtatctattaccacaattttagcatttcgatgctacaatttttttcatgaagataaattatttttctagtagtgatatgtaaattaaatatgatctatacgactatcattagatgatgggtgagtggaagatatataccaccgagaaataagcggagtgaaaataatgacaaatagtttacatctattatctatatgtgatggagtgacggcacgatgtgtcagcagtacaacaagtttttctttgattacgaataatgacaaagacatcgttaaggacaatatgtgcttatttgaatttccaaaagaaaaataaaagacaaatcattaaaaatgatattaattctggtgtaaatcatattaaatttattgattataatttaggcaaaattggttatatatcatcgaaagttcacgctttttgttttaaagcaccgaaagataccggttcactttaatagcacccaaagttcaccctgtttccatttttaacacttccattaattctcgatcgttttccgtccgccttgatcactattaacctagctacgcacacgatatgacatctctacccctcattgctatgcattctacttataattgtgaggggcagaaacatcatatcgcgtgtgtggctgggtcaatagcaatcaaggcggacggaaaacgactgaaaattgacagaggtgattcaatcacaagattttgagtttcttgatcccatcttttgtcttgtagctatatttgcgcggtatgcgtacaaatgatatgcatgataattcactggaggtagtttaatatttactcgatgtaaaagtcaaattaacttaatccatcttctattcggtgaatggattttgagatatgttaagaagtagaactcctaaactattttaaaatgatattgttgttcgctatctataagacaacttttgaacaaattataattttacttttcaatggtataaatgcccgcgtataagcgtgggccaccttcctagttctaaaaaaatgtatattttcgggaaaaaaaaacagattttctcccctaaaattgtcgcaagtattttagcgatttcgtattttagttgtttagctgattctagatatctccatgttgatgttttgaatcagcaataaatttttagggcttcgaaccggtgctaa

SEQ ID NO: 21503 - DNA, 195 bp, Oryza sativa
aatattaaatctgtagttttgtgataaatttgttgctaaatttgtagttttgtgatacaatgtcttaaatttactctattttagaattataaaacaaagaactactagatataattgatgccagtaccatggctacttgcaacatatagtgatccttgctttgttggtgacttatgtatcttttaatcctgcagg

SEQ ID NO: 21504 - DNA, 460 bp, Oryza sativa
ttgtctgtggctcattcagcagcagtcgttctcgcggcgcacgcgctcgcagtgacggccaggacgaacgctgaaagttgtccaggtccaccgatacaattccaaaaccattgagccatcctgccaagcattttccctgatgagtacttagtaccaaagccagcctcaacctctggtacctaacaggaaagcttacctcaaaagaagatgagcgtccataatggcagggaaagcgaagggcgttctactgctcatcatacatggcctcctggaaagaatgggtccagtcccgattgacctgacaactgcctttcaatcttggtcagaagctcttaggctgagatacttctaaaaatggacccccaaagcttcgaccattacctagaccagtagcagtacagaatacctccatggatgctccagcaggatgtttaatcaaccgacattagatgatgtagaa

SEQ ID NO: 21505 - DNA, 192 bp, Oryza sativa
tatgctttgacatctattactagatttgatagtactcacagagaatgatgagtaaagaaaatagaaactaaacaaccaaaatactcaaactaagctctatggttcatgtttatggtatgatgggttcatcaaagataacagacatgaccaggtggacatgagaagcttcaaatttatctcctgaagtcacca

SEQ ID NO: 21506 - DNA, 1501 bp, Oryza sativa
ttatggagaaaaggactatcactctttataatggcatcaagccaatgcaaagtcacatgtcgaatatcgatctgcagtaacagaggaaccctgtgagtgcacaaataacctaatgaaactaattacaatggattcatttatgcacgtgccctcattcatctaaagaacatccaacgaagatgtattccccacacttgttaaagaaaagagaggtttagtatcttatgcaactaattgctatatttacttaatcaattcctattctagcattccctaatgtagaatgtcacaaggttgaatactccaaggtccaagcaaccacatattcagtagtaatggaaacaaaatggtagagtgttctgaagttagacccaatttgacatttttactgctatcaaacttggtttccaaaaaaaaaaaagtacgagtactggtaaatcaaacaagccctaagttagacagtggaagatgtgctcacactggaaaaggaagacgaagtgctgtaccagcaatcagaagttcagaactttcttttccttcccctcgccttggccctcttcttcctcgcttcctctttctgcctctcggcctcctccctctcaaacttctccctctccctcttctgcaggaagtcggtaaccgacaggtagatcacctgcattgccaaaacaaacaaagcaagagcgaagatgaacacaatatccagcaacgctatgcgccaattcatggacaaatgctttaaccgcaagcacacatcacgcaccccgatggtgaggatggagagcccgacgaacgcgacggtcaggagcacggacaccacggtggcggtgacgctgtcgtcatccgccgccaccctcatcatggcctcggtctgctccatgggcgcgtcaacttcccccgccgccgccaccgccgctcggccgcggcgcagcctcgtgagccgcagcggcctcgtcgctccgccgcatctcccaccgcgacggagagcagcgtacctcaggaagagcggcagcggcgtcgcctgagccggggacgacgggaggacggcgagggagagcgggtgcgcgtgcgctgccgccattatcctcgcctcgcgccgcccgaagcggaacgaatggtcggaaaccgagcggacaaaacagctgggccaatccgatcctaaatgggcccgcgtgggccggcccatagggttcgcgtgcggtgggtgggcccgcccgcccgcccggccggccgagtaaattccagagggatccatccctatccccaaccttcttctcccccacgccgcgacgtgacgtgacgtcacgcatttgtcactttctcgtagcactctacccctatctaatccggtgcagcacgagaagaagaaggggagagaaaaatatctcgcgcttcacacgcaacgcaagaactcgacgaggcgagcgagcgatcgagcggacaccggcggcataataggcacgggaaggcgtgggggagggaggagggcgacggtagggga

SEQ ID NO: 21507 - DNA, 421 bp, Oryza sativa
tccgatatctggatatccagttcataacaactgtcgtccatatatttcacataatatcgggctagaagcaatagaaaatgaagctaagacattgaagtttatacacttcttgcatagatagattttttttagacggaaggccagtggcccggcttttaattgaaagccaaaacggcagagttcagctggggttgccagcgtactgcatagatagatgccacctccagtcatcctaatcaagtaaaagtataatttgcatttgacaagatcacaagatagtcacaaaccttgtgcctacgatacctaatggactcgagcatgtgtatttgctttaacttaatctaactagccatgagttctcaagttatcttaaatgacaatagaagacgttgagcaagagtatagtttaattatgacaaca

SEQ ID NO: 21508 - DNA, 1228 bp, Oryza sativa
gcagcgatggcatccccggcgccagctgcagcgtctcctgccactccggccatcctgcacatgctttgcttgtaacgtaccaggaatcactacaagttggcaatttcaattcatgtctacatatcagtcctaattgttgattgtttctctgattatccattgtcagattgagcggcggcgggcgagctcctacttgccgaggcaacgctcgtcctcatcccaggtcctcagtgtgcgcctcactggccggccaccgtgccccaccacgatgcgccggtacaggctactccaccgcagcgcggttctctgctcgtagtccagcgtcggtacaacaacgcggacgacgacgagtcggggttcatcgacccgggctgccgtcgccgtggctgcggacgacgtcgccctcggcacgtgtgggcggctgtgccgtcgcggccgtggatgccggacgccagctggtgagctagctgatgtagttcattccaccgccgaggatgccgaggtcgacatcgacgtcgtccacggccacggcggcggaggcgcgagtcgacgaaccctgactcggcgtcgtctgttggaaataaacacgtcatggtgtgtttctggcgtggttgagtcagtgtgtgtgtgtcgcgttgctgcatgtgtgcgtcgtgtgcgttctgttagtttgattgagtcgtgatcgcgagtgcagggctgctgcatggttgtttgcatggctgttgcagtgttgatcgagtcgcgggagtgcgtggtgtgcgtggcgtcggttcttgcggaggaagccgcgtcgtccgggcgagcgtgcggctcacggcgacattgagcgggttctgcggaatgtggtacaatggccggcatggaggctagctcccggtgtgtccccggtctataagaggcccccgtactccttcgttgtttctttgcaaggttcagtgagtaataaagccaagatacaggagcgatcggctccgcggcgttcgtcgctgtaaaatccattgttcatcgtctccctcaccggcgtttgtgttcgtgagtgtgagagtgttcctgggctgagccaacaattggtatcagagccggatgacgaagatcggagatagctcgtcactgaagatcggagaaggatcgagctcgggtgccgccgagcgcgtcatggccaactccagcgccgtggagctcccgctgttgacaaggaccaactaccacgaatggtctttggtga

SEQ ID NO: 21509 - DNA, 416 bp, Oryza sativa
cacatctcataacattagtaatagtagaacttttccttcggacaatatagtataaagatggatatttgtctttaaagccaagattcctagccatttatcttcccagaaccttatttgtttcctattatttacaatccaagaactcatatctaagaaggtatctttgatcttcatgagacctgaccaaaaatgagaatcatcccgttttttattaactcgggttatattataaactgattgtaaagatactttcataaaaccggatcaccgacctgatcctatgtttccctatggtggctcacaccaacgatacctaaaaatgccaaaaatctgacactgaaacggacggccgagatgacacgtggaccgcccaactgagcatccacgcaaggccatgaccccataaatgacctccc

SEQ ID NO: 21510 - DNA, 1501 bp, Oryza sativa
gagtgaaaaatcattatgttataatcgttgcttggtttgtgttgttcggttgagcacttgttccatgatgcaaatgaaaatcaatgtgttaaatgaaatataacagtatcaactatccacttaactattgcatgtcagtgattgtagccattcccatcaatcaccgttcaccaatgtgcagacatcaaaaccaactacttgatctagtaatgatggatgaaaaagatggcactatgaaatgaccaaaagtacaatgcggaagtgaacataccggcaagcgaataatctgggtttgttctaaaacggatttgcgtattgcttgtttgatccaccagtgagagtatgtagagaatcgaaaaccctttgaagcatcaaacttttcagcgcctcgtacaaggccctgtattccttcctacaaaagttacagaaagaaatgtgagtcataagcataatcatagaagggctatacttaaccgtagaaaagggcaagcaaaatacctgaataagatcagaaaattccattccaggaccttcaaactctctagcaattgagattacaagtctcacgttagactttaccatcgtgttcttgcaggaaattccatagttcagacgttttcgcaaagtgttctcgtcagttccagctgcttctgcccactgtgagaaggttggttcaccgccgttgtagtgagcaagctccttttggatagcttccaacttcaggagatcctgtgtcaattcatggcaaccatccatagtaagcttaagttggtgaaaatggtgctaaacactaacactgtgtagtctgtactgacgatgatgccaagaacaacaagaataatattgggactagaaaaccagtgttcaagagatgatattggaacagaaaagcaacaattctctaaatttttcaccttaactgttaatagtctgttactgagccatattcagcttcttgttagcgagcaatattcaccttactgctagtgagcaatctaggatgggattttagatgctgtggaatttgctgcaataaacatatgctgctgcaacatttgtaccaaaacatgcatcctaaattttgcaagcataacaccacaaaaccaaaaaatgcaatctcacaaaatgcattcaatttgttagcctcacctgaatgccttgtgagaactcaacttcttgttttgctgtcagaagcctccggccggtcatcttgtagaagcagccgagaggactccggcaacccttcaacctcttcttcctcgccgacgacgacgccgcgacgggattccggccgctgaacgatttggccgccttcatcgccgccctcaccctccgagctctcctctcggactggcgcaccgatttcacagccacgccctggacgcactgctcatcgtcatctacctcggattcatcgctgaagatactggagaaccccgcatcctccgacagacaggcatcggcgtacctcgcccccaatcccgcctcggcgcggaggatc

SEQ ID NO: 21511 - DNA, 1496 bp, Oryza sativa
cttctatcgaatagagaagcactcaagcttgttatttgatctgcctcactttttttcttgggctttttgacggacctcgtaaccaagaactccacgttcggccacaagagttgtgcagttgctgagggtgtccactgccaatttgctgtttaatactgtttttcacgaatatggtttacctacatacaaattcggggcacggatcggtcagattccaaattgtcacagataggctaatggatagcatatggcatatgcataaagtaaaaaaaaaaaagaagaaaaaagatgcaacttagatgcttggatcacccttcacacaatgtgctcgacaaccatttatcactgttaatggcataaaacaggatgcgactatgggttgaatatctgatggattaatcccattagacactcaacatgctacatttgtgaatgtcatttttttacggaaatttgagcggcctgttgcaacaagaaaaacaaagagtttcaattgcaatgatgacaacaaaacgttcttgacagaaacgaaccaacatctttctgtttggtcaactgatgaccaaaaagaaacatgagatggctaataaatacatttatgacgaatacaacactacacaaacaaaagttaaattcaatccacgcaccagaaaatagaaaaacaaaccagacttaacaaggtgcaaaagcatttgcatttggatttgttattactcttccatccaaaaaaacaaatttgacctacatgtctgtggagtgacacgcgatacaattatctatgccactaattttttagaacttctataattatcttggccacataaaagatgtcagataacacttccatcatacaacttctatttactagcttcaatacccaagtaaaagagtttcaaaagtaacagacttgtatgatcaatacatgtttccagcaaaaagaaagaaaaatacagatattgtcctcgatgcaacacaggacacagacatcttgactgcaagagaaaatcaaccttttgttgggccacaaataccccggtaagcaaaacaatggaagataatttgcaacaaaaaatatactagttattactgagaaaaactgatgcaatcatatggagaaaaataaaaaattctgcgacgggactaggtgcctcgacagcagcgaagcttgggaatgccctaacctgacaaggccgggacccgcctcgtcggcggcgaagacgtctccgtccctcagccgggctcgatggacgggtggagcactggattcggagatttggaagagagagaggaagaaccaagggtgagtagataacaagtgaatggatcggactcttcagctacagaaaggtgaactagtgaatagtgggctttgattctgcaggggaggtggtccgtggtccgtgggccgtgggccgtgcacgcggaaaggagggcccaccaccgtgccgtgcttatccaccaaaaaatcggttcaccccgtgtgcgtgcgcgttcct

SEQ ID NO: 21512 - DNA, 1030 bp, Oryza sativa
aattcaacactgctataccgatttggatccaaaatccactcgatatatccaaagaaagctgagctgtaacctgcaagtcaaggtcgagacgttacgtcgagggacgccgatttctgcagcgagaattgagcatatatcaaatgggatgacgggatcggggtggaggatgtaggttgcatgcaatgcactcaggcccgagagggacccatccccgattgcggccacccgggcgttccacggccgttgctttcgccgatcgcaacgctccaactatcaagtttggacatgtgtgtgactgacaccaacacgaaagctatagcatctgcccattatcacaccaaccctagacagtgtagcccacaccgatgatcgatcgaccgatcgattgggtagccgcagccgcagctggctgctgggaaaatgaccgcacaaacagaactcgatttgtatggttcgttttaatcggtgtgcatttgtttactaacaaaagctccaagtttttaatagaaaaagaccaaaacttctcgttcgtgggagtgaaatttcagttgaaaacggaagggtgaagggggagagtagaatgatcgatcggtacgtgccggagtgtccaatcgatcaattataactttcgtgactggtcttttttaaaaacctgtaacgacaagaacatgtggctggcaaaacctagctattatagcacggaggcaaacatatgcatcggtatggcagcgcctctgtgccgctgtgtgtgaccccagcatcgatcagcaggcaggcagcagtctctatctcgctcattatctttggccttatcctccctatcggaaaaaagagctctgttcgaactgttcgttatttaatatagcatggaaaataaaggaaaaaagatagtgaacgaacgtttgaaccagggtacagctacgtacgcacgtataatctacttgactttggacaaaggaaaagaaagaaaaaggcttgacagatctcttccccgtgtgtacgtttatacgcgtgactaactccagcatcc

SEQ ID NO: 21513 - DNA, 1501 bp, Oryza sativa
cgtgccaaccacaagccagcatgggaaacgactttatcttttgtatagcatgattcattatagtgtgccagactgtgaagcggcgagaagtccgtgggggtcgctggggagtccattgcctctggttttgaggtggagattatgatccaggaacggtgcactatggtgagttgtgttgtgcgaggggtattgtcacagttcctttccaaggtatcgtggtggtactgaggcgcatggtgacatgttgtgggattgtgtcttgtgggtatagtggtacacctctgatcagagtaaaactattcgaatagccgtgcccgcggttatgggtgagttgagcaatgtttttcgtgattagtctcacactattcattaatggtaattgtgataattaatttgattcctggtttggaatggtatattcctggtatggaggtttgatttgtacaaccgggggttggttgtttagatgaggttgggcctatgcaacacgggagtgttgtatgttgtttatttaatattgattaattattcaactgttttactattctcttaaatatttatcaaatgctgtttacgcaaatgagatacattatgccatcctttgttatcctatgcacttgcatatttgctatgtggcttgttgagtatgtcatatgctcattcttgcaatattcattcatcagaggaggagtacttcagtgaaggtgatgatctggaggactaggcttggtccgggttaagttgcttgtggagtggagtcgccatagttgttccgtagtttgctttagtttatttttccgctgcgtagaatgttattctttgagaggaactatccacctctgtaataatttattatttgcgaatattaaatagctgtttatttgtactctattatcaatttgttattgcgtgcctcggctgattcctggacgagggtttaacacacatgtaagcgtttggaattttggatagaaattctgggcgtgacagccggtctgaccaggcctcctggccggtctaaccgcagccatgcggccggtctgaccgagccattaggccggtctgaccgccgaccagacagcggtccgaccgaggcttcaggccggtctgaccgtgtgcccaacgtcggtctgaccggtgcatctggccggtctgaccgggctccagcgccggtttgacaggaggattgcaaagggcgatttaagaacttcatcatcttcaaacaaagttaatagaggacattatttacctcctggaacagagccgaatcctaggtggatgcctaaggatttaacggctactcaaaagagaagattgcaacgtcttcgggcccaagagttaagagagaaaaaggccgaagaacacagggataaaaggttcaataaattgagaccaccaccgatttggaggcctaaatccatagagaaggcacgaccgattgatgtagaggagaaggaagaacaatcagttgctaaaagtgaatcatctccaaaagaagaca

SEQ ID NO: 21514 - DNA, 1130 bp, Oryza sativa
tatgatgcacgggtctaaaaattatgccaaaattcatgatgcttactgggttagtctacatgatgcatgtaaaaaattctcaggtttatcacctacggtttagtctagacaaaaataacaagcagactgactcaagattccagaaaaaaaaaagaacaaccggcacaaaatgaaactttaatcaagttttaggttgtataaattttatcaccttttagtcgtattatgttagggtggtccagaggctagatgaattttgggtggtccatctaagcaaacaatctagagggttaagcacagcaaattctattctatacccaactacacattttaggccataccggtgaaattttgaaatatcgggagaggaaagtacaaaatcccaccaaattcatttttggttcagagataacatagggagatggaattccaatattgtctagcaagttttaagttttatcgactcattttcaaaacccatttactaggggctatgtttaacccgatattttagaaatccgtgctaatacataggagtagtttgcaaatggatttcaaaacttttcaaaacactatgttactgttttgctgtgattattaagtgatttcaaataaaattcaacaaaaatagtatttccaaaatgtttcggtcctatagagcaagataagagttttaaaatcaaaacatgagacataaagtaaaataatctctaaagaaggatgagatataagattgaacatgatttttgcaaataatttgtaactgagagcatagcactcaaaataatttttaagaagcaattctaagtgacaacttaaggggctcctgtagtcggtatttgctctgataccatgctgtcataggctctccagaccttccattatatttgagagatgaagtgaataattcaagtcatcaaacaagcataatgaaacatccgacgcctcgagagaggaatattggagacattgctgggcccttagcctgccagtcaacttcagcctgagatgtgcccgtcaaaccactcgaaggcggcggccagatgtgttacacattcaggagacttgacaaaaatggctaaagatctgcaacatcccaaatattcctaactcatactcatgtgaatcta

SEQ ID NO: 21515 - DNA, 371 bp, Oryza sativa
ggaaagagcaaaatcaccaaaacagcacataaacaagcatgaacagtacatgtggatatttttaacatgtagatctcaattttagaaaaatttagagacttgaaccaactaaatccgagctaagatgaattagttatgaatttttgaagattaaatcggattaaaacacttatatggattttaattgaattatgacgcaataatgaattatttttgaaaaggaaaaggggtttattgcgtcagcggctagggtttgcggtggaccgggcgcacggcagcggttcacgggaacgaacggccgagatcgatccatccaaaacggacggccgagatcgatcgggtctacggcggctcacggcagacggccacga

SEQ ID NO: 21516 - DNA, 1501 bp, Oryza sativa
cgatatgatctttatgtatgcccgatgggtcaataagttctgctacgagccactgttgacgcgtggaccgaaaaggagttttcaggttacagccaagtatacatgaacctacagggtcgcacacttaatgggccggaataagaggattggatagagatccaatatgagcttaattcggatagggatccgaatagtagtcctacgggccttggaggcccgagtgatggatcctatatattcgtgaggggtgtgaccggtggaggtgagaaaccctagccgtcacttccctacccgagcaaaaccctagccgcgcgcgggtgctagcacatctgcacggcgaggagaacgcacgaggaggagaaggccgagccggtgcgatcgactacttcctctacatcgacacgcgctacttcgcgagagttccttcgacttctcagcgtcttcttccgctgcacagcgcatcgagtggtaacgatctatgatctaatacttgcatggttcctggtttacgcgatagaaaattttgatttatgctatcgtagcctacgcgtatcccaacagtggtatcagagccgccttgtatagtttatgatctagatcattgcatataattgatatgcggatgtagtagatgagatgtattatgttgtatatgagttcttaggtgatcggaacatgagatgaaccgatagccacatgggttgatgagatcaatcggtatgtatgttggtgacttcactagaatgtttagtactcaccaacgccgagcgcgagtgtgttcatcggatagtccgatgtccactggaaccgcacgccaatgagaaaaacaagccaatgagattgactcggtttcggcataatttgattacgccgttaaggttttcacccgcgggggacggctctcccctcgaccccctgcccgctaaccggctagcgggaccgccgtgtgcgttgccccttagatttcgcttgggttttattatatctatcttactttattgctgttatatatttgatatgatatggtaggatagattccctcagaaaaattaagtaatttatgctcttccaataattgcacctattacggttgtgatcataagtgatgggtttgccatagcaaagtgtcactttttatcatgataaaataggatagatatcggacatctatatgcggagatcattggtttacttgacaaggttatcaaaacagttttggaccttggggcataggttgggttggacatggagatgtcaccccaatagcacaagagtcacatatgatgtgattagcaaggtgttgcttacctattttgatagttgtctagctgtgatgccaaagcttactagacactaataaaatgaggatcttgactcactatgttactagagggaattttatttcacaatacatagtgggagtatcttttgttaaattgtttaatgaaaggttaaatgtaaacatggtgctgattttgcatgcatatatttctattataga

SEQ ID NO: 21517 - DNA, 1501 bp, Oryza sativa
acaaaaggacaaagtccatatgatgctaaacgataatccagataaatttggtcaagtagtgactcaactgatctcatccttggagtttatgttggacatgaactctaggagtttggcactccaagggcagcaactggtgttccttctgaacaatataaacttcgtgcttgagcaagctaacaattatactgatctgaagctgattctaggagaaagctggtgcttgcaacgccatgtccaacttgatcagttcttggcaagctatgtcgaagcttcttggacacctgtgatgtcatcattcataataactcgaattcctaaaattttatggccccagcaattgttcgataagttcaattctcgttttgagatgacctacaatgtgcagaagacatggaaggtcacggatcctgtgattcgacagaagctgcgtgagaagatcacccagaaggttatcccattgtaccgaatgtacttggagagctactcggacaagaagcaaaagtctgcgaggttcaatgttgagcaccttgaggctcgattgctggaaatattcgaggggtaaatgaaagatgtgtctgtgcagtaaatgaaagacatttaggacgatgtgttactgtaaaaagttgtgggtgaacttcttggatagtactattgtttgaaagacttagattaatgctctactagtttacttaattggaaaatgtaaatattttgttttagaggtaagactactcaaacaagtattcgtaaatttacccctccttactttccagggttgtacttgtaattgaaatactatacattttttttctctaaatgatactacctccgtttttaacatataatgcaagttgattttttaattcatttgattaattctctttgaaatatttatgcaaataaacaaatatataatgcacatttataatacttttgatggcaaatttagtgatacttttccagtttagttacttattaattaagtgattgaataaatattattagtcaaatttgaataaaagttgacaatgtcctatattaaaaaacaagtatagtaaccaattacgaaaatttggcaaggggaaaggatgagtccaaattgctacaaccaccaaatctgatgtgagagagattttttttatttctatttttttttatttttctactacttgaaaacggagtcatccttctccttcctcaccatcattgttcttgcagaacgatactaccccagcaaaacaatacgtgcccctttaatttgaacggaaaacataggattctttttaagattcatcttttttctatatgatcctttgaaacttgaaaactattgaatcctataaaattcctcaggaataccgcaatccatacaagttttataagatttttaacataaggtcccacctcacggaaagtttcctatgactctatctgtcccatccaattgctacatttttccaatccaatcaaacaatcttctgttttgagcttgaattca

SEQ ID NO: 21518 - DNA, 1195 bp, Oryza sativa
tagattcacatttcgaaatttcagatgtaaatcagctggcaaatgaacaaatcaataatacttgcaatatgttgcagtctagcttgcctttcaaaggcttctcttacaacatccggatcttcgtatagctcatggtcttcacctataatttcaacagattacttctaaaagcataaacagatctattaacaattgatttagatatgcattagcttcacagtttgatggtagtctaaccttcgttgccaaggcccatctgtggttcagcatataaacatgcttctagctccagcatgaacaatttgattcgaaccccatcagcagtttcatacttcagcttaagatatttatatcttgggattgattctatgctgcgtgcaaacccacaaatgcaatattcttttttttctctgcatcaaacctataggtttgtgcatcgcagaacgatgacaccagactctccattttcgttgggtggctcgcatgctcagggacatccaatcttcagtgtctatgccgtactcatcgcgccactccacatcagcattaacaactgaagcattctccattctaccggcaatgatatcatagataaataaaattcaatagcccatacaagacatagccaatcatatcaacaaacacttcttataaaataccaacatctatctagccatttataacccagccacagttccggattacattttaaaaccatatgccttcaatctttcctctgctattgagtgcaaacttatcactcaacattgctacatctaagaaggcaatcttttgtgtatggaactgacccctccttagtaccaaacaacttcgcaccatcttgtgacttaaacaaaaggatataggattggttaaatgcatttacatttttctaatactcgcatcgcactagtgttgctacagtcagtaccatagcgctagagctatgtgaatccaagttgctctctacagtcgatgaaataaattaaaaaaaacacacacatcagccatactacataccgagacattatgttgcaaataaactacatgaaaacaccaaacgatcctatcatcccattcactggcagtgaaaaaccttacaaaccttgacgcggtgatgcgacaccccagattccactcctccctgtacgttccccaaaatcgcagcctaacctccaccttcaactgccctaga

SEQ ID NO: 21519 - DNA, 1501 bp, Oryza sativa
catctagaacactaaagacagtccgcattgtcgatgtccagaccttcaatagcaattctgtggattcctccatgtggttacccaaaattttatcaatgtcaagaatttcaatgtacctgttccatattagtcaagatcacaaacgaaataaagtttacaaaacgtataaataatcaagttaaagaaataggtagtacaatttaattactgtatttgcctaggtacaattatttggggctgcaagaacttgtgcaggacaaacgattgctgcaatcaatcagctagcagaaacaaaaagatcaagcaaccgatcaacagaaatactgaatcaataaatatacgaacctgaccagatgctcactgtgttgatcgaaagctcctcggagcatctgttcgtgtccgaccccaatcatgaaatcagcaatcttgttgaggatggacactgacttgaggtcaatgtgactggccgtaactgacgaagcttggccacttcgcactgttctctcctcactgagtgccatgtaatatccgtcaaagctcacaccgtttgggccgctgctaccgccggagcaggagcgagaggtactcatccatgaggctgacgaggcagagccagaaccgtcgccgcctccgcggcagctggacctcgcgagctcccagatagatgtaggtgtgcaaccgagataacttgccagagcgtcaggtttccagatcttgaggtggcacaactccactgcaagggagcccatggccgtgacgaggagggattttgcgcggttgtgcagatcaccgtacgccaagacggggtgctccaacatctgcagcaggttcttggcggcggcgaagtagtcgtcgagccgtcgccggtggtcccggaagaactccgttgtttcggggttcttgcagattccgaagacgattgatctctcgatgtcttggaggaataagcgcagcgtctgctcctgctcgcgcgtcgccgccgccgcagacacctcttcgctaaattttcacgcgcagttgatttcagtgtttctagaacgtagtaatctgcagttttgcacgttggagttaggatcacgggaaaacctgctgtgctgcggcggcagatgggaggaggaggaaccatggaagcatggcgagaaggcgccgagaagagcggctccatggacgcggcgctccagatcgcagcggggggccgccgcgccgagcccgccaagatcatcagggaatacatggtagtcgagtcgtcggtggtcttgctgcgctggagaaccgcgtgacgaggctcgttcggctccccggcgccggctggtcgccgcggcgaggcctcgcctggttttcgcgtccgttgacatgtcaatctctcatgatctcatcgagcccagccttggtgatttttatttctgttacttgcacaagctgaatgcttccaccatagtttagccgtttagcacctactccgtccatttcatattatataagtcacttttatagtcggcca

SEQ ID NO: 21520 - DNA, 1501 bp, Oryza sativa
tagatgtaggtgtgcaaccgagataacttgccagagcgtcaggtttccagatcttgaggtggcacaactccactgcaagggagcccatggccgtgacgaggagggattttgcgcggttgtgcagatcaccgtacgccaagacggggtgctccaacatctgcagcaggttcttggcggcggcgaagtagtcgtcgagccgtcgccggtggtcccggaagaactccgttgtttcggggttcttgcagattccgaagacgattgatctctcgatgtcttggaggaataagcgcagcgtctgctcctgctcgcgcgtcgccgccgccgcagacacctcttcgctaaattttcacgcgcagttgatttcagtgtttctagaacgtagtaatctgcagttttgcacgttggagttaggatcacgggaaaacctgctgtgctgcggcggcagatgggaggaggaggaaccatggaagcatggcgagaaggcgccgagaagagcggctccatggacgcggcgctccagatcgcagcggggggccgccgcgccgagcccgccaagatcatcagggaatacatggtagtcgagtcgtcggtggtcttgctgcgctggagaaccgcgtgacgaggctcgttcggctccccggcgccggctggtcgccgcggcgaggcctcgcctggttttcgcgtccgttgacatgtcaatctctcatgatctcatcgagcccagccttggtgatttttatttctgttacttgcacaagctgaatgcttccaccatagtttagccgtttagcacctactccgtccatttcatattatataagtcacttttatagtcggccatatgggccgtccgacacagcatggtctaggcccgcctgggccgaggttaattgggctagcacggcccaaccgacatgccgggccatgctgtgccagcccacgtgctgcacacatggcccagtcacggcccaatacgactccagccgtgctaggccggcccgaaggcacgacagtatatcgtgcttctccatacaataagtctaattttcatccctaaactctatgggctatgttcatatagctggaaaataagtttattttgtattcctcttttatttgggccatgccttctatggttatttaagtatatttttcgtccctatactattttcttctatcgtgccataccgggccggcccaccatgctgagggtgtagcctaggcacgccccgactgtcgggccgggtcagcacgggcgcgaccccagtcaggccgtgtcatgcttgggccgggccaaaatggcgtgccttgggataggccacggatctcgggccatatggccatctatagtcactttgatttttttttcccagttaatttttttaagtttaactaattttgtagaaaaaaactagtaacatccacaatataaaattaggttcaataaatgtaacatgaatatgttttaatagtatatatatggacctgcacaccaggaagg

SEQ ID NO: 21521 - DNA, 1501 bp, Oryza sativa
tgaaatttactcaataaaatactactctctccgtttcaggttataagacgttttgactttagtcaaagtcaaactgatttaagtttgaccaagtttgtagaaaaaagtagtaacattttcaactcgagataaatttattatgaaaatatattcatatattgatttgatgaaactaatttagtattataaatatttctatatttatctataaatttagttaaacttgaaatagtttaagtttgaccaaagtcaaaacgtctttgtaacctgaaacagagggagtaccttgtttgtgatgtcgtacgaatgtatgaccatcacccaaatctcactcagatggtcaatacttacgaaaatatttgtacactatgtctatgatagaaatcttaaatgtcaaataaaatcatggaaactaaccaagtttcaaataagccaaaaacgctacatgcggactataaaatatatggcacgccaatcaacatgaattttcgagtactctcttcgtagttatgagtttccaagttcaactttaaccgtttgtcttatttattttttttgaaaacaataaaaacacaaatcacatataaaatgatattcatgttttatcgcctaataacaacaaaaatattgtttttaaaattatttcaaataagatggataatgaaagttggctcgaaaacttatgactatttaaatttaaatcatatcaacttatataaacttatgttgtttaaactatcttacatattccctctatttcaggttataaggctttctagcagtgtggacaatgctagaaagtcttataacatgtgtctagattcattaacatctacttcctccgtttcacaatataagtcattacagcaatatgaatatgagagatgctggaatgacttacattgtgaaacgaagggagtatatgaatgtggataatgctagaaagtcttacaacctgaaacggagagagtattatttttagttattgttctcgtagtgaactcccatggtaacgtccggcgtttcacctgcggtgtgtttagttcacgccaaaattagaagtttggttgaaattggaacaatgtgatggaaaagttagaagtttatgtgtgtagaaaaaatttaatatgatggaaaaattggaagtttgaagaaaaagtttggaactaaaactaggccctggttgtataattctacccgctggcggtgtcgcttgtgaaagaagcccattgtccggaggcatcggcccacgtcaaaaagtgaccgttctggatcgggctaaaggcggctacatcacttcgtcccgtggccggtgcgcccttcttcccaattgcgacacccccccaacttgtcgtcttcaactcttcccacaccacgccgaattgccgaaaccctagccacccctcttccccctcaaagcggcggcggcggcggaggccgctgcatcgcctgctaagatgtcgggcggcttcttccgggtaagtagctccgatcctccgta

SEQ ID NO: 21522 - DNA, 1501 bp, Oryza sativa
tcttatagaaataaaaaagttataaaagaaaggcccattagacttaaaaccgaacaaaaattaaaaaccaactctataaatctctatatgtgccggttatatggcatacttgtgctgtttttttctcaaatacagagtgctcattttttttaaaaaaaagatataaggcccgccagacctaatccttatccccgagcgagcaagcggagcaagcggcgcctcgatccttccatctcctcatcttctcgtttttcccgacttcccttatcctctctctctcctcccttcattttcctctttctcggtgttttctccactgccgtcgcagccagcgacgccctcccctctcccctcaccagtgcgccgcttcccctccccctcgcacggcgccctcctcctctcggtcttctctctcgctctcctctctctcgtagccgaggcggcaggcggcggcgcaagaggggtggcggcggcaggtggagacggtgcggcccagcggcggcaggaggcagcatcggcagcgatggctgcgccctcccctccgcggcagtagtgggaagagcggcggccgcccagaggtgccctcccaccaccagatccagcgggaggaaaggctccggagctgcgccgcctcgccatcctccccgccgccacctaatgcgccggtcgatccagcggcggcggctccctccgccccctctcgccttcctccggcggcggtggcggcggcggcggcagccgcgagcggatccggcggcagcgggcggatccagcggcggaggctccctcctccgccgcctctcttctccctccggtggcggtggcgacggccatggatggatatcgtggcgacggctgagggcggcagtggcgacggtcaaggttggatccggcggcaggcgagtgaaattttgtgatgtagttttgtgattgtgatgtatattgtagttcttcttggatgtttattttgtgattttgtgattattgtagctgagtgatttggttgtgccgattttggaaattgtttctcttgtatccaattctgagagggattgggattcaggggctgcggacgaaggcgcaccgcgagggacgaaggcacccttcgtccgacttgtgacgatagaaaaaatttaaatatttatattagttatagatttagggagtcgtgtttagatatggtacatgccctagcgtcgcgccgcgcgcggtacgtgcattggacagtggtgcggtcaaaagtgggcggcacttttaacttctttttgtgcgagtgatcgatcgatcgatcgatggtgtataatcattgcatgcgtatgcccgggtggtttccacgtgacgcagctttaatttgctcgatcgcggagtctcctttggtctcctccacccattcgcaatgacgcagcacggcagcagcattggttggttagtacaccgtcttatatattcctagctagtcgcattggcgtgcattgcgccatcgatgacaacacgacgcgta

SEQ ID NO: 21523 - DNA, 1277 bp, Oryza sativa
acccatggtagttaaggaaccggttcgcggaatgcccctggaagaaacttatagtacttaccactagccagcgtgggcaacagctggagcttgtagcgtagctttcctctagccgacgcatccaggcaagggtgggcgtgatggagtttggatgggccctgcgacggcctatgcggcttccggattcacctaggcacgagaggggactgcccgctgccttgcgaggagtgggggtgaaacctgaggtgtggtgtgcttggttagagggggttatgcgaagggtcctgtcacggcctctttccggtatgtcgtggtggcatgtcggcgcacggaaacgtgtcgtggggctgtgtcttgtgggtacagttgtacacctctgatcagagtaaaactattcgaatagccatgcccgcggttatgggcggtcaaccagattcaccgtgattagtttcaccctagtgtaatcttttgaatttggatagtttaagtggatggttgggcctgttgcaacgtgggatagcgttggacagtggatagttaatattaattaattattacaactgtttaaatctttcaacttctgtttataaatgctcgctttatgcaaatgaaccactctagctcttctgtgataattccctgcatcatacccctattccggtatgacttgctgagtacagtgggtagtactcagtcttgctctatttttcccaaccccagagtacgagtatgtgtcagatggaggtgtctctgaggagtaggcttcgtccgtgccgtcgaggatgcctgtggagtggtgttcccgctgcagttctagtcaaggcttagcccctgttgtctttcttttcttccgctgcatttatgtaagacttttatgatgtttgtaagacgtggatctgaatgtcaacattgtcgtttgtgtaccccggccggtcctggacggggattttaatgcacattctgcttggaattctattcgggaatttctgggcgtgacaacagcggcgcacacgagagagagggaaagagggaggagagggagtttctcaccgaggttggccagcgcgagtggagacgacggcgaacgacgacgacgagcgacgggaggacgacggcgacgggcggacgatctccgggacatcctagggaacaaaatgggaaggattagagggagaggggtggtctacggcgggcggaaaccatggccgaaggcggcggcaatggtggtactcaccggcgcgcggggagaagcgggccccgacggtggatttggccgg

SEQ ID NO: 21524 - DNA, 448 bp, Oryza sativa
gaatcattaaaagctaaaaatagccgaaatgatgcgacttcataatagaaaaaaaagttaaatatatatgtatgggcatgtttagattgtaactaaaataaacattaacaagttttgtcaatgctaaaattttggcaatggcaagatttcttatgtattgactaaatttggtaataaactaaacgtagatattgttttttaactttgcgaaacaaatatattatggttgaaaatgacatcaaacaggctctatggttctggagttccgtgcacacagcaccgctcgctagctccctccgtcccgctacctatatatatctccatctcgagtgcctggatcacatcagcaaattaatcaacgggctcaagcgttaacacacacacacaccgatcaccgaacacgtctgaattcgccacgggcgacgcgccgccgccggattcacgagga

SEQ ID NO: 21525 - DNA, 232 bp, Oryza sativa
acatatgctaaaaagtcaacggcgtcaaacatttcgaaacggagggagtatatacgaagagacgaggtgaggtgaggtgaaacgaaatgatgatggaggtggtgtctaggtagtgtttgtgcgtgtatctacacgctccgacccccacgaaacgaaagggatcttctttgctcattacccatctttggatgcccagagtacataccatatgtgtcatctctgtcacgccaga

SEQ ID NO: 21526 - DNA, 740 bp, Oryza sativa
cgtcccgtgctaatattttcattctaacgtatgagtagtgtataatttcggggaggaaagaatgcatgatttaatttctactttctagtaataggaaatctcagatgaagtcatgaaacctacatggttcatctagaacttgcgtggaattttaatcataagaaagttttggttttccatctccagttttcctctttctatgggggggggaaaaaaaaaaaaaccccagccccagccccaacccagctacgttatgtttgttccaattctcaccaaagcagcaaggtagtataaaacggcaatctttccgtgcaatgcaatgagctgaatgctttacacaagaatggaatttcggaacaagctctactaaggcctctagctcacctctcttcgcttccaatttcaaaaaccagcttcacaaaacccctccaaaatttatgtaattacctcccatctctccatactgccatatctaacgcaaagccccaaaagcacaagggctaaaatgcaaaaacaaatagcagtaaaattgtaaaaagcttggcagtacactaatcatgggtggccaggtctttccctttacaacccaaaatcaactcaaatcaaatctccactgcttaagagcttcaagcatcagcaaccttctcctcctcttcgcttggagaagcaagagcaggagagcagaagcagagtggagtttagctagcgagcgcaagccaccatgcgcgggccaccgcatg

SEQ ID NO: 21527 - DNA, 1501 bp, Oryza sativa
ggaatgttttgttccttcacatattattgtgcacttgaccatcggttttcgaacgtaaaatattatcggctttacctcgccaaaagaattttatttacgctgtggtaaaatttcgctagttgtcagtcatattcctatatgccagttcttccctccgtgccttatttctgacgatatcagtgaatctgtgattgatcttgaagggattatcctcctcgcaaagatttctcggaagccactatcatggcgcctctagagtggtgatatacttgctgtacacagagggcgagctagacgcctagaccgtgcgtcaaactcagcttttaaacggttaagcggagcgttttgcacaaaagtactttttatataaaagcttctttaaaaatcaaataaatatattttaaaatttataataattgatattttaaactccctgccgacgaatgattcgagtaaatttataataattaatattttaaactccctgccggcgaatgatttgagttgtttcgcatggcgctaaaactcccagctgaaacttagccgacgtacgaacatgttggggaatatataacacaaaataaacccaaataagccaatggggaatacgacttgttcggttattctcaactctgaagaaagacaaaccaaaaacacattgctcaaatatgttgggttatttaatagccacaaagttgctcgagtttatttcacttaacgaaattgttacaggcagtatattagtgcgtaatgatccgacaaggtcctaaaataggcaaataatcgaataagctaagtggtaatactgctactattgtgcagtacaacaaatgcaaccgatggaaaattcacctaccaacgaaaagccaaatgcacgggaaaacaatactggatctatccatatgactatgacagtaagttacgaccataagcaacaaaagactgcaagcagaaaaacaaacgagaacaatcttataaaagaaaatgaaagaacaccggtgctaaaaataaaagtaaaagttttgcagataaataacattgcataaaatccataaaaaaaatattcatgaaataataacagcaactcttcaaaaacgacgtgactggttgacaaagaaattggattaaataaagtaacaaaacctacaccaaaatcagaatataagatcaaattcgtcaggtgaattcggaaaagcggcatgctgtatccaaccgatgagcaataaatatctgcccgtatgccatcttatgacattgcatactgcaagcaaaaattgtgctcagattactcctggacacttatcaaatttgctttgtgcaaacaatggagcattatctaaaacatgaaatgtgagtaaattcgcaactcaaatataacgatttgctccatgctggaaccgcaaaataagagggcaagatgaagtgttctctcaacagtacaaaacatttgcttatgggcgttccgtctggtctcaacaacagtgcaccctaagcaagcatc

SEQ ID NO: 21528 - DNA, 1501 bp, Oryza sativa
aaataggcatggctaagtaaaacagtgataacgcgggaatttaaataaagcgataatgcaataatttaaatcaacataattttataaaatgggattcaatatgatcaagatgatgtgtcttgccttgctcgttttcccaatcgacggcttcgacttccacgaagagcggatcttccgaagctgcagcgtctacacgaccaacggaaaagaaaaaggctttaacactaaataactccacataacagcagaaacaaagcacaaaaatgggttctttacatcttaaggagaaattagagacttgaacggtccaattacgagttcaaaatggcaaagatatggccattttaagtttatatgctctttaaatggatatttacgaatttcttcatttaattttcaattaataaacggattattgcgtcagcctaggggcgggcgcgcggaccgggtccacgggaagtggggcccacgcgtcagccgctcggtccacggtggcctgggcgcacgcggctggcggcggtcggcgccgtgggtcccgcgcgtcagccgcacccgcgggcgcgggcggctgacggccgggcccacttggcagccgcgagggcgcgcccgagggcggcctcgccggcgcggccgacgggagcggcgcgcacccgcgccccgatggtcgccgccggcgaccaacggcgcggcggagtggcacccgagagagaggagggaagggggaaacgaaggggacggtccacggctcaccccgagacggcgaaggcggcggaaacggcggacggagcggaggaagacggcggcgcggctcgggatgacgagggcgacggtgctccggcggtcggcgagcgaaacggaggcgcggacgaggtcgacggcgatgcggcgatgccgagggaggtggcgccgagccgggaggaagaccggagcgacggcggcggcgaaccgaaggtcgacggcgacggcggagagagaggagcacggcgctagcacgattccgacggcgagagcgagcggtgagcggcggaaacggaagagcggagctcgggcaacgaatatatagcaacgggagggggagagcgcggccggggagagaggaaaccgctcgcggagatctcggccgccatagatgcgccggcgaacttcgcgggattaaatccgagcgaatccgagggagagagagagggaaaagagggggaatcgggagagggaaacgcggggaataattcccccctcattaaggcgcgcggggaaggcgggatgcggcggattcggcggcggcggcggcgctagggcacgggcggcgacggacgcggcgggaggaggaagatgacaggtgggccccacccgtcagcgagagtggcgggcgggcccgcctgtcagcggcgcgcgcgcgcggggaggccgatgggccggggggggaaagagagagagagggagggaatgggccgagccggcccaagaaggaaggggggggaaaagaacttcttttagggttttc

SEQ ID NO: 21529 - DNA, 1501 bp, Oryza sativa
taataatcgaaattcccaacattttacccaaaaagaccgttgtaggttttcaatttagttcctgaactccatgtataatttcagtataaatactgaactacaccatgtatttggttttctgtcatgttcagacataccctcatgtatgaggtttagcaattcaacgagcctatcttcgtcaaattcaaaagcagcctacgtaccacgcgcatagttcaacgagggcgtaacaaaccaacctccattgctcaagtcaaataaacaatatgtttaaaagcctcaccttctcttcgaggaggccgtagatgaagttgatgagcacttcgtcctcgaaccctaggagctcggtgacacgggtcgcgatccatggtttcatcacatccatcttcaccttagtcatgtccacctgtaaccaacccaacagagagaaaaaaaacaaacctaaatcagagtttgcgtcgaaacaaacagctggtagcacaaacgacacggcaaccagcaggtgcgtgagcagatgaagcacactgaccaggtgttcaagctcgggcgcgaacttctgcgtcttgagcagcttcgcctgcttgttggagaaacgggtgtcctgatcggccgacgtcccctgcgaaaaccccacggcgaatcagcgccgcctctcacagatccagcgagcgaggggctacacggcgaggtgctagatcggtacggaggatcggagctacttacccggaagaagccgcccgacatcttagcaggcgatgcagcggcctccgccgccgccgccgctttgagggggaagaggggtggctagggtttcggcaattcggcgtggtgtgggaagagttgaagacgacaagttgggggggtgtcgcaattgggaagaagggcgcaccggccacgggacgaagtgatgtagccgcctttagcccgatccagaacggtcactttttgacgtgggccgatgcctccggacaatgggcttctttcacaagcgacaccgccagcgggtagaattatacaaccagggcctagttttagttccaaactttttcttcaaacttccaatttttccatcatattaaattttttctacacacataaacttctaacttttccatcacattgttccaatttcaaccaaacttctaattttggcgtgaactaaacacaccgcaggtgaaacgccggacgttaccatgggagttcactacgagaacaataactaaaaataatactctctccgtttcaggttgtaagactttctagcattatccacattcatatactcccttcgtttcacaatgtaagtcattccagcatctctcatattcatattgctgtaatgacttatattgtgaaacggaggaagtagatgttaatgaatctagacacatgttataagactttctagcattgtccacactgctagaaagccttataacctgaaatagagggaatatgtaagatagtttaaacaacataagtttatataagttgatatgat

SEQ ID NO: 21530 - DNA, 1501 bp, Oryza sativa
acaacatgttgatgggagacaaccttgatgaagtcatcgacaagcgcttgtgtcacgaccggaaatcacccaacaggcgttcctgacgtgcgtgtattattccttgtcccaggaggcaaggtacaccaaaagttgatacaattcagagtttaacaagcggaagcgtaaatataattattacacgggcaacaacggcccagcacacaaagacaacgaaaaacagcggaagactagggcgacgaccacaggcgcttgacggcaggcacgagctagacaccgaagccttcatcttccaggaactcctcatctgggcttgggaaaattaagcaagactgagtacaaccaccgtactcaacaagacacacccacgaatgcagaataaatgcaagggagtacaagggaattataacataaagggttagggttgcagtaaacagcatttaaagacatttagttactcagggctattttgtaaacacgatcttagaactacacaatattattaaacaaggccgtgaaccctcacgaacctgccttaacccaaggcctacgatgattcggaccgaactggcaacccgacctgggttccagctcgtcccaagccaacccaggccaaccattccatattttagttgttgagcaaattttaagaattaaaacactgacttgggtacattgctcggcttgcccatatccgagggctcggctattcgaatagatttactctgatcagaggtgtacatctttacccacaagacacatcttcctcacgtgttgccacgtgccacataccaccacggtatacggacggaagacgtgacatagtttccaacccatcctagccttagacaagagtaccgacccaatcctacctacggccgggatacccgggacaggcaggcagaactgagcccctagcattgggcaccaaccctccgccgtatgacatctcgactaccgggccgcagctcgtgtagccttcatttgccctggagaatgtccatcgacgcccgacttcatccatctccaatccgtgtacttttgtttatgactagactgagccacaaactaagccttacccattagacatgtggaagtacggtagtgctttgcaacagaggcccgagcttaatccttatagtggccggggtgctacttcccacaactggcatgcacccaaaccccaccgaaaacaggttttaggggttttgaaaggggaagagaggtgtatgtccaattccaccataaaccaacaattccatagtgtccaaatgatatgagcattcccaaagtctaaagttgtaaaacctcctaatgttacctaattaaattgcgaagcatctacctagaattaaactagtggtgtcgtgagtagagtgtccactagttggggttttgtttgatctagggtgaacaaggtaataataataacaatgacaataataatatggtcataacaaaggtaaataggcatggctaagtaaaacagtgataacgcggg

SEQ ID NO: 21531 - DNA, 742 bp, Oryza sativa
atcatgagtaatctaagcataaaaaggggcagtcccaaatcctatgacataggacatcgtacgcaacttctggaacaaatcccttaacaaccaaacaagtactcaggcttgtaccccgcattttaaaaacaagtggaaaggaggaagttaaaacttttttccaattaatagcacaagtttttggattaattggaataaagttaaaaaatcaaagtaaaaggtaagtaaataaagtaaaccaagcttgcaagataagttgaaacagttgaaatcaaggtcacaaattttgtgcttttgaataactggttccaaaagaaataaaagaaagttataaaatcaacatgctaaatttattttattgcagcaagattaaataaaacaatgttgtaaaacttttgctggtaaatgagccattagtacagtaatagatgtacagtactaataacactggaataaatttcgaatgagaaccactaaaagagattatgaagtgcatgtgctattagtgtggtttaattaaaagagaaggggaggagaacagttctacttttccaatatttttagagggcttctatgggtaaccatttggcataacctagggtcaacttggctctgataccaacttgtcacgcccggaatttctatccaaaattccaaacgcttacatgtgtgtgaaccctcgtccaggaatcagccgaggcacacaataacaaattgataatagagtacaattattactcta

SEQ ID NO: 21532 - DNA, 1501 bp, Oryza sativa
cgctcggatttaatcccgcgaagttcgccggcgcatctatggcggccgagatctccgcgagcggtttcctctctccccggccgcgctctccccctcccgttgctatatattcgttgcccgagctccgctcttccgtttccgccgctcaccgctcgctctcgccgtcggaatcgtgctagcgccgtgctcctctctctccgccgtcgccgtcgaccttcggttcgccgccgccgtcgctccggtcttcctcccggctcggcgccacctccctcggcatcgccgcatcgccgtcgacctcgtccgcgcctccgtttcgctcgccgaccgccggagcaccgtcgccctcgtcatcccgagccgcgccgccgtcttcctccgctccgtccgccgtttccgccgccttcgccgtctcggggtgagccgtggaccgtccccttcgtttcccccttccctcctctctctcgggtgccactccgccgcgccgttggtcgccggcggcgaccatcggggcgcgggtgcgcgccgctcccgtcggccgcgccggcgaggccgccctcgggcgcgccctcgcggctgccaagtgggcccggccgtcagccgcccgcgcccgcgggtgcggctgacgcgcgggacccacggcgccgaccgccgccagccgcgtgcgcccaggccaccgtggaccgagcggctgacgcgtgggccccacttcccgtggacccggtccgcgcgcccgcccctaggctgacgcaataatccgtttattaattgaaaattaaatgaagaaattcgtaaatatccatttaaagagcatataaacttaaaatggccatatctttgccattttgaactcgtaattggaccgttcaagtctctaatttctccttaagatgtaaagaacccatttttgtgctttgtttctgctgttatgtggagttatttagtgttaaagcctttttcttttccgttggtcgtgtagacgctgcagcttcggaagatccgctcttcgtggaagtcgaagccgtcgattgggaaaacgagcaaggcaagacacatcatcttgatcatattgaatcccattttataaaattatgttgatttaaattattgcattatcgctttatttaaattcccgcgttatcactgttttacttagccatgcctatttacctttgttatgaccatattattattgtcattgttattattattaccttgttcaccctagatcaaacaaaaccccaactagtggacactctactcacgacaccactagtttaattctaggtagatgcttcgcaatttaattaggtaacattaggaggttttacaactttagactttgggaatgctcatatcatttggacactatggaattgttggtttatggtggaattggacatacacctctcttcccctttcaaaacccctaaaacctgttttcggtggggtttgggtgcatgccagttgtgggaagtagcaccccggccactataaggattaa

SEQ ID NO: 21533 - DNA, 976 bp, Oryza sativa
cgtgaccttaacgagaacgcgaatgtgaacgattgtgaacgaaacgtgaacgtcaaatgcaatatatgttacttcgcgtttatcctaatacatctttttgtatgttgcagaaaagacgttgtcgtcgtcgtccctcaagccggagtggtagctagccctcgaaggaattcgcgcaggcaagtgacgtaattatatatattattgttatatttgtaatgcaattaagactattagatttaatatatgacacttagacttagttttaatataagattattagatttgtaacaagacttagcatataagattgtgtagggttctaatatacgacagttagactacgcatatatgactatttgagttttagtataagattatttgagttttaatataagattattagatttgtaataagacttagtatataattattgactagctagggtcctataatatacgtcacctagacttagcatatatcactatttgagttttagtataagattattagatttgtaattggacttagcatataagattgtgtagggttctaatatacgacagttacacttagcatatatgactatttgagttttagtataagattatttgagttttaatataagattattatatttgtaattagacttagtatataattattgactagctagggtcctataatatacgtcacctagacttagcatatatcactatttgagttttagtataagattatttgagttttcgtataagattattattgttttaatatacgattattagatttgtaattagacttagcatatacgacagttagacttggcatatacgacagttatactaagcatttatgacttcccatatacgacagttagacgtagtatatatgacttagcatatatgattattagcatataagattattaaaacataaatgtctcatgacttagcaactgtttcctgtatgaacaga

SEQ ID NO: 21534 - DNA, 189 bp, Oryza sativa
tatcttgtggtattgtttgtttctaggctcgcgtctctagttcgttctagcctaggaccagcacgatacttgactttgaacgattattcaactttgcattctctgatttaaccatttgccatacttgctacatatttaagcctacccagagctccacagatttgactgcagctatacagattgtgaaca

SEQ ID NO: 21535 - DNA, 857 bp, Oryza sativa
tttgtgcggtgttctacagctaaaaccacaaagtcgtgatgtcctgtagcaaaatttgcctaagaaaaagtatacgaagtacatatacggggaggagagattttttggatagatccaatcgaccaaccaaatttatctacgacagatctaatagccaaaataatgggtccatcaatttaactggaaatcaaaggttggatgtttttttttttgaaatttctaggattttttaatttagtgccacatggtgatatagtaatgtttggaggatgtccatgtggtggcttgagagagtttttaggaaagtatggacttttagtatataactaggaaaggtagcccgcgcacatacgtggtgttttcgctaataatttgtttgggattaatttttctctgttagttatgaatttcctatagttatccttgcaacatataaattctaaacttaaattacctacaattgagttggttcctatgtatcatttgtagcgtgcacatatcttttagaatatttttggcatattttatttttggagttccaaaactttaagtaacattattttcttgtatacaatagttgtcattgtggatttaaggatatattaactaaagatattttgtgttgaaaaatatggttaatagcattgtttcatataataaaaagattaaagtgcactggcggtcatttaactttgcgcagctgtgtcaagccggcccccaaactcgcaaaacgggcatttaggtgcctaatcactgttcgggtttcactctagtccaaccgggcgctgggacatgcatcattttgcagtaagccccttgactgttcgtgtggctctctcatttctccccccattagc

SEQ ID NO: 21536 - DNA, 269 bp, Oryza sativa
attccatgaacggtacatggaaatgagcgccaagggtagagagatgttcggagcgaggatcagaaactccaacttcttgcaaggagaagatgttctctggatccatttcaaggatctcttcgatctgtaccagttggacgccatcgacgtctctcttctgagcgcatggattttgtgagtatctttgagtcgatttgtttcgttcaataattagctcctggcatatatgtaagcaataatactttcttttcattgttgtagaatggaga

SEQ ID NO: 21537 - DNA, 391 bp, Oryza sativa
ggttctcccaggcaaaagaaaaatcgtcggagttgaggacaagactgacgaggattacgatcagttgactattgtagtcttaattagacttagcatatacgcacgaaacacttagcatatacatgactattttagtcttagcatgtaatattatttgagttttaatataagattattttatttgtaattagacttagtatataattatttactagctagggttgtataatatacgtcacctagacttagcttatatcacgatttgtaattagatttagcacgtaaggttgtgtagggttctaatgtacgacatttacacttagcatacatgacttagattgctaaaacataaatgtctcgtgacttagcagatgtttcttgtatcaacaga

SEQ ID NO: 21538 - DNA, 309 bp, Oryza sativa
taaacacttttccaattgcgacacatggaacacattatggactcctgccaaagattgaggtaactctaactgataagcaacctctcctcttctactgacaatcttataaggtcccacaaaacgcggtgccaattttcctttggtgtgaacacgatgaactcctcgaagaggcgtgacacgaaggtacacataatctccttcttcaaaactcaaatctctgcggcgattgtcggcatactcttatgacgagactgggccacacgcaatctttcttgaatgatctttaccttctcttctgcttcccttagg

SEQ ID NO: 21539 - DNA, 1501 bp, Oryza sativa
tacccggctgtacagatctaactccaaaccaggagctaaacaaattattactagttatagcatcaataattattgtgagaggtgtgagactaatcacgaaaaacattgctcaacccgcccataaccgcgggcacggctattcgaatagttttactctggccagaggtgtaccactgtacccacaagacacagccccacaacatgtcaccatgtgcctcagtaccaccacggtacctcggaaaggagctgtgacattaccccttgcataacacaacccaccacagtgcaccgttcccggatcatagtcacccccttataaacaaggcatggactccccagcgacccccgtgggcttatctccaccacttctcagtctggtgctccgcaatgaaccatgctatacaaaaggtaaagccgttgcccacgctggcttgtggttgacacgattaatgtttcacaatagtagctcgcgaaccggtccttaattgtcatgagcacgactctcaaaaccatgtgctcacaacccaccattatcaagttttagttggcaagtaattaattaaccaatcacgattgaccatcgtgaactatcattaagccatcattaaataataatgagtcataagtaatcccaatagtgtgctaatgtttctaagcatggctaagcaatcatatctaatatctagctgaaccaatatatatagctcaactagtcaagttataataacccaaggtatcaaagaataaagtaatcaatgcaagcaggccataacaaaggaatagattcacaccacccagtgacattcgaaactaaatgcacagttgaaataaatagagaatttaaatataggatcaacatgctcaaagtattgtgtttaggatctgtgtgacttgccttgcaataatcggtcttcaattaatcttcttgaatacttccggcgtactcacgaaccttcgcaacgacggaaacgacaagctaacacgcaaaacaaagaaaaagactaataaaaaccaaataaacaatacataaaaagtaaacaaacatgtagatcataattttaaatgaattatgagacttgaacggcctcattctgacttcatatgaatttattatgaattttacaagattaaatctatttaaagcccatttaaaaagaattaaataaacttaattcaatttatggttaattttaatatgtagatctttattttatataatttttgcaacttgaaccacattaaactgagttacaatgaattagttatgaatttttaaagattaaatcggattaaaacacttatatagattttaattgaattatgacgcaataatgaattatttttgaaaaggaaaaggggtttattgcgtcagcggctagggtttgcggtggaccgggtgcacggcagtggttcacgggaacggacggccgagatcgatcttatccaaaacgaacggccgagatcaaacagtccacgaccgggccacagcagacggtcccga

SEQ ID NO: 21540 - DNA, 350 bp, Oryza sativa
ttgtgattccaggaatacatactaaaccttcagttattggcaagtagttaggaataatattcagtcatacacttagttgtgtggaattttggaaaagatcaactaccgaggcagacctttggtactattgatatgtcagtttgatactttcatacattgcataaaatgagggttcaatgttcggaaaatattcagacacagtttagtgacaacttgtgatattaacccttttggtcatagaattcaactatttctgccaatatttcaattgctttgtaaatcgtttctgtatgtttgtgcaaattagtgtttaatgtaaatcctttgatatgttttttttttttggctgg

SEQ ID NO: 21541 - DNA, 312 bp, Oryza sativa
acagatggagtatttgcacaaaaaaaaagaactcctagggaaacttgacacttggttcacactaagagcacttgatatatctcagagcatcacctggaacccctcttaatagtacggtttttcctaaaaactcgatttcagaagataaactatcctatgcacttctcgagtccggtccgttttgattttgtactttttggggggtctccaagcatccatcttccacaccttggactaatgcacctgaaagctactcaatgagctcattagtcctttaaccacatttgtcattaatcaccaaaacccactagg

SEQ ID NO: 21542 - DNA, 451 bp, Oryza sativa
atcgacgcccccgtcgatcaaccctaggctaggaacgtcctctcttggccacgtccatgtgtccagtgccagcgcatgtgccatgctgtgtaaccattcccggcctacaccagccatgcgcaccatgcctgcgcaactgcgacacacgcgcccgtgaaaccgcgagagtcggctctgataccattttgtaacgtcccgccttcccctaggccgggcccgcttacatctgatagctttcataggtaatagactgtcctcacagaccaatacatatattttctgcacactttgtcctcactcgtgtgcacccgggaagaatttcccggtcggtcacccatcccaaattgctccaggccaccctggagttcattggagattggcttccggaaaagaagttgcaacttgttgatatgagtattctattaatcctattaagccctaggccgggatg

SEQ ID NO: 21543 - DNA, 290 bp, Oryza sativa
atggactttggtagtccatggttgatgatgagagcgccgtttgggctcatttgcttatatatttcagaattatatacttgctgtccataaattaaaatgatgctagagtaacttgtccttacttattttactcattaatttctcaataaaattagctttatgcaaacgttgaacctagagacccactataggctagaaagcttgcatacttctctctcccttatgtatatataattttgggtaagacttgcgagtacaatcttgtacttaacccggtgtctgcaatttca

SEQ ID NO: 21544 - DNA, 1032 bp, Oryza sativa
tctaaaagcataaacagatctattaacaattgatttagatatgcattagcttcacagtttgatggtagtctaaccttcgttgccaaggcccatctgtggttcagcatataaacatgcttctagctccagcatgaacaatttgattcgaaccccatcagcagtttcatacttcagcttaagatatttatatcttgggattgattctatgctgcgtgcaaacccacaaatgcaatattcttttttttctctgcatcaaacctataggtttgtgcatcgcagaacgatgacaccagactctccattttcgttgggtggctcgcatgctcagggacatccaatcttcagtgtctatgccgtactcatcgcgccactccacatcagcattaacaactgaagcattctccattctaccggcaatgatatcatagataaataaaattcaatagcccatacaagacatagccaatcatatcaacaaacacttcttataaaataccaacatctatctagccatttataacccagccacagttccggattacattttaaaaccatatgccttcaatctttcctctgctattgagtgcaaacttatcactcaacattgctacatctaagaaggcaatcttttgtgtatggaactgacccctccttagtaccaaacaacttcgcaccatcttgtgacttaaacaaaaggatataggattggttaaatgcatttacatttttctaatactcgcatcgcactagtgttgctacagtcagtaccatagcgctagagctatgtgaatccaagttgctctctacagtcgatgaaataaattaaaaaaaacacacacatcagccatactacataccgagacattatgttgcaaataaactacatgaaaacaccaaacgatcctatcatcccattcactggcagtgaaaaaccttacaaaccttgacgcggtgatgcgacaccccagattccactcctccctgtacgttccccaaaatcgcagcctaacctccaccttcaactgccctaga

SEQ ID NO: 21545 - DNA, 1501 bp, Oryza sativa
gttttcaggttacagccaagtatacatgaacctacagggtcgcacacttaatgggccggaataagaggattggatagagatccaatatgagcttaattcggatagggatccgaatagtagtcctacgggccttggaggcccgagtgatggatcctatatattcgtgaggggtgtgaccggtggaggtcagagaaaccctagccgtcacttccctacccgagcaaaaccctagccgcgcgcgggtgctagcacatctgcacgtggcgttccgtccctgtacgtgtggatactggtagaggcgccgctggtttgcggtgctgattggcgtgggagtacggcgaagagaacgcacgaggaggagaagccgagccagtgcgatcgactacttcctctacatcgacgcgcgctacttcgcgagagttccttcgacttctcagcgtcttcttccgctgcacagcgcgttgagtggtaacgatctatgatctaatacttgcatggttcctggtttacgcgatagaaaattttgatttatgctatagtagcctacgcgtatcccaacagtggtatcagagccgccttgtatagtttatgatctagatcattgcatataattgatatgcggatgtagtagatgagatgtattatgttgtatatgagttcttaggtgatcggaacatgagatgaaccgatagccacatgggttgatgagatcaatcggtatgtatgttggtgacttcactagaatgtttagtactcaccaacgccgagcgcgagtgtgttcatcggatagtccgatgtccactggaaccgcacgccaatgagaaaaacaagccaatgagattgactcggtttcggcataatttgattacgccgttaaggttttcacccgcgggggacggctctcccctcgaccccctgcccgctaaccggctagcgggaccgccgtgtgcgttgccccttagatttcgcttgggttttattatatctatcttactttattgctgttatatatttgatatgatatggtaggatagattccctcagaaaaattaagtaatttatgctcttccaataattgcacctattacggttgtgatcataagtgatgggtttgccatagcaaagtgtcactttttatcatgataaaataggatagatatcggacatctatatgcggagatcattggtttacttgacaaggttatcaaaacagttttggaccttggggcataggttgggttggacatggagatgtcaccccaatagcacaagagtcacatatgatgtgattagcaaggtgttgcttacctattttgatagttgtctagctgtgatgccaaagcttactagacactaataaaatgaggatcttgactcactatgttactagagggaattttatttcacaatacatagtgggagtatcttttgttaaattgtttaatgaaaggttaaatgtaaacatggtgctgattttgcatgcatatatttctattataga

SEQ ID NO: 21546 - DNA, 370 bp, Oryza sativa
aagtacggttttttaatgattaaaaaccaatacttgacagtcttgcaataatgtggacggcagatgagaagaccctgaaaacatgggaatgcaataaagaaaaatactaatatattttttctatttatttaatgaatagggttggtgtaagttttataacttttcttttgaagtgcttgagcttaaaatctaccaggcctagcaaatatatgtgaaggaaacatgcccccaatagtataattgccatgaacccaaccagaagtttttatttcccatcaaattggtttgttcaaaataaagaagaaatttatatattgaaggaccccaaaaggcattgaagttgaatttttttttacatggccaactaatg

SEQ ID NO: 21547 - DNA, 724 bp, Oryza sativa
ctatgaatttctaaagatgccctgtacacttgaaagtttactgctgaattttcgagcttttactattgttctaaaattcttgagatgtactatcaggactcgaaagttgagtgtctcactccattgcatcttgtttttaagatacttaaatagaggagcaattagaacaatgagatgccattcaatcgtttgaactattttgtcacgtgaggaaacctggggagtagtttgatattcttttttgttcactattttctctctatttttgatctatcaaacagatgcataataagatgctagcctcgtcatcaatgaaacgtgtgcactgcatatttctgttggttgtttcacaaattcataatatttgatctatcatctcatttattttcagaaatggttaagattgttgggggctccacaccatcaagtacaaaatcaggttagccatgtgcatgttattgactcaaatgatgcactctttgcatgctaatttcgcccatgtcttcctttcttatgccctcttgcaaatatataatttttttgagaaatttaatgatttactattaacaaacgcccgattattttttctttttttaaaacgtgatcattttgctcataaaatgtgacctattttaagcaagccatgctttagttcctttttaaaaaattgcattcaaataacagtgcattagcacaaaaatgtgccgttgtttgctgggctatt

SEQ ID NO: 21548 - DNA, 368 bp, Oryza sativa
tcccaatcacttgatttaagtatatatcaacataagaattatatattgttagtatctacagctgatcgaatagatttagttctttcttacgtattcataactgccgatcgattcaaatatgacatcggctcagagataaatgatatatcatcggcaactagccgaacggctatcatttatggatttaaccacgatttctttgtctttatttcttgttgattgcaggatcaaatcaactggcacgctcagatccaaaagcaatattttttggatctgcactggagttaagtagatctcctaggcctcgtgtttttctcatcaacacgcttttggcacgcccggtgggacccctaattagaagtcagaga

SEQ ID NO: 21549 - DNA, 1501 bp, Oryza sativa; identical to SEQ ID NO: 21517

SEQ ID NO: 21550 - DNA, 677 bp, Oryza sativa
tatgtaatgacgatggtattagggtagtatctggtagttttgacgtgtgtctaaattacgggatatcattatttttggttatatgctgatgatgaggtgggctgctaatggtgacagctcagtacgggtattcctccgcgcttgtatataatcctaagttaattccctggagagtattcctccgtatttagccctggttttatggtcatgacgagctgtcataaggaactcggcagtcatgggtggcttctcgaagtacaaggagggcatcggatagagggtattagctagtatatcggttaactagaatgtatgtatactatgtaaatttgttaacaaccaaatttggtaatttcagtatcggagatggagataaaactgaggcggaatccaagatggaaatcgtttcggaaacagagtaaggatcggctaaagtccgaatcggatgtgaccaggatcggcggaatccgagttggacaaggttagccgattgagccgagtctgacaatgtgatgcggtacacgttgtcgaggatagttaatgcgcttcatgaggattgccatgcacggattgagtcttgagaaggcaattgtatctattaattaggatatttcatgtaatttccttagagatatgtttgggcaaaagtctgccacaaagacttatggtatcttaga

SEQ ID NO: 21551 - DNA, 342 bp, Oryza sativa
aatgctgcttggtattttcttttccacaatgctcaagtaatttgctttagagtggataatactctagagtagttatgtttgaggaattatgtagctctggaattatatgatcctatttccgaacatgcttaccttcttgtttgatataagttgtgcaataagctggtccacaaaatgtcaataatgataaggaataaggtcaatgcaataaaaattgcagatgacccttgttctaggataattttagaacctaaatcaataaatggcagaatgatcctcctttttccaaatcgtaccttggttggtgctttgtcttaaactaaaatatcccccttgtgtagt

SEQ ID NO: 21552 - DNA, 183 bp, Oryza sativa
cagtccaaattcagcactgacagactccagtagcttttcctcccattttgcatctgcaagtcagactacagaactggtacatgaagaatcagatcgcaatgcacacctttcaaggtaaagatgcttggacttcttgcatttatttacttctatcggagcactcattcttaagtcttctgcagc

SEQ ID NO: 21553 - DNA, 866 bp, Oryza sativa
cctatttccagacatctccagttaagaagagacagatgcctatcaaaagctaaattgcacagtttttttttttttttggtagatcacctgaaagatgctggagaagtgggccagaaccttaggtcccttgaatcgctaggatggacatgaagatacagcatgtctgcccagtcaagtttctggtcctcagagaaaacaaagctctgtccatagccttctaggctattcggtagctgtgtgtactccttcttggtgtccagtggctggctaaagaaatcaacaatgtctctcttcaggtttgcaatcacttcatctggcactccatggttaatgagctgtagtttattccaaaagtaaatgtttccattatactagttgcacagctcaaactgagctagagctaccttacaggacatgaatttattcattttctgcccacaactttatttgattatctgtagcgtctttaatcaattcaaacatttgtatatacagtatgcatttgcaaataggtatctgttgctttccgaagatgaaatgccaagaacctaaagttacataccagaaagaacccccaatactggcaggcagatctcagcttcacacactcctcttctgatgattgcggacaaagcaatttcttgagatcgatgatcggaatcgccatgtcaccttggtagttgttgatgacctcctcagaactagcctctggttgatgtacctttcaggtatgtgttcatctggatcattgcaaatttctgcaagcgcctgcacattaggcactgggagagaaccaacggatcttgctcccgccattgcaattcccagtttctgcactaagtgttttcttttcttttccttttttg

SEQ ID NO: 21554 - DNA, 487 bp, Oryza sativa
aagaataagtgtacgtgcggtgcacgccctttcctcagaacagggacacaaaaagtaatacagaccatccccaaacaacatgcacacagaaggaaaaaatgattccaataatgagctcgctgattttgtgtgtacaacagaatctgaagattatatacttgtgaacctgatattttatgagaaactttgagaacaggatgagaagttcggttcaactgttgtccagaaaagatgcaaggtccttggctacatgtgaccaagagaggcataattttattcagatcatgcacactccttggctacatgtctttgcctacatttgtattccacaaaatgattgcaattattgatagacaaaatgaagtggtattgttacaaaatacaggttgcagcagaaatatgaggcattgacatttcccttccaagaaccgcttagattttattttcccgagcaacgcagtcgttcggacattaatttagtaagtca

SEQ ID NO: 21555 - DNA, 454 bp, Oryza sativa
acccaggattgggttttttttgggacggagggagtatgacataaatggattagaaggattttagccattgaaagtggaaaccaataggaacaacatgaacagcatgttacacatcctaattcacgtatttgatggcaaatagaagccattgtgtttcaggcagctcatgattctggggaagcaaacatactgaatcaaacacacctgtagttcaaattctgccttcctctttccccatcattgagcaaacccctataaagcaatctctgtgttcaatatcactgagattggcatgcaaagaacataacacaacctgagatagcaatagagaggggaaaaatcatggagcagaatgtacgggcagctggggaaaggataatatgatcaaggcaacaccttgaattttagactaacatgaaacctcatagtcctgccagatactgtggttaatgat

SEQ ID NO: 21556 - DNA, 379 bp, Oryza sativa
gtgcatgatcggtaaggcctcatccatctccactagacgttgggagcttcaagtgcgagcagacttgccactttcctgtattagatcagcagtcgatgaatatgataatttcaactaagaaagttcgattaccggtgtttatttatgtctttggcacaatgggggacctctgatctatcatcataaatgccaactcactgaaattttcgcacggctacttagtgacagtcaatttgatcctaatgcaatatgtcgcccaaataatcttctaaagtttattttgatcactaattggcagatgatttactgtatctttttaatggaatagatgatttactgtatcataataacatctaatggttatttccactctctcagg

SEQ ID NO: 21557 - DNA, 376 bp, Oryza sativa
cgataccactctatattaagatattaaagcaagtagaatataataaacaaaagcataatatacttaaatgcagcaagatcttaatataaagggcggatttaacatgtcaatcaaacatatagaataaatattgctaaatctggtaagatcggctgaaaccccgatgctaccctaatcggcaaccaaaaagcaggctagagatcgaaattctaagcacgacttagcagatcaaacataactgatgcagcactaaatatgaaaagaataaccatatctagacaatcaagccaccggacgcttcatagagtggtggatatcttatataatctaagccaacatcgctatttaacctaaccggctgccttctactaacaga

SEQ ID NO: 21558 - DNA, 1501 bp, Oryza sativa
ttactaatacttaattaatcacatgctaatggattgctctgtttttcgtgcgggagggattagttcccatcccctaaaaccgaacacagcatatatatttttcgctttctctaaatcattgtcaagaaaaatgagagtatcatctgcatattataaaatgaaaaaccatcatcgactagatgaggaatgaccccactaatttaaccatcttcctttgtcctcttaaataatatagatagcatattaacaaatatattaaaaagtatgagggataaagcctctccttgcctaagaaccttatatatttgaaaattagatgccacttggttatttacttttataccaatatatccatcttggataaaagaaactatccaatcacactattttttgaaaaaccttttatctttaatgtttattgaacaaactattacttaactttatcatacgctttctacaaatcaatcttaaaaatctgtgaaatggtcgaaaatgctcgcgtttagcacgtcgctctcctaacgtgaacaaaactttccacggttacgtcatttgcatcatgcacgtgtcctcgtcggtcctgatcagttcgtacgtgcaactaaatgccacccctttactatgcatcttttgcccttgcaaacgcagcatatctcaggtttgatttggtcggcaaccaccattaattatgaagatgacttatgcctgataaacactaattgcataacatccgtcacatcgcatctccaagcaaacattatccggcatgctgttacccggttgatgatggaagatgacctgaacacacagtaattggacggcagtaggcacgggatggtgattcaagtcgttgctctagtaatttactaaactccaaatgctgatgcagaacaggccgaaattgtgacaatttgaacttttacaaaaacttattaccagaatagaccatgccaaaaacatcaacaaaaatacgttggaaccgaaaatctgatttggaagtggctcaacgccaagtatttgttgaatttataagcacataataatttaatgtatttcataaataaatcatgacgttacagatgtaaactagcgtaaaaccattataagatttaaacatataaactaggtagtaaagcatgaataaatcgaatatgcgcaacatgctgaacacgaactaagggtaccggaagaccagttgctcaacaggaagtactcgcggttgcgggcgttgatgacggcgctatagatggccaaaaggcccgatggcccggcccacggcacggcgttttggcccagcccaagcacggcacggcccgtcaagggtcgggcccgtgccggcccggcccgaccaccggcccgtgactgggcctctccgccggcacgttgggccggcacggcacgatgggccgcatgccaggcccgacacataaacaatagggaggaagaatagacatattatatgccacggtcgaaagaataggaacgtaaaatagacttattt

SEQ ID NO: 21559 - DNA, 1501 bp, Oryza sativa
tgaaacatacctgctgcccccttccattactgttattctcctgagactgatcctgctgaactagcaccggctgattagcttgctcgatgtttacttcattgctttcattagtctctgatttgatctcaccaccgatgttcaactgttgcgactgttcttgacctgcagaaaaagattcaccaagttggagtggcttgatacgctgcctctggctactaccctgtgtctcctggaaaacaatccttcctctcttacgattgtccatcctgttcttcttgtcttccagtcgaattgctttgtcaaccaacccctgaaaatcctcatagtcatgagagatcaacataactgacacctcatcctttaagccttccaagaacttctcttgcctttcctcgtcagtacgcacatcttctggagcatagcgagctagacgattgaactcatgaagatattccgtcacggtacgatccttttgcttaagtgcccggaactcacgcttcttcaaagcaacaacacctgcaggtatgtgtgtcttcttgaatgcctcagtgaactccgcccaagtgattggttgtccttctgctctgttcatccggaaatgatcccaccattctgatgcaggtccttgcaactgatgtgaagcgaaaacaactttctcctgatccgtgcactggagcaattccaacttcttctcaacagcgtgcagccaatcacctgcttccactgggttggtagtgatagagaaggtaggcggcctcacacgaagaaaatcagctaacttgttctgcggcggcggaggattgacattgttgttcctttgctggttctgcatttgttgcactaacatgttgatcaattgggtctgttgagctagcacttgagcaagggttgggttctcttcattgttattgtttccacttccactggcgcgagtgttcaccatctgttgcagattagaaaagataggaggagaggggttacactaaagacaagaccttaaccaggttaccactgatctggtgtgtgtagaccattatattgttcaagttgattaagcaagcaacctagtacagttacacactcatcaatgaactactccaatgatgggaatgcaaccatacctacacacaaagcaaacaacaaacgttcaaccctactaactattcttcaaagacactttggcggcataggttctaagctaggttccaaacttcactctatcttgacagctgaacactttgattcaactatcatcttcttattcctcgatccacttgacttgcagaagttgacaacatcgacgtcttcgagtttctccatcaaatttaacaactactcaagttgaaagagggaaaagaggagagaacgacaaaacgatttgtgaagaattctagataaggaagaaaggagaaattttcacaaatcatgtttccggaaaattagtccttaaggtttgactatttggcttatcctacagtcgagatggctctgataccaactt

SEQ ID NO: 21560 - DNA, 1501 bp, Oryza sativa
taacatttacaacctaacaatttcttctacgaactatagggtacaaagatgggtatctttccttaaaggaagtattatctatccgcttatccttccaaattctgacttgttaaccgctatttattatctaggaactcatatttgagaaaaatacttttaactttcaggagacctgaccataaatgggaatcccttgtttcctctcaacttgagttattgattggttattaaggtattttattttcaataagtcttgtcaaactccttgctcatttattaacttaaacaactatttgctcaataaacactagttttaaatttcaaaattatgtcccatctcgtcagtctatatttttttgtgtgatcatcatcttgccaaaaaaagtgatatataataatcaattttcaaagaacccctctgagaatcttaaaaaaaaatattataaacgtagctagacttaagagcacataattaatcaaaaccaaccttcctcctgcaggtgtatgtttacctttccaacaactaagtttttttttaattctttgtttaatctttttccaatctttattacttagctttttaaaatacatagaaataccaagatattttaaaggaaagtctcccggtatacaaccagaaatgtttgaatattgttcataacattttgtgtctgaccaaagcaaaataattcactcttgtgaaatttatctttaggcagaaagcatttcaaaagttgataataacaactatgggtgtgttcgtgcccctttttccaacccctctctctcgctttccacacgcacgtttttcaaactgctaaacggtgtgttttttgcaaaaagtttttatacgaaagttgcttaaaaaatcaaattaatccattttttaaaaaatattttactaatacttaattaatcacatgctaatggattgctctgtttttcgtgcgggagggattagttcccatcccctaaaaccgaacacagcatatatatttttcgctttctctaaatcattgtcaagaaaaatgagagtatcatctgcatattataaaatgaaaaaccatcatcgactagatgaggaatgaccccactaatttaaccatcttcctttgtcctcttaaataatatagatagcatattaacaaatatattaaaaagtatgagggataaagcctctccttgcctaagaaccttatatatttgaaaattagatgccacttggttatttacttttataccaatatatccatcttggataaaagaaactatccaatcacactattttttgaaaaaccttttatctttaatgtttattgaacaaactattacttaactttatcatacgctttctacaaatcaatcttaaaaatctgtgaaatggtcgaaaatgctcgcgtttagcacgtcgctctcctaacgtgaacaaaactttccacggttacgtcatttgcatcatgcacgtgtcctcgtcggtcctgatcagttcgtacgtgcaact

SEQ ID NO: 21561 - DNA, 1367 bp, Oryza sativa
tcggcttgattagctccaaactcacctggtaacgtgaaaaccatgttaaccgacgcaggacaacacttttccctttagccaacctttttgcttcgtcggcttgacctcatcggctgtagcagcttggttcttaacacgccactcctgcctcggcttcgttttcttcagccgatggttaatctcttgctcgacttcttggaagcgttgtctgttcctcaatctttgaaccctcctttcctgattctttgtaaaaataccaaaagggcaccattgattttttccgccctcatcatccccctgatcttaatttactgggcccacatctttcatgaacagggaacccttggttgccctaacccaatggctctatattagaatggccttgaaccttctgcaacattactgcgttccggacaaatcttcaatagatggcagcctcatcccttcaggccagcaaaatctgaaaaactcacaaccccaatgaggatcaaaaccaccatcatcttcttcataatacctctcctgctgctgcttgtcatatttcctctggtacttgttgataattctagccgcattcatctgaaagttctattctttcccccatctgctgtccttctagatgtgtgcaccatgttaacagggaaaggattaccatcaaccttcattggcttctttaagtcatcaaatgtaatcttccctccttcaatagccacctagatttgctgtctgaaaactttgcaatcattagtagaatgagaaccagagttatgccatttgcaatacctccttttgcctagctcctcagctgatggaattatgtgaccagcaggaagttgaatttgtttctcccgaagcaacaaatcaaaaatcttaccagccttggtgatatcaaagtcgaatctttcttcttttccagaacttctcacccatgggcatggcacaacctttttgctcctgacccactcggctgctgccacttcggaatcatcttcatcatcagaaccatacatataagccaaatcggctggctgcgaatatgtcaaagataagctgtaacatctgttcctcatctccctgaatctctggatataatattgaacagattcattgtggagataatgggttcctcatacccacacggtatggttatcccactagttataggagataactaatatcagggaaatatgtaatggatcatgacttgggtattacgtttccttgtgtactatggaacggcctaaagtcctgttttgataatattgtaaagtagatttaggaaaccgataccgtattggttaaggtttctatcttgtaatcctgccccccatcctatataaggtgggcaggaggccctctatggggca

SEQ ID NO: 21562 - DNA, 1501 bp, Oryza sativa
gttgtgaaacatttatcgtgccaaccacaagccagcgtgggcaacggctttatcttttgtatagcgtgattcattatagtgcgccagactgagaagtggcgagaagtccacgggggtcgctggggagtccatgccttgtttataagggggtgattatgatccaggaaaggtgcgctgtaatgggttatgttgtgcaaggggtattgtcacaactcctttccgaggtaccgtggtggtattgaggcacatggtgacatgatgtggggttgtgtcttgtgggtacagtggtacacctctggccagagtaaaactattcgaatagccgtgcccgcggttatgggcgggttgagcaatgtttttcgtgattagtctcacacctctcacaataattatggatgttataatctggtaataatttgtttagctcctggtttggagttagatctgtacagccgggtatggttgttcagaatggttgggcctgtgcaacatgggtgtgttgtttagtgttgattaaaatttatgattaattactccactgttttacttatcttaaatctttgctaaatgctgcttttgcaaatgagcctatattatgccatcctttggaatccttgtgcacttgcatatttgctgtgtggcttgttgagtatgtcatatgctcattcttgcaataatcatcaaaactcagttgaagataaaggttccagaaggagaagacgtttggcttataccccagttgagctgcctgtgggagtggagctgaagccatcgctagatcgttattccgctgctgttttcttttcttttgtaagtatgtaacgttattattaagatggatttttatattaaattgtcagtttgtgtacctcggctgattcttggacgaggattttatgcacaaattagttcggaaattactagtgaatttccgggcgtgacaagttggtatcagagccatctcgactgtaggataagccaaatagtcaaaccttaaggactaattttccggaaacatgatttgtgaaaatttctcctttcttccttatctagaattcttcacaaatcgttttgtcgttctctcctcttttccctctttcaacttgagtagttgttaaatttgatggagaaactcgaagacgtcgatgttgtcaacttctgcaagtcaagtggatcgaggaataagaagatgatagttgaatcaaagtgttcagctgtcaagatagagtgaagtttggaacctagcttagaacctatgccgccaaagtgtctttgaagaatagttagtagggttgaacgtttgttgtttgctttgtgtgtaggtatggttgcattcccatcattggagtagttcattgatgagtgtgtaactgtactaggttgcttgcttaatcaacttgaacaatataatggtctacacacaccagatcagtggtaacctggttaaggtcttgtctttagtgtaacccctctcctcctatcttttctaatctgcaacaga

SEQ ID NO: 21563 - DNA, 1483 bp, Oryza sativa
actgaggacaacctgaagataatagtgggaagtaaactgaatgtaaagaaagtgaatccgagctgcttggtcgtgggaactatttccagttatgaaccaagtgatatgttcgaagattgttttccaagggcaaattaaaaatcacatctaacaacgaagctttagatttgccaggataaccatcaaacaataagaagtccagcacaaagccatttgggaagacgtcaaagcatgtcaagtgggataagttggttcggttgagaaacataattcaaaggcaaagttatcgactctcgcatggaatagcagaagtagctagcacccggagagcaggaaagctaatatgaggcagttggtggcaagttagaagtaaatgacaagcatggtattctcatgatgacaagcatggtatcctagtaatgacaagctgatatcgacgcataacgtgaagtgggtaacttgtatgaggttgacgccaaagatatgaattatgagaagttctggaacggaagcatcattaaactaccgcaacctagtctgagtcagctaaaaggtgcaccctggttcaagtcaggtgaaaagaagattccatctgcaacaggagatcaagccaagcagttcagagtggggaagttttgctgggcaagtccattcaagaagatgcaacggaagaagtcagaccagaaaagaagaccgcccaacctatcttcttgctagcctcctcgaatcttggggacgagattcctgtaagaggggtggatttgtcacgtcctaataaattcatcccgaaataaaaatcatcctctaaaaagaataatagaattaaaaaaaattcgaaaagaaaatggcaaacactaaaatacgtgctagaaaaattcgaatgtggtccggagaatttttgttaaattctccttggtctaaaaagagccctcaaattttacttgaattttcagagcaccggaaatatttattaagcaacaacaactatgatcaaagtttactaaaaagaaaagctaaaaataatcctccttcctccctttgggccaagtcccaaagtcctctctctctctctctcggcccgcggccaaagtcctctcttcctccctctctttctctccctctcctcctctaactccttctcttgggcctcctctccttcccctcggcccagctccctcctcctccctctcttccccaagccgcctctccctcttctcctcctgggccggccgcccggcccaagccacgccacccagccgccccatcctcccgagccgcaaccacccccctcacgcgcgccgcacgcgcgttgcacgcgcgctaaccgtgtggggcccacgcgccggtcgtctccctcctcccgtgaaccctagctcctttcctccctcaaatccgtgcgatttaatcatgggattccaaaattaaatagggggaattaatccccattgattcctctttgatttcccccgttttcccccttgaa

SEQ ID NO: 21564 - DNA, 720 bp, Oryza sativa
tcggactatctgatccgacatcggatactccgatacttagaaaaactcacttagataggactttttcaaatcaagacagagagtgaagttctgtgaaaaattggatagtccgatacatcagatagtctgatttcaaatcggatagtctgatgttgctcaagtaaaaatgcaataactttttactccgaactccgatttcgaagatcttggactctatggaaagctagtttcgtgggctatcaaacccaacataaaacttggtccaaaaccttcaagagatgttgaaaaacttgcaaagaaaacttgcaaagatgttgaaattttggcttaggtttttcaactcacatgtttttcaactcgcacaaagatgaagccttttgagcacttgtattcaaccaattatttgcatgtggtatccctcttaatagtacggcatcctaaactcaaatttaaaaagtaaagttataccaataggagtaccttcacaccatattgtttcttcacttggagggttaccaacgtcaaggtcatttgatcatcgggaagatctcatcttcttgattcttgacatttcgtcttccatttctcaaatgattaatgcggataatacatggcttcaaatggcctcgcacggttcatcacgacacagtcttcactcgcccttcaccaccggcgccaagccccttgcttgcccttcaccaccgcatggtccatcgcagc

SEQ ID NO: 21565 - DNA, 1121 bp, Oryza sativa
aaattacttgccagttaccactgattatctgttttcaaggtaattcatgatattgttggtaaattttttttaaaaagattgctcttgaatacttggttattattatctgtagcaccaatcagaagctacaacgtcaccttggaggttattaatcaatttgagcacctgcttgacaaattgaacatttgctgctatatatgtgctaatgcagtaatctgaatttatttggaataatcaatggcaagttatactagactgaacaccaggtagtattggaggaggatcaaaactattgaagtgatattattgtgaacaatttcacaatttaatatcacttcaatacttccatagtccaagtacgattaactgtttcatggaatttaatgacattattatacttttcgtggaatttactgaagattctttgacaatttggggtttggatatacttattaatgttaaatttgtaatttgtggccttggaaaaactagtttgatttgtactaagaatcacttttgctatttgtcatgtcacctgaaaatttcttgattgttaacacctaagcttgcacattgcataatcttaacttgcagaatatataaaaccacaactttagtataatttacttcaaattaaagtttactttgtttgcctctctagttttgatttttatcttgtttcttagtggttcggattcattaaataaaatacagtgactttatcttaagtaagaaatgaaaatattaatttcttttgctattgggcgttggtctagtggcctcaaaaagggtttgatagataagaaaaaatagccacttcattacttgatggtatcataaaaaaatagtttagcttttctctctctctctctctctctcttttttggagaaagggttagtaaagcttagttttttttaaaggattagtaaagctttctgggatcactaacttagattagataccacgaattgtgaacaacttgtccctttagtcaccatttatatctgaggaagctagggatgatttcgttgcacactcaagtcactctaaagtctaaaccgaggtttccttgtttcacctatatacttgtttgctttcaggatttttctctgttcttagt

SEQ ID NO: 21566 - DNA, 673 bp, Oryza sativa
gccaagataagtttgtgaagccggatctagcctccgcaacgaaagagatacccttagtggaaggaggagtgcatttgtgcaacctcacgaggatagggttaaaaagacccggctctttgcgagctccctcaacggaaattagaatcccctcaattgaactccgggaaatacatcgacgcgtaaacctcggtgatattctcactctctttaccgtcttgttccattgctttgtgctatgctaatattgttgttggtcgagctcacctctttgcttgtggattgaatctagagctcttaggttgttctcttgtttgtattgttgttgtgcaggtcagatagtctgatctcagttcagactatccgatcacataggactatccgacctgatatcagacaatccgaccctattttgttttagcttccgcatttattttaaaaaaccgcctgttcacaatcgacatattttaaaccgcctattctctttcccttcatctaggcgacatcaaggtcctttcaattggtatcagagccaagtctctctattaagggctttaccgcctagagagtaaagatgtcgattagtggtttggtggatattgttcctttactccttttagatggttcaaattatgattcttggagtactcgcatacatgtgacatatttaggacta

SEQ ID NO: 21567 - DNA, 1052 bp, Oryza sativa
gtgcatgatcggtaaggcctcatccatctccactagacgttgggagcttcaagtgcgagcagacttgccactttcctgtattagatcagcagtcgatgaatatgataatttcaactaagaaagttcgattaccggtgtttatttatgtctttggcacaatgggggacctctgatctatcatcataaatgccaactcactgaaattttcgcacggctacttagtgacagtcaatttgatcctaatgcaatatgtcgcccaaataatcttctaaagtttattttgatcactaattggcagatgatttactgtatctttttaatggaatagatgatttactgtatcataataacatctaatggttatttccactctctcagggcttaaaggtcactgcatacgtgaggtgcttgagcagtaggaatctgcatctaccatggatgttgttgctacacaaacaaaacaatataattgctggtattattttcaaattttggtccttttgactctatattaaattctttatccattactgtttctcgatagtttgctgtgaatgattgcctgcacattcaaatgatatgtgggattagtttccagtcagaagtgcaaaacttagctagatctctcctgatgcacaaatctcactttttgtccggatgaattctacacatttcagaccagaaaaatcttggtacaagtcttaatacaagccatttagttatcagcatattcactgcgtggtagctatactctaaaaaatattccaagaaaatatggttatgctactgtttaataatttgctgaaggaaatagcaacattgcaaagagatgcaaatggtgctacttgatgctgaaacctgagtaccagtcattttaattgtagctgtttggagcaaagttttggctagatgtagtgcataaattaaatttatttttgccgcttgaaacttttatatacacaggcaactattttttttcttttcatttccaaaggcttccttccgtattaaccttgttttttttatcaaactactaggtaagttgaacgagt

SEQ ID NO: 21568 - DNA, 1501 bp, Oryza sativa
cgcggccggcggcggcggctcccttcgccccctccctcccagatctggccggaggagggaggggggaggccaacgggggcgacggcggcgacgacggcgtggggcggcagcggcggcgacgacgacgcgcgcggggtggccggcagcgtctcccctccccctccctcctagatctggccggaggagggaggggggaggccggcagcggcgccggcgacggcggcgacgacgacggctcccctcccctcccctctcagatccaaccggggaggggggcgacggcgtggcggcggcggcgagccgcatgcggcgaatttttttttcctttttttgcattttcgcaggcaggccgttgccccgactgcaaaaatcgatgattttcacagtcgttgtggtgcaggcggacctccctcccgcctgtgaaaattagttttggtcgcttgaaaaaattagttttctggtagacactcgtaaaaggtgcgcggaagcttatcctcagtttcatatggcgtcttgctagtggtagggacggacccaagattggcccaaggcttatgccagcccgcgtcctgatgcttgtattcctggccagggcgctgtctgagctccaacaactatgtgtttggtttgtgccctggtatatcctgagcttgcctgacctgactcttcattagcctgagccaagccatcaaatttggacgcctaagcttcaggcagctactcttaatgatgcactagatgctggggcgcgccaatagcgcgccgcctgcatatagattgcttgattagtgtagactaatcatttgttttcaggctgaatcaatgattatgtaagaaaaaaaaacctatgaatacatttgcagtgaatgccgttgatgagtaatttccatacattgttttacagattctgttgagaacaaaactcttacactttacaatctaaagatgaagcaccaatgcatataaaaaataaaaatcaaagttttacataatgatcagagtaatgtgtccatggtgatgatacaactatatttgatcatacaaatctaccagtcaaaagaagacattgtggcaataacattctccgctgaaaggttcacatccggagtattaattgcaatggacctgtccaagtacaatccatcagtattaatgagttttttaaaaaaaaatgtttcagaggatatcttcaaatcagtatcagtgaacatactggaagctcagaagacacttattaattggatttaggaagtgtggcaacataattttcattttacctctcaatacagatagttatatcaagtgatacaacacgagactacatatttgtatttattacatggaaatgcagtgagagcaaaagaactctagaatttagattgatatgaaattaaacatgaagggtaagaaatttacaggagaatcaactaataattatccttaatgttttcctacactaaggcaaaagaaaatgtgtaaattaaattgactgtcactgtga

SEQ ID NO: 21569 - DNA, 298 bp, Oryza sativa
tgggactccaatattctaggcatttttatgttgatgtaatggcgtggaatttgtcggtgttccatgtatatttaatttagttgcttaaaagtcggtggtttcgatccgtccacatcaagcctccacacatgttcattactaattcatctgcctttaaaagcaaattggtaattagggagtaatttctgaatgttctaggctcaaaagtggttctggtaatcttgaatatttgctctggatgacattccctctatttttgcttctgacttgaactgtgaccgtgcatctctgtggtgat

SEQ ID NO: 21570 - DNA, 1501 bp, Oryza sativa
atatatatatatatataatcattgaaatagggaacttagccccgcaaacaacccaatataaaattcacttgtatggagatttgaactcaggaccttgtagtactactcaggtcactataaccactaggtcattgtaactactcaggtcaccgtaagaaaatttgaggtgtagagaaattaccgagcctgtgcattgttttttttggtgcaatttttgcttagggtatattctatttatgctatgttgaacagcgtaggctttttattccttgtgtttacaatgattctttgaagatgtacaagctaaggtaagctcaccccccggtgaccagtctaaaaaagacaaggtatgttcgtacaacctattgtaacgcacggatacatttgctagtgctgaaagtatttcaaattgtttgatcaaatccggttccaattacaagtttacaacagttgtaacatgaatgaattctaacccttcgaagatgacagtttaatcctcaagccgtcgaggtgattccttccgtcgagctttgccgagtagtaacgcttcatgaaatccaggtagcccatcgacgtgtaccgcgcgttatcgccgccgccttccccgaccagctccggcagaggcccgaccaccgcgtcctggcacggctggtggaacaccgccgccgacacgcgctccctgtccggccgcaccaccgccctgtgctccacgctccggtacttgccgttgctcatgatctgcatgcattttttgcgagacgcgtaaaaaaattgcatgtcaatatattaaaagaaaataaatttttgttacataacacaatcagctagactatttgaactatataactttgctcatttctagtaatggaaataggaacccttgcccttgattttttttaaaaaaacaatcaactagaccggcttatgccaaagaaagaaaaataaaataagaaactaaatcttaggaagaactacggaggctaaacacaacttctaatagcgggaaggcgtagagccacgctacactcctaagaaatccccagaaacagcaaccccggctaaggaatgcagatgaccccggctaagaagatgatctgcatgcagacgcacgtagcagcaaagcaaacatgaagccaagaaatcatcctcggcgatggctatgtttgcctcgacgccattgttggtcagtcggtaacctcgagtatgtcgccgacgttgacgatgaacgcgccgtcgtccggaggggcgccgacggcgagccacctgccgccggggctcctgatctgcaggcccggcacgtcgttcacctgcaggagcagcgtcaggcaggcggcgtcggtgtgcggcgacaggccgaccaccttgccggcctcccggcacggcgggtagtcgttcatcctgatgccctgcggctggtcctggaacctctccagcagcgaccccggcctcacgcccatgtccttcgccatgaactccaacaggcatctcgccaccctcgccg

SEQ ID NO: 21571 - DNA, 1501 bp, Oryza sativa
atgtgtactccatccgttattttacttaatatttagggtgtagtctacaaaacgtacaacttatacatgatttggtaaattgaattgacattttagattatccccgtatagtccgaatagattggaatccacatgataagtatatttatatgatcatataatccatattgttattttttatcatgatttgtcataattctcgattgccatgcaaggcctcggatgtgactagctacttgttgatattgtaaatctaattcagtcgcgtatatttgtgaactgatatgggccaaatagagtgcaccctacctagtaagcatatttatgtgatgatattacccatatcattaaattgttttttcacgttttgttataattctcaaatgccatgtaaagcgcaaagatatgacatatttcttgttatattgtaaatctaatttaatggtacatattattataaccgataaagaatatatagtgatatatactccatactgtcatctttttttataattttcatgtccgtttggattacagaccaagaataaaaatatgacctaaaatttatattttacagattaaagtatagttaatatagatcataaattaagttaatggtaaataatataatttagtaaactttattttcaaacatattagagctaattttagttatttatgattataatgtgatatatgacactataacatatgttttcgtgttttttttgtctgtgagatataacgcaattggtcaaatcgatatgaactgatttaattctaaagaatataattgtggtcgaataaaaaaattctatatataatttaaaaaatacaatagtttatttattatttatatactacatttatctcaaataatatatggaaaaaaggagttaaggagagggaagaggggctccacattatctgcaattagtgagtgtggctggttagttacctatggtgaacttacccacctaggtttaagatctagacttgacatgggccttatatttatggctaattattcttgtagtaggcaacgttcctatcaatagcgaggcgtttatgatgacttcactaatttgaagatatatcattggctcagtctctcgaatatgttttctatggataagtgtacgcgtatgtatataaactcatgtgtttgtaatatgtttctcctaaaaaagcggcatgcattacccttccaaaatgattatctaaaaaatcaattaacaaatttctggtggcaaagcacacagcatcaagacgtcttgactaagtgctcaaaaataaactgacatcacccaaatacccgatgttaattagtgaatatattgtccaagaggcaagaactttgatatatcgctttgttgtagaagctagtagcaacagatcagaatacgaacaacatcaccaaggagtagtataaaattgtaggtaaaaaagcgaaattatatgcttaaaaaaatagagaagtggaaggctatgttaagagatc

SEQ ID NO: 21572 - DNA, 1501 bp, Oryza sativa
acctgacatcctaagaaaacatgacagattatcttactacattactacccaataacatcacctgtggtacatttttactctaatgcaaaataactaaattcgtcactactaaaaataacttcatgttgatttctactaatctacatttatttttacttagtggacactactttcaaataacttcatgttaatgtgtactagtactccatgtttatttctacttagtgctcactacttgcaaattaatacattgctactcacctaaaaatatatgtactaacctagtactaacttcaacatactactaatttaatatatgtactaacattcaacaatgattaacaaatcattagtgtcgtacttagggattataaatttatacctccagcgttgctgctctcttctgcatagtcatgggcatcgcatccccttccagccgcgcagatctctcccgcgacgatggcagcccgatgagacacttggtggtcctcgccccctcaactccaaaaatgacccttgtcgaagggtggagagggggatttaaagccgccagtcgaacacccattgtttgataggggcagtcgcagggacctgttgacagccacagttcaatattgtgcgctgggacctgttgacattgcacactgtcagatgtgggcccagtcgaacactcgtagttcgacaggtccagtccaactccttttgttcgattgcttccacctgttgaagactcgccgtttgataggcacctgtcgaatttcggcagttcgacatggccctattttgacaattatttttgggtggccatcatttttactattttccattaaatgaatattatttctgaaaacaattccacataaataataagctatagagtttgtgattttgctatagcttataacaggaagccggagtaacgagataagatccagggggactgggaaagtgcgcaaccaaaacatccaagaaaccaatcaaatctcgctggaagaaagcataaatactagacaaaaaaattccatttggacgaacatatatattccaagaagttggtggagactgactttttcttgggtagaatatttatacatgttgttgcttttactgaaatatgctgtaaaggggatactgaatagcactacagctagctaggtagctcaacactagtccagagaacataatcattatatcaaacaactcttgcgccatatgttcatgtttgattgaggagaaccatatgattgtgttaataaacaatttttttggcaagtacgtacggatgcaactccttgagtactcacaatcaaaatattatcagtatattttaaagtaaaacgaaggattagtggattaattgacaagagatgagaagtgccgattaatgaaggaaagctccccaatgtttctctctttcgggttgtttgaatataatcctgtttcgtttcttccatagattttttttttcggcgaagacatatttatttcttccatatgcttg

SEQ ID NO: 21573 - DNA, 1501 bp, Oryza sativa
aaatagaagtctgccattaaacagatagaataaagacatctataacatacaagaaaatttgttgattaaggtttataaactccaaatgtaagatatgctaatttctaaaaaaacacacacatggtacacataatagttccatatgaagcaacactattgttgtgaaacaatagtttctcgtaaattaaaaaccacatggtttaaataaatttgatttagaatttatataatgaaaaggtaattagaagaaaattaaaagcgacgttcacaacaatctcaaataaattattgataaaaaacatgttcagaatagagtaaaaaaatattttaagaaatactcatccacacataagtatttataattaaaattcaagcaacattaaataaggtgtcccgcgcatgtgcgcgggctacctttctcgtctagtgaataaccgacagctcctataagatttataatccaattccctttttcaaaaccaattgggactacctaaaaaaactgtcgtaagttttttgagaggaaaactttcaagagttatattgtaacttgcatataactatgttgtacctcctccgtttcatattacaagactttctagcattccttacattcatatatatgttaatgaatctaaacatatatatgtgtctagattcattaacatatatatgaatatggataatgttaagggttataatatgaaacgaaagaagcaactcatatgtaacttagagtatatctatgaaagacttacagctagcacagtggtacaactccggtctgcaaactgaagatcgtgggatcgaatcccagccacacgcttgctttgtttttcctcatccttgctcttgcacgaatctcggagcaagatctaatggttaaaaaacgcaagttttctctcctaaaaaccgtcgacaacaatgtagcaattccgaaccaattaagcacatataagaagatgtactttgcattgaaggagtaaaatctgaaacatgtgcttgattatgttgacatgttgaagaagtagatctatattagcaccttgcattggagatacatagggccaatcccacgtgaagaattttttttccacaactagtcaatgtattacaaatctagaaaatcagaaattgcgtcgacatcacacttagctgtgttggggtagcctgtatccaaagattttccttaaaattgattgtgctccaaaatggtttatccccctccagccctgcagcttgattagtccacaacttgtccagcacagcaataggccccaaaagtgtatagatgctcatgctctcgagtctcgatcacacacggacacagagtctccgccgcattttcttcttccccaacctccacactttcgtcctcccccctttctcctcccccttccccaacccacacccacacacacttccaagctagccgtctccaacaaccctccccccaccatcctccccatgtcctcctccctcccctctcccctcctcttcc

SEQ ID NO: 21574 - DNA, 1501 bp, Oryza sativa
attcctctatttcttaacctcctttcagtgacctccaatattttctcaggttcttcttcatatgttatgtccgtctgtaaagcaatgtcatccagaggtacttgttctgttggttttcttaagcatttcttgagctgtgagacatgaaaaacaggatgaattccggttaattctgctggtagttgcaactgatatgatacttcacctcttctttgcacaattctataaggtccaatatatcgaggtgctaattttcctttcatttgaaatctttgaactcctttaagtggcataacctttaaataaacaaaatctccaacttcaaaacttaagtctcttctttgattattgttgtaattcttttgtcgattctgtgttgttttgagtttttctcgaataatcctaacatgtgcttcagcatcatgtgcaatttgtggaccaatcaactgtccttctcctgttttagtccaattaagtggtgtcctacattttctaccatataaagcttcaaatggtgccatcccaagacttcaaatggtgccatcccaagacttgactgataactattattgtaagaaaattgggcgaatggcaaacaaatttcccaaactaggccataaaccaaaacacatactctcagcatgtcttcaagtatttgattaactctcagtctgtccccagtttgtggatgatatgctgagctgaatcccaactttgtacccatagcttcatgaaaactcctccaaaatcttgatgtaaattgggttcctctatcagagacaattctttttgtactccatgcaatataacaatccttgtgaggtacaactcagcaagcttgtttccatcatatgtttgcttaactggcaagaaatatgctaccttagttaatctgtcaactataacccatatagcatcataacctcctttagtctttggtagacctataataaaatccattccaatttcatcccattttcattcaggcaggggcaaaggttgcattaatcctactggtctttaatgatctgcttttaccttttgacatacttcacataaattgacatattctgcaatttctttcttcatattagaccaccaaaatattttcttcaaatcctgatacatttttgtactcccagggtggatagaaaataaagaatcatgtgcttcttctaatattttatccttgatttcctttttatctgaaacacatatacgcccttggaattttaaaactccattattttctgtaaatcctggggctttgttctaattttaggagaaatttggacactaccagggaggcagatctgaaggatttaagaaatctattgaataaacatgccctaggggagggcaaagatattttaatatggccatacaataacaaaaagatcttctcagctagatctatgtatagggtgattacttttggggtataagagatgttgaaaagatgaagatttggagaagtaaaattcctttaaaaatcaaagat

SEQ ID NO: 21575 - DNA, 1068 bp, Oryza sativa
gggtaaatgaacttctatattttgtttgatagaaaagagtttctggctcccctaataccctttttaggggtgcatctcggtgctgccaccattatcctcacgcgtcgccggttgtctgcctctatcctcgcgcgagcggatccattgctgccgtggatcaggaagccatggcctcgttgatggtgggcatcggcaacggcaccacctccacgcccatgtttgtgcttcaactactgctgtggtgtgcatatttccatcggttgtgacctgtttactaatctagctttttagctttttggtctttcctcatctctcttgactccaatcctcgtctttctgattttttttttgtttttgtgtgtgtactggacagaaggagcgagagtgtcacgatggtgcagagcatatcccagattggccgtatggcgagcaaatggatagatggtattgccctgcctaataattaataattagtacatctttgttcaccgcaaaatgcaaattttagtacatcttgaattatggggtggttcttattttttttggtatatgtaaacagaacctgaacatcagatttaatgagagattcaaccaagaagctgaatttttttgctactgatgtgcattgctaaaccagttttctgttgcataaagagtcctgaaacttcttgttgcaaactgaagtgatgttctaacaattttccattggagctttcactggtttttcagaactgaaatcttgttttctcatcagcttctcttgcatctttctgcagggtttctttcatgtagggaaaggaaatgtgatttcagttacctgactgctgccgcaatctgcgaagcatctacaagcgacgccatcggttcaggcagctggcacggcaatgccggttccccttgcctccatatccaactcctcttgtgccatttacagctcccaatggtatggattccaacttggcactgcaagaacacggctaccttttgagtttttttccctgatgttggttggtcacctagaaatgttggcctaagtgttatttgatatttctcacgaccattcaaaaa

SEQ ID NO: 21576 - DNA, 1501 bp, Oryza sativa
  unsure (1)..(1501): unsure at all n locations
ccatggtggtctcatcttttggggcggcgacgcggggataaaccctagcaaagcttctcacgggcctcaccgaaggagcaacagcatcttcatcaggtcaactagggctccgcccatgccgcacgatgagagatatgggaagagaggggatgggaatggaagagggtattgtggacttgtggtgctgacatgtggggttcatatgggtcccacactgactcacatgccacgtcaactaaatttgggagctatactgtcttcagacctaatgtgaccgttttgcaaatattcgggatgcattatatccagtattacaaaactcgacgacaaaatgagggacgtcaagtgaactttttccttttttttccatcttgtaaataatacacaaggcctaaggggttgtttggtttgtgtcctgagggccacgcctgagaaaaactcacgccggacaggcagcgttgggagatgtaacacttgcctcatcaggcaggctgaagctttgtgcgtttggttcgcgcatatgcctgaagaataataaaatatcaaaaagcaacttttaccagcgcaaagtatggaataaatgacacattagaaaccattaagagcggcggaaggggcgtccgctcggctatgccacgtaggataggaacagtgcgcgcggtggtgatttttcgaaaaagccctccaatttgtttgtaattcgaaatagctccctccaaacagtacctgtgagatgttattttaggtcgagacccttataaaagtcggatatacattaaaacgagggaaaaatcgcgagtaaggacagcgatgtaaaacttaaaagacgaggggcttttccgcaaagcgacgcgcactaactctaactgccccaaaccctagccgccgccgccctcttctctctcgtctctcctcaggcccgtttagttccccaaaattttttcccaaaaatatcacatcaaatctttagacacatgcatgaagcattagatgtagataaataaaaaactaattacacaattagggaggaaattacgagacgaatcttttgagcctaattanctaatgatgggttaattaggctcaaaagattcgtctcgcgtttctagccgagttatgaaattagttttttcattcgtgtccgaaaaccctttccgacattcggtcaagcgtccgatgtaacacccaaaaattttcatttcctcaactaaacacaccctcatcctctcccttcccctctcccgccgtcgccgccacgcgccgccgcctcctgcccctcgcgccccccggccgcgcccacctctaccgccgcggccgcgtccacctcccccaaaaaaccctagccgccgccacctctcatcccaccctctccctctcccgctgcgtctgcctccccctcgcgccgccgtcgtcgcctccgccttcccctcgcgcccccgcctccgccttgcaacgtagccatcgtcgtccccgtcggctcgcgctgccgcctccacctccc

SEQ ID NO: 21577 - DNA, 178 bp, Oryza sativa
attatttctccaacaaaatgtgaaaatacactccgcggtgcattcaagcacctcttgtaagctgaaatccttgtttttcatgagaatcctttgtcctttggctgtctattcgatgattcactcccattggccctgaaaccttttccatttacatccttgctgaattgataacataaca

SEQ ID NO: 21578 - DNA, 1501 bp, Oryza sativa
  unsure (1)..(1501): unsure at all n locations
gccgctagtcgggggcgctcgatgatgccgacggcagtggcggagacggggatggctgcgctcggcggcggcgcgaggcgggaggcggaggcgctcggagacgacaacgcgacgacggcggcggcagcggcgggggaggtggaggcggcagcgcgagccgacggggacgacgatggctacgttgcaaggcggaggcgggggcgcgaggggaaggcggaggcgacgacggcggcgcgagggggaggcagacgcagcgggagagggagagggtgggatgagaggtggcggcggctagggttttttgggggaggtggacgcggccgcggcggtagaggtgggcgcggccggggggcgcgaggggcaggaggcggcggcgcgtggcggcgacggcgggagaggggaagggagaggatgagggtgtgtttagttgaggaaatgaaaatttttgggtgttacatcggacgcttgaccgaatgtcggaaagggttttcggacacgaatgaaaaaactaatttcataactcggctagaaacgcgagacgaatcttttgagcctaattaacccatcattagntaattaggctcaaaagattcgtctcgtaatttcctccctaattgtgtaattagttttttatttatctacatctaatgcttcatgcatgtgtctaaagatttgatgtgatatttttgggaaaaaattttggggaactaaacgggcctgaggagagacgagagagaagagggcggcggcggctagggtttggggcagttagagttagtgcgcgtcgctttgcggaaaagcccctcgtcttttaagttttacatcgctgtccttactcgcgatttttccctcgttttaatgtatatccgacttttataagggtctcgacctaaaataacatctcacaggtactgtttggagggagctatttcgaattacaaacaaattggagggctttttcgaaaaatcaccaccgcgcgcactgttcctatcctacgtggcatagccgagcggacgccccttccgccgctcttaatggtttctaatgtgtcatttattccatactttgcgctggtaaaagttgctttttgatattttattattcttcaggcatatgcgcgaaccaaacgcacaaagcttcagcctgcctgatgaggcaagtgttacatctcccaacgctgcctgtccggcgtgagtttttctcaggcgtggccctcaggacacaaaccaaacaaccccttaggccttgtgtattatttacaagatggaaaaaaaaggaaaaagttcacttgacgtccctcattttgtcgtcgagttttgtaatactggatataatgcatcccgaatatttgcaaaacggtcacattaggtctgaagacagtatagctcccaaatttagttgacgtggcatgtgagtcagtgtgggacccatatgaaccccacatgtcagcaccacaagtccacaataccctcttccattcccatcccctctcttcccata

SEQ ID NO: 21579 - DNA, 165 bp, Oryza sativa
ataaaccatgtggaaccacaaccagagataaatagcacttcccgtgctacaagccttccaaatatgttgagtcaggttggtcttctgctttcatgtttagttttaattaaaatctgtacgcacaaatgtttttttaatccatgttggatatttttgtactacagt

SEQ ID NO: 21580 - DNA, 363 bp, Oryza sativa
agtgttgaaattattattttttatgtcttgtgatactaaatagatgcattaaaactgtttcttattacattaagtttatcgctatgtttggttgaaccttagctaaatatgaactattgtaggctgccacaacaccatcgtcacaagcttctcctcatcattctaccactgtatcagctcctttacaacccactggctttctgcggtctagaagttctgctccttcaggtcactttctagcttacatgttaagctcaacactaatcagaacttgctgataatttaaccatagtcattatcattctttgtgctcgaatttatggccttacattattttttatgacccgtccattgttttctagg

SEQ ID NO: 21581 - DNA, 856 bp, Oryza sativa
ctcactgctaaaaaattgaactcatctttactgactaacatttgctaacaaagctaatctttttgactggaatttgattacagaactagcctatgttgactgaaatgtactgtcagaactaattattctgggtgctaacaaaactattctgatatgttggtgcctaacattgttagaggcacacaaaactaagcattgattatctgacatttgcacatactttcagtgaattaaaatgacctaaacagaactctgaaataattatagtgaaaaccctcctgaaatttcttcaggccaagaacaaaaatagtgaattgtggatactatgatagaaatcaaattgttggtgataaaacctaaaatcataaagtagtcatcaaggggcctccccttgctctaactccagtactccacaaaatccatgtattgttaatgcatatattcaagcaggtcttgttgataaaaaaatctcgagaatatcagacaaaaaacaaatatgcccccattgccagtacatgaaaatgcactaatcctcccccaactctgttgccaaccctcgggcccacatgtcagtgagcagatgatctggattgtacttgtacacatacaaatcaggaaagcacaaaaaagataatagaatcactaacctaataaaagatcaaatacatcctccccaaatgtatatagcttcagaaactgcattatacatcctcccctaatgacataaaactttagatcgaacttaatcaaccaaagtcaacgcacagcatgacacagatgacaaggatctactagcttagaaaatggaaataaactattgctcaccatctgggccgtaaacatcacattgcctaat

SEQ ID NO: 21582 - DNA, 1501 bp, Oryza sativa
atgcaaaaggctatgctggtcgagacctgccccaaagctaaaagcttcgtatatgggccgtgactacaatagctgccactttgtgggctggagccccagacgccgatggacgcaactcctcttctttcctctgcgaccgtgacagcacatgcgtcgatcgaaaagctactctcatccttcaccagaaaattcctcctgcaaaatatgcacatcaacgttggtgtacttccacggcaaccagacttggaaggctgcgatagtgcaatcgcaaactctgatgctgcaaagcctccatctccaattctccatggctcttccagcttggtggactggtggcctctgcctgccaaaggcatcttgttcttaaaccaaaccgtactcatcaacaatacctgctctctcccatgtcagattttaacgaatcctgcaccaacacactgtaccagacatcatctcgttgacagaataaacaaagcagaagtcatccatctcccctcctcacgagccagagccaagccatgacgtagagacactgcaaattgcattgttcttgcaaactcctgcaagcttactgactctgcaacacattgcgtgctcacaatcaacaccttcatgcgtaattgcacagaccaaaaaaactcaagtactacaattagaagattattattcaaggtgatggagattattaagaagggaagcaagcaagcagaccaatcaaaatgacatggagaaaccgttggtacggctctagtgcgcgcgggtcgcgatcggatggacgcccgcgtgatatggatgaaagatattgcgtccgtgtctcaccaccacctcgcacttgacgcgaagaaatcggcatcgaccagacgatgacacggcagtgttgcgacaacatacgatcctgtcatgttagccatattggatggatgggtgaagcaccctatcagaaacaagatatgttattcctttttttttctgaaacgtttatatcatatactatcatccatgtcaaactcaacttggttaattatactatactagagagctacgcaacttagcaatccagagttaattgattctaattcggttttgcagagttttcagtagtttcagtccataggatgatgatgattccatggaaaaatgatgtctatgagggaaaaatacataccgtacaacagtagtagctagaagaacgaaaagaaaaataaaccatgcgttggtgttcaacgcgatggcgcaactcgaaggtacctttcaggctaggctagtgcagcttctctttcttggtctgtccacaaacgtaagcctcccaggtccaagcagagaaacgggtccaatcgctttcttggttttggcttggaaagcaccatttgacaaggccatccataatccaatcccctcttgtgcacagcaccgtgatcaattcgacaaattgacccccaattttttctgaacaccaacacgcgttgaacctgatactctccctgcgattcctgccatcttc

SEQ ID NO: 21583 - DNA, 1501 bp, Oryza sativa
aggattaggttcatttagcctataatgcattagatatctatgaaactccagcatcgtgagatattttctaccagtcccatcataattactatattcgatgcctagatggaaaccagattcaccatagggaaatagcaaaggatattgcaaagataggtatgatggatgcaaggaagaaacttgacgcattccgtggtctctatcgtgcacgagcagatcaaatttgtattctttcgcatcaaagtcaccaactattatggtagttatttcagtacttgttggaaggttatactggacatcatctctagcattacagcctaataagcgaagagttattttctcatcaccatgctgagaaagaaggtctctaacgtatctgaaattttgaacaagtctattgttgctatcaagcatgcgtgataaggcagcaatgatttcagggtctggcctatcgttgtcatcacggtcacggtcaaaaatattgagtcgattttgggtttcattctcaggatcatagatataaagctgtgcaaacttagggcgtgcaccatgcgatggtagaagagtaccaattctgtggtgcacaacaccgttaattttgaaaacataaggcgcatttccagtattgatcgatttatcaatagtcgctcccattgaagtgaaagcaaacattgaattgtatgatcgaatctgcctcagaaatcttttggatcgtgcatcgccatcaaatttcaatagggtagcgagaggttcaggtggtggcctgaaagcatgcagctgtattttgccacccttacaacataggttgtaaactttcttcctctttgacacagcagatagagtcttaattctctcctgaaaccagaagactgcaccacagtaggggcactcatgtgttggagggccatagtacgaccgtcctgggtatgatgctgcacaatacatatctgagaatgtatttcttttaaccggccaatataaattgttttattttttttatcagaaaacacggacctttcaatgattggatgtattccttatctgtccttgatgaactaccggaggctctgctgtttaaagctgcaattaacgaacattgcaatcatattttagtgccgtagcttctcatatatagggtaatgaacgctgttaggtgtgctttcagtacagtattaccattctgtggtgcaaggagaggaggcatctttgaacgcagcaaagaccggtgctgtctatgtagcttggatagctctggagtaaagtccatcaacgaacgtggctttttggctcgatgaatctggggaggttgggctggcaacggtatggcgctttctatgcgcatcgcagatgagcgcaacaaaatgttcgcggctcgtttctctcgactcgcgcgaactctctgaaccctgtccatacggtggtctggtatttgccgagactgatggagcaatatacgcagactaataggaataaataaagagtttcatggcatccctaaaac

SEQ ID NO: 21584 - DNA, 1501 bp, Oryza sativa
aaaatccaatttccgattacacggcttgattaacacgcacggcgagaactcttacatgaccagatcttacatggtctttcgtctctgaaggatccgacaaagccttatccgctttgggcgtccacagccgaagttcccttaagttcctcagaggctttgtcaagacagcgtgggacgttaggataggtttcaacgctaggtgtcttttatggtaagggatctctgggtaaaacactaggcgatactgtgcacctgatatcaactttgttggagtagaggtaatgggagaatcgctacaccactggtcgagaaccaggtagtagtcgtaactcgaccacttaaagtggagatagtgggagaatcgctacaccgctggtcgaggaccaggtagtagtcgtaactcgaccacttgaagtggaaatagtgggagaatcgctacaccgctggtcgaggaccaggtaatagtcgtaactcgaccacttgaagtggaaatagtgggagaatcgctacaccgctggtcgagaaccaggtgtagtctaaactcgaccactagaagtaaaggtagtgggagaatcgctacaccgctggtcgagaaccagatgtagtctaaactcgaccactagaagaggaaatagtgggagaatcgctacaccgctggtcgagaaccaggtagtagtcgtaactcgaccacttaaagtgaagatagtgggagaatcgcaacaccgctggtcgagaactaggtagtagtcgtaactcgaccacttaaagtgaagatagtgggagaatcgctacaccgctggttgagaaccaggtgtagtctaaactcgaccactagaagtaaaggtagtgggagaatcgctacacctctgatcggggaccaggtagtagtcgtaactcaaccactagaagcaaatgtacgagagttcgctatgattgactggttgagaaccagtgagtaggtgtctctcgatcatttgaagtcgtggtgcgaggaccgctgcgttattgttgtagtcgtaccttgaccatccgaagttaaggtgcgagagattgctacgttttactagttcgagaaccagcgagcgagtagaattatctctcgaacaccaatggatgttgcggtgcgagagattgctacgtgctggttggagaaccagcgagcgagtagagttatctctcggacaccgatggaagttggcggtgcgagagattgctacgtacttgttcgagaaccagcgagcgtgtagaattatctcttgaacaccgatggaagttggtggtgcgagagattgctacgtgctggttggagaaccagcgagcgagtagagttatctctcggacaccaatggaagtttgcggtgcgagagattgctacgtgctggttcgagaaccagcgagcgtgtagaattatctctcgaacaccgatggaagttggcggtacgagagattgctacgtgctggttcgagaaccagcgagcaagtagagttatctctcggacac

SEQ ID NO: 21585 - DNA, 1501 bp, Oryza sativa
gatcgtttatccgttgctgttttctcttttcttttgtaagtatgtaacgttactattatgatgaatctgtatattaaattgtcagtttgtgtacctcggctgatttctggacgaggattttatgcataaataagttaaaaattactagtgaatttctaggtgtgacaaacagcaagcagcagagcagtggagggatggatggagcagtgaagcaacggaggggatggagcggcatggctggggcctggggatggggatagaggggatgtggaagaagatggcagcacggtagacgggaaggtcgccgaccggcgtcaatggcgatggggatcgatgatgacatccacgaaaatatttctttttctttttcttttttgtcctaacctgttagcatgtacgtgtataaaggtgattaatgaaagagtaatcatgtgattaatttagccagtttttccccacatttagacgtgtaaaacgattttataaaatttagtcaattgaacattttttttttgaaatagatcaaattttcattgacccggctttggaagaaagcccaaacagtatacagagtcttatacaaacacagaaaacaaagctacgaaacaaaagacttaaaaaaaaagtcggcacataacactggttctctcagaagcattccataccttgataacacctcacattcccccaggcactaacccctggtacaaaagacagcaaaaaactgaagccaaaagtagactcaaattgtcacaggaagacgacatggcttcaattgttgcagtttggccatcagcagctcacaccatcctttcatagtagcttgatctccttcctttagcatgatacaccactgctgaataaaagacaaagctttataagtgatttgcaaaggagactttgccaaaatatttgagaaaacccagtcattcctaattagccaaagtgcccagcacacactagcaaagagcatcacccacaccccctggacattttttcttttcattaaccccaaacaatctcttatattcataggactaatggttagacccaaaacatctctcaccacacaccagtaaagacaacaagaagacatttaaacaagatatggttagtagattcaatcttgccacacagtttacagaattcatcccctccctgccattttctcttaatcaactgggatgcacaaggaagcctgcctctgtctgccatataaagaaaatctttgatttttaaaggaattttacttctccaaatcttcatcttttcaacatctcttataccccaaaagtaatcaccctatacatagatctagctgagaagatctttttgttattgtatggccatattaaaatatctttgccctcccctagggcatgtttattcaatagatttcttaaatccttcagatctgcctccctggtagtgtccaaatttctcctaaaattagaacaaagccccaggatttacagaaaataatggagttttaaaattccaa

SEQ ID NO: 21586 - DNA, 1501 bp, Oryza sativa
tatgcttacatggcatggccattgtctgtttaggttattaggtttttcctccgtccttgtgatttggcttgtctgtttatgatattgtggatgatggccgatcatatgtggcttagatctgatactattttgcagcttattgtgtagattaataccatgtatctgctttatcaattgtttggtctgtatatgactcctgattgtgtttctttacatcctgcagggctaattgtcatattctgttgttgtctctgggcctacactggatcgcagtcttcttttccactgttccgtgcaaggtaactatctccttgctataattggatttttgttcctgtatatgaatatatgaatttatgtgcttcctttttagctcgtgcatggattgtgtgtgtaagtgcttgttttgtatgcctggcaatctgtgctaatgatctgtgatagaatgtgcttagactttatgcatatgtgttgtctctgttggggcatgtaacaaaaatgacagtcagcgcatcatcttttggtagcaatcgcacacgttagcttgcacatggctatctttctgctctctttcctcatatttcaaacattgctgcctgtaacgaatttcttttccctgttctctctaggctttatagggctaaggtagttttctgctctcttcttctccatctcatcttttctgtcttccctgtgctattccttctgcctctgttgcacactttacttccagattatctctttgcagtgttttagggatgccatgaaactctttatttattcctattagtctgcgtatattgctccatcagtctcggcaaataccagaccaccgtatggacagggttcagagagttcgcgcgagtcgagagaaacgagccgcgaacattttgttgcgctcatctgcgatgcgcatagaaagcgccataccgttgccagcccaacctccccagattcatcgagccaaaaagccacgttcgttgatggactttactccagagctatccaagctacatagacagcaccggtctttgctgcgttcaaagatgcctcctctccttgcaccacagaatggtaatactgtactgaaagcacacctaacagcgttcattaccctatatatgagaagctacggcactaaaatatgattgcaatgttcgttaattgcagctttaaacagcagagcctccggtagttcatcaaggacagataaggaatacatccaatcattgaaaggtccgtgttttctgataaaaaaaataaaacaatttatattggccggttaaaagaaatacattctcagatatgtattgtgcagcatcatacccaggacggtcgtactatggccctccaacacatgagtgcccctactgtggtgcagtcttctggtttcaggagagaattaagactctatctgctgtgtcaaagaggaagaaagtttacaacctatgttgtaagggtggcaaaatacagctgcatgctttcaggccaccacctgaac

SEQ ID NO: 21587 - DNA, 1501 bp, Oryza sativa
cacattgatgtttcacaaatatacgaaaacatattgattcggttaagcacatgtgcattgggatagtttttgtaaccaaaccgagtatgtggattgacatttataacaaaacaacttaaagagtggaatatcaactttcaagcgacttatggaatgtttttttttttgcattttttctactaaattttcacattaaacccacttagcccatgtttttatttcgatattagtttcgtttggattccttttactctactacttcgtcccaaaaaaaatccaatcataataatgaatatggacacacatgtgtctagattcattgctagagtttatctttgtcggtgatatgggaccgggagtatcgtgaccagaggcttgaggcagacacaatcgcccacgtggcccggcaccctcggggacgtcgggcccgagggtgaggtgtccgccctcctcttgatttccccgaggggggtcgggttactcctgccccggccccgacggccgaggcaccccgacgcctaatgaagtttgcgccacatatatgggttaggtgaacacggcagggctcacctaaccgcatttattgcggactggacaggcacgtcacgctgcatgcagcgcagtgcagcacgttcctttatccggtctgtgaccagtcacagaccggtcagatcaacggttaggtggcgactggcggtctgacgcacgcctcgccccgtcccgtcaagacgagagcctctaggcacacgtctccagccggagctagcgtgttacttcttagagatggcacgttagccctggtcagatgaataccaggcttcatcccaaccattacaggcaagatgttacacgaagaagggcgaaatacatgttgcaaagctgacgcgtggtggacaagaatgaccgatttgtgaccggtctgacactgctcatatcgtcagcagacagcctcgttctcacaacgagcctgcctccggcagaagtggaggtaggtatgtgccgtcccgtcagaaggacgttcggagggcaaccatgcaaatctccgcttcatttatgaagagaagaaaagtccagtttggaaagggaggggtgcatgtggtatccccttgagatataaaaggaggaccttgcccatttagagtgggggggctggagattgacgaacaaagaagaagggagagtttggctcacactttgtaactccttcattcatagatccaccaaaacacaggagtagggtattacgcttcccagcggcccgaacctgtatacgtcgcctgtgtctcttgctctttggataggccgcgatctttccacatacagagagagcctgagatctcaccctgagcccccggccgaaccggcaaaggggggcctgcgcggtctcccggtgaggggccacgagctccgtcatctggcgcgccagatagggggactcagcgtgagtcttctgagctctcgcactcttccgagtgtgccaagcttttcttgttcagcctaa

SEQ ID NO: 21588 - DNA, 1501 bp, Oryza sativa
agcaaagtaaaattaacgcaaagaatttttcatcatttttgattgcagattaagttgatctatacaaaaaagaggcctgaagggcttagaagaaagaaaaagaaaaactggagatcggagggggcctgggggctcaatccgatgcgcccgggtcgccggcctcgtcgtcagcatcgtccgcgccactggcgtcgccctcctcgtcggagttgggggcaaacgcgagccgaggggccgagccctcgaagctgttgacgatatgttcggcggcatcccgaacccgcgcgcgcgcgtcgtcttcggtcccggcagggaactcatccagcgccatccatggggagaagttggggtccctggcctggtaactcgctaatacgagttccactgctccttgggcgaggtccctcgaggatgacttgatggtcttctcgagctcctcggggagttgttggagagcccaggccatcttcgtgaggtgcggagcgaggccttccagattggtggagtgcgttgtcgtctagcctttccagaggcccacctgccgtccggcgcgatccagacgggagactgcgtcccaaagcgtgccgggccctatctcgcccgccaggcgaagggcctcggcttccccggcggatgagtctagcgcgcgctgcatgtcggcgacggtgtgttcggcagctgcgaggcgggcggctaagtcgctttcgcccgtagccgccccgccgctgcgcgccctcgcgtccagctccttttcccgcgcctcgaggttagcagcccgctgctctagcgcggctctctcggcgcggacgcattccagattgcggcgcgcctactcctcctgcgctgcctcgcggagggacaggctgtccgccagccgttgtgccgcggcctcggactccccgagagctcgctcccgctcagcgagcgcgtcctcgcggaggcggagcgcggactcctcttcggcgcaggcggcctcgtgcgccgccagcgtcgcctcccggatagcggcggcggcctcgcggtccgccaagcccctctccacggcgccggcgtgttcttccagcgccatggcacgggcctcaagggcctcctcgcgccgccgggacgccgcttcagtctccgttgctcgctgctctcgggcagcggcggcgtcaaggatcccctggtgtcgaaacatgaattcggcaataataaaagggggtagcgcacgagacctaaaagtggatggatgcagagacaaatgatttagacaggttcaggccctctcaatgagaggtaataccctactcctgtttggggatttgaatccgccgagtatgtattgatctgacgatcaggttgtctcatgcccctagagggggctccctgccctccttatataggttggggggcagggttacaagatagaagccttaaccaatacggtatcggtttcctaaatctactttacaatattatcaaaccaggactttaggccgttccgtaatatacaaggaaacgt

SEQ ID NO: 21589 - DNA, 1501 bp, Oryza sativa
ggtcattactatttttaacaaattcttttacaatattttcgcaagtgtggatttatctttaaattatttcaaaataatgaatcacaatctatatttttaaatttttcaacacaacaaaaaaataccattttttcttttttttaacattagcaaatcattacttttttaaaaaacttttatttccattttttaaataccattttttcattttttaacattagtaaatcattacttttttttaaacattttatttccatttttaatttttttttcttatacatttactttgcttttttttttaaaaaaaaacactgtgcactgcaggctggtggcctgccttcacgggccgccgtgccccgaacggcccgtgggccgcgggcgtgccgtgccggcacgggcacggcccggccatccacgggccgtgcttgggccggcggctcggcacgtgggccggcacggcacggcccgtttcatcagccgtgcctaacgggccgtgcctaaacgggccgtgccggacccgtgcccgtgccgggccgggccgtgccgcccgtttggacacctatactctccccccatcgtacgcaacgaaacccgattgccgcgccgctccccgtggagcccaagtggcggcgagggtttccgccgcctctcgtccgcctcgccgacctcggaccccggcctccatcctcctcgccgacgagagcccaagtgtgccgctccccgtggagcccaagtggcggcgagggtttccgccgcctctgctccgctcgccggcgacagccccacgttctcgaccgccgtccccaggtccgcttccggaatctcatcctttgcgggctgatactgcttcgcgcgtcaagccatcaccagctgctccctccgtctccggaacaacaatattctctccgactgctcacgacgggagagcggcgcttcggcgacggcgatcccggtacgcacacgcttgagaggctcccactttcttcattctgctactgtacggttggattcgtgcataacaatcactcaaatctctatgtctaacctgcccatgattatttattaagttcgagttggttgaagaatccactttgttttgggggaacttttacatgatagagaaatgaatggtcttccgttgtgaaacaccatgcttgattttacaggatggtgctgtgttgtctcgtttctaggtttatagactgtcatttgctatagaacctcatggtttatagttaaactgcacattagatctgtcaagagcagcagacaacagtagtagacgttttatttattaaatgatgaactgttggtctcaactctcaagcagtattttgattatctttaattctaagtgccaatagcagcaatagtaatggacgtttctaaatgtaattataaggtttgtgtgcatatttactttgatacaaggatgcataccgtgcatgcatctcaattatctatgccactaatctaatatatattttggagatgaaggaac

SEQ ID NO: 21590 - DNA, 1501 bp, Oryza sativa
ggaggatggcgaggcggcgcagctccggagcccttcctcccgccggatctagcggtgggagggcgcctctgggcggccaccgctcctcccgccgctgccgcagaggggcggacgcggccatcacctccgataccgcctcccgctgctgctgggcctcaccgtctccacctgccgccgccacccgtcgcccgctgcctcccctcttgcgccgccgcctgccgcctcggctccgagaaagaggagagcgagagagaagaccgaaaggaagagggcgccgtcagccgggtggagggcgccgtgcgaagggggaggggaagcggcgcactggtgaggggagaggggagggcgtcgctggttgcgatggcagtagagagaaccccgagaaagaggaaaatgaagggaggagagagaggataagggaagtcgggaaaaacgagaagatgaggagacggaaggatcgaggcgccgcttgctccgctcgctctccgcttgctctctcggggataaggattagatctgacgggccttttttttaaaaaaaaatgagcactctgtatttgaataaaaaaacagcacaagtataccatataaccggcacatatagagatttatagggttggttttaatttttgtttggttttaagtctaatgggcctttcttttacaacttttttttatgtaaggaatatatttttttaaagggctcataacataaaaactaaatcctaacgatctaatatttttatatttattataattttagtttacccgttgcaacacacgtaacacgagcatctatttattaaaaatgtttaaataataaaattttcttgacctgtccttgttcgctctttttttttatttttttattttttcccctcaccgtctaatcttctttcattttttttaatgtctacttattaatatttgacctcaaatacaatttgtaaataaaaaacaatactcactctcacaaaattaataagattgatttttacgatttgttgaagtccacatatttttctcaggtaacaatacacatgtatattcccacaattgcaaagtgggtatagtttaaccggataagtttcttgtggtggaaccagtcaatcttgatttaaatctttgatttgacatgggtgcttgagacgttcgtggtaaataatttttttagcagattagttgtctaaaccaaacaacactttttgtcactgtacacactccgtgatcacccggtgcaacgcacgggcacttttgctagtaaaaaaaaaaatcaaaaaaacgcgtcgtccgctgctctcgtcctctcctcgccagtagccacgccgcctccaccccacgaaagcccgagaagacgccgccgcctcctcctctgtcgaaacatgaattcggcaataataaaatggggtagcgcacgagacctaaaagtggatggatgtggagacaaaggatttagacaggttcaggccctctcaatgagaggtaataccctactcctgtt

SEQ ID NO: 21591 - DNA, 1501 bp, Oryza sativa
aattttgactatgacagaaggacaagctatatgctcaggggctcatcaactcaagcgtgaggattatatctccaatttggacttgttccggatacattccacatggattcatagtcatgagtctattttctatgctcaaagactggaccaattattattccccgtaagggctatcaaccgaatacttgcgccagtcgggattcaattgttacacctattttggagtatcccataagggataatcattcagatcagaagctattcatatgagctacacttggtctatattacccggaagatttattactcggaagcatgttacatgcgtcatcctttaaagggtgtcgaaggcatattttttggcctaggcctaatatgtctgcagcccatattttcaggtgtggcctgtcacgttcttttagggacttaggcacttttcgcttaggccaaagtgcgcgtgatcaagtgcccaataccttaaaatccttttataccgcagttattcgactttttaggagttggtacaatgcatcttaaaaggtgtcaaacagtaaagctttatatagctggcccgctgacttttttatatagtcatggtgctgtttgggtttttaagcaattgattggatacaatatcattgctttttgccacgtaagtgtgcatttttattgaccaatattatggcttaggctgattatatattgtggtcatttttcaggcggttggtaaatcctttatgagtttatttactcggattttataccacatatgccatatatttccaggtgtggtggaaccatgtgtcttctagggacttaagcacatctgttaaagcagtgtgcgcatggcgtatgctcaatactttggaaatttctttattcacaacatacaagcttctttatagctgttttgctatgtgaattttcaatgatgtagccaactttaggttacactcatcatattttacaaagcagtcggtatatcacttggatcatattattcagggattcacaccgcatatgctacatattaatattaagtcgcttggttgactacaattatcgaaaccactcggtgcatctagtcgatgcacctgactttattttttcagccctccacagtcttctgttttggaaaaagcactcgggagatcatggcgaagatgattgaagcactcggctttggagtaatctagttcgaaagaagattatctttccgactgtaaaggtctcaggggctactgtggagattatgggtaccccatacccacacggcatggttatccgactagttataggggataacttatatatataaaatatgtaacagatcatgacttgggtattacgtttccctgtatattatgaaacggcctaaagtcctggtttgataagattgtaaagtagatttaggaaaccgataccgtattggttaaggtttctatcttgtaatcctgccccccgtcctatataaggagggcagggagcccctctaggggca

SEQ ID NO: 21592 - DNA, 1501 bp, Oryza sativa
acagggccggtgtcctgctgctaggggctcagtcctgcctacctgtcccggagattctggccgtaggtgggattgggtcggtactcttgtctatggctaggatgggttggaaactatgtcacgtcttccgtctgtataccgtggtggtatgtggcacgtggttgcacgtgaggaagatgtgtcttgtgggtaaagatgtacacctctgatcagagtataacctattcgaatagccgcaccctcggttatgggcaagccgagcaatgtacccaagttagtgttttaattcttaaaacctgcttaacaactaaaatgtggaatggttggcctgggttggcttgggacgagctgggacccagggtcgggttgccagttcggtctgaatcatcgtaggccttgggttaaggcaggttcgtgtgggttcacggccttgataaataataatgtatagttctagaatcgtgtctacaaaatagctttgagcaactaaatatctttaaatgccgtttactgcaaccctaaccctttatattctaattcccttgtactcccttgcatttattctgcacttgtgggtgtgtcttgttgagtacggtggttgtactcagtcttgctcaatttttcccaaacccagaagaggagcctctggaagatgaaggctttagtgtctagctcgtgcctaccgtcaagcgcctgtggtcgtcgccctagtcttccgctgtttcccgtttgtctttgtgtgtgctgggccttcgtcgcccatgtaataaattaactatttacgcttccgcttgatatactctgaaatgtatcaactcttggtgtaccttgcctcctgggacaaggaataatacacgcacgtaaggaacgcccgttgggttaattccggtcgtgacagtgcttgcctcctgtctgaacgcagagtgcacgatttccgaggcgcaactgggtggttacaagggaacatggtataacaattaacgaaggaaggatcaaatgcaacaaattaggtaggctgccattctgccttgcagacgggacaagcagattaagtgcgatcctatcaatgcataatatttttcaagcaacataattaagttcaaatataggctcgagatgttcaaaggtggcttgccttgctcgagatcttgagcttgatcctcgaaatcctcgcactgcgggtcttcgggctccgaaactatacgcaaaacaggacaactcaataaacggcgaaaataaagctctattaattacctctaagcgtgccattagatagatctcgagattaggaattttggaagttgaacggagtcaaacggacctacggttgggaagatattgaatttctaagattattggatttttggtctaaaggaaaaggatttatttaaatcctttttgaaaaagaaaagaaaagaaaagaaggagggggaaaaattagacttccctcgggcggctagggcgcggcccgagagaaaagggacggctctgccgagctaaa

SEQ ID NO: 21593 - DNA, 1501 bp, Oryza sativa
tgttgttgttgttgttgttgttgtgcgtgtgcgtgttgaggtgactgaccagcctcgctcgcggtcgacctggtcgaactcgatgccgcggtcgacgatgcggtgcttgctgcgggcggtctggtagcgggagaggctgatccagatctggttgtggatcatccgcagcagcagcgacggcaggatgagggagaaggcgatgtcgaggtcgccccacccgttgcgcatcacccggcgcgcgccgtgcgccaccacgggggccatcaccacgtactgcgcatgccaccccatgccatgcatgtcaaacaaagctactagccgagaatataatcatcttttttaggaaactgcatgcatgtactgggatgtgcaattttaaggtttggatttggctggccattcactgtatgcaaacaactgcatctgttgaagttcatcaagaggaacgaacgggggagcaaggaaaaaggatgaacatgttttcttcgctcagaaatcagaaggtgagaatttgggcgtgtaccttgaagttccccagcctatgccacggccattcggtcaaagggcccggcctggtcgccatggctacgctgccgtcgctgtggtcactctgcctcacctcacctcacctcacgtcctcacctccccctctttcacgcaataataccgtggctagccaagcaccaacccaacctagcactacccactgcttcgccttttatacccgtgttgagggaggccgtgagagaggcgtgaagcgcatatggagacgcacacgcctctctttcctgtgcctctctcatggtgtgggtgtctgtgtctttgagtagtcgtcattcaatcgagacggtcagaatcagcacaagccacaaggtcatcgtctgtggccactgtcactactgcagccaaggacaggggctccaatcaggcaggcatgcatgcatgcatgcagagggcgcattgatgcgtcaaaaaaagagagagagaaacaggtacagtacggggatgactcagcaccttaatgcggtatactgcggcgcggttacgccataacgcgggcgcggcggcctccgtgtttcactcttgcgttgcggcgcgcgcatgaggcaacaaggcaggcaaaggcgcgagagctagcggttgcaacaactgaaaaagtttcttccggtcggtcacgcaggacgcgcttgccgacgcccggtgcctgcctcgtcccgggtatgtatacaaactatacacggcgacgtgttaggagtagggatgtaagtggagcgggtaagcgggtttttttagcccgcttatctcacttctagtttattttttcttctaaattttatactaccacgtgaaaaataaactagcaaacgggtttttatacggatagcgggactacccacttgcattcctaatagggagtcgggaccgagcacgcaacagcttgcgatggagtcaccgccccgtcctcatttctcccccccctcctcatacctagacagagagc

SEQ ID NO: 21594 - DNA, 866 bp, Oryza sativa
caatcaatcaatccagccctgccctcctttcggtttcgggatcccctttccccgctttccctgatgcgagaccgaattcctcctccccatccggatccggctggtcaccgttgtgcgtgcgtctagtcggagatcagcacggcgaaaaaaaaaacccgtgtgatttttaatcgagaatttcgacgacgccatgcgtgcaccgtgcagcgtgctgcgccgccgcctgtgccgtgcggaaacggccgtgcaagctcctgcaggccaaacaggccgcggcccgtcacaggcgacaagtcaggcctgccactgcgataccgacaccaaagtatatatgtgctcccgtaacacgtcgttttgttttttttttgtcaaagtttaactgctaatttccatttttatactactccaagtaacattatttttgtgtaataaggaatgtttagtgcttgttgggtggcgcaagattattcacaccgcacgccaggcagggcgcaatcgtgtcaggaaaggccacggaacattatttttcggcccaaccgatggcggcggcgggcacctcctcctcctcctcatcatcagatcacctctcgagcacggcgcaccacctcatcggccccgtactcccccgtcccgttccttcgttccgattcggtccttcgcctccaaggctccaagccacccgcgacctcgagcttcccttctctctctctctctctctctttctctctcgcggcctcgcgtccgcctgcctcctcgcgacaccgcccgttccgttcgagggggggcgaagccgggtgggagggggaagaggatggcctccgaggacggctgcggcggcggcaacccgccgggggacgcagcggccg

SEQ ID NO: 21595 - DNA, 1501 bp, Oryza sativa
aaagaattataaaaaaaataaatggtgccaacgatcaataattcgccgctttatatacgctataacaggtgagggaaaaaaataaaaagaaagaaaagaaaaaaaatgtgcatctcgttctcgtcgatgtcatcctcccgccgccgcactaatcgttgctgcaccggtcgccgtcctccacccgctgcgctggtcatcgccgcagccctcctccgcaccggtcgttgtcgtcctccacccgctatgctggctgccaccgtcctccactcgctgcgctggtcatcgccgcaaccctcctcctccgcaccggtcgtcgtcgtcctccacccgctgcgccggtcactggtcgtcgctgtcctccacccgctctgctggctgccaccgtcctccactcgctgcgctggtcaccgctgcagccccctctctttccccactgctcgctaccggctaccctcccggatctggtggccggcggcggaagaaggtgcgggacggcgacgattgaagacggtggccagggattgaagagctcatcgtcgttctctccgtcgagctcgtcgccaaaccatcgcctctggcttcgctctctgtctaggtatgaggaggggggggagaaatgaggacggggcggtgactccatcgcaagctgttgcgtgctcggtcccgactccctattaggaatgcaagtgggtagtcccgctatccgtataaaaacccgtttgctagtttatttttcacgtggtagtataaaatttagaagaaaaaataaactagaagtgagataagcgggctaaaaaaacccgcttacccgctccacttacatccctactcctaacacgtcgccgtgtatagtttgtatacatacccgggacgaggcaggcaccgggcgtcggcaagcgcgtcctgcgtgaccgaccggaagaaactttttcagttgttgcaaccgctagctctcgcgcctttgcctgccttgttgcctcatgcgcgcgccgcaacgcaagagtgaaacacggaggccgccgcgcccgcgttatggcgtaaccgcgccgcagtataccgcattaaggtgctgagtcatccccgtactgtacctgtttctctctctctttttttgacgcatcaatgcgccctctgcatgcatgcatgcatgcctgcctgattggagcccctgtccttggctgcagtagtgacagtggccacagacgatgaccttgtggcttgtgctgattctgaccgtctcgattgaatgacgactactcaaagacacagacacccacaccatgagagaggcacaggaaagagaggcgtgtgcgtctccatatgcgcttcacgcctctctcacggcctccctcaacacgggtataaaaggcgaagcagtgggtagtgctaggttgggttggtgcttggctagccacggtattattgcgtgaaagagggggaggtgaggacgtgaggtgaggtgaggtgaggcagagtgaccacagcgacggcagcgtagcca

SEQ ID NO: 21596 - DNA, 244 bp, Oryza sativa
agccgcttcattcaaaggaacttacaaaaagctcttagggtggtaggttcaaacaaagatttgtttctgaaatttcttgaagaacctaactcaattttctcaagacagttggtagggtctcacaccaatctagcaccccctcagaaaaaacggattacggtactaaagccacttggttcttttgagagtgatggcacaagacaaactggaactgagcaaattcaagagcaaaatggagcagcaa

SEQ ID NO: 21597 - DNA, 1501 bp, Oryza sativa
taactgatttttatttctgacagaaaatacagtctttcagagattatgtttttgctgcaagattccttttggaagtatgtacgatcttgttagtgccatgggtccatatttttttgtaattgtttctgctcatatgcttttatcctgtccttttttctcccgccttattcttttctatgttgccaagtgctgccatgtccccgtcgaatcttatcgttctgctcgccatttctcatttcttgtgattttatacaagaacagaccatgaactgtgctacctctttcaccaatctgccttacaagtgcctgcagaattccagcttttaagcatgtgtctcttgaaattttgtggaaagagggcatcttgctacagcaatatctcagaatcatgtcccctaagtacaaaccctaagtgctttaaattctgagagcttttcagatatattcaccgtgctcatcaatgccagccactacccactagtatctgaaatggttcctgtaattaagttaggtcacttggctttagtttgtggaaaattaaaatcacacatggttcatgggatgtcactattttcaggattccatactccagaagattgagttgcagctacctattgccagaaggcaatcaatttgttgagggatgtctggagcaaagccagctatgggtcaaactcaaggagatggtatgtatatttatgtgggtattttattagagggatttgagggttttccataaatttcaatatttcttgccattatatcaaattattatgcccttcagtacttattcttcttcattttctcttttttgaaacagaaatttggcacttcttgaatgtgttctacatctagttagttctatgttatgtgtgggaaattggatatgctatgcatctggaaatattagctagggccattgggccaatactttgcagtattgctctatcaaaggccatttttctctatttggggggggggggggggggggattacacaacattgtattattcttacgctcttccaagataatgagatgttttggcagttttgctattcctttttatttctcgcttcattttgcttttgtggatctttagttttttcgggtatatctctaaggtttgtgctatttgcagaacatacataattttaaattttaatcctttcaggttgtcctgtccaacagatctattcatatttggagaaagccactgactctgacaaatttcatgcggacagaaaacctgtgagcatcctgtggcatacctttcttctgtgtggttaacttaggctcctctactcctatgtgacaattttattttgatatgaaatgtggtagaaataattttgagaataaaaggcacatgaaaatgaagtgtaaaactatatgtagtgcaatatgcttatgccattaaactatgctgatccagctagtattttttttcattcctgtgatgattcttgctcttttttttattattaatatgggtttctctgc

SEQ ID NO: 21598 - DNA, 1501 bp, Oryza sativa
agacgatgctgctcttgttgctttaagtctttgtttagtgcttttaactggttacatgattgacttttcctgaaccacttttggcctggtgtaaaactggtccattagcaggtagatcctcctcaaggcccattaatcgggcaacgacacctggtggctttctctttaattccacttctttagtcatctcttttgctaataacacttttaatgaagttgcatttgattttctacgtgaagaaccatcacaaggtgcctgcagagaaacccatattaataataaaaaaaagagcaagaatcatcacaggaatgaaaaaaaatactagctggatcagcatagtttaatggcataagcatattgcactacatatagttttacacttcattttcatgtgccttttattctcaaaattatttctaccacatttcatatcaaaataaaattgtcacataggagtagaggagcctaagttaaccacacagaagaaaggtatgccacaggatgctcacaggttttctgtccgcatgaaatttgtcagagtcagtggctttctccaaatatgaatagatctgttggacaggacaacctgaaaggattaaaatttaaaattatgtatgttctgcaaatagcacaaaccttagagatatacccgaaaaaactaaagatccacaaaagcaaaatgaagcgagaaataaaaaggaatagcaaaactgccaaaacatctcattatcttggaagagcgtaagaataatacaatgttgtgtaatccccccccccccccccccccaaatagagaaaaatggcctttgatagagcaatactgcaaagtattggcccaatggccctagctaatatttccagatgcatagcatatccaatttcccacacataacatagaactaactagatgtagaacacattcaagaagtgccaaatttctgtttcaaaaaagagaaaatgaagaagaataagtactgaagggcataataatttgatataatggcaagaaatattgaaatttatggaaaaccctcaaatccctctaataaaatacccacataaatatacataccatctccttgagtttgacccatagctggctttgctccagacatccctcaacaaattgattgccttctggcaataggtagctgcaactcaatcttctggagtatggaatcctgaaaatagtgacatcccatgaaccatgtgtgattttaattttccacaaactaaagccaagtgacctaacttaattacaggaaccatttcagatactagtgggtagtggctggcattgatgagcacggtgaatatatctgaaaagctctcagaatttaaagcacttagggtttgtacttaggggacatgattctgagatattgctgtagcaagatgccctctttccacaaaatttcaagagacacatgcttaaaagctggaattctgcaggcacttgtaaggcagattggtgaaagaggtagcacagttcatggtctg

SEQ ID NO: 21599 - DNA, 1501 bp, Oryza sativa
aaaagtactccatgaataccaaaatataaggatttttagaattcaattgcatcacaatataagtagtagtttccatcattccgattatctcaatgatttcatagctaatcatatgcttggaagggtttagggaatccaagcaattcaaaattcaaaaaattaactatactaaagtaaaaaaagactatgacctaacctcaatgtttgttaaacaatttaggccttgtttgattccacttagaattattataatctgattattattaggagtaagctgaaacaaacagataacttattatgatagattattataatctataagccagattactataatctggtaatccactctaaaggtgctttttttaattattggatagctaataactagcaaacagctaataatccagataaacaaacagctaacaacttattctatatcggtttattataatcttattataattcagtttatagtaatctagctcaataatatatattataataatcttaaactgaaacaaacagggccttagaaattcatatgttttgaaatggagatagtaccactcagaaagcttgaaggatttcatgtgttttggttaacatattcatgtgtgtcttttcgtgcaaccaaaattttctttagaaacatggtgaaccaattagatttagaaattataaaatatttccaagtgttacaagtggaaatataataaaaataatattgttaaaaaagtaaagaaagtttaagtacaaacagaggaggaaatataacaagtgcttcactatagacaaatatagaggaggacgaaatgtacaaacagtcgtttttactttttaaaagaaagtacaaaccactgtattgcgactcaggcgttgtttagatcccagaaaattttagccaaaaatatcacatcaaatgtttggacacatgcataaggcattaaatatgggattgcgagacaaatcttttgagtctaattacgtcatgatttgaccatgtgatgctatagtaaacatttactaatgacatattgattaggcttaataaattcatctcgcaatttataagcagaatctataatttattttattattagtctatatttaatacttcaaaatatgtatgcgtgtacttcaaaaactttatatcaaaaaactaaacacagcctccaggccgcagcctacagtaggcctatagagagattccacgggattcgatgaactacgaccacgaacaggagggggacaaatcaacaagcaaatcataggggtcccacatttcagaggtagccaaagattcactggcaggtgggcccttcacactttgaaggaatcaacaacgacaccccccaagtcatggattccttctcgctccctctccacgtcgcctataaatccgacgcggccgctccccactccacccacagcccacacttccattgctcctcccctctcctctacagtctgtgttgagcgcgcgtcgaggcggcgagga

SEQ ID NO: 21600 - DNA, 1501 bp, Oryza sativa
ccacaagttcaaagaggtacatagttttacgtaaagagaaaaagattagataggacaaggatagaacaggtagataagatgtcgcattactcctcttattgactgatcaacttttaataataacgtaaagcatttaaaatatctaattatgcaacataaaagtgtcattttacattgtaatgtacctaacaaaagttatacattcagagtggttcgcatttatatctctaaacttaaaacttaaagagtcaaaagccacatgtttgtgaaaaaatcaaatttgataagtattaccaatataggagtatagaatacacttatgtttgctatcacattgacaagtagggttgggccttaaaacaacaataggtaaatgttgtggatacataagttgttgtgtgaatatttccttttcaataatattcccttggttccaaaataacttaatttttcactatcttatttgcacaaagttaatgcaccatggctcttggctgtctgaccgcagcttattagtctgcaacagcaagccatggcattgctgtttcatgtagcaaacagttgtacgggagcaatcaagcaggcacaaaaaatgttagaaaaacataatatatctcatttccaaacaagttttattaaaaaaaaaccaaagtatatgttcgtgtcatggatatgtgtttaatgctaattttgatacaaatatcaaaatactactactccctccggtttagaatataaatatttctggctatgtatctctacacatatctaaaaatacttatattttagatgaagagtacaaataagagaaaattctctcataaaaggtaatatcgcctttctaaaatataagggattttgtccatctaataacataggcaaaatattttactacttccatcccaaaatataaaaacttttagttattacatccgtctcaaaatataagaagttaggattgaatgagatattctttaggactattaatttggataggatgaatttggacagcctgtccagattcgtagtaccacgaaatattagatccaatcattggttcttatattttgggataaagagagtatgaatttggataactacatcttcagatttatcactaaaaatacttatattttaaaacggatatagtatattttagagcagagatagtaagcaacatagagctattttggcctcataggaagaggataaaattgacttgtttccattcagaaaaaaatatgtataatattgacttgtcccaaatgatatacacatgctgggtaaaaataatataatattattgcacacacttgtatatattaaaaacatgaaggaaggagattcctcttgcccttgttttgatacaggaaagccatcagtccaactgccctctcttggagccttcccccctcgcgagaactagaagtagaagaactcatcatctcacctcccaaactgacacaaccctccttaactcattcctcctactcctaactgc

SEQ ID NO: 21601 - DNA, 1501 bp, Oryza sativa
agcacgacggtggagaaaagggtttttcactaatttgctggagttcacgtttgacgtttccacgtcaatttcgtgggagctttgtcacatgtggtgcttttaacatggaagttataaccagcagtggcttctcttttgaaacaaatgagttttacatgactatgcatggcataataatataattctataggaattaaaaaaagaacgctccaaagaaaccctaagaatgcatggttgagcttgttatcacatgactgataactactccctcacgccgttggctttttgactaatgtttaaccattcgtcttatttaaaatttttgtgcaaatgtaaacatacttatgtcatgcttaaagaaaatttgatgataaatcaagtcacaataaaataaattataattacataaattttttgaataagacgaaaagtcaaacgtttatcaaaaagtcaacggcgtcatacattaaaatacggagggagtatattagttactccctcggtcccataatatagtaacctagtataggatgtgacacttcatacttcatagtacaatagatccgaacatgctttcttttccaggttcgttgtactataaagtgtctgttctagattactactcctatattatgagacggagggagtagggtccatggactggaagaaatgattatgtcttggaaagcatatatacttgtgaaatctcctttacagatggtatataaaatgatctctctcttacaaaagtgaaagggtttgaaaaagggataaggtgcaagcaagttggataaaagctaactgaagattaaatctgaaagatgaagaaatttggatcaatagatgttctttcattagacatgtagagtatgttcagctgctcttttttactgtagctatgtggctgcaactgtaagccaacatcagttgtttgtgtcatgtctggctgtagttgtagccacagtaatgttgcaacccctcctaccgaacataacctgagttgaaaacacgcaatagctgggttctggaattgttgttttggtggtaagcttgttagggtgctgataatgtaagctcaaattcacagcagcgtgttttaggtttatgttgtgagtgttgtgtcggacagttttagcctgtgtttggttttagggatggaaactagtccctcccgcatagaaaactgagcaatccattaatgcataattaattaagtattagctatttttaaaaaaatggattattttgattttttaagtaatttttgtatagaaactttttgcaaaaaacacaccgtttaacagtttgaaaaatgtgcgcgtgaaaaataaggggaaggggctgaaaaaaggggtgcctaatacaccctactctgttcgttttcttagaaagctggatcgtatctctcgatccatctttgatactcttaaaaaagagttggacctaatataacaaattggccacgtttgtggcaaattgtgggactattcagtttgtcgcc

SEQ ID NO: 21602 - DNA, 1501 bp, Oryza sativa
accagagcacctggttcaccttggtagtgatgtgaaggaatctcatcggcgttgacgtcgccactgtcttccacaggatctcctggctgctcatgccgaggcagataccgaacgccgacaccgggaacagagcaggaatggccacgttttgtccgacagaagcaccagctcctccgatgactgatgcgacacaacacacaccatgagctctctccagtgttccagcaaatcaaagcacatagatcgatgtgtagttccggaagaattagctcaagaaacttacccggagtttgtccagtttagggccctccagtgcggcgaagaagcgatcaacctgaggcatggacttgatgtggtggctgcggatggcatcgccgtcgcaaccgtcctcctcctcctcagggacctccgtccccggcgctagccagatgggtgagttgccgctcaagcttcccggaccacgtcttgaacgagtcgtagcgcctatcccgagacagagatgaattcatgtgctttgaaacttgaataaagcttataccttagtccagcagcagcactcctctcatcctctggctcaactccaagccaatttcatggtttaattttgggttcccgtcggctctaattgcctaatagcatggatttttttttaaaaaaaatgtaatacagataattgttcattctattgtgctaattttatactgctccacaaaataaaattcagaagtaaaattgtacatgaccaccaaaaacactatggatatcatcaatcagtaactcccctaatctcaccatttttctcatgatttttttttctatctgactgtcttacacgtctccgtttactgttctctgctcctcggcctaacttgcatgtttatgcgttgccggtgcgccggttgcctgcttaattaggccggttgattggtaattagttcatgcatttggggtttggatgccggtcactgtgatggttgtttccggttgggtggcgcgttgaatggcgcgtggcatgctgccatttcttgttttggtccacttgtatgttatttcagatcggtctatctgttctgcactctgtgcctttgtgattttctgtttaggcccttaacttttttgtaaattgaatgtgaagaaggcaaattactttactagccaaatgatttagaggaagactggtgcttggtcaagttcaagaatcaaaacaaggttacagtaatacttcaggacatgagaatccattgcaaaaaaaaccttaccaaattttggtaatgccaaattttggcaattatgccaaaattttgataagatttcttatatagttatcaaattttggcagcaaactaaatgtagccacttttttggcaattttatcaaaatttggtaaggttggaaatggcatcaaagtgaacaggccctgtataaacttccgataatttggtcatcacgccacgtcgccacacaagccagctcgctccaagcatggcgatcgttgagtcat

SEQ ID NO: 21603 - DNA, 1501 bp, Oryza sativa
caaattgcttccagtcattggcacaaatgccaaaccacagcttcagctccggtacatactcaaccttgccgatgaagggtagtgtccactccccaatttggatccaagtgtgtttcaccgtgtccaagcagtaggtgccagcaccatccaccgatatgcagatgtgggagccgccgtcgaccactgcgtatgaagtgatcttgtgggggctggcatgcttgtacttggggtcacagacgaatggcggtggcgggaggcgctggcactgccaggacttggtgaaggaggtcaaggtggacctacggtagacaaaagcctcaaactgactgctcagctgtatgttgtctcttggtatgtgattaagacaagtatccatgatgtagacgctgccacctccattactattgtcgtcgtggtcgtccttgtcatcggcactggggatgaagatggagtagggcaaacacttgggcttgtggagagagggcaaggtatccactttgcacgtatcggcatcgaagaggcaggcgcggccagattggtctgtgcagagcaccttgcgacctgcaagcggaatacagttgatataccaactcaagtactcagctgaagatcgaaagttcatgattggtgtaggaagctgaatcgttcctatctttaacgttgctgccgcttccttctcgttattgtcggcacccgcccatggggtggagtcttgtgggcgttctgattcagatattttcccattcagtatcagtgcagcaggtgttgtagtgttgaacaacttgtagcgcgcgagggtgaggtcgatgcagcgcagcgatttggctccagggatgcggttgtccacgatcaggttcagaaaccgacgagagaggcccatcgtcgattggattgggattggatataatggtcagcttcaaaacagaaacaacaattaatctcgtcggtctccgtccccccccaaaaaaaaaaaaaaaagctatgctatgcacctggagaagtaaacgacattcaaggaaggaagagtaccgcaatagcagcagaagccggcgattctactcgatcccaagtcgactgaactctcctcctttgtctttccttgcgatcgattcagctaacagccgcccggcagcgatgcctttaaagacggaaggaagggatggcttcacaaaagccaaacaaacaagagaagaataacaaacaaaggcgatgagaaataggataataaattagcttttgatcaatgaaaagagggttaagatcaagcggatctgcagggtactgacctgaggcgagctggagaatggagggggcagggtggagctcagctcccaagccctagcaccggagcagaacggcggcggcgtcgcgggattgagggacagatggtttctaggtctggacggaccggctgtgttcgtttcgacgttttcccagcgcgctacagtaacacggaaaacggaatagttaattaacacgtgattaattaaatattagctaa

SEQ ID NO: 21604 - DNA, 1501 bp, Oryza sativa
tacagggggagatctacgttcatgacaaagccctcaaaactatgagaacatacatgagtcaccacataaatgatgacctaagataactcagaatgacctaaattaagataactcagaatgtgacattgcgggaaacagtatcaccatgctatgcaaagcgcataacacagggagttaaatttatatcatcatactaagcgaagcaaataacacagggagagttaaatttcatgacagtactcaaagaacaatttgtctcttacataccaaagtgccaaaattattcagacgataatgatgggtaagataatacaccaaagtaagttattattcagaacaataccttaatgttaccatcggtgccataagacatgtggcattttgagttgtgcttgatcattcggagttccactttcccgttgctgccataagggttattgcaactgtcattgcaagaggcattgccagtcccattgccgtcatggacaacacattgcaccacatctgtaccggtcaacacagtaaaaaaaagctcacctaaatcagaaccaaataagcccgccgtgggtgtccaactgtggtagaaccttgcgacacagaatctgccagaccccaggttgacaagatgaggatgctgcatctctgtccactcttggggtgcctccagctccttccaagatcctactagctgtggctgagagtccatggtggagagaatggtggagaggtcagcggcaccaaattgcttccagtcattggcacaaatgccaaaccacagcttcagctccggtacatactcaaccttgccgatgaagggtagtgtccactccccaatttggatccaagtgtgtttcaccgtgtccaagcagtaggtgccagcaccatccaccgatatgcagatgtgggagccgccgtcgaccactgcgtatgaagtgatcttgtgggggctggcatgcttgtacttggggtcacagacgaatggcggtggcgggaggcgctggcactgccaggacttggtgaaggaggtcaaggtggacctacggtagacaaaagcctcaaactgactgctcagctgtatgttgtctcttggtatgtgattaagacaagtatccatgatgtagacgctgccacctccattactattgtcgtcgtggtcgtccttgtcatcggcactggggatgaagatggagtagggcaaacacttgggcttgtggagagagggcaaggtatccactttgcacgtatcggcatcgaagaggcaggcgcggccagattggtctgtgcagagcaccttgcgacctgcaagcggaatacagttgatataccaactcaagtactcagctgaagatcgaaagttcatgattggtgtaggaagctgaatcgttcctatctttaacgttgctgccgcttccttctcgttattgtcggcacccgcccatggggtggagtcttgtgggcgttctgattcagatattttcccattcagtatcagtgcagcagg

SEQ ID NO: 21605 - DNA, 1501 bp, Oryza sativa
cggactcccagagtccagctgcccagcagcaaagcaatccgcttccactcgggaagcctagtctatgatgctcgtagacattccgaatcacacaaattcgtttctgaccactcaggtcatccatctgccacataggctgattctggttacgattcccacaccacaacaacttttcacaaagcactggcaaacaaatctacgcaacgggaaacacctcacatccgcccttgactgtgggcacggctgttcgaacagttagttaacctctgcagaggggtacactttacccacaagacacgaacttactccagacactggctggtgtcggaggttcgtgacaaggcctttccaaagccaatcctgggtcacctcatgccacatagagggtctccctgaccaagatcgggccaactccggctttcccttaggactcccgggtgccttcctctgtttcggactcccaggatgcctctacccccacatcccggctttccacctctattggcatacaagatttcccaaaagcaactaattacttagccagggtgtcccataccaccatgtggttgcacttgttatgcttgatgaatttcccacaggaatcggtccttatatgcgaatacgggatgacgccacataggcacaacacccgcatcgcgagttttcacaattcattttattttcaaacacaccgacaccacatgtcgggttttcaaggcttctcaaacccattttccaagttttcgacaatcaacggtgtatgtgggatatttggtatacgcgcttagagagcacggataccgaggtaccacaagggtggagcgacaaggaatcagggtagtacagcctacaggaattagtgcgactactgggtaggtccgtcggtttggcacgcaaaccgaggccaagcaagttaagtgtgtgattctaataatgcaagttgcaaacaaaataataatgattttccaattataggagcaattgatcaaagggtgacttgccttgctcaaggtcttcacgaagcttcacgaatcttcgagaaaaccacgattgacgaaaatccggtaaccgcaactatacgtaaacaatcagaacctaaacaaaagaccaataaaagatcctatttagactaaattatagtgccattagacagatctcaattttatggaattactggaagtggaacggggtcaatcgggcgagcggttgaggagatatggatttcctaagattatttgtattttctgtctaaaggaaaaggatttattaaatcctttggaaaaggaaatggacgagagatgtgaatcagacttgtctcgggtggcattggcgcggctcgagggacttgcgcagctcgggcgagcctaatgggccggcacggccgcgaggagggcggcctaatggggcgcaggagggggaggagaccgaccgggtggaccgcggtccaccatgcggggtcccgggacgggcccacctatcggcggctgggtccacggaggaa

SEQ ID NO: 21606 - DNA, 1501 bp, Oryza sativa
cttcatggtacagaaagaaaaataacactacgaaatatataacaaaggctaacaaatttatgacacattggttgttagctcacctcttatttgtttgtctaatatagcggcctttccctcacgttttgactcacaaaaaatatattcgacaggacatggacatgatgttaaggctatgcactcacccaaatcgaactggttcttaacacttattctcatgcactgatgtctggtctaacctagatggatttaaggaaacaataattcaagagatagaagtaaatacatggatagtagcagcacacacagctagagtcaatgtgcagatagaagtaaatacatggaaatggtcctcctaacacaccattggatgttctatattttgcatcttgcatttgcagaactttcattggtagtccaatttaaattgggcaacaaaataatctgtcacagaattgattgttcattccaatttgagctaaattttatatgtaataatgaaaaacaacagatacaactattttgcatcataactcataaatttaggtgcagtccatacatgaatttcttgatctttagagttcagtcctcttggaaaccagcacaatgtagccctcgagcttcggatgcctgaatctcaaccaggtgtcctctaaaaaatgtaactactacataacatttggtttaactaaacggaaggtcagcagcaggctgagcggaggagacgtagggaatctggtgtgtcggcaacactacatgactgaaaacaacaatgaccggaagaaataggtcaggcgcagaaggagaggattaaaggaggattaccacggattggactttcctggaggagcctgagatagttgagaagcagcaatggctacgacgacccgatctttagatcgattgtgggggaatcgaacttgaagggacaacagaaatagcttggagggactacgaaggatcttctagaagttttgaggagcttcgagggtggcgaggagttgagctcagatcggcagcggcggtggtggcgatttccccagtaagatcaaagtgtgttttgattcctatttttgtgatgaacaattgacatcagtgattattggttttgatatttggagttaatctacgaagtggattttgagatgattggattttacggggtccggtcagaccgggctagtgtggctgatcagaccggtgctatgcgacggccaacgttgtgtcggtttcggtttcgggttgtttctttggatatctgagtttgtttcatgtttatgacttctagatggatactatacatatgtattactattgtttgctaacaatgagtcaagttggtgatagcttggtctcggaatatggtttctttgtttgattcatgtgtaggtgactcgatgcctcgggatagtatttgcggtgatggatcgggagtcggcttggtggtaagacgatgtccgtggtggtcagatatcatacgggatacttaggctagagttga

SEQ ID NO: 21607 - DNA, 1501 bp, Oryza sativa
aattcaaacagacccggaacttcctggtatggaacaccggaacttccagtctgccaggcccgggacttccggtgttctagtgtaggaacttccgggtaacagaacaagaataaaattcagatttcgaaacaggagactaagccaatcttcacaagatgatgcacaggtattctaagcagaggacagatcacagaaacatcacataaagagacaagagcgattttttcctgaagttcggatcttgtgatcctactctccgttgaggagctccaaagagctgggtctcgattaaccccttgcctcacttgtgcaaaaaccccagaggaaatccacagcctttaaccccaaacactcctaagcaaatttctagaattaagtgaccaccaagatccaattcaacctacttctagaaatccgccacaagtgtaggttgctctacttggaaagcctctaaaatctcagcacaagaacttcattaatttacctcgttcccttttgaaggagaggagatccttcacaaacttacccgggacatccacaatatgcaacggattctcgtggatgacacctaaccgtctaggagatcatctccaagagtaataagcaccgagatgacagcccacgagatattccaagtgctcacccaagatcctagtctttacacatctccaaatcttcctctctccctctcaatctctctttctcacaagaattaggctctagattgagtggagaaggcaagaaacacttgggagaggctagcaacagctctaggttcgaaaagtaaaagtggaatagccaaagaacgagctggaaacgagctggttatgtataacggctaggtgacgtcatctagccgttactgacaattttgaactggaaactagacaggaagttccagacctggaagataggaacttccggactacacttaggaaaatctttttcacaagaccggaactttcggacctgaaagacaggaagttccggacttgcatttttggacagatggagtatttgcaaaaataactcctagggaaacttgacacttgggtcacactaagagcacttaacatatctcagagcatcacctggaacccctcttaatagtacggtttttcctaaaaaactcgattgcaataaataaactatcctatgcacttctcgagtttcggtccgctttgattctatacttttgggggggtctccaagcatgtgtaacgctccgcttctcgtgggacgttaaaaactaatttggcaaaatcctatatgcgaaaatttcattttttgtgtgcgagtctaagtcatgctgtagatctcaatttaaatctccttgatcctcctcctcaaaatccctattccaaatcaagtctccgaaatcgaacttcgaagttcaatcgcatcctttgaatcctcgccaaacactcactcccaatccccaaaaatatcaaacactaccttgagtcttccttgattcctccctgaaccctcgagttcgaat

SEQ ID NO: 21608 - DNA, 1501 bp, Oryza sativa
aaatgctcatcgaagtagcgggggatatatagtaaacaattcgtgcatgcagcgacgtactccctccggttctttttatatgacgatggctagttcagtagtacttaagttgcaaatacaaataactttttttttgaaaggaatgttgcaaatacaaataataagcttatatatctcttcactcatattagcattaccattgccgtttaggcccaagcggtgcgccaccgtcgccgccgccgacgccgccattgccatctccggtgaactccaaaccgtgagcagcatgatgagcatcgcggcgcccatagccaaccgaggcatttcctccatagccgtacagtacgaaaacgtgcaaattaactgcaaagcaagagcttagtcgagctagctaattaaggagctaacacacagcaattaacagtgcatggcatctcgagacgaactgcatgtatatatataggtagaagtatacgtatacacggtttttttaaaaaaaaataagtatatgtatacaggcactactaattaagcaattaagtaatagtaattaactaggacactaacacgcaaccaacgtacacacggtttatacactgtcaaaatggctagttgacagtattttttttaatactatttgtgtttggtaatgtacgtagccagtcagaaattcggagtgtttcccaagtatagtagtatactccagatcaggtacagactgtgtcaatgcatgtcagagaacgtctcgattgggtattcagttatactattcctgtaactacctgctccttactatacgtttatataggccctgtttagttcgcgaaataaaaattttttgatgtcacatcggacgtttgatcggatgttggaaggggttttcggacatgaatgaaaaaactaatttcacagctcacctggaaaccgcgagacgaatcttttgagtctaattaatccgttattagcacatatagattactatagcacttatggctaattatggactaattatactaaaaagattcctctcgtgattttcatcataactgtgtaattagtttttttatctatatttaatgcttcatgcatatatatacaaaacttcgatatgatgtttttagaaaaaaaattttagaactaaactgagccatacgttgcagaatgtagaaataataatcaatcattgacttgacttgacttgaaactgagattgagttaatttatgataataattttgatggtacatacaaatagcttaaatgctactaaaaagttaaaaaaaaaacgttggtttaaaaaaattttctaataaaagtagatggaaaaagttcttaaaaaaaacatactatttaagagcttgataagcatatataaccacaataaaataatctaaaaagaatggaacctatcgaaacccacatgcagagaatatgagggtgtaagtgactaatccactaaatccagttataaactaaaataagctacgaatatcttattatga

SEQ ID NO: 21609 - DNA, 1501 bp, Oryza sativa
gggctgaaaaattctttccgtcgaagaattcagggacgttcttacttatgttgtcaatgctcaggcctacactcgcttaatttatggcctgatacatctccatgtagagactgaattcagttcccatcatcgaaaaaaaaaagaaaagaaagaggtcaacgtcttgtgagcaaaccaaaatgattttcttgtgagcaaaccaaaaagaaaacagagagtatacctgtcaagccttgttatctagctaattaaggatacattacacatttattataaccagtagcctattgacattgctaagtattcaaccatgaatataacttaggtctctcacggtccggttaatcttatcgcacgcaataaagaacaatttttcgggaacgcgtaaaaaaaaaacagttcggttcattactttaattactgcccctttcgtactaaaataaacaaacacatctcacggcgagcaccgactcactcaacccttttatcggcaaggcgctcctggtctgaactgatatgacagtgtgacactgacatactctagtaaacgcttgtttattttagtactgtccagaagaaacattataccattctcatgcaacatgtcaaatcatctagctgaaaaccatagcaaaacaggctttttactagtagaaatactagaaaccatcgtaaaattgcttcctggttatctgcaatggaaatccaggacttcttcagagctgcactccaatgaactgggagacactgacttgaatcaagtctggaggagtgcatatgcatatgcacgagagtcttacttgtatgatgtcactagtagctacgctttctaacttttaactgcagagaaatgtctctttcttttctaccttgtgttgtgtgattcaatgtagcatagatactagcacagaagcttcattttaggccgataattccttctctcgaagaattcagggctctttaacgttgtcaacgttcaggtcacaatcagcctcgcaagttcaggtctacagtcttgcaacctaaacaagctggttttcttcattctgattctggaagtaagaaaaacagagggcatacttgtcaagcctacccggatttaatgtgttggcaacttttttgacaagtcgacaagcacaattgcaacacctaaacaccttgcggtgatatagagtctctaaccacctcgatctagccaaagggccaaatcaagatgggttttgcaaaaagaaaagctaaaccggctagcggagccgatttagagatcaaaatcagcctctaggccgatttagatcgatatgaggataactacccgtcttgtgggcaaaacggaaggttttcaggacaaacctacaaagaggtgtcacactctcgcagcggcggcggatggtttacggcgcaaaccgataaagatggactaaaactagggtaaaatagaaaacatagtaaaagaacgattcaagtagattgtattcgggggttttacaatgaaccggcctta

SEQ ID NO: 21610 - DNA, 1501 bp, Oryza sativa
caagaagatgtgggtgaggtcacctgcggcttcagtgggtgcttgaggtggtgacggcggagctcggccgggctggccagggctgccagcggctacatcagcggatcggcttgatgagctcctctgcaatagcgagatcggcatccgcaaggagctcgcctccgactccctcgctggcgaggtagtctagagtggtgcggtgcgacgcccgccacaggggcgttcgcctccgccgagaagacgcaggcgaggttagctatggctttgttgggcgctcgaggcggcgtcgatagcggcggagctcggccgggctcgccggccacctctcccccccctctgccagcggcgacctcccgggctcaccaaagaaaggagaagaaagaaaagaaaatagaatagagaagatatgaagaccacacattttctcttataacttacatgtgggcctttttatcgctgactaggataccacgttagcgaaaccggagatacatactgttgtggaactctaattgcatggttttgtattatttaggggtgaagatttctggtattggagataagggatgtgaaacaaactcaacataaagttgagtgacgatcggtgaacttattctctttttttttttttttgagaaagagtgagagatagttggcttgttcggttgggccatctgaacatctatcttgcagttatgctagttgctactagtagttgtgtgattgggcagcaattgagatcccctgcagtactgtatgtgcagtactgcaaacgacctgcatccgtggttgggagatgagaatttccaatgtgcatggaaacttaaaatttgtgaccacaaggtttatagagtatagtaacaaacttagggcctgtttagatcccctggcaaaattttttacactgtcacatcgaatgtttggacacatgtgtggagtattaaatataagaaaaataaactaattacacagattgcatgtaaattgcaagacggatcttttaagcctaattgctccatgatctgataatgtggtgctaaagtaaacatttgctaatgacggattaattaggcttaataaattcgtctcgcagtgtacatgcggaatctgtaatttgttttgttattagtctacgtttaatacttcaaatatgtgtccatatattcaatgtgacacgccaaaacttttggccgctagatctaaacactccattatttatttttaagacttgtgagaagattgatttgactaccactgccataataggttggactagttattattaatttgaagcgaaaatatacattatagccaatatgatactatacattttgatttttgtttttttagttcatttttatttaatttttcataaaaaaaacttctaataacttgttcacatttcatccctatgtgataagcacagcaaatgttattgcacaagcaatagtagcatggcaagtggcaacaatgatttatgtgacttttttagttgtccagc

SEQ ID NO: 21611 - DNA, 1501 bp, Oryza sativa
atatcgcattgaacctttcagtttgtccattcaaaggtattgttattcgtgcatttgtatctccatttttattagcttaggccctgtttcttttagcttgagattattataatccagattattaggagtaagctgaaagaaacagacaacttattgaagtagcttattataatctcgagcctagcttattataatctgataagctcatttaggtgagcttttttcagattattgggtgaaaaattacccaccatgccaccccactccttttttagacttgcaaacctaataatctaggttctaataatctaggaaagaaacaactaaccgcttattctactacatattataacaatctagcttatagtaatctgactcaataatctagattataataatcttaagctaaaagaaacggggccttagttccttcatctctatatccattatgagacaacaagcttattctgagtccattctcccaatcctaggcttattgattacatttttaagatgttgcattcggtaccaacaaatcatttctttatggtaaaaggctacatctttatatgatctttcttacacaacaaccaatactactgtgtcaatcaagggttatggaacttactgacaattacaaggaatgttgcacatttagcaaaaaaaaaaatctatacttcggttgaagattttgatattagctagaactttactagatcacaaatatacatatttatattgtcttcgttaggtcagtcaggctctatgtataacaagctaaatggcaatatgtcgagatatgcgctgaatataaatggcagtatcaataccagatgtaaatggctaaaattgttgatatgaatagtccatgttttcttttttatctacattttgggcatttagatagtatttacttttttagaattctatatatgtgtagtaggtacactagagagtagagacagatcaagaggtgtgatgtctgtagtagatgcatgctcttctcaattgttatcactagcagtgctgcttgagaaatcatcaagttcaatatgtaccttatgggttattctgtgttcttgatactatcactcttatttatggtctctttttgttctcagatggtgccaatcaatattattaatggtttatcttttctggaagtcctttgtttgtaggtatctagataaccaaaacaattggagctgatgacatgggattccaaaaaatgcacatgctatatatgtggagtctagagatatgttttattttgtttgataggaatctggagatgtgtatgttcactagatgaatgtttgttcattacatgtgcaatcattatatgcaagggctcaggaacaatgaggtgatgttttagctagaaaatcatacatccatactagctaatttatacctataatttggtccgcctttgtgctaaattatgtgtgcacaacaaattgctagcttacatataaatcttatctcatgtatgattaca

SEQ ID NO: 21612 - DNA, 1501 bp, Oryza sativa
ctctgacgctcagactccgcttgttttacacacaggggttcagactttcagttgcccctctgcagcaacagccaacaagcccacccttgcagaagctttgtcgctaggaatctagtttctgaacttttggaaattcggaatgtcgtcgagatgaacaacacatctgcaatctcacctccctcttgcagagttttagtgttctccattttttatttttgcccttgtctagatccacatgtaccaaatctagaacatgaacttcaatctgagtatccagtaaaacctatgacatggaccctagccaaattattcatgcttttaccaaatttcgagtagacttcaaaccgaaccacactaaattttgagaaaattgcatatctatcattgcataagttaggattcgctcaactactatcacttaaatgggcttagctagaataccataattaaccaatgtgtatttgctaaaatactatcccggacagaaataccctggatcttcttcttcatccctccctccaatgactgaataggtcgccagtggccaccgccggctccactgccgcgccatcgctcacgtcgtctgggctgggcaccgttgcgcatcgccgccccaccctgactcgccggctgacgacaacctcgccccgacaccttgctgccaccggcaattagggcgttgccctccctaccatcggtccatcctggtatgtgtcggcgaggcagcacctgtgaagccggcggtggccgccagcaacctcttcaagcatgggagggaagaagatgagctaggggcatttcatttctagatagtattttagtaatgatcgattgtggatggtattctagcgaagtccattttgaataattgtatttttatccagtagatatgcaattttctcctaaacttttggcctatctggacgtgtcaggggatggggtgacacattgatgaatggtgtgttctgactctgcttgttttacgcaggattcagattttcgttgctcccatgcaacaacaagcccacccttgcagaggtttgtcgctagggaatctgcaaaatttgtttctgaacttttggaaatccggaatgtcgtcgagatgaacaatacacctgcaatctgcagtatcagtatgctccctcttgcagagttctccaatttttttttactgacatcgtagtttgatactctgtgcaaccataagtttacgtgaccaactttaattgtacgtattatttaattttttttataattagtatttttgttgttatgagataataaaacatgaataatactttatgtgtgacttatgttttaaagttttttcaaaaaaaaaattaaataagaaggacgattaaaattgagcacggaaaaatatggctgcaattaatatatagccgcaatcagtagtttcattgcattgcgtacatcagcatgacgtcatcacctaccatctcttcttctctacgacgtcgcctcgtataacaacaagctcttc

SEQ ID NO: 21613 - DNA, 1501 bp, Oryza sativa
tatcgacgccgcctcgagcgcccaacaaagccatagctaacctcgcctgcgtcttctcggcggaggcgaacgcccctgtggcgggcgtcgcaccgcaccactctagactacctcgccagcgagggagtcggaggcgagctccttgcggatgccgatctcgctattgcagaggagctcatcaagccgatccgctgatgtagccgctggcagccctggccagcccggccgagctccgccgtcaccacctcaagcacccactgaagccgcaggtgacctcacccacatcttcttggtggaggtagcggtgaacacccctgcggcggtcgtcgcaccgcaccacatcggactacctcggcggtggggtgagttggaggtgagctccttgtggatgccgacctcgccattgtagagtccccgcccgttgacgaggtcgacgacgtgaaaggatacgagggagggggcaggcagacgcgagggaggagctcgtcaagccgaaatgctgtcgctggtggtcccaacgtctacccctccggcaccggcaaccatgatgagatcccactctagctcgtggaacacgagtgggaggctacagagggcgaggcgacatgaggtgtcggtagcacggcaaggtttggttaggatgtgcagagctggtggtggtggagggcaatgagttcacgagcggtcgagggtgccggagctgctgctgtcggtggtgccatcctcctcaccggctgctcttcctcaccgtctgttgctgggcgctgcccgatgatatgagcacagaggagagattgagagagagaggggggagggaggggggggtgaaagggaaatggtcattgacaagtgtgcgtcgacatatgctacgtcaacaaaaaccgaggataatatggtccatattgctaagggacttatttaacatggtttcgaatacttgaggggtcaacatttctaacattgaggattagggggacgtcatgtagactcgatctgaagttgaggtactgagagtgaacttattccaaaaaaactgaaaacaataagcccactatgagtccacgggcccaaagacccaggcccaaaccgcgtgccgtttccctgcacaagcccaaccccacacatatcatctcatcccatctctcccccgtcttctcgaactctccatctcgggatctcgcccacccaccactccaccccctctcctctccgtgcgccgccgcagaattcctcgccgccgccgccgccgccgccgccgtgaggtccatcgagatcgcgaccggagcaggtgggtgatccgctcccgcctctcgcctcccccctcttacctcccctccttcgtgatttccccggtcccaaaccctagatccgccgcacggccccttgcgggattagatctatcggtctcggggggcaggtctctacgtcgtttttgtgattcgttgtttaatccgattgtatttttgttttcttttggcgatttgataggtgcaggttgcga

SEQ ID NO: 21614 - DNA, 1501 bp, Oryza sativa
cgttttaaaatcaaacttttggaaagtttgattaagtttatagaaaaatatagcaacatttatagcactaaattagttttattgaatctaacattgaatacatttgaagtttatttgttttatgttaaaagtattgctatattttttataagctttatcaaagctaaagaagtttgacttagaaaaatatcaaaacgacttatagcatgaaacgaatgtagtacaatgttgtttgagcatatcacttgtttaaattatttatataatttacttatcaaaatatgtaatctattgttataataaaattaataatctgattcagatatggcctacgagcgtatattttagttataataaaatattgaaacaatagattaaataatttacttatcaaaatatttaatctattgttataatagagaatattatctccaatgcagatgcttactcccttcgtcccataaatttcagttttagtattgaagataatatttttaatacaataaatctatacatccaatattagattggatggagggtatatgttggagcctggagaagaaaatgaacttcacatgcgtatgcacaggcagacaggctcatatgaccacacggatccatcacagcctaaaaatgcattcttttaacaaaagagtagttgaccaggtctccgtgtcaatcaatactactactagtactagtagtctagtactggagtagtaccaaaagcagcagaccaaaagaaagaatctctctactcgactaaaaatcacaccttcacccttcatgtcagcacactaaccgcgatatttaccccaaatcccaccgatttaacagcggttagtagtaataataaagtaaggtttggatgcatggacttaactttaatctctatatttagacactaatttaaattattaaatatatactacttacaaaaccaattacataaataaaagtaaattcgcgagataatttttttaaacctaattaatccataattaaagaatatttactatagcatcacatagactaattatggattaattaggctcaatagattcgtcttgcgaattagtccaacattataaatatattttattaataatatatatttaatatttataattagtatctgcacatacgatatacgatatcatagggtcttcagcgaaaaggcccccatcgtcttccccctttccacggtagttttcgttttccgctcgccttcctcctccctctcccttcccctcctcgaactccgcgcggcggccgcggcctccctccctcccgctcgatcccgacagccgccgcagctccccgattcagcgcggtctctgctctcctgctcctctggtggctcacgcggggaaggatccggcgctggatggatgagaggaggatgaggtagtttgtttggtggtttggttgtggcggaggtaagcccatgtttgggtcgaggagggtgaaggacgagatggagctcaggaagcagaggacc

SEQ ID NO: 21615 - DNA, 1501 bp, Oryza sativa
aagggagagagagaattgaagctataccaatcgtctctgatgagtcatagccagtaacagttgggcaggcaaaaaaaaaaaaaactagaggtgagcatgaagaataagttgcattttacatccatgattggttccataattaggtttggttctggctggaaatggtagtagcttactaggtagggcggtagtatatacggttgtgcacgagcgaccacagttgaagctatagcttgcgctgaattaagggcttgtttagttggcgaaaagaaaatttatgagtgtcacatcatatgtttgactagatgttgaaagggtttttggacacgaataaaaaaactaatttcatagctcgcctgaaaaccgctagacgaatcttttgagcctaattaatctgttattagcacatgtgggttactgtaatacttatagctaatcatggactaattaggctcaaaagattcgtctcacgatttccccactaactgtgcaattagtttttgtttttttctatatttaatgttccatacatgtgttcaaagattcgatgtgatgtttttgagaaaaaaaatttaggaaactaagccaggtttaagtgggatcaggaaatgatcgatcgatctgatcggtgagctagcggctgagctctggagatgcatggttcagagttgtgcgcccaagtagaggaacagtagtgtatcagagaccagatactcgtatcattacggagcactgaattgggtagcagagctaatgcaccactgaggtgacaattcgcagtttatgtttgtggtgtacaagtaaattattgcgaatcatcaattcatcaccaacaaaccgctcgtcatggccatgagtcgtcccctgctgccggcaattcatctgtggtctgtcaattaattagatatagtatttgcctttgtgtggttgtaatcaacatagatttgcagtcgaagaagccgctcgaattgattaatgatttgatgaactccatccggtgattattggagcataatttgctgccgggcccggacatcatctgacgtcagcgtacgtaacaaaccggtttttgcatgaagtagtgcaaacccacgatctatacgagccactagcaatgacactacgatcgacaagatagataccgaagcagacaattacagtagcttagctagtacatgtacagtactttgtactcccttcattgataaaagttacacctatttcacatttaaattttttcaaataagttgttcctatttgtaatctttatgaatttaaaacttaaatgaagagataaattaaatgttttattagaacctcaaggactcatctaaatactcattggttacatgcttgcatttactacttgattttgtaacattcaaggtgatttaatttcttcttggtcttggtgttaaaagtaatgtgctggtttggtttgagacctaaattagacttaccaatatttgacaattttaatagtgtttagtatctatttggt

SEQ ID NO: 21616 - DNA, 1501 bp, Oryza sativa
ctggaagtacatggtagcattcgtgtgcgctggccaaaagtttgattgctcggttttggttttcattgcggtaattcgtcgtggccactagatttctggtggtgctgccgtggtccatatgatccatttggttttaaccatttttctgcccgatattggtgtgcatccgcgtttcagtgcagcactcagggctcacatcaggtcggtacgtacgtagctgctagagattgcacggtagcataaatatatactgtctagctagtagataggtagcaagcctagcatctatcattgcagcttgatagtgttagttagtactagtttaagacagtcatttttgttttgcataaacaaaagcaggcgttctgtcttggcaactcgctcggtgcctggccgaccaaccatcatatcagtaaaattgttggacattttgcaaagtgaggttgtaggctcacatcaaaattgactaggactaggtcaccagaaaacaggcaaaagtctgaaacatgagtatcagactgaataaattgtatagtggaggagagaaacatatggtgcatgctgtacattcagctgtgacacttccactgaaaatagttgaaacaagcagagaaacataaggcttggcttcccctgacagatctgaactgaaccacctcttggtttctcttttttttcactacaagacaaccaaatctaaactgaaccacctcttggtttctctcttctttcttttatatgcactacatgacagcacattcagttgcaaaatcagatatctgttcttggcacacttggcagtattggggagaaaaggattctcttagttcagtgcaagcagctcttgatacggaagtgtttaaactaatggagtacttggttggtggcagaacaaaagagcatcctttgttggaaactggtattgtcaagctgcacgccttgggtggatggatttccggaacaaaagcaaaaggtagtatagcaaattatatagtatatgcaattatatctagaacatactagctactattcagaacataaatctagtcatccgtataaaaacttgcgcacgcaagacgcaagtgcatgcatggcgtgagtgcatgggatcccattgtattcctcaagaaaaacaaaagcacaagaaacaaacgatatggcgtgagtgcatgagatgcatcccattactcttcaaacaaaccaaaaaaaaaaggcacaagaaacaaacgatgtaacaatgctataaaatgctccgttctagcaataacccagggattcagctcagcaattcatgattgaaacggtcatacagacagacactgcctctcaccaaaaatgggttttcattcaggagtgatatatgcgtaccttgattagtactttgacaaaaaacgagacattaattggaatgctccttacgcccttatccatcttgtaatcaaacattcaagctaacagaaatcagggtaaaaaaatggaatcatcgaggcgcatcggtata

SEQ ID NO: 21617 - DNA, 1501 bp, Oryza sativa
gatttattgttgacactagacacgtactccgtgtagtacaccatgatggtgaggtcgtaggtcagcgcgtcccagagtagcacgccggcgagggcgaccgcggcggcggctctggacgcgagtagcagccacgccgggcgcaccccgctccagcggctgctccacatcgcggaggccccggccgaaccgatcgatgcggcggcggcgtcgtccaccgcgtgcggtggtgacgatccatccgacggcggtcgcttgcgggaggacagcatcgcccagagggacgccgcgatggcgccagcgacgatggcgaaacagagggcatagctgagggttgccataggagctaattaagctgggtttaagctcaaggagatcatgcgagcgatcgctcatcaaagtgatcaagtgcacacagccacacagggactagttgctggctttgctgccttcttgtcgagttaccacttgacaatttgaccggtaggtgttgtgtccggagtccggactggttgctgccgttgcttgcagcaaataaacggtgcgccatctcggcccatgcggcccaactccaaccaggccagccgacgcgcgccggccgtagcatggcccagccctcagggagcaccgcggtcggtgatggccgacgacgaattcgcagagcccccggtccacacgtttgccgtgacgcgtcccctgtcccctgaatctgaagtactcaagtcttttgcacaacaatcaaacaagtttatgtgcctggacaagtttacctatgagagatccacaccacaccaaaaagacaatattggtcgcaatattgtcatactctgactaggtttcggggtgaacttgtatataaattcatgtatgtaatgtttctacgatttcttttggattgcaaggtgacggccagacttgacttcgtaagcatgttttgggggcgaaaataacgctcattgcaagcattacaaattcaggtcagccttgtaacacttccgaggtgtacttctgatgaccaagtaggcaggtaaatacaacgcgagtcgatcaaaagtcaaagccatgggatcttcaactcaactgcgccgtcgcgcggtcgcggaaactccttatcttttcagcctcgtcaaacaacgcggctgcccctgttttcctttccatcacggtgatggcagctaccgtggagtagagcagaaacctttttcgcctgttactcctgctccatgatttctctgtcggaatttgcataagatctcctattctcgtcacaacccattctacatccaacaggttactgcatattcctctgttctagagtagcacgctactatgctacagaaagtactgtctacatctaaggtggatgcaaaccaagagcagaacacaatgaaggacaaaaatccacattgtcttcaatcctttggataggcaatctagctaagtctaatcaagcagtataaccaattgaacatgacaataaagaataaactggaaagaacaagtc

SEQ ID NO: 21618 - DNA, 585 bp, Oryza sativa
catcaatagttattgtgtcaagagagattttgagatgttcttcatgtcatgagatatggcttgtgggctgctgaggcctgagagctgagagctagaggctgagggcttttgatttttttttggttgcttttccacacctgtgacgggtggtgagttgaaacctgtcggaggtgtttatcacctttaacaggtatagctcctccttcgcagtagtcgagcaaaagtaatgcttcaagcatgcaacatttgggtgatcgagaacttgcatcgtttgcagctcccggttcttgtatctcgcatcttgaagaactttctttacagcaactctctcaccagtttctagacacttagcctgtcaaagataatttaattagtaatctctaaacagaaaggtaatgacagaatggcatataccaatggcccacctggaagacaactccaaatgaaccacgcccaacagcacgctctgcgatgtaactaattgtctgcaatccaataaaaatccagtactataagtttttagaaatagacaaataatggcacataacggcaattttttaataatgtggtagtgtttgccacata

SEQ ID NO: 21619 - DNA, 1092 bp, Oryza sativa
  unsure (1)..(1092): unsure at all n locations
atggcacgtggactgctggtanagnccacaagattttgatggaataaaccgatccgtatatgaactgtattgaatcaatcaaaagcaaagagatcttacgtagaaattcgcatttggcagctggaggtttcgtcggctaagggtacgtggtcgtggggacaccactgggcagaggacaagggtttgtcctcacggacggtcatcttcgttggcgcctccaagatatgcagacaagatgtacttctcacaaatctttccaccttttattatgtgcacgatggagatgtacacatgtgcgagctcactcctgtaatactatctctatttttttttgttggttactaaagttatgtaaaaaaaaaaaatagagggagtacatacctaatgtactaaacccagagataaaatttgtagacctcacaataattttttttcgtgaacactaaacgagatttggagggagagacgcatcttcaaatattttttaagaagaaattgtgagcatgatgaggattggacacaagacctcgagatttaaatcacacacccttgctactgcactatcgagtgcatctcagaactcacaaaaaaaattgattattatatttttttagttctcaataaaaaaatttgattattgattgggtgaggaaaaaacatttgggttaaatcgaccgctgtttgcagcttactccctctgtatatgtataattatatttctagcacttttgtcctaataagtgcacatctaatgtactattgttctatcaatcgtttcttatttaaaattatttccatcttacctcaatcatcctacaattctaatcgttccttatctaaataagtgaaaggagtcatttttcacaaatttattgcgcaacgtcatccgataaacataaaccgtctgattacacatatagatgatatgagccaccggatactcttactagtaagatataccttcacaattcttcaagaaacttcttttcgcaaaaaggtacttccacatcgctagcttagaaaagaaaagcattctcgtgtgtttgctgcttcacgccgcatctgctcagtgtcacccccttctccttctca

SEQ ID NO: 21620 - DNA, 1501 bp, Oryza sativa
cataactaattcatcttagctcagtttaatgtggttcaagttgcaaaagttgtataaaataaagatctacatattaaaattgtccataaattgaattaaatttatttaattctttttaaatgggctttaattagatttaatcttgtaaaattcataataaattcatttgaagtcagaatgaggccgttcaagtctcataattcatctaaaattatgatctacatgtttgtttactttatatgtactgtttatttggtttttattagtctttttcttcgttttgcgtgttagtttgtcgtttccgtcgttgcgaaggttcgcgagtgcgccggaagtattcaagaagattaattgaacaccgattattgcaaggcaagtcacacagatcctaaacacaatcctttgagcatgttgatcctatatttaaattctctatttatttcaactgtgcatttattttcgaatgtcaccgggtggtgtgaacttattcctttgttatggccaatttgcattgattactttattccttgataccttgggttattataacttgactagttgagctttatatattggttcagctagatattatatatgattgcttagccatgcttagaaacattagcacattattgggataacttatgactcattattatttaatgatggcttaatgatagttcacgatggtcaatcgtgattggttaattaattacttgccaactaaaacttgataatggtgggttgtgagcacatggttttgagagtcgtgctcatgacaattaaggaccggttcgcgagctactattgggaaacattaatcgtgccaaccacaagccagcgtgggcaacggctttacctttcgtatagcattgttcattgcagagcaccagactgagaagtggcggagataggcccacgggggtcgctggggagtccatgcctctggtttttgagggggtgattatgatccaggaaaggtgcactgtggtgggttgtgttatgcgaggggtaatgtcacagctcctttccgaggtaccgtggtggtactgaggcacatggtgacatgatgtggggctgtgtcttgtgggtacagtggtacacttctggccagagtaaaactattcgaatagccgtgcccgcggttatgggcgggttgagcaatgtttttcgtgattagtctcacacctctcacaataattattgatgttataactggtaataatttgcttagctcctggtttggagattagatctgtacagccgggtatggttgtttaggatggtcgggcctgtgcagcatgggtgtgctgttcagtgttgattaaaatttctgattaactactctactgttttatttctcttaaatattttgctaaacgctgcttttgcaaatgagcctatattatgccatcctttggtatccttgtgcacttgcatatttgctgtgtggcttgctgagtatgtcatatgctcaccttgcaataatcaatcaacctca

SEQ ID NO: 21621 - DNA, 1501 bp, Oryza sativa
ttttactctgatcagaggtgtaccactgtacccacaagacacagccccacatcatgtcaccatgtgcctcaataccaccacggtacctcggaaaggagctgtgacattgtcacatcctgatttttgtttcaggatttataaattatttaataaattattaatagaatttatattaaatgttctttaatttacaagtgaagttaaatgtgggaaataaaatttcctaaatctaaggcatggatggatttaatttttattaaattctccatgattaagtatactctctgaaattttctcggatttttcagagctcaattcctaaatgatacaaagaacagttcagtaattatttgatcaataatgatctaattataattgttaagtgcttttcttgtttaaaatccttaaattataaattgttgtttaaaaggaattattagaaatgattttaaaagcctagaagagaagatctaattttaatttgttaaatctcaatataaaatggggccagataaaatttcattaaatactttgcttaattctataattcctagatttttctgggatttatttgagctaaggaagtatttttaataaatggaattgcatttcatgaataatttaaatagaaaaaggttttaaaatcctccttttggctttgggccgaaagtcggcccaaaacctctctttctctctcccttcccggcccagtcagccaagtcggcccagtccgccgagccgccgctctcctctctctctcagccgctaacaggtgggtcccacttgtcggggtcgtcgtcctcctcgcgccgccgccgcccgaaaccctagcgcaagccgccgccgtctccttccaaattcggccgcgtctttcccgatccggtgaaatcaatagaggggaaatgatcttctcgatctcctcttccttttctcttatagaaactccggtcaatttcctttggaaataggcggattcgagtttgattcggattcgtttttccccaatctttccttctcgtcgccggccgccgtgggccttcgccgccgcctccttgcacctatataaggacccccgatatctcctctacccgccgccacctttgccttagcccgccgtcgtgtctagcgccgcctccgcgtagccctagtcgccaccgtcgttgccgtcggttcagccgcgccgcgccgccgttgcagccgccgtcgtcggtcgccgtcgccaccatcgggatcgccaagtcgtcgccgtcctcgtccgccccttcgccgccgccgaagaccgccggagcaccgtcgccgccgtcgacccgatctccgccgccgcttcttcctcgtcgccggcgctgtccgttgttcctccgccgcttctttggtcaccggtgagttcgccgcgtcgccctctatccgttggtgtcctctgttcgcgtcctcgcgccgtcgttcgccggcgagcttgcgccgtccgagccgcccgagtcgccgccggtgctgacgtcgtcgc

SEQ ID NO: 21622 - DNA, 891 bp, Oryza sativa
atatctagattcattaacatctaaatgaatatgggcaatgctagaaagtcttacattgtgaaacagagggaatatgttttagcttggcataagttttgtgaaagcaagtgttatataaccaatcccaatagcacatcaataaccaaacacgaaaaaaacaatgaccctcggccggatgccgctggtacaaattatatttaatgttatgttaacaccaaacaaacacaccatttaattatatttaatgttatatttaatggaactaatttgatgttatacctccgctcaaaatacaaaaagggtgatacataggcaaaatactttatattgaaatggagatagtacactatttctctataaacttgtctaaatttatagaagtttgatagaaataaagtcaaagcgttttataatataaaatgaagggaatagaaataggtcagcagttacattatattttagcatctatcctatttcttaaattttgttgcacttaccgtagagtgcatgaaaataatttactcatagacggattaaattaagaaattgttagtgttatagataaggcatacccaatagtctttggttaggctccgggggtgggggggcggcaccatatactaagttttatgcggagtcatgtctcatatacagaaggtattccggataaggaaggagaggcagagttctatatgaaaactacaaggactactcatatcatatccatacttgtctctctcgttctacttagacaaagagatatctgtggatataaatacaagaccccctaggaggagaggggacacagtcagtcataatagacaccaatacacactgccaaacatcgacatcagaagataagcctagacatacccaatctgatactacaga

SEQ ID NO: 21623 - DNA, 1406 bp, Oryza sativa
  unsure (1)..(1406): unsure at all n locations
gtccacctccatggtgacgggccgcgccgcctcttcaggcttctcgatctccatcgccgcgccgggattgctgctgcttgtctcaggcttggcattgctcctgctcttggttttggttttggagagcacggcagagacaaaatccatgcgcagattggcatcctcttccactgttttgtttggtaggcaagcaagcaaattacaatccattcctggttcctctccttaaaaaccaaaccaagcgggcctatgtttactgaagattagtctttaacaggggcctatgtcaattccttgccgtcatcaaacagacagacaaacaaacaacacgatgatgatgagttctgtcttgacggctgcttccttccaatctcctcgcaatttcatcaaactacaagtacagctaaggcctcagcagcgacgcctgcaacaccaacaacagcttctgattgttggcagcaacggggcaataacaataggaaacatgagtttgtgccgggattgctgctgcttgtctcaggcttggccttgctcctgctcttggtcttgattctggagagcacggcagagacaaaatccaagagcagcggcttggccggcgccatggcgtcgatgatgctgccgccactgcgagagatggcgtggcctcggctgcgtttccggctaatccgtcgcagctaagaagctcgccgacggctgccacggggcgcttccacctctgcgcccatcgccgtagcgccggcctgcgcccaacccactgccgctgcgtcgccacgccaccccgccgcccgtcgccggccacccagctgctcccccgcccgcgccgctcttccgccaccgcaccggccggcccgcatgagaaaactgagaaagagagagagaggaagggagagaaaagaggaagagatgatgacgtggtcaccctgatgtgtggggcccacgtgggtcccacactgagtcagctgccacgtcggataaaaccggagtcaaaactattaatggaacttagtttgcactttttataagttggagtatgtgttgtatccggttttgctgtttaaggacgattttgtaacttgatgacaagttgagggaccttcgatgtactttttccttttcttcattgctggttttttctccctccaacctcaaatggggcggtgtggcccgattccagatgccttctcgtacaccgattccagatgaaacgaatcaatgggccggccggcgggcccgctatagctacaccaccccccagtccaccacacgacgcgcgctacattctccacctctccaccattccaaactgccaagtggcaacaaacctactactaaacctgagaaatccagattcccacccgancngacacanntcctntctcctcnngcngcngccgcgcnntcct

SEQ ID NO: 21624 - DNA, 1501 bp, Oryza sativa
tttcggttgtgaaacattaaccgtgccaaccacaaccagcgtgggcaacggctttaccttttgtatagcatggttcattgcggagcaccagactgagaagtggcggagataagcccacaggggtcgctggggagtccatgccttgtttataagggggtgattatgatccaggaaaggtgcgctgtagtggattgtgttgtacgagaggtaatgtcacaactcctttccgaggtaccgtggtggtattgaggcacatggtgacatgatgtggggctgtgtcttgtgggtacagtggtacacctctgatcagagtaaaactattcgaatagccgtgcccgcggttatgggcgggtctaacaatgtctttcgtgattagtctcacccttctcatcataataaaaggtgctttaattggtaataatttgattagctcctggtttggaatggtatattcctggtttggagatagaactgtgcagccgggatggttgttcagaatggttgggcctatacaacagggtatgttgtatagcgttggattaatattgtctattacttaactgttttattaaattctgaaatgtttattaaatgctgtttatgcaaatgaaaccctactatgccatcctttgttatcctgtgcacttgcatatttgctgcgtggcttgctgagtatgtcatatactcaccttgcaatcattcatcagagaaagagttctacaatgatgctgatggtgtggaggattaggtgtagccctggtcaagctgcctgtggagtggagtcgtctgcgccgtttatcttatttttccgctgcttagatctctattgattgagaggaactatctacctctgtaatgacattttattcgcttatttaattagagtaataatggtactctattatcaatttgttattgtgtgcctcggctgattcctggacgagggttcacgcacatgtaagcgtttggaattttggatagaaattccgggcgtgacaagttggtatcagagcctccttaaccctaggttatgccaaatggtaacccatagaagccctctaaaaatattggaaaagtagaactgttctcctccctttctcttttaattaaaccaaactaatggcacatgcacttcataatctcttttaatggttctcaatcaaaatttattccagtgttattagtactgtacatctattactgtactaatggctcatttaccaacaaaagttttacaatattgttttatttaatcttgcttcaataaaataaatttagcatgttgattttataactttcttttatttcttttggaacctgatgttcaaaagtacaaaattggtgaccttgtttccaactgtttcaacttatcttgcaagcttggtttactttatttacttacctttttactttgaatttctaactttattcaaattaatccaaaaacttgtgctattaattggataaatgtcttaactccctcctttcacttgtctttaga

SEQ ID NO: 21625 - DNA, 1501 bp, Oryza sativa
aggatggcatagtagggtttcatttgcataaacagcatttaataaacatttcagaatttaataaaacagttaagtaatagacaatattaatccaacgctatacaacataccctgttgtataggcccaaccattctgaacaaccatcccggctgcacagttctatctccaaaccaggaatataccattccaaaccaggagctaatcaaattattaccaattaaagcaccttttattatgatgagaagggtgagactaatcacgaaagacattgttagacccgcccataaccgcgggcacggctattcgaatagttttactctgatcagaggtgtaccactgtacccacaagacacagccccacatcatgtcaccatgtgcctcaataccaccacggtacctcggaaaggagttgtgacattacctctcgtacaacacaatccactacagcgcacctttcctggatcataatcacccccttataaacaaggcatggactccccagcgacccctgtgggcttatctccgccacttctcagtctggtgctccgcaatgaaccatgctatacaaaaggtaaagccgttgcccacgctggttgtggttggcacggttaatgtttcacaaccgaaactcgtgaaccggtccttaattgtcatgagcacgactctcaaaaccatgtgctcacaacccaccattatcaggttttagttggcatgtaattaattaaccaatcacgattgaccatcgtgaactatcattaagccatcattaaacaatagtgagtcaaaagttatcccaatagtgtgctaatgtttctaagcatggctaagcaatcatatctaatatctagctgaaccaatatatatagcccaactagtagagttataataacccaaggtatcaaggaataaagtaatcaagaacaaaagggctataacaaacaataggttaattccacccaatgacattcaaaaataaatgcaatagttgaatagaaacagtagctttaaatgggatcaacatgctcaaagggttgtttgggatctgtgtgacttgccttgctggccttggaactcttcaaattcttctcctgcaaaaacggactctccggaaacgtcggaatctaaacagaaagaagcaaaatcaccaaaacagcacataaacaagcatgaacagtacatgtggatatttttagcatgtagatctcaattttagaaaaatttagagacttgaaccaactaaatccgagctaagatgaattagttatgaatttttgaagatttaatcggattaaaacacttatatcgattttaattgaattatgacgcaataatgaattatttttgaaaaggaaaaagggatttattgcgtcagcggctagggtttgcggtggaccgggtgcacggcggcggttcatggaaacggacagccgagatcgatccatccaaaacggacggccgagatcgaacggtccacgaccggctcacggcaaacggccacga

SEQ ID NO: 21626 - DNA, 611 bp, Oryza sativa
aaatggccataacttggccatttgaactcggaattggaccgttcaagtctctaatttttccttaagaagtcaagaacccattttcgtgtagatgctgcagcttcggaggatccgctcttcgtggaagttgaagccggcgtttgggaaagcgagcaaggcaaggcacatcatccttgaacatattgaatcccagtttataaaattattctgatttgaattattgcattatcgctttatttaaattcccgcgttatcactgttttatttagccatgcctatttatcattgttaagacattattattgctattgttattattaccttgttcaccctaggaaaataaaaccccaactagtgggtactctatttatggttccactagtatgaacttaggtagatgcttcgctggttaattaggcaacattaggtggttttataactttagactttgggaaatctcatatcatttggacattatggaattgttggattatggtggaattggacatacccctctcttcctctttcaaagcccctaaaacctgtttttcggtggggttttggtgcatgccagttgtgggaagtagcaccccgaccaatataaggattaa

SEQ ID NO: 21627 - DNA, 1501 bp, Oryza sativa
atgtcaacattgtcgtttgtgtaccccgaccggtcctggacggggattttaatgcacattctgcttggaattctattcagaaatttctgggcgtgacaatatttatacccatagggagatactagtccttgtcgaacaagaaagaaactaaaaatgaaaagataaagtccttatcggacactaaacacactttactaaagataaaatgaaactaacaaactatgcctaattaatagataactgtcatgtcgcatccttcttgaactcgaactcctctagataagcttcctttgattgatccgactccaccaagaacacgacatcgtggcgacttcactcccatcggccgattctagaactttgaagccgatactgactctaagccgatggtaactttgggcttactaaatttcaatgttaacactatcatgtaatgtcataaactaatttatagaaaatagatgtataaaaataatggttttggcggaactacaccactacttagtggtctttatctatactgttttaaaagaccttaatgatagtatctacttatgtgggttcatgctgtcagtgtgaccacggctaggggtgaaaacggtacaaaaactttccagattccggacatattttcaaaaacggaatttgtcggtcggaatttttcggaaacggaaacgaattcggaaatattttatcagaaacggaatcgaaaatgataagggcagttttcgttggaactcggaatcgatcagaaactttccggaaattttctcggaatttccggaaattttgtgactgaaataccctggattccttttgtaagcactgaatagtgaataccatggtgtttgtctattatttttttaaaaaaaatatttgttatgcaaatctgaagttacataagaatattttttcctgcattgggatttatcaacagtattactctcttaaacataaataatttatttcatagattgtgttttgtgatgtactgttgagacttaataattggtcttatatggttgtgttttatgatgaattgttaaccgttgagacttgataattggatttatcaatttgaggggttttcgtattccgataaattttcattactgtattcgcgccggttcattttcgctctgttttcggtttcgataatatttgattccattttcgtatccggggtttccgattccgatacccaaaaaaaatataaaaacaaaaatgataaaggtggtttacgtccgtttcagtaccgttttcacccctaaccacgcctctacttgaaattcaaatcagtgaatccaccatctaggagtattactctacatcaaaaggtgagccatatgaaccaacatcatctattcccatgaatttcaaagaaagtatgaatttttaattaacattggaaaatgtaatgaaatattttttttatttttttgcaacgcgtgagcatttagctaatagtagtagtatagatacagagtattcaaaactaatc

SEQ ID NO: 21628 - DNA, 360 bp, Oryza sativa
gtgaaatacatgtacgaactcagtaaaccgcttgtcaagcttgagctgctgcagtccctacccacacaaatgtacaagttccatcagctgtacatggagatgagcaccaccggtagagagatgatcggagcgacgatcagggacacggacttcttgcaagaagatgacattctctggatcaatttcaggggaatctacgaactataccagctggacgccctgacgtctctattatgagttgctggattttgtaagtatatcgttcagttagatttcttactatacgtctcctttaattaattaggtccttctatataagtagactatagaaaataatatactcccttttatcgttgtaga

SEQ ID NO: 21629 - DNA, 1501 bp, Oryza sativa
aagcgggtcccaccagggaccacgcggtatggacctggcccaccagctctctctctcccctccccgcccgcgcgcgcgccttttggccgccttcttgggccggccggcccattaagctcggccgagccgccccattctctcgggccgcgccctagccgcccgagggaagtctaatttccctccctccttcttttcttttcttttctttttcaaaaaggatttaaataaatccttttcctttagaccagaaatccaataatcttagaaattcaatatcttcccaaccgtaagtccgtttgactccgttcaagttccaaaattcctcaaatctcaagatctatctaatggcacgcttagaggtcaataatagggctttattagttgtcccgtttcgcgtgtagtttcggagcccgaagacccgcagtgtgaggatttcgaggatcaagttcaagatatcgagcgaggcaagccacctttgaacatcttaagcctatatttgaacttaattatgttgcttgaaaaatattatgcattgataggatcacacttaatctgcttgtcccgtttgcaaggcagattggcggacctacctaatttgttgcatttgacccttctattgtaattgttataccatgttcccttgtactcacctagttgcgccttggtaatcgtgcactctgcataggtatcgacggtcgccttcaaacttaaaatctgagaaacatcttgggtaaaacttgggttttacaaaagacttggaaaaccctacacctgggtcggtgcttgcgaactaaatgaattttcaaaaccgcggaccggggaacgtacctggtgtacggtttcccgctcttgcacttaaggaccgtttccttggaatttcatccgaacataagacaagtacgaccacatgggtggaatgggacacccctggctgagtaactagcttatcgggggagccatgatgctaagagacatgtggattcgccggggtggtgtcggggaggacccctgggcttcctggcacagtatggtctgggacctaacctggtgttggtctaggacccctctcgttggcatatggtgaacccatgtcggctttcgaaatgccttgtcatgaaagccttaaggtctctagtcgtggccgttctgcacgggctggatgatccgggttagtaatgtcgtgtgggtaaagtgtaccccctcaacagaggttattaaaactgttcgaacagccgtgcccacggtcatgggcggatgtgaggtgattcctagcgtagttttgtttgactactgccttgtgaaatttgctgttgtggaatgggtttgatgtttggaaaatctgcggctgatgggatcagccaggcccgggtggccgtttgaaagctgttggccgggtgccaatcttgatcaattcaaaagactgaatcattgcacatactccgaccggacgagacgcactgtctcatccatgtcatttgagaagcactcccttagttgtttc

SEQ ID NO: 21630 - DNA, 1501 bp, Oryza sativa
aaagccaaccagagggggtgaatggttggtataaccaaaaaccgaaaacttttagcggaaataaaagttaccctcgaaatcgacggatcgcggtctgaccgaagtagatgcatcgatctgaccacctggatatcgtcggtctgactaaggttgtaacagtggtcgaaccaccgagatcaatcgccagctccagttgccgccgccggtctgaccgcaggtcacccgccggtctgaccgctgccttgccgccggtctgaccgccggagtgttgccagttagaccgccgaaacccagtgaaacacaaatcgaagaactctcaaagtagatgaaaactttattgcttctctctgtgtttacaaagtgcaccaacagcactccttacaaaaatctcgactaaactcgaaaccctaactaaactagcaactctattgctctcaaaaaccgatacaaaaagcgataccgggaggcctcatgctccccctctatttatacatgaggtaggcagcctaaagcacgaaccaaactcatactaagagtccaaaataccttaggaaaccctctagtacaagacacaaactttacataaccaatcatatcaaatttggtgtccttccaaattcgactctgcatcccatacgcacacaatacctccatcgtatgccatatggaatctccatcaaccacgtgcatcaactctagccttagtatcccgcatgatatctgaccaccacggacatcgtcttaccaccaagctgactcccggtccatcaccgcaatactctcccgagacatcgagtcacctacatatgaaacaaacagagaaaccatattccgagaccaagctatccccaacttgactcattgttagcaaacatcagtattacatacgtatagtatccatctagaagccataaccatgaaataatcacggatatccaaagaaacaacccgaaaccgaaaccgacacagcgtcggccggtcagaccgcgggcctggccggtctgaccgcacacatagcaccggtctgaccggcaacctccgcccggtcggaccggtcacataaaataacagtgaatccgatcatcacctgaaaattgattatctacaaaaccacttcgacgataatcttcaaatatcaaaaccaataatcacaaatgccaattgttcatcacagaataagaatcaaaacacacattgatcttatataaattgcatataaatttgttccaaaattttccctctttttttccctcctccatgcacgccactgacattttttccctctttgcacgaaaattgtcgagtgatttttacaatttcaacgaagacttgaagatgactacttgggcagttgggcttcttctgacgctacgctttatataagtgaagggcactctgccaaggccttgcatccgcgctacagtgggtcatcgtcttcactgcacttgcagtgtcatcttcaagctgcagtgaggacaaaggaaaaaaaagaaagaaggca

SEQ ID NO: 21631 - DNA, 986 bp, Oryza sativa
agatgaacataatttgttctagtgtacaaaccgttgaaaaagtggatcatccttacatataattcataatatttaattgttgattttttagaaaaagtatttaaatcatagaagcaatcataaaaaatcatataaataacaatgatgcacacatagttatatttagccattgtgttctcactggattgcgtggactctttactcacactctgctcgaaaagttatttgatgggttgtcttccacactgtgcaattgaattggactttacgagcctgtgcattaagcataggatcatgtccaacccaaatccacccattaataaacaacaagaatataataataataataataataataataataataataataataataataataataataaggaatagtactatacatgacatttaactatgtacaatctgttttaactcttgaattattttggagaggaagacagacaaatatatctgtgtattgatgaaatggataggatcaaccactcttgaggtgaggacgagagagggggaaacctatctacctatccagctcatcatgaatctgggacatatgttctcctttaggctgaaggaaactgccctatataaagcctatacttgaccctatactatacttacaccatcagtataactctttctactcttgctgtgacaaggggcatgggagatggagagcagtagagctagtagaagccttcggtgatgcatagaaccttgtcctttggttttttacgagcatatggctagttctatggatagtacgaacttctgatgtctagctacggagtagatggataagtgatttatgtttggggtaatgggttagtctttatgtaaatgaactgtgagatactttctcgatagaaatagggtacttttagatacttccgggcggccgccgctcctcccgctgcacgttgacgacgccgacgccgccgcacgcctctcctccctgcagc

SEQ ID NO: 21632 - DNA, 1376 bp, Oryza sativa
atcccctaagtaaaataatcgatgcgcacagttttgcctggtctcctgctgttctactggtgcgtcccacctagtcaaatatacaaatctttgacattaattgatatctaaatttttcatgtatggcattagctgctagcaacatactccctctgttacccctcctaggttgtatttttttaggacggaaggagtaggtagctagttgacgtgactgtactagagaaagagaaccaacatgtaggtgtgctttcatgcattagtccagcatgcatgcatgtagccacggccaaataactagccactgaaagtactaacctttacactaatatatctactaaaactactataaaacatcaaataggtgtcggcactgtaggtgccggttttactaaaaccggtacctataagccttttcccacctccgtggtccgaaaacataaaaaaggcatctttaagatgttataggtgttggttctatgaaaaaaacacctataataaattaaaggtgtcggtttttttaaaaaagctggcccctttctgatcgagccatgagccgagccgcctgaggagcggataaggaaaagcgcctcggtctcatcgagcagataagggagactgcgcctttctcacgcgtctctctctctctctctcggtctcttctcttcctttctcttctccaccacatacctcctcttctcttctcttcctcctctctttctcctctcccggtggcaggaagagcggcaggaggagcggcgacatcggtattggcattgtcagcagctgcagggaggagaggcgtgcggcggcgtcggcgtcgtcaacgtgcagcgggaggagcggcggccgcccggaagtatctaaaagtaccctatttctatcgagaaagtatctcacagttcatttacataaagactaacccattaccccaaacataaatcacttatccatctactccgtagctagacatcagaagttcgtactatccatagaactagccatatgctcgtaaaaaaccaaaggacaaggttctatgcatcaccgaaggcttctactagctctactgctctccatctcccatgccccttgtcacagcaagagtagaaagagttatactgatggtgtaagtatagtatagggtcaagtataggctttatatagggcagtttccttcagcctaaaggagaacatatgtcccagattcatgatgagctggataggtagataggtttccccctctctcgtcctcacctcaagagtggttgatcctatccatttcatcaatacacagatatatttgtctgtcttcctctccaaaataattcaagagttaaaacagattgtacatagttaaatgtcatgtatagtactat

SEQ ID NO: 21633 - DNA, 1501 bp, Oryza sativa
  unsure (1)..(1501): unsure at all n locations
cattaggcttgccacagaatgggctagcctgcgccatcatgatgaggctggacttcaagtcgaaatccacgtctcccatgttgatctgcggcccaatggccacattgtcagcagagggagcagcgaattcgcggagagtcttgtttgctacagatctccaggaactattgcagatgagcattggcatcctcattaggcttgccacagaacgggctagcctgcgccatcatgatgaggctggacttcaagtcgaaatccacgtctcccatgttgatctgcggcccaatggccacattgtcagcagagggagcagtgaattcgcggagagtcttgtttgccatagtcttgaaggtcggtggcgctggtacggctgatttctctgtcggtagagttttctgcggagcagcgactcgtggcctgacactccggaagaaagcttctggattttctttgaagttttccggcaagttgaaaccagtcatgcactaccctgtttgcacaacaaaaagtgaaaacaaccaaggttagcctgcaaaggaaaatgattatacagaggtaaatataaagtataagttcaagtaatctctattatgaatcttccccggcaacggcgccagaaatgcttgttgatatttcttaacgacattactagaaatataatccccggcaatggcgccagaaatgcttattggtatttcttaataacattactagaaatataatacccagcaatggcgcagaaatacttctgatatattatggttacagagttcatccgcaagcgcatagatataccattgtagcatttcacccgagagtattccaagggtatcgtatttattttatctcgtgagaagatcatgtagagggaacattgactaataatttatacattacttgtgatgatcatattctaagcaggggttaagataatccaagggtagagtgacacacaatcattcactactcattctcataatatatcatctaagctaagtagatagaaaagaggaagaaaatctattcctatacttctaatatacatagtatacatacattctagttaaccgatatactagctaataccctctatccgatgtcctcctggtacttcgagaagccacccctgactgccgagttccttacgacagcccgtcatgaccatacaaccggggctaaatatggaggaataccctccctaggaaattaacttaggattatataccggcgtggaggaatacccgtactgagctgtcaccatcagcggcccacctctcatccgcaatatataactccaaataatgatatcccgtaatctagacaccacgcctaaactaccagatactactctaatatcatcgtcatgacatagtgtcgaaacatgaattcggcaataataaaacggnggtagcgcacgagaacctaaaagtggatggatgtggagacaaaggatttagacaggtcaggccctctcaatgagaggtaataccctactcctgtt

SEQ ID NO: 21634 - DNA, 1501 bp, Oryza sativa
acacaactcacaagagtttgacaaagttcaatggaatgacaagcaaccaaaatgtatatggtttaatcatgatagcacatttttggctctggtaggaatttatatcaaatgaggaactctcaatttatcattttgaaaaacaaaacatcctgaatgaaagtcaaactagtatcaggatcatagcaactcatatttactatctcatatctcgcaacaacttagacttagatcagcaactgcagctcatttacctcaggttcccggataattgttggctactaatatttaacctttgagagagcatttaccaagaacccatatatcagagatatagaacagagcaactattcatcatttcaacgaagagaactagcttgtcttacctagcatgacttaaacctatcctatctttttggtattttctattttgcaaatttttatattgttttcaagttttataagatgcaagtggaaagcaaatatgcaattggaaagggaaatatacaatgtgatacaagttaccttagtggagggagaggtatatccccccaagcttggctttcgctcagggtccttgataaggattgaacccctgaaagcgaaagtacgcttgtaggtcatcgtgctgttgctgcatcatgttgatgtggtgaactgagcatcagcagattgttgccattcttacgtttgagctatgtgttccgtgaggttgtactggatctcccctgtctgcacatcaagggtgtccattctcctagtgatttcacccaagtcccaacgagaggaacttgagcaccattcacttagagatggaggcacaccacatgatctgggaggttgattgtccccccattggatgtcatgaggcgcatgccaccggtcctcactggcacttgcccaagttgagactccgatgctatggcgtggagcttaggtccatccgggtgcatcctcggttggtgcccaacctgcctcatacatctatacggttggcaacgggatttcatttgtacaactgggtaaaaagtaaatcaaagatccatctactccatgtttcagaatattgccttgcgctagataagcctcatcaatacacggacgagcggctgagataaaagcaatttggttgctaacgacccctagcccttttgctatccaagtaatcaaagaagtgcactcaacaggagcagagaactttatactttctaaccattgccttatcatacatttcacaggagtaattttaatttttctaaccgtggcaaacatgattgacggagcgtggggctcctcaccgggagaccgcgcaggcccccctttgccggttcggccgggggcgctaagtgaggttcttcgccctcgatatgaggaatgtcagcgagaaaaagcgcacaagacacgggccacgtagacaggttcgggccgctgagaagcgtaataccctactcctgtgttctggtggatctgtgtgtgaaggaaaaccgagagctccagagccaga

SEQ ID NO: 21635 - DNA, 306 bp, Oryza sativa
ccgccgaatggtgtttccgcttgcacggctggcctttaatgccgccgttgttgggcgtatacgtcttcacagaccggccgcctcgtccgccgcagattggtgcttccgcctgcacggctggcctattatgccgccgttgttgggcgtctacgtcttcaccgaccggcttgcattcaccgccgccgactggtgtttccgcctgcacggctggcctttatgccgccgttgttgggcgtctacgtcttcaccgaccggcttgccttcgccgctgccgactggtgtttccgcctgcacggctggccttta

SEQ ID NO: 21636 - DNA, 218 bp, Oryza sativa
atcccgggggggcctgacaggcgctgacagcatttgaaccgggactaaagatgatctttagtcccgattggtaacacaaaccgggactaaagatcaaatatgcccgttacccttttgaaccgggactaaagatcatctttagccccggtttttattgcatccgggactattgtggaaatcggccgaccgacaaagatggtttctccaccggtgggaga

SEQ ID NO: 21637 - DNA, 1501 bp, Oryza sativa
cgggaccacgcgggatggacccggcccaccggctctctctctcccctccccgcccgcgcgcgcgccttgggccgccttcttgggccagccggcccattaaggtcggccgagccgccccattctctcgggtcgcgccctagccgcccgagggaagtctaatttccgtccctccttcttttcttttcttttatttttcaaaaaggatttaaataaatccttttcctttagactaaaaatccaataatcttagaaattcaatatcttcccaacagtaagtccgtttgactccgttcaacttccaaaattcctcaaatctcgagatctatctaatggcacgcttagaggtcaataataaggctttattttcgccgtttgctgagttgtcccgtttcgcgtgtagtttcggagcccgaagacccgtagtgcgaggatttcgaggatcaagctcaagatctcgagcgaggcaagccacctttgaacatcttgagcctatatttgaacttaattatattgcttgaaaaatattatgcattgataggatcgcacttaatctgcttgtcccgtctgcaaggcagattggcggacctacctaatttgttgcatttgacccttccattgtaattgttataccatgttcccttgtatacacctagttgcgcctcggtaatcgtgcactctgcacaggtatcgacggtcgccttcaaacttaaaatctgagaaacttcttgggtaaaacttgggttttacaaaagacttggaaaacccgacagctgggtcggtgcttgcgaactaaatgaatttccaaaatcgcggaccgaggaacgtaccgggtgtacggtttcccgctcttgcacttaaggaccgtttccttggaatttcatccgaacataagacaagtacgaccacatgggtggaatgggacacccctggctgagtaactagcttatcgggggagccatgatgccaagagacatgtgaattcgccggggtggtgtcggggaggacccctgggcttcctggcatagtatggtctgggacctaatctggtgttggtctgggacccctctcgttggcatatggtgaaactgtgtcggctttcgaaatgccttgttatgaaagccttaaggtctctagtcgtggccgttctgcatgggctggatgatccgggttagtaatgtcgtgtgggtaaagtgtaccccctctgcagaggttattaaaactgttcgaatagccgtgcccacggtcatgggcggatgtgaggtgattcctagcgtagtttttgtttgactactgccttgtgaaatttgctgttgtggaatgggtttgatgtttggaaaatctgcggctgatgggatcagccaggcccgggtggccgtttgaaagcttttggccgggtgccaatcttgatcaattcaaaagactgaatcattgcacatactccgaccggacgagacgcactgtctcatccgtgtcatttgagaagcactcccttagttgtttc

SEQ ID NO: 21638 - DNA, 1501 bp, Oryza sativa
caggagtactcagcaagccatgggaaataagtgtttaatgtaggcttcaaagaaaggctgttgtttttgcgattgattttatttaaactcttttctgaaacaactaagggagtgcttctcaaatgacacggatgagacagtgcgtctcgtccggtcggagtatgtgcaatgattcagtcttttgaattgatcaagattggcacccggccaaaagctttcaaacggccacccgggcctggctgatcccatcagccgcagattttccaaacatcaaacccattccacaacagcaaatttcacaaggcagtagtcaaacaaaaactacgctaggaatcacctcacatccgcccatgaccgtgggcacggctattcgaacagttttaataacctctgcagagggggtacactttacccacacgacattactaacccggatcatccagcccatgcagaacggccacgactagagaccttaaggctttcataacaaggcatttcgaaagccgacacagtttcaccatatgccaacgagaggggtcccagaccaacaccagattaggtcccagaccatactatgccaggaagcccaggggtcctccccgacaccaccccggcgaattcacatgtctcttggcatcatggctcccccgataagctagttactcagccaggggtgtcccattccacccatgtggtcgtacttgtcttatgttcggatgaaattccaaggaaacggtccttaagtgcaagagcgggaaaccgtacacccggtacgttcctcggtccgcgattttggaaattcatttagttcgcaagcaccgacccagctgtcgggttttccaagtcttttgtaaaacccaagttttacccaagaagtttctcagattttaagtttgaaggcgaccgtcgatacctgtgcagagtgcacgattaccgaggcgcaactaggtgtatacaagggaacatggtataacaattacaatggaagggtcaaatgcaacaaattaggtaggtccgccaatctgccttgcagacgggacaagcagattaagtgcgatcctatcaatgcataatatttttcaagcaatataattaagttcaaatataggctcaagatgttcaaaggtggcttgcctcgctcgagatcttgagcttgatcctcgaaatcctcgcactacgggtcttcgggctccgaaactacacgcgaaacgggacaactcagcaaacggcgaaaataaagccttattattgacctctaagcgtgccattagatagatctcgagatttgaggaattttggaagttgaacggagtcaaacggacttactgttgggaagatattgaatttctaagattattggatttttagtctaaaggaaaaggatttatttaaatcctttttgaaaaataaaagaaaagaaaagaaggagggacggaaattagacttccctcgggcggctagggcgcgacccgagagaatggggcggctcggccgaccttaa

SEQ ID NO: 21639 - DNA, 1501 bp, Oryza sativa
acacaggagtccggcgtgacgcataggcattggagtgcttttaatgggcaacttttgttctttagtaaagcggctcgttgtataatgtttatctagatcatgatcatatttcattatctgcaaggcctacttgcgttggaaagttgcatgggaaaaaaaaaaaggcagaaatcgtgatcaatggaacttttgttgatgatggtccttcagtccttgcatgtggattttgtggtaccaatctgccagcagcacaacttttccttaggtttataaacggcttatatatagtaatatcgtcgattttaacttaggatcataagaatgtcgtgaaatgtacaggtgacgatcgaccatcctttaaagtgtggtggcatatatattaacaaatccaagtaaggtccattaaacaacacaacaattctcagtgattttgcaaaatatatacaataacctaccaattttataaaaagaaaggaaaaaaaagtgcaatgcgaacatagctttaattgtagatttgtaataatctggatgaaaagttaaaaattatacatctgaaaatgttgttttaaaagtataaacatatttaggattcacaaatagatgtcactaggtaattccccgcgctttactgcaggaattagcaattctcaatatattttttctcgacaaccagagtaaaaaagggaacacaaataatgaaatataagagtttattagtacttatcatgaaacaatcaaatgatacccgtgcttttatatgaaacatattgataattatatgttaaaaattataaaaataatagatagatttgttaaaatgttatgcaaatatttacaacatcatatataatttatttaattgtgggctataactttatagaaagtatagatttcagatgtataaacttaaaccttgaaatcttaaagcactttgattagtaaagatgataattgtagattggtcctgaaaaatacttctatataattatatttttaatgatctctatgaccaggcatgtgaataaaaatgtaatgataagacatcatacacattggagacaatgtcaatggaaacggcaaacaaaaaaaaagatctggtatatatgtgattagggggatcatcaatatcaatcaattttttaaactgcacgattgcatccaaaggtcacaggttaatttttttacgatcatcaaaagtaaagaatccccaccagtataaaaaaatattatcttcaaaagcattaaaataaatctaaaagagatcgtgaaaagaatatgaaacactgatgctatactagagttggaattaacttcacaacatatatatgaactcttttggatcctttcttttgtgaaagcaaaccctcatcggtacaactgagaaataattaagtgtgtagtaaaaaaagatgaaatgaagaacagaagagcaattaaatggagccttccattccttcgatcgatcaatcgatcgatgaggcatgttagctttgctagaagc

SEQ ID NO: 21640 - DNA, 1291 bp, Oryza sativa
aatatgataataactgagctcaaacttaatcactatagttcaatctggtgtaaacctcatatgccattggtgtcaacggtcgccacaattatttgacttgtcattttcatcttatatccattgttcttccaccaatatgacaagctgcattttaacacagagtcccgcgcaatttcaaagtacatacttcgcaaacatggatctgacctactaagggagagcaacctctctgagtctgcaatggtggatgtttggctggaagtcgagtcgagccatttcgacggcgcgatgtcgccgatcatcttccagtgcttcatcgtccccatgttcatgggtggagcaactgacattggagtggtcaatgagagcttagagaagctgaagaaagcccttgaagtctacgaggcgcagctgtccaaatccaagtacttagccggggatttcattagcttggcagatatcagccatttcccgacggtttattacctgctggcatctgcccatgcttctgtgctcgaagcctatccgcgtgtgaaggcttggatcgatgatgtgatgcagaggccgagcgtgaagaaggtgacagaggctctgaagatgccgtctgcttaataaaaactgaagctatacagtttgtagtaatgaactcaatttcagcgttgcgtgacatgatgcagcagtttgcatcatctgtatgactatattcgtctagaaaaaacgtgttgtttgttcattaataagcagtgtagcgcctatatttatgagatgcatgcacattatcttcaataaatttatatggtattgaacttttcactacagcttatgatgagataaatatctgtcaaactgacaaatataaacatgcatctatattgataggattatttttctatgcctcctttgtggagctacaggtaatgaaaagttatagtacctatacaaaagagtaatcgagtaaaaagaaacctttcattgaaaatattagatcatttttgccatgcaagcaagtcctcttggaccactccaacactatacatgattaatatgagtcgataattgttcaatccaggttttatcacttaattagctgacctacttcctcctttcacaaggtaagactttctagcattgcccacattcatttagatgttaatgaatctagacatatgtatgtgtttatatttattaacatctatatgtatgtgggcaatgctagaaagccttacattgtgaaacggagggagtatgaagtaacatcatggaaaaacaacttcttgtatcaagccaacag

SEQ ID NO: 21641 - DNA, 163 bp, Oryza sativa
aatatgataataactgagctcaaacttaatcactatagttcaatctggtgtaaacctcatatgccattggtgtcaacggtcgccacaattatttgacttgtcattttcatcttatatccattgttcttccaccaatatgacaagctgcattttaacacagagt

SEQ ID NO: 21642 - DNA, 984 bp, Oryza sativa
aagtcaccaagaagagtttttctgaagaggaatgtgggcacggggaaagtgcccatataattgctaggctcctaaggcatagcagttatctttgggacccggttcttatccccacccgggagtaaatatcttttcccgctatttcgaaattctttttaaacccggttagggttaagaaccgggactaaagattatagcactgcatatgattttcgcttacatatgtgtttataaaatagaagttaatgcattaacattatttaaagtacaaagattaatgacaattacttcgaaaaattatttttgtctgtaataaatgaagtggataaatcgtaataagcaaatataattaataaaaattccaataatcatatatacttagcatatatatgaatgatattattatattggtaaaaactctaattaagatatgtatgtacatactgcatgatttaaaattaataaaaattgtaatcatcatatgtacttagcgtaggaattatattaaattacatgctaaaaactctaattaacatatgtaaatgccacatgcatgatttaaaccttttaaaaattcgaatagtcatatataagtagcatatgaaagatagtaaattaaattgtgaaaaactctaatatatgaatgatagttttaaaaatatgttaaatttaatacttttaaaaattctccagtcaattataattagcatatgaatgatagtaaattaaatgttaaaaactctaattaacatatgaaattgccacttgcgtgatttaaaacttttaaaaatcctctagtcaattataattagcatatgaatgctagtaaattaaatgttaaaaactctaattaacatacatatgaaattgccacctgtgtgatttaaaacttttcaaaattgtaagtatcacatataactagcatatacatgatttaaacttgttgaaacctctaataatcgtgcgtaattaacatatgccata

SEQ ID NO: 21643 - DNA, 1501 bp, Oryza sativa
aatcacttgatttaagtatatatcaacgtaaggattatatattgttaatatctacagccgatcgagtagatttagttctttcttacttgttaataattgcagatcgatgcaaatatgatatcggctcaaagataaatgatatgtcatcggcacctagctgatcggctatcgtttatggatttaaccacggtttctttgtcttcgtttcttgttgattgcaggatcaaatcaactggcacgctcatacacccaaaggcaagttttggacctgcattggagttaagcagatctcccaggcctcgtgtttttacatcaacactatgactatagaacttgctagacatgagtatggtattgaattgaggtgttgtagagctcatgccttttgagtcaagtttactgaatgtataatacatctggtcgccaccttcgagtgatttgaagggcacatgccatgcagaagttgattggcacgcgtgagtcccagcaatatcctttgtgcttaatattcgataccatgtaaattatattgaacggtgtttgattatgatcatggggcgcattgagacttgagtggctattatgcgcgtatggattgcactcacccgaaaccatgtgaaggtcacaataaatactggacggtataattcttggcatgctgggcaacccagcccagtgaaaacgcaagtatttatttgcttttgtttgtgaaggggggacctcattaatttaagcatgattgatcaattgccatgcatgcatatcatgcggcaaccgaaaggggcatgtcatagtagcaagtacatgttagtgataaaagtatatggttgttaaagatgtattaggaatgattgatttgtatgtattcttttcttatctgtaatccttccttatatccttcccatgtactcttatatataccggctcctaagacttaatacagcgtgtctaatattcgtagtatcttcccctctccctatactatacagtcaggttgctcatcggagatgatagttctgacatgtcattttgccagtagttcgctctagtccaaccatatctcgaactaacttcgtattctcaaattcaaaaacacgaaattcagaacgcacaactccaatttcactggtgtgcacgtacgtaccctagcgtcgtcactggagaaaatataggagaagatagagcagcgcatgcagcaaactgctccacgcgcgcttggcggtagcccgcatatgcgtgcacgttccgccatgcatgcgcgcacaaatctatagaaacaaattataccacaaattataccgtaccggatggtgattctacataatcctcaaggttttctcaaaactcaaccaatccaggcaaatactccatctcgatcggcttctgtgttctagatcagccatgtcgaagagatctcgatcagccatgtcttcggccggagaggaggtcgaggcaagcacgctcatcaccctaagggtcaaggacaacgaaggtgtcagga

SEQ ID NO: 21644 - DNA, 1501 bp, Oryza sativa
aatttgtggtataatttgtttctatagatttgtgcgcgcatgcatggcggaacgtgcacgcatatgcgggctaccgccaagcgcgcgtggagcagtttgctgcatgcgctgctctatcttctcctatattttctccagtgacgacgctagggtacgtacgtgcacaccagtgaaattggagttgtgcgttctgaatttcgtgtttttgaatttgagaatacgaagttagttcgagatatggttggactagagcgaactactggcaaaatgacatgtcagaactatcatctccgatgagcaacctgactgtatagtatagggagaggggaagatactacgaatattagacacgctgtattaagtcttaggagccggtatatataagagtacatgggaaggatataaggaaggattacagataagaaaagaatacatacaaatcaatcattcctaatacatctttaacaaccatatacttttatcactaacatgtacttgctactatgacatgcccctttcggttgccgcatgatatgcatgcatggcaattgatcaatcatgcttaaattaatgaggtccccccttcacaaacaaaagcaaataaatacttgcgttttcactgggctgggttgcccagcatgccaagaattataccgtccagtatttattgtgaccttcacatggtttcgggtgagtgcaatccatacgcgcataatagccactcaagtctcaatgcgccccatgatcataatcaaacaccgttcaatataatttacatggtatcgaatattaagcacaaaggatattgctgggactcacgcgtgccaatcaacttctgcatggcatgtgcccttcaaatcactcgaaggtggcgaccagatgtattatacattcagtaaacttgactcaaaaggcatgagctctacaacacctcaattcaataccatactcatgtctagcaagttctatagtcatagtgttgatgtaaaaacacgaggcctgggagatctgcttaactccaatgcaggtccaaaacttgcctttgggtgtatgagcgtgccagttgatttgatcctgcaatcaacaagaaacgaagacaaagaaaccgtggttaaatccataaacgatagccgatcagctaggtgccgatgacatatcatttatctttgagccgatatcatatttgcatcgatctgcaattattaacaagtaagaaagaactaaatctactcgatcggctgtagatattaacaatatataatccttacgttgatatatacttaaatcaagtgattgggatagatcggtcgccatgccgagacagtataaatcacttagatcgaaataaatattaacattgagagtatatatgttcatagcatagccgatcagatagatctagcttgtatcggctaatactccgataccactctatattaagatgttaaagcaaatagaatataccaaacagaagcctaatctacttaaatgcaacaagatc

SEQ ID NO: 21645 - DNA, 1501 bp, Oryza sativa
catgcttctctatggcgaccaagcaatgacctcaacagagttaggggctaattcaccaagggtgatgttctctagaggcgaagaggcgaagaggggcgcgaggtgtcgctcgaactcctagagggggtgagagtcgaagcactagaacacatgcgcaaatacgccacaaacacttcggcaaattacgacaaaaaagttcgaccgacagagctattgcctggccatctcgtcctaaggaaggagaacccggtggtggtcgggaagcttgaatcgaagcgggaagggccgtacctcatcaagcacatgtccaggacatgctcctttcgcctagcgatgctggaaggcgaagagttcgaccattcctggaacgcggcttcccttaagcgtttctatgtgtagcgcgggtggcacccaaatcgctaacttgtaaaaatgtacatactgttatgtaagcctttcggcactatgtaagcccttcggcacaaaaatgcaaaaaaagaggaaaatgaaaaaagaaaaaaaaactggatgtagggctattatccactctggaggcctgaaccagtataaaatatttgtgttttttgccttttttgtgtgaatgataatttgtggaaaaaccccaaggcaaacgcctgatcagcgaaaatgccagggggggcgaaacgaatcggccgaagcatcgctcgctgaacgttgaaactgtcacgaccggaaataacccaacgggcgttccttacgtgcgtgcattattccttgtcccaggaggcaaggtacaccaaaagttgatacagttcagagtttaacaagcggaagcgtaaatagttaatttattacatgggcggcgaaggcccagcacacacaaagacaaacgggaaacagcggaagactagggcgacgaccacaggcgcttgacggcaggcacgagctagacaccaaagccttcatcttccaggggctcctcttctgggtttgggaaaaattgtgcaagactgagtacaaccaccgtactcaacaagacacaaccacaagtgcaggataaatgcaagggagtacaagggggttataatataaagggttagggtttgcagtaaacagcattaaaagacacttagttgctcaaagctattttgtaaacacgattctagagctatacaatattattaatcaaggccgtgaacccacacgaacctgccttaacccaaggcctacgatgattcagaccgaactggcaacccgaccctgggtcccagctcgtcccaagccaacccaggccaaccattccacattttagttgttaagtaggttttaagaattaaaacactaacttgggtacattgctcggcttgcccataaccgagggcgcagctattcgaatagattatactctgatcagaggtgtacatctttacccacaagacacatcttcctcacgtgtaaccacgtgccacataccaccacggtatacggacggaagacgtgacatagtttccaacccatc

SEQ ID NO: 21646 - DNA, 1501 bp, Oryza sativa
agctctgattcagtacataatctagttaatgaacaactcctcaatttaagctaaacctactgaaatttaggtgcctgaatttaagttgtcatgttttaaattttgctctagtactgaaactgcagcgactgaagttgtagtgactgtaggagtattctagttaaagatttgggattgagatcccctgacataacttcctactgatttggtggttgacatgtgggcccgagagtggtggagctcacatgtcaatcatagtgaacagtaacatcagaggatcctcttcccaagatctgatgttgctgtccatctcaattctagcaatgtcctgaaatcctaaataccttctaaaaactgaagttctgaatttatttttgaaattcaagtgcaaatgatttctgaaattcaagtactgaaactgagttgtgatttaagttctgaaatcagtcctagtatattaacaaaaccaattttcgagcgttagttctgaaacatgaaaatgaactgaagagatcaaatctgaatttgtactagtgcttgttctgaaatctgaaaatatagttgtgcttgttctgaaatctaaaatcttaagttgtacttgtatttgtcctgaattttaacttcagttctgaaatctgaaaatgcagtagttcttgttcagaatcattaaatcagaagttgtacttgtttgttctgaaaatgtttcccccaaaataactggatatttttacaagtacatgaatgaattaactttctttttgttatatagaagcgtcagatcaggatggggctggagctatggtacatagaggtgggattgataccggtggtaagccctctatttgtctgattgctacagttcatagagcaaaactaaaactctagttcatgagtagtagtaattttcaggaatactcaagttcaagttgtcaagttatgaatttttttttctgatttaattagttttgagacatggaatttaagtccaattcagtacctggacctaaaatcctgtttttgctcaagttttgattttactctagtactgactttatagtgaatatgtactgaactttgcatgtaaaatttatgatttgtctaattcaggttcaaacgggagaaagtaaccagatgacttaaatatcacaattaatttagagttgttggcgaagaccaatccaccggtgttgcatagtagtctaggaaagttgcagataaatttgatgtgcctctcaaagttgtggagacagtggcgcaatgttcaggaataattatgtgatgatatatgatgaagcacaaacatgtggcctttttagggctactagtgagcgtgcacatacaaggcatgtcgatatatatactaagcgaagtatattggagaacaacacatccattgttgatgcacaactatatatattaatacattgtagctcacatgcaccgataaaaataaaagtattgtaagcgttgctttgataattcatcaaataaacgtaaattg

SEQ ID NO: 21647 - DNA, 378 bp, Oryza sativa
gactacaatattggtgccagttttttttgttgaaccggtgcctacagtgctaaaaggtgtcgatcttttatttttcattgtgcgaaggtgggaaaggcttataggtgtcgattttaattgaaccggcacatataagacgggtctctacacgggttttttatagtgtaggtgttggtttaaccaacacctatgggatgcgagaaaggtcaaaagagagaccaccgcttgtcgtagagaccacccgcggcctccccttgggcgccgctgcccaaccaactcccctctcaccggatccggcggaaggaagggcgccaccaccgcgcgccgcctcctctcgagcgccgccgcctgcctcctgccgcctcccctcccaccaga

SEQ ID NO: 21648 - DNA, 738 bp, Oryza sativa
caattttgggtccagttttgcatcttgtcggttgttgccgggaccttgaaaaattgaatcgtctcgtcatcgggtttccgtttttgtgatttggagaaatttttatcaaacggttttggagttgccgtactgtgcgcgtgcggggagtactgtacggttgaagagagactccagattagatcagatctatctgtgactatctgtattatcctctttatagaattgttaagcagcggatctgagatatttttataaaaacggaacctacatgatatgagcaattcatttttgagatgatccaattttagttttgcactttgcgtttgagtccctgtaatattcatatttacatttgagtccctgttggaggtcagtggtcagtttttgttgaaaaaaaagtaaaaaaaaggaataaagaaagaaagaaaacgcagaaaggtgcaaagaaaaaaaaaagaaaaaagccgcacctaaaaaaaataaaaaaaggggcagaaaggtgcttaaaaaaagccgcaccaagaaaaaaaatcattcatcctttgagtatgttatcagagtgcagagttgtgcattgattcatatctagtctttagaggtgtcgggtgcttgcttgagctagagttgagtctaggctaggccagcacattgactagtactttgaactattattcaactttgtattttcttattagcacaattgtgttcctttgctgctatatattgtgcctttcaagc

SEQ ID NO: 21649 - DNA, 420 bp, Oryza sativa
atagtacatcataaatttacaacgtgcaatgggaatcagaggaaataaatcataagagtcaagtctgggttattattctctgcaatttgcagatggatacatcgtaaatttactacttgcaatggggactagaggaaataaatcataagaggtaagtccggttccatttttctctgcaatttgcagatggatgtattttgcacatcatgtattgcaatcactacctacttcatatttatttaatcctttctagcatgtgcatatatacatcagaattgaacagggatatatccagttttaatatttcccccaaaataggtatatatgcaattttcatacaagtacactgagtaaatggtattaagccaggtgtagctacttacacaaccccagatcaagtgaccccaaagcacccagcca

SEQ ID NO: 21650 - DNA, 434 bp, Oryza sativa
taccagcacgttaattcttgtgttggcgaatgccatagtaaatactacttggtttagccaactgctgtaattattgtttaagcaatttgttccttgtttgtggcaataatgatctcttctattctgaataaatattcaattgtatacagccaagttgatcagatttcagaagcaaagttacctgaaaaataaaatgcttcgatttgctccccttagcctgcagccacgatgctttgatcttgtaagataatgaagacgaataactaatcttggggatcatgaattgatgccattctgaatagaacgaataaataaataaaaatattcagttgtgcagtccgatttgattcagaactagagtagagttacctgataacctcgcctgaggtcgcaatgctttggagctggagcgccccgtgtcctctcccacccca

SEQ ID NO: 21651 - DNA, 1501 bp, Oryza sativa
tatcaaaccatatccaagaatgcctgtttcaacagattccacatgtccaggtaacataacatgtatgaatgaccaattaaaaaccatttcgtctatggcaaaaggaaatgatgctaccagtgtaatctactaattcaaatatctagattatctcattctcttgcatatcgatcctattgattgattagcattaggccctgaaatgtaaaggtggtgacacatctgaagcaggtttttacctgatctgatctgaactccggagttcgcatccggtgcccgaaagaaacttgcttcgcttgcttgcttgatctgaaccaccgattcccccctcctcccctccgtcaatccatccaaccgtgggccgcgaccagccagccaccggagacccgaccccgatcgcgtcgccgtcgcgagccagtcgatttcccaaaggaagatcctgatacccgaagaaagatctccacgatttggatggggaggaggcagcaacggagcgagtcccagtaagggggagatctgagagcagctgcggcgagcgggaggagagtggccgccggcggcggcgcgccggcgccgggagagccacgcgccgccgagaagaaacaaaaggcccataaatcaaccggcccaacaacaatgagcctcacgcaaggtctcaatcccattagttgggccacacgaaagtcgaaatatcaaaaaagtccatttcgagtccctcaagtggagggagttaatgtggactttttttaaggccgcacgtgaggtgtaatcctgttcttgggccgcacgtgatcgagatctcgttctgggcctaactagtatgaggccgcacgtgcggaagccgcaatccccattgaagccggcaatcctcgccgccgtcgccgcccccgtcgacggcgatagcctcgccgccgccgccgcccccatcgccggcgaatcttccagtggtttggtttgcttctctctccctctctgcactgtctccgttcatcgtacaccacaaaaagaaattgggggattttctactcaactcgggcaatttccaccaagctactaatttgccatgtataggaaacttcaaggttgaaaatctctgcaactgagcgcgtattatcgtacaggctgatgtgtttgccaaaaagtagggaaacatcaaggttgaaatctctgaatctgagcgcgtattaacgtacggatgataacactagtcatagatacttgtagggtttgaatttctctagccaatcacaatttacaaatggggactagagcaaattattaagagtcaactcagcccatttttcaattccaagtttgcagctggatatatctgcttgcatcttgacttgcttggattgtgatggatgactaataacagattaaagagaaccacacctaattcatacatctatttaaactattctagtgtgcatacatcagttcatcccaagaagaagataacacgataggcaaagaagggatagccatagattcttgttgc

SEQ ID NO: 21652 - DNA, 292 bp, Oryza sativa
ttagcaggcttaaaggaaagcaatgaaccccaccaaaagatgcccattagtgtgtactgagaactcattaggtccgcagtaatgatccaccgagtgtggagcaacagtaattcaccaggccatccaccacctggtgccacttaaaacttgagcccttgatttgatgagctttcaatgaccaaagtgacatagatctaactcagatgcatgatttatttgtagggtccattcttgtagactgacaacaagctgttcaaatgactactgatgaacatcccttgctggtggcagg

SEQ ID NO: 21653 - DNA, 421 bp, Oryza sativa
tcctgacctcgagtcaaaattttttcatcttgatctaatgcatccttctgtctacaaggtacttatcaaatactgcaattcagatatgcagtaagcagtaacgacacatgccgatgtttttccttggggatttgggttgcctaaactattgtataagatgaatatatttgtaggagaatgttgatttgttctgtcttgcattactgcttctctggtggttaaagttaacataaaaaaaaaacaggcgaaaaaagcttttcattttcttgttttctaataggactggttactgctaaattaggtgaatagcaattatcttatttgacctctgtaaatatcttatgtgactgttctacgtttcaggttggacttcaatttttgtctggtgttatatcaggtggcaatgcttgttgcgtagcaa

SEQ ID NO: 21654 - DNA, 1501 bp, Oryza sativa
tgcttggaacgagccttaggtggggttcttttctccttaagataaagataaagataaagcttaagttttttacgcaaaatgaggtggtattaatgtatgattgattgagttttaattattacaaacttaaaaaatagataaatatgatattttagagcaactttcatatagaaagttttcacacgaaacgcaccgtttagcaatttgaaaaacatgtcacgaaaatctttatttttatccaactcttactggagaaatggacgggaccttaatttagtaatatgcttctaggccatttgggagccccattgagtacccatgaagagatcggaatacttcttttttaattactaacaaacatctcatagtacacatgaacagaaattaaataatgcaactacatataattggtgctgtgacaagtgactactgccaaagtactgcttttgtctccttttttttttcaattcaaatgcagcttctgttcccctcgtgatacaaatcgattaattcttgcctatgtccagaaagattgatacggtcattagaaaaacataaatcgaagagtattagaagagttctttttagtattgtcatcttaatcgacacacttatcatatatcctacattatataataagaacccttttctcccatacacacaaactcacaaagcaaggtggccattagtatatgattaattaaatattagctataaaaactttaaaaataaattaatatgatttttaaatcaactttattatgtactccctccgtcccaaaataagtacagttttgtactattaacgttcaacgtttgaccgttcgtcttatttaaaaaatttttatgattaacatttttattgctattagatgataaaacatgaatagtactttatgtgtgactaaatatttttaattttttcacaaatttttcaaataagacggacggtcaaacgttaggcacggatatacacggctgcacttatttagggacggaggtagtattttttaagaaaaaaatacatcgtttaataatccaggaattgttaataatccaggaattgtgcgcacataaaacaagagagcacaagttaagaacttgtagttccgaacacaccctaacacagcctcagcacccttctaacatagttctgtaacatgtataataactttgcaagaaacattgtaggctatccctttcttcagcagagaagaaagacaaaaagaccaatggaatctatcatgggtaggacctttatgttaccgaaaaaatggggctttatgacatatctattgagtttcatattgaaactcaattaaattaagtctccaatactcaactgaaaagatatgaagcgcatgtgttcatgtacaggcacacttgaattattgttactctgtttatgaaagtaaacatgacttgagacatgaaaaacattaaaagggatttgtcacgtcaaaataattgatgttgggttcacaactactagtagcaagca

SEQ ID NO: 21655 - DNA, 1501 bp, Oryza sativa
aatcgtcctacttctcaacgggtagttcgatcggatttttgtttaagggctccatgataaattgataagagctaaaaaaattaatgagatgtgtgtttatccttgtaaagcatgggcatattagctagtaagtgaaaaagaaactggggtagatataaaatgagcattaatcaatcggtgataggtctggatgtacacctctaattacctgatttaaatcttctttactacaatttgcattggatgactatttcttctccattaaatggctcttcttgttgcacatttgtgttcttcataactctatttatgtcacatatgactatcatctcaaaagaagtatttctctctaaagaaagaaatcagaataaagcccatatatataatggtcgtagaagcaaaggaaggccttgttaattgggccttaatggatcggcccaaagaaagcaaaccaggtccatcaaaaaccagcaaagcccgtcgatgcaaccgaggctcccactctccctgcacccggtccatgcacccatcccccgtgaaccggcaccctccatgtgggccccacctctcctcggtccatagaccgggtccacgacaaaaaactccctcctcctcctcgcctcgtgctctccgccgcctcgtttccatctccgccgcgctcgccgcgttcacactataaaacaccccctccccgcgccgccgccgccgcagcagccgccaccgccgccggaatccgagacctctcgccgtcccgccacgcgcgcgcgcgagcgagcaaagagagagagagaaatggccaccgctgccgccgcctcgctgcagtacgcgctgcacggcgccgcctccgcctccgccaagcccagatccgccgcgccaggcaggagcgtgcgcgtggtcgcggcgaggaggtcggtgcgggcgcgcggaggggcggtggtagcgcgcgccgcggttacagttacgtgccgggttctttgttcttgttctttgttcttcgtcctctgctcagaattccttaactgaattctgaattctttgtgtgtttgcaggcgagtgcggatgcgacggcggaatccaagtccggcgggtaagttgtttctctccttttttccattttattttcaaaatggttgtgttgctcttcacgaagagaagagatcaggagaacgcctggaattctggattgattcagactggggaaacgattcggtttgttctagatgcaatcgtataagtggagtagctttcctgccatttttgacgattactactgtcttgtgtgtggattgtatagctcatatgaacagaattactggctttttgtggcttgtaaagttgtaatccgaagctttattgctttgctgtgcacctatgcttttaactttggtggaaatgagatttattgatttagtttctctaattagtggtgttaactgggaggcatgaacaaagcagcctgagttttttttcccctagttaatttatacacacatgttttcaa

SEQ ID NO: 21656 - DNA, 750 bp, Oryza sativa
cctcattgtgtatggaacatctgtgagcaataggttttgattcttctgtagtacattatccgctagtaaatgcaggtctccctctgccatgttgattgctctgaaatatatatacttctgctgctactcggatcagtgcattcaaaagaacatctgcttaatggtgatcgtactagaaactttagagaacaaattaaaacgaagccggagccggagttcagtataaaccagtaaggaagaaactaacatatttttggacatgctctggtaattcctctgttgctgaactgatccaatatccatgaagcatttgctgctgaatgctggcttcaaggaaaggaattatcagatgagcctgattacactattacaacagtctttgcttgcaaagatcagtgcttttaatcagtaaccaattcttttttcattaaagaggatatagagtacttcctccatccacgaatataaggaattataggttatttactagaaattaaggttgaggaatggtcaggaataatatgcgaagaaatttgaattggaggtgatttatgggactagtaatatctcaagatcctttataattgtggataaatacagggctaaaatcttgtatatttatggaccgagggagtatgtatatatcaaagtgttgatatgaagacatgaagtaaccgagggtaaaggaaatctgaaatcatcagtccatctatcagagtctaatataaagcatcagtccctgtcttcagg

SEQ ID NO: 21657 - DNA, 1501 bp, Oryza sativa
aatgggccttgagaaaagagaatgggaggtggactggtggcccaaccgcccaacaaatataattcctttgaaaataagatctatagataattctaaatatgattttaactgcacagaaattttctgatcaatttattagtgtataaactaacctataggttagttgacagccacggatttagctaccgaggagctgaaagtggtgctatatattcgtaatgatctggatgtgatttcattgctcaatgaaatatccactatctacaaaattcgtgatgatcatctcattcacaaaactttggtgttgttggtatgccatgaacaatttgataagaaaaagctgagaagaaatgaatggaaaataagtgtaaagtgtttataaattcaattccattccaggaatataattgttcttttcttttcttttctgaagtggaaaataattgttctgcacacaccattcaattccaggaattttaaagatttgcagggcagcttttgattcttattccacaattcttcatttcacatctacttcctccatttcatattataagactttctagcattacccatagtcatatatatgttaatgaatctagacatatatgtgtgcctagattcattaacatctatataaatgtgggcaatgctagaaagtcttataacttgaaacggaggtagtatttgttttttcatgttccttagcttcgtcgcttaatatccagagttcattggtcatataagctgggtatttgtattatgtcaaaaagcacaatttccccttatttcacataattttctaacattgacaaatgacaggtaactcaggtggcccactaattgactcatatggtcatgtaattggagtaaatacagctacattcacacgtaaaggtaatgctcctatattaagatcagcactgcctaaatatcaaaagatgtacagctcacatgattttcatttgcctgctttaatctgtcacgaagagtataaaatggaccgatactttctgtttttatgcgtgccacattttgctgtgcattcagtacaaagattctagtcattgagaatcctttgttgggagaaaccaagaataacagaagtaactgtagagctaacagagaccatgcagcatcatgccttgttgaatccttttcataagtcctcgttcctgtatgatgaaaggaatagttaacagactgtcaggatcaaaaattaattctccttatcataatattgcccaagcagcaggcaaagtcttgttaccatgtagtcaatacctatggtcaaagatcttttctccattctgccttgatttgctgggaagctagattttctctagaaatacaagttgtggccttgctgagatatttcattagaattgaatagttggttcggtgtcgcattgttatttggtgatactgataccctatgcaggtcaggttatgcgatgtaaaactatctaattcaaaccgctgttatccccagcattttctg

SEQ ID NO: 21658 - DNA, 583 bp, Oryza sativa
tcctgcagccctgtttgctacgttcaacataaagagcagtatcatatcatggccatctagtacagaagatcacacgagctggcaatccacaacagccattttcttgtgtgtagtacatccggtttccttaaattgagtgaaaagaacaaagaactgaaacagataagtgttttttttccttttatttcttttttattttgggagaaaggggtattacccaacttctgttccaagctaataattgtttggacaggtacagaaaatgctggggataacagcggtttgaattagatagttttacatcgcataacctgacctgcatagggtatcagtatcaccaaataacaatgcgacaccgaaccaactattcaattctaatgaaatatctcagcaaggccacaacttgtatttctagagaaaatctagcttcccagcaaatcaaggcagaatggagaaaagatctttgaccataggtattgactacatggtaacaagactttgcctgctgcttgggcaatattatgataaggagaattaatttttgatcctgacagtctgttaactattcctttcatcatacagg

SEQ ID NO: 21659 - DNA, 1501 bp, Oryza sativa
cgtttctaaatatttaacgccgttgacttttttaaatatgtttaaccgtttgtcttattcaaaaaaatttaagtaattattaattcttttttatcatttgttaaatatacttatatgtatacatatagttttacatgttccataaaagtttttgaataagacgaacggttaaacatgtgctaaaaagtcaacggtgtcaaatatttagaaacggagggagtaattgttttctttttaaaacaagatgatgatatctttttgggggtgaaatggagatggtcggtgcttgctcacaatgtggcccgcggtgtcccagacgaacccagagccggtcccctccaccgtggcgcccccctcctcgccgtcctccgcctccaccgcttgcccgcctccccgtcccggcgtccgcccgacgacgaggtccttgatgaacaccaccgacggcgacgcctcctgcatatataggaggaaaaaaaggtgatggtcggatcagcgcgttagggtttaggacgcggcgtgctggaatctactaccacctggaagaggcgcacaacgcgggcctcgtcgatgtcctcgccgcctccgccgccggggtcggcgcgggcggggcgcggccgaggggaggccgcgaggaggaggagcgccgctgcggcggcggcggaggcggaggaagcgcggcgtgtggtggcgaagggtggtgagttgggaggcggcggcggcggcggtggcggtggccggaggaggagaaggcggagcagcgggtggaccgccatggctggagtggcgctcgttggacgcgcgctatctgatgcgtggctgggagcgaaggcggtattgttgaaatacgccttcatctttgcaaagcgaattttgggagcacgccttgtacgtttcaatttcgagagagagtggaaaaaaaaaaggtttatgccatttcgaccagattctaacaatcagtagttatgtaaccacgaaaataaactaaaaatacctactagcttctcagaatctcttggctcaaccaagagtctgtttggggagcttctagcaacggtagattatcacagaatcttcagttcccccaatagtcgagattgtcaccaagattttgacaacatttagttatagaacccaaaaaataaattagaacctaggagctggaaaacacagcttctctagatttttcaaaagttggctaacagccagcagattctcataatcttgagctcctccaaccagggcgtaagattgacatgaacaccagcaatgtaagtaaacaatgaaaatgtttcatctcggagtagaaatttactgaatacgattgaattaatatggtggattcatttgttcttccaaatggacccaggtatgctcctagaaatgcagttagtttgatcattggcctaagaaagcttttaggttgtgtttagttcaacgcaaagtttggatttttgttgaaattgaagatgatgtgactgaaaagtagtgtgtgtatgacagg

SEQ ID NO: 21660 - DNA, 1501 bp, Oryza sativa
atgcttgtaatatcactccatttgtgaacaagtttagcgtttttcattagagcagcagtggttatatgtaagaacgtaacactggaagaacatgaacatgtagtgtgctgtagaattcgtgcttatcaaggttctatagttgctccccggtaaaagaaagaaagaaaacaaaacaaaacaaaccgtgtaagtttagtggtcatggatgaccttgttgtttaatttgtggttcataacaatttaaagttgagctaccggccaatagttgtgtaattttctgtaggaaaaactgaatgatgctgtaagaaatgatctaagcaacaaagaataagttggtcagagggcatggcaaggaatgccaatagataattacgcatccacgaatggttacaagttacttgctttgcttgatgaacgaaaagcattgtttaatagcagttggcactgttacctacttacctgtactctttttcttgcttaagcaatttctgcaagtcaaagacagctagctaatcaggaagcatatctttctttcaataatgcattcaactattcaccttaatttttccccgggtctattatatcctaaatatagtgttgacttcgactaataaaacaacacaagaaatacaaccaaaccttgcactgaacctattggcaagaaacaggtccacattcattttcttcatcacttcttaagaatcagtggttttttttagaaaatttaagaatcagtggtggcttactgtaagaagctaggggctatgcatgcgaaatgaacgtgcagtaaactgcagattggctagctagttaatcagtgcagttgaaagtcagcagactgtacagttcctaaaactattttcttctcctagttctctataaaatgcagattattacagctcctcagagttaattctttctaacaagatgaaagtgacatgcatgtatggcaaaagtcaccgatgcagttcacacttttcagtaaacacatggcaacattgtccaaactccaggacacagatcacagatgtggtggatatcacgaatgcaagttgcaaccagaaatcacatctttctgggagaaattaagatgtgatatctctatggcaaatagtgtcccctctaaacgtggtgcaagcaaagagagtagttgccctgaagtttaggagtataaatatatactattgtttgaagatgctaggaatcttcttgcttctaggtgagcgaatatctctgatctcttggaaaacaaagcatataaacctgaagtatctgaggcaggtatcccctaggagagtcagtatccagcctgcctgatgcggttgtctaccacgtgagaagcacggctcagccaaagtcttcccttattataggatctaaggaacctaatgtggtattgattaatcaaccaatagctaatttggggaaatatatattgcactaattacatattgcattggttctttagatgcatgcctctttccttcgtctgatcctataa

SEQ ID NO: 21661 - DNA, 573 bp, Oryza sativa
aaaattttgtccattgcaaggaggcctttttggtagcatctgtcaagtatatactcgcagcttggctatatgcagacaaggccggccaggccgtgtggccgcccgaggcccccaaaatctaggggccccctatatacacatatagtatatatactacgtaccgtataattttagttcatgagctatggctctatattaagttagacagctaaatagcctaatatagaaaataaattttagtccatcgtcaggcctgttttagcgaagccgaagcgatcttcatctgactcccgtcgcttcgcctcgatcacatcacaccactcacatcgtgcagcctcaatcacgtcacgtcgctcgctgctcctgcgctctcggcaacttcttgacttcttggcatctcgcaaacggaaacagcaagttggcaaatcgtggctcgctagtagccacgctcgtgtcgatcgtccgccgatcgccttctctgctcgctactgctatttatttctatttgaagttttaaaattttatatatagataattttatcacatcgaatattaaatgttgtgtgtttatat

SEQ ID NO: 21662 - DNA, 803 bp, Oryza sativa
cccgcgacgtcaccaccttgctgtgcctgtccttccgggccgccgccgcccgcgccacccggctcgtccgccacgccgccgccgtcgccgccgacgcgcccccgccgccgacgccgacgagcgcgccgcgcgggcgcttgcgctccttgccgccgacgacgacctcctccatggctgacgcttgcgctacctcatgcgaaatccgcctccgcttcgtctgctcaaatttgggggggaaaaggggataaaatttgtaaaaaaaattctttacgaaatgatagctttagaggtggcaaagattgcaaaaaaaaaaaaagatttgtgggagttcaaattgtccacaaaatcttctcagaggttgcaatttgcaaatatagtaaaatttggtagcccatttgctctcccttgatttgtaaatggattgtacattgcaatttatgaaaaagtaggagctttgtggaagaatctactaaaagcaaacataaatctgaaccttttgcggctgttcttgcagaattatttatggtgccaactttgctgtgacaactttttttgtcaaaacgaacttcaattagggctaacaacaagaagaataatcaaaacgtcgagttgattaaagaatttgtaatttgaggtcatgtatcagaagctcccatcttcccagagtcaaatctggcaagcaaatcaagaaatctctggacaaaataattccaagaaaaaatggggggaaaatagctttaactgaaactctcaaaccactatctttcatcagttcatcaccattttcctgcattacttaaagg

SEQ ID NO: 21663 - DNA, 689 bp, Oryza sativa
tagttttaggatcgtgttacaacatagcttgagcgactaaatgtctttaatgctggtttactggaaccctaaccgtttatgtcataattcccttgtactccatggcatttattatgcatttgtgggtgtgtcttgttgagaacggtggttgtactcagtcttgcttaattttcccaagcccagatgaggagttccttgaagatgaaggctttggtgtctagctcgtgcctgccgtcaagcgcctgtggtcgtcgccctagtcttccgctgtttttcgttgtctttgtgtgctgggccgttgttgctcgtgtaataattatatttacgcttccgcttgttaaactctgaattgtatcaacttttggtgtaccttgcctcctgggacaaggaataatacacgcacgtcaggaacgcctgttgggtgatttccggtcgtgacaagttggtatcagagcctcccttgaccctaggacgagccgtagatcccaagccttagcaatattttcaaaaataaaaatcctttgttatttgtgaaaacccgctattctctctctgtcttgctgcttcatttatcgtcaaaatctgatcttttaaaatgttgcttttcttttgtttttgtttgtagatggccggcagcgttacccgtcgtggtttggacatgactggcttcgtcttggagttgcggggca

SEQ ID NO: 21664 - DNA, 1501 bp, Oryza sativa
gagatatggaatgttatctcaatcgggcctaaagttgtggcccgtcactgataggggtcatccgtgacgggcttaagttttatacccatctaacatgtatgtgcgaccatatctcaatcggacacttttcagcccgattgagatgacttccttgtgacggcccgctatttctaagcatattagagcccgtcacagatagaagtatctgtactaatgaaacttgtgctctaggggttcatgattggtcacaaataatgtctctaatcaagcaagtcatgatagagagggcactatgttcaaagtagagatgatcataggatcaaagcatgcatataatatatatatatatatatatatatatatatatatatattagcaacagagatgatttttttaaaaaaaaacaattaacatcagaagcagaaaagttcaacggatcttgttgatgaaattggtgtgaagccccttacaatgtcctccgttatagaggtggtgtatcaaaggtggacagacaaattaaacaaaggtttggaacgttgcaacagataaatggccagtgtagcgcattaggccaatttggggaaaaaaaattggacactgctgtgcaggtaacactggcaatggccatggaagcatgacggtcactgaatgtggccatgttgcaaggcgaagcaaagatcaatggaagcaactcagatggttcaaatggatacaagtatatttgtgtcaagacagagcaacattcttaagtttaatgttaagttcggaggtgagcaaattgtagaactgcttcaagcctgtaatgatgtttttttattcccttctaactttggtccacaaaccctaaccttatgattatagtactaaattcatccttaggaccaccaccactaacttccatttctacgcaacaaattaaattcaccaaaacaagaaatacatacagttgacatgctgcagcctgcagctcgctaatgccattccttggactggtggtggccattacatagaccagagcaatatgaaaattctcaaacaaaagaaatggtggccattctgcaatatgaaaggggattatgaatatactgaatcacaatttcaaccaacttatcagtgtataaaacgctgatgatttttacagcactcccatacagatttcaaccaaatttgtgctgaatttgtatattatttcatatagatttgcactgagccacctagtctttcacaggctttgctcagagctgactcgagctgcagctgtagctggctaagctcatccattgtgaccaccaatggcaggtcttctctagttgcctcttcaagcttaacatatgctagtttaacagttcagatacctgaccatcatgaagagttgtttgctcactcacacaaaatcacaccgtttcaattcagtttttgaaattgctctgaaatctgtaaatgaaagaaggctttgttaattgtaacctgtaagcaggagccaggagcaaaaaaacagaca

SEQ ID NO: 21665 - DNA, 396 bp, Oryza sativa
atgttgctgttcctatctgcttgctcaaggatgctaaagttgatatatcggagaaatgtttagtagcaggcttaagccatgccaaattcaatcgttattcgttagtactacacaagtaaataacgacgtcaaagagggaggtacatgaaattctttatctacctacaaagtaaaaaaccacatgagagagacaagtgtgtgaattcatatctatcatacaaagagatctaggttgcatttcttcatatagatcctgtctcatcctgggtagttgtaacgcaaactttccaacgaatcaaaccagagcacggctcgatctggctgatgcatgtgtgacatcgaatccccggaaacaaagacgatcgtttttactactgttctatctcttcatctagt

SEQ ID NO: 21666 - DNA, 1501 bp, Oryza sativa
atctccatctccatctggcgagcagagcaggggaggggaggggatcctcacctggtcagcctctttctgattcatctctctctctctctctctctctctcccatcgggactggaatttgcttgcgttcgttcgttagccctagcttctcttctagatctggaagaagctcttcttttaatttcatagccttaaccttaatacaagtaacagtttgtttgttccccgaaatatttgggggttcaattgaacccccatgtcccaagttggatccgcccctgcttgcagaggtttattgctgtgactttgagggcttatgaaccatattctccttgcaggaaagtgtgggtaaagcgcagggcaacaagaaatggcagcattcctgaggtcaaaatgttcgtcaggtattgagatttgagaatgcctcaacgtttatatgattgtacggataggtttgcaaatgcctactagacacatttggcttgtgcaaagttaggatatatgttctactccataaacaaaccatggacaaagttatggcttctaacgatagctgttggttggacctaaaccagtttagattggcttttagcctaaattaaccaattgttgattacttttgggatttgatctagtgcgaaatgatgattaattcatagcattcaaacacgtgcacaattaaaattgttgattctgtgcgactgatggcctttaaccataataaaacagtatcttataccttacaagtgctcttacctctagttagatttttttgcctctgcctgatggcttaatatttttagcttatggtgctgtggtatgatgctgatctaatttgcatattgctcatggttgttcttcatctttttagttggacgtaccttgatgggaggccttgggaacaatctatttggagccgttaactcatctgttgaaacggtgtcaagaccatctcattgtgatcctatctttcaggtatgacttcttctatctagcagaaacatcttgacatcacttcttatagcaacttgaaaagtctaaaattaattaatggacaaacgtcttgttcttttcactagagaacccatggcacagtagacaagcatatatttattccactatgatgtggttttgttgatatgattgaataccttttattattttttttacgatcgacatcagggatttgctcagttgtcaaactagattgtttggcagattggactccatcttagtatcttatacgtttcttttttgtcgtactcttttagccattctttaggaggaatttttattgttcttatctcaaaacagcagggactccatgtcttggtattttaaaataaattttatgtgccctgctattcgtgcgacgataataggattgttgctgggtgccggcatatgtagttctttgaagttagttatctcatcatggatgttttccatgtggaataaaactttaactcgtgttctcattctggtttcagcaaatcagaacat

SEQ ID NO: 21667 - DNA, 1501 bp, Oryza sativa
accatattttttccttgaacaattagatattttcagataacaattatctatttttttggttgcacgaagaaaccatcattcttgattttacgacatagtatcctctccagttccataatttttgacgttttggacattaataattagagctataaaagtttgatctcaatcttgtccaaaacatcaaaaattatgaattggagtgagtagttgttctctaaacaaaatggagcaaattatcactataattaattagataatcactgcaacaatttatttggaactcaactttagcctaaaatctctttcataatcgcacatcaactcaccacactctatacttataatagctggtagctctttggtataagagagcccctgatgaaaaatttatgtaaagctatattgaaggaaaagaggttttcgggttagaaataaaatgaaaacattagttgtcgattgaaacagatactggaagaagcaaagatgatctctttttttttgtctttgtagttttgttaggtagatatattgtgcaaatggtttgtttgtgtattacacctgattttgattatcaccagctaaataaaatcttgatgtttatacgagtccttcattgatgtatacaagatttaggccctctattttgctagattttcttagaagcaatccaattcctacagcaaacaagaaagatttagacaacacaaatgaatcctccattgcaaattcagagttgttttgcttacaagttcattgtgcacaactaacatatgttgcctctaaccttctgcgatgaggcccatgccaagcaaatcaattatcccaaatcgtatttcatcgatgcagattaagacgttgcacatccttattgacgtagaggttgaattcttaattattttttgttttataaagaaagacagattgcatgtttgcactgtgtttgttccctgaggtttgcaacttctctcttccacacgtaaaatggagttgcttaaaatactagcctgaaaatttttaagcaatttttatatagaaaagttttggccgagtttagttccaaactttttcttcaaacttccaacttttccatcacatcaaaacttttctacacacacaaatttccaacttttccgtcacatcgttccaatttcaaccaaacttcaaattttgacatgaactaaatacaccgtttgtaaactatccatcagtttgagaaatgtgtgcgtgaaaagagcggggaaggtgaagaaagcaacacagcccctagtgggcccacatgtcggtctcggaaaccagcttccatgttagtactactactagccatctgatgatcgtcaagattcgtgctgcactgaaagaccgagcctgagcctggccccacatgacagcgtccctgaccaaacaaaaccccccaaacccttcgtctcctctcctctctcctctctcttcccaaaccctcctcctctcaccgccggcggcggcggcgcgctctcccgga

SEQ ID NO: 21668 - DNA, 1501 bp, Oryza sativa
agccacactacacttccaagaaaccctccaaaattagcaatgcctttagattcgtagtacttaaaaaaatgtgttttagatggaggaaatattttcttaaaaattgttaatttatctgtccaatatgtatgtcaggtttctctgtatagtatatagtgagcattttttctctagtttctttgcaataatgagcatgtcacaacataaatagcggatgtccagagaggagcatatcccgaattatcaaaaaccgtctacccctctgtcaaaaaaaaaagtccaatcctagttacgaatctcgtgcctaagctcatagctagagtttacctttttttaacagactagtatcacataattctcatgtaggcaccacatgtatcattgtaccatactatattttcacatatatcaaagaaccaatctatataggcaaataataataatctcgaggaaataaacaaagaaaaaggccgcaaatcactaccacgtagaagtaccaaccacctcatcgtcatcggaaaggagatttgctcccagcctgtttttatgcccagagatgtgaagacatcatatatgaacacaaaaaaagaaaccctgatcttctacaccgtggctttattcagccctcgtaacccgtatacagaaaaaagttgtcaaagcagctgacaagaagaggtgccgttgaccccacccgtaatccatgaaaacgagcccagtgacttgtaagcaagcaatgttcaattcatccacgaaaaaagcaacatgcgcattgaaaatgatccataaccgtgccgctaattcccagtcagtcactgtcaaaatgtttgtggtatattgtgcatcctttctaatcaacataaatttttggttggctaggtttggtattaaacctgtgactcgattataacataatactactacagtactactcccttcattttttaatagatgacaccgttaattttttctcacatgtttgaccattcatcttattcaaaaaatttacataattataatttattttgttatgagttgttttatcactcatagtcttttaagtgtggtttatatcttatatatttgtataaaattttttgaataagacgaatggtcaaacatgtaagaaaaagtcaacaacatcacctattaaaaaacggaggtagtactaatatgcagtttagaggccttggcaaactacaggcgctcctagaaaccgacaattttgacgtgtgttcttgtagtacatacaggctgtgctgcagttggatttgtcaggaggctactatacaatgattcaacgaacatgagcagcagcctcgtctgctcgtgccattttgtacttaaaacaaggcgcgattccggctgtcgatacggcagagttatcccccaagtttctttatccaaatcactcaccaatccagtgacaacgctagcttaattggttagtggactagtatatagtagtactgtatagctctcgcgtgttcactcctcagtcctc

SEQ ID NO: 21669 - DNA, 1501 bp, Oryza sativa
gtgacggaaaagttggaaatttgtgtgtgtagaaaagttttgatgtgatggaaaagttggaagtttgaagaaaaagtttggaactaaactcggccaaaacttttctatataaaaattgcttaaaaattttcaggctagtattttaagcaactccattttacgtgtggaagagagaagttgcaaacctcagggaacaaacacagtgcaaacatgcaatctgtctttctttataaaacaaaaaataattaagaattcaacctctacgtcaataaggatgtgcaacgtcttaatctgcatcgatgaaatacgatttgggataattgatttgcttggcatgggcctcatcgcagaaggttagaggcaacatatgttagttgtgcacaatgaacttgtaagcaaaacaactctgaatttgcaatggaggattcatttgtgttgtctaaatctttcttgtttgctgtaggaattggattgcttctaagaaaatctagcaaaatagagggcctaaatcttgtatacatcaatgaaggactcgtataaacatcaagattttatttagctggtgataatcaaaatcaggtgtaatacacaaacaaaccatttgcacaatatatctacctaacaaaactacaaagacaaaaaaaaagagatcatctttgcttcttccagtatctgtttcaatcgacaactaatgttttcattttatttctaacccgaaaacctcttttccttcaatatagctttacataaatttttcatcaggggctctcttataccaaagagctaccagctattataagtatagagtgtggtgagttgatgtgcgattatgaaagagattttaggctaaagttgagttccaaataaattgttgcagtgattatctaattaattatagtgataatttgctccattttgtttagagaacaactactcactccaattcataatttttgatgttttggacaagattgagatcaaacttttatagctctaattattaatgtccaaaacgtcaaaaattatggaactggagaggatactatgtcgtaaaatcaagaatgatggtttcttcgtgcaaccaaaaaaatagataattgttatctgaaaatatctaattgttcaaggaaaaaatatggtgctagtgaaaataagtaagataatgaaatattttttatcactaattcatggttgtcaacgatcttacttactgataattatttttgacggttaaagtcaacaaactagcttaaccaacaatccgaacatgtgttctaaccagaatacaaaggggaggggaaccatcgccacaatccaaccgttgctccccacatcaacggccgagatgtaaccttcctgatctcatcaccgacttaacaggaaatttttcttatttccaaaaaaaaaaaaaaaaaatctctcctctcgtcgcactcttccccccgaatccaacactaaccctaaatcgcagcggcgggcggcggcggcggcggcgcgatgg

SEQ ID NO: 21670 - DNA, 1501 bp, Oryza sativa
gctctaactgcggaaataagaaatgttacaaggcaaatgaattattttgagcttttttatactatacaagattagcaaaggaaacataaatggtatgttcttttggtacaaaagagaaaggtctaaaacttggaagagtgtaatcttagaaatgttcctttctaaaatgataaagaattatcaatgggtagagattatgcacgaatgtgacaaattcatacataccatcaaaaactccaaaaagaccaataatctgcccatcaacagagtcaattcttgtctcgtaaaagtcttccatggaagcccttttaccaggggagctcgcatacccatagctaaacttaccattctggctggcaaaaaaagaatgagaaatgttgagcaaataggagagcaacagtcctaataactgcatttacaccataaaatcaagctaccatgacaacgttgattaattggaaatagaatattattcataaagtcactactcctaaacttccagacgcagccagattgcaggcactacaattattacagttcactggttcaaaaagctagaaccggttgtgttgtgtggtgagctacaacaacatgacctattgtatatgctgttactgaaagaactaacatggcatgatgcaagatgtcatattcatagaaaatgcatttgagaaatgagggagacgaacttccagcttgcaactaacagtaccaaatgcccaaaccgtgcattactcattagtttccttgatctcaacccatagaatgtataagcacatctaaggtggcctcttaccttttgctatcatgcccattaggacgtgctacacttaataattctccaacgtaacatcacataagttcattttagtctgtattcagaataaccgtccaaatttattcgacgcaactgcttatgctcagatcaggtatgtagcatatgaatatcctacttaaacggacaacataactccaaactggatttatcttgtttatagtcccaccaaaaagtactaataaaacaaacaaaaatgggattgcatagcttatcccatactccagccttgcttttgagcttaaacagcgtgttcaaagcaaaggaaacccacgcgagcagttatacgaaattcgtgcgatgcagcaagcaacgtatcacacgcctggaccgtactgaattgattagaactaaacattcagccattatctactagttgccagattatccattatctaaaacaaaaactgctagtcgccagagctaagctagacaatcgaattgactagatggagtactccaaaaaaaaaacccagaattcgggtaaagcaaacacgaatcagacccaaaaaaaaaagcgcaaaaagaggacaggagaggcgtcccgagaatcaatcgctcccacctgaggccgccgccgctgaccggcgatccatccgtggggatcacggagctcaagtaccccatatcccccccctagatcacacgaacgcgaacgcgaccagc

SEQ ID NO: 21671 - DNA, 1501 bp, Oryza sativa
aataaaaatcatagtaaaacaaaaaagcacgagatttttgaaggagtaaaatgtatgggcggcccctaaacttgtaaggctatgtcatctaggtccccaaacttagaaaatacagttttgggtctctaaactcgcttagccgtacatcacctgtccaaattgcatttgagccagtctactcgccgacgtggactgccagcgtggaggggcggggacagctagggtgtcaaatatgcaaagaacccccctattccctcatcctagaaatcatatcgaatcccctgtccccattttttccccaccatgctgagcaacgaaatccctagcaagctcttggtcgattcactatccccttctttgattccctagtgacgctgtgacgacgtcaagatcaactagagctgcgtgcgattcgtcatgttctaccatggctacagcaccaacaacaactccgtcggtgtgtggccgtcatcggcaaggtttacaataccgctggtaaccgcgcggttacagcggttaccggccttaccgtgggggtacggtaataaaaataccacggtaacctccttaaattcaaataaattaaaaaataatttaaatttttgataaattttacatagtttcgtatggtttttcacgattaccgcggtaaccatgcttaccgccggggcgcggtaaccccgggcccggcggtttgggaaaccctggtcgtcggatccaccaggagctcgacgacgccaagctcggcactgtcgcctagcccgagcgcaactacatgtcctacaactactgcgcaaatggctggtgtggttacatggaatcccgttgattaattgctcttaatacagctgagaataaaggcatcatcttttacatcaggttatttcttctctcctgttgtagagcattggtgtcttgcaagcattttgagtttacatgtgcaagttttttcattgagatggaaatggatgtgagttttggtattgggaggatcaatataaggagtatttgacaaatacaggacatcttggctcttgcagcttctggtatccatgcaaaatgtccagctcctgttgtgcatgtgcagagaaatgaattggttgagctgggttcagacttcatagggacatgaacatgctgcagagcaacttgttaggactgaaatgtgtagtagcttgttgtgtatttgttgtggtgaccaagatgtgtactaccttcaggctagttgaaaatgtgcaattatctgaaatgtactgaaaatgatatttggcgaatgaaatgatgagggaatagattttttttttcatatttcacaccctagctgtccctgcccctccacgctggcagtccatgtcggcgagcgactaggtcaaatactatttggacaggtaatgtacggctaagcgagtttagggacccaaaaatgtgtcttctgagtttggggacctagatgacatatgtctataagtttagggcccgcccatatattatactctctttt

SEQ ID NO: 21672 - DNA, 1501 bp, Oryza sativa
ggctgacctgactgctgtcgactggtttcttcgcctccacggttgtacaacttcatcacttttgattggtatcactatcttcaccaccaccaatatttttgccacctctggtgggcaatattatctctatattggtcgtcttgtctctatgccaactgcgtcagctactatcaatggaccattgtaactacgacaaaaggacaagctatatgatcaggggcttactagctcaaacacaagtattataccttcaatttggacttgttccggatacatgcaacatgaattcatgatcatgggtctattttctatgctcaaagactggactatttattattcccagtaagggttatcaaccgaatacttgcgccagtcgggattcaattattatatctattttggagtatcccataagggataatcactcagattagaagctattcatatgagctacacttggtctatatcacccggaagatttattactcgagagcatgttacatgcgtcatcctttaaagggtgtcgaaggcatattttttggcctaggcctaatatgtctgcagcccatattttcaggtgtgacctgtcacgttcttttagggacttaggcacttttttcttaggtcaaagtgcgcgtgatcaagtgcccaataccttaaaatccttttataccacagttactcaactttttaggagttggtacaatgcatcttaaaaggtgtcgaacagtaaagctttatatagctgtcccgctgacttttttatatagtcaaggtgttgtttgggtttatcaagcaattgattggatacaatatcattgctttttgtcacgtaagtgtgcatttttatttaccaatattatggcttaggctgattatatattttggtcattttccaggcggttggtaaatcctttatgagtttatttactcggatgttacactacatatgccatatatttccatgtgtggtgaaaccatgtgtcttttagggacttaagcacatctgttaaagcagtgtgcgcatggtgtgtgcccaatactttggaaatttctttattcacaacatacaagcttctttataactattttgctatgtgaattttcaatgatgtagtcaactttaggttgcacgcatcatattctacaaagcagtcggtatatcacttggatcatgttatttagggattcacaccgtatatgctatcaagtcacttagttgactataattatcaagaatcactcagttggttggattatttactctttgactatatgttcagtttgctcaactaaccacatagtcgggggctacacctattaggtgcatctagtcgatgcacctaaaatttcatttaattatttttcagccctccacagtcttctgatttggtaaaagtactcgggagaccatggcgaagatgattgaagcacttatctttggagtaatctagttcgagaaaagattatcttttcgactgtgaaggtctcaggggctact

SEQ ID NO: 21673 - DNA, 368 bp, Oryza sativa
gcgattaaattgatataaaacctgtagttttgtgataactttgttactaaatctgtagttttgcgatagtccaccttatatttgtacttctgtgataaatttagtgttaaatctgtagttttgtgatacatcataattaggtcatctatcaaatggtgttcagtacaggattatattaagatcttttcactaggaccatgcaattggtcacaggaaaatggaacacatgaatcagagaagatccaagtaatcaagtttccaacaagccagaaagctagaaggcataacataaattggcacatattacacagttcagaataggttctgatgtacctaaaatgtaggggggaaagagaataggtcgagta

SEQ ID NO: 21674 - DNA, 1501 bp, Oryza sativa
cccttgcatgttcaacagcaactcgtggacgtggctgcgtccagtggcctgtcacaatctttgtgtgctctgctgtgcttcacaggaaaggaatgccatggccatttctagctcctctgcccgaaggactcttgatctgcttctttctcttgttgaggaaacagtttaacccgtgaaaccagaccatctaaaccgtacttctttgggctgggctgggttaacatgctaaatcaccttaaaccatcgatgaataaccacacttttcaggtaaggcttaacaaatcccacatcagcttggaatgtgccggatattggtgccatattttaaccatttagaatcatatccaaattttgaaccattagtgtagtgtttaagacaatcctatccatcattagctgaagactataatgtggtcccctagtaaacaggtaaaggcagtttgatcaaattttagggcataccttcgtcaaagtaaattgtctcttcagctcaagctccacagtatgaaactgtccaatcttcacatgatcgttctcagttatattttttccacgtacacgcaagacagatccctccttatcataatctacagactatgtgcaaaacaaaggagcatgtcagttatcatcaagaaaataggtaagttttgatttggaaacaataaggaacaaaactaataagagcatcactggctaaaaaactaaagacagcattattttttagtatgcaaggagaaatagatttctcgacctcttcggctgtggtgccacttagctctaagtaattcaaatgcttaagtgacgatgcttgttgcttgacttggggggtcccattactccattatgcaactctaaattattatttttctaaggcagaggcagaaattttgcatttaaaaagtacagaatttcactccaataatattatgtttaggtcacccattgtacagcctttgcggtttgttagattgtcaatctctttccagttcacgcattgtgtaggtaaactaggctctcttcccaaataatcaaacaatgacagtgccactcaagtctcaaattcacaggttgcaatccacataggttacatctgactgtaatcactagtataagcactcagtgcagatagaaggaagacagatgatatatcacctcgactacaatttccaactttaacctcacacgctcagcatcacgtcctccagatgccatctctctcagaactttcctgggaatcaacaggataaaaatatgtttaaggggattatgagttctcactgtgcactgaaggatctagatatattttgatggagaaacatagaagttcacaagaataaaggggacagaatcttcaagtaacacaaactacattaccaccaaggttgaagtatgagtatgatcaaagcctttcaagtaattttacatatctaatttttctataatcacataaaagcataatggcattgagaaattgttaggtttagtttttttaataaaatgg

SEQ ID NO: 21675 - DNA, 1501 bp, Oryza sativa
ctgctggctcccgatcggcgaggcgcgtcgctgggggcgtcggctacactggctcgccagccgccccccatcgccacacctacccctccggtgtcgacagtagccacaaccaccctcccctctcttggcttcttcctctttgcaagcagaagggggtgtccgccacccttgtctcccttcttctcgcttcctccctggcagctctgctgcctagttgtttagttgctttgcttcttacaccagtgctcctctctctgtgctagtggtgaagttggaggtggtttgtcgcagctgtaaggggtgtcctgcgaaggccggggtcctcgccggaaacatggatgacaccgatgccttcgatgccttctctcctccttgatgctcctccctttttttggccgtctgcttccagtctcggccgtggagtctttcggtggttgaggagaagtgttcgtctatgaaggtggttcagtctgtctgtagtcagggctcttgggcctcgcaagtgcttctagtgtcctgcgactaagtgaacctatcgtagtgccgagttggagcggtgtgcttatcttcagtgccagagttttgtgtttggcggagtcggagctgctgcatcgggcttagccgatgagctgggcaacgataacacaacacttttgctctggcccattgtagatcctcctttggagggagtctcgggtgaaagccctgtcttgtcttccagaatcggcaacatcgacgcttgtgggtgtcgtatccttcttggaggtgctgctttgtggactctctccccctttgggtgaaaactcagtccaatttttgggcaggcgtcggcagcggcttctgtcgttgttcccctccttggaggcttcgccttgaaggtcttgctcttccctcggtcacttttgtggttcggtcgtttgtcccaggcttttttctctgtcttctgtgtaaggtttcgtcagtttccctttagcaaactatgcagttgtaaggtttttgagcccggtttttcttattaacaaggtcaactctcttcttataatattccggtagatctcctaccgtcggtttcttcaaaaaaaaaatattttacctttcagtttataattaatgcattgtacatttcctctcaatactttggagttcctttagtaaaactggataaaaagtttgtttcattgacacatgtatacgaaataattaatttaacccctcctcccaaaaacaaacaaaaaaaaaccagatgattccttcactacatatataggctttgtttattccaaatccacaaaatcccaatccctaaaagtcactctcacagtcacacttgacaaattagacaacatccttcgaggtgttagtacgcacgcgtaacacacatacaaaccctcatctaactagcgaccgtctcaaaaaaaaagaagggaaataccatgtgtcaattttaggtttaggaggcattgggaattgatttcatccggtttctggtgatagaactagc

SEQ ID NO: 21676 - DNA, 1501 bp, Oryza sativa
aaatattagtaaatatataaaaaaataactaattacacatattgtgtctaaattatgagatgaatcttttaaacctaattattctatgatttggtaatatggtgcttaaatattattaatgacagattaattatacttaataaattcgtcttacagtttacatgtggaatttataatttattttgttattaatttatatttaatacttgtgtgcgtgtgtattcgatgtgacacgccaaaactttacatccatggatataaacactccctcaccctctatcgggtgcaaatacgcggaacaccaaggacctgggtgcaaaaacacccatcaccctcccccgacgaagcaagagaagcttccactagaaaatggcccaatcccgtcgcccccttcccctcctccgctcctcccaaacccaaatccgccaaatttgactcgcgcgaggggcccgattcgtggggcgcgcttccccctgctgctgctgctgctgctgctgggattcggacgagctggtcgcgttcgcgttcgtgtgatctaggggggggatatggggtacttgagctccgtgatccccacggatggatcgccggtcagcggcggcggcctcaggtgggagcgattgattctcgggacgcctctcctgtcctctttttgcgcttttttttttgggtctgattcgtgtttgctttacccgaattctgggttttttttttggagtactccatctagtcaattcgattgtctagcttagctctggcgactagcagtttttgttttagataatggataatctggcaactagtagataatggctgaatgtttagttctaatcaattcagtacggtccaggcgtgtgatacgttgcttgctgcatcgcacgaatttcgtataactgctcgcgtgggtttcctttgctttgaacacgctgtttaagctcaaaagcaaggctggagtatgggataagctatgcaatcccatttttgtttgttttattagtactttttggtgggactataaacaagataaatccagtttggagttatgttgtccgtttaagtaggatattcatatgctacatacctgatctgagcataagcagttgcgtcgaataaatttggacggttattctgaatacagactaaaatgaacttatgtgatgttacgttggagaattattaagtgtagcacgtcctaatgggcatgatagcaaaaggtaagaggccaccttagatgtgcttatacattctatgggttgagatcaaggaaactaatgagtaatgcacggtttgggcatttggtactgttagttgcaagctggaagttcgtctccctcatttctcaaatgcattttctatgaatatgacatcttgcatcatgccatgttagttctttcagtaacagcatatacaataggtcatgttgttgtagctcaccacacaacacaaccggttctagctttttgaaccagtgaactgtaataattgtagtgcctgcaatctg

SEQ ID NO: 21677 - DNA, 1501 bp, Oryza sativa
catctccaactgttaccttgatggcggccacgaacagtgcacaatcggtgagggcggcggggttcctatccaagatttttccgggcttgtccactcgtaccagagccaagagccaacatagcctcagcgatcgtgaaaatttctcgaagcaacgtagttccttcaaaatctgtttccatgcacatcacaacgtacggatcacgatcattactccagaatctgaattctgaaatttccacaaaatggatgaactgatgaagggaagtccagcctcgatccaagattcaatcacaatgtgccacatcggtttgttaagatggtcgtaaacagttgctggtcagaattcttgcttttccttttacaactttttttttggaacaattctgaagaatccttgtcccctgaaggcagaatccttgccttgccttgccaaatggtttagtcgatgacttgaggtccttctaactgttcattctgattctgaacagtctacagattaaggtgaccataagttttagatattattccaaggcatatcaaggaggcccaacctggaggatgtagaggccgttggtttttaatccataactgaaaaaaggactacctattgatacttcgacaaatttatgtcttcaaatcttacagaattttcaactaatggatatagctagttttaaataaaataacaaaaaagagagacaaatatgtcaaaaatcataaatttagagaaaagaactattgtaaaaatctagttttggtgaattgtaacaggatgcaagtgctatgtaactgagtataagtgcactgtaaatgagtataactacaagttagatatacaagaacacaaatcttaatataaagatcctatgaacgaaaaagtaaaagatagaaatataaaaatctgtcgcaagtgaaatactagcaaaaccgaaaaaaaaaatcaaggagccccaacagaatcctcactaaaaacaaaacgagacaaaggacggagaaacactgtcgggagaaaaactcggaagacagcactgaatgtctgaatttttggacttcttttatctaaccatcagataaaacaggcaactaaaacgaaacagcacaaatttaagagcatggaggactcagtgcacagtacgattgtgatcatcaagggcatgcatatgagcaaatgccatgtttaggttcggcgagcgagccttcgttgtttccatcactgtcctccatggccgtgctcacaaatagcgccaacttaaatcagcaaattaacgaaccactgaaactctgaaaacatacgaagaaaagaagaaaattctacttacaagccagaaattaaactcagactcaaaacatgaaaaaaaaacacaaaattaaacctagcacataagagaggagaggataatgatgaatagatggtaattaagcaggatgggtgatttattactccctgcttaatgaacagagcttagccttcttatatatagcactggtatcagcaggaaac

SEQ ID NO: 21678 - DNA, 1501 bp, Oryza sativa
ctgcacgcctgcaactgcaacggcaaccgtgcgtgctcccatccacccatgacagcgtgcgtacgtgctcgtctcacaccgaacaactctccatgtactatgcgactaccgttcgagtaaacccccctcgtcctacttacatgcgcgaggccgttgcgaatcaatcaacactggcgtcaatcaacaccaaacaattcgttcgatttcttagtttagtttagtttctcgcttaatactctattctaaagcacaagggaagcagccaggaaatggattagtgatgaccaaacggacaatcaacagtaacgctgttggctgctgacgactattttagttgacatgtccatacataaatacacataatccagagagatggccagctccgtgaccagcaaagagacaaggctggggtctgataaaagaagccctacctgagcttgacctccctgtctcgagccccccatactgcatacctcatgccatactctaatcagtataatccaggcattaatgagatgcatcagctttataatacaaagctaatgacatgccaatacatgctgccaaccttgcattcctccagcctacatatgtgtccatcgaaagatacaccattttggaattgccttctctctgcatttaggcacgcaccaaatccttgtagccatgggccatcactcacctgccctgcttcatgttagctcagatttcagcctctcaggaccatttcttgtgatgcatatatactaacttgttgtctcatatagcactagttacatgttcatggatcatatgtaataaactgccatcatcaaggatcagcctgtatatgctcatctctatcaatgctagaagtctacgattactaacaaaattagcactgcaacactcactgacagacaacatcaaatcaagctcctactatctgacgacaccatgctgtccatgcagctaggatggaggagataagccaacattcagacaccatcaccatgcgtgatgccgtgatgagaagaaaagtttgagcagctagctagcatgggtcatcagatcatgctgttagagcagacagcattggtcaatagtcagaattttgggtgttttcttgggtgttgggtcctcatgaccttcacctttgtcagatttagcagggatctaatgagcaaaaaattagtaacaaagaagcctacagcaagtagccaaatgttgctgtcccctctgcccctacctaataagcacaactactgtacactccaaacatctgctcactcacatgcatgtgacgtttatggtccacaaactacacatgattatggcaatagtgccctatgtctcggcatgttttgcataatggagtatggatctcaatcatgctaatggctagcttagccttttgtgaactaacctccttgcaagtagtattattcaggatggggcctggtttgcaaatatgttagagtgcagacaccatggcccatttctgtcgctgcaaccttcgcca

SEQ ID NO: 21679 - DNA, 1501 bp, Oryza sativa
acatgccgagacatagggcactattgccataatcatgtgtagtttgtggaccataaacgtcacatgcatgtgagtgagcagatgtttggagtgtacagtagttgtgcttattaggtaggggcagaggggacagcaacatttggctacttgctgtaggcttctttgttactaattttttgctcattagatccctgctaaatctgacaaaggtgaaggtcatgaggacccaacacccaagaaaacacccaaaattctgactattgaccaatgctgtctgctctaacagcatgatctgatgacccatgctagctagctgctcaaacttttcttctcatcacggcatcacgcatggtgatggtgtctgaatgttggcttatctcctccatcctagctgcatggacagcatggtgtcgtcagatagtaggagcttgatttgatgttgtctgtcagtgagtgttgcagtgctaattttgttagtaatcgtagacttctagcattgatagagatgagcatatacaggctgatccttgatgatggcagtttattacatatgatccatgaacatgtaactagtgctatatgagacaacaagttagtatatatgcatcacaagaaatggtcctgagaggctgaaatctgagctaacatgaagcagggcaggtgagtgatggcccatggctacaaggatttggtgcgtgcctaaatgcagagagaaggcaattccaaaatggtgtatctttcgatggacacatatgtaggctggaggaatgcaaggttggcagcatgtattggcatgtcattagctttgtattataaagctgatgcatctcattaatgcctggattatactgattagagtatggcatgaggtatgcagtatggggggctcgagacagggaggtcaagctcaggtagggcttcttttatcagaccccagccttgtctctttgctggtcacggagctggccatctctctggattatgtgtatttatgtatggacatgtcaactaaaatagtcgtcagcagccaacagcgttactgttgattgtccgtttggtcatcactaatccatttcctggctgcttcccttgtgctttagaatagagtattaagcgagaaactaaactaaactaagaaatcgaacgaattgtttggtgttgattgacgccagtgttgattgattcgcaacggcctcgcgcatgtaagtaggacgaggggggtttactcgaacggtagtcgcatagtacatggagagttgttcggtgtgagacgagcacgtacgcacgctgtcatgggtggatgggagcacgcacggttgccgttgcagttgcaggcgtgcagcgggaattttttttatttttaattttttttattaaaagttttacaaaaataattttctattttgaaaattgacggaagtagtcgcctaccgccctttgggaaggcgatttttaaaaatcgccctcccagagggcggcgaaaatgacgtggcagacggcc

SEQ ID NO: 21680 - DNA, 1501 bp, Oryza sativa
ccagaagaggagcccctggatgatgaaggctttggtgtctagctcgcgcctgccgtcaagcgcctgtggtcgtcgccctagtcttccgctgtttcccgtttgtctttgtgtgtgctgggccttcgccggccatgtaataaattaactatttacgcttccgcttgttaaactctgaactgtatcaacttttggtgtaccttgcctcctgggacaaggaataatgcacgcacgtaaggaacgcccgttgggttatttccggtcgtgacaagttggtatcagagcccccttgaccctaggacgagccgtagatcccaagccttagcaatattttcaaaataaaaatcctttcttatttgtgaaaatcctttagtctctctctgtcctgctgcttcatttatcgtcaaaatctgatctttaaaatgttgcttttctcttttgtttgtagatggccggcagcatcaaccgtcgtggtctggacctgactggcttcgttttggagctgcggggcatgtgcgttgtcctggggtatccgcatggagtggactaccagggcaagcggctcccggagcaggagggtgacgatgcagagccccacgctgcttgggagattactgcagtgatcctcactggctcacccgagaggacttcgttggtagtcaccgtgggtggagattccttctctgccgcttgccagaacgccgcactcctcgccatcggcactctccaccagtgctacccgaacgagttgcagcactcgccctaccgctaccacccttgccgcggaggagcccgcgactacgccaccttccgggatgctagctcggaggatgacgctaccatcatgcacctggcgcgcatggtggaggcgtacgacgcggcccatatcgacttccatcagatggtgcgtcgtgggttggtcgagaacaacatgaagatcctggagctgcgtcaggagaatctgcagctgaagaaggacctagacgcagtggacgcgcagctgcgtcagctcaagatcgcccagggagaggtctgtcgccccaagcgtcgccgcgtctgccgcagcctgaagatcaccgcccgcaagagtacctccaggcccgagcttgttcgtcagtccctggcgtggacctgcttcgtcgagacccctcgtgctgagcccgcgcccgtggttcctcaggaggatggagcctccggcgttggcagcacggaggatgtgctgctgctcaccttccgccctggcccgtcgcagtagtagacgagcagttagtaggcttgcgtgtgtgttcttctcgtttgtttttctgctagagtcgtatggggcatggttatgccggtgtgtggtataactgtgtcggagcttgtctttattttatttgcttaagcaacttgaactttaatgaaccaatttaatagcagtaataaattcaagaattatggtagtcgtgggtggttagttttaattgtcagctctctctgtttgctggttctgtgtggggttttc

SEQ ID NO: 21681 - DNA, 1501 bp, Oryza sativa
taatgatattagttaaaagaaacttggaaggaaacctgtgcggatgcacgggcacctcacttattatttatgaaaaaatgctaaaagaaatcatatctcagtacaaattatttaaataaatagaaaaaatatctatgttgtaaaatatacgtagacttaaatatagtaaatattactttgtcttgattatgaatggcaccaaggctttctttcatgctgcctctaaacatggatctcccattgatgtagatctactccttaaaaccagcatgaaccataatttcatattgtctaattcactatcggcatcctcatacataattgcatcgttaagtaggaagttgagttttatcgccaatcgatttaactatatgtatgttcttaccatacttataaaaatatagtaagctctgttatccatgctcgaggccctttagaaaagaacaaagagaaaacgaagatgatgacaatatttttttaatgttatgagttgttttgcagaatagcgtagacgtaatttatttatggtgttaatttatcaataatacttaagtttttattttttaaaatactatacaaacgcatgtgctcataatgccaacccacttacctccctatgtatgcgcaaccacatatcctattcttataatcacctccgaaagattagatcagcatatcttaaaattggtgaagtcagcaccaaagcaagtattcataatgcgcacacatataccttaccctatgagcaccttcaaaagattggaccgatatatcttaagattgatggacctagtcatttgtttacttaccgggtgaattgcagggaaaatatgaaagacatttgttgctgaaaaatcctgtgcgtgtgtgcaggtgcgtttcctttgtgtccattccggccgtgaactcttgagttcgtgcttcgattcagccgtgagtgttcattctcagttgacgcctattggtggccactaaaaactccaattcgagtacaaaaattttaataaaataaatggagataacatgttaccttatcgttgtttctttacactaatgggattctatgagttttgttggtctaacaggttttgcaagtttaggtcataaaatgtaaacatgtcgggatatttgggcttattcccaattgaattttgaaggagcaccaaaactacctataagatatgaaaccaaatcacatatttgagtataccacattgaagtcaacacgacgatagaacagatatatggtttgtctgatttggaatctggacgaaggagatacgataaccagaaaaacaagccatcttgccaagctgagggtggagagtatggggtcaattggaaggaagagaagtcacatggcaacccagattaggaagaaaaacttaactctaaattttcttctcaccttacctctatctctatcgtattttcaaaactaggaagttgattaggtgacgatacttaagaaactaccgattgaaagcaacagtgctatcca

SEQ ID NO: 21682 - DNA, 1501 bp, Oryza sativa
  unsure (1)..(1501): unsure at all n locations
ggagggagtattgatctatcatagtatttttttttatttttttataaatttttaaacaccgtgcataaaataagagaatattatctcgaggaacaaaattcaactttcatgctagtaggagtgtaggactgcagccatttcaactcttcatttactatatttttcccttttacgagatgtgtgtacacccttcatgggctggaactggaagccttgaattgacgcgatctgtgactgtgtaggcccgcattcggataactgtttcgtgtcagccgctcagctgcgctctggacactagctgctttttcacgcactgtttgtccgttgaccacagagacgaagccggccaggccttgcatttgttcagtccatcggatatcttttctcgttagccttgcattttcttttcccgggccatcagagatcatctgttcattcataaacgaagaaaatccagtttataaaagcttggacaatcccctagaatacatacagttatgtgtacgcttggctggaatccagtcctttcacctgtgaccccctacgagctgggttctcctttagtacggacatatttggtaaagctctatcccttaaatttaattttagaagtttggggttggagtagatctataagttagggttgaagtagatctatagagtagtatgaatccagctccacctctctcatttatttcgtgagagctctctaaccagttttacttttattttagatgaaaaggttacaactataagaaaaatgaagcttgagcagccgtgccgaacaggactttgcatttacaacgacgacgctgcactgtgctgtgcatgcgagaaacagaggggccgggtgcagcgcatgaagcccatacggcaggaagcacgtcgctggtggaccgcgtgcgttcgtcctgggcgcgagccgctgggccgtccgtcctggactcgcgtgtgggttgtgcagaaacgagacgtcaaacgctttggcgcggtacgcgaaattcgccacccacccgcgcgctgtgccccgccgatgatccaccaccaaacggctcggtgcaaagccccaaagcccaccatatatgggcaaggctgggagtggaaacgtacgtggaatcggcccaaggattcccactaatcaaatatcccatgccgctgcacgggaattnttttatttataattnttcttattaaaagtgtacaaaaataattttcattttganaattgacggaaggagtcgcctaccgccctctgggagggcgatttttaaaaatcgccctctcagagggcggcgaaaatgacgtggcagacggccgttcgctctcgggcgacggccgtcaacgaaatttgcaggcggcccccttgccgccctccgctagggcgattttatactgtgcggggggccggctgcaaattggcggcgagggggggcatggaattttgcaggcggcccccttgccgccctcagctagggcgattttgtactgtgggggggccgcc

SEQ ID NO: 21683 - DNA, 1501 bp, Oryza sativa
ttgtggcggattttggatgtggtggaggaaagcagccatcatgttggcctgctaggcgaggatttgggtgaggatggagttggtgtctggtggtggtggtggaggcgggggaggaggtggaggtgggctgccatggttgttgtggttgctgccttcggggtgactgccttcaccggtagcagcacttctcctggttgtcaccatctgaaaaccccacacagaaccagcaaacagagagagctgacaattaaaactaaccacccacgactaccataattcttgaatttattactgctattaaattggttcattaaagttcaagttgcttaagcaaataaaataaagacaagctccgacacagttataccacacaccggcataaccatgccccatacgactctagcagaaaaacaaacgagaagaacacacacgcaagcctactaactgctcgtctactactgcgacgggccagggcggaaggtgagcagcagcacatcctccgtgctgccaacgccggaggctccatcctcctgaggaaccacgggcgcgggctcagcacgaggggtctcgacgaagcaggtccacgccagggactgacgaacaagctcgggcctggaggtactcttgcgggcggtgatcttcaggctgcggcagacgcggcgacgcttggggcgacagacctctccctgggcgatcttgagctgacgcagctgcgcgtccactgcgtctaggtccttcttcagctgcagattctcctgacgcagctccaggatcttcatgttgttctcgaccaacccacgacgcaccatctgatggaagtcgatatgggccgcgtcgtacgcctccaccatgcgcgccaggtgcatgatggtagcgtcatcctccgagctagcatcccggaaggtggcgtagtcgcgggctcctccgcggcaagggtggtagcggtagggcgagtgctgcaactcgttcgggtagcactggtggagagtgccgatggcgaggagtgcggcgttctggcaagcggcagagaaggaatctccacccacggtgactaccaacgaagtcctctcgggtgagccagtgaggatcactgcagtaatctcccaagcagcgtggggctctgcatcgtcaccctcctgctccgggagccgcttgccctggtagtccactccatgcggataccccaggacaacgcacatgccccgcagctccaaaacgaagccagtcaggtccagaccacgacggttgatgctgccggccatctacaaacaaaagagaaaagcaacattttaaagatcagattttgacgataaatgaagcagcaggacagagagagactaaaggattttcacaaataagaaaggatttttattttgaaaatattgctaaggcttgggatctacggctcgtcctagggtcaagggggctctgataccaacttgtcacgaccggaaataacccaacgggcgttccttacgtgcgtgcattattccttgtccca

SEQ ID NO: 21684 - DNA, 1501 bp, Oryza sativa
tgttaccaaccgggactaaagatcaaaagtttttaaaccgggactaaaaatcgtttttagtcccggtttttaatggaatcgagactattgtgaaatttggtcgaccgaccaaagatggtttctccaccagtgctcccatcatggatttaagttcttcatcaatattatatatttttcttttagcattctcgttttcccccaatcatttgcccttgttaaataatattactgcctctcataaatataagtaacacgttgttgttactcccttagtctaaaaaacatttttcacgcatctaacacatactgataaaaaagactagaatatacctactttattaaattccaaatgcaattattatctattttatacacttccactataattattttttactttaataaaccctatacaataataaatgaacttattttaaaataaacggaaggagagaaaattgagtttattaggagacagagggagtaatttttatgtactcctatgttgtgttgagaggaaacaatatcttactgtaccaaacatctccataatactcgggattagttcgaaacacaacgggacaatgtagcacggcaaaagagagaagagcatcgaccgtacctctggttccgatttttaccattacaggataatctaacgccatttatgggcgtaggcagtaattactcctcctgttttaacgctcctgccctgaatctttctttttatcggagacaaggactggtttgaaactttgaatctgagggccgcttaagatttgacgatgatttctctacttctactttcttcgtctcataaaatactaactaagatcatatacaactgtatttattagtggtctctctatattgtcatgcaagtaaatttgatgatatggaagaaagagaaatgagtatggttgttatgcatgacaacggctcaaagtcgactcttagcatttattagagcaaattttgttgcatggtagtgaaaaaaaggaaagaagagtaagaaaaagtattttgatatattaatgattagagaccatattgtctctaactgttgtaggatgctagtctttagataacgtagcgctcatatctaactctacctttgtacatgccctaatatcgaattagacatatcctaatactacaagtctgaatagaagagtatgaaaaggtattttgatatattaataattagagaccatattgtctctaactgttgtaggatgctagtctctagataacgtagcgctcatatctaactctacctttatacatgccctaatattgaattagacatatcctaatactataattctaaatagatatactttcagatttatagtactaaagtatgtcatatctggacaaaatataattcattattagtagtactattccaagaaaaaaaacaaggggtgaaacaaatctagttaaacacattttgttgctcgccccactcccattaaagacagcgctagagaccgaagca

SEQ ID NO: 21685 - DNA, 1501 bp, Oryza sativa
actctagctctctaagcaagagcgacttgtgccaacgatcacagtgtcatcttgaccgctgctgaagcctcgtgatccgtgcgcgctctctctaggaagctatctttgatcacagcaattttcagtggttgattttcggttctggattgcttgacattgatcatactactacattcacaacatgcacatttcacgaaatagtgcggccaagtagcagtatcattcaccacaagaaagaatccaataatacgaatacgaattataatacaagcatcacaatcgcagttcaccgatgatagctgtctctgcaacgtgctgttgagaaaattaatgagttgatactgatacaagaaaaacaagtgaaatcagtagcagaaattaatactgacgagccccggttgcgacagcacagcgtctattgccagtgcaggcgcaatttagccaaaagggattttcagagacaagatatcagaaatcagaacttctgaggaagtcaatacagtataacatatgctgctcatgttctcccaacaactcacctcttcgaaacgctctgctcttgaatcttgatttcagtaactttcttggatcacggagatattggacagaaacaattgagcatgatatctatatctagcagtagtaggtcggtttcacatacagaaacatgtagtgctaattatcattcatacacatctcattcttgtgtaccatatgcagacagaacattccccatcaaagttactgggtactgaaagaaacaaactatgtcaacagctatcttcatcatgcaaactagtaactaaaggccttcatgccaaacaccagtgatgttaacaatcttatgtcaaatggaacatcataatgctcagaagaatccgcctgtctgatcatcaataagaaaataagcttgtggaagcgattcatctatatagaatcactgaaccagtactctgtactaagccacagttgtgaaagaaaacaggaagatgtatagtttttttaatggaggaagatatatagttggaacagaaaggacatccatgggaattcagacttgtactatccagatcaaaattgctactgctaattccaaagaatgatcacccacatgattatcatgaatgcgctatgacataacacaacattaaacaatccataaatataaatttggtgcatagtcaacagcgtataagactaacctaggtgaagaattaagtaataatagaacacggttgaaaagacacaccatgcagaaagcatgatcactgcagtgtcaattcataaaagagttcatgcagagaaattttgcaacttccgcaagcgcttcgcggctgaggaaggcttcttcaagaccttctttgcagatttcgcttttggcttagtcttcttcacaggcgtaggcgtttcttttataggcccaggcagaacacccttttttagtgcactccctcttggagtagcagatggtggcagcctcaagcactgcggcggcaaagga

SEQ ID NO: 21686 - DNA, 269 bp, Oryza sativa
ctgccaaggttgtggattggtgtgactactgactcttattttttcacctttgtgatgattcttcttcttcatgtggcacattggaattacaaccaagtgaagcaatctacaatttcgtctatgaattgatcctggcatttcgctaactatattctacacgacgacaataactaactctagctctctaagcaagagcgacttgtgccaacgatcacagtgtcatcttgaccgctgctgaagcctcgtgatccgtgcgcgctctctctagg

SEQ ID NO: 21687 - DNA, 1501 bp, Oryza sativa
gaagaaagggggagcggggatgaggaggggtagcggggagcggggagcggggagcggggatgaggagcggcggcgtggagcggtatccttcgaggcggtgcgaagagacggaggacccgtcgctcacaacgcgctcctccactaggatctcagtctcctcccgcgcgctcaatcatcatgcccaatagctcccccaacctgcaccgcatccctgacgatgagaccccgccttttgcgacggcgagcgtgccttcggccatctccctggccgaccgccgctgatgagggagaagggggggggggggggcgcaccagttgcgtctgctgagctcccgccaccgctggacggtgctgatgcaagggtagccgctctagccactgttagattaatgggctaggtccaattaaatcctaataaattccattggcccacattaaatgctatgggtaataataccaccttggaaatctaagtgaagaggttcaacttaaatacagagctagtggagagtctctgttgaccggttgagatggtgcgtggacaactaggcggggcgaggcgaggcagacagctgctgctgcgctctctcgttttgtaacggacggtaataaacacggagaattgatttcatatcaatgaacgcgtcggttacggaattaaacgtcgtgaattgattccatcggttacggaattaaacgacgtgaattgattccgtattaacgagcgcgtcggttacgaaattaaacaccgcggttgatgactccgaatgttactctcgcgctcgcatatatatactccgcagcgaccagaaggacttacgaagttcttcccaactcttgcacttcgagttcctcctcctctgtagctgcagaatccttacccggttctgttcacctgcgcacacaggtgtacgggacgagcaggtgcctccagaactccgtccacttgagaacttgcacgggtaggcgcgcaatcaagtttttgggtagcgcttcaagcgcgactgctcctgttcttcgttcttcgacgacaacgttgcatcttcctctacttctgcttcaccatggcttctactttagagaacggaggagacaacatcaacggaggcaatacgaatgcctcaacatcttctgcaccattatctgggtataagattcaaactttatttgattttcttcttgttatttacatgttcacaatgttatccataggatttcaatcctatgtgaatgtcaacgatgtctatgcttattttaccttaagcatgcttatgtttatgtttagccttatcactagatcgtttctcattgtgtatgtcatgtttattgtcttaatattttggattaaaatatgccgaattatgaccaaatttccaacaatccaaaaacttgataggtctttttcggtagttggctttgctgcatcactaaaaccacatgctttcgatggttcaaattagaaaagatggaaagcacacacactttttgtggttgacggcga

SEQ ID NO: 21688 - DNA, 1501 bp, Oryza sativa
gaatcccagtttataaaattattttgatttaaattaatgcattatcgctttatttaaattcccgcgttatcactgttttatttagccatacctatttatcattgttatgaccttattattattgctattgttattattaccttgttcaccctagaataaacaaaaccccaactagtgggtaccctatgcatggtaccactagtatgaatttaggtagatgcttcgctggttaattaggcaacattaggtggttttacaactctagactttgggaatattcatatcacatggacattggaatggttggattattgtggaattggattcacacctccccctctattcaaaaccctcaaaatggttttaggctgggctcggggtgcatggttttgatagtagcacctcggccacataaggaccggtcttcgggcctctgttgcaaagcactaccgtacttccacatgtctagtgggtaaggcttagtttgtggctcagtctagttataaacaaaagtacacggatgcagatggacgaagttaggggtcgatggacatctctagggcaaatgaaggctacacgagctgcggcccggtagtcgagatatcatggcacggggctggtgtcctgctgctaggggctcagtcctgcctacctgtcccggaggttccggccgtaggtggggttgggtcggtactcttgtctatggctaggatgggttggaaactatgtcatgtcttccgtctgtatgccgtggtggtatgtggcatgtggttacacgtgaggaagacatgtcttgtgggtaaagatgtacacctctgatcagagtaaaacctattcaaatagccgcgccctcggttatgggcaagcctagcaatgtacccaagttagtgttttaattcttaaaacctgcttaacaactaaaatgtggaatggttggcctgggttggcttgggacgagctaggacccagggtcgggttgccagttcggtctgaatcatcgtaggccttgggttaaggcaggttcgtgtgggttcacggccttgattaataatcttgtatagctctaggatcatcttcataaaatagcttttggcaactaagtgacttttaaatgctgtttactgcaaaacttaacccctatgttataactcccttgtactcccttgcatttattctacacttgtgggtgtgtcttgttgagtacggtggttgtactcagtcttgctcaatttttcgcaaacccagaagaggagttcctagaagatgaaggctttggtgtctaactcgtgcctgccgtcaagcgcctgtggtcgtcgccctagtcttccgctgtttttcgtttgtcttcttgtgtgctgggccttcgctgcccatgtaataaattatctatatacgcttccgcttgttaaactctgaattgtatcaacttttggtgtaccttgcctcctgggacaaggaataatacacgcacgtaaggaacgcccgttgggttatttccagt

SEQ ID NO: 21689 - DNA, 1501 bp, Oryza sativa
gccggcaaatgccgtgctgaggtatgtctggtcctcggggaagaatcttgccaagccaaagtcactgatcttgggctgaaacttatcgtccaggaggatgttgctcgccttgatgtcgcgatgaacaatcctcaggttggactcctcgtgcaggtactgcaggcctctcgcgatgccgatgatgatctggtgccgcgtcttccagttcagaaatggtgcaccatcaacacctgcaaagttaatggatgtgtaaaaatgtggatcaagtaaacaatgtttttgcttgttcttgacagtttttaggttcaggatgtaatgcttaccaaacagtatcttgtccaagctcttgttcttcatgtactcgtagacgagcagccgttgctggccctccgagcagcagcccacaaggcgaacaaggttcttgtgctggatgctggttatcatgttcacctcgacgaagaactcggactcgccctgacctgacttgccgacgctcagctgcttcacagcaaccttcctgccatcgtctagtttcccctgataatgaacattagcattgcaaacaaccataatgcaatcagaaattgctgtagaatggtaggtgatactgatacagattcagtattgttttgtggcgtttcttggcagaaaaaagtgtaccagataaacaggtccaaagcctcctctcccgagctgattcttctggtggaaatccctcgtggccttcttcagtgttgcataatcaaagtatgttattgtgcgcagattgccgctcatgttgccgctgaaatactcgggtacctctgttacatggacagaaagagaaacagcagagttttatacaaaaattatggagcagtttgtgttttattgttgatcagcaggtttgatgagaatgataggttcacctgacggagccctctttggcctcatcaatctcctcatgatatctggcctgaggaacttccagcagataccaagtaggatgaagatgactatgatgagaatcacgatgaaggccaggaagaccgcactcgcatttgggttcgccattgttgctgtctatttctgcacattcatccacccaaaacctaacattttcagctgaaacttgttctaaaatgttttcgtgccagttacttagttgcctgtactccgtacaagcaaagcagaggtgaattgcacatatgctcagtgacatgccaaacaaaaaaaatacagtaaaaacctgaaaactacttaaaaaaattactcattgtgacatgaacaaatctcatatatccatttatgtatcctatgttagttttcaggttaactcaagcctgaagtaattaagggtaggaacctaataaacaacatgatagaaaacgccatgaactaactaataccacagatcagccatgtcgaggagaaaatacttcctctcaccactatactagactcatctatttagttcaaagaaaactgtagttaagtcatcttgtacctactgtacgtacct

SEQ ID NO: 21690 - DNA, 1501 bp, Oryza sativa
ccaatcaggtgagtgacagacagagagaactgtaggtaaaaatttaccataccccaatgttcctccgccctcactaataaccatgtttgcagacttcttgtccttgcgctcaggacaatccttggcccaatgcccaggcttgccacacacaaagcaatctccttttgcctttcctttgcctttcttcttaaaattggtagtagcctttggtttgacatcaggcttgactttcttgttgttgttgtgagatgcatgagggttcttcttctgcaccaaattggcgctagaacctccctcgatctttttgccctggttgtcctttgccctcgccttctcctcaacacccaaagagacaataagatcagtaacactgaactcttgcctcttgtgttttagagaagtagcaaagtctgtccaagaaggtggcaatttggcaataatgccacccaccacaaacttgtccggcaactcgcagttgttgttctcaagttcctttgccagcatctgaacttcatgagcctgttccactacagaacggtcatcgaccatgttgtagtcatagaactgctccatgacatacagcttgctaccggcgtcggaaaccccgaacttggcctcaagatcatcccacatgtccttccctgaaggcatgtgcaaatacacgtccacaatactgtcggcgagcacactgatcaatgctccacggaacaagctatccgcagcctcgaacttagcctcctcctcaggggagagaggcggttcactcggtttgccccgtgaaacaaagaaacaatgcatcgccgtcaaccacaaaaagtgtgtgtgctttccatcttttctaatttgaaccatcgaaagcatgtggttttagtgatgcagcaaagccaactaccgaaaaagacctatcaagtttttggattgttggaaatttggtcataattcggcatattttaatccaaaatattaagacaataaacatgacatacacaatgagaaacgatctagtgataaggctaaacataaacataagcatgcttaaggtaaaataagcatagacatcgttgacattcacataggattgaaatcctatggataacattgtgaacatgtaaataacaagaagaaaatcaaataaagtttgaatcttatacccagataatggtgcagaagatgttgaggcattcgtattgcctccgttgatgttgtctcctccgttctctaaagtagaagccatggtgaagcagaagtagaggaagatgcaacgttgtcgtcgaagaacgaagaacaggagcagtcgcgcttgaagcgctacccaaaaacttgattgcgcgcctacccgtgcaagttctcaagtggacggagttctggaggcacctgctcgtcccgtacacctgtgtgcgcaggtgaacagaaccgggtaaggattctgcagctacagaggaggaggaactcgaagtgcaagagttgggaagaacttcgtaagtccttctggtcgctgcgg

SEQ ID NO: 21691 - DNA, 1501 bp, Oryza sativa
aagttagaggatttgcttcccaagtcaacggcacctttggaggcctcagttcatatgttatggcccttgtaacttagacttcgtttgaaaaggcttcttaccttagattttgagtggcacgtaaaacgagataagccattaccacttaattaattaagtaatacgaatcaaaaaataatattgtttgaattttttaacacatagtttaacaattagggaaacatgatcacaaaaaatgagggagaaacaaatctaagaagcagtttagaactcaacgttactctctgtttttatttaattgtgttgacagtgaaatttggtaatcggcaaagacgtcatcggcttagaatcattatcggctgcagcatctcggaatcagccgatgggagttatcaagtcgccaatagtcggattcctgctatattcggctaaggaaatcaatctactaaaggaagcttatccctaagtgaccgagtttaaagaggatgcgacatggcagtttatctattaattaggaatagtttgttagtttccttttatctttaggaaagtgtgtttagtgtccgataaggactttatattttccttttatctttaggttagtttctttcttgtccgacaaggacttgtatcaacccatgggtataaatatgtacacctggggtctatgtaatctatcgctacgatcaatacaattcggcgcatcgccaccttttaccttttctactttattttatcatccggcgggacttggcacccgacgcggggctgcatcgtcttcgatctccggcgaagggataagtccaatgttctgccggtccaggcaattgtatcgtctacgtcggcgtcgttcaaggctgcatcagtacattcgacgtcttggattgctctggtttagatgatatatttgcctacctatttatcatatgtttctgttaatctagtcctagcatatcaatttagctctatcggctgcttctcgttttagggtttctgccggtatcagctaaatcacattgctagattagattagcttggacatctaccaccctgaaaaatcagtcaacggcttgattgtctagatattatgtttcttttcatactcagtgctgcatcagttaagtttgatctactaagtcgtgcttagaaccataatctctagcctgcttttgactgccaataagggtttcatcggggtttcaaccgatgagttatctaggcgttgcatcggcttacaaggattgtatacatattggaattaaccgatcgcaacatagattttactgtttatctaatcctatggatttaatgacatcgaacctctagccgatgtatgctttgacctttggataagtgcttattatatattgtctctagccgattggtttctactcggttatattgttattttattacattatcaacagctgattgcctttatatcatcatccacattggacatatagccgattgcttaaaccctatcgctatcggctggcat

SEQ ID NO: 21692 - DNA, 306 bp, Oryza sativa
ctgagtgaatgctctactattgccgcacttcatttccccaagcctctcaaacctaaaaggcaatccaccaaaaacctaaaaagggttctttgaatggttgctacattttcagttggacacgtgggttttgaaggattagaagctacaagagacatgaaatcaatggactatatttataatgggttttaataggatattttcttactacaaatttatttattgactatagagataaaaccaaatctgacacagataacggcattcaaatattgaccaatccactaattatacctttacgattatagt

SEQ ID NO: 21693 - DNA, 1501 bp, Oryza sativa
atcaagcctaggggctatagggccggcaatcgccagacggcccatcaggggcccatgagcccctataacattatgtacccctgtaaatgtctctttcgtaagggtaatcatgtaaattcccctgtataacctaaaccctagtagtaagaacctgtaatggggctataaatagtcccctagggccatgtaatagggggatcccaagtgaaaaatcaaaattcaatacacttcgttttcttccaaccacctttgagtaaatatgtctttcgatgtatgcagttgtcattttgacaacacaaacgataaaatcaatcggacgatgtcgagaatcagatttatgcatgaataggccaagaactcaaagttaacacgatgatctgggccaaaatttacaagtctgcatagtgaagcaatagaggaggccgccacccgaagatgggccaggatggcccagcccatcctggcaccgttggatgcagggttcggcgtggacgtccaaaattgcatcccaatgacggttggagggcacttcgaacaattcccctttcacaaccatcataactacctctatatggacttcaccttctcacttcactcacacacctcaagcaagatctctctcatttctcacaagtttagtttagtagtatctagctggtggaataggaatagagtagaaatcaggagtacgaaagtcttcggaagagttcgggtatggctctagtagcttttctcttctcttttgtaagctttgtgcttttattagaatacttttctatatacatttgtgtctagattacgggatatcattatttggtgttatatgctgcggatgagaggtgggccgctgatggtgacagctcagttgtcacgtcctgataaattcatcccgaaataaaaattattctttaaaaggaataatagaattaattaaaattcgaaaagaaattggcaaacactaaaatacatacaagaaaaatttgaatgtggcccggagaatttttgttaaattctccttggtctaaaaggagctctcaaattttacttaaattttcagaacgccggaaataattattaagcaacaacaacaattaacaaagtttattaaaaagaaaaactaaaaataatcctccttcctcctttgggccaaagctgacccaaagtctctcctccctccctctcttttcctttcttccctccttcccggctggcccactccctcctctcctcctcccgcctgggcctgccccggcccaagccgagcggccgcctccctccagcgaccctcacgcacgccgcacgcgggctgactgcgcctgaccagtgggtcccacccacccggtcgtctccttcctcccgcacggcctcctctctcacccgtgaaccctagcgccgattcctcctccaaatccaccccattcaagccggctctttccaaattaattggggggttttaatccccattgattcctctttgatttcctctgttttccctcttgat

SEQ ID NO: 21694 - DNA, 1501 bp, Oryza sativa
agtaaaataacatcaaatggcccaaccactacactactggaccgaggagtcatcacacaacgcacctgcaaatttgtgggttgattgggccaggctagggttcggctgaacccccaccagcgccggtgatcgcctcctttcacatggacgtccaggattgctccccaatgacggttgcgggtatttcggaatattccgaccatcacaaccgtcattggcagcctataaatggaggtcccttcgctctactccaacacacactcaagaaaaagatcaagaagctctctctcaagtttagtttactgttctagtgctagtggagtaagaatagagtagttctcttagacctcgagtctttaggagatttcgagtaaggctctagctcttccttcttttgtaagacttatagtattaataaaatattcttctttatatagctttggtcttttacttaattcatactattcaagtaccgactttagttcgtatttgtctcgatataataatgtagctagcttacgagagatatgcattggtgtgggtttaatgttcatttctatgattgctctatgtctgctgcagtgatatggagtagtatttagtaatgtaagcgtgacgcttagattattagtaccattaattggggttatatgctatgggtcagtagaagtgggctgctgatggtgaaaactcagtacgggtattcctccacgttcgtatataatactaagacactttcctagtatgggtactcctctgtattcaataccgatcggatgtccatgacgggttgtcgtaagaaaaatggcaatcagggttagtcttttgaaacaccaggagggcatagttagggggtttggttggatgatcgtatattagtaagtgtaaactaaagatgactatatattagaagtacaggaatgaatcttttgttcttctttctccacttagcctagattatagttcttagttatttcttttgtgtgtcaatcttatcctaccccttgaattgattaacccctgcatatactttggtgaatacaagtaatatataaattattagcatagtactcttttagcatatctccccttgagattaaataaatacgataacttggaatacttccgggtgaaatgctacaatggtatattcgtgcgcttgcggattatatctataaccgtaaaatatatcgggaatatttcaacgccattactaggaattatatttctagtaatatcgttaagaaataccaacaaacatttctagcgccgttgccgaggaagtttaatgattaagagtttactacatgctaataatcttatatttaccttggtataatcactgtcctttacaggctacccttgattgtttttgttttattatgaaaacaggatagtacatgattggtttcaatttgccgaaaaacttccatgacaacacaaaagccttctttaggagcgtcaaaccacgtgttgtccctccttagaagactctatcgac

SEQ ID NO: 21695 - DNA, 1501 bp, Oryza sativa
gttacgattcgtaacactagtgctatctatatttagaagtttacatccacaatcgctctaattatgtgggattattaaacgatgaatatatttttctgtgaggaatgaattgaaatagattaaatagttacgttacgattcgtaacattagttctatctatgtttagaagtttatctggacaatcaccatcatgtcagtgtgccaatacgctaaacttagaagatgcctccgataatcgtagcattagtattatttggggaatgaattaaaaaatataaataatgatatattacaattgataatctatgtttagaaacttttgtcggttactcgctcaaattgtatggggtaataaatcggtgaagtatacttttatactgaatggacaagataagctaccattgatagcattagcggttctatttggtatattatcccgattatccaccctcaatttgtgctaaaataagatttttacatcatcctagtcaatatttggggttaccctgtctgcattataatttatttttgtgcttaactataatatatacatacactataatttatctaaataaaagttctggtatgattaaaaaaactaacaattttgtgtgtggcgtattgagtggaagaatgtcatgttaggatcacatgggagagagtgcatgcgacgagatcatccttgttggtctgtgcaggtggtgtgaaatgtgatcaatatatatggtggtgacagagagagaaactaacccaaaaaaacaaaaaaagagagatgagagcgaatggatggatgcaattggcattaattttcggtctttgctgttctcccccagccaggccagtttgcttcacgcaatattctaaccctttgagaaagagaagtgtacttgttgccaaggccaattgcaagcatttgccttggctttaaagtctcatcaatacaacggcaccaaaaagaaaacacagagatagaaaaccacctagtagctgatatacatttatatatgacctaaataaaaaaattccattaatatgtataattccagcaacaacataaagaaataaaaatgcatttaagaaaacatagaaagaaataaaaataaagtaaataaagctagctaggcccaaaattggcagtaattaagtagggactagtatagaaatatatggatatatacaccagcctccaccaatgggattgcaaacagcctacttatcactttgctgctgtatttacgcttttgcccttcttccctcctatatgtacagccgcccccacctcattcctccattcttactccacacacacactctctctctctctaccatttgtgagaaagaaaatcgattcagttctagagagagaaacaaacaattttcgctgtctatctctctcttgctactagtcggtcgatcttgagttagttttaaccctacacaagccaaggtaacaacatctagcaggtaggagaagagagctagagactaggtggtgggggc

SEQ ID NO: 21696 - DNA, 187 bp, Oryza sativa
ggggccgggcagctgacggccgggccccacacggcgcgcccagaggcggccacgtcggcgcggccggcgggaggcggcgcccgtgccccgatggttgccgccggcgaccatcggcgcagcggagcggcgaccgagaggggaagggaagggggaaaagaggcggtggtcctcagctcatcccgggtga

SEQ ID NO: 21697 - DNA, 1501 bp, Oryza sativa
acggcggcgtggcgcgcccgcgtcagtcaccgctaacatcactggatcaaaacccatctatctgtcttaattagccagatggagtatatagattactggaagtaacacgctgttattatcatccgatgttggaacaatcgatgatcctatgactgcacacagcttgctggtcaaagctagtgtgctaaatcgtcttacataactaatttacaagacagggggaaaagagctatatatgctttatttgtaatcctactcacagaatctttctcgggtacacatcagacacatcaactaataaattttatcaaaaatttaaaacaattatttatgtacttccagtactacacctatgtgtaaatacttagcctcaaatttattatattttaacgttaataaaaagatgataattctgacaattttaagagtataaatgtatctgaattttgttttttttactcactaaatataatgattttgaagatgaaactttatacatatatgtaatactactaaaattatagatatatattttttctagaatttttagtgaaatttgttaggtggtgtgcacacaaaaagatttatgtgcatatgatacttttttttacttgttcatcatattatttaactattaatttcatgcttgaaaaaaatacattctaaaaaacattttctactgtattacttggaccactttaaactattcatcatgtttatttcttaaaatttctaaatcaaatcgataatccgctttaatagtccgttcaataatccaaatcaaacgtaccattcggctttcctttatgtccttccaacaccaaagccaaattcaggcaaccggcaccttatctgaaatcagttaattactttgcaagacatttctttatctgaatacaggttaattctgcatatacaacaagcgatcagtgggggtgtatccctgatgttcacagcatatgctacatgggaaaccagcaggttgcgattgtacagcatggaaaccaccaaaaaggcttgtacaccgacaaaatgcgtcgaagaaacgccaaggttttttatcgcctttagcggttagcgcatcagaacgcaacagcaaagcaaaacccaatcaaatccttttcctccaaatctcgccaaattcttcgagcgagacacgtataaactctcactcgctcactcacacctcacacgctgctgctgctgcttctcgatgaggaatattttttttgcttcggttaaagcaacgctaattccccgcgtcgcaagcatgcgtttctaggagaaagtaaagcttgcgtttttgagactaaagcttgcgttttttgttttttaattgtggagtttgggaggaggaggggaaaaaatcgcgatcaggaaaaggcatctcgagaataattatttaagtccccagagcgagcagtgacgcgaaattccccaggagagatctccatctccacctccactgctcaggcggggatgtcgtcggcggcgtcggcgt

SEQ ID NO: 21698 - DNA, 853 bp, Oryza sativa
caagttttggttcttgacccgtctctgattcctgatgtggtggatgtggttattggtgatcacttgtatgagctgtcttttagagtagaacctgaaaataggcctgaggagcctgtgcctatggagatggagaatttggatgatggggatttggaaaagaaaaaagaggggaacatgaatcaggatctggggaagggggctggtttatttgattcaggtaacagctctaagatgggttctggtggtcaatttagtgagaggggtggtccttctgctccctcttctcagctaaatctgatacctgaatctgatgacttgactgtttctgatgaagaatttgatggtttagatgaggagactataatggttgacaaggcccagattcaggaaagtcttgtggcaaagctctctgctatccctgaggcagtaatctctccatcaaggaagagtaagagaagggcaagtgatagcgattagcttgttcttgaaagggccgaaaagttgaaggctgataagaacttggagaacctgcaggctaaaggtaattcagttaataatgtttcttttacacaattttcaaatgatcaaatatctgcacatcttcataatcttggtgttataccttctagtaaaaatgttgttttagatgatgtaattaatgatttgaaatgtgtagaaaataataggataagcggatgtgcttgttcttctattaatcaagtttgtacccctaatgttgatactgagtcattagatgaccagttggaggataattttttactacaacatttatgtagtgaaattatggaagaggtcatggattttagcgaggactgtgagaatagtcttaaaa

SEQ ID NO: 21699 - DNA, 1147 bp, Oryza sativa
tcacgtgcccttgaattttgcctcatcctctgtatgtccctgagtttttattttgatcccttctatacccatgttgtgagttgactgtgaattgaccgttagaattgtcccaaaatgactatattgcccttcgcttgtacttcatgctttctaatttaaaaacataagtcttgttaataaaaaaagcttaacctaaaaataaaaaaagggacatgattattaacattggatttcgaaaacaaaattaatttttcaaacatttttttaaagataatgaaatccaaaaaatgttttattcggaattcgaaaaaccaaaactgttttttatttaaatttcagcgaaaattttcaataaatttcatcaaatctgatttgaaacctatttaaaaatctatgttttagattaagtaattatggcatgtttggttttataaatgaatcaacttttaccttgagagccatgtttttttaatcaactactctgtactaagcaataagtaagacacaagggtaatgtagacatttttggaaaaatctaacagtcaattgacagtcaactcacggaatgggtatatcagggataaaaatgaaaactcaagggtgcgtaggggataagacaaaatttaggggcacagaagaaattgggcgaaaattcatgggtacataagggattttctcatatgtatttgatgtgataccccaaacatgtgctgtgccacttgatccttggtctgatgggttcatctcaacagcagaaactgtgctatgcttaccgatccagtggttccatacttgcagctgtgcacaagtttgatctctgcagctgatagttgataatgattccttaccagatggtttatacacactttaactgacaattagagttgctttcagagaaggacccacgagtcggcgtgttaagttcggttaaaaaaattttccagtcttgtttctctgaatgctggctagtcatcagtactttactctgtcctcaatcaacttcactgtactatattttgtgatttctattatttatttttcctccgaggctggcgatggaatgcatacccatctaagtttgctgctttctggtaacgacagggcattttcaaagtaatgggtagctcaaagaaggccaaggtgaagt

SEQ ID NO: 21700 - DNA, 1501 bp, Oryza sativa
tgcacaccacctaacaaatttcactaaaaattctagaaaaaatatatatctataattttagtagtattacatatatgtataaagtttcatcttcaaaatcattatatttagtgagtaaaaaaaacaaaattcagatacatttatactcttaaaattgtcagaattatcatctttttattaacgttaaaatataataaatttgaggctaagtatttacacataggtgtagtactggaagtacataaataattgttttaaatttttgataaaatttattagttgatgtgtctgatgtgtacccgagaaagattctgtgagtaggattacaaataaagcatatatagctcttttccccctgtcttgtaaattagttatgtaagacgatttagcacactagctttgaccagcaagctgtgtgcagtcataggatcatcgattgttccaacatcggatgataataacagcgtgttacttccagtaatctatatactccatctggctaattaagacagatagatgggttttgatccagtgatgttagcggtgactgacgcgggcgcgccacgccgccgtcaggtgaccgatcgatcgattgctcgtacgtcgccgtcgtcatgatgcgccatgggtcaatcactgcctgccatcatggtggacggccggcgccggcgacggcgacccgtagatctcgattgaccgattagccggacaattagtgcagtattcagatccataagcccatttagaattttcgcttatatttatacttatcagccaaaatttaaatttaaatttttaattttaaaataattttaatgttttttcatcataatttatttttcagcaaattttatttttcgtttgcgatacgccgtttgtcttattcctcgaataagccagataatggggctgtttgtagggggatgaacagtatttcgggcattggttccagcttaaagtgattatctaattactgcaattccttgtgcaatctgactgctgctcccggtatatggcagacgattattgcacggataacgctgaagttttttttttaagcaaaggataaagctgaagtagtcgagtgggctgttggcctagggccaatgggcatctggtcaggccaccagaagatgggaattgggccgatcctgaaacataatgggcctaggaggccataattactttttgggccacttaaatctcatcgtttggcccattcggacttcggagtgtactccgctgccgtgggcgggccgcagggaagcactgtgaacctgtttgtttgggagaaaagtccggagatggtgagaagtcgttgatgagcattccgctggtgaacgccaaaagctaagaaattccgattccaagctgctagttcaggttttttggattttgtagctagaaattcttaaaatatgaacggaaatctgattgagttcctccatgagatttatttggaattgtattttcaggtcaaaccaaagtcgcaacaaagtta

SEQ ID NO: 21701 - DNA, 504 bp, Oryza sativa
ttttttaataactgtacctggaaagcgttgccgtctaaaagaaacaaacacagaaagcatgtcacccatgtcatgtcatgtggtggttcattatccgcaatcgcctcttgtacatatgtcacgtgcataccaccaatcaatgacaccaacgcatcaaagaccacagacaataatcacactgctgttttttttatgtgcatatcctggttgaccgggaaaattttgttccatcttgacacataagtaaattctcttcttaaggatatagaagggtaaactcactgttatcaaagaaaatagtgcttgagaatctatgcaacataatagcccaccaccaatcacttttgcacgttctacagattaatccctgatattttttatatcatgcgatagtcatgtgtttgtttgaatcaagtaaataacatatatttaaataaacataggcattttaccgatagcaaagcatgggtatttcgctagcattcaagaagaagagaaacttgg

SEQ ID NO: 21702 - DNA, 292 bp, Oryza sativa
agaacgataggaatgggaggcatcggaaaatagtgagacaaatatatccacctccaattctagaagtgaaaactgatatctcatttttccaccatgttcccactcccactgctcttagattacctctttcttcctcttcctggctcatcccaaacacctaaggctccaaatatttcaggcttagaacatgaactgttgatgatgcctgtggtgttgaagtatatatatagacataggtgaagcacctaaactgtatactgtacaggaggcaatgagtatgcacacatcataa

SEQ ID NO: 21703 - DNA, 1501 bp, Oryza sativa
ataaccacccctaaccaacacacccacccccggtttcatccccatccctatacaggcgatgagcaatccccgatgggcctaggtaaatccggaagtagcatagacaaaaatataggtccatccatactccatcacgcccacctttgccaatggtgtgttggtatttcttaatgacattactagaaatataattcctagcaatggcgcagaaatactcctgataaattatggttacagagtttatccacaagcgcacggatataccattgtagcatttcacctgagagtattccaagggtattgtatttattttatcccgtggaaagattatgtagagagaacttgactaataatttatatattagttgtgataatcatattctaagtaggggttaagataatccaagggtagagtgacacacaagcattaactactcattctcatgatatattatctaagctaagtggaaagaaaatagaaagaaaatctattcctatacttctaatattgttgatgagaaaaacacgaggcctgggagatctgcttaactccagtgcaggtccaagaaatcttgcttttggatctatgagtgtaccagttgatttgatcctacaatcaataagaaataaagataaagaaatcgcggttaaatccataaatgatagccaatcggctagttgccgatgacatatcatttatctctgagccgatgtcatatttggatcgattgacagttttcaataagtaagaaagaactaaatctgttcgatcggctgtagatactaacaatatataattcttatgtcgatatatacttaaatcaagtgattgggatagatcggtcgccatgccgagacagtataaatcacttagatcgaaatatatattaacaatgaaattatatatgttcatagcctagccgattaaatagatctagcatgtatcggctaatactccgataccaatttatactaagatattaaagcagggaaaatatatcaaacaaaaagcttaatatacttaaatgcaacaagatcttaatgtaaagggcagatctagtatatcaatcaagcacataaaatataaagctaaatcaggtaagatcggctgaaaccccgactctaccctaatcggcaactaaaaagcaggctggagatcatggttctaatcacgacttataaggtcaaactcaactgatgcagctataagtatgaaaagaagaacaaaatctagacaatcaagccatttgaagtttcataaagtggtagataccttatataatctaaaccaacgttgatatttaacctaatcggctgccttccaatgatagacgttagccgattgaaggttaaatagcaatattgtcaaagattatataagatatatgataactcgacgaattacataagcaagattagagtatcatgaagatgaaagcactaatcccgagaacggaagccgccataacaagttttagctctagttgaagatcgaaatcga

SEQ ID NO: 21704 - DNA, 1501 bp, Oryza sativa
ggttagtatttaaagcgaggcggtaacggtcggaaaaacggcaatgagcgatattcttggaggaacggatatggcaattccaaaacattaccaaatattccggacttggggggcatgtgttaacaaccaaatttggtaatttcagtatcggagatggagataaaactgacgcagaatccaagatggaaatcatttcggaaacagagaaaggatcggctaaagtccgaatcggctgtgaccaggatcggcggaatccgaggtggacaaggtttgccgattgagccgagtccgacaatgtgatgcggtacacgttgtcgggttgagttaatgcacttgatgaggattgccatgcatagattgagtcctgagaaggcaattgtatctattaattaggatatttcatgtaattttcttagagatatgtttgggcaaaagtctgccgcaaagacttatagtatcttagagtttgttagagataagagtcgtgtccgacacggacatattttgtaatctcgggtataaatagaccccaagcctcatgtaatacaacaacacacgttcaaaaacaatctcggcacatcgccacccttttactttcgctttgtttcgacgagttcttgctttcgggttgagctgcatcgatttcgatcttcaactagagctaaaacttgttatggcggcttccgttctcgggattagtgctttcatcttcatgatactctaatcttgcttatgtaattcgtcgagttatcatatatcttatataatctttgacaatattgctatttaaccttcaatcggctaacgtctatcattggaaggcagccgattaggttaaatatcaacgttggtttagattatataaggtatctaccactttatgaaacttcaaatggcttgattgtctagattttgttcttcttttcatacttatagctgcatcagttgagtttgaccttataagtcgtgattagaaccatgatctccagcctgctttttagttgccgattagggtagagtcggggtttcagccgatcttacctgatttagctttatattttatgtgcttgattgatatactagatctgccctttacattaagatcttgttgcatttaagtatattaagctttttgtttgatatattttccctgctttaatatcttagtataaattggtatcggagtattagccgatacatgctagatctatttaatcggctaggctatgaacatatataatttcattgttaatatatatttcgatctaagtgatttatactgtctcggcatggcgaccgatctatcccaatcacttgatttaagtatatatcgacataagaattatatattgttagtatctacagccgatcgaacagatttagttctttcttacttattgaaaactgtcaatcgatccaaatatgacatcggctcagagataaatgatatgtcatcggcaactagccgattggctatcatttatggatttaaccgcgattt

SEQ ID NO: 21705 - DNA, 1501 bp, Oryza sativa
gttggaatgttttgtttttgaacttgggtaaagttccgtgaatggtgatgagatgatggagagtggtgatgatctacctcgaggggtagatgtgtgttatttattcattcacattacaagttttacttactctatactattgttataaaattccattgcgaaacatgttgtgaactaaagttggcatttatgcaaattaacctatacacagcttatccttgaatatggccaacatgtagtatgctaggattgtttccaacttgccagtacattaatttgattaatgtactgatttcttgctttcttttacttgtttatgctcagaccctgctgcagataatgactgtttggatgaggagtttgatgcagcttgtgatgttgtagatttccaggatggttctaactagggatttaccctagtcggtttgcctatgggcttttgggtagcacgcttaccgcatgaaccaatatttatggcttgtcgccaagtactacttagaaccttattaagattatttatgcttattgcttagaaccactcattatttggatatcatgcttgagatgatttatgtgagactatgttgcattcctgggcaactagtcccacatgaggatgggtttgaaatggttgagataactggggaatatgcctttgttgagatcgagtctctagggtacgcttttggtcgccaccatcgagtggttgacgggcgtatgacatagatgactgctgtggctattccaatggttgtgtcttctatttcatatccgatggcttagagcctatgtagtgcactcttcaagacatgtcggggtctgcgatgaggttggatggttaccgtatttatttgggttttatttgagaccccatccatccagatatttcgcgctgacatgccttggagcgttgcaccacctaggctttgggacgtcctcacattattgttattgtttttattgcctagagtaaccaaaaccctgctggtgggtactgttttacggtctcactagtaccaagtttaggtagatgcttcgccatttaaattaaacaaactttaggtggttttataactctagactttgggagtcctcatatcatttggacattatggaatggttggcttatgtggaattggacacaaaccttcccctctattcaaaacccccaaaatggttttaggctgggctcgaggtgcatggttttgatagtagcacatcggccactataaggatcggtcttcgggcctttgttgcaaagcactatcgtacttccacatggggccactataaggatcggtcttcgggcctctgttggaaagcactaccgtactttcacatgtctagtgggtatggcgtagtttgtggctcagtctagtcatgggcaaaagtacgcggatagggatggacgaagtcggggctcgatggacatctctaggacaaatgaaggctacacgagctgtgccccggtagtcgagatgtcatggtacagggccggtgt

SEQ ID NO: 21706 - DNA, 1099 bp, Oryza sativa
caagtctctaatttttccttaagaagtcaagaacccgtttttgtgctttgtttctgctggttatatggagtttattagagtaaaagcctttttctttctgttggtcgtgtagacgctgcagcttcggaagatctgctctacgtggagattgaagccgacgtttgggaaagcgagcaaggcaagtcacatctcctttgaacatattgtgtcccatgctttaaaattattttgttttaaattaatgcattatcgctttatttaaattcccgcgttatcactgttttatttagccatgcctatttaccattgttatgaccttattattatttgtaacatacccaagcctgtaaacctgagaactaaatttaatttaaatgcatcatgtggttgtggagtgattttaattgtttttggatcttaatcatctcatcatatgcatcttgataggcctagagtcacaaaaacaattaatctggtaattatatgcatccaaaacttccacaaaagttctcaaaaaaaaaaaccttgatatgtcagaaatcaacccacaatttttcagagtttttcagtaaggtttgctaacttgttgatctcctttaatctgtctagaatcctgaaaagaactgcttagcagattcaaacttgctctctctgtaaaatttatttcaaaacctctttttgaagtttggtttcagccaaagtctcctactaactttcttctaacaccctgaggagtggcacaccctggatcactctctaaccctttcttctctccctccaaaaatccaatcagctgctaactgcactgtcaactgctgctaaccaacactgtcaatacatattcatcactccatcaaacctaaaccagagacttctaacccaatccacttcagcacatttactctgcacatcacccctgaccaagaggatatctagcccagatttcttgctgcacaaaatccaccttgatccctccaaagatccttggcagcaaccctctttgacttagcctccaaggctatatttgaatttctttcactgcagtgggccccacaccctctgggacccacatgacagcctcccactctcccctcacagc

SEQ ID NO: 21707 - DNA, 1501 bp, Oryza sativa
cacacccacaaatgtagaataaatgcaaaggattacaggggattataatataggggttaggatttgcagtaaatagcatttagaagacatttagttgcttagggccattttgtaaagacgatcctagagctacacagtgttattaatcaaggccgtgaacccacacgaacttgccttaacccaaggcatatgatgattcagaccgaactagcaaccagacccaggtcccagctcatcccaagccaacccaggccaaacatttcacattttagttgttaagcaagttttaagaaatataccactaacttgggtacattgctagacttacccataaccgagggcgcggctattcgaatagattatactctcataagaggtgtacatccacaagacacgtcttcctcacgtataaccacatgccacataccaccacgtcatacggacagaaggcgtgacatagttcccgacccatcctagccataaacaagagtaccgacccaaccctggctacggccagaatcccgggacaggtaaccaaggttgagccccttgcagcaggacaccggccctgtaccatgacatctcgactaccggggcacagctcgtgtagccttcatttgtcctagagatgtccatcgagccccgacttcgtccatccctatccgcgtacttttgcccatgactagactgagccacaaactacgccatacccactagacatgtgaaagtacggtagtgctttccaacagaggcccgaagaccgatccttatagtggccccatgtggaagtacgatagtgctttgcaacaaaggcccgaagaccgatccttatagtggccgatgtgctactatcaaaaccatgcacctcgagcccagcctaaaaccattttgggggttttgaatagaggggaaggtttgtgtccaattccacataagccaaccattccataatgtccaaatgatatgaggactcccaaagtctagagttataaaaccacctaaagtttgtttaatttaaatggcgaagcatctacctaaacttggtactagtgagaccgtaaaacagtacccaccagcagggttttggttactctaggcaataaaaacaataacaataatgtgaggacgtcccaaagcctaggtggtgcaacgctccaaggcatgtcagcgcgaaatatctggatggatggggtctcaaataaaacccaaataaatacggtaaccatccaacctcatcgcagaccccgacatgtcttgaagagtgcactacataggctctaagccatcggatatgaaatagaagacacaaccattggaatagccacagcagtcatctatgtcatacgcccgtcaaccactcgatggtggcgaccaaaagcgtaccctagagactcgatctcaacaaaggcatattccccagttatctcaaccatttcaaacccatcctcatgtgggactagttgcccaggaatgcaacatagtctcacataaatcatctcaa

SEQ ID NO: 21708 - DNA, 258 bp, Oryza sativa
attcatgtttgaactctgtaatctgaagttctgtaagtttacaatcgactgcagtttttccctttttggccaaaattgaatagtaatgaactgcgttgatcggtcttgtgtgaaatgagatgcattcattttcgcatcaaaccaggcagacagaaaaacatttacagaacctcatttgtactaggggaacacatccttgcacacaaatttcccctgtacactccgtgcagatcaactagcaagtatgtttccttgtac

SEQ ID NO: 21709 - DNA, 313 bp, Oryza sativa
cggtgaatccgggcttgattggattgggtcggattcgatttttggatcacccccggagggcgggaggtaaaacccctcctcctcatttatggctttcctttcctttctccggtcgatccggccgaaatcggcgattgctcgccgcggaatcccgattgggtgtggggggatggcctgatctccttccgagaaccgggagctcggatgcgtcgagttggttttgtgctccttttgctttccctttttctggattcgggtttccatattggaaggtttcttgatctcgatttcgtggcgagagctggttgctgaa

SEQ ID NO: 21710 - DNA, 245 bp, Oryza sativa
cgacctgattcaacccggttttgttagtttagatttaacccggttcagagatgtaaaatgaacttatttcttaattgttcaagaacaaaaaggcctaacccagttgcaagaaacgctaacgatgagcccataataataccggcccaagggacccctcacagaaaccctagaaccgcctgattttcatcataaagacccctagcgccgcctccgtcttcgccctccgttgctccccctctcccaga

SEQ ID NO: 21711 - DNA, 1501 bp, Oryza sativa
ccgcttccgggaacggatacgtggcgatgctgaccacggtgctcgccgcagagccatgcagcctgagggctgatcggacgaccgagacgttggccggggtgacggcgagagtgggctcgacgacatccggtctggccgcggcgaggcggacggcgaggtcggtgcaggggccgatgtggcttgtggcgaagaagggcatgagcaggaccctcagcttcttgctgcgctcggcagaagccattcttctccgcaagccttctgctcttctctagcctggagttggagcgttgatgtgtctagtgaggattgaggaattgatggatttctgcacaagaatccaatcggcggtggggaaggaggcgcgcacgcgagcggcactcgacccggcgcgacggcggccagggaggcggagagtggtgctggtgatgcaggaggtgagcgggctcgattggaggcgatgcaacggcggatctcggcgtgtcgatgtggtggcgagggcggaaaagcaagaagtcgcggccccgagatgctcgatcgtgtgatggtggagaactggagatgggtttggtgggggaaaggaggaggccgatgacgatgaaaaaggggcacaggatgttacaggaggaggactgtggtggtggtggggaggatggacgcggcgcaccactttctgcgtcgagctccggtggcgcggcatggcggcgcggtggactgggtgcagcagcggaaggcgcgcgcgggagatgaggaaaagtaaacgggcggcagcaggcgacgtggcgcgcgacagggagtggatggttggcgcgactcggcgtcatcgcggtcgcggggccggtgcgccgggcgggtacaagcgaaacgctgctcgggtgacgcgatctacgtacagctggcgctgtacgtgcggtggttggtacggggaagcgacgaagtcgtcgttgtgaggtctgcttggcactacagcacggctgagatttcaaggggcagcggaaaggggggcgcgttgtccacggcttgtcgcgggacggcgcactggcgagctcggtgcggcagggagggagggcgggttagggttgcgcgcgcgagcgcgaggtgcggcgaggccggccgacgcaccaggtccaggtgcgtcctgggaatttttttcggttttagatttttttttaatatttacagaaataatctatcggccaaaaaaattataaaaatagaccctgccgcccacctctgaggcggcaagctgacgtggcaaacgggggattatattttttaaaaatagtgtgtattttttaaaaatttgtttgaataaatgcattatatttttagggttttagttgtactaatctagaagtgcgtattatagatatcggtaactacgtagatctgctagtttggaatcaatacattaccgttgcattggcttacacaagaagatattacgttgtagatgtttattgcatgaaagagtaatatgatctagttatttcgttgacagata

SEQ ID NO: 21712 - DNA, 813 bp, Oryza sativa
gccaaccactctggcgccccaaaaaggaccatttctgggataagttttttcaggggtctatttgcgaaataagtttttcaaaaggaccaaaatgtgaaaaatccagcctagctacctgctgcgagattgttgtcaaggctcaccaagtgacatgttgttgcaccattctctcttgacgaagtctaaaataaaattgtagaaaatcatttttttttctagtgacaacaatcgctcatcataggtctcacaaggcatgaatgaatttaatagggcgtaaatgagaagtttggagtccaatgacttgagtaaccaaatttcataagtaatcatgagtgtggaatgttgttacttgaatgatcactggatctaaccaagcctaccttcagcttaaaacaaagctatgcatatcagaaattaaaccaccttttacacatatatctagtaccgtgatatatatttctcataccccatatatatatatatatatatatatatatatatatatatatatatatatatatatatatatatagacacacactatatatatatacacacacaccgctcgttgtcttacttatcttacatcctgtaagtaacgctgtgtttgtctgtgcgattggaaagagttattctctcgtttatcgtcaggggcggtaccacccattaggcggggttaggcggccggcccagctacggcccgtgccgccccgaccctccatatccttcttggaccgtctaccaccacatccaattcacaattggcccataaataagcagcccaagtgtccaattttaatcctgcgtatgtga

SEQ ID NO: 21713 - DNA, 1501 bp, Oryza sativa
tcagtagtaatcattatcaggcttgtctgacagtgtctggcatgatgaataaattgtataattttttttcataggattcacttgtgaagttttttttttatcatctgcagtttccctatacggctataccatgtcgatgcctggtgatgcccaacctgaaggttctcaccaatccgcttcctccgcaaaacctgccttgtcatcgtgccggaggaataaatctgagaacacgtcatttgtctcagatttgagagatcacatccaggagtttatccatgcttccccgaatgagcacaggacctgttttaccaagactatcaagagaatgtttggcatgtcaaaggtcgttgcagagagatccaccgaagcaaaggaacctggagctgaaagtgttttgccacttcagaccacggtgtcgcggtagactgtgatcagtaatataattttctctgtagaaagtaatctgtcgctgaggatgatcttaggatagagaagtcatagttacacttgataccagtagatcatgtacagtaactggaggatattctgtattaatttgactgctaaaaggcctatatatattgtaagaagagaaactgagaagcagttctttgaattatctacacccaattgtgctatcacactagaagagacatttcctcttctatggaatcacgctgcacagcataacactttttttttctttctaatccaatcaaatctttttgttgcctataaaaacatgtctatcatctacaattgcgtcacaagtatgaccaagactgtacaaagcagcctagctgatccagcaagcaagcgccgcggcgacgagctggacgtgccctgctcggagagcgagctgaggctgaactgtgggttggagccgtacaacgcctgcacgccctcgacgtcgtccacggtgaggcgcaccttcttctcccgcggcttgatgctcgggtacatgacggcgcgcggcgacgccgagtggccgagccccaggacatggccgatctcgtgcgtcgccacggactccaggtcgatggccgacgccgtcgcgtcgacgtcgaagtccaccgcccagtgctccgacgcgtcgaggtggagccgcccgttctttggggagaaggcgtggccgaggatgccgagcggcccgtcgaacggcacgccgtcgccgtggttgccggcgtagaagcccaccttgatgtcggccgcctcgtagtcgtccgtctcgacgaagcccacggggatcgtccgcgcccaccgcgcgaacgcgcgctggaacacggcacgcacggcggccggcggcaggtagccgacggtggccgtcggcgagacggcgtaggacagcacgatcggcgggtccgaccgcgtccatcgcggctcgcccttgaagaacgtgaaccggctgaccacgccgccctgcgcccccggcgagagcgcgacggacacggggcgctccacatcgtcatccccgacgccgcagcgcggcgacatgatctga

SEQ ID NO: 21714 - DNA, 336 bp, Oryza sativa
agtgcttgttttattattctcacaattttatttgtaagagatcctatccgcagtccttgattccaccccgtttgcatttagcatcaagcttgctacagttgcttttaggcaaagtcatagcaatcttgagaaatggttggttgaaaagctgactgctcaaggagagacttttcttgaggtaatatatgagttcttccacatgtcaccacaaattcaggcagattgtacttttctatatggtcttcattccagcttggctctgtagtctgtacttttaatatgcatgctaacagctagtacttccaggaatgtgtgaaattcttgaaggaaattatg

SEQ ID NO: 21715 - DNA, 1501 bp, Oryza sativa
gctcggtggcggacgcagcaccgcgtgtggtacgaggaggaagaagccggtgatgcggaaacagagcgcacggcgagctacgcgagtgcggggacggcgaaaaaggaagctgaggagctcaccgacgggaggaacggtgtcgccggcgaattggggatgggaagggttggaaggctgagggtggcacgcgaccgagcggcggcgcacggcggatgacgccgagccggcgcggtgtcgaggcgtgtgcgccggggaaggagagatggagtgcggcgatgggcggcgcagagctcctcgttgactcctcgtgcgcacgtcggcttcccggcacgcgcgacggcggaggaagggcgacaatggcgcggcggcagagggaagtaaaacgggaagaaaagagggggagctcgggcttgggttttataggtgaggaggagaggtcggtttggaggagggaaaccgaccttggcggtcgagcgctcggctggcgctcggcgggcggtcacgagcgggagcagcgttttcgcgggctgcgcgaaacgtggcgacggcgaggatgcgaaggggcggtggaggcggtggatcgtacggcgggaattgaatcgcgggcgcgggagcatcggcgtggcgcggtcaaggtgggggcacaggcgcggcaggacgttgtcggcgtcctctgcctccgcgcgcaagaagacaagggcgagaggagagaggccgggtttagaagggaaaaagtgagggaggacggtggaaagggaagcctctcccttccgttttgggcggcgggcaggcgaggcgcgtgggagcggcgtccttgccggtcggccatgcgcgcgagaatcggcagcgtggctgggattttgggcggcgtcggcgggagtcaatgagagagagagggagagagagagagagaaagggtgagagagagcgaggaagaaggagagagcgagcgcacacgcgcaacgcacgtgcgagggggaggaggaggagcggctgagaggagatgggccgagggaggcaaaatagactttttcggaggagattgattcgaagagaatttgaacttggaatttgacttagattttggaattgggatctggatgagaggaaggagtagacggaggattcaagatggggttttggatattttggatccggggaagtattttggcgatgattcaaagagagggatagaatttcagagtttgatttggagacttgagtcggaagaggaatttcgaggaggcaatttttgatggtgacgagagggatcaaggacggatttgaattgagatcttggcacaacttagactcgcatacaaagaacggaaattttcgcatataagattttgccgaattagtttttaacgtctcacgaaaagcggagcgttacattaaggtactaggaagtaccatattttctagtataaaatttgatatctctcaatattatttccagtaataggagatatcaaatttacattaaaaatgttggtgcccg

SEQ ID NO: 21716 - DNA, 1501 bp, Oryza sativa
ttgatgcagtacgagctagagctatctatctttttgccactagctaagtgagtgtagtgatgactgatgagaggaggagctcatgaggaggaggaggaggaagggggaggagaaatagtgctggggctttgaagagctccaagtcgctcaccagtaacaggaagggttgttgtgaagtaattaatatagagtgggggaggaggagagagagtgtgtttgtatgtgtgtgtagggtgtagcatagcaagcactaacagtagcagtggagtggtacgagcccagtactactacatgtgtgtgcacaaaaacaatgtttgacaaaagctgtgtgcattaagggtggtgaagcgattaattagcgtgagagggtataggattagcgagagagaagagaggaagctgcaacccagcacagaagcaggcccccaacgtgccccatgcactgcatccatcctctgcccacccacattcagatggattgatgctccaccacttgcacctcactcacacactctctctctcatccattactccagcagagcactctgcttaatcttttttttcttttcaccaagcataagatcagttgggggcatctaaaaaatttactacttaattaaaccatcgatggactagttttgttttggtccaacaaaaaacaaagaggggggctactagtaaattaaaagaatctgccccgttactttaaccgcaatgcatgcacacgagcacgtgactccatgagctgtagcctgcgggagtgtccatggaaaacggatgccgaagcatcctggcccccgatcgaaatcaatgctagctagctacaggtcgcagcttgcactctcccactcatcagctcgctagctctcccgtacatactcatactgcttcaattccctcggcagcagaaagtctgccatccagaatggttaaccgcccggttttactccagctatattctcataaaattaacaccactcttgatgttgattcattagaagttactctaagatcaaattttgattggggctgataagtcaacaagtagatattaagagtgaccctaaaaatatttcccattcatgtgtcaccgttgatatgatgagaggtaaaattggagttggctgaggttgcaattgatgcatccaatgataatatgagatgaacgaagtaacatcaaataaacataataaaactttttttatccatgctcttaacgatttaaaagctaatgcaacatcaaagtaaactacgatacaaaaacattcagataaaattaaaatgaagtttaaaaattaaaatttttgttgcggccgagatatataagacaataacatgacgggtccgtacgctaaaatgaatcatttcattaatttggtaatgccaaaattagcaaattggcaatattttcaagttttagtaggatgtgctcaatataatgttgttaaaatttcatagacattatcaaaatttggtaacaaactaaatatagccctataat

SEQ ID NO: 21717 - DNA, 1501 bp, Oryza sativa
ctctcgttctagaacccaaatattaaacttatagcatatttgtcatttttcactccttaaatggatgttccctcgtttctcgcatgctatctaaatagttatattttttaaataataataataataataataataataataataataataatatagatcaatatgtatatcattctacaacatgtaggtttaagttcaagtcatttttttcataattgtttatacgatataaataaaacaaggggacatctgaacaaaagagaactatctcagaagaaagcagcattttttttaactcccattctagtactgaatcttgaacccaaataggtaaagaggttaaacggcacatttgccatttttttactacattttcacataactaacttatcagaagcgcaggatggtacatgttctccctccgtttcaaaatatttgacaccgttgactttttagcacatatttgaccgttcatcttatttaaaaatttttgtgaaatatgtaaaactatttgtgtacatgaaagtatatttaacaataaatcaaatgatgtgaaaagaataaataattactttaattttttgaataaaacgaatgattaaacacgtactaaaaagtcaactgtatcaaacattttaaaacggagagagtagttaattaaggtgtgaaatggtattgtttcctcgggcattaatctttgtcagttgctacagcctgcaacagtgcacatggcttgaaccgatggttacaggccacagaaaaaaaaaagggaatccaagtactttgtctgatcatcacctctaaagttaatcaacatgacagcatgtggataatctcccacgtcctctcagttgcggttcagaagttcacagcgagaaataaattactcttcaaattgaccaactttgctttagattccatgcaaagcacacgcctacaggatcgatcaagcagcagagacatctcgcactgattttgtcagtacaacgtacaaaaatacgttctcgatcgacgaattcttctcctcatctctttcgctgctgctgctggcctgctgctaacaaccagtaggtgctgcattcttgactcctgcccggcgcccgcgatgatcagaactccacaaccaactgtttccgtagccgattttaaaaaagtttttgcagtacaattggtacttcgttcttggatggcaattagtatctgaatgcgtacctgctacaagaaagattcggcaaagcgaaaacaagaacagctcattgtgccatttgcataatttgcatgcgtgattcttcagaaagtgcagctagcaggtagctaagccagcctaccacatgggggaatagggacaggatgggccaggacggcgccgcgctataaatctcgcgccaattcttgcccgcaaattcagcagcagcagctaccagcaacaagcattctcttctagccttagcctagctagctagctttgttgtctagctctgatcgaggttggtggtgatca

SEQ ID NO: 21718 - DNA, 299 bp, Oryza sativa
cccccccccccccaaaattttttatttttgttttatttgtttgatatttttttcacgcttagggacacacaagaaccaaccatagaaaaattgaactcaaatagacgtaacatgtgacatgtagaatttttcctctcctctcctctctccgaactagtgcagaggagagagatgtgcaacttttttatttttattttatttttttgatactttttcacacttaggaactcataggaacccaccatgtaaaaaataaactcaaacggacgaaatatgtggcatatggaattttccaaagc

SEQ ID NO: 21719 - DNA, 1501 bp, Oryza sativa
accacccatatgccactgccaccgcgccggcgaagtcaatctctcgttggacgctggacgacgacgcgcgcgtcggtgcgcgcccgcgcgatggacgacgacgaggcctctgcggccgccgccgcttcgcatggggggcaagtgtcaaatcgcggcctgcgcgcgaacgtgacagccgataactactcgtcgtctccactcgccatctcccctctttgtgtaaagccaagaaaccctcctgtacagtcgctttgcacgccatgcatgcctcctctgtcaccggtcaccaccaccccccctcacttgctgccggtagcaagcacgttggcttatttacccccctctccctctgcaagttgctttgcttattctttctcgtcttcgacctgcagataaaacctcaaccgatgtatatatccgcaggtcacatctgcaaaaaccagagacgtctgactttgcatcgagcacaccggagaagagaagagaacatgcatgcatgattacaatagtacattattcagtgctactagtagtagcagcaggcagcagtaacagtaacgggggtggtagtagtactagtggcatacaataatcagcccacaatatacggctcaagcaaacagctccacatggaagtcggcaggcagcacgctcgctagctccatggccaacaccacaccgagctcactccgctttactactctcaatcccaaaatatagcaacctaaaatcggattatacattttctcatagtactcgaagatgttctatccacctgtccagattcatagtactagaaaatatcacatccggatatgtttagtttacgctaaaattaaaaatttggttaaaattagaacgatatgacggaaaagttgaaagcttatgcgtgtaaaaaagttttaatatgatgaaaaagttagaaatttgaagaaaaagcttaaaagtaaactcggcctaggttcttatggagagttttttttcctctcaaagcagtggcagcttgctgctagccccaccaaggagaaagaaaggaggaatgaaagggaaaaaattagaaacgtcgcgaataagtgaggagggagggagaggggagcaccgtcacgtgaccggaccattgcccactctttcccctgccaaaaaggccatgatagggcaagtcacgtgctgacccacccacctccaccaccattccccgcttacctcgcgtctttctttttcacccattaaaatgcttgacctaccatcccaaagttttttttttcatataagaaataaaaacacatatactagcaaccgaagtcgatcgagtcgagtcgaagttattaatggccatgaagaaactaaggcgcaaacgcaatgggcaagtactggtagtaccacgagagaaaattcaccagaaaataacgaaaaagcaaaggatcagatggagaattaacgaacgaacgggaggtacgttagtacgtcgaacgtacgtgagacaactaatcgcccctgcctt

SEQ ID NO: 21720 - DNA, 1501 bp, Oryza sativa
gcggcggcggaagagaggcggaagcgggaggcggcggcggtggatcggcggcgacgacgagtctgggaggaggcgacgaggagcgcgaatcatgcggcggcgggcgtcgaaattttttttttgagagggatttttttttttttttgatgaagagaaagagttcgtcgtgcgggccggagatggagtggacttgggggaggaggtggggcgatgtacggtctggatttgtttcgtcgtatcgtagaagggatctggcccgtccgttcggtacactggactccgagtcagtgataactacggcgcagccagttttgtcttttttattgcttcatcgggccggaaccggatgaccgggcgatggaattcagggtcggtttgtgtcatttaattacgacgttaacgttaaacatgtacaacaataataaactgatcaacgttaatattttgtaaagtaaatttttagagtaaattgtacccacggtacaaagaatttggtagatacgtgcgatatagtataataacttgaagaaaaacgagtagactggtatataaacttgacaatcacgtgcattttaatcaaaaacataaatatatatctttgattaatcttaactgctaggttttggctcatgaattcaatttcgtgttttgccatgttcataacccaatacaatgaatatgttgattaggcgagtcgctcgaaaattatgttatttgcatgcacttatttttgataatcatatatcttttggtttcaaatagatagattattttattgttacaactaacagataaagcaatatataatacatctaaatccttgtcaagatggctggcatgagtggctgctttttttatatggcataaaaagtatggtgtgcaatattgatatttagccaaaatgcacgcactagccaagttgttcccttatatactcagtttttaaatttttgcactagattacacccacctaccccaagtttacgtattgtagatgtaatttactcaaaattttaaaataagatcatctattgaaaaaacaaagatagtatgtaaagagcattataaaataatttatcgttctatgggagaaaagaaatgaaaagaggagtgaaatgaaaagaggagtgcctctgcgtcggtggtaaaaaagaaatgctgtatgtcagtggtagatatcatcgaccaagatccgactgtgcccaataatcaatactacacatgtctagcatgccggttatggttgaaataaagttatttaaatgatgcattcgttttttttcaagttttattgagaaccttttaaaacaaaggattaatgtataaattttgtaggatttaaatcttatagaatttttatatttgaccttttttgatataaaggattgaaagaatatctaacttaattgcatgtagatttgttttaccgttatacttattttctccgtcaaaaaaagacaaaccctgagtttccgtgtccaacgtttgaccgtccgtctta

SEQ ID NO: 21721 - DNA, 1501 bp, Oryza sativa
ttttcttgttttaattcaaaataaatacgtcttgtattttttgggtggaggtagcattattatacttaattacctaattaattagatactcctaagtacaaaaaagttggtggggcctttaattgtctctgctcgtcccgctatctctgatcactggtcactactatcacctaaacgaaatcctttgggcagaattaaccacttctgtcatcaacaaccttccgaaagaaaaaacttctctcaccagctaccacaccatcatttagggctgctagctgttaagtcttttatggcatcagattctttttattgtacactcaggacgcgaggtagaataacatttacagacacagtactagtaatttgaaataagctatagccataacattgtctacgtacttgaggacaactcgaccggcataatgtgcctatgctatattgcaatgtcgtgtaccgatgaatggccctgtacccgtgtgactgtatatttgtccttggaatctcaatcaaccgagagcatatgtcaaatgattttttgttcgatatgcatggagtgtgcctgcccctaaccattttaggatgttctgtatcatctggatttcttttcaaagtccacttatgaggcctgatttggttacttcagtgatggtttttcaacaacgtactactagtactaaagatttttcacggaaaacaaatcgaataggcactgaacttttttgttataggaatgggcacggactgaatgagcgtccgaggcagctaaacaaacacatgtcagtacaattgttacctgtcggttcgtgcatttatttatttataatatatttttggaaacaaatatatttctgtaaatttttttaaaaaagaaaacacatactataaattaaaaaaagttatcggttcgtttcgaaaattcaccgtgtggtggtggactgttggtggtgggttgtgggccttgtggccctttgggcgtggggcaaggtggtctttgcaattgctttttgtcagtgggtagtcgcatttaccatcgtcgtttaggcccaactggcccccgtcttgttgtgtgtctgattgctcccagctggggtgggttgctgcaggattcccagggagaagaacacacacatgatggatgatgatgccgatgcgtgccttgacctgccccccctctcccctgctactactagtagcagtagtggcccaggcctccttacggtgtgggcgtcaccacacagctcaccgcgggccacgcagcttaccttgttactctcttcgtttttgactttggttaagatcaaactggttcaagtttaataaaatttgtagaaaaaaaatagtaatatttttaacctaagataaatttattatgaaaacatattcaattattgatttgatgaaactaatatagttctataaatattacacatttatctataagtttagttaaatttaaaatagtttaacttttactaaagtgaaaacgacttataacctgaaa

SEQ ID NO: 21722 - DNA, 1501 bp, Oryza sativa
gagttgccggatttcttgatccggcaagggaacctcgacggaatcgacccgaacaagattccccaggggcaaaggatgtgccatggtctcgccgtgaacgcgttcttgggcatggagcagccgtaccgtgagagattcttgcgcgacggcctcgcaaagcgcgtctacttggtcgggccactctcgttgccgcagccaccggccgaagctaacgccggtgaggcatcgtgcatcggttggttggactccaagccgagccggtcagtgctgtacgtatgcttcggcacgtttgctcccgtctcggaggagcagctcgaggagctggctctcgggctggaagcctccggcgaaccgttcctgtgggcggtcaggaccgacgggtggtcgccaccggcggggtggcaggagcgcgttggtgataggggggtgctggtcagagggtgggtcccacaaacggcgatactttctcacccggcgacggcggcgttcctgacgcactgcggctcgagctcgctgctggaagccctggccgcccgccgtccacgctgcctgacgtggccgctggtgttccaccagtttattcaagaaaggctggtcccccgcgtcttaagattggcgaaaaggtgtgggactggccaacgaacctgcggcactaggaggcgatggtggtgccggcggcggcggtggcgcgagccgtggcgaggttcttggagcctggtggggcaggggacgcggcgaggctcagagcgcaggagctcgccgccgaggctcacgcggccgtggccgaaggcgggtcctcgtaccgcgatctgcgcaggctcgtcgacgatatggtcgaagcaagggcggccggcggcgaggctgcggctgcaccgcaacctcagtagcctataatgccaatgcgttcgtctgtacgatgtcgagtcattccactgttgcaggctcccagttcatttcgctcagttgtcatgatgcactgatgcaggccttgttgtgactttgagaaacgtttattcagagtgcaaaccgcagaacacttcttcagttcagttcaatgaaatcagtatattgacttggtttgtaatttgaagcttttaggggtagtttggatatagggactaaactttagtctatgttacatcggatatttgatattaatttataatattaaatataagctaactataaaactaattacatagatagatgctaatttgcgagatgaatctattaagccaaattaatccatttttaacacatatttactgtagcacaacattatcaaatcatgtactaattaggcttaatagattcgtctcgcgaattagcctccatctatgtaatttattttataattagtatatgtttaatactttaaattaatgttaaacatcctttatccaaactacgctttagtagtttgggaaatctgataagaaatgggttgggtaatcttttcttctctttttgaagaaaagaaattgtggatgatttgaacagc

SEQ ID NO: 21723 - DNA, 1353 bp, Oryza sativa
ttgctagccctagaaattcctcccagaaacatataattaattataacaaatcgctcactaattcgtttcagtgatagacaggcttgagtatttcgccaaatgatatgattgccctatcaatcacaaccccacaagtagtcgtaaagttcaacagaaagttgtttttgatttcttgatttcgacgccttagggtgacaacatagaaaacacaatatatatatttttgtttccataataaaaaaaagtcttacagttacatgtacagcatagtttatatagacagggtcacataacataacataataggcaataatctaccaatacaatttacatcatgaacgtagcaaagacggaattaattagtatttaagcacaaatgattccgagcaagatgcaacgagttaagctaggctattggtacaccatacacaggtagaaaaaagtgtacaacgatcaacaacataaaaaaaaaagaaagaaattatatcgcccaatgatgaagtacgagagggacatttcaaccaaaagtatgatgttgcatgtaacaaccaatagaaatggacctaggtttttcggtattgcacaaggcaggcaggcagcagggggcgtgtgcccacaccaaaggtaccaacctgaacttgcagacaagcgaaagattccaatacgcataaaaaagttgctttcaaacaaatctgtaaaatcattcaccccttgaaacttttgcaatgcagaaagcaaagaattattgatggggagttcacattattcaatctccatctttacatttttcctttgacaccatcgtacaaaagtcgggcatacttggttgttctgagacgacatgatagctgctaactatttttagcatgttgttgagatgtatcactatgcctttgaatctaaaacagaaggaagttggctgacatctagaacatatatactgtacataccatatggaattggcaacatagaactgtatcaagaaatgattaatctatctgtattgctgtctattattagggttccattttattacgatgtggtactgattaggagggaaaagactttatttagatttagggacacaagaatgagagcacaagctacactgagcttgccaaataacaaaaggttatttgagacactgacaatgaaacaagctgcaaaccacagaacagaacacaaggcaaacatggaaatctcagtttataagcatatgccactggcaaaattgacttgttgctccaactccatatcgtactataattcgctcgcaccttgttttcctcttctggaaaggagagcatctgtagcccctggttagaaaaactcaacaaagcgttcatagggcat

SEQ ID NO: 21724 - DNA, 1501 bp, Oryza sativa
atcgttaagagcatggataaaaaaagttttattatgtttatttgatgttacttcgttcatctcatattatcattggatgcatcaattgcaacctcagccaactccaattttacctctcatcatatcaacggtgacacatgaatgggaaatatttttagggtcactcttaatatctacttgttgacttatcagccccaatcaaaatttgatcttagagtaacttctaatgaatcaacatcaagagtggtgttaattttatgagaatatagctggagtaaaaccgggcggttaaccattctggatggcagactttctgctgccgagggaattgaagcagtatgagtatgtacgggagagctagcgagctgatgagtgggagagtgcaagctgcgacctgtagctagctagcattgatttcgatcgggggccaggatgcttcggcatccgttttccatggacactcccgcaggctacagctcatggagtcacgtgctcgtgtgcatgcattgcggttaaagtaacggggcagattcttttaatttactagtagcccccctctttgttttttgttggaccaaaacaaaactagtccatcgatggtttaattaagtagtaaattttttagatgcccccaactgatcttatgcttggtgaaaagaaaaaaaagattaagcagagtgctctgctggagtaatggatgagagagagagtgtgtgagtgaggtgcaagtggtggagcatcaatccatctgaatgtgggtgggcagaggatggatgcagtgcatggggcacgttgggggcctgcttctgtgctgggttgcagcttcctctcttctctctcgctaatcctataccctctcacgctaattaatcgcttcaccacccttaatgcacacagcttttgtcaaacattgtttttgtgcacacacatgtagtagtactgggctcgtaccactccactgctactgttagtgcttgctatgctacaccctacacacacatacaaacacactctctctcctcctcccccactctatattaattacttcacaacaacccttcctgttactggtgagcgacttggagctcttcaaagccccagcactatttctcctcccccttcctcctcctcctcctcatgagctcctcctctcatcagtcatcactacactcacttagctagtggcaaaaagatagatagctctagctcgtactgcatcaaacgggcggtagttgcactgcccgtttcaagggaactccagtgacaaccagcttcttgccaattcagaacgtgaccgtgtggtacgtacggccaaggcagtggctagctcgcgatggcgtcggagtgggaaatggccatgggcgtcgacctcggcatggggatgagcacgtaccacaacgcctccggtggcatcgccgccgcgccgatgatgggccaccacggcggaggaggcggcggcggcgggtactccgccgcgcaccaccaccaccaccattactac

SEQ ID NO: 21725 - DNA, 1501 bp, Oryza sativa
ttagttcccaataaaaaccctcagttgcccgacttactataacattgattgttatgtcacttgtctgtggatcaactctcaagcccctcattaaccatccttttatagaaggtacactcctctcagccggtctatcaattcccctttctgatacaataaaatctgacagatctaccccagttggcccgtaacagacgtttcgtggtccatggtaaacttggaatatttgtttgttcgacatatctgtcaacgaaataactagatcatattactctttcatgcaataaacatctacaacgtaatatcttcttgtgtaagccaatgcaacggtaatgtattgattccaaactagcagatctacgtagttaccgatatctataatacgcacttctagattagtacaactaaaaccctaaaaatataatgcatttattcaaacaaatttttaaaaaatacacactatttttaaaaaatataatcccccgtttgccacgtcagcttgccgcctcagaggtgggcggcagggtctatttttataatttttttggccgatagattatttctgtaaatattaaaaaaaaatctaaaaccgaaaaaaattcccaggacgcacctggacctggtgcgtcggccggcctcgccgcacctcgcgctcgcgcgcgcaaccctaacccgccctccctccctgccgcaccgagctcgccagtgcgccgtcccgcgacaagccgtggacaacgcgcccccctttccgctgccccttgaaatctcagccgtgctgtagtgccaagcagacctcacaacgacgacttcgtcgcttccccgtaccaaccaccgcacgtacagcgccagctgtacgtagatcgcgtcacccgagcagcgtttcgcttgtacccgcccggcgcaccggccccgcgaccgcgatgacgccgagtcgcgccaaccatccactccctgtcgcgcgccacgtcgcctgctgccgcccgtttacttttcctcatctcccgcgcgcgccttccgctgctgcacccagtccaccgcgccgccatgccgcgccaccggagctcgacgcagaaagtggtgcgccgcgtccatcctccccaccaccaccacagtcctcctcctgtaacatcctgtgcccctttttcatcgtcatcggcctcctcctttcccccaccaaacccatctccagttctccaccatcacacgatcgagcatctcggggccgcgacttcttgcttttccgccctcgccaccacatcgacacgccgagatccgccgttgcatcgcctccaatcgagcccgctcacctcctgcatcaccagcaccactctccgcctccctggccgccgtcgcgccgggtcgagtgccgctcgcgtgcgcgcctccttccccaccgccgattggattcttgtgcagaaatccatcaattcctcaatcctcactagacacatcaacgctccaactccaggctagagaagagcagaaggcttgcggagaagaa

SEQ ID NO: 21726 - DNA, 1501 bp, Oryza sativa
ctagattagcaattctctgaagcaaaaagttgtcagcctaatataacccattaatttactaataacattgattaacctaaatctttgcatacaaaaatttgcaccttaccattccgagctaccgggagatgattcctgccaccatgcactggcggcatgagcacctacggtaggaaagccagcgcctagagcactagctcgtagagcaccacaagcaacaacagtagaatctggagcaccgtcggctcccacaacactagcggcatctggatcaagggcagtcgattcaccggcagcctgattggatttggatcgacgcatcttcgattccgtcagattcatgcttgcgcatggctagggagaactactttctcagggatgagcgattggggatggttttggctgattctagctgtcacgagagagattggagaagacaagtgattagggaaaaaaggaggcaacgagatggatagagagaagcacgagctggtgttggcgcgaagaggattaggggcgcgccgaaaaatcgtgaggatttggcgcgggacggtggtaggcatggcggcgggatggaggcgggcgcagcagatcgagagctcgaggaaaatccgggcggaagaaacgatgagttgcccccaacgctagtttctcttgtttcgtagtcttggtgcctgcgcccgaccccgtttcgtgcatgagacacggtttctctctttttttcttctctcccttcattaaattctttgccacatcatatttttgcttatgtggcagcctaataaattctatagacactagctgaggtggagggttgggagtgccctgagaagagctggagccgaatgacaaaagcgatgaagagactcgatccaaaattaattttgctgtggatcttgggagtaccactctcgtcgataaaatatgtggtacttcatatcctttccaaatattacacattatttttatcaccaagaccaaaaaaaattaactcatctggtatataacaaaacaaagatatatgcacgcgtacaaccatttagtataaaaatggtttctcggattctgatcaatcatttaattttcctctctatttaaatgtgtagagcctataagtaggaacaacttatttgaaaaacttaaatataaaatatgtctaactttaatggatggaggaagtatcattttcagtgcttaattactggtacttgacaataaggccggttttgttttcttgatctatatacacaactctataactgtttaggattttttggcatgcaaacgagataaattagtgttaactactataaatttaaaaatatttttaaagaaaaacatgtgtatatataacttttacaagaaacacgtggtttgagaaagctggtttcacgaaagaaaatagacgttctgaatatctatttagaactcagcctaattagatattatacaatatccaagcttcaggaaaaacgtgcgcgccctgatgattatgaaattt

SEQ ID NO: 21727 - DNA, 576 bp, Oryza sativa
agttttcttagcaaatttcagcaactataaggttagttttcttagtaaatttcagcaagtattttatattacataaatactaattgtggtctgttatatttcaaatgcacaaaaactcatcagcaacttttttttttgaagctatgaatagtgtgcattaaatgctagttctgttagctttttttttagaaaataatttcacatgtgtgtatatgatctgaaattttactgaatgttgttttttggaggaaaggcgtaattaaacgcccggctttcattaaaaagcgcaatactgaatgttgttttcgcttaacctctatggatttatttcttcttctatgacttttttgtgcttatgcaggggcaaaatgagaaaaaggcatgtatctaaggcagctatggaaaccgaagaagatggaaccagctgcggctacctcgcttttattctaaagaatctgaaaataatttggtatttagtggcttatggcatgaattaagttgaagtgattaagtaccctctctatgatctctgttttcaaaatagtgattgagtacctcaatttctggagaaacagt

SEQ ID NO: 21728 - DNA, 1083 bp, Oryza sativa
aagtaagatgtttaaaataaaaaaattacatattatgatagtttgtttaatgataaatctagtaacatcaattttatatgattaatcttttttatttttttctattaatagtcaaagttgataatgtttgacttgtcactaaactaaaaatgcttatattttgagatggagggagtagctaacatatgagactctgaaagaattgcttttgtcagctttatatagtgtagttcattttctaattccatggctacacattgttaaaatctatacttaggccatttacagtgtggtgagatagtggttggcctcacctcgtcagctcgaagattcccgtccacataagcgtgggttatgcccttgctagggtgcgcaagccctcacgagaatacacgaatcttgtcacggattgttaggacgaaggacaatgatgcacatgagcaaaggtcgaaaccgcgttagggaggttgtgatcacgacgcaaagcatctgttgccaccaccattgagcttcaataggatccaactagccgaggaagtagaggaagccagatccgacgcttgagctaccattgcctccgaggccaaatgcagcgagcactaggttggatctattgtgttcatggcgcagagctaaagataacttgaaagatggattcatatgatttttttaaaattaactttcctatatttttttcttataaaaatgcaccgagtataaaaatgtgcgcgtggaaaacaaggaattaaagttaggaaccatacatccgaacatagcctactactccctttatcctgatttgatcatcacctaagcaaagaatgtaaaggccaaagacaataaaacctttataattctgaaattaatcctcatcggttaagatgctacgtcgctcgtgccccgtgaattgcatcaagctttaaatattgcacgaggttacactaatataaattaatcttggccgtggttacatgcagcgtattaaattatgtctatttattcttcatacaaataaacagagagacacgactagttagggagaataattattttttagaagatcctaaaaataatcttagggga

SEQ ID NO: 21729 - DNA, 1501 bp, Oryza sativa
cccagtgatggtaatgaaaatctcccatcacttagagttggtgggattttctaaggctagataaatatatctgcttgttttttttatgtttgcttgcaaattatatttgacaaatataatttcaagtcaagaatctcagatatatcttttgaaatcggttgcaagtcacgggtactttgctagttacttcctctgtttcgtaatgtaagtcattctagcattgtccacatttatatagatgttaatgaatctagacaatctagatatatatgtatgtctagatttattaacatctatatgaatatggacaatactaaaatgacttacattgtgaaacggagggagtaataaatatctaaagtcatggaaaaactaattaatctttctcataagcacattaggcctcgtaagctgaaaaacaaatgccatcaaatgcatgattggataaaatgatgaccgtccgatcagatacatactccctccataaaaaaacaaaccctaggtttccgtgtcaaatgtttgattgtccgtcttatataattttttttatattagtattttcattattgttagatgataaaacatgattaatactttatgcatgacttgtctttttaattttttcatattttttaaaataagatgaacagtcaaatctagggtttatcttttttaaaggacggagggagcatatgtattatccctccggagccttctagtgcctctcctcgcgcacttggcaggcatgaaagagaacaagcaacatatttgggaacttaattggcggcaatttcataagttgagtacttatgaatttgacacatggaccaaatgaaacaaatattgtctctagtttttaatatatgatgtcattgacttttaaatacatatttgactattcatctttttcaaaactttttttcaaataaataatatataaatcatgcttaaaatactttcaacgataaaacaactcacaacaaaaataaactacaaatatgtaaatttttttagtaagacaaatagtcaaccgtgtgtttacatgttaatgatgtcatctattaaaaaccgaaggtagtatgaattgtttatgtaaaaaacatagaaattctatggcggttatgtatgtgacctatgggcaacttcatagtaatatttaggtcaaagatcattttagctacaaaagaaaaaaacaatcttaatctttaacaaagatggtttctcatggtcgtgcaaacacgcgactttgagtagctagtatttgtgaaaggacgacgggtaccattatgttttatagaaaaaaaatatattgtcagcaggtaagcgacccagatcgtagctgatcagcgtgcttacttttttaattagtagtttcagttaccatcgcatcgtgactcacggagtgtacctgcttatattattttaagtcgatcataaatcaaattttgaaatgcaactatacgtcgagcgcccaattcgagggtggaaaaatcggacgccc

SEQ ID NO: 21730 - DNA, 1501 bp, Oryza sativa
tatgcaagaatcactaaaatacatcaaagtggtatgagtgaagaccaaaagatggaccaagcattccagctatatgcctctgaacataatgacaagcctttcacaatggtgcatgtatggaggatattacggcatgagaaaaagtggtctacatatttgaagaaaattaacaaggaaaagtacaagagtataacttctaacccaactcatgttgtgaatgtcgaagatgctccaaaactgcgtcctattaggcataagaaggccaaagatgaacgcagcggaaaacgtctggcatcagaggctatttctgttattgaccagaaactagataaattcattgaagcaagcagcaaggctgagaagataggagaggtacaacaaagtttggcaaataagaagctagaagtagccaaccttaatcataaagcagctcaggaacaaacaaagagtaaaatgattgacctttacaaagacttactgctagctcccacaagtgatcttagagaaagttcaatactatagcccactactagctccaattcatctatagccaatctaatagctaatttatacaatgttgcttcctataatattaatatatggtcccacctgccatacacatattgcatcttggagcctgtgctacagctggctacaaatctgtagtctgctgctcttctctcttattatttatctcattaaaatatatttatagctggctaatagcctgctattgtacctgctcttagtgaagaagctttggctgagagatccaaaacattggagtgtatgagattggctttgtttgctaaagataattgaggtatgtttttaatatattgttggcaaacaaattgtgttgtgatagtaccattcaaatctgaacaagtgttaattttgtcaattgtgtgaactcattttatttttctagtgcttgtttgaacacaattaattatgttaactcattttttatactgcatgttgaacacaattaattttgtgaacctattttctttttatactacaactgaatactatcaattgtgtgaatgcatcctctttttgtactgcatttgaccactatctattgtgtggacccattttatttttctagttcttgtttgaacacaactaattatgtgaactcatttttttatactgcatgttgaacacaattaattttgtgaacccattttccttttatactacaactgaatactatcaattgtgtgaatgcatcttctttttatactgcatctgaccactatctattgtgtgaacccattttttctactgcaactgaacaccattaattgtgtgaacccatttgactaccctgacatatttatgtgtgtgtatatatatcctctagctcacacattctccccctcctctgccttccacattctttcttccctctttactcttccatcttctctcatccttaacaccatgtcgaaccaatctgatggtgattcccctacacatgatgattctcttg

SEQ ID NO: 21731 - DNA, 249 bp, Oryza sativa
tgaattaatggggggtagctttgaatttccgattacgacggttcttgcatctagaactggtcttatccagcaatcagggactcatgacagtaatgttgcaataataattagtatcctacttagttaatttatttggaagaccaattaagcagaaatggacggaagaaattcaaaccttcaactcggcgacggcgagcaatttaggaataccaggaaagttttcatcagtttaattattttatatgcaga

SEQ ID NO: 21732 - DNA, 504 bp, Oryza sativa
tcagaattcaaagctctgaattacaaacttactgagaatcaaagacaagtacaacctacacaaaaactgtctcactgccgatatatgttctggctaacatctaactagatagcagcagcaatacaagctttcttcaatgtatcatgagttcacgatgatatttatttgacccaattttttttcgataagctgtagacccatttcaactaccacctttattaaaacctaataaaatcaacattttacacaatgtggtgcgtatttacttcatatattggcttgtacttgtactgtctacaatatacagttcatattggtccttaaaatgtgaccagtgaatccgaaaaccagaagttccagaagggtatacaagtgcacaatatcagactatcaactggaaaatagcaacgcaatatattaaatataatcaaatataattgacccgaatccacaagatgttgtcagaaatcacaaataggataatatggcatgaatatgccaaca

SEQ ID NO: 21733 - DNA, 274 bp, Oryza sativa
cggccgggttgccaggaagtttcgggccaatggccgtgcagaagacatgaccggaagttccgggcataatgccaggaggttccagccagatggtctttactatgattcatatgtaatttccaaaaattcagagggcaaagtggttgcttattttaatgtgaatacaatgatgagtaccgcacttgtgtgtgggtgccaaaggctttggtaactaacatcaagggacccaaacttagacaggtttgggttcctaaatcccaagcttgatttcttt

SEQ ID NO: 21734 - DNA, 974 bp, Oryza sativa
tttaaacatagtgctatgctgcatggccggtgccacattggtcaacaaagatggagctcatagaaagagggttgggagaggagaggtgattgatttgtgctttctcacttacttagggggtgtttaaatgtaggggtgtaaagttttggcgtatcgcataggatattatatagggtatcgcatggggtgttcgggcactaacaaaaaatctaattgcaaaatacgttagtaaaccacaagacaaatttattaagcctaattaatctatcatcagcaaatgtttaatgtagcaccacaataacaaatcatggagcaactaggattaaaagatttgtctcgcaagttagtcgcaatctgtataattagttattttttagcctatatttaatagtgttcaaatgcttgatgtgatagggtgtaaagttttaagatgggatttaaacagggccatgtccatcaacattggcttcttttttaaatttgcatagatactagtcatttcaaaatgttactaagtacaaccttgggatgagatttgatccatctaactagattcgttgttagaataagttaaattctattctactactagattacaatattttagacagatgcagtaacttcccactcacaatacggatttcgtcaccagacatcagtaaaggagaaattcattccagtcatgacgtgtcagctcgtagaaattatagtatactctctccgtcccataatataaaagattttgggtggatataatacattctattacaatgaatctggtcacatccatctaaaatcctttatattatcatactaatccataaagcgaacttggcaaccttgtgttaattaagctgaaaattttattgacagaaacaacgcaaagacaatgttcgagccgcttagactgttctggccgtggaacccaacatgctgctcttttggcccattccaagcccacaggagaaaaaaaa

SEQ ID NO: 21735 - DNA, 1501 bp, Oryza sativa
gaattaaatttgaaaatatattgttcattcaattttttatcaggaatattcgggatacaaattttttttcagaactataccgtctgtctcgcacaactattacgcgaaaatgacgtgggaatgacatcgcggacggtatcacgcggtgaaagcgcgagaccatgcgcggcctcgcgaaatggaagagcgagaccggctcaagcaatcagcgacagtccattgtccaacgactccatttgattagttattaattacttcattaacaattaactaataataataattagtgattaattatctggattacggattatcgttgattgcttgagcgagaccgcatggcaccggtatcgttgattgcttgatcgctcttccattccgtgaggccgcgcggtctcgcgttttcacttagtgataccgtccgcaacgttattcccacgtcattttcgcgcaacggttatgcgagatagacggtatatttctgcaaaagattttgcatcccgaatattcctaagaaaaaaatgaatgaacaatgtattttcaaatttaattcgtaaaacagttcgtggtttaaacacaaaaattgacaattcacgagctttgtccacaggccaaaattatgtacactgacacgtagttgtttggctttgatctgaaggccaaaatttgtaatacctgagcctaaaactgatctttctctatgtcagtgttgcagtgaattcgtccgtagatgttgcagtgaactgcaatgattttgagttcatgcattcatgtgatataaaaaaggtaaattagaaccatgccattataattttgtaaagtttgagatatgtcatcggtatctcaatgacatgtaggacccacatgagtcaatgacatgtgggtcaggatggcatatcttaaattttgcaaaattataatggcatggctccaattttccctataaatgggtggcaaaatgtgcaggctcagaatgatgggaaacccttacggaaggttaaattaactcggttttaatagttaaaggaagctttattatattattttactagaaaaaatgcccgtgcattgcaacaggtgaagtttattttaatcttattattattatatggtttagttaagatgaaattcactgtgggagttcgcttggatatatatatttttagaaaatcataagctgcagttaggagttcgattatccttttttaaacagatttcttatatgattccttatgtattaccaaaagtgaacgatcttaaaaaccgtctcaaatacggatatgtatttccaaaagcaaacgaacttaaaactgactcatacgcggatgacgtaccaaaatactggcaaaaatatctttaatttctataatagtaaagaagagatatagattaaaaccaaaacataaaattaaaaccgactcaaacacggataacaaaccacataaacatcttcaatttttataatcgactcaaacacggatgatggaacacggaaacacct

SEQ ID NO: 21736 - DNA, 1501 bp, Oryza sativa
cggacgcgactgtcttcgagttcgggtcggcggcggagtccggcgccgccgtgacgctcgcggggtactgccccgtgtccgacgacctcgagccctgccgctgggagctcgtcccggccgccggcgagggcgcgccgcagttccgcatcgtcttctgagcatcccacatgctccggcacctgggcatcttgagctgtaccaggttttatatattatgagtaatataggtgtgatctttcgtctgcatacctgtatcagctacccaggcgttatcttgaaataaaacttgagttgttgatgagtatcttgataagatttgagctatcatgtttgattttgtattctgctgtagatgagttcacttgacaccaacgaaagctttcgaatttgtgtgctcgctaggattatagaagcttgcagtttactagcaggtccacaacactggaattcgtgggtaatgttggcctaatttcagaaaactcaatttatgtaggaagtgaatgttatacaatttattcattcagaaggaaagaaatcaaacgttgatcacatagccctcgatttaaccacgaatttcctcgttgatcacatagccctgcatttaaccaccaatttcctcgttgagtcgttgatcacatatattctgttatatgtcgtgctggtgtctcttcctgcaacctttctgaatttccgcccctgggaactaaattgtagcacatgttaaaaatactaagttgtttctttgtcatccgaatatctgactagcaataagatgatgttctaatccccaaccaatggatcaattagtgcacctgattctggctttctgagggttcatttgtccatgctgtcgggtttggtcacttagggtgagtttgaggagaaggggattgagaagattgagaagatacacaaaacgaggtgagctattacctgcttagatgatttgttgagtgaagttgccttgttgaattatgaaactggccatcacaattcttaactgtaacttgttttactcttgtggttactcccctaggagtgggattctgaacagcctcatgtttcttatgttgagttgttgacatggctgatggcatgaatgttttctgaagatacctcactgaatgaacatctactgtagggccacaggttgcatggcaaccgtaaatcgattaccaaattggaatctgaacaaattggaatctgaacctctagtgaacaatgcttgaatttgaatattaagaacatgaatatctacctcattgtttgaggcatgacctgtaatttgacttgaatagttcctataatgtttcgcatgattttgtacataccactttctgcctatgcaaggaaacgctgcttctcatgacccaaccctggaatccttgacaagttctgttcctgaaatattcatctgaggctgtgtttagttcagcgcaaagtttggatttttgttgaaattggagatgatgtgactgaaaagttgtgtgtgtatgacagg

SEQ ID NO: 21737 - DNA, 1501 bp, Oryza sativa
ctcgatcactagtttcactacaataatgtgaaagcgattaggttctttttagggtttcgtaatcgtccggcacacgccatgactgcttttttctcttcctcatctgattaaaaaaatgtctgcttttttttggaccatggtggatggtgcaccgcaaccagacgcaaagaatatgtaaattcagagacagcgagatcgcaatgttactgtagtgaaaaagcagagaaaagcgcaggaagaaaaagggggaaaccacatgaccctagttactttcatgttgcaagttttatcctctggtataacccggctacttctagcaaatgtcaactgtttggtttcctacaggaagttgaaaaaactccctgtctccgtggcatctgaatctgattctgaagttcttgctgatagcaatacggcatgtgaattaatttggtgcactctttgcaagaacttctgtttcagaaaattgatccagcaacactagtacaaagtacaaacatttatcaggctcagctgttcctgccagttaacctgaagattggattgcgcacaagcaagataatctctgacaaatgtgtaaggttaactcagttttttttcccttcagaacgtgctaaaacatgctaaagaagataatctatgaactaaggaagagcatacacaaactaaaacatgctatactcattaatttttactaacaagattagtgatgagaactaatcacaatatgcacaaacagaaagcagatatggaccttaactacgcagaaatggagaaaaacaggagagaaattaatcaaagccagtactcgagatggtgaatttacctggtatgtcagctctgaggtagtactcggagtccgtctcggcccagtcgacggtggtcctggccccgcggcggagcgcggcgagcagcacctccggctcgaactcccacagcgggaaggcgtcggccgggtcgaagaacttgccgaacaggaaggggctgaacagcgacccctccccgaacacggccctcgccgccgccccgtccgccgccacgccgccgccgatcgactgcaggaacgagctgaacgtgttctccagcagcgacatgcgccacctcggcgctgctccgtcgccgaccgcctgccggacctcgatcccccgccgcggcggcattgatggcgactgactgatcgatcgactgcctgtctagatgaggcgcaggtgtgtgtgctgggcgcacgcggggagaggttcttgtacgcggaggaggaggaagaagaggcggtggtggtggtggtgatggcttttgcggaaagcagaggatgagaggtgtgattccgtttggaggtagtagacgatgtgattcccgcctttttttcctttttctggagatttccactgcatttgccatgcgagggagacgacgacgacgacgactaatctccgtgggccgcttcttcctactgggctgcccagaagcccatcgcatcacaactcacaagcccatatagctt

SEQ ID NO: 21738 - DNA, 966 bp, Oryza sativa
catcacaaaaatgattttacatggttttcatttttattttttttagaaacacagtacaaacatcgtctcactatcaacaggtacgtcgcttaccactaaaataatagttagccgtaaatacgagcacacgtgtcaagtctaggacttgagctcgggtgggttggtttcaccacaaggaatctaaccagttaagttacactcaatttactttttgttttatttttataaacattgaattaggaaatataagaactgaaatgcatattgaaaactacgtagattggtatataaatgtgaacaaacattgagtattgcccactactttctccttgcgtcttaggtcctactaatatttaggaagctgtaaattaattctgataagtagtaagtgagaatttaaaatgttagattaatttttttgagtttattttttaactaaatctgtacccaacgttcttaaatatgagtgaaagtgatctaaattatttaggggttgttcagattgatgttgtttcaaatcatatcttttttaaagtaaagttatcaaatatgtgcatacatttttttccaaacttgcctaaacacatataaggaatcctgttaaaattcaataatattgtcaacttaacaaaattttgataatgccaaaattcggtaaatttcattttgattacaatctgatcagctccttagatagctaaaaattatggaagctctctaaacatgagctataatcatattcctacatgtttggaacacgggagacatgaggaatatctctatggaataagtgaaagctaacatgagaattgagattaatttgcatgagatgagtgcctgacacatccacacgtgcataagcttcatcagttccctggtcatcaggaatctgcacagtacgtatatatcctacttaattatgtgctccaccatgttatgagatctaaagattctctgagaaccgag

SEQ ID NO: 21739 - DNA, 157 bp, Oryza sativa
ggagaaattgaatacgtgccactccatattttccgtcaaaaatccccgttaccccctattgcacgtgggcccacctccctcccctctcttctatttccccttcctctctcgccaccaccattgacgcggcaggtgtcgtcgccgttgtcatcttaga

SEQ ID NO: 21740 - DNA, 1501 bp, Oryza sativa
aacataccccaaattgtgtttcagtcacgctcagagatgctgaatcctgtggattttacccatctagaattggcctacatgctcgttgtgttcttggagagaccgcccctgggatagaaaattggggtgcagtcgtgcagagaatgacaggttcaggttatgtttattggggaatttcagcctgtatctgaactgacaaacaagagtctggccggctatggttgcttccgcagtcaccttctcacgggctaataatgcagataatattttggttcttgagaaaacaacgaggaatgccatattttttatgtaaaatttagtatcttactttaactaatcatctgagttatggaggtattgagagactaagaggccaaattctacactgaaaaatgtgatacataatacctcttcgaatacaataaagtcacgcaataatgtaactactagtctactacaaataatcatcgtgaaagtgaaacatatcagatacagttactaagctgactgatacaaacatgaacaagaactgtctgaattgagcttctcctttgagctttttggtcaaatgatttggggactccctttgtagtttgatcaggccagtatcaagaagccacgtattttactccctctgttttcctagatagtacttcctccgtatcatattataagactttttagcattgctcacattcatatatatgttaatgaatctagacaaacatctatatgaatgtgggcaatgctagaaagtcttataacctgaaatagaggtagtagataatttgttaccattgatcatcactttttcaattttgaccagtacaataattattgttatatggttagtctatgatgaatgaaagtttaatacctatacactttgataatttggtatcttttaaagtacttattcttttttttggaaaaaaaagaagaaaaattgtcaaagttgaaatgtgaatagtaccttgtactctctcctcgagacttcataatatcccaaacgtatctaccataatattagcacaccaaatctcatactagtatataatcaaagcacaatcagacaaggatgttgtggatgacatcacaattgtcttttaccccatggaaagagtccaaagggatatcctatttttctacaaggaaatgaaaagaggatctttcacagtggtcctataagtagggaccatgtcattccaacaagcaaaccaaaacagccttgcaagcttctcaatccacttcactaatcactaaccttgcaaattttcacaactccaaagagcaaaactaaattgtacgaggtagcaaagcaacccaatccttcagcaaaaaatgatcctaacttgcccaatggacacttgacaagtgtcgcggatcgcagccatcggatgcaatttgattggctcttgatcagcctccggatcgtgtagcgcagtggtggctagcacgtaggtagcaacaaagccatggacatggagcatgagctcagggg

SEQ ID NO: 21741 - DNA, 894 bp, Oryza sativa
ctatagactgacttttggtagtacaattcctgtttttctctgaaagccacaggttagcttatcaggatttgcttgcaaagctacattttgcagcaatccttctagctcttcccaagaagttaactcagcggtcccaaaagacctcgtgaacgttaaaatccatatttggatggaattatgacgaaggtgtctctcttttttgccaatgattgtccacctatccctttatttgcaacatctataatggcataagacatatatagtacaatgttttgttctcttctattgctgttctgttggctttgtgttctcttctacctcatcatgcctgcctgcctgctgaattttcttcgttggagtcttcgtctttcctggatgcatgcatatccacggctggaaaatgtgtggaatggtagaatgattggtctttttctaggtaaaatcaattcaaagtcttttcagtaactgttcaccattgacaaactgcggtaaatgtttgttcttgccgggcctttgttgatgggcgacacctcgaggcccagcgactttccttcggtctatagcctacaattgtacatatatgcacaagtcaagatgccgctacaagaaaaaaagggggcccatatcacacttaaaagcttggcctgccaataattttgatgaatgttttgttcattacctccaatttgaccaaaaaaatcagcaagaaacccatgtcatgtggtagtgtgaccaaagagctttaggtggccctgtagcagaatttggtaatcacgaatccaaatatatgaagcccaaattctcggtactgtaccagacaattggacacagaaccaagcataccatttggcttttgcaacttggggatttttttttctttctgttttgtgcaga

SEQ ID NO: 21742 - DNA, 1501 bp, Oryza sativa
gatgtccgtccaacagtagagagctggtatttcgcaaacaacaaactgcattagaaatgtgaagttgtgtgatttaaatccttagcaaaggtcttacatcttcttactacacatttttttaatgtcccgggcttatatttggttgaactgttgaaggtgcatgcattactccacttggcttcagaaaagtgaacacatacagttatcacattgacgttgccaacatatatctgatgataattaaacaattatcaattatcaatttatcatgtgtgttgtgtaacgcattttgtacaacaatccagcttatcattagagttcaatagtacgtctgcatatcattttcgatgatcaaatttgttttaaagaaatttttaccgtaagaaaataggaatatggatcttgttcaaggataaactcgtagttataagtccaattaactcaaaagaaaagaagaaagcgaggaagcaatatttcttgataagaacagtacaacaacagctagaaacacatactgcaacaaccaaatcagtctggaacatttattatattattataaggtgctgcaacattaatccaaaacaaaaaataaaggaaataatttaaacattgacaaaagttgatctgacgtccgtaaaaacataatacaacaagcgtcatatttaagtggggatcaggatactctaggtttgaagttaggtgacttcgaaaatagacgatcttagttcaataaggagagaagaggcatggtagtcctttactatcgccattattctcgtcatcatagcagagtgttatacagagagtgttgtggtagtattgagcgattaggataagattcgtagtcgttatatcgttatattttataacataggtaataataagttgtatctactgttgctgttcgccgtagcactcttctccgtctagcggcgaagactactccttatcttcagactagcggcgaacagaggtcttactcgtaacactatggtactgccaccgacggtgtagcggactcgtggccaccttgcagcatctctccacgctcccaccgtcactgcacaggcaagcaggggcgggttgactcactcctcttccgttgattctgatttaagatctcgtggtacattactccattacttctttagttagcagattaggattcttttagttttgtttgtatattccttatctttcatagcttcaaatgttagattttagaattaatgttgcatactataagaagcatttgttaggtgctaagaaaaaaaaaggaaaacaataacgagaagttcaatttattgaatcgtaaaagggtgctattcacaagttcttttcggctccaagtaatgttgttagtggccgaccggggttgaaccctagcccccggccgcagccaccctcccttcctctcccccgcctcgccgccgctagagcgtgtcgccggaaaccgtgcgacctgccgggatggcagcagcgaggctacaaaccccggtgc

SEQ ID NO: 21743 - DNA, 1501 bp, Oryza sativa
ttgtgttgatacagatattttcttttccagccatttgaagaaatttcgtattgtacttgaagtgtacaagtatttatttggtgcatcctccattggacaatgcttctccttgccgctcagctacccgggtgcgtcatgcccgcagggaggctcactttatttctcttggaattgcatttatatttcatcaactgactttctgttttttttatctaccagctcttttaccaactattatatcaacatcccacaactcgtatgtttctttttcttgggatgaataaacactgttctcacaataaaggaattgtacctcagtaaatccccacatatacaatacaaacaatttctttagtgtagagaagtttaaaagaacacacctatatgcccttgtgtagatataaatctccacatattaaaatacaagttgaagaagagttgcttgtaggtccatcgattgtgcaagtttaggtgactgataaacaaggaaaataaactaggcaatagataaatagcaaaaatattatctgtgtgtttcttttattttgttaaaagggtatcaaccgggctcctgatatcacttatagtcacatctggcagttttatatcaccatgctgatgtttttaattgaggttgcatttacaggtaagctgtaagtgtactaaaactgctgtataattgcatttacaggaaagcaacagttagcatatgaagcacttttttgtactcccatattgatattttttaattgaggctgcattttactaaaactgctgataacacttttataccctcatgttgatgtgttttaattgaagttgcattcacggtaggctgcaactgtactataaccatgtacatttggtcatcggtctccaatgatatactctactccctctgccccatttaagtgcagttgtgggtttctgtgtccaacgttactttgaccatccgtcttatttgaaaaatttatgaaaaaaataaaaaaaaagttatgcataaagtactattcatgttttatcatctaataacaatataaatactaatcattaaaaaatttcaaataagacggacggtcaaacgttggacacagaaacccacaactgcacttacatttggacggagggagtattaatttgcagacatgtaccaattctttagaaaacaatacatcaggctagtctgactgcaatgataacttatctttatgtgcacacatcagaaatttggctttggaatctaacttgatcgctaggttttgcagtttcgctcaattgctgggtgctgccactagattttttttgaaaccagtatcagcacaccggatttggaagttggaacgaaccactcaatcagtactcaacttctcatgccatcatatttgtctagttaaacctgtgacaaaacaaatcactgaaacacagatgggtcacaagctggcagacacagggcaagggagagttgactgagttgtgaagttgcagacttgcagtacaatgg

SEQ ID NO: 21744 - DNA, 476 bp, Oryza sativa
tactcctactccgtagtccgtactccccttatttcccctcattgctcgagttattatggcctaaaatacggctccagcgctgctgcgagctccgtgcaaggctacaatcagaatgtacattaatcttcctataggagtagtagtagaattcaaatcaaaaagaaaaaaaaagaactcttacaatgcgtcgtacgctgtacgtagttgctgtgatgcattgcattgtgcgatttatttgtgattttaatttgttttttttttagtttacgcattctttataaataatgtctacgggtatagcccgtcgacagtgacgaacatgtaaaaacactatcatgacagagtgtatgcttcggactcgaaaacaccaagcgaagcagggtgaggacataattacttttagtattttactagcaaaatgacaatatgatgtaacggatgaaatcaattttaattttacatacatacatcaaaca

SEQ ID NO: 21745 - DNA, 1501 bp, Oryza sativa
aaactaagagaaaactaaaagcaatatgaaaagaacgattcgattgattgatagtagattttttttcttacaatgaaccggcctgtcccttatataggggttggtcttgccttatacaggccctcctccacatccaactcggggtagaatccaaaggaaacccgaaacatgcattcccgagcaaggaaacttcgagacccgacgaaacagggttggactcggacccgccggtcagaccggccacacaccaccggtctgaccggcctacaaccggcggtctgacctcccaacacatggcggtcagaccggcccactcggaggaaaccggtagatttccaaattttggcaatctttcctattctaatcctaggtgctaaatttgggtgtaaacagggccaacatgttatagaggtggtactcgacacaggcgagacggcaaaatgcatcagcacgttactaatacatggggctatctttccttcatttcctccttgcgttttgacatgccgccaaattacaatgttctctccgaaccatgtccgtccaccgggtacactcgcattccaaccttatcactcgacattgttgatcgtgctagactccaactatccttgagtttggtctcagcccgccgtcaacaaggttgatcctaggtactgcataccaacaatgtcatgatcggaattacgtatcgtcgcaggggcgcacaggtccagacacagcacgccgagtgcttaggacgcggttacaatggcaggagttgtgcgggagggagcgtaagacggcgtgtcggacagctacagtacttaccggcttgcgatttagataggactagttggcaccccgcgcctgcccgcgggatttgctagtttaatcacagaataaaataaatgttttaaatgattagatgcacttctttgtatatataaaatagatgataatgcggcttcatatatagcttctgttattacgatacaatttatgttttattttttgaaacgtcattatgtattgttatgatatatgaaagttattttcatgtacaatctggatactgtcacaattaggtagtgtagcacttctctgcttcatctcaagtatgtttcaaaaattggtttggattcatgatacctaattattgtatgttatccaattgtttataacaaaagaaagctcacatcttatgtaataatggaagttgtattgaaaaaaagattagtattatctttgaggatttggatgtacataatggataacaatgtcacgagtgattatgagctaaagggaagtgaatggatgagtagccagcttcttgatccaatgcatggctgatacctctcatactaatgcgatccaaaggcttaaaattatcgatgatgtggcttcttgcatgtcttgctttataggagtaaatgctttttagtgggtaccaactatataggaagataggatttgttagatctttcggttatcaatttgttagcaattcagtcagtattta

SEQ ID NO: 21746 - DNA, 271 bp, Oryza sativa
tgttaaattatatgcctacgtaaaaatatatttaacaatgaatcaaatgataggaaaagaattaataattacttaaattttttgaataagacgaacggtcaaacatgtactaaaaagtcaacggcgtcaaacatttcgaaacagagggagtactaaattttaacgtcccgcctctcctaggccgggcctgctcagaacctctgaaccagcgacagtaatcgctactgaacacacccaagatactaaattgtaacgtcccgactctcccagg

SEQ ID NO: 21747 - DNA, 1501 bp, Oryza sativa
acaagataagctccaatcaatggagctgaaaatgagatacagttgcagaatcataatttatgcttcgacccaactgcctctgatcaacgaatttaattgcaccttttgatccacataattgatagataggagagtaccaccgtactaggcttggtgatcagatgctagtattgccaacgcagatattatctatctttatggactactgatggaacagtagttgaagatctctgaacattaactgtttgtagaggatctctgaacattaacttgtgaaccaaataagtcaggagtttacggctcgacattaacgacgaccagtaagtagaatacagcctgcatggaaattttcagaataaacactcgtacaggtacagcaagtgacttgaatccttcattaatttcctgaactgctctgcttagtgttttctgaatttacagttaacctagtactctactatatgatcatctcacgaaaatcaaggtcaaaactacacatgagcattcagacatccaagcttcctttccctcctcccaatgacatatatagccaccgtgattaaacattattcccaacttaattaattcatccattgattaatcaagctattggaattctaaagcactactggatcgatccaaaacatccgcgatttttccctcatcccaatggtccaagcatcgatgctctgaagtctgaacttggcccaaaaaacccccacattttcagatccctacgcagcatcaatcacaagatccaagaaagagaaacaagagaaatagtgatacaactccactactccagaaacaatgaaacatgcagtgttcagatgctcgagctcagatcactatgcttcgagcttgcagcttccatgcaaaccaagagcaagctctgctcagctggcaagactgaactttctgaaacttcaccactcattctgaagctctagttaatcctacacactataatttatttggcagcaaggatcatgctcggattttgtatattagagaactatatcaatcatcccaaatggtctctgtgggggccaaccagccactgtgctgcacacatggtggcgtgatgctctccttgaccatgccaatgggagctgcacattgggtaccatttaattagggtggtctggctaattaagggagtgtgctgacatgattgcaatggcttctctttacgattattcatctccccaacttggagcttgcggctccactcaaccaatatgctgctgatactagtagatgtctagaagaaagcagcagcatcctgtatgcaaaagctttgcatctgcttgccttctctggtttttcatttgaggcaagttgatagccccctcgtgcactcacattattaaccccagtttgcaccaaaggagaaacatggctgattagattagttttgtagggttctctaaagatgtactgataggttgctacctgctagtaactttttatgagataggagatattggtgtccccagcc

SEQ ID NO: 21748 - DNA, 1501 bp, Oryza sativa
ggttcgttccaacttccaaatccggtgtgctgatactggtttcaaaaaaaatctagtggcagcacccagcaattgagcgaaactgcaaaacctagcgatcaagttagattccaaagccaaatttctgatgtgtgcacataaagataagttatcattgcagtcagactagcctgatgtattgttttctaaagaattggtacatgtctgcaaattaatactccctccgtccaaatgtaagtgcagttgtgggtttctgtgtccaacgtttgaccgtccgtcttatttgaaattttttaatgattagtatttatattgttattagatgataaaacatgaatagtactttatgcataactttttttttatttttttcataaatttttcaaataagacggatggtcaaagtaacgttggacacagaaacccacaactgcacttaaatggggcagagggagtagagtatatcattggagaccgatgaccaaatgtacatggttatagtacagttgcagcctaccgtgaatgcaacttcaattaaaacacatcaacatgagggtataaaagtgttatcagcagttttagtaaaatgcagcctcaattaaaaaatatcaatatgggagtacaaaaaagtgcttcatatgctaactgttgctttcctgtaaatgcaattatacagcagttttagtacacttacagcttacctgtaaatgcaacctcaattaaaaacatcagcatggtgatataaaactgccagatgtgactataagtgatatcaggagcccggttgatacccttttaacaaaataaaagaaacacacagataatatttttgctatttatctattgcctagtttattttccttgtttatcagtcacctaaacttgcacaatcgatggacctacaagcaactcttcttcaacttgtattttaatatgtggagatttatatctacacaagggcatataggtgtgttcttttaaacttctctacactaaagaaattgtttgtattgtatatgtggggatttactgaggtacaattcctttattgtgagaacagtgtttattcatcccaagaaaaagaaacatacgagttgtgggatgttgatataatagttggtaaaagagctggtagataaaaaaaacagaaagtcagttgatgaaatataaatgcaattccaagagaaataaagtgagcctccctgcgggcatgacgcacccgggtagctgagcggcaaggagaagcattgtccaatggaggatgcaccaaataaatacttgtacacttcaagtacaatacgaaatttcttcaaatggctggaaaagaaaatatctgtatcaacacaaagcaagaatatgccaatttcaaattctcaaatgggtgacgaagttgtaaacttcgccttttaactctctctggtaaaattcaatgtacggagagtcaagagagacacagataaatcatactcaatcaataatattgtaagaacacattgtagaa

SEQ ID NO: 21749 - DNA, 1501 bp, Oryza sativa
agtgaggttaagtatagttttgatgtggccaagtgtgataagatttttgattatcttttacaagagaaataaattagattacctaaaggccatgtcataccatcacaagaggagttaaaacatcgagcatattgtaagtggcatgattctcattctcactctaccaatgattgcaatgtgtttcgacgacaggttcaatcggccatagatgaaggacgattgaaattcaccgatggctccaagatgaagcttgatcatgatccttttccggtgaatacaattaatttcaatgataagaaggtgttgattcggccggagcaagccgaatctactaagggaaaggaagtggtcattggtgagccaaggcttaagatgatggtgccaaagaagccggaggttggtgtttggaaggagaacaagggtgaagcttcaacttctaaggctcataggaagaccaaagtaaccttcgatatgctcttggagaagtatgagaagcaaggtggtgagagggatcacaacaaagggaaaagaccaagatcaccccctagggagcggtttggtcactcaccaagacgatcgcgttcacctccatattttcatccacaagacatgtcatggggttcttatccaatgccgccaccgagttatccttatccttacttcatgccatggggggcaatgccgccaatgtacaatcatatgcctccaatgcaattcaacaaagggtggggaggaccacggaggccaattcatgagcgcttatcttcaccaaacaaaagccgattttatggtaaaaatcgggttaatgaagaaaagagggaatgaacgcgcaccaaggtggaggaaaggacttcggaagtgattaccatcaagatagggtcccatgatgtgcctataccttctggagatggagttggaaagttcccaagcgagaaatccgaagccggtaccagctcctcgcagtcggccggtctgaccaggccttccggccagtctgaccgcggtcatgtagccggtctgactgggccatcaggccggtctgaccgccgatctgacgacggtctgaccgacgcctcaggccggtctgaccgcacgccacacgtcggtctgaccggcgcgtctggccggtctgaccggtggtctacagccggtctgactgggctccagcgtcggtttgatgagagggctgcaaagggcgatgtgagggcttcatcgtctccaaacaaggttaatagagggcattatttgcctcctggaacagagccgaatcctaggtggatgcctaaggatttgacggctacgcaaaagagaaggttgcaacgtcttcgggcccaagaattaagagagaaaaaggccgaagaacagagggataagaggttcaatgagttgcgaccaccaccggtatggaggcctaagtccatagagaaggcaaaaccgattgatgtagaggagaaggaaggacaatcggttgatgaaggtaaatcgtctccaaaggaggaca

SEQ ID NO: 21750 - DNA, 312 bp, Oryza sativa
tactttttcttttcaaaaattcgaacagccagcgtactttgtgcatcgtgtggaggaagaataaagcgatgcaaaaatcttctatgcgcgcatatatatggtgccaaaagtgcctaaaaatgcaatcaacattttaatttgaaccgcgatcatacagccattaagtgcttacaatattacttccttggtctagggcgtgtagcaattaagggatagaaaaagtctacaagtctaatagtagttactaatgaccacattgccctaacaaacgattgcgaaacttttgaagacgatgttgtttttccagcaata

SEQ ID NO: 21751 - DNA, 565 bp, Oryza sativa
ccctataacccttaccataatcaaaataagcactaggagaatgactactaataaaccagtcatctcaaattaacctaacagcttttgtagcctaaaaaagcttacaaaaatggtataacacctttctgtcgggcaccttttcatgtgcatcataataattccaaagaattattgaatcgcgttaaaaaggattttaacagcatcgagccgcatctttgtgagcacatattgccaaagcaaaaagcgcctaagtccctagggatcacaacgggccacgctgaaaacataattgggctgaagtactatacaggcccaggcccattagtactcccgataccctaaaaacaccgaagtccaaacgtcatttcgtcttccccgccgagactctcgccattccccactccgtgctacagtacagaaccgcgccgacgaagctagggttcatcaatctgctccaacccaccctcaaaaacttcacaaaatttctccccgcgtccaccgctccgattccccattcctctccagccatatctcggaccaaattaaaccatcctgttcacattca

SEQ ID NO: 21752 - DNA, 1501 bp, Oryza sativa
gagagggcgggcaagatcaatttgagtggcgggaggccacgtttgaatacttaccggcgaaggattgacttgaccgcgtgcgaattcggattgcgacgtgttggcgccaatccgggcgcgacgcacggcggcggcgagggtgaaaacaaccgatttgggggtgaatggtttgaattgtgagaggggaaaccaacgtctaactttaatccaaccatgcggcaagaattggcgcgattcacctagggtagaagcgaaatcgtactcggcggcggctttggacgggcgcgcacggcgtcgagcggtgatttcttgcggcggtggtcatcttgacttcgtcgtcgtcgtgattggtgcggcggtggtggtctaagggcgtcgaacggctagcggcacgccaaggcggtcgggcacgcgcaatcgatccggagaccgacgcgtggcggctcggcgtgcggcaaagtcggccgccaggacggcgcgcgcaagggggaggagaaggccaactaaaccacggtttttgagtgggatgtggtcccctaggatcaattctagactttgcacaagattgggtggtgattgggctgctctagctgggctgggcattttgtcgagcaccttgagtgcaatgaacagtgttttcaggaatttttaaatatttccctagaaaagaatgaatttaatctatggatttgaaagagtttcactagggtttgaagtatagcaaatcctcactaatattaggataaactaaggaaataatctatggttgcaaatttaagagaatttgcacaaattcactagggtttggaataaagggaataattagggtaaattagtagggctctaagaaagtaatacttgaaccaattaaagagtcaaatagatttttaaagcacactaatttaatcaaaagccagcatgatgcagtcaaattttagtttaaaatttgaggatgttacaaatatgtagctaggcataggagtgtttcaagtgtaggtacacgatgagtgacctgaagttcgacacaaacacaatatgagcaagcaggcccattgttgacggtccttaaatcataatatttgaccgtcaatacttacatataatgaaataaaatatggtatccaacttagtggtagggtttattactaatcatttccactagtgttggtgaaatatgtgtatgcaggtattttgaggagaaaacacatccgtcatgcgaaaaaatgcacctccgcgcattcaggacgcgtttacacggattggagggcccatatgtcaaccaaaaccacttagaattgggccaaaacattgtgcaagatgttggggggcccaataagcaacctatcggccaaaggagaggccgggaggacggatttttggtttggccgaaccaatcctggcgcctcccgccatctggcttcacgtggacggcttggattcctcccctatggcggttgcagggtgttttgatcatttctcatacccctaaccgtcatttgga

SEQ ID NO: 21753 - DNA, 170 bp, Oryza sativa
cgcgccggacgcccgccaatgagcattcccggtttttttaaaactatttctacgagatataggaaacgagataacatcgaatcggatcgtattttcactatcttgcttcacgtagcgcttgatggagtaaatttcccctactctacgtgcgtacaagtcgcatgtggaga

SEQ ID NO: 21754 - DNA, 389 bp, Oryza sativa
  unsure (1)..(389): unsure at all n locations
ataagttgcacatgagctccgcgtatgtttgtattctcaagcgtgtcttcttgccagcttgccgctggtctgacgcnctggtatcaacgattctgctggtttggtaaataaatctctcggtttccctcaaaaaaaaaacgcctgcatatttcattcctcacttttcagagaagccacaaccacaaaccagcagcgtgaataatgtttattacggagtaatcactatttccatcagctgacaactttcgatactgaattactgatactcgttcagtctcctgcatacacattacagataagtactgtagtatttttgcatctatgtcatttctcaattactcctagtgccctccattgctgagcggtggaaccttttttttttttttaga

SEQ ID NO: 21755 - DNA, 1501 bp, Oryza sativa
caaaacgaattagtcagacatgacatgcaagtattcacaattttgaaatgtaaccttccaccatgctgcctaaggcacccagacaaaagtgcatgcaggtgcagcataaactgcggatgcaactacgtatgcaccggtcgcacgcaagcaaacccaggtgttcgaccaaatgcctcggacagatctctccgcacaccaagaaaatcgtcccagtggcaactgcaatgggaaaccgagagccattcatacgcctagaacacatacctgagggatctgcgtggactttccgctgccggtctcgccgacgacgatggtcgtggcgtgccgctccaccaggtagaggatggccttccggtacttgtacaccggcagccgctgccgctgccgctccaagctcgcgtacccaaacctaaaaccaaccgcggcgagagcagcggtgagcagccacaccttcagaaaccgcgagtagcgcgcgcgacaatgcgagagggaagagggggggtttagtttagggtttgggggagcacccggatgaggaggaggagctggtgcttgtgggcaggaagaggacgccgccctcctcgtcctcgacgatcgccgccgtcggcttctccgaccccggcctccagaacctcgacatggcacgcgccgccgcttctcgtcgtcgccggtggggaagaccgtgtgtccgtgttgtggtggatgggggagcgatagtgtgggaggcccgcccactgccggtgcttcaaatgggcttttgatttgggcccaccttggatgggctattaggctttggaatgaagaacaagtctattttgcttgataactctatgctcccgattaaatcgtctccttcaaccgcaatactggatataactccacgtttatctccgaaaacgaaataatttgctttggtttcaaagattgaggaggcgttatatccggtattgtggttgagagaggcaatccgatccggagtaaaggttgagtgtggtaaaatagacatatgaggattgttgcccggttcctgaggattgatgggctaaaatcaaacctcacacatgcgatggtgctgggcttctggaaagtcggttcgattcacagcccaaggcagccaactgaatgtgctacagtggtgtagcttagattgttcctaaattttcttatcacacagtagtcgcacatgcacaatatcacattttgacttgtgcaaatacgctccccaacacaaacttaaaaagacgaaatcccacgatatatcattgatctcactaaaatcatattaaaagcccaccttcataggtgtagtcatacacccacaactccatcaccatattactattacttctttagttcgcagtgacattgttttcctctcaccagtaatcgataaaaggtgaatgccaacggctaaaaggtaggagctgtactagaataaagcacctcgacaacatccatgataagccatgaattcgacgatccactctattctctttaatca

SEQ ID NO: 21756 - DNA, 467 bp, Oryza sativa
caactgatcgatacagttttcaaccagctagaacctactccccccatcttataataaatttatttttgactcctcatttatcctaaaataaactcattttttaagtaaatgtatcagagtttgtgaaaataagaaataattatattaaaaataaataaagtgaagaatatctatattgagatttgataaagtaaaagtattcttatcttttaagttttgtgttgatgtgtgagataggtgaaaaaataatttattttggaatgaaggaagtattagagaagcttagtgatccgataacaaccgtagtcaactaagaaatcttaggttacatccttgcccaacccaaaagagaaaaacatcgagtgattcaaactgccacgttatcaaaagatcatactcatagagtacagatcctgagacagagcatccttgcctgataaagttccattttaagctgcaaacttagg

SEQ ID NO: 21757 - DNA, 1501 bp, Oryza sativa
gaatccagaaaataaactagaagccagaagctgaaaaacccagcttttccaaattctcagaagctgccagctgcttctcagaatcttaagctccctaaacaggcccttaatatgggtatagccgggaatatgtgtcccaattagggcatgtttagatcaatttgctgtagcaaatatttttggcaaaagttttggtagcaaaagatttggtattgaagttttatttattggtgtgtttagatgcatggtaagattttgccattttagagagagaaagagcacggcttccaacgcactattttagcaaaatttgctactctagactcccaaatgataaatgtcaaatttgccaacttttactactaatgattagatccattttgacaaaaagtactccaaaactgcaaaacttttactattttagaggaactaaacatagacttagagcacccacaatggtaaagtaaggtgctctctataaaacatgtacatctcagcaatagactatattaatagtaaacccctcaatagtatgtctacatgggtatctatagctctctcatgcattgcctcgtttttctctatagactatctctaagttagtagatagctttgctctctctcttcatttaatatcttccaagtaggaaaatatgctgacatggatcttttgtagagagcttataaataaccattgtgggtgcttttaggtacttattggtatttaatgttgttcaaaacgtagttaaaatagaaccgtgagagtattattgcatgtctcgcatgcatccaattgcttgtttgtgtgctcatatgcatgtctaacacatcaccttgatctatgagattaaattttagaagaaatgattttttttcttggtcttcatatcttttataagtatgattaaattgggatgacgggagtagttggttagtcaaaataaacccgggcatatgtgtaatttatggtgctagtgtttggcagagaataatgaggtgactatatacagtatgattatttgtcacaaatgcttcctccggtcaaaagtactcttcgtttccatcgtacaaatgacttgctcgtagtttcttttactgtcggaattggcgaataattttaaccaaagggccggagtgatatatacttatcagtgttgacatgaactcatctctggagtataatgttttccacaggtttttcgtttatcatactcgtagcatccaccaaaatttatgatttcagtactattttttttcttaaaaatatacatgcattaaatcggaataatgaaatactccgtatcatgtatcatgtggctctcgatagtactttatccgtttcataaaaaaccaaaacgtatttgaatctgagtaagatatgtcacgttcaatcatattttctttaaggataaagggagtacggttttatctaccggcgaaaattgtagagtaaagcattggctcccgggccgggccgggcgggatctttgacgcgcaaaaa

SEQ ID NO: 21758 - DNA, 517 bp, Oryza sativa
  unsure (1)..(517): unsure at all n locations
cgtctgcaagtagctcatcattntttcttcttgaatacgaatttcgaatcaatttaagtatgggtagtatgctcattttatcttctttctctttatttcatacatttcttagtattctcgtcctaaataagccctgtattttgaaaacggtagagtaccttgtttactgaatatactacacttgcattatcattctagtactaaatgtcaactatgctcgaatagactgctactgttcatggaacagtcatgtcaaagtgcattgcataagccaccccaaaaatactagtatttctttgtgtagttatttggacaactctttctgcacttgcaatcaacagtagcagtctatgctgatcacatcaactattcttaagttagcaaataaaatatgtatatcttttttgtaatttttgttccatcaattcttgtttcaaactggatatgaggcatctggttataaagctcaaaattgatcgtatttcagtacatcatgtaattgataattttcttgagt

SEQ ID NO: 21759 - DNA, 1501 bp, Oryza sativa
cggcctgggagaggcgggacgttactattagtatcttatcttgggtgtattcagtagcgattactgtcgctggttcggaatggctgcaagcagcaacgacacttgtgttgctttgtgagggtagtctgtggcctatgaaagctgtcagatgtaagcgggcccggcttgggagaggcgggacgttacaattagtatcttgggtgtgttcagtagcgattaaaaaaacttatgttttgggataggggtaggttttgaagtgactattactatgtcggaatattatgaaatttatatcgaaactcttaagtttaatcttcgatgtgaattttcattaccctgctaagtgggtgccacttaaatcttctcaaagcacctttgcacgaatggaagcataaccaaattaatggagcgcctcactgtccctaacaagcaacaacaaaggaacagaaaactaataaagatttgaccataacgaagtactccttgttgtcacgagcctttgagaagactgtggtggaattggacagatcaacaagttagggcttcttttccagttgtttctaaagtggaattctaaaatcacaaagaaaatccaggagtagaatatcattgcgtgttcaatcctccagatccccatgacatggttcaatcatattgttgaatgcttcaaagaaagaaaaacaatacaaaataattacgaaaatgagaagacacggatcaagatttccacgagattggagacctaatactagataatgcaacgtcggattaacttttcagataatgcaagaataaaattgcagatttggtgatagttattgtttaggcataatgatttactagctatagatatcatcattgattatattcgcgcgtaatgtcgtgttatatcctcagccacaggtgatgtcagagttctacagcgaatacgccgcattttctaatctatgaatgcgactgcaaaagacaattgaggtagattgattattgccttgcactgatccggatctgtttgggattccatctcgcagcaactcccggccataaataaacctggttaactaatacagttctgaactactgatgaagtgacgcagcggaaacctggggcgcgccggccggccccggcttcggcttggcgtcagtgccggggcggctgggaaaagaaacaccggccgtcggcgacgccacgcggccacgcctgtctgcactctgcacgcgcggcttaccgatcacacgcaccaacgtaccgagccaccgaggcacagtgctgctctgctctgctcaaggtcgagcgctctccaatgcggcaaatgcccaatcggagaagcgcctgttcgccgattggtccagacacccgaaaaaataattaaaggggtgtttagaagagagaggctatgacttatgcttttgagagaggggatgtttgagagagagtttagcccctctctcccaaacaccccctaacacgagcgggatcttgcacggcaaagccaagcca

SEQ ID NO: 21760 - DNA, 758 bp, Oryza sativa
ttaaaaaccaatgctgaaaaagaaactacattgacagtatcttataatcattcaaaattatgttttaaaatttaaattttggctttgacatattctgtttaggcaaccggtggggctataagtatttgtctaaggatttttattttaaaaaaaaaacccacttctttctttctttttctctttttcaactgttaagttttacgctatttttagtttcttattatgcattctgcctgtttctgtgcgggcgaatgaacaggggaagctagcacgaatgaacggggaaagctagctggcgtgtgcgcaccagcgacgcatactttcgcgcataactaactcctctagttaatgctaatgatagtaattagaaaaaaatgtgaagatttttttaacgtagaaactcgcattcatcaactcgctcgcagatttaatatgccatgtggaccaattgaattccagcggaacctctggctttagaagataaagatacacataccggacaaattataatctaacttgaattttgatgtgagatagaaaacattgtgtagcgtagtagcagtatataataagggtgcaatggtggtgtttgaatctctgaagatgaagatgacgagattaagtgtttcacgtaaaaataagatgataataacgtgtgattaattgagttttaattattgcaaacttgaaaaatgaattagttcatatagaaagttttcacacgaaacgtactgtttagtagtttgaaaagcgtgaca

SEQ ID NO: 21761 - DNA, 988 bp, Oryza sativa
aaattataattacgtaaattttttaaataagacgaatggtcaaacatatgagaaaaagtcaacggcgtcatctattaaaaaatagaggtagtatcctctaacatcagttaatagtagagaacaaaactactatttactcatgcacagataaattaacgaacatgtatacaataataccttttatttatgcgcgaataaacaaatacacacatattagacgatcaatttaatttaggaagaccttataaaacttaggagtagtaagctatgccctaccgacttatttttttcaaaaatttgtcgatatgtttgtagtaattttttttgtgcttcctttatttttcacaacgagaagtttaagcccctctagttcattttgtattgtacatcacagtactactactaatgtttagtttattgtgctaagctgtcaaaatgaacttcagtaagagggaggtccacggatcagcgctgtaggcataaaccatgcagggcagcagagaggagtgtcacctcttcttcttcttcttcacctgctataaccaccagctgttgctagctgtttctctccccttgtcatgtgacctccctactcccatctctattatttctctctcccctccctgtccctatcattcccattgcccgatttagcgctcgccgttgttttcgcagcagcggcggcggcggcggtggcggcggcggcgcgcggcaccaacaaacacgcgagctaaaacgagggccgcacaatctccggcacccgcgccgcgctacattaggatacgggcgctcggcgacggggaaggtttcgggcgtcgcgccatcgatcgcgggcgcgcatttgcgttgattccgggccaggctccctccccggccatggcgcagctgccgcccaagatcccaaccatggcgacagcttggccggagttcgggggcgggcaccatcaccatgctgcccacggccaccatcaccagcgcagcccctcca

SEQ ID NO: 21762 - DNA, 354 bp, Oryza sativa
acagttggcttgcacggtatcatgctggatttttgtaagttcattttctgcatcgttccaattagtgatcctaatcgtttccagattacttctatttggctgcttctccatcaatttggggcagaatatgtgatatccgcatattcgatatgttatctacatagctgttgttaggacatagaacgcaatccatgtggtccccggatattagctgcatctaatgctattgggcaatgcaatccttcaaatggagagttttggacaagcaacatcattttgcatacgattttcattgttctgttttcagttttcaattgttgttggtgaactaaaagatataacaaattttgcagc

SEQ ID NO: 21763 - DNA, 1501 bp, Oryza sativa
cagcttgcgaacgcagaattccccaattttccctcatcgttcttggcgatcccctcaaccgcaggatcttggcgaaccggcagtccgcgcagcggtcgcgcgtgcggaagctgcagtacatctcggagctggagcgcagcgtcacgtcgctccaggtgcgtgccgaattacgcatttcgtgcccgtaatttcgccgagcaccgcatgcgcgcgcgcgccgtgaatttgacctccaaccgtttgctctttttttctttctcccgagcagacggaggtgtcggcgttgtcaccgcgcgtcgcgttcctcgaccaccagcgctcgctgctgacgctgggcaacagccacctcaagcagcgcatcgccgccctcgcgcaggacaagatcttcaaagatggtgaccgccatttgccacctcaattatgctactatatatcgttctcacaatgtcgctgtccgaattcaattcggcgacagcacgcaaccaaaattccacagctaaactaacactcgttctgaattctctcttctctgctctgctcagctcatcaggaggcactgaagaaggagatagagaggctgcggcaaatctaccaccagcaaagcctcaagaacgcggaatcccaaccggcggacgcggccccggtccgcggccgcgacaatgccgacctgatcggcagcgagggggccgccgcggccgcgccatgcccgcactcgtgatcggccgagatccggacgctctctagacctctagcgaggtggcgccggcccgtcgcgacaaccacgagcgttgccgcgggggtgggccggcgccgtgttaggattggtgcattgttaatttgggttttgcattctttggggtgtaatgtaacatgatttgttcattcgggttgcttttgttcattcttgtgcatcctctgctgctgctgctgctgctgctgctgctcctgattcttctctacttccctgatttgtaattttattccggcattttgggcgaaggttgtagctaagaattgtaattcagattgggtgaggtcaagtgttttgtttggctggtttttttttctctttttcttttttgtatctgataaaatcaaatgtaatgttccttcatttttcctgtatgatccactgtatgtatttacagctatccatcagtctctctctctcttccctttaatccttctttcctctcgccaactttcgttattgccaactgttacgaagctcgcatgtaaagttcatctacacgttactgtagtatctaaccatttttttctctctctctcaattggactgtgggtgtgtgatgcatactttacaatcaagcagtacagggtaacaccggcgtcagtcacatgcatgcaattcgcaggtcgacaccaaacatgcaaccaaagcatcacattccttgctgtttcatcgcgagattttaaatggtgaacaaggagaggggtcaccgggagggaggtgccttgcttttgctgcaagggataggca

SEQ ID NO: 21764 - DNA, 452 bp, Oryza sativa
ttgttcttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttcttttttttttttttttttttttttttttttttttttttttttttttttttttttttttttttttttttttttttttttt

SEQ ID NO: 21765 - DNA, 335 bp, Oryza sativa
aaaacaaaaacaaaaaaaaaaaaaaaaaaaaagaaataaaaaaaaaaaaaaaaaagaaaagaaaaaaaaaaaaaaaaaaaaaaaaaaaaaaaaaaaaaaaaaaaaaaaaaaaaaaaaaaaaaaaaagaaaaaaaaaaaaaaaaaaaaaaaaaaaaaaaaaaaaaaaaaaaaaaaaaaaaaaaaaaaaaaaagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaga

SEQ ID NO: 21766 - DNA, 204 bp, Oryza sativa
ttatgtttatatgtctccgtatggataacaaaatataaaaagcagtttattacataacaccaattcaattgagtaattcatatataagattacatccattcatctagccaccacattgcttagttaattatggaccaaataatgtaaaacctgttagccagggtggctagctatctggtttgtttgcgtctatcaactcttaga

SEQ ID NO: 21767 - DNA, 317 bp, Oryza sativa
ttattctattcttttcttcattgtttttcatatatagattcattatatcccatcccaaaatcccaaatcaatcaaccccgaatagtctccaaattctcaaatcaatctctaaatacataacaaaatctttaaaaaattacatcacaacttctacaaaattcattacaaatacatcacatattcacatcacacacaaatcaaatacatcacatattcacatcacacacaaatcaaatacatcacatattcacatcacacacaaatcgtctcagatccgaatcacatatttaaaaaaagaaagaaataaaggaagaaga

SEQ ID NO: 21768 - DNA, 1501 bp, Oryza sativa
ggagcgatgcggtggcagcgtcgtggagcacttgtacatgatctgctcctgcttctgcccgcacgcggcgacgacggcggctcatgtgtcggcgcccgtcgtcgccggcgctgatcacgtcccggccccgtgcgacgacaacggtgtcgacctggcttttacgcaggacgagttgaccgcggcggcggtgaccgtgggcgaagtggacgaggacgaggtggccgtggcggcggcggcggcgacagtggacgcggccgtagacgagatcgtcctgaatgcactgggattcaatgagtttgctcgcgacctgaaggagaccatcgaagcaaaggatcgtgaggacgcgttgcgcgcggagggctcgtcagtttctcccggcgttcgtccaccggtgtagccgcgtccgcgttcgtgttgtcgtgtgacatgtttccgcccttacgaatcggtgtcgtaatagctgtggattttttctggacgtccggagttggaggtgtatgctgtagtacgtaatacttcagttaacgttttgcacaaaagttttgcgctttggataattgaatagttatccaacctaggtctgcttataatccatcaccaatataggtctgcttgtagtccttcaccaacacagatatgatggttcgtgccctatcaaacattcttttccttgcaagctaactatactactctctttgattaaaacaatgatgtttaacccctattaaaactcttaaaacgttcactattaacttatctaaaaaatacttagctccaaaacataaaaaaaaagatgggtatatttattttgattttgtaagcttagtggatcttataaatttaacttttcaatagaaaattattgtcaaagtcacatataaaaataccttaaaagagttaaacgagctgtagtacctccattatgaaaattcacatttatgacaagtggtttgaaattccctaagaaaatattgttgtattggatgattacatatgtagaaaattgtttttgtttctcacgatgtgactttgtggctcatgttttacgagattcatctctctctctcttgtatgcacgagcaaatcaagtcgcgcacatggctggcccaccaaggcccacgtcacgctctacgcagtgaaacaattcagtcggccacgtgcccacatgtggaccccagactcatgtgattgcgtttctcccgtgcgatcgtgctagaatttttatgttttttcacctatttttattactgactttattttaatttcccctataaaaacatacaaataataaaatttattgttgttttaagcctttgttgaaaaaagtggcttcatgtttacttactacagtaatttgattgtaaagttttaaatttaagttgaaaattttattaagttggttgaaggttttcaaatttgagttaaaagttttgaattttaagttaaaagatttcaaatcttcagttgaaagttttcgaatccaagttgaaaattttaaatc

SEQ ID NO: 21769 - DNA, 1501 bp, Oryza sativa
aggcgccagcgactagtcctgccaggcctgactggagaacggtgggatttggtgctgctgcaccctcagcggcgctggttagttcctttttttttttattggatcgatggaagttctgagctgagcttgttactattgtgcttttggctttttgtggtctcgatctagttgaacagagctgttctaagagcatcttaatattattcccttgcttagcagtaaccaagtattacaaatcaatagcgataagtgtatgaaataaaaaatttgcccctttatatctttgtagtttgtaataagcctgctaaattctcaatgttcatgtgttctgttcaaaatttatatgattcagaaattatccaaaccacttgtgctagcgttattcataaattaagatgtcatggctgatatgatctgtgtatgtttgaatttcgacagtaatctcaaatttatacaactcaaaacttgtataaaccaccggtgctatctgttagagcttgcattttcagaaatagctgtaattggacatattttcataaatgatcatgtattcttagtgaatttggttctatgtattgttgtgatgattgctgcttttgctggatcaagcatcatgagtgaatagccctgataccagaggttttttttttttgcaacgcatgaagaaccatgctctcatcttaattttcatttgttcagtcatgaattgtttgtgcaatatattcagaaaagtgttcccatgtgaatttcatttgtttagtgatatatttgtgcgtgcaatatttggataactgccaatagcatcatcatcaggttctctgatatgtttgataaatgaaaactctagaagctcaattaggtagcagttctatgaagttttgtggttcaacagagcatatcaattgattttctctgaactactctctgaaattttgtggttcaacagagcaaaggtgtttgaataaaataatctacaacctattaacgtgatgatggtaacgttttttatcagtgaaggattaaaactccttgattcccatttatttatgcgaaggaaaaaatgagccattttttatcccagttttgcatcgcggaggaaaaaaaaatctatttttcaaatgttatttactgatgtgtcatgattcatgatctgagaatttatcattgttttagacggatctatttggttttacttaaatgctcaccctctagttttaacccttctagaactgtgccatctgcccatctgtaatatagtgtagtggaatgattcattcggctcagttgaactagaaaatctagaaaatgaaccttgcagctgaatgatttattccgatcatcttgaccaaatagatttatttctggatttggtatttgctttctcattctgctgagttgcacaatgttcaattgtaggctgggagtaaggcgagcccaagaacattatagtccggatttaatttttgctttctcattttcaggtatagcagagtacattatg

SEQ ID NO: 21770 - DNA, 1501 bp, Oryza sativa
tatatgccactactggggtgtacttctacaggatttatccattgtaatgctgttatctttgcatatcatgaaggtatgtgtatattatggatggccgaatatgcttctgcttactcccattttgtatcccacacctggtgatcttttttcttaattctgtcttcagtgctgccactgtgtttcccttggttcggaagtaacaaactgtcctatctggcatgtaatacctgctgctgctcaaccattataggtatggataacacctctatgtcggtataccatgaccaacctttgttttatggtccagtcttcacaaaatctacgctcgctgataatttgttgtcaaatgtcaacagggcatattcttgttctttttccccctcttgtacaggagcaccaaagtaaaggagacataagctaaagatggagtgaagaacagatgataaagagttttctataaactaccatttttatctgttatgcaggtaattttatattaattcaatttgtggagaacccttgcaaaatgctttcattatcaagtactttggacttttgagcctggactaacgaaaagcattacattaacagctggaatagctggttgagacttgagacgagggatatacggaaagctgcaatcagttgcatattggcctctcattatcatgtatgattgtaggagcatggttcaaagaatatgttctgctccttatctgctttgcagtaagaccaatacacattttatcattttatcttccatatcttatctcggtttctcttgatttgctctcatgtccaccatttcctccctccaattcaaagcttcttcttgtttaaacttattatgtaattcgttctaaattggtgggttctcaatctatcatctttttatcctgtctctgcaaggtgcaaaaaggtgattctttgaaagaagattctgggtacggagggaattgcgactgacgagatgcttacagttcatctgctcatgtgatgtgtcacatggcagaaaacatggagaaatgagcgccatacgttgccatgctgcgattctagagatccagtcatccagacagtggaaaggggggtcgtaaaggatggcgcagattatagaataaccatacagagtacaattgaaatggaccaacgatgaaaggaaggaaatctgagaataaattccagtgcagtgccagtgtcagtttcccggtgccatgcctgaccatgtaaattgcgatccgtatgactatccaaaagaatggcaatggctgtagtcctccgaatttagtgagttgaaagtgacttgtgagactaaataaaatataagcgactggcaatggctttgatcctgtagccactagccagcgataactgataagtgcagtaatgtctcagacaatttttagggcgagaacttttatggtacaatgtactgctagtatatactataagtatatatgatctaacggtgtagattgatttgattttttagttaattaga

SEQ ID NO: 21771 - DNA, 1501 bp, Oryza sativa
gtttaatactttaaatgtgtatccgtatagttaaaattttttttaccaaaacaactaaacacggccactgtgtgagctagccattgacttgacgcccttagaagaagaccaaaacgtttcataaaataaaaacaaaacaggagcgagacaacagctactcaaatttcgagaacgcttattttttgttaatggacatttgggtatattaattagcccatgccgcaggtgcgtccctcctctgcacccaaaactggagcccctccgcttctctatcacttgagcgatctgagactgagatctgagactgagagcgccttcctttgttcttccccccccgttgagccagctaacaagatcgctcatgctcttgccggccggtgaacaactattttccttgagctaacttacaaggtactacgtactatgtgattggaattaattttactttccgtatttgcaagcaagaactaaagttgttgtcgggtagtttgttttatttattgagtactctgtgtatcaatgataatccagttatggatattctagtctagttcgaaatattctccgcatctactggtgcctaaattgttggcgctagaagccgcggtgattgctaggtttgcttactcgatgtcgaacaatctattcctcgccagattggactcaggaagagcttgagcttggcatagttccagattctcaagaaattaatatttctccatacatgaaagtgtttcttcggtgaactagaaatactttttttgcatcctgtttctctagtttatttgttggccttttcattcctcagtgtgtctatgtgagtaagaggaggtgattcatctcacaaatcatattgggtcaagctgctgcacagcttgtatgataattaggaatatttctcctatcttatcaagtgaatcagaaaccaaagttccagcttcagagtttcttgggttactgacgagaaaagaaactgcacccagaacacaagcactaccaagggagcctgaaagaagatatttcaaagaagattgtattagcattttagtgtgtaaaaacttcagcacagctattgctataatttgcataggttcttgaattggtacttgacaagctaagaacggtatcagctaaatctaccagtttgcaaacttcagccgtaagactgagtaactacaagctaggcgattgctaactattagtttcactagcaggttcatggctgctaataggtgacaacaaccatctattagcatcctattaggagatggatcagaacaacctttgctaataattagctagctaactattggtaccagtggatccaaaaaaaaaaaaaaccgataatttatagctcgcgcaatcgtcccgatgtgattcatcatacattttgattaagatcttttttatatgttcagctggtcctgtacattggcaattcactctgaccttgtgtttgcttgctgtttatacactgcattgaagaacataaagaacacga

SEQ ID NO: 21772 - DNA, 856 bp, Oryza sativa
aacccccctcccccccacccctcgcctccattcctgtattcctgtttctctattcatgttttatttttttgatgttttttcgcacttaggatcacgatacaaccaaccacaaaaaaaaaattaaactcaaacggaatataccacttagctagatattcgaaaatagcataccacttagcctactttgcaccttcatcaaaattagacctcctttagtaaaaccctttgatcagcatgttaaacataatgcactctaccactatatgaaattacttaatctctaattcaaaatataaccacatgaaataattgtcataagttgaacaatacagagagatgcagttttttttatttttattttttttttgatatttttttcacacttaggagaatacaggaacccatcatagaaaaattaaactcaaatagacaaaatatgtgacttgtataatttttcaaagctctactaaaatatgtcacatcatgataagtccctgccgccctgagcaaggtcttcccgaaatctccatcccacgcagcctccggttccatgtaaaaacagtatcttcaatgcattcggcagcactggctaaggatgccgcgacgcgagaaggtgtcccaaggattttttttaaagtacctcaaaatgaatgtgagacgtccatttgattcgatctaatggattagattcaatcgtactacacctggtagtagatgtagtataattcgtggaggggtaatgttagaaatgtaatagatggcattgtgatgaatttgcaattggcttaggagtaagttcgtaatctagtccacgggtcaatatgcccaatcagttcacaactgcagcacgcgggga

SEQ ID NO: 21773 - DNA, 1501 bp, Oryza sativa
gtttttgtttttactcccaccaagtattctgctgattagttttagctgctctacttctttcggcagctctttaacacgtgtttctcttatgtcaagagtttccaaatactcgagcttcacaatcgtcggcggaacatgggtaatatccgtccctcggaggctcaaatacttcagcacaaacatcttacaaatgtgtttcatatgcctgttcttgaatcccttcagtccttgaaaatccaggacttgtattattctgtcattgaaagcatggaatggaagctgggtgaggctcccgaaaacggtcagtgaccgaacttgtgacagattcatgccttttgttgaatctccatgcttggaactgctgctctgcatggaaagccgacggactttgttattactgggtgctatcatcatcagatgaccaccaaccacagtaataaaattctcttctcttgccttggtcacaatatagtcaagaaccatgtcatgaacttgaaaggtttttagtttcccgttgctgctgtgctccacaggacgtatcaactttcttcttaaaatatgattgaagtatgattccgcaacttcctccgccgtcagcccttgctttgcattgacaaaaccttcagcaatccatcgcctggacagacacttcctactaattttccaaccctttggaaatattgccaagtacagtaagcaggttctgagatatccaggcaaattattgtagcaacaatcaagtatccttgtaaccccatccaaattgagagaagtttcttgttcctgagccccagcagtaatagaaacctcttctggcaataatttgtgaagtccagcccagtaactctttggctggtcttggttgcacgccactagaccagccatggtaactatggccaaaggctgacccccacaccttttccataaatcaccagggacattgttctgtaccttgtgtctatctttggtgcttttggattcagaaacacttcggttgaatagctccttggaatcacgaggactgaggaaactaatcggatacaatagatccttgttttctggccggcagcaggtcgaaccaaccgcttgaaatcttgaagtaactattattctactgcgctctttattatcagttagcaacaaataatctgatattgttttccatgtttttgcagaccatatgtcgtcaaccaggattatatacctggcaacaaaaagaagacgacaatgtgaggtagacgaagagtccatcatccagtaacaagcttataaattgaaaactacaaacatacataatgtgccaccacgtacacaaaataataaggaataaagcaaatgatttaaactaggaaggtagcccgcgtgaatgcgcagacatgcatcacatggtaagtttgagatacttataagagcgaaatattaaccggagaacatctaccatgatttctctgtaaattgttttcatcagcattaattgcttttataattttctaacctctga

SEQ ID NO: 21774 - DNA, 1501 bp, Oryza sativa
ttctgagtgtgcaagacatgtcatatattcgtgaattattttttttttgctgagtgagatagagtttggaatcggataatatcatcggatgcccataaaaacaattgtattaaaaaatgctgagtaaaagaataactcttacgacaatcccgtgtcacccgttttctctttgccattgggtttggccattccagtccttagctgagatgtggaaactgctgaccctgcaaatacaatagtgtccgtgaacagaagcagaatacatataacctttagctcaattgttcatgtttctctgccatcagaatgcagtagcaaaaacaaacatcataaggaaatcatgctataaaactgtgtcagaaattggcacttttaggttatttgaacagtactttctgttcagagaactgttcaagctacagtagtaataatctctttttgaattgcagtagtccataaataggtgtataatgatcatttactaaatatagttataatgtaagccatagtgtcgagttgataagactaataatatgggcaagtggtttaccttgttcacaatggacgaacaagttcaaaaacatataaatctggtttgtagaggataggatttcctcaaaaaagatataaattcccttcttaattaacatattgaatacaaacaaagtaaaatcaatttcagatcatattagtcactggaaacggggtcagtggcagcgaatcctagacccgggaacgccatccccgttaagggaacgcggggtcattttcgtgcccaccttgtaaaaacctctcacaagtagcataccacgtttctcgaccccgttcctcaatcccgtcgacccgggaactttgtgactaacaaacgcaggaaattgcagtactatccgatcggtattgaatattggttttgaaatccagtctaaaactttacatgggtgaatccacccatttgatactacaaatatcccattgcaattgtcatggaaggaagtcgcagtcctatctagatcactcacatcaccaagtctattgtggttctgaaacataagaatgccatttctgccctagctatattatatcctgctgcatttgactgagttaatccaaacagttgcttaaaaaggcttcagcaaaaaaaaagtgggaaaatcgtagctacaaacctatggaaatatatttcaatatttcccatgcaatcattttctttaataaaacatttgatatctggtcaaatttcccacccaaactatgcgcaactccattaaagcttatttgaatatataatttattatatatatatatatatatatatattctttcttctattttcaatctacatagctataatctagaccaaccatgactagtggcatatatctttctctttttttacctcattaacatggtaatttctaggccttgagagcaaatatgttggctccatttaaccttcactaacttatataatactccctctgtcaaaaaaaatataaacagg

SEQ ID NO: 21775 - DNA, 1501 bp, Oryza sativa
ggcccatcctgctccaacatcaagcattcaaaacccagcctttcttgcaggttgggccttcttgtcaggacttaaaagcattcatcaccttaggacatgttgaaagcatgttcacaggtggaatctggtagaggctttcagagactatcttacaacattcattcaagacgataaaagactaacaatcaatatactgaaatattttattattatttttccttccttttctccatcctcacgtagtaaagtttccttttataaacagacattatgggtcatgcatatctttatctattttatttgtgttagaaaacttatcttcttaacaactctaagagcccactattaattaccgttatacatgcccttagggcatgatcaatgatagagacgggtatggtctcttaaacaatacaagattatttagagaccatgtctttacgataattgagacgacaaaggctctaatcattaactcaaaaaatattccttttgttaatattcttttcatatttttatcctcatgcaaccatatttccatattatagtgactaagagtcgttgttaagccgttgtcatacataacaacgatgttttgtctctcctctttctctttcctccatgtcaacaagtatttctaattagcaatgctaagagaccactattgacaatcattgtacatgcccttaggccctacaagaatacttaccatatcgaaatttttgtttggttgtgataatttttgtttggttgtgatacacgtttaccgatctcacgatgacaattccctagcccactattacatatgtgtaatatttgtggacaacttggatagagttacacacccacaactccaccaccacactggtgctttcttgtacaatttgacatacaactaaacacataatatatatacagcatctaactacagtacatcttaagttgaaagataggtttagccctaattgtttgtaacactttggcaaaaaagtgactcagagtaaaatttgctctattaaaaataacccaaaaaaatccaatatgggaaaattggaaccataccattataattttgcaaaatttgagatatgccatcctgacccacatgtcattaactcatgtgggtcctacatgtcattgagatacatatggcatatctcaaactttgcaaaattataatggcatggttccaaattacccataaaaataatgcaatgttgtcttagaggaaatcattatacaaaaatgacaagaaaaatgttttatctgtaccagtaccactatgcattacttagaaaatggcagaccagatcagggttttgtcattatttttataaaggggcatttgcaaatttgccactggttttttcaatattgcaaggataccactcgaatgacagttctagtggcatttttataattttttagtggcagttttgcaataacgattcaaagtagtggtaaatttgcaattgccccttttatgaaaggtaatggaata

SEQ ID NO: 21776 - DNA, 1501 bp, Oryza sativa
aagtactgtatcagaattttaaaatatcttatattttaagataaattaaaaagtaaaatcccttatattaagagagagtatatacatatttctttttctccttcaaggaaggaaaataacacatcattgaacgacagaatgagtaaccaaaaccatttttgaaggcactcctggtaaaacataggacaaaaaattgtaatactagtatagtacaaagagcatgaacggatatgaacaaaaaagtttcagaactggttgtccctttcttctgacctgactttgccacaatccggcgaagccgccatcagaagttagtagaacattcgacaagttacgactagtttcactttgatccgtataagaactcaaggggatttcaactccatccgttatggtcaatcaagaacatcttctagatcgaagtcaatagtccaacagaggcatctctgtcggaagaccccagatcaaagtttgccatctggccaactaatcctccagcgacggttaactgttatccctgctccaccatgtctgaccaaactttattctcccttcctctactctatatcgagattcatttagaatgtttctcattttagtataatgttgatttattttagaacggagagagtactctctctcgagattcatttagaatgtttctcattttagtataatgttggtttattttagaacggagagagtactctctccaaaagtgcaggagcagcacgtaacgtacccataccattctagtcgtgtattgatgattgattgcttgcttgctgtgagtatttttgtcacgaggatcaggtgaaacaattaaaaacacaacggccaaaaagacaatggccaccatgtgttatacacagtacacattcgcacttgcaaatcatggaacatgattagttacaggacgatccagtagttatagtactacggagtagtatcaacaatcaagcaagtagtttgtgaattgtgaccatcaaacagattcgtgtagtacaggttgaaatgaactgctcgccggcgtcgcagcggagtagtgcgggtcgtcgctactcacgagcgtgtgccacttccccgtcgttgtcgccacctacttctacctgcgcggattcccgtcccgaagtgacaatttccccgtgaaatccccccctatccacaagggtaaggcccgtgcagccgccgccaccgcctcctcgcacctcgtttcttccaccaccctcgcgcggcggcggccgtctgccgtctgccaatccgcccgcccagaaaagccgcctcgttccgttgtctcagcgcgtttgaccagcgatctactatccccccttccccctcctcctcccacgcctcacacactgacacacatatgggcataaatatgcctccgttgggagagatgccaacacgacacaccagctagtagtgtgcgggtttgggagaggtgcgtgtgcgccctgagctgctgctgccgcccggccgccacccgtgacccgcgcca

SEQ ID NO: 21777 - DNA, 713 bp, Oryza sativa
actttataatttttttcatgtttttatatatttttgtacctttatcaattatccaaaagttataaatgattgggttgtatggtgtgccttttgggggaaagagatgcaatttgcacccttgatgaatcatccaaatactaaaataaattgaggtaatgtgaaaagaaggaatttacacccttgatgaatcatccaaaggctaaaaacaattgagatgatgtggcttcatgagagaagagagaattagcattaactacatttaggggaatgaactttatagatatataggattaaaacatgatttaaccaattttatacgtaagttatatagtttactaatattgttacattgtaattatactatcagtgtcgttaaaatgtaacaatgcgtaattacaatgtagttactaagttacactattactttcactattactttgatatagttacatttgaaagtttttataaaaaaaactttgtgatagtttttttaagcaatttccttagctttatatttattaatttgccaccaaagataaaaggattgttaattttatcccactttagaaaaagtaaagtagcacactatgacggcgtcttgatttttcataaccaccaactggttgaatcgaatgaccgagatcttgttagggcattgcaagctacttagatgcgtgtatttatgtgtcaaatatgcaaagagcaaataatta

SEQ ID NO: 21778 - DNA, 1501 bp, Oryza sativa
taagttcgtgtcttgtgggtaaagtgtacccctctacagaggttaactaactgttcgaacaaccgtgcccacggtcatgggcggatgtgaggtggttcccgttgcgtagatttgtttgcctgtgctttgtgaaaagttgttgtggtgtgggaatcgtaaccagaatcagcctatgtggcagatggatgacctgagtggtcagaaacgaatctgtgtgattcgggatgtctgtgggcatcatagactaggcttcccgagtggaagcggattgttgtgctgctgggcagctggactctgggagtccgagaaaatgaaaaaggctctgggagccgattaatcaagtggaatggctctgggagccgagaagtaatgatctgacccgggaggtcggtacattaccaattgagttgttgaaaagcatctcttaaagtcgaattgagatgcaagtctctcttcggcccaaacttagaaagaaataaatcacttagtgatttcaaaatgccttcaaataaaagatttgtaaaacaaccttgcctctcctccaagcttgcatcaaacacctaagttcccgtgacttgctgagtacgaaagtactcacccttgctctatataaatatatatatatagttcctccgccctgaagagaagataaagtgaagagaagattagggtttcgtcctggttcccagccgtcgcctgtggtgttgggtgttagttcgttggttccgctgctgctgctgttgttggtgtttcctcatccgtgtcgtcggttgcattctcgggttgttctgagctgcaacctaagttaaggtaaataagtcctctatttattttaaggattgctatgattcatatttgtcaccgtgggaactagcactatgtcctgggactggtaccgagatcgcggtttcgtaggaaacggttcacgccgttttccctacgacacgctcctgtcaggtgccgttgtacggcggtatcagattggggtgtgacaatatatatgcaggagtatgtggtattgtactagtacgatatcactgcttttcatagattgagtgttgcatagtgtatatgggtatactctgttggatacgtgtgcatatgctctaaattttcttattaattttatgatcctgtgatggcagtgttttttacatggacttctacgacgacgacgacgacgacaatctcattaccgaatggtgggatcaagaggagttatctgacgatgatgactactacattgtagctgctcttcttacggacatagagcataagaggaccaaaagaaagcgtcgtggttcagtcccagctcgtgagataattcatagggacaggtttgctggcaatttgcgcatagtggctgattattttgcagatcctcctgtatataatgcaaaattatttaggaggaggttcagaatgtcaagggagctcttcttgcgcatcgtggctagtgtggaggctcacgatgactacttcaggcagagaccgaatgcaa

SEQ ID NO: 21779 - DNA, 1501 bp, Oryza sativa
accattccgcacactaactctctttgccttttcttctttccttcgacagttagggaattgtcaaatccagcaaggaggagcccgatctagcgtctctgatcttcatcgggtcgactcctaccttcccatgtcccgacaagcccgacaccccttacctcaacgacgaccatgacaatagcgtgcataaacgatggtggaggagaaaagacatctcagtgactagggggtgtggttgcgcatgtaaaggcggagaggaggaacgttggtggctcatggagaaagagcgatggtggcggtgcgtggagtgtcaattagtggttattggtggtctaaggagtttgctcttgacacaatccccaacctagtttgttggattttttttctctgagtactgctgatatgttggtcatcagtcatcgtaaataaatagctagttttaaagtagtaaaaaaattgagataaaaggtggagtactcgagtaaggatgaaaacgctttagaaacggaggaaaaccacttttattgtttccgttttccatattcatttcgaaatcggaattagaatcgaaaaccatggatacgaaaacggaatcgaatattatcgaataaaaaaatgaagcgaatacgatatcggaatataaaaaccccttaagctgaacttcttaaaaaatgaatgaagacatgtagcttaatatattttttagacaataaatcgatatttataatttatgtcttgaagctagagccgtgccaaacaagccctaaatcgatacttctaatttttattaattaataataatacaattaggtgtacactttattcttttttgaaaaaagaactatattcatctataactgcattagtactatggcacgtagtataaatctaaatatttggagcagaaaagtatggagctaatcaactgagaaatacttcatttccagttaaaaaaattctaaattcgtttcctgaaattttccaaatttgttttgaacggatagtagcattatcatattcgtttacattttcgaataaaaaattcgaattcattcggtttctcggatccagatagacttggcaaatactgtagttaaatattccctgtaactctccccattccttcccttggcgtaaaataaaagagaaatctccccccgtctcgtcgtctcctccgctccttgcgcctccccaagacgagtcgcggctgaacagaagagggggagtaggcggcgatctccatctggcgactcgcgagcagagcaggggaggggatcctggtgagcatctacatcctctttctttctgattcatctctcttactttttttctggaatttgcttgcgtttgttcgttaaccctagcttctcttctagatctggaagaagctctcctcttaatttcagcgccttaaccttaatacaagtaccagtttgagtttgtttgttcccaagttggatccggccctgggtaatttctttcttgctgaaggtggagagactga

SEQ ID NO: 21780 - DNA, 1501 bp, Oryza sativa
acggctctagcttcaagacataaattataaatatcgatttattgtctaaaaaatatattaagctacatgtcttcattcattttttaagaagttcagcttaaggggtttttatattccgatatcgtattcgcttcatttttttattcgataatattcgattccgttttcgtatccatggttttcgattctaattccgatttcgaaatgaatatggaaaacggaaacaataaaagtggttttcctccgtttctaaagcgttttcatccttactcgagtactccaccttttatctcaatttttttactactttaaaactagctatttatttacgatgactgatgaccaacatatcagcagtactcagagaaaaaaaatccaacaaactaggttggggattgtgtcaagagcaaactccttagaccaccaataaccactaattgacactccacgcaccgccaccatcgctctttctccatgagccaccaacgttcctcctctccgcctttacatgcgcaaccacaccccctagtcactgagatgtcttttctcctccaccatcgtttatgcacgctattgtcatggtcgtcgttgaggtaaggggtgtcgggcttgtcgggacatgggaaggtaggagtcgacccgatgaagatcagagacgctagatcgggctcctccttgctggatttgacaattccctaactgtcgaaggaaagaagaaaaggcaaagagagttagtgtgcggaatggttgtagtgtcaccggatccgaagatggatagaatgggaaggtccaaattaaaatataaagttagatgttgtgtaaatgaaaagaatggttaaatggtgatataatatgaaaaattttaagaatatacagtacaaactgtaatttacctttttttctttagcacaattaacgatgagttatctattatccgatagtctcgtgatatgctaagcccactgcagttttatcatctctgcacagtatggttggatcggtgtacttagctattactaataatctcatgatatattgatacatgacgatataaacttctactaatacgggatggttaattctattaacacaggctcattaattatgataagatagaactgactaaaaaaggataaaaataataccatcaatagtctcatttcctcattgcatgatatatgatgactatctctcatcaatatgtatataattatattggtattttcctaattctttcatattgtttttttagtttttatatgttaatttggactaatattttttctcataattaaatagtaaacagatcgtttttccatatttctccattaaaatgtgaaatattgcattgtataatttgaaagttgtattataagtgtatgtaatttaacgtgtaagatatggacttatagtataatatttggtttttttctctaaaaatgttgcaccatactccctccatcctaaaaaataacgtagtctgcatgtaacacatcatagt

SEQ ID NO: 21781 - DNA, 1501 bp, Oryza sativa
gaaactggtgactctcaatactagcttaagaaaagaattaacgtcgagctaatcaccgttatacgtgattggtcgccataactctacaataggggcataggtgctctcccctaccacaactccaagctactagccacccacgaattcctagtcgtccatgcagaaagggattgatgagattgagggcgaaagagaaaaagatccacacattcctctctcgtagtatcaggtgctcgcaccaaagcattattttaaaattctagttttttttcttttgtgaaacctcaaattatagatttgccttgttcacaatttttcaatgtttaagctcatggtaatttctgcacacaataggccaaaatatggtttcgcaccttccatagtttttatacgcgtatgtataacatgtcatagtttgattgtttgagtgtggttacttggaagagaaaatcccttatatacccctgaaattttacctaatcccttctatacccttgaattttgcttacttccttgtgtacccctaaaatttgattttgatcccttgcatacccttcccgtcagttgaccgtgtattttctataaaaatgactattatacccttggatgaagaaagaaattcatgaattacattattaaaaatataaaagcttctcgcatgagactattatagttatgagtttgttgtgcgatgtattatttatcccaaaaaatatttttagataatgaaatagaaaaatacgtatttatttttttaaaagaagtcataaaaatgaggggcattcatataaagataggactacccatgttcacaacattttttttatgaatgctcctgataaaaaaatccattgtcctattaaaatttcaaataaaaaatttaatttattacatttattttattttcaaaatttatgtcaaaattttctgcactaattatttagtcccattagttttataaaatacacatactgtgcactcaaataaaattttcaattgtttttgaagcttatatttaaacctaaagcatcaagggtaaaaatgacatttgcaaccaaacgtaacagtgaaatgatggaaaatgtaacggtgagggcatacaaggaatcaaattaaaatttcaggggtatagaagggatcgggtaaatttcagagatataaaaggaattaagtgagttttcaggagtacaaagggaatttactctagttggaaaggttaaagcgtacagatcgctaggtaaggaatgtataacgaaccactttaaccaaggcgtacatatgatcattggatccggctcttcagccagacagcctctccttgccgttgatccacacacacacaaaaaaatattactatattataaactagtagtactcctactaaattaattaaggaaagaaatacataaatcaaatatcgcacagatcgcactatataaagctacgcgcaccaaacccatccctacccgagaagcccctcgcctccggccgcctcccgcaa

SEQ ID NO: 21782 - DNA, 1501 bp, Oryza sativa
gaagagccggatccaatgatcatatgtacgccttggttaaagtggttcgttatacattccttacctagcgatctgtacgctttaacctttccaactagagtaaattccctttgtactcctgaaaactcacttaattccttttatatctctgaaatttacccgatcccttctatacccctgaaattttaatttgattccttgtatgccctcaccgttacattttccatcatttcactgttacgtttggttgcaaatgtcatttttacccttgatgctttaggtttaaatataagcttcaaaaacaattgaaaattttatttgagtgcacagtatgtgtattttataaaactaatgggactaaataattagtgcagaaaattttgacataaattttgaaaataaaataaatgtaataaattaaattttttatttgaaattttaataggacaatggatttttttatcaggagcattcataaaaaaaatgttgtgaacatgggtagtcctatctttatatgaatgcccctcatttttatgacttcttttaaaaaaataaatacgtatttttctatttcattatctaaaaatattttttgggataaataatacatcgcacaacaaactcataactataatagtctcatgcgagaagcttttatatttttaataatgtaattcatgaatttctttcttcatccaagggtataatagtcatttttatagaaaatacacggtcaactgacgggaagggtatgcaagggatcaaaatcaaattttaggggtacacaaggaagtaagcaaaattcaagggtatagaagggattaggtaaaatttcaggggtatataagggattttctcttccaagtaaccacactcaaacaatcaaactatgacatgttatacatacgcgtataaaaactatggaaggtgcgaaaccatattttggcctattgtgtgcagaaattaccatgagcttaaacattgaaaaattgtgaacaaggcaaatctataatttgaggtttcacaaaagaaaaaaaactagaattttaaaataatgctttggtgcgagcacctgatactacgagagaggaatgtgtggatctttttctctttcgccctcaatctcatcaatccctttctgcatggacgactaggaattcgtgggtggctagtagcttggagttgtggtaggggagagcacctatgcccctattgtagagttatggcgaccaatcacgtataacggtgattagctcgacgttaattcttttcttaagctagtattgagagtcaccagtttcgtggtggcgggttttttctttttttcctgattgtagcatttcagggttgtaattttatttttttaatgctacattaaaatgaaatctcacacctatcttgtgtggttcgtttcaaagagaaaaaaaaatacacgcatcatgtcagccatttctccgctatcttttctctctcttcacctctgatcccttctctcttctct

SEQ ID NO: 21783 - DNA, 234 bp, Oryza sativa
ttaaaaaacataggataggagcgagaaacccatgagttgatcttaaaaatgaagtttaggtgagtttatttacttaatgtagaagaggtaactaggatatgtcaaacattacctgtgaatttttcgctagccccaacagaggacagtcgcggagatatcatgcgagactgataggcacggctctccaccagcccaaacaatagagtgatcgctggaagatggtttgcaattttg

SEQ ID NO: 21784 - DNA, 640 bp, Oryza sativa
aactagtctgtcactcgcagctttatgaaagataagctatacgctggcaatccaaaagaaactactcggattattgatcgctacaataagtagcgttggatccgcggaatacacgcgtaacacgaataagaatcccgtgttattatcctgtcttgtgcaattgttactattattgaaagttgtttatgacagtcggcaccagctgctggccagtagccagttcgtccattgtgacttttgcaccattataaatatcaactgtaaaacatagtggtcagtcatcactacgatgatgagatttagtttggttggttttgctgaaacattctctatgcgatcaccgtaaaaagactactccgtattaatctatatccgcagtcatggtctcatggaccatgaagtccactttaatagcgagttggtttgcagcggacatcaattctactaatcagtttccctaaaaaaaaatctactaatgagtttgctttatctgatatgcttacgtttgtcctatttttgtactaaccaccccttaaaattccgaatacgacaacataacaagcaagatcagcacccacaggttattacaataaaatactttttcaggaatgagatctagtggctctcttttgcctttagt

SEQ ID NO: 21785 - DNA, 598 bp, Oryza sativa
aacgatcccaagaacaggtgtatctgatatgaaacaatacatatatgggttttctaattctttgggctagctttcatacattttttgtgggtcataataactactgatttggttcacaaacaatatattttgcagggcaatgcaaatggattgtataggaatgctacatcatgaagatgggaggagctaaagctatagtattagcttatgaacagttataatttctttttggagatgattcaaatctcattttctgtatgtatgtttacctgacatgttgatcacagttgctcttaatataattacctttcatcgattggattgtactgtgttcctgttttgtggcattgttctgttgatggcgatattatagtagtatgatgtttgatcggatgtaaatggtgtgaatttctcaagcctgatatcctacaatatatagatatgcgactatataatacgtattaattattcttaacaacgcatcatgagacgctttaatagctgtagagacgttattgatcacatccataaaaacgtcccaacgaatgtagagatgctattttggtgtctcaaatatgtttgagatgctttacaaagc

SEQ ID NO: 21786 - DNA, 649 bp, Oryza sativa
atatgatagcgggtatttcaaggaatggcttcaggttcttttgcataaagctaattttataattcttttcacaagcctaaaacctagcatagactgatcaaattttagtaccagtgttcactttaaacaacgacggttctgtccaccatccattgtgatcccaaggatagcttcccgccattgaatcgtcatggttttctgaggatgtccaccttccctcctctcgggatgtggctccatcagcataaaattcatcatgcaatatcccatcccccacaagttaagaatttaaagtctagccaagtgtaatacatgtcccggtgctcaataaccgcgagcacggctattcgaatagatttggtttactcacactgcagtggatgtacactttacccgtactccgcaacttgcccaacacatgagcctacgtcccaacgaatgagacttgccacggcaaagcctttcaataacctcactttggcagtatccgctccatgaacttaagccctcatgcactctaggcgtacacggtttctagcagtgagaggagttctggcgctcccgagggggaaaactcacgcaagcctaacatcgcattctgtagttgaacccaatccatgctgtccccttttgggtatctccttgtagt

SEQ ID NO: 21787 - DNA, 1501 bp, Oryza sativa
tttgatcggccatgtcgacgtgcgtgcttggggcacttttttcgaaaccggttcttgttaggagttgacgactaaacgtccgcatccgactgcttctttttggatagacctatgcatcagacgtctccggacaatgttgcgcgtaatgttccattgctcgaaaaaaatatttcaacataaattgtttcttgatgtttcatctttcactaaagaacatttagccgctttatcaaagatgtttcaattgaatgcaacacaccgattgcaacaacaaaaacccaatatttgcaacatctgaaaattcagatggctcacagatcacaaagcaaaaccttcaccttaaccgtcatcgccggtctctggtggtgactccggctgcgaagaatacccgccgtaacccggttccagcgacggctcctgcacattttcgtcgtacaggctgcacggagttatcaacgcggcggcatcccctaccttaccgctgcacaacacgacatcccacgactcggcgtaggtgtacctttggaccgtgagcgtgacgtcgaactccgccgcgccgccgccccgcaggtccccggcgaggcggtcccgagccaggcgtggcacgggcacccctctcccccacgcgacgacgctctcctcctcggccgacggccgcggccccgcgcagagcgccggcacggcggcgccggcgagcaggactcctccgtagtacaccgccacggtggtgccggcctcgaagcagacccccatgtcggcacgttgcgacgcgaggcggagcgtgaggttgaactccgggttgagcgtgtcgcggggcaggtccgtctccgggtcgaggccggcgacggaatcgatcgcgacggagtaggaggccggttgcgtccagtctttgacgatggcaacaatcatcatagccaagaaggctactgctatgaggatcatgcaaaccatgacgaggcatacggtgtctatacgcaatcttacacctcctagtacacctcggcgttgagtgttgtccggctcagcgacggcccaatggacaggcagctcatgctctgccggcggcgcgatcacggcggacatcgctttctcagcacacgttgtgctttggaatctactttagagttttaatcttatcttgccaaacagagcgggtgtctggtatgtatttatgcgcctgaatcgattgatttgttctatccaccgtggatatacgggagagtttaaacttcgatatccgaaaatttgattgtcttttagtgcaaaatataacatcataaatatagccactcttaaaaatattaacatgatatgcatcatataggtgaatcatccaaatgttagaaataactagaatgttgtgatttaatgagagaaaataccattagtgttacctaggtattttaatagatgacatttttgaattttagatacacgtttgaccatttatcttatttaaaaaatttacgaaactatcatttattttgttatgagttgtttt

SEQ ID NO: 21788 - DNA, 1501 bp, Oryza sativa
catataacaagcaggaacaaagcacaaaaataggttcttgacttcttaaggaaaaattagagacttgaacggtccaattccgagttcaaatggccaagttatggccatttgaagtttatatgctctttaaatgaatatttgcgaatttcttcatttaaaatttaatttaaaaatggatttattgcgtcagccgaggggaggggcgcgcggaccgggtccacgggagtggggcccacgcggcagcctcacggtccacggtggaccgggcgcacccgggctcgcaccgggcggcgccgtgggccccacgcgtcagccgcacccgagggcgcgggcggctgacagccgggccccacgcggcagccgcacggtgcgcccgaaggcggccacgccggcgcagcggcgggaggcggcgcgcccgcgcccctatggtcgccggcggcggccataggcacggcggagcggcggccgagagaggggaaggggagggggaaaagaagcggcggtccacggctcaccccgggtcgacggcgacgacggaaacggcgaccggagcggaggaagacggcggcgcggctcgggtggacggggtcgacggcgttccggcggtcggcgaatgaaacggaggggtggacgaggtcgccggggatgcggtgaagccgaaggtggcgacgccgaggcgggaggtggtccggggcgacgacggcggcggaccggagctcggcggtgacggcagagagagagagcgatggcgcgagctcgattccgacggggagagagggcggcgagtggcggaaacggtggagggaggcacggggagtgtttatatagggtcgggagtgagagagagcggccggacgaggaggaaacgggcgcggaagatccggctgccattgatggcgccggcgaggttaggggagagatttccaaacgaatccgagggagagagggagggaaaaatggggggaaagagggagggaatcacggggaatatttcccccctcttgattgcacgcggggcagacgggggcggcgggattcgcggcggcggcgggagcggcgggaggaaggggatgacgggtgggccccacccgtcagcgagagtggcgggcgggcccgcccgtcagcggcgcgcgcgcggggaggaggccgaatgggccgcggggagaggagagggagggatagagagctgggccggaccggcccaagagagagagggggagggaaagggaactttttagggtttttctttttataaaatcattttaactttgtttatttcttaataattattatttgtgctgtgaaaattccactaaaatttatttacgcattttaggcttttaggaaatatacaaaaatcctccaagccttatttgacttttaactttgcacattttaattgtggaggctttcacacggattttaattattctaggcataaattcgaggatgtattttagagtcgttttgggacgcgacaagcactcacttagttgttttc

SEQ ID NO: 21789 - DNA, 1501 bp, Oryza sativa
ccactatagtacgttcaacaaatggtttcactatcactcattctttcatctaccctatagttcaacaaatggtttcactcttcacccattctttcattcctcattgaacaaatggtttcacttatcactcattctttcattcctcatggaacgatctagatcatctctctaagatccaacgtccctatagttcaacaatggtttcgcttatcacccattctttcattcctcatggaacggttcaactgattcctctcatcttgcgcgtgcatgcccctcccacctgtgcgcataccgccgatctctcctaaaatcatgcactcatggtgatttcagaaaagaaaaaaaaatcatgcactgactatactgtgctaccccccctcaacccccaatctggtgttcatcaagcccgctgcctaagggagccatcgtttcgcttattcgtggaataagcgaaacaacatatttgcaaacgaaaagtaatttgtgaataaaacttttatatacgtgtttttagcgatctaaaagcaaaggttgaaaaataaacttggatgaaaaaaacctcaaaatcaactccaaatttaaggttgaaaattcaaattttggctgataagcataagcgaaaagatgagactgtacgtcagcgtgtcctatgcctaccaagaccccccgctggtcaccgggctggtgccggacttctgcatcgggccgcgggaatcgcggggcgagcttgccgtcgcacgggtgccaatgtgagcgcgctagggtactggctgccaagcctcgccgatagcatgagggcagtagcaatgcgtcacgcctcattgaggaaccaaaatgtccatgttggaaaaaaagcagtcgaagctcacctcagctcccctctccacattgcacttgagctttaggtaggtccaccaccttttcttttcaggccggccccaccaccttttcttctccttccccctctctctcttcctaaagctgacgacgctgacacaaagcggatgaagaacacgtgtctcagtttggtcacacgttcttggtttagtcacgtgaaatgcacacgtggctgagaatctcctatgtgtaagcttgaggctgaatgccacatcactacactgtgaaagcccttaggagcgctcaagtgatgtttgacgtcaatctgcagaagcggaacaggtgggatgagtgcaggacgagagtcggcgagaaggcttcatgccatttagattttgccgaatagttattaggagacattataattccttctgttaatatgtgatacatttattataagaaaatattatgttttcgtttcgttttttaagtgatgtttgacacatttattttgttcaaagattatgtacaaatgcataagatataaattatacataaaatatttttatgataaaacaactcataacaaaataaatgatagtttcgtaaattttttaaataagataaatggtcaaacgtgtatctaaaattcaaaaatgtc

SEQ ID NO: 21790 - DNA, 1501 bp, Oryza sativa
ggagcctctggaagatgaaggctttagtgtctagctcgtgcctgccgtcaagcgcctgtggtcgtcgccctagtcttccgctgtttcccgtttgtctttgtgtgtgctgggccttcgtcgcccatgtaataaattaactatttacgcttccgcttgatatactctgaaatgtatcaactcttggtgtaccttgcctcctgggacaaggaataatacacgcacgtaaggaacgcccgttgggttaattccggtcgtgacaagttggtatcagagccacccttgaccctaggacgagccgtagatcccaagccttagcaatattttcaaaaataaaaatcctgtcttatttgtgaaaatcctctagtctctctctgtcttgccgcttcatttatcgccaaaatctgatctttaaaatgttgcttttctttttgtttttgtttgtagatggccggcagcatcaaccgtcgtggtctggacctgactggctttgttttggagctgcggggcatgtgtgttgtcctggggtatccgcatggagtggactaccagggcaggcagctcccggagcaggagggtgacgatgcagagccccacgctgcttgggaggttactgcagtgatcctcactggctctcccgagaggacttcgttggcagtcaccgcgggtggagattctttctccgccgcttgccagaacgccgctctcctcgccatcggcactcttcaccagcgctacccggacgagttgcagcactcgccctaccgctaccaccctcgccgcggaggagcccgcgaccacgccacctttcgggatgctagctcggaggatgacgctaccatcatgcatctggcgcgcatggtggaggcgtacgacgcggcccgtatcgacttccatcagatggtgcgccgtgggatggtcgagaacagcatgaagatcctggagctgcgtcaggagaatctgcagctgaagaaggacctagacgcagtggaggcgcagctgcatcagctcaagatcgcccagggagaggtctgtcgccccaagcgtcgccgcgtctgccgcagccagaagatcaccgcccgcaagagtacctccaggcccgagcttgttcgccagtccttggcatggacctgcttcgtcgagacccctcgtgccgagcccgcgcccgtggttcctcaggagggggaagcctcaggcgttggtagcacggaggatgcgctgttgctcaccttccgtcctggcccgtcgcagcggtagacgagcagttagtaggcttgcgcgtgtgttctttctcgtttgtcttcttgttggagccgtgtggggcatggttatgccggtgtgtggtataactgtgtcagagcctgtctttattttatttgcctaagcaacttgaactttaatgaaccaatttaatagcagtaataaattcaagaattatggtagtcgtgggtggttagctttaattgtcagctctctctgtttgctggatctgtgtggggttgtc

SEQ ID NO: 21791 - DNA, 300 bp, Oryza sativa
aatggggagtattctggtgttagagggagtatgctacagtgctggtccctgcagttccagtgtgttttttggctgagcttgtcatgtactccgtagctggaatgatccagtgggtgtaaccctcggtgtgtgagttggttttacctctttgttgaactactgttggctctctgaaaaagccaggtcactatcaatataatgatctttcctctaaaaaaatggggtcgtggattattttttcacagaaaccatctgggatttttcagtccagtttcaactcaagggctgatgttgtgcttc

SEQ ID NO: 21792 - DNA, 198 bp, Oryza sativa
gatatagagggttggtagcaatactgggcagaaaagcaagaagaatatccagaactaagaattgacaattcacgaccccatttgttcatgctttgatgcagattgtacaaatcattcaattgttgctgagagcctgagacacttccatcaatagcttcctcaattacatcatactcccttattgatactctttcaagg

SEQ ID NO: 21793 - DNA, 360 bp, Oryza sativa
gtgccttagtttattgactgtaatatgtttttttaatacaattacaatataaatatggtacagtatatgttgcgttttattatctttatcgagaatttttgcccccatctttattttatagctgcgtctgccactggtacagtatgataatttacactcaatcagtaaggtctatacatgttctttttctgagtttgaggctgtctctgcattttggcaagtcacatatttcttacagtttccattattttgcactgcacttccttcacgtacattatgcaaatgtgggagttgccattacctgataattaggaaaatgcttgtcaatattgctttgcgcaatatttaacgatagtccgc

SEQ ID NO: 21794 - DNA, 1501 bp, Oryza sativa
aagttggagatatagctaaaatcactgtgattgagaattccatttctagtgtccaaaaagcttgaagcagaacattttgcatataactgatcaaagctagatagaagtccagtgtcaaaattaactaattctgacccatgttggtcttgcctttccagtccaactgaactagaagtaaattgctctagaagttcagcaccataattatgagagaatcttgcctgcttttggccttgcctatccaatccaactggaggaaaacattgttccaaggggttacaagggtcaggtcgccggtaagtgtttgatatttcatatggtaccacatgtgtctcctcaatctgacagggggtgaaaaatctatttggaatggatccagagaatccttgtgacaacataggcacccatccatgataagtgcatggccttggttcaacattacagttcaactcagtagctgaagccagtttgccttcggagtgtggttggacatcctctagcaacaaattagaaacctggttgtgagcagtgtctcttttccaaccagaatttggaagacccacagtgtgcacccatggtaatgccatgctctcacgtgcttcattgcccctgtgaggtaaatcaattttccaatcaagagaacctgaagggccctgattgtatccccatggcaaagccatgaattgacgggattcctgggttgcataagaggatgactctttttctgttctcagtttagttcgcaaatcaaagtcactaatcctgtaatcaagcatattttcaaaatggcatccggtgccagtaggagtatggccacagaccttcatcattctcatggactccttacggtgctacattacagcaaaaaaaaaaaatcaaatcaaatcatggaacttgtaaataatagacaaacatttttgagtgggtgatagtgcattacataggttcagcaaaggataccttttttatcatgctgttggcgcctagcctttgcaggatgtcagcaaaaaattctgatctgagaaatttatgtcatcaggccaaccattatcggacaacatgaaaatataaagtaaaggagttcttcaatatgtaatgtcaaccttctctgcaaaaactcagaactttccattgacatagtttttgcagctagctttaataattttcctctcttttctgaaaagatccgtccactccaaggttctatgtctatcatcaaaagtgaaaagaatatgagcttagcacattagataaatatagcagacgtaaattgctgtgagaacacttctaatcatatgtatctcgcaatactaatttatgcatggtgaatcagtaacatgttcttgtatcagccaacggttgcagaccaaatatcagcaaccaacacacttcagaaaagatgtgtcgtaggcagcatgaggaaaacaaacataaataatacaaagagcctaggattactgccttgcctgatagtaatttctgttattttcattcaaagagt

SEQ ID NO: 21795 - DNA, 160 bp, Oryza sativa
cagtacttgtgtactattacctgtcaattgctaagagcctttaccaaaaagtttcaattatttggagagacaacacacttattgacaaagggaaataaagcattttttggcactagaaacaaaaagcaaattatatccagtttataataaggcaaagaaa

SEQ ID NO: 21796 - DNA, 1501 bp, Oryza sativa
tatacccattcgagaagtacggctgtactgaggtcgtttcatgtttaacttcatggctcggtccttaactgaccagggacggcactagcctttaccggacaccacccaagtccttcagccgccccagtcgaaaacatttgtttaattttatttctcctttcacaaatcatgtcatcaacatcatggcaatgtggtgctcatgtctccacatgccgcatctcaattaccttcccaaaggtaattgcccaagcatatagcatttgataaatatgagtatgcatgattctagaatagcatttctaagcaattgtcataattgactagggactcatacgtagacatggttacaaagatttaagggtaaacaataatcaaggcatggcataatcccaagtaggatattcatcattgcatgcaattttatttataaacaaaataatttcgcaattgggatcaacatgttcaaggaatagtgatgacttgccttgctcaggataatccttattattgctataatcttgatcaaccttcacctcttggaagttgcagacgttgcctcacgactaaccgatacacaaggtctataatacgcgagaaaaaccagtattcaaacaacaatcaaatatgcgcgacaaaatgtactattcgtgtttgctaatggattccaatcacgctaggggctaaggtttcttaatctttctattatcaacgtggcctatttaggagttaaccaacatagcatttatgggatacatatatatttggctaatcggtggtttagtctatcaaatggcttatggaaggattatggctaagcatgcatctatctaaataggacgtttatatactagaggttctgttgttagatggatttatgatcaatcaaataatgaatcatgtgtattattatttaattgatggaggctttactttaattatgaacatatttcacttgtcacaataaaaaggataataattatccatgctttgtatgttagagttgtttaggttaatcatattatggttacagattatcccttaataaacaatcctaatttacatttgaactataattataatcatatgaggtcaagatttatactagtatttatctaatatacatgtttgtcatacactccctctaattaatatatgtaacatgcaaattaatactataccgtacaactataatgggacgtatagtatatgtgtaagcaacaatgtcttattattggatcatatatttgagtagttgctttttactataagctatacaatacatgttgattttaagatggctctgtttgtttaaataatggatatcaactgactatatattctacttcacatgacattgtatcaactaatttttaagtggtccaaatacaactagctctgtgattactctcctaaacaagttaaagattcatctaggtgtgtttatatttttgtcacgaaatatgaggctaaacattatttatatactttggacgcatgcgta

SEQ ID NO: 21797 - DNA, 456 bp, Oryza sativa
atgataagtagaattgcttatccttggtctgtgtgccaagatgaaatatatatgactatcaaaagtagatggagagagtatatcctagcaatttgaatatgaatatgtttcttgtctagattcgtaatcctagaatacgtctctaccacccaaaatcttttatatttttggacaaacggggtataaactagttaagtccaatatattattacttgcttcgatttgataattcttacgtttgaacaaggttaagatcaaatttttataacttttactttcaataagtttaaaaatatttagtttaatgcatagaccatcatatacagatttgtattgtaaagtactaagtaaaagtaaaagtaaaaatgtatttattgattgtatatattataatagaaaaacttagttaaagatatattttgaagatcgtgtcattgtaaaaaatatcaggaatta

SEQ ID NO: 21798 - DNA, 1501 bp, Oryza sativa
ccccttaaaactttgttttatgagttgtctttagaaaatattgaaaaacaaatgaatttttgcactttgaaatatagtcttacgaagaaagattgcttcaaaaagaaaggaaatgtttgtttcaaactatttaattgcaaaattgtccccaaagccgctctgaacttatattaaattttgggaatggtcaaaattagcttgaaaagaaaattttctctgaaaattatttgtgaaattgtgattccaaataatgtattgcaaagttttccaaaataaaacttcattcaaaaccaaattttcagtgcatgtcttcgaaagcctcctttcaaaaggttttccaagctgaattccaataattatttgcctaaagctttgtttaaaaataataataataataataataataataataataataataatagtaaaaaaaaaaatttttttcatgagtttttctttgaggtgttcaaaagtattgttgtttcaactttgaaccatgcatacaatctatatggtattttggccctatgggcaagagttttcttttgcgaaataaaatcaaatgttgttttcaaagaaaaattgattacaaaagtttttagttgccatgttgctttttgttaaacacatgtgtgattatacaaaatcttgcctgaaaaaaaaaatctattttcaaattatatttggtaagaaaatgtatctcttggaaatttcaaatgttttgcaaacatcacttccaaaggatatttgtgcaaaatcattttgataaaaaaaaaatctactttgtgaacgcaaaagcatatctccttttaaattgctttcaaaatttcttattttaaggggggtagcctatgatggaaaaacctcgaggaaatcaataacttgtgggaaaatatggacaaggaatactatatatcaaggtatattcgcccttgtacaaggaatttgaagtatcattggatagtaaaactgcaaagggtgtaacctcaaccctcgacggcaagattcataataaatattaaggaacgaaggattgaacaaatgatgaagaaaaacaacaatgcagcattgtcatgctactattgatgcctagtatagtagtttactaactttcaacctactaacttctaacaagaagaacctaccacaggacgtgaagacatggaccaatagacatcgagaaacaagaactcctccaagctacaagacccccaaaatatgggaataaaccagcccatgctactccttgaagatcctccccaagcttccaagaacaaaggacgagtccaagcctcactaaagcctgaagactacaccatcaatctgaatcacctaaagcaatattcttcgaatgaaaggtgccacctgactccagcaaaacgaaggataaatgtcacgtgttatagatgtggcgaggaaggacattgtgccttggattgccctaagaaaaagctaggaaatggacaagtaaggaatataccctgacacccaaaaaggaaaa

SEQ ID NO: 21799 - DNA, 684 bp, Oryza sativa
tacgttccaccggcccagacaattgtatcggctacattggcagcatcaaaggctacatcagtacattcgacctcctggattgctctggtttggttaatatatttgcctaccgatttatcatatatcttagttaatctagtttggtagctctatttacttgtatcggctgagattcgctttaaggtttatgccagtatcggctaaatcgctttaccagactagattagctaagatatccactaccctgaaaatcagtcaagggcttgattgtctagatattatgtttcttttcatacttagtgctgcatcagttaagtttgatctactaagtcgtgcttagaaccataatctctagtcttcttcttggttgccaataagggtttcatcagggtttcagccggtaagttatcaggacgttgcatcggtttataaggataacatgcaagttggatttagccaatggcaacaaaggtttcactgtttatctaatcatttagattttatgacatcggatctccagccgatgtatgctttaaccatcggattagtgtttattctattatattgttagccgattggtttctactagattattctattgttatcatcagcggattgtcttcatatcattatttacatcgtgtcagactctacattaaacatttagccaatagctcaaatcct

SEQ ID NO: 21800 - DNA, 1501 bp, Oryza sativa
gacattatacaccaggccgtcatttgagcaattacagtctgcatgcaagttgtaggctaaaaggaaacatacattgcatgaaaatttgtaggaaccttggtcaattgccggtgctagtaaaaaaacatcaacaaaaaatatcaattcattttttttgaaactcaaatattgctttctccattttaatttgcaggtattagagcaagtttaatagtatagcctactactagctccaattcatctatagccaatctaatagccaattcatacaatggctgcttactatactattaatatatggtctcacctgtcatacacacattgtgttttgtagtctgtgctgcagctaactatagatctgtagcccgatgttcttctctctcatcgtttatctcattaaaatatatttatagctgactaatagcctgagtctgctattgtacctgctcttaacacatcaacaaaaacgtgtgaacaaattggtacaatctacaaatcagagtacgtcccaaccagcctcaaaccctcaaacaatggatccatttatgtatcaagaacattttttctaagaatatgtggcggaaaaccaagctaaaaatttcaaaattctcaaaaatgaattcgcttatgcacgttaagagaggcaatattaacaaactgtgaatattaacaaactgtcacattaatcacaatataacacctaactttgtttgtaagctatagaattaacaaccaacaaagagtatgctactaacgacttagtttgaaaaaatacacggctaaactgtatccacctttcctttcaaaaaaaaaaaactgtattcacttgaggcgagtccttttatcccatttcccaacttccacgtctcattttctgcgcacacgtttcctaaactattaaacgtgtgttttttttaaaaaatatatatatacgcagaaaggttgcttgaaaaaatatattaatctattttttaagtttattaagctagtagttataaccatgtgctaatgagtcactctgcatgcgcaaggattagttcccaaactgttttgctgaacacagcatattcctctacatgatactccattcattttctatataaattattttgacttttttttctgatcaaattctttttaagtttgatcagatttattaaaaaaattaccaacatctacaacaccaaattttatatatttttctttgtgttgaaaatgtagttatgtttttctataaatttgatcgaacttaaaaacaatgagttgaaaaaaatcaaatacgaaggggtattctacaagaaatgtagaaatatcatagaatcctttgacagatcacaggagggagtagcttaggtcgactggaaaataaaactttatcttgatattttgaaacgaaagaaaaactaattttataaaaaaaaagaatgtagaaacatcttgttatttccacgaaacacagggtgttcgctgcatgtttgccctccccctctaaaaccccagc

SEQ ID NO: 21801 - DNA, 1501 bp, Oryza sativa
aatctggggtaggttctcatgtttcgcctatgcggccgcaagatgtcgttgtggcgaacaccctcctggcgatatccaacacagcagtgaaaccggagatgaccgccaggaggaagaaaaagaaagagaaggttgtgcaagtcgcccgcggcttttcgaaaagcgaagagtccgacgggactcctacttcgccggttttgcggcgcgcaccttctcgtagcaggcgcatgtctccgccacctgctagcgatgctgaagcggcgacgggtgggagtgcttcggcgccggccgctaaggcgattgtttccgaggacgaacgggttgaggcggttccttcgcctgtccgtcaacgagagggaaaagctccggcagtcgaaccgaccgcttcggacatgacgctcaccgcccacacttcgtccccactaatttcgccacgcggccagagatcactccgtttgtggacggtgtgtgccaggtcattgcaccgaccgacggccttgggctcttcaccgagctaaacgagttcggcgaaagctgcgcggccgtggaaagcctatttgtgcgggtatgagttttctgcgcgccgaattttgtcctttcgtaatgttttttgtttctccttgtctagggccttgccgcgcacttaagcatgaagaaatctgccttagagaggctagatgggtaccgcctccgccttcggaagtccgaagaagaccttcgccacaaggaagacgaaagacgcattgtggcggagactctaaagaaggcgaatgctgaaaacaaggctctttcgggggacaacaagtctctccatgctgaccttgaagcggcgaacaagcgggatgccgaacgagaccgacaacttgcttcggccgaggagaagattaaatccctcgaagctcgccttgtgtcggccgaagctgccgccgcgacactggtaccggccacagagtctgccaagcaggcctgttacactctccggctgacccttaatgaccttggggcgcgggcggaaggtgctccgggcgaaggtggaaccgcgttcgacttttccgaatggacgcaggaagcggccggctcggtcatcgaagtggcaggcgcctacggggactgctgcgctcgtgtttcgacgggattcgtccttagccttttgcacgcgcacggcagcgaccacatcgggagttttcccctatttcgtgaaagaagaatggcctagcaacacgcagtgttctggggctaccttaagggcctttcgaagagggttttgggaggatggtggtcgagattgtgcgaagactcgactccgcgagaaccttgaaaggatcgcgagggacgaggaagccgccgctgccaacaccgaaagggatcccgggccatcggaacgggccaccgggcacgagggcgaaggcgatggaggccaagaccaccctgaggtgtgaggcccttcgccctcgtgtgctttattttttttcttcctttggtcctttcgggctttctggta

SEQ ID NO: 21802 - DNA, 820 bp, Oryza sativa
cataaatatatttatgtctataaacagtgagcttgctatgcttatggatgattcatgttgaggatacaatgtaccgatgttaagcaccgtccctttttgtttaaggcagtgcctcgtattcatgtaatgagggagaaatgtgtaatacagacaagttccatgaggattcgtttgaaagatgcggatatgtgatcatgtgtataattgtttactgacaaaggagacctagggtctcgtgtcagaggaactatattctaacctcgagttaataaccaacctgtggatggaaaagaaaaacaattaaactgtgttgggttaaaaagccaacgagacagtagttgaggataggagtttggatacgccttttacagatcaagataaggattgttggaggaaacccctaagggtacccgccatgcctctacattgataagatcggatatacctgccaacagataaggagatccaggagacatcaatatttgagaacataatagtcgatggttggtaattagtttatctggtatcagaaaaaggtcaaaggtgatgtggcagaagaacaatttggatgctccccatctcgaggaagcactaaagatgaccatcggcaattaaaccctagtggtatagatacagatagcaggcaatgtatttccctgaaggtagtcagtgcagcttttgacgaaccacatcaaggtttcactgaaaggcagcaagccaaaggacctcatcatccccagaagcgttcgcaatccacattaaagaataccacctgttagagataagccgaaagaagattgataaaagagattggcaaaga

SEQ ID NO: 21803 - DNA, 1501 bp, Oryza sativa
gaagttatagatcttgatgagttatacaaccttgttattgatgactttttcagttgaaatcatttactacttcaaaatattatttgaagttttgaaattcaaatttttaattgataaaacaaagtcacaagaaaaaatagccaaaataataccagtaagaacacaataacatgatagagcatgattttagaaacatttaggaaaaaaatcatccaatttggagttaatatgggtgagatacactagttttaaatttttcaaattttattttcgcatacggcttcttaagtggcccgcatggaaaaatttttccatgcaggcgcttaagtgagccgcatgcaaaaatgagctcatttttacatgcggccctcttaagaggcccgtatgggaaaatcgatttttccatacgggtcacttaagcagccgtatgggaaaatgaccctcgatttttgcagacgccactagttacggtccacatggaaaaatgatggggcctcgtacagaaaaatcacttttgtagtagtgtcactcgcagccagaggaagcccttcacctgatgagcttgttgcaagatagcgccagaaatgacaagcttttagatatgattgaccacaggatggatgacatgcagcttcattcttaagatgtaatgcacatgatgcatctcgcaatgtggtgccttcagcttcatagcaacagaaggccttcgatgtcaactgtacgttctgaaggttctggaggatgaagccagtcaagccactgtgcaggaagatctcgatttcaattttgttgttaccagttcatcaatcttcaacgaaggaatcatgggtgaatcaaatctccctttcagcatcattactgtctggaccacgctgaaccatagcagtgtgtctatgtgtgctgatgtatttgactgggtagatactgctttccttatcatggtcttccgtccgtatcagtgcctgacaaaacttacctatctactgtaaaattaaaggtgtttttgattattattctgtgatgaataattgggcattggagattattggttttgttaattggaatttattcacgaagtggttttggagatgattggatttacaggtgaattacaggtgctgtcattttatgtgaccggtcagaccgggctctggtagccggtcagaccggcgtgtaatgcgcggtcagaccggcgcagcccgcggtctgaccggccgacgctgtgtcggtttcggtttcgggttgtttatttggatatccgtgattatttcatgattatgacttctagatggatactatacatatgtaatactgttgtttgctactaatgagtcaagttggagataacttggtctcggaatatggtttctttgtttatttcatgtgtaggtaactcgatgcctcgggagagtatttgcggtgatggaccgggagtcggcttggggataagacgacgtctgtggtggtcagagatcatgcgggatacttaggctagagttga

SEQ ID NO: 21804 - DNA, 1501 bp, Oryza sativa
acacaatgtttttttcttggcaccggccatcaggcagagagcagagtttggaagataatgcacgagacaatatgttgggggaacactactagcaccacaaagtaaactgatatgcgtataaatcaaatactcctacaaggtaagccgcgcagcaggcaaaattgcttgcaaaatcaaagaattttttatgatgtaatggtctcagccaaaccattcacttcccccttaattccattctccggtttccgaagagtatatctccaccccaacaacataatcacaatcatccatcacaaactcaaagacatggaaatgcgaggggaacaccactattagcaagaagatagaggggaactgtttcaaaggtgcttactcaaagtgacaaattttaagttccaaagtggcaaagtctcgatccatgtcaactactccaaaaaaaatggtcttacttcactatagtatatcatgtacttccatgtcattgtttcatgtgcatcaaatttactaattactagtattgtcaaaagctcgcagaagtagaaatatgatgaggaaagcaaaaaaatataggcattcattgaaatgtaggtgctgtttggattgagaaatgagataagtgtcacgactggaaataacccaacgggcgttccttacgtgcgtgcattattccttgtcccaggaggcaaggtacaccaaaagttgatacaatttagagtttaacaagcggaagcgtaattaatttattacatgggcggcgaagacccagcacacaagaagacaaacgaaaaacagcggaagactagggcgacgactacaggcgcttgacggcaggcacgagctagacaccaaagccttcatcatccaggggctcctcttctgggtttgggaaaaattgagcaagactgagtacaaccaccgtactcaacaagacacacccacaagtgcagaataaatgcaagggagtacaagggagccataatatagggggttagggtttgcagtaaacagcattaaaagtcacttagttgctcaaagctactttgtaaacacggtcctagagctatacaatattattaaccaaggccgtgaacccacacgaacctgccttaacccaaggcctacgatgattcagaccgaactggcaatccgaccctgggtcccagctcgtcccaagccaaccgaggccaaccattccacattttagctgttaggcaggttttaagagttaaaacactaacttgggtatattgctcggcttgcccataaccgagggcgcgactatttaaaaagggtttattgcgtcagccgaggggagggggcgcgcggaccgggtccatgggagtggggcccacgcggcagcctcacggtccacggtggaccgggcgcacccgggctcgcaccggtcggcgcccggggccccacgttgtagccgcacccgagggcgcgggcggctgactggcgggccccacgcggcggttactctgggcgcccgaatgcgggc

SEQ ID NO: 21805 - DNA, 446 bp, Oryza sativa
actactcaaaggataggttaaagcttgggtttctctcaaggtagcactatgataggtcactttagcaccgagacatacacaaacacctcgacgttacatccctcttaatagtacggcattcctaaactcaaatgtaaataggaagagaattataccaataggaatgccttctttccatctttccctcttaatagtacacaaatgccgaaaccgtttcacatatattcttcaaatgattgatgcggttacttgtagcttcaaatggcctcgcacggtccatcatgacaaagctgtcactcgcccttcaccaccggatttggttctttggcgcaaagcatcttgcttgcccatcactgccgcatggtctatcatgaccgagcaccgcttgcccttcaccgtcttgccatagtagccacttcgtatcccacatcttcaacattttcaat

SEQ ID NO: 21806 - DNA, 708 bp, Oryza sativa
caccttaggaaaccttatagtacaataaagaaactttacataaccaatcgtatcaaatttggactccttccaaattagactccgcatcccatacgcacacaatacctccatcgtatgccatatggaatctccatcaaccacgtgcatcaactctagcctaagtatcccgcatgatctctgaccaccacagacgtcgtcttatccccaagccgactcccggtccatcaccgcaaatactctcccgaggcatcgagttacctacacatgaaataaacaaagaaaccatattccgagaccaagttatctccaacttgactcattagtagcaaacaacagtattacatatgtatagtatccatctagaagtcataatcatgaaataatcacggatatccaaataaacaacccgaaaccgaaaccgacacagcgtcggccggtcagaccgcgggctgcgccggtctgaccgcgcattacacgccggtctgaccggctaccagagcccggtctgaccggtcacataaaatgacagcacctgtaattcacctgtaaatccaatcatctccaaaaccacttcgtgaataaattccaattaacaaaaccaataatctccaatgcccaattattcatcacagaataataatcaaaaacacctttaattttacagtagataggtaagttttgtcaggcactgatacggacggaagacca

SEQ ID NO: 21807 - DNA, 1501 bp, Oryza sativa
acagatctttctttgaggtgtggtgagttgcgcaatttccaagcatgaatcaatggtggatgaatgctacatatccctttgaagttcttttagtattttctgcaatgccatcagagggatgaagcatggaagcaccactctgtaaatattgctgttaaattgttgaggccatttgcttgttgttccttacgatagtgattttaatttacatttacatggttttctttgtgtttctatgtctttattctatttcacaatcattctccatgcaggttgtgatgcgaaaactactgaatacaaattctttaagaaattgtgggagcagtcaggctgtagacctcattctttctccaaacaaaacgaagaaaaacagatgggtttgtaactctgtatacatttccatagggtgtactatactcctgttctctttggcgctcttactaaatgacttgaaacagatcattcatatgtatcttatgtgatttttctgtgccttgtagaatcgcataatgtaatgccaggcagaaagctccctgcccagaagagcactttctcttctgaggagacccccgctacaccttgtaagaatgaagaaatctaccatgagcaagtcaatgcgaaagcttcccattctggttgaattcgttttctctgatctcctttagccatgaatgatgcagttttagactcttctaactattaattgtcttctctgcagaacatggcaataatgatacacctcagttgaacccacatgattacttgactgttcatgttcacacacccataactcaggtttcgtttgaagccgtaggaatttcaagaaacactggtgagacattttcatctttcaataagaaatacatagcatagtgactgactactatactgctgttgccggaaattgtcactatgatatatagacatttcctgtgtatggatgttaacttgttttagaaatgcactattttgtagggttatcattccatcataaataatggcgcccatggtagttgaggtttttcttatatacatatactctttgaatgaaaataacagaaattactatcaggcaaggcagtaatcctaggctctttgtattatttatgtttgttttcctcatgctgcctacgacacatcttttctgaagtgtgttggttgctgatatttggtctgcaaccgttggctgatacaagaacatgttactgattcaccatgcataaattagtattgcgagatacatatgattagaagtgttctcacagcaatttacgtctgctatatttatctaatgtgctaagctcatattcttttcacttttgatgatagacatagaaccttggagtggacggatcttttcagaaaagagaggaaaattattaaagctagctgcaaaaactatgtcaatggaaagttctgagtttttgcagagaaggttgacattacatattgaagaactcctttactttatattttcatgttgtccgataatggttggcct

SEQ ID NO: 21808 - DNA, 164 bp, Oryza sativa
cctcttgaagtttttagtgggggaagcagtagaggaacataacagaagtaactctgaatgattctacacaagtacaccgagcatgattaattgccaatttaccatatttgctgaaatgtacgcgtcgcacatcacattctttcccccccttttgttgttgtagc

SEQ ID NO: 21809 - DNA, 1501 bp, Oryza sativa
ggttgattatgacttatttctaactttcacaaaataaaatttcctaaaaatatagctatgttgtgatgattgttcgatctatgcgtggccttttaggttgaaccaatatatatcttcctttcaagagatgtaagtggtatgcaatatttctatctatctaagaatgtatgcaatatttttgtacacttaagattttagattttagaacaatacagtgcatttacatccatgcaaaacacatacccctccataaaaaaaaaccaatcctaatctggacaaacatgttgggatgaatgtgttttttttaacagagtagtatactagcatgacatgaattgtacgcatttattgctatacaacagttacagctgacaggtagacctcacacatcataaacccacatgccagctgctgttagcttgttactgctatgcactgtgcagtaatggaaaaggatatggatccatactacagtaggatactacacaatactgctatataggtggtgtttagatttaggggtgtaaagttttggcatgtcacattgggtattatatagggtgtttggtaagggtgggcagaaaaggaccgaaccgaaaagaccgagaccgagaaattcggtcatcaagtcgatcctaggcagtgaaagaccgaattttgttcggtgaatttagttagtctcctcggttaaccgaatagatcgaaaagatcgatttatcaaaaaagtgtaaatgcaacttacaatccactatattaaataggattaaactataatttttacatccctacttcttctaggcatgcaacctaataacagtcttaactcataagtgcttataatttttttttgtgatttttgtgttaaaaattttcattatttctttgcatgtatgaaaatattgttgaatttcggtcaggaccgagaccgagaccgagaccgaatttttcggtcctgacatttttgcgttgaaattcggtcttcacttttcaaagaccgaagaccgagaccgaaattttcagtcagaccgaatgcccacccctagtgttcgggcactaataaaaaactaattaaagtatctatgagcaaaccacaagacgaatttattaagcctaattaatttgtcattagcacatgtttaccgtagcaccacattggagcatttaggcttaaaatattcgtctcgcaaagtagtcgcaatctgtacaattagttatttttttagactatatttaatattttatgcaggtgtttaaacattcgatgtcacatggcttaaaattttaggatgagatacaagatacacatatggccccagctcaggtgcccattgggacaagccctggcctaggacagttgacctgtcttaagagtgtcgtactcgtgcgttgccatatgtgcagttgacttgcgccgaaacgtgcgcatggcctaccatgcattcaagtcggtcaagttgtagcctgtaggcctccgtcaagttgtagcctgtaggccttcgcc

SEQ ID NO: 21810 - DNA, 1501 bp, Oryza sativa
cactacctcgccacgactccaaaagagttggcggcggaacaaaagggcctaacacacggacggctgctgaagactgcctcctctactcctcgtctgcctggctgcctcctgtagtcggctcctcagtcgaagaaacgtcgatcggctgacgcgaagggaccggcggaacctgtcgagggccgacagcagcacgggccgctggcggtgtgggagctgggtagtcgaaacggaacacggtggaagaaccaacaacacgcttccgcgcagtgcggataaagcgtgggccacggtgggaggaagcaactggggtgtgtccaggggtgtaggaggggctaactgggtgagggtagggggagtacactggtgagtacggcgcacgcgagctgggggagcgcaggccactgggagtgcgagcagagccgcgggagctgtgggaggacaggtggctggcgtggtagaggcgacctgagtcccaagagacagtgtcaactgaggtgacaccctcctcggccagacgggcctccagagcggcgtagcggcgggcaagggagcggtaagcctcaaggagtaggtcgtgctgagtggcctgagcctccgaaagctcaaccatgcgagtcagcactggctgaaactcactgtaaggacaagggtacctggcgtttgcgtggccagaaggaaggcgtggaagctgccggaaggcagagcccccgagacggtggctgtagtcgtaggccaagcgacgaagcgcagtccaggagaggtcctggcacgcgatctggagagtgggcctggccacagtgaagtggtgtgggcgaaggccagctccgtgtatacctccacgagggtaaaggtacacagagagctcacagcgagggggaacacggtccacggagtaccccgtgtactcgggacacgagaagccaaggaagcgggcgaggtctcgaagctgagcgacatggtgaccctcaccaaaaccgtgggaactgaagctggcgttcactgccatctacaattttgaaagagggagaaaagatcagtaaccattttagaaacaaactattgaaaataaggaaaccaaaaaaagccttagcttttcgcaagtagttttgaacttagtacccttagggtcgtcctaaacgtcgggtttcgccctaggggcaagcctgtgctctgataccatctcttgtcacgcccctaactagtcccgaccggaactagcccgtgacgctccaaattaacctgttaatctataccagtcctaggaaacagtgctggtatcacaggaagacagaatatcacagcaacagaggtctctttattatagagtagaggtacagtcatgttgggctgcggacagatcccgagctcacaactgcatttcaaaagggaagcggaagccaagactcggaccaaacaacacaggcgcgacttgggaactaggccgaaaccctaaaactcatcgtagcgggatccgcttcatcttcttcagcaactggggggg

SEQ ID NO: 21811 - DNA, 1501 bp, Oryza sativa
ccatattgtacttctcttccaacacatggacactcagctcaacaataggatttaacaagcatgttctcattttaattttgtttggtaaatcggccaagttaaaaaaaagggtaagttgaagtacctattggacctactgttgcagttaggggtgataatgggcctaatattattttctacgaaatttgagggttagatttgaagtggagtggactgaatttctatatattttctttactcaaaaatatattgagattgagttcttttcttctctttttcaactcacctctctcgttttccacgtgcacacttttcaaactactaaacggtgtattttttaaaaaaaaatatacgaaagttattttaaaaaattatattaattcattttcaagttattcttatctaatacttaattaatgatacattaataaaccaccacgtttttcatgcagggaggtccacctcacgaacacagcctgagtaggattgtgaaaggacccattacaaccctgtagtacatgccacaccgtttgacacctatttaccggaaacaacacatttgtagtgatatggatctaattaaccttaccatatttagtttcaaagtgcaaaccttaaaaattagagttatttaagtttcaaaattcatacccttaaataaaagtgattttaaggccttaaggaggaggcacctcatcttaattgtattatttatttattttgtaggagcactgctacacgtactaaatttcttactaaatttgtgtagtatatatttatacatcaacactagattagagaaataccgagagatgcaatactctgttcgtactaaaaagtgtggtaccccggtccatcctaccgtaagaaaaatttgtaactactatcacatatatacttggttgattgagtttttgagtgtgattaaaaggaatcattttgcaaattgtagcgatctggccctccaggagaaatagctgcctagctacaaagtaggaaacatggttggttttgtccttgtcgtggctactccaagcaacaccaaaaaaaacgcatgcagctaagctaggcagaggcagcgctttcggcaggaaatcctacggtaagtcggtaatccatcatcatatcagcggagacaaagtgcggaaaaaaggtttatcaaaattacccgcgacaccgatcgaatcaccgcgggggcatttccggcaaccccgtgctcctccgaaagcagtagtggcagtgggatgcccctgacagcgacatggcctgggccgtggtgatgagtgatgacccggagaatgagagaggcgactgtgcggatatatatgcagcgatagctcactcggttgttgcatcgatcgcttcatcactcgctagctcatcactgcgagcggagacagctcaggagggaggaagcaaaagaagagagagagagatcaagagatagacgaagagatttgtctgtgtaaatcaatggaagggcagcagttcgcttggggaa

SEQ ID NO: 21812 - DNA, 373 bp, Oryza sativa
tttttacatggatatcatacggtggatggtcaaagaatctaagccttttttccctgacaaaaattgtgactgatagataggaactgatccacctaaggttgcacctctccatccatgcactgcaactgatatgactggttggcattatctgtcttttgtttctgcttcacctgattcattgatgaggtttatgctccatatctaaaagctaatctcgagccaatggtatgtaaacatcaggggataaaattacactgttcgtaatcaggacaccagggcgggacaagaagggttacttcactgaagaatttgtcccgtatatggcacaatatcggaacgataactaattactctgtttgccttcgttttcagt

SEQ ID NO: 21813 - DNA, 1501 bp, Oryza sativa
aaaaaaaaaaatgtaaatcattaattctactagagaatgccccgcgatgctgcgggattaacaaattgattaacatgacaggaggtacaatctcaagaagaaatagagaaatagaagacaatcttaagaagaaatagaagaaataaataacaattagcttttttggagaaattttttttaacagccctatctagaatttggagataatttaggtagcatactatttttatatagattgatgggctgaataaatgtgtgatgtgtgtggagatgggcaaatgtgttcatgtgggctatatttggcattgaggagacgttcatataggctatatttggcactgagaagacgaagagactcacctggttgggctcaatcctacattccatctaacctctgaaaagcacgaggtttaagcttttggaagaagggattcgtcagtcggtaggaaaagtactaaaattgtctgggccgctgtgggcctcatgcctggctctctttaccgggcctcggcctctatatgggcctaacaggtagacatgtttgctcatctcattcgtcgcgacccctcgcctctgtatatgggcctaacaggtagacacgttcgctcatctcattcgtcgcggcccctcgcctctgaatatgggcctaataggtactccgtaggcacgttcgctcatctgatctcgccggttctctgtaaagtcaaatgctgtgcctaaagaaaagaaaaaccaggcacggcgactatctgttttgccgtttgtttgaagtttgaacagctaataaactactactccctccgtcctaatataaaggattttaagtttttgtttgtactatttgaccactcgttttattcaaaaatttttttgtaaatataaaaataaaaaattatgcttgaagtactttggataataaagtaagtcaaaaaaaataaataataattttaaatttttttgaataagacgagtggttaaacaatacaaataaaaacttaaaatctcttttattatgggatggaagaagtactacgtagtactcacctttcttcgccgtataatcgaaaaactaaaatactagtatcgcctttcgccgtatatttcgcctcacatttgaacgactaaaaaccagttttggcatcctggtttcgtagctgcgtcagtgctggcgcctgccattcctcaaggcaagccccttcaacaaagcaacgattcttccaaatatccaattcaaagttggtcttttttgaaagaacccaaataggcaaacacggtactggccataaaagatcccccttgcgttcgaaatcgtggctagcttgacgtgcttgcgttcgactctgccgcggaaacgcagataaaaataagtaaataaatcacccagcctccttctgcccggccataaaacggaggtcgggcatcatggggatggcacagtcgtcttcgtcttcctcgcgcccctccgactccgagcagctagaggagcccagcaagccggtca

SEQ ID NO: 21814 - DNA, 897 bp, Oryza sativa
tccctcctaaggctgtgttcgctagagcctattcccaaccagaacagtgcacacagaaaacggaacggtctattaacgcgtgattaattaagtattagctattttttttttcaaaaatagattaatataattttttaagcaactttcatatggaaacattttgaaaaaacgcactatttaactgtttgaaaagcgtgcgcgcagaaaacgaggaagatgagtattccctctggtttcattttaattgacgttttggacaatgacacggtctacaagatacatttttgaccttatttttctattataatatatataataaataaatgcatgtttacttttattatagtattttaaaagacaaatctatatatgttgttctagttcctttaaactaaatatttttaaaagttattgatagtctaagttataaaagtttgacctcaaccttattcaaaacgttaattaatatgaacggagggagtaggtaactaggctggctgtgtccctagcacgcaaaacaagcagtgtttagcgcatgcttaatcaagtactctagctaaaacaaattttaaaaataaattaatgtgattttttagagtaatattcctataaaaaaacttttgtaaaaaatacatcatttattagtttaaaaaatatacgcgtgaaaaacgagaaaggtgagttgagaaagtgaagataataagaactcagtctaaaactccctcaaaactaactggccgcggctgtaagaaaaaagaaaggaaaaattactacacctagtccgaccccgaccgcgtctcgtcggttccccgccacaagcccacaaatattatgcgagagagagagcacccgttaccgcctccctcacctcacgctgacgatcgccaccgcctcccc

SEQ ID NO: 21815 - DNA, 1501 bp, Oryza sativa
agcatttgcaacttcaatcaggtacggaaagacacctcatggcttcttggcctgtcttttttttttctcatgaagactcttgaattctctgcctccacagatcatggtgggtgcatggcaggagcatcttcatggttcttgagatcgggagcagcataagcagtatgaggatggagaagaatggctgtgctgttccttctcctcctccttctcaagaactcttcagtttgtccatgcctttcatggcataattccctggattccagaatctctgggtggcttagggaggtatgaacaaaccggcaagtcataaatcggcaatagtgagctccgactggatcttactcctcagtttatcaaatttagtttcattcccttgtaaccttattccagttgtttcaactttctattgttcccccttacaaaggtcattgcaattgtatcttgtggaagcagataagaagttgtctcggtgtaatcttgttttgtggagtcaaatgtttgcttgtgtgttgcttgggaatattttatccgagatgctcatatttaccttgaaagatagcattattgttatatcttcttttacatcaagttatttcctttcgttcgaaaaaaaaatgcataaagttatttgcacgaagagacaggattatgtgaggtcggtgttggaagtacttaaggctctgtagcttcagtcataaatttttttgcttctgatagaaagaatgggaagagcatgtatgtgttgaatacttgaatctacgaacgtctaagcatgtactgagactgaagcactgtaattgcatcttggttattcttgcaagctgatgctgccaaagtgcttcccgcatactgcaggctagtactagagcacagatttccggcagatgtccagaaaagcttccttggacatgaacatacagccaaaagaagtgcttgtaatgctggagacagatgctttactcagtacttttcttgggagcttttaagtgtccaggaaagatagcatccttgattgatcttgttcgacatatcaacgctgccatctttcacatatcaacgctgccatctttcttgttgttcgatttgcaatgaagaggcaggattgtgtgggtgggtattgcaaagtaagaatacgtgccattctgtttatcaatagctcggtcacaaatatgtgttgtttttctgatgaaaataataatagaacacatgtaattaatctacaaacatctaagcatatatgtattgaaaatcgctgtctctgaataccgaagcactgcaggtggtaccttgatccatcatacgtcctagtcattcttgcaagctgaaactgccaaagtacttactgtatactgctagagatagtactccttcgtttttttaatatatatcatcgttgactttttaaaatacatttgatcattcgtcttattaaaaaatatagtaattattatttattttattatgacttgatttatctttaaatgttctttaagcatga

SEQ ID NO: 21816 - DNA, 749 bp, Oryza sativa
gagttttaaggtcccatacctgatgaatagagttttatggtcaaatactagtactaacataatactccttagtagccaacacagaagcacaagtttgcacaagttttgcagcattaccatactttgatggtcttgtcaagtgagccagagtaaagccttgttactgagacaccgagcgaaatcacttggcgctcatggccactgaggattgccactggtccagagtcacccttcttgtcaggaattttccaagccatgatgcgaccatctccggtaccagcaaacaacatctcatccttgatagtcatggaacaaaccagaccagaaggttcacggagactggacttcatccctgtttgtgtgttccatgcctacaattcattgtagggatcaatatcaacagttcaatgcacaatagtaacatcgcaatatgtaacacaaaatggactactcccacaaaaaaaaatcaacgaaattaaaatattacctccacggacttcgtgattccaacaaatatccatgggccatgggtaatcatgcaaccaatcttgcctcccatcttgatggcatcaacgcactatgacagaaacattaagaaaacaatgcaatgtaataaatattagaatttttttatcagccagacacctatcttttcctccttgttcagtcttctctttccaagaaaatataatcatcaatcatctcacatctttttttttcttttttttttactttctctttcttttttt

SEQ ID NO: 21817 - DNA, 230 bp, Oryza sativa
ctcgtcagatgtctccagtggtgaggcgcactacacaacccttcctaaggaaccggtctgaaaagttgagccgcacgttcttgctatggagcttgaaggtctcacggtcgtacgccatggcagcgtcctcggcggtgttgaaggtgtcgcgtgtggtaaagcttctgcggtggtggcaggaccgggagcagctttgtcgctctaacggtggcggcacatgaaggggaaaa

SEQ ID NO: 21818 - DNA, 254 bp, Oryza sativa
gggggttttgttgatggtcgttatcgatcagtttcgaccgtcaatattaccaaaatagaggagaactagtgatgcttgcaatgcataaatatgttagaataataatattccactagtattaggtatactaaccttttgcagagattgacaataaagtgaaggagaatcgacatcaacagaaacgataaatcaatcggacgatgtcgagaaccagacttatgtatgaataggccaagaactaaaaattgatacga

SEQ ID NO: 21819 - DNA, 243 bp, Oryza sativa
aatcacaaataaaataaataataattctaattttttttaaataaaatgaatggctaaacagaacaagcaaaaagtcaaaataacttatatattatgggacggatggagtataacgacaaaggagacacactttgccgcagctaccagttggctggctgatgagaagaggtcggtttggctttggtaaagtaaacaatcgcagtagattagacactcctgcctgaccaatcgtcgtgtgacaga

SEQ ID NO: 21820 - DNA, 337 bp, Oryza sativa
aacattatgcttcttcatcctctgtttatgggatcatcaagagcatgttgagttaggaagtcactgctccccatcttagctctagcagagaagtgctcaacattgtggtgcgctatcataacgattgtagtttattatatagggacaacagaggcacgccctaagtggaaaaataagtgaaactagcggataagatcacttgattatttgtgtgatcgattagggataaaagttacaaaaccagaaggttaatttggtgcaattttcgtatcttaacaacttaatttgcttgatggcccgcttaagcgggccaccagtgataatggaacttcgcagg

SEQ ID NO: 21821 - DNA, 444 bp, Oryza sativa
aatccttcccctctcaagtaagagaagctttgaaaaagatgtcttaggtggagtcctggcttatacaccagttgagcgcctgtaaagatggagccgtaggcccgctagtccgctgctgttatttttgattgtcaggccttaagtgcctttgtaataatgtaaatattatcgatataataaagatgtgcctttcgtatcatgtttgtgtggtgtaccccggcttttcctgggccggggattaatacactagcgttcgggaaaaggaaattttcccggtcgcgacaagctggtatcagagccatctcgactgtaggataagccaagtggataaaacctaaggacatattttataaataaaactatttgcgaaagttcctttctccttcccctaatgctatttgcaaaaggtttactcccttcttccttgttcggatttcaactagt

SEQ ID NO: 21822 - DNA, 321 bp, Oryza sativa
ccttaggaagggttgtgtagtgcgcctcaccactggagacatctgacgaggcaatcgcgcaacaacagtgagaacagcggggcacgacaggagtgtccatggaaaaacaaccacagcctccagctccattctctcattaagaacgctgacacaaccacaccatactcgaacaaaatgcttcacatgccggtgtggcatctagcagcgtgtggattgactctgacgtgtgggccctggatagatggggagatgtggaagtccacttacatttgtgccccacgttttaaattttaatttttttttcttttttactaactaaga

SEQ ID NO: 21823 - DNA, 1501 bp, Oryza sativa
ttgtgtggttaagtttgctgcattttgattttcttgattctttcgtttttcagagcgtagcgttttttagttcatctgttgctaagttaagacctttcaagtctggtcaaaggaaaaagctcagaaaatggtagatatcatagaactccaagttgttagttcgttgtttcactttcaatgagaatgtcattgttcatgtaaaattattcatatcttttgaatatggcttcctgatggcaagcagtgcatgtaattcagaaggtgaaatttcgtccccagtgttgctgtttggatcgtagaatagttctctccttccaaagctttgctccagtttgttcggaattatcgtactttgcaagagactgttcttttactcaatgtccacatcactctgctcagaccatgtttcaggctatggctgcagatgtagaatgaaacattttgtactagtaggtatattagctgtccaaaaattcctcgaaatttgcacatagttttgcagaaaatctaacgagttaaagctctgaatcctaaaatatcccccaaaaaacatcctctgaattctgaagagtgaaatatctgaatctgtagatgtaaagtcatatatgtagcagttatgcacgcagactagcagtctaccagttttaggtttagttgccaataaaacaaattttttgatgtactgattggtgcacttatctcctgatattttaagttttaccttttttcggcatctttgcaaggatcactcttttcctcactatatattgatgttatcattccattaatcatgttgcctttcataaatatcaatataactcttcatgtacaatctggtttttaatgtttggaggcatttactctgtgaaacagattccctgtttagattactcttttcccattatatattgatgttgccttctatctgaatgatccctgttatgcactacctagtttttttttttttttttagtttggttgatcaatcaatgcaataatattctgtagtgtaaagcacatgttcaagggaaaagggatactcgaatcaagaagcgggaagaagatgatgacaatattatgatattatgattcgtttcctttttcccgctttgcatcttttgggtactggtggtgggggacagaggaaacatgaatctatagctcaagttagaaggctatgtgacaaatttagtgcctctgttcaaaattgtgttattggtataatttggatttcactagtttattttgaagattgtgctttacttaatgttctttctactgtgagttatttctacttttgaaaattatctggaaacctgacctttcttgtttgttgttttgattagatctgaggactgaagactactgccagtttcagggaggatttctactcagtggaagcttgtgttgtagctggtcttttgatgaatctattggtctcaaatacattgtagaatagtatttgttggttcgttgaactcaatgggttctttgccgtcca

SEQ ID NO: 21824 - DNA, 662 bp, Oryza sativa
attaatttgacgtgcttatagtctctgctctcatgttcttaggcgacgactaataatgtactccctcgaatatttaacgttgttgactttttttaatatgtttgatggttcatcttattgaaacacttttatgaaatatataaaactatatatatacataaaagtatatttaacaatgaattaaatgataggaaaataattaataattatttaaatttttttaataaaataaacaatcaaacatgtttaaaaaagttaacggtgtcaaatatttagtggcggagggagtattagcagtaaggtaataatgtgcctagctcatatacggccgcaagacaacacagctcgccgtgttgactactgtaaattacagtagtaataattactgtacctttttcttaaagataatctacagcaacccttttctgccatcaattaagtaaatcaattcaacatataaacttgtatgtctacaagatctttgaaactctgttgttttttttccgttgaatgcaaaaaccaactgtaaattcacagaagagtaaaatatcaaattgaaataagatgtacacagaattaattgcatccatctcgtcataaagaaaccaagcaaccagggaagaaacaagtgcaagttagcttaggtaaaagcagagaccagt

SEQ ID NO: 21825 - DNA, 211 bp, Oryza sativa
agaagcaggccaagttcgcctacaccacgcagcaggtcaagtcctgcatcctcctcggcctcacctccaaggccgccgccatcgagcaggccgccttgttcaagaaggccaacctcgcctgccactacacctagctacccatacctcgccgccggccggccatctctccggccatctctctctcttagctagttggtagctagtgtcgtca

SEQ ID NO: 21826 - DNA, 420 bp, Oryza sativa
cttttgtttgaaatcattttgaaatcactaagtgatttatttctttttaagtttgggtcaaaaagagacttgcgtctcaaatcgacttaagagatgcttttcaacagctcaattggaaatgtaccgacctcccgggtcagatcattacttctcagctccacaacagcatgtagcatgctaaataggagatggaaatgaacaaaaaaggaaaaaaaacaaaaaggaaagccactggaataatcttgcgcaatcgacggtgcgacacctccacaacagcagcagacaccgagtcggctcgccgaagagcagccttgtcgcctcgctaaatcgccgccgcgtcgccggagacgatgagaacgagacgacgaaatcgtcaacctctccttctataactctctctctctctccgtcggcaaaagg

SEQ ID NO: 21827 - DNA, 347 bp, Oryza sativa
ttactggagaacagatctttgctgggtcagcctaaaaccacattagtcccaatttcaataggattcgggattaaaaatcatttttttccggttaaagagccgcacgcacttttatggactaaagatcatttttagtctcggtttagaaatcgtccggccccttactatctttagtcccagttgttattaccaactggaactaaaattcaacgcatattatataatcccttgctcgtattttctcctcctcgcgcgcaaacacttcctcctccctttcctcctctctccactctctttttcctccctcttatccttttctttttctctattaacctctattttgcaga

SEQ ID NO: 21828 - DNA, 364 bp, Oryza sativa
cttttccctcatatcaaatgtctagacacatgtatggagcatcaaatgtggacaaaaagaaaaactaattgcacactccaactgtaaattgcgagacaaatcttttgagcctaattacgtcatgattagccataagtgctacgataacccacatgtgctaatgatggattaattaggctcaaaagatttgtctcgcaatttacaggcggaatctgtaatttgttttgttattagtctacgtttaatacttcaaatgtgtgtctgtatacgtcaaaaaaaaaactggcgatgaactaaacacggccttagaagattgagcttaaagaggtcatagctctttgttcacataagccaatctagtgat

SEQ ID NO: 21829 - DNA, 1501 bp, Oryza sativa
tttttttttccccgtgttggcaacttgggatgcccattgccactacgccgatccggagagcgactggtcgtggacttgtggtggcggctcgtggcgccggcctagcgctttttctgtagctttgcttttcttgtttgccactggcgatgtacgtggtggcctccgggctccggcagcaaatcagcgatgctgcaaaatgggtttagcgttaacagcgctgtcgtttgtttactgatctgttaccagcgctgtaattcagtaattcagcagaatggtaaacacaaccaagatttttgattgcagctctgaactatggccaggcaaaacaatcattttgacgaagggtgtttcctccagttcactggctgtatttcttccaccgagaggagtggatggttggtatcagtgacgacacaacaacatctcgatctcaaaaatctggaggcaggctggcagccagtagcaggagcttggagtgccgatgtcatcagtctcattcacaggacgcactaatcatatttattgctaccaatgaaatcatacaaaatgagttattagctagagtagtgctgcatacaggcttgaaagtcacccaaagctactactatcagcaataagttgttctgacagtggaagtccccatatatattcgcctttattctatgacattgacacaccacaaacacgttttggcaaaggtatttatctacagggaaggagtggcgattgctcctgcctccgtcagcagagggaccaagttccctcctttgtgcatcgccatggtatctgtttgaaagacatcaatgaagatcgacgttaaaatagtgtagaaaaactctggcctaagtgacccttgttctagcgattttcttgttcagaaaaaagttaaacagcgataaaaatgcatgaaaatgttgttggtccgatgacattagtatcacaagttcacgacaaattaagaacaaggaactcaccgtcacagccaccaatatgtttccctttaatgaagacacaaggaacagttctctgtccagtccaatcggcaagagctgactgcagctcagacccatcaccttcgtattatgaggatgaattagttcaatgataaattacaatgtatgaactaaagaatagccaggacattctaaaattgactcatgtaataatatatgatcttttttctacactgttttaacgtcgatctagtcctccctactgagtgttgatgtatcagagctataagtgggtccctgtagtttcttctctgttcggttgtttagttctcttttatgcactatttgtcagaattttgcaaatgcatttctctttttttttcttctctttaaataaccggccggtttctttcaaaagagtgaagtttacagccattttcagcatttcaatttgattaaactcattattgcaaccagttttgctctaaactcaactacaataaatccaatgatatctaaaatagatgcagcacggcggagtaatatgt

SEQ ID NO: 21830 - DNA, 1501 bp, Oryza sativa
cattttcggcgctctgctctctcctttgcgtcggattcaagtaaggcttgttgagttcggtgccccatatccctcaatctcgggtgcgattcgatcgggtttgcttcgaattcgtcgttcgattgaggtatgtgatttcttgtttcttcttggttctttcccctttctgttccctgttcttcgtagcaagtatgttgccgattggcctgcttgatttggtttcatggagaggttgcagtgtgggtttgtagtatcttggtttgctttgagtatttacaaggaaaaaaaatgaattaatacagagcagttggcgctgttccatttttgctgctagttactgggcatcatcatatattagttcatcaagcatggcatttcatgattgaatggttaaagagacctgcttgatggataattaattagggtgagtatctcatgtgcaattcaatatctaaagaagaagtctggccaagttcgagttccggtgtgcaagcaagcattgcacactgcacattgaccatgccgggagaatggacatggtttgcgagtcccattggattggatttcaaacgttcctttccatgcggactagtgcaccatttctgactatgttcctcaactcccccaccccgggcgtgtcctttatatattaacatatcaagattcatctcaacatagttgttaaaattgtaacgcctcctgcttcacagaatgtcaagcctcgaggagccacttggtcttggggacctgccaaagttgagtattaacagacttgaaaggttctctccaagtgcctgcagagcaagtgttgatgacagcaacaccaacaagtaagttctagtgttctactgttgcaaactttaccgtgctacatttcttcctttcctagttgttgctttgtcggtatttttactttgacgcggaatgtttttccagtatttccagaggtttaagcaaatcatgtacatttccacctttgcaacacttctatttttcttcaggaacttgttagtttactttagtgacagtagaattttattactgaagtatgccctgaaactcgtatgatatgaccatgtgaacttactttcagttacaagcatcgcaatggtggcaacaatcagacgatctttcacagcagtgctcattcatggcatatgcaaggccaatatactgattcatcctgcaatggggtggatatggagttcagagctcttccacggaaggtagtttgatcatgtgtaactgaaatggctcatgggtgattgggtgtattcaatttcatttccttgttataggtttcatcagaccacctcaaatagaaggaatgaactcacatgtagcattatgactgtggcaatgcaacatgtcagtcttctctatttacctttataactaaataagtgaaaatggccgctgatgaagtatagtgatcgtaatgtattaccacaagttactccttttctcaattgatgattaactggttttcaggttttatggg

SEQ ID NO: 21831 - DNA, 1501 bp, Oryza sativa
gaggaagagcggcctgagagttcaatgacaattgttgagttacgatagattcttttgcagttaaggatgcattttggtgcagaagcctgaacttgcagcttacctgaacaatggcaatgtgcagaagcaccccgcgaagtccgacggcgatggaggccgcagccatgacggcaggaccaacgaggaacctgacggccatggcatacgaagcaagggagttcccacaggcaatgatccgtggctgcaatgccatgaacaatcctgcaaaccagaacatagttcagtcattgcaatcagacatggaaccatgtaagattacagcaatgcagcatgtatcagagatgcacaaacaaacctaggctgaacatggccattccgagccctgcatctgaaaggatcgaaatcgaccgggcgatgatagccggcatctcaattccccacctgaattacatcacattgttcacaagattaacaacacatgcaacaaacagagatgactgatgatgaacatggcaatgtgaaaagtgtgagtaaaatgtttgcttaattgacctgtaggagacgagggaccagatgacaccgaggaggctggagtaagtgtttgggttcctgatcagcttcctccagaccatgatcagtatgagcctcgtcatcacgctcgccggcggcatcgctgccgccctcccctcgccgtcgtcctttggccggagctgcgccgtcgagttggaccccagcttcgacagtgtcggcccgtccttctcattcttgttcccgaagctgtactcatcataggcctgagcacctgtgcatccatcaaagaacattttcttttgtcaaatcagtagtttactgttaagattttgtcttaactgtacaattcaactctacttaacagtcaatgtcactgttaagatcagaaaagcttacatgaattaacaattcaagaaggtaagtttgtgaaaaagaatcacttcaagaatgtggtattaaatcagtatacgcagttgagttctccaaacaatcagcagaccagtgtgatctggaccgttgattatactgatcggatggtcaagagcacaagacaagagtgattaattgtgcagaagcaaacaacagtgtaatacacgcgggcaaaacaaaaagggaagtcaaagtgcacgaaaagatgataaaaaaggtgtcgtcacctttggcgtcgccgtggtcggcgccaccaccgccgaagacgtgcaccgcgccggcagcggcggcggcggcggcgcgctccgacaccggcgaggcgcttgagctccacacgaacatgtgcaggtccttcctcttccccaccaccggctgcggcgagtggcccccgccaccggcggcgcccttctcctcgtcgccgtgcttgccgttgccgacgatgttgaagaactcggcgtggttgaagctggagccccgcggcgtcgggttccgcgacgactgcagcgagtaaatctcgacgccggagaggttggagacgcgc

SEQ ID NO: 21832 - DNA, 1501 bp, Oryza sativa
tactcatatctgaagagcatcacaatattacctgcctataaaattttcttcactccatatcaatgaagaatccagggtttcatccaactaaccaagtagtaaaacaactgaaaatttaaaatataccatgtcaattcaaagttaaacaaatgcatgcataaataaagcataccaaaagcaagttcactatcactaggatgaacaaaaatatatctcaagttttttaccagataaattggggattctcaccttcctttcacatccaccaaattgtgaagctactcctgaagtggttataaaaatgaacacttccatcaaacagatttttctcaaggagtgtcacgcacatacctaggaataaaatcatttagcagtttgtagagaaccattggcttgtagtgctttacgctccttttgacgacgttctctctaaattggtcacaagattacacatcaacaaaacttcaaattgtatgcaatatatcaagatcatagtatagaaaggaaaaacatcataatagcacaaagatgctcctataagagcactcttcaattgtaaaaatttctggctagcgaatatggaatttcttcaccaaattgtctgtcgaaaggaagtgttagggatagttcgttcccgaaatcataaaattgaagaaagttgcagcacagacgcgaggcatttccacaaacagctggcgcgcatgctcgagacaagaaacaatcaacagatgcacggatcgaactgtggggaaaaggcttggccagggtgtagtagggcgacaggatcaaagcgtagccttgggagatcggaatggggggataaggtgggtgaagaagaaagagggaggcggcgtaccctgcgttcccagtaggggtggaagcagacgaagtcatagacgggggtgatggtgttgaggagcaccaggttgactcccgtgaacagcagcagccccgtcatcggccgcgcgtggtgcggcatcctcccctcctcctttcctctccgctcctctcctcccttcctcgccttctttcccgattggtcaaacaactaaacgcagaggctggatgggcgacctcgctggcgcgccgtccacctcctgtgctgctgctccttcgccggcgggtgtcgcgagttccgccgctggccggcgcgccggcgtgtgacagagtgtgcggcgtggaaggggatttctcctcctgacttgatggtgtacatgggcctcaaggaacatgcggcccaatataaagcccacgtacgtggctgaggccgaatacaaggcccacaattagacgtcgagcccacacccttggtgagcaagcccatcttagagcattattggctgggccggaagcaaaaactccgaacccgccacctcagcggcataaaacggaacatgagaaacacagtattgttttcaatggatgcactcatgtacaacaaaactgcattacggatttatatacgtactacgatgcattgcgtactcgaaaaaagagaaga

SEQ ID NO: 21833 - DNA, 1207 bp, Oryza sativa
agggagtcaaattgcactggttttaatagttaggagagttgtcttatctggttttccggttgatggatacgaattagattcaggctatttttaagagagtcaaagcggacttttccgccccaaattgcatctgtttttaggtgggctagctactcgtctgaatcatggatgctaaagattagcagagggatcaagcacactaatcacgttcatttgtgtcggaagacacgacaaatcaatttttgttgattgttattatccatcgccacgtgcagagtgacgtaacgtgaatgcacaggagactggtgtttggcgtagcagcatgtgattagttagttagccgtcgggattgtctacactactgctgatataatagcaaacacgaatatgtaaattcgaattcatatgtcaaccactgttgtcgcgtcagcaatattgcataggatttgcatccaaagttggtgatgaacaagcctcaggtacaccctggatcctagagtatttggtactacaagcagatgcagttttcgtttcttacttttgcaaagtcggaaaaaggaggagagtacttttggggttacaagtcaacatgagtcaacactactagagactgcgcacatgacaaaggtgacagataagagagaacaaagaacaaagaaagttcccctgcccatccatagttgatcagattcggacgtgacactaaaattcacaagaagaaaagaaatctataaagttcttaataagtactgctagtattctctctattttataatatacatatattataaatcgtttgtctttttcctattaaaaatttgttaagtttaataatacctttttaaaatatattttgataatatgtttgttttgtattgaaaatactatttatttttcgataacttgatcaaacttaaaaaatatttgattagcaaaaagaaataaaataatttataatataaaacagagggattaataaagaaaaagaaaaacacaaatatcaatgaaataaccaaaaagaaaatccagaaaggggaggaatttttattggcccaaacaccctgaccgtcggaggccaccaagaaagaaagagagagatccctttttgctttgcgcttttgcaaacccttttccaattcttcttctttgcgcctctccaaccttcctccgtatatatcaatcatcgcccaactccagctcccaactc

SEQ ID NO: 21834 - DNA, 445 bp, Oryza sativa
aactgtgaatatgacgtagtactatttgcaatcaaaattattattattatttgtggggaaaaatattatttttgtttttacatgtgcatgacaaatggactacattgatgcaaagcataggaccagtacattgattagtacaatgtggccgcagctgtgactggcagtgccatccaaccagaaaaacgttgtgcctacttcttcctacgatcccaacttaagtcaatatttctgaaccagctgtcataaaaacacagaagaaactcgtgccattcatgtcaagcaaaatatttcctcatcgtcatcatgagcgattcggtctgatctgaaatctcgcgtattaatccagatgataatcgagttcgttatataatagtatgtcagacagtcccagcatgagagatcgtcaacggtacacgattagatcttcgattatcttcgtaga

SEQ ID NO: 21835 - DNA, 1390 bp, Oryza sativa
ctgatgtctttttaaaaaattaaattatactcgatgatcaatctagcgtctaaaattaatccacaaaggctcgataatttcaatgtgaagatatcgcgtatcacaggaagatgccaagtgatcaggacactgatggatatggagtacttcctgtgtaaaaaaaaacgaatttaggactgtatgtgatatatttttttattgtaataggatatatcaaatctactactatattgatttttattgttattgggacagaaggtgtatatatcctaggctggcctagaaaatataagtgtcgtacaaggtgtaattgttgagatctgaaagcatataggagtatatagcatgtagcttaagcccaactgttcggtctgaacacacattatattagatctctagctagatatcatggaaagtctaaaggcgtagcaattatgctccatcaagtcaaaacaagtgtcaatcgactgcatataaattattgtgattataactgctagctacactgcaacagtgatagtacttgatacacatatagccagtacaagcttgctagttggtagtggctatttactctgatttagttttattatgacatcgtcaaactaagcagggccaaacatatattatggcaacattcaaacagtgcaaggtactgttttatctattttttctattaactttttttgacaaccacagctacagaaatacaaatagatgctgactgggaacctagtgctggtttttctaaccgacacataggcgtcaattatgggagaaataaaaagtgccggttttggaactggcatctttaaggttatgttaacgccaaaatttagtaagattgtttagtggattcggttaaggaatcgtgaagacgtggcatgacggcgtaattctatatattaattaggcatgatttagtagtttccttttatctttagaaaagtgtgtttagtgtccgataagaactttatatttttccctttaatctttaggaaaatttatttcttgtttaagaatgactcgtatctacccatgggtataagtttgtgcacccggggtcattgtaaactatctccgatcaataaaaatactctcggcgtatcgccaccatctttttcgaggtttttacttatcatccggtgaaacttggcacctgacacggggctgcatcagctttcgatcttcggtgaaggggtaagtcctactgtttgccggcccagacagttgtatcggctacattggtgttgttcaaggcttcatcgcttcgatctcttgcatcgctctggtttggttagtatatttgcctatctatttatcatatatcttagttaatctagtttgatagctcgattaactgtataggctgggatgtgctttagggttt

SEQ ID NO: 21836 - DNA, 1501 bp, Oryza sativa
acgaaaccggagatgtaacattctccaactatgaaaaccagagtgtgcacggtctctaacagcagcccaatttgaaaccgaaccaacaaacagcctggttaacacgtctagccatgaaaagctaggccccatacactagcttgattgttctgaatggattaatagatggtagattatatttgattttgtgatgataatcgatgtaaaagcgaaagagagttaactattacccgtataagttatattggcattattccatcttcaagtttaactttatatatacaaatacaaaacataataacagttataacacaaaacatatatcatatacaaatatactactccctctgttttagattataagtcgttttgactttggtaaaagtcaaattacttttagtttgaccaagtttatagaaaaacagtaacattttcaacccaacacaaatatattataaaagtatattcaattataaatttaatgaaactaatttagtgttataagtattatactatatttatccacaaacttgtttaaacttaaagtagattgactttaactaaagtcaaaacgacttataataatatgaaacggaaagagtattttatagtggatgaaactaatttagtcgtctagatcttagtacgtttcatcataaactaaaataacttacaatataaggaggatgaagtacacagttgagaagctatttaaatctaaacaaagtattacaagcaatttaatttaggtatagactacagttttgcgaaaattgaatcaaggccttcgagcaatataatcggtgaaaccgacgacgaggtgctgggccaacaaatatacaaaatattattgtgcatgtgtttgtctttaaaaaaaagttgagtactaaaaaccagtgcaatttgaaggagtggaaacagctataacagccagcgagagaaatgtatatcaacagaaaaaaaatattataatgtaaaaaggaaagacaatatcaaagtaaaaaatatagagtaattaaattgtatttatggtataacaactcgtggctgtgatttagtacaataatttgagaagtgaatattcaagtccaataacttgacaagtaggcacgtacattttagtataggaagttgacaatttatagtattttggtgtaataaataggtatatgttgttttggttaacaagtaccgggtgagttttatcacaatgtcaatatgtcatcatatagcaatcatgtggatatatataatcttgaatttaatccataagaattacactgctcattctatttacaccttagatttaatctataagatttacattgctcgattaatttgcatcattagtttggattttttttcaccttcctatatctcaaccaaaatataaaattttcaacgtagttaaatttatttgactttcaattactagaatgacaaaaattatgtatacttatacaaatctatgttatattgataaaataagttctaaaaacta

SEQ ID NO: 21837 - DNA, 467 bp, Oryza sativa
tccagaatttaagcatgtctatccccaaaagaaaaattgaaaagaaacatgccaatttatctgcagacttcaaagtgaaaatatacctcagatttaatgaattatatttccaaataggcaattactcaaaatctcaagtggtgcgttattagcaatcttgtaaaagaaactgctactctttttagactaaatacaaatcaatccacagaaaagtatggttgttgtgccctctgtgggtgtgcctatagacaaaacacttgtcctgtactactaatctattctgcagcaagcgcaaaagcgcagttaaaaattatgtttttgatcactgaaagcaatggcatcatgagcacaacacgaagatcatcgcaagagcgccatttagcactcctctctgtgtgtgttgagaaaccttctttgtgttttatgatgtgaatcgtgaatccctctattatatctttttacctgga

SEQ ID NO: 21838 - DNA, 1501 bp, Oryza sativa
cgtcaggttcctcgttggtcctgccgtcatggctgcggcctccatcgccgtcggacttcgcggggtgcttctgcacattgccattgttcaggtaagctgcaagttcaggcttctgcaccaaaatgcatccttaactgcaaaagaatctatcgtaactcaacaattgtcattgaactctcaggccgctcttcctcaaggaatcgtgcccttcgtgtttgccaaggagtacaatgttcatcctaacattctgagcacagcgtatgatctctttaccaccatttttttcagtattggagaaatgtccccattttgaggtttcttttcttttatgccctgaaatctctcgccctgtttcccggttcccttttccattgtatcacaaacgccatgcactgaattttctgaaaaggggcgcatcttgcagcttttgatgattcctaatcatattgttttagactaagaaatccatttttactcatgatttatcatccacaaaggcagagtccataacaataccattaaccatgattctataacactatcattgtatctgacatgaccatgaactcttgttctgcagcgtgatattcgggatgctgatagctctccccatcacattggtctactacatactgctggggctctgaagagctctccaagtctcaactcaactgtgcaagaacttgatgttactgacagtttgattaggatttatggtctgttttagttgctcagattttgtttggatgataggtcagcttagtgatgctaggtggacaattatccgagaacttttgggttcaagtgacggccagccacggtttctgattgaagattaggaacatagacatcacattagtgataacaggcatccaatttgtaagacattgagaaggtctgtttcaaattactgacaatgtagtaagacattgaacagtgcttatttagcattccaataactgatggtaatgcgcttacttaaggagctactctgaaggaatttatttttaatctcttgagagattagctccggattttccttttcaaatgtttctgagtttgagggctccttcggaagacaagattctgaaaacacgggaataatcgtaggaataggatgtcatgctataacaaatattataggaaataaatttataaatttataggattctataaaaagtattgttttgtagtaccataggaaaatcaagaaactttaagttacaaggatgagaaaacatgaggtctagtctcatgttagttttctgtcaaaattcctacaaaatgagcaataggaattttaaaggattttggggaagccatttctatgtttcaaaagatcatatggggaaatttttcaatggattttaggggttgaacgctttatcatcacttgccaacaaaagttattacactttgtttaaggtgaggtgaataaattcttagacataacttactaagggcaacaacaatgtatatagcaaaaatagtccatataaat

SEQ ID NO: 21839 - DNA, 1501 bp, Oryza sativa
tttgcaaaatttgagatatgacatcctgacccacatgtcattgactcatgtgggtcctacatgtcattgagataccgatggcatatcttaaactttgcaaaattataatggcatggttccaatttaccctatcatcattgacataattatagaatatagctgaaattcggaatttaaaataaggaacacaggaagaaaagactagagtccatactggcataccatagaactaatggaaatccggaactagaaaaataagaaaactaaaagtagaggttagagtccatatagaaatacaatttagctggaatttggaattagaaaaataacaaaactgaaagtagaggttagagtccatatagaaatacaatttagctgaaattcgaaattaaagataaggaatataggaagataagactatagtccataccggtatacaatataactaatggaaatttgggattagaaaaataagaaaatttaaagtagaggttagagtccatatagaaatacaatttagaaataacgaaaattcaaaattttaaaaaataaggaatatggaatgaagtatatagagtccatataaaaatacaattttaaaataattaaattcgcaattagaaaaaataaatactaaaagataagtttagagtccaaatacaatttagacataatagaaactaggaattaaaattaagaatattggaagaagagtatagagtcatataggaatttataattaactaaaatttgaaataaaaataataaaactaaaagtagagtttagagcacatgtagaaacacattttacaaataaataaataaattataatgaaaaaaagaatattggaacaatagtccataaagaaataatattgaaacatgagtccataaagaaataaaattagaaataataaaaatttagaattaaaataataagcaatagtagaaaaagagtctagagtccatataaaaatacaatttataaagaaaagaaattcggaattaaaaataagaaatattggaagatgagtataggaatataatttagaaataactaaaattttgaattttgaattagaaatataggaataaaattataaataatagaaattcatgattaacaaaatgaagaatgttggaagaggattctagagtccatatagaaatacaatttagaaataactaaaattcgctattaaaaataattaataattgtcatttatatacaatacattacgaatattacacattggttagtttgatcaagttagtacaaaatttaaaattatgttgtccttttaatatatttgataataaaatatgaaatatgctattatatgagagaaaatataagaatgctagctgcgcaatttacgcgggccaccatgctagttcatgttatgttcgaaaaagctaatggacgagcgctcgcgttcacctgcccccacgcgatcaatttactctgaccaatcccatgccacacgaagtatagatggcc

SEQ ID NO: 21840 - DNA, 1501 bp, Oryza sativa
aaatgcacaaatattaaatacaaccgaagtctgggcataacgattaagctttgctgagtcaatacaacatatggaaacttctgtaaaggctccactggacaaatacaaggcaggaaagaatgatgtaatgcatttatgtgcatggtgagatcttggaattgtctaatcagatcacttatccttccaggggcatttgcagtggctaagaagtagacagaacttggctcagttttgcctaggttatatatatgctaaaaagctgtgtttttagggtgatattgtgtgtcttaacctttttgtacatgacatataaacttgtaggtatcctttgctattattctatgagttatgtgaacatggcagttttttttcacagcattctattcccacatggccacacatgtggttatacctatattttaatattcaacagacttcttctttgacttatgcctaatctaattgttattcataaatccaatttcttgtgctatcatcatttttttaacaatttacgtgaaaatgtaatatgtttgtcttacatacttaatgtttgctaatttaattgagtccactccatgccattatttggagccaattgttttcctactccatttgcctctgtatgcccttttctgagctgttggtctcatgaaaagctagccatcatctaataagtaagtttgacaattaacttaaacaggtcaaattatgtgccgagcatgaaaatgataaaataggaaaaggttgtgaagaattattcaagtgattctacaattcaaatttataaatgacaaccatttccatttctacgaatatcataccgatcttcacaaaagcaattaaaatgtagttaaaaccatctgatatcccagtatttaatcacttaaagataaaaatagtgtgcgaaagcattctgtgattctgtcaatcatgatatgagcattttcagaaaatagcataaaggcttacattatatctccaactgcaccctcttcttcttcttcttcatcgtcgaagtcttccaactacattacaaaatacgatacttaagaatcacatttagcaagcatgcatcttgcattaaaccatacccaatgctagctcccaatataagcctattagctcaagcaggaaactgttttagaacttactccatatgctcaatttcctgaggtaatgcaaatactttctcttttgcgactacagaaattctggtgtctactcctgaaatactactagatcagtggttctatatatcaatcttctttacgatagctaatactggtctcagaatttaacaagagatgtgattacgaaatgcttacatccaagtgctcatcgtcatcttcttcatcctcatcaagatactcctcgtcctccgaatcactatcttcttccatccagttctctgttttcttcttcttcttcccttgcttggcacccccaccatattccgcctcctccccctttaccatgaacttatcgagatcctttatct

SEQ ID NO: 21841 - DNA, 890 bp, Oryza sativa
ccgcggtgacaaggccttcctggaaggatggtaattaagctcggtgtcactgataataatgtcttgtgtgaggcagtggctgagcctaccgcctaccattttctgtttactccaatcgatcataacctaatagcagggacaacataagctgtgcactttgttaccaaaattaaccttattaaactgtggcaatatcaacttttgacaagctttggtgttatcgaattttagtagcgtttgatgtcttttcaaaatttagtactagcgtttttatgataggaaagttctagaactactaaattttagtagtatgataatattggtgacatcatatttagtttgttatcttactaaaatttaataaggttaaaagcgattataaaatgaacaagcccatagtatcttcctacgtttatagaaaacctaactcaacacctaagttatagggtttatttatgattaaaaagaggttgctagaattggggtatgaagtagacttttttacccctatttttcgtaatgagacaattactctttttcataactagaaaaaaaatatccatgcgttgcaacgggtaaaagctattttaatcttatcactgttgtacagtttagctaaggtgaaattcactctggaaattcgtttggatatttattttacaaaatcataagctacaattaggagctttctgtatttttaaaaacgaacgaacttaaaaacagactcaaatacatatatgtatttctaaaagcaaatgaaattaaaaaccgactcatatacggacgacgtacaaagtaccggcaaaaacatcttcaatttttataatagtagtgatatgcgaaagtagactgaagaactgaaatacttaaccgttctgttgttttgcagc

SEQ ID NO: 21842 - DNA, 1501 bp, Oryza sativa
tgctgatatagtgctatgtgatagagttcccaaaaaaaataaaacagaactggacatactctgaggttaggagttaacacaggaaaccgcacatctggcacatgcctaatcccttgaaggacatcctttgcatcagctagctgaactccgaaatgagtgataagattagttatttgaaatttaactgataccaaatttgtcaaattaacagtacaaattttacaaattaaggtcatacaaaaaaataatagtaaaaggagttcaatataattatcagagaagtagtgacaacttccgatgaggatttccacataaaaaaatccggttttgaagtaagtgcaatcacatatgctagaaaaggtggattttaaatcaagaggtatcttgacattgttccttaaatatctgttaatttaaattaatatatgatactacatttattcacttaatctaagtaattacctgcggcacccattttggggaaacaaaacttgtggcttcaactactgatagaccagaagccaccaatttgtgtatcagttcaatctttacagaagctggtacagtactcttctcattttgcagaccatcccgtggtccgacttcaactatcttcacaaaccttggaagctcccacaaaacctgaaaaccagttattcatcaattgagaaaaaagagtaatttgtagtaatattttacaatcactacactttttcagccaccattttcacttattcagttatgaaggtaaatagaaaagactatgacatgttgaattgccgcagacataatgctacatgtcagttcattcctcgtatttgaggtggtctgatgaagagatctaaaaaaaggaaatgaaattgaatacactcataagccattccataacacaggatcaaaataccttccgtggaagagctctgaactccatatccactccattgcaggaggaatcagtatattggccttgcatatgccatgaatgagaactgctgtgaaagatcgtctgattgttgccaccattgtgatgcttgtaactgaaagtaggtccagatggtcagatcttacttttttttttcagggcatcctttggcagtaaaaattctactgatgataaaagaaggtgagaaaggaaaatcttcggtgtaaaacaaaataggaaaggaagaatctagcatctgtatggtttgcaagagtaaaacttacttgctggtgctacggtcatcagcacttgctctgcaagcatttggagagaacctttcaagtctgttaatactcaactttggaaggtccccaagaccgagcggctcctcgaggctcgacattctggaatcagatgttacaatgtgaagaagactgttgatatgaacacttgatatatgtcactgaattgagttataatctcaaaacacatgaagaacaggaggaaaaaacaatgtatcgggtcgtattatctcattgatcatatgccaactgaacaaacattagtttccgtttacca

SEQ ID NO: 21843 - DNA, 196 bp, Oryza sativa
ccgccgcccatcaccggcggtagcaagggcgccgtctctctcagggtacgtacgtatatacgtttgtgcgtgacagtctcgcttggagtcttggactgattgatctgatcaagttgattagtgtctcagctggatgactgggtgctgtgccgcatatacaagaagacgaacaaggccggtgcggggcagaggagca

SEQ ID NO: 21844 - DNA, 1004 bp, Oryza sativa
ctgacttttttatatagtcaaggtgctgtttgggtttatcaagcaattgattggatacaatatcattgctttttgccacgtaagtgtgcatttttattgaccaatattatggcttaggctgattatatattatggtcatttttcaggcggttggtaaatcctttatgagtttacttactcggatgttataccacatgtgccatatatttccaggtgtggtgaaacaatgtgtcttttatggacttaagcacatctgttaaagcagtgtgcgcatggcgtatgcccaatactttgaaaatttctttattcacagcattcaagcttctttatagttgttttgctatgtgaactttcaaagatgttgtcaactttaggttgtacgcatcatattttgccaagcagtcggtatatcacttggatcatattattcggggattcacaccgcatatgctatacattgatatcaagtcacttggttgattacaattatcaaaaccactcggttggttagattatttattccttgactatatgtttggttggttcaattaaccacatagtcgggggcaacacctattaggtgcatctattcgatgcacctgactatatttttcagccctccacagtcttcagatttggtaaaagtactcgggagaccatggcgaagataattgaagcactcggctttggagtaatctagttcgagagaaggttatcttttcggctgtgaaggtctcaggggctactgtggagattatgggtaccccatacccacacgacatggttatccgactagtcttaggggatagcttatatctatggaatatgtaacagatcatgacttgggtattacgtttccctgtatattatggaacggcctaaagtcctggtttgataagattgtaaagtagatttaggaaaccgatcccgtgttgttaaggtttctatcttgtaatcctgccctccaccctatataaggtgggcaggaggccctttagggggca

SEQ ID NO: 21845 - DNA, 1501 bp, Oryza sativa
aaacagagaaaaactagcaagctttttaggatgcagatacaccaaaggaagaaaaggaagctatgagtaacttatcaaaaatcattatagacttgactaaattgtgtaaactctgtggtggacaacagtcttaattaaattgtgacaaaccttcaccacaagtctcaagatgattccctgatgctgctctgtaacatttgatatgttgattaaaagatcaggtgctatgcttcccttgtcctgttacagaatgttaacttcatgttgttggctttgcagaaaaggtaaaacagcctagagaaaatgagaaacaaacgaagcagaataggatacctcacttagcagacgttcaaatgccatctcaatataaacaatgcaaaaattccggactattgtggaggaagtagattcagtataaatcctccataaatccagcatgggcagtgaaatctcaggcctgtgcttcacccgtttgttaatgtggctgagaatttccataacctaatggagtccaaaaatggtattattttccattacatgccattgtctaattgacatggaaattatgctatagaatcatgcaaagaactgaaggaaaacaggactggcactctgctacctctgaataggttcaggttacagtaacaaatgcaagtaattcttgcaacataaagcacaatagtctctctaattatgtcgtttagaagattatgtgtacatgaacaaatcactaaaacactataatacgcactgttgctcgaatttcatcaaattgaagcaggaacattgtaaacatcaccaaccaagagaccaactaaaccaaccgaaggagaataatgacacacctacacatatgtctcacatacaaatttcaatcgacccaggaccagaggagtggtatgcttacgagcttgcggacggatgcggtggcggaggcgagcgaggtgatggcgtaggggaggacgcgggcgagcagcggcgcgagccgcgcgtcttcggcgagggccagccgcgtcagcatccggtccagcgcctcctccctctccgcgtcggtctgcgccgccgccgccgccgacgatgtctccgccatctctctcccggcgatgttggactcagctgctcagtcgcccgtgtttccttccaccgcaagaaggtgagaagaagaaaaatggtcgagtcgggttcgagtccaaaccgcttaaaacgagaggggagtcgtgtcgggctcgggtccgacccacacgagtcggtacactcgagaacgaaacgaaacgaaacccaacccaaccaactcggcgcggtcgctgcattcttcgtcctcaagccttgcgccctgcgctgcagcggctaaaacctccttgatcgcggcgaaaacccgcgaaaccccaaccgccgctcgccgtcgccgccgtcgccgccatggcctccatggagcccttgaaccggtgcggatcctcccactgtgctcccctccgtgtatccatgctgcattgatgatagt

SEQ ID NO: 21846 - DNA, 1501 bp, Oryza sativa
gggggatccaaaatagatagtgacatatttgtcggttcttggtgaaatcgatccgtcaaactagcttcctcttcttgggtattgtatatctgatatccagagtggttttgttcacctttcagatctctgcatattactatactactagtactagttagtgtggaaagccctgagttgactgaagatcacttcatcttagccctgttacacttggttgcagtaataacctgacagttgaaggtgcacactagcaacttaccaaccgaatgttggacgtcctttgtttttggcttctgattattatatgtattggtttagaagtcgcttacactgaaatttccatgtcatatgtgctctttacttactctattgttgcttcaagaaaggggaattgtgaggtgcatttaatattcatgctgacctcaagtgtggtcttagcaaccaatttctgttactacctttattttttcccatttcactgtgtcgaagtgtacaatgtatctgggatattgtgttttagttttgctaggccttgtttgtgctgttagactttctttcgcccattttgaaggcatgccagagatttttttttcccttctaaaattgaatatttcgttctctcattcgtgccaaaggcaaagagcatgttcttttctacaaactgctagtaaatagtaattgcttctatgctctcactagacctttagatccaatggttgttacttcagattatagaggtactagtctcatgatattcttaagtggagactaatctgtgaccaatcccttcttcctgattgaaacgcctgaaccctggcaattagaacttgacctgttctactagtcattgttacctcccattatctgaaagacttaactctttgtatcaaatgcaagtctttctctagtttgtaacaacatggatggaaaccactctctgaaatgctaacatgttattcattcctactttagatcagcgtttgtaatgcttctgttcatatcagaaagcaatccccagatgctgtgtgccatgcatgaatttgttgaaatatagagctctgtgttgtcagaacagtctaggagatgtggtgagccctgtgggcagtgtagtactaagactgagagttggttatttacttatttgtattcagtatggtccctcttgagacagtttgattgggtttattagcgactatgagcacatagctatagtcccagttatattttggttgtagtcgcagcatgtaattggtagtcttgacaaggataggtgttttatccacgagcatctcctgttctctatctttgcatcagtacataattcccctcaaagtagctttcaaaattccagaggtgtagcatggaagcacttctggttgacactatactatccaactactaattatttgtaccatatgtaagggtttactaattgactatatattgtctattatactgatataatagaattgaacagctcataacctgcaattgtcttttg

SEQ ID NO: 21847 - DNA, 268 bp, Oryza sativa
tccccccctctctctctcctctttttcttcatcgcctctccttttcttcgcctcggcgccgtcgccgtcctccactctcccgccgctcgcctgactccctctccctctctctcccgccgccgccgcgagcctcactctccctccctccctccctccctcccgttggcggcggctgtgaagacaatgagaagggctgccgccaccgccggagctttgtcagcggatttgttcgtcgccgtcgcgtcatcgagcggtgaacggcgagcga

SEQ ID NO: 21848 - DNA, 564 bp, Oryza sativa
gcggcatttatcctccatggaagtcgtttccgatgggtgcagtagtgcttattggtgacacgcgtgcgagcggcgatggtgcactgaataaagatgtgcttagctatgtaatggaacttgttttgctgtagtaggctgggatatgatgtggcaatggcctctaactattgctgttgtgtacataagcatatgaatgcatgatttgtaatggtcgggtgagcccttaatttcatgtaagcaacttacattgcagtgttaaagagtttggtaatggaatgacatgattagaacttgaactggaagtataagttgtcaagaatttggaaatgtcatttggaaatggaatgacatgattagaagttgatctggaagtataagttgttaccccgtgcgaacaataattttgcacgttatatatgtatgatttagaaaatatatgtttggtaaaagaattttttctgtcaggtactgaatgggtaacgatcaaaattaaaattttatgtagtacagaatgtccaacgaaattttatctagtatagaatgcgtaataccagcaaactgaga

SEQ ID NO: 21849 - DNA, 269 bp, Oryza sativa
ctacaatagccactgcatccttctgttcagaggaagccaggatgagaatcccagcatcacgaaatggaaacacccctattaccacgttgtccggtatttccatcttcgtttccttcctaccatagcaagcaatttgtctaaaactacctgtcctttcatccttggattctcaccaccaatggtttgtgttcagtgaatgatctaaccatgcgtcattcacagttcttcgttcttgtctttactctcatgattttctctttgttccagac

SEQ ID NO: 21850 - DNA, 1291 bp, Oryza sativa
ccagcttagtcaatgctttgaattatttttttaaaaaaggaggtagtaagaaataaacctgacaaaagagtttgaacccccactaatactactaagtgatgtggactagggttcacgatcttccgaaagattctgataagcagtcgatttggacggagtcatgacacaactcgatccggcttctgaacgaacacgctcttaagccccgcaatcgcagccccacgtctcctccggttattaaccatgtcgaaacgtgattgacgtcgctgataaggctaatccctgtttgcgatacgaagaacacaaacaagaacaaggaagaatacaaccaaaattacagatgaatgattaagcttacaagttgggatcttacaaaccaatctagcggcgagactgttcttgatagaataatctaagcaaaacctgaaccctaaaggtgacggcgggtactgatatatagagtttagggtcatgcaaacaacccttgacgcaaccctaatgggttccaacacaatatacggtccaaaggcccaaatacggtgacgcaacaccgggacaaattctaaacatcaatttgtttggttgattcctattgacttgaaaagaatttggacgtgggactagaaccattggaaatgttatcttcttagctttccatccatataaagaacaccctaatccgagcatgtatgcgatctgggcgtccgttttagtgcagactagtcttggactccgaataatactcgaagtcgacttggttgagcctccatattgatttgggtgcccttgatgatttccacgcctctaagtctttctctaagcgtcgctttgtcctctccatgattcttaatcataatataatcattagataggaatctattctcaaaatcatgtaaaaaaacgtaggaacaagctcacctctaaattcaattatcgtgcgcgagctcttgtaattggttttttaatgaccggtggaggattgttgtgtatatccaatggagtgatgtcctcatcactaaagaaacttcttttataagcaacagagagacgaaataaacaagactggtatcaaagattgttatgaacttttgtaaacaattgttttctcccaagtgttgcaacggttctttccgaaatttatccgttgcatccatggtagtcgctctctcttcttgacccggtaaacacaaataaacatattcactcactccgtcactcggagaagaacaaattaattaataaacaatggagaatttgaggtaaatcagattcagatagatatatagataga

SEQ ID NO: 21851 - DNA, 1501 bp, Oryza sativa
agagttatagtaagagagagtgaggagtggaagccgcctcctcacacaagcccgaaaacattacacatacactataggaaaattttattaggcttgacagaggatgtacactccggggtgcgaaagataggattaaggaggagaaaaaaaatgaatacagacgtaagggcatagtagtcaaaactgagcaagcagcattataaaaagaaaatgtgggacatcaacgagtaccatgtagcactacttatatggattaggagggaaaatgttctctcagcagttccacatggataatgagtcataagaaattatttgtttcataatgttgtatacaaactggatctagttggtgatagtggtgattaaccattatttcaagttgcatatttggaatgaagctatcaattctagatgccatagatttgataaacgacaaaccatgagcagcagttacaccaaaacagtacctaagggatcataacaaaatcgttcatcattcactctgaaaaaaatcttcaaaaactggatctacattaccaatgcttgtttgagcactgaacaggacgttgtggccaacctgctttaagaaacgaaataatcaatttaaccttgaaaaataaatcctggaccatatgccataaatttgacaatgcacaggcacaaaaagtctgcattaattatctgttactgtaaattctccttgcctaaaatcgcaagaggccaagagtgaagagcagtattcaacatgaaggtttcctcattggcgctagcaactagcatcatcaatcaatcaggtaaatgaaaccaacagaacatgtaaggaacagaaacacacgcaacagggcacattgataagcgacagcaccgaggtcaaagctttggttcaggatttaggtttgatctcactctcacctgccgagggcttcgaggacaacgacggcaagcccacagttgtcgccgcgagcggacttggggtctctggccagcgagacgtcgtcgtagaatgcgcgcgccaccatcctcaccatcctgccatgccagccaaaaatccccaaaccaaaaccaataaaattacacctcccgcagatgccaactatcatcaatgcagcatggatacacggaggggagcacagtgggaggatccgcaccggttcaagggctccatggaggccatggcggcgacggcggcgacggcgagcggcggttggggtttcgcgggttttcgccgcgatcaaggaggttttagccgctgcagcgcagggcgcaaggcttgaggacgaagaatgcagcgaccgcgccgagttggttgggttgggtttcgtttcgtttcgttctcgagtgtaccgactcgtgtgggtcggacccgagcccgacacgactcccctctcgttttaagcggtttggactcgaacccgactcgaccatttttcttcttctcaccttcttgcggtggaaggaaacacgggcgactgagcagctgagtccaacatcgccgggagag

SEQ ID NO: 21852 - DNA, 1501 bp, Oryza sativa
gaggaagaacataagtgcgagcgttgtgtctgttcatcccgttagcaaaggatttgtagcgcatgcgagagttaaattcggagaattcaatccgcacgattaacccgagttaatgcgattaatcgcggaggatttgtagcgcatgcgagagttacgtttggagaattcaatccgcgcaattaaccccgttagcggaggatttgtagagcatgcgagagttactttcggagaattcaatccgcacgattaacccgagttaatgcgattaatcgcggaggatttgtagcgcatgcgagagttacgttcggagaattcaatccacacgattaacccaagttaatacactagaatataatgcgattaatcatggaggatttgtacctcatgcgagaattacgttcggagaattcaattcgcgcgattaaccccgttagcggaggatttgtagcgcatgcgagagttacattcggagaattcaatctgcacgattaacccgggttaatgcgattaatcgcggaagatttgtagcgcatgcgagagttatgttcggagaattcaatccgcgcgattaacccgagttaatacaccagaattaatcatcttccgatacagaacaagagagggagagcatccacgcgattaatcgcagaggatttgtagcacatgtgagagttacattcggagaattcaatccgtgcgattaacccgagttaatacacagctctgtgcacgagtgtggctgtccatccaccatctcaaccggtgaacagagattctccactagctccatatttaaattaagatctcttcacttaaattttcaatatggtattattacccatagcactaaatttccaatatggtattattgggatttaatttggcctacccattaatctaatagacatctagcaaatcccttaatttttcgatagaaagttttaaattttacttgaaagtttatttcatatatagatttcttttcaatctgttagtaagcaaaatctaaaaaagaatattttcttaattatcgttattattctaaactaacctagttagttatgggagaagaaaaaaatgcatgccaccactctgttagttacgggagaggagaaaacgcaggccaccactcggttagttacgaacaggcatctgcatggcacggtcagccacggagcgtcggtcctctcgagctggccgccgccgaatccgccaatgtacactcgaagtgggtctcctatctgtggagactaaaaatagcagattgtgtggatctggcgtgttgatcagttacccaaaatcaaagctacagtacctaccgtgctcttgcgtttacacttggcatactgactgcttcttttttatataaatatatagaaatagtgccaggttgatggagagaaactaaacgggcgctctcgtacactgtagacaacacacactctgcacactgaagacaacgcactcgcacaaacaccacgcacgcctgccattgctagat

SEQ ID NO: 21853 - DNA, 311 bp, Oryza sativa
ccaaaataacagtgcaaacttagacccgttctgtccgggggcttcggacaacgctgtcaacgcacaagatgagtccttcctcagttaatcttagatcatgcgcactgaccacacgatcgacagagaggaataatggtcaaaacgtcaagcagacggcccgcacgcacgcaccgacgcacgcaccggcgcgccgcgagggggtgtccagacaaaccggcgtctgtcacctacagagaaatcctgcggggatcgagctaggcgcggacgtatgcagtgcagggcagcgagagacaggtaagtatacagtagga

SEQ ID NO: 21854 - DNA, 433 bp, Oryza sativa
agcgcatgagcatttttaaaagaaaaactgaactctattcactagccaagttcaacctattagtgtcatgccattgatctgaaggaactcaggaagatggctgaatggttttaccgggttcggttttttgtatccggtttttctgatgggtcaattttcgcatgggaacactagttttttgggtggggtggttttttttatgtgggggaggtgcgattgttggggaggacaactacaccgcttttacagtactagagataaaccagatgcaccccagccctcttaaaactcaacctattacatatatttgttgttcaagtaacttaaaagtcaacctttcacatatttttgttgttcaagtaattgttgactctttagatgtgtggctacaaatttgcaatatgcactctcattatgatatccatgtactgca

SEQ ID NO: 21855 - DNA, 1501 bp, Oryza sativa
gaagatccatctgtttagaggatggtacgttcattattcaaatttaaactaacagcacactccctacgttcaattgtgcaccaaatgcggtctgtacctgtgcatgcatgcaccatgcagcgattagagaaaaacaatattttcattctcttcccaccagtttaattagatgctaatggttatccactaaggggagagagtatgtactcccgggagtacataacaatgatcctataaattaaaatggttctatactaccgtccatagaaggcagccccgatgaagagcgctattggattcacatgtggacccgttttgatttctattcgagaaaaaaaaaatccgtagtacgacataactatcccacattaatcggtataccggagtgttcctgacgcataaatacctctctctcaaaccatcctattggtaaatcgggtcctcggtgagagcacgatctaccggcggtgatccggacggatcaatggcaccggccgattttacggcgacatcggtgtccatccgatactaggttttccttttttttttaatttcacgatcttgtttgatttgatttcagatgcatcaagcaagagagagagatgggttgttacatacctttgtagaagagctgcagggagcaagatgagggagccaactgcctggcgatagaagacgaagatgtagatgttcatcccgtggttgaaagcagccttggatatcacaaacatgccagtgtagatcagttggacgacgatggcgacaaaataaggcttcatacttgctttcaccatcttgatcgatctagcaatggcaggcgtgcgtggtgtttgtgcgagtgcgttgtcttcagtgtgcagagtgtgtgttgtctacagtgtacgagagcgcccgtttagtttctctccatcaacctggcactatttctatatatttatataaaaaagaagcagtcagtatgccaagtgtaaacgcaagagcacggtaggtactgtagctttgattttgggtaactgatcaacacgccagatccacacaatctgctatttttagtctccacagataggagacccacttcgagtgtacattggcggattcggcggcggccagctcgagaggaccgacgctccgtggctgaccgtgccatgcagatgcctgttcgtaactaaccgagtggtggcctgcgttttctcctctcccgtaactaacagagtggtggcatgcatttttttcttctcccataactaactaggttagtttagaataataacgataattaagaaaatattcttttttagattttgcttactaacagattgaaaagaaatctatatatgaaataaactttcaagtaaaatttaaaactttctatcgaaaaattaagggatttgctagatgtctattagattaatgggtaggccaaattaaatcccaataataccatattggaaatttagtgctatgggtaataataccatattgaaaatttaagtgaagagat

SEQ ID NO: 21856 - DNA, 728 bp, Oryza sativa
tttatcggggtactccgtatccatcaaataccgccctccaactagattctcatatccaccaaaaagtaaaattcggctcgatatccgtacaagcacccaattattcggatttttgacccgaaattgtcccaaaataatacgagcgggcaggcatacgggaaatatccatctcatttttaccctaccccctccatccaagctaagaccagatagaacatttcacagtacaacaaatctaaacaggtttgaaatatcacattcaatctgtaatcctagattgctatactatgagactgagggaggtatagtaatgtaaaacgaatacccagctatatagaagagatatacaagaaatccaaaatatataggttgggatctaaacccaaaaaatgataaaaactgttgcaatttcgttgacaattcgtagaaattttatccatattttgaatttgctttttcttaaactcaaccaatttattctatgattttggcattttgcaaatcaggtccgtggatacgtccaataaacattagtaaccgtgtactatgtcggatgatctaagactgtgatgaagagtaaaaaatcttgttcagaagatccatgcattgatactctaaattttacactaagattttttatattcgatatactagtatactaccaaattttataataaaaatatgtctcggcaaagatgataaaattaccgttggttatacgcttcaga

SEQ ID NO: 21857 - DNA, 209 bp, Oryza sativa
ttcttattcagaagaatgtcttgttgtgaatatttaatctataaagtaaactttggagaatgtttattgtaaaaaaaaaattgcatgattggaaattcataacttgtcatcgtgaagctgattagatgccttgatactgagattcacttctgttacttccattttttgcactagttgtttcattacatcagtgatacatgggatgcagg

SEQ ID NO: 21858 - DNA, 1116 bp, Oryza sativa
ccgctccggtcgccgtttccgtcgtcgccgtcgacccggggtgagccgtggaccgccgcttcgtttccccctttccctcccctctctcggccgccgctccgccgtgcctatggccgccgccggcgaccataggggcgcgggcgcgccgcctcccgtcgctgcgccggcgtggccgccttcgggcgcaccgagcggctgccgcgtggggcccggctgtcagccgcccgcgccctcgggtgcggctgacgcgtgggaccaacggcgccggccggtgtgagcccgggtgcgcccggtccaccgtggaccgtggggctgccgcgtgggccccactcccgtggacccggtccgcgcgcccctcccctcggctgacgcaataaaccttttttttaattaaaatttaaatgaagaaattcgcaaatattcatttaaagagcatataaacttcaaatggccataacttggccatttgaactcggaattggaccgttcaagtctctaatttttccttaataagtcaagaacccatttttgtgctttgttcctgcttgttatatggagtttattagagtaaaagccttttctttttttcgttggtcgtgtagacgccgcagcttcggaagatccgctcttcgtggaagttgaagccgacgtttgggaaagcgagcaaggcaagtcacatcatccttgaacatattaaatcccagtttataaaattattttgatttaaattattgcattatcgctttatttaaattcccgcgttatcactgttttatctagccatgcctatttacctttgttatgaccttattatttttattgttattatttccttgttcaccctagaataaacaaaaccccaactagtagacactctactcatggtaccactagtataattttaggtagatgcttcgctaattaattaggtaacattaggtggttttacaactctagactttgggagattcatatcacctggacactatggaatggtttgattattgtggaattggattcacacctcaccctctattcaaaatctccaaaatggttttaggctgggctcggggtgcatggttttgatagtagcacctcggccatataaggaccggt

SEQ ID NO: 21859 - DNA, 824 bp, Oryza sativa
gataattaagtaggtatgtttaaccaaaatgttgcatgcttggtgtgattgatttaaaattcatacatcacaaatccggtttcttttgtgctggtccaaaattcagaaatatcaagtaggagtatatgattgtaacttttgttgttatatttggaaaaaaaattgcagtacaactacaaagtagatctaattaagccagttactcgcaaggtgcatttctattgatattgaaatagtgcaaaattgttctacaaaactgctgtctgtaaaatttcaactacaggttcaattcgtctcaatgactccaaaataaaattcttgcaaacagtaggatcgaagaaaaataaaataaaaacttgctagacacaacaaatcttattctctcccttcttttcacacttgatgtcaaataagttggacgtaaaatcttacagaattatttttctcctcaaactagcttggttcatatttttaaaaaagaacatgatttatagcaccgttcaacataaatatggtatttagttgtattccccccttataccatactaagttcgaattaataatctgaacatgaataaaaacagtagaaatatatactatgttgcatctctgcatatggtatagcacatacaccggcggatccaccgcccagcgacccgatcgagcagtcacccgggcttatcggtggaagatccttttgaaattctatgcaatttaacaaattgaaattgaacattataagcaaatgttagctataattaagtatgtccaaggctttaaaattttactgagcacatatcatatataaattaaattaatgcagg

SEQ ID NO: 21860 - DNA, 512 bp, Oryza sativa
gcgccaaaaatgaaaagattttggatggatgagacatttcctagaattataaatgggacatggtgattaattaattatgtattagctacacgaattaaaaaatgtattataatgattttctaaaactactttgttatagaaagttttttaaaaacacgcatcagagaaacgtgtgtgtgggaaacatggttggagaagtttgaaacatccactacgaacgaacttagggtttgtttgggagcttttgacaattacagttttttttaagaatcagaagctttctcaaacagttcagattttaagaagttgtagaatctagtaaataaattaaaagttagaaactgaaaaacctaatttatgtagatttttagaaactgactacttaattaactgtttcttcgaatcaaagtgcggtgccaagcttccgattgttcacgatagataccccacataatccctgtagagcaaattattgggattggatgcctggatctgatcgaaggacactacca

SEQ ID NO: 21861 - DNA, 217 bp, Oryza sativa
ttatgcggcaaaaccgaagacgctgaacaaatgggtatctagctcacacacgtaaacatattagaagaaagtagtacagttttagttacacaacgcaatagaccagacaggctgttgccggggtacaaggaacaaatgggtatctcgtggatgtcaagaagaagatcgaacatgtggactgaaattatataagagcagatcgtcctcactcctcaga

SEQ ID NO: 21862 - DNA, 1501 bp, Oryza sativa
acttgtttatattgaagtgagtaagtgtagtacttgactaacatttccatcatcatttttgtcatcaacttctggttcatctggttcatccttgaattgaactttcttggagccacctttcttccttactttttggtcatcagcttcctcaaaaaaatccttatacctggaaaaatcatctttgctggtcaaagcataatactataaatgaacaaatattaaatacaaccgaagtctgggcataacgattaagctttgctgagtcaatacaacatatggaaacttctgtaaaggctccactggacaaatacaaggcaggaaagaatgatgtaatgcatttatgtgcatggtgagatcttggaattgtctaatcagatctcttatccttccagggacatttgcagtggctaagaagtagacagaacttacagctcagttttgcctaggttatatgctaaaaagctgtgttttttagggtgatattgtgtctcaacctttttgtacatgacatataaacttgtaggtatcctttgctattatcctatgagttatgcgaatgtggcagtttttttcacagcattctattcccacattgccacacgtggttatacctatattttagtgttcaacaaacttcttctttgccttatgcttaatctaattgttttttcataaatccattttcttgtgctatcatcatttttttaacaatttacatgaaaatgtaatatgtttgtcttacatacttaatgttttctaatttaattgagtccattccatgccattatttggagcccattgttttcctactccatttgcctttgtatgcccttctctgagctaaacaggtcatattgtatgacagttaacttaaacagatcaaattatgtgtcgagcatgaaaatgataaaataggaaaaggttgtgaagaattattcaagtgattctacaattcaaatttataaatgactaccatttccatttctacgaatatcataccgatcttcaaaaaagcaattcaaatgtagttaaaaccatttgatatcccagtatataatcacttaaagataaaaaaacactgtgcggaaacccgaactgtttcgcattctgtgattctatcaatcatgatatgagcattttcagaaaatagcataaaggcttacattatatctccaactgcaccctcttcttcttcttcttcatcgtcaaagtcttccaactatattaataaaaaacgatacttaagaatcacatttagcaagcatgcatcttgcattaaaccatacccaatgctagctcccaatataagcctattagctcaagcgggaaactgttttaaaacttaatccatatgctcaatttcctgaggtaatacagatactatcttttgcgactacagaaattccggtgtctactcctgagatacttctagatcagtggttctatatatcaatcttctttatgagagctaatactggtctctaagaatttaacaagggat

SEQ ID NO: 21863 - DNA, 1501 bp, Oryza sativa
attcctgaaactatctaccacttctccctctcctctctctccacctcattcatgcatgcatgctttttagtgagttttaaaatgaattttctcaactaattatccaatctacgatctgatcacaccttgtattctttgtaattaaatctttacaataagatatcacaatattatattatggcgaaaaaaatatatgtttcaatccattaacactcattgtttcatacgtgatagtgaaatgtttcaataggtgtcgttagtatgtttcacaaaattcttgaaactacctgctgccactactctcactcctctctctccacctcatgcatgcatgcattttagcgagtttcaaaacgatttttcttctaaactatttatccaatctatgatccgatcacaccgtgtatttgttacaattaaatctttacatcgagatatcgcatgattatattttgattaaagaaaaacatatgtttcaatccattaagattagctattttaattatatgcaatagcgatatgtttcaacgtgtatcttcaccatgttttgtaaaatttttaaatgttttagttgcttttttttcaccatatataacatgttttactcgttagttaatagaaacatttgaccggctgattttttccgggcatcgggcgcacgatgggaagattcctcccatgagagcgaacgtggaggcttctttttctatttctttgataaattaatagatgtttactagtactccccgttgaatagtcccacattgattgtggaagggcaaagcacctaagatataagtggaggagcccctcatctcaatggctaccttttggggtggaaaaggccttttatgatcctacactctctctgtcccataaaaattttaatcttgagtttaaatctggacatacactacatccagatccaaatcaacaattgagttttttatggaagtaggttgcacgatggcacgatgcatttttggaatgcaatttgcaataattatatcagtgccaaatcccatgtgtcggtatgtgtagtatatcaaactagaagccgatattactaataaacaagttgacagtaacgtacactattatcatgcttgatccatatttttcggagtaagagtactccataatgttatcttctgatcagtatactacgtgtgacgacgtcatggtaagcatgaatacttttgtgcaagctaacgctgagcacgatgtgcactaaaaaaaggtcatatatatatagagagagagagaggtgtgagaacaactcaattaatgccaggaagttagaatgtcattatcagtttttgaacactgatcatgacttcccgatttgtgtctcttcttttttcgcgaacgcgtaaaatttgtgtctcttcacctatatgtatattgatttgcactactctacacactgcagagtcacaagatcacataattttgttcattgctgtttagtgtggactcttcatggcttcctccttccggc

SEQ ID NO: 21864 - DNA, 648 bp, Oryza sativa
agtgttggcttggatttactgctcatctggaagccatttcacatctgcaggtgagttcccagatttatgaatctatcagcctggtagcacaaatagaaaggaaaggggcatttattttcagcagaaatagaaaggatggagaaaatacgtatagtcgaaagtgattaatgtaaaagttcagctgtgttgaatgaaatatatgatggcaggtgattttaatttcaggattcggttcaacttttttttcctttttctttttcaatttgtagtttgtagagccttgattattcaggtttacaggatgttatgtttgtttacatcaaaataatctctctcaaaaaactctggttaggtaatactttagaatttagaaattaatgtaccattatatactagctaggattcttggaataagactgagatggggagtgcatttggcttttgcaactccctcatttatcgtgagcatactttttaaactactaaaaaatgtatttttttataaaaatatctcatacagaaattttttgaataatcaaacaaactatttcaagtttcaaataattaatacttaattaattgtatattaatggcttatcttgtgttgagtgctggaaaaaaatccctatccaaatgcggcctaagcca

SEQ ID NO: 21865 - DNA, 511 bp, Oryza sativa
agcccgtcacaaatgaccatcatctgtgacatgcaccatcttgaggcccgtttaagataacaactaggcccgttacagatgactcatcagtgacgggctatatacttaatctctatcgggcatgaactaaaacccgtcaccgatgactatttttccatttttcatatgaaatgtttatatttgtaagttaactatagcaaaataattttacgggtagtaaatgatttcaaatggaaaaaatgtcaacaataaagttgtataacttatcaatatttacaacttttagtttggtcatttttcaatataacatttttttgaacaatttgaatttgaatttaaaaatatgacaacttcaaacaacattttcaaatactaatgatttcaattgaaaaagtcatcaacaacaaagttgaataactcatcaagatctaaaacttttatttttgttatttcttcatctgacgaaatgttagtaatattattcacaaattttacatatatgtgttatagt

SEQ ID NO: 21866 - DNA, 402 bp, Oryza sativa
tagattaatcaggcttaaaaaatttgtctcgtgaattagcttttatttatgtaattagttttgtaagtagtctatatttaatactctaaattagtgtctaaagacagggactaaagtcaagtccctggatctaaacaccacctaagaaatctgtaactagaagttttatttgtgataccgtggaaatcataaacatttctattctaagagtattttccagctggtttccacatatatatatatatatggtttcacaacatgtttccccctttctctcccacgtgttttactcgccgcggccaccggcggcggcaccttggctgcttatgatttggtgagactcctgttgactattatatatagttggttcatttgaccacgtcatttccttgggtcatcagt

SEQ ID NO: 21867 - DNA, 1501 bp, Oryza sativa
tatatatagttttgtgaaatttactcgaggaatttatgaatatgcggtacgagtacaaaccggaccatgggcacgcaccagtcacttctctgcaaagtgccaaaaagacaaaatgtaatcttaacctccggtcaatattctcttcaggccgtaggctccactgatcagtgatcacacagagcgatctggtcctctcgatcagaccacgagcattgttgcaagggcaatagtatcagagtacttcgaagtccgaacttgttgttctttctcctttgaccagtggctgacgcttcgtctgtcctcggcgtcaaaaatccgataccataaaatcaccgagctataattcagaaatttttcccacgactcgaacgatttctgactttctgcgggtccaagcagttgcgttacgtcaggcgcgccacggagtggcaaaggaggaggatatcgcgggaatcgcacggcggaggacgccaccaccactaccacggtctactgcgcggacgccagcctcgcctcgcctcttcccagttcgcactatcgcttgctttccttgggcgtcggtccagccaaacccacaaagcacaggcaggcaggcaaacctgtgaagtcacgagtttgcccatcggtggtcacaccgctcttgcctcctgctgctaaatcttacagcatccgtaagcattttccataagcgtaagcatgagcatttccgctactgctctactcgctagcagttatgttagctagtggcagccacacgacgcgtcgtggtgtgacaactttacgtagatctggatcgatcgcttgaggagtatgcgatcgtttttcgtttgttgcactccgaacttgttcggtgccatcgctggctttcggctaaatggctggatttttaagattgtcgtttaacaaaaggcttgattccaagttccaacacagtgaatttgccctatacaaaggcaatgctcttttctttctcatcactatgatccatggagagcattcgttccgatatgctgtaatctagaatttgactagatccatcctaaaactataaatctggacataacgacctagaatagaattaaatccattctactctctcttctaaaatataaaaacctagcacatgattgatcatattctagttctacatattctggcaattattcgttatactaagttatatctaatccaatacaactgtacatggtaactatatttttgagatggacatattatggtgattagatccatcctggtttgttacttaaggacggtgggagtatatttgtcaatgcaaaattacgaaacgggcaggattgtaattgcacgtgaatagcggcatagccccacaagtcagcagcccgtactcccatgtgcttcgcgccctttgcttcatatatacccctggcacgcacttacacacacattcgctccggagcgcagtacgtgacacccgcacacgaagccatgggacgccgcgcgcgcgctctcctccacgcgc

SEQ ID NO: 21868 - DNA, 1501 bp, Oryza sativa
gttgctaagcgcaagaatagcttataataactgattttgcacagaaaaagatctggtatactctgtaacaagacttgagcgattttgggccagagattgagacctcagtgctggaaaggagctccggcctacgtacggcctgtacaaattggcccagacgggactgcggcctcggtgctgcccataaggattggcccagactccagaacagggttacggcactggaaataagtctatttatatccctcaactcatttatgtggttgaatcgcattcctcaaccgcaacaccgagtataacccgtccaccaaatcccaaaaccgttgcaaattgactcctaggatggtttcaaaggcagttttgtcccacatggcatatttggccccgttgatttgctgagtcagcttgtgaaacccatatgtcaaagacaagaataaaaatgaaaatggtggggcccactgttgcccaccgccgtcacaagcgttccccacacattgccttcgccgcctctaccacatcgcatttgccgcatttccccctccaatcccgcaatacgccaccgccgtcgctggtcgatgccccctcctcccccgtcgctgccgtagcagcaatcggggatgacgtcggcggtagcagtaggcagtgccaatcctccaccccacgtgccaaaaccctagtagcaccccacgcggcggccacctcctcctcccactcatgccagccgtcaccgacgtctcttgctgcggcttcgtggaatcagtttggtcattgccgtagcacgcgtcgatgccaccaatgctgtgggccaccatcggccatccatatgtgttgcgtgcagacggaggtgcaggaggaagagggtgacgggagcatgatccggtccaactcccccatctcccgttacatcgtcctctccttcctcaactccggtcactactcactagtcactactccatcctcttttcttctcgacggctggcagcagggtggggtggtgaccaacgagatggtcggctagaggagcgagagaagggcctagagaagaaaaggaggaggcgaggccaagccccaggatagggttgcccatggtggcgacggaggcggctgctgcggcgggagggaaggggaaaggggaggggggaatgcggcgacggcaatgccggagaggcagggaagacgatgtgcgcaacggcggtgggcattgacagtggaccctactgttttcacttttatccttgtctatgacatgtgggtcccacaagctgactcagcaagtcaacgggtcaaagatatcacgtaggacaaaactgcctccaaaaccatgtggggagttaatttgcagtggttttgggagttggaggatgagttatatccggttttgcggttaagggatacgattttcaaccagggacatgacttaagggaggtataatagacttatttcaaacggactacgtgcggcccatatatgttggtcgggaacgtgattatagactacgtg

SEQ ID NO: 21869 - DNA, 1501 bp, Oryza sativa
aagtgtttaatgcaggcttcaaggaaaggctgttgtttttgcaattgattttatttgaactcttttctgaaagcaactaagtgagtgcttctcaaacgacatggatgagacagtgcgtctcgtccggtcggagtatgtgcaaatgtatcagtctttagaattgatcaagattggcacccggccaacaactttcaaacggccacccgggccaacaactttcaaatggccacccgggcctagctgatcccatcagctgcagattttccaaataacgatccccttttcacaacagcaatttcacaaggcagtagtcaaacaacactacgctaggaatcacctcacatccgcccatgaccgtgggcacggctgttcgaacagtttgttaacctctgtagagggggcacactttacccacacgacattactaacccggatcacccagcccgtggggatcagccacgtcgggagacctccaagctttcatgacaaggcatttcgtatgccgacacaggtttaccatatgccgacgagaggggtcccagaccaacaacaggttaggtcccagaccatactgtgccaggaagcccaggggtcctccccgacaccaccccagtgaatccacatgtctctcggcatcaaggctcccctgataagctagttactcagccaggggtgtctcattccacctatgtggtcgtcttgtcttatgttcggatgaaattccaaggaaacggtccttaagtgcaagagcgggaaaccatacacccggtacgttccccggtccgcggttttggaaattcatttagttcgcaagcactgacccaggtgtcgggttttccaagccttttgtaaaacccaagttttacccaagaagtttttcagattttaagtttgaaggcgaccgtcgatactcgcacagggtgcacgaatatcgaggcgcaactagatggttacaaggggacatgatataacaattaacaaaggaatgatcaaatgcaacaaattaggtaggtccgccaatctgccttgcagacaggacaaacagattaagtgcaatcctatcaatgcataatatttttcaagcaacataattaaattcaaatataggctcaagatgttcaaaggtggcttgccttgctcgagatctggagcttgatcctcgaaatcctcgcactgcgggtcttcgggctccgaaactatacgcaaaacgggacaactcaacaaacggcgaaaataaagccctattaatgacctctaagcatgccattagatagatctcgagatttgaggaattttggaagttgaacggagtcaaacggacttacggttgggaagatattgaatttctaagattattggttttttggtctaaaagaaaaggatttattaaatccttttcgaaaaagaaaagaaaagaaaagaaaagagggagggaaattagacttccctcgggcggctagggcgtggcccgagagaaaagcggcggctcggctgagctaaa

SEQ ID NO: 21870 - DNA, 1501 bp, Oryza sativa
caagttataggtatgctttaaaatactactacatacctggctgaaactgcactgcttctttttattgtgatggtgaacttcggttatggcagaatgtggaggggcattatttgtggcaacctttaatgcatcatactagtcatactttgatatatttgtaggaactttgacctcctttttcgttgagcattactcgatgagcaaattatttcttggtaaatttgtaaagtggtcctttacattgtatttgcttcaccacattagtatgtgaccatgtttattcaatcgtaggtgtttccttgtcctgttggtgcatgttctgccataagtccgtgacaaattcgtggtttacactgttaaattaatcattttttcaagctgaaaaggcaccatgttaagtttgctattcagtgcaatactagattcactgacaataaactgttgtcttgtactctgttgtgactacgaacacttggtgcaatcgtatagatgctgagatagtgattcgtaggtgtgaccttatgtttagtcataatctatgaaaaattccaagaaatgatactattctgctgcaatttctacatttgctcataaaaaacattagatttcccctgcagcaattaagtgttgagctatagatcatctctattaaagtgatcttgcattgttcagtcctaaaagttagtgaaaatatgcatatgagactatcctttgatccaataattcttaggttgccaacgatgagcatagaagaagctggcttacgtgagatgaaaatgatggagaaatggcaagaaagaactgccaagatgattcaagaatcaaactccgcatggcacaaggatggcagtcggtcagcccaagaggacgaggacgccgaagaggagaaagcgagaggatgggatgactggaaggacgataaccctcgtggtgcaggcaacaagaagctcactccctgtggctaaattatatgctatggcaattctattgaacttacatctgaaactgaagctcgtgtaaaaatatgtggtttttactaactttccttactgcggcatttgttgattgctgagtaataatgtgttccatatgtatattataattgtgcatggtttccttctgccaatatatgggcaaccaagtaatgccagaaaagctgatttgagaagcaaacatacttgctcggtacaaggatgtcacactcgtcagccacgagcccaaagggtagatcacccaattgagcacgttggcttatctccatatttttctcaagattaaggtgtctccttgtcccatatttggtaatattcatgggtgattaagacgttgcgaaatgcttacggaacttcaagtagtcttacactttggtgggtttgcagggggcacgaagaagacaattatgtgatacaaaagccaaacaaatgacaaacccaacttatactgctaatcgacctgttattactcgaagcaggttgcaataatttgattcatagaattacag

SEQ ID NO: 21871 - DNA, 1501 bp, Oryza sativa
atggtatcttctgatcagtgtagtgcatatatactataaaatgggcaagataatgcatcttgctaagagctaatccactcatcaatgtcatagtaaaatacgacgcgttaggttgccagtcatattttgtcatagtttactatgtccaagattatataggtttcactaacttagcaactactccattcgcttcatcttatcaatcgttttgacattttatcaaatctacctataataataattagcaattacactaaattagtttcattaaatataacattgaatgtgttttgatatacatcgttctcacatttgtcatcaatcataatacaatgagcaagataataccaccatctgcatggacaagatctccttctcagctacaacatctccttctcgctttgagtgatttcgtactagttgattaactggacgaaaggggagccctcaatgctccacacgccaccatcttgaagtccaagcaaatctacgagtacttgcatgaagaccgccaagacgaccaaaattggaaaataatttggaaaagtaaatctcctccgaagattcagttcttcatttggttattatccaaagaacgcctccccacaaagcagaacctgtaaaaaaagaaaattgtttcgtccgcgaactgcgatcttttggtgttttagaagaaactgcttttcatttctgtgttgattgttcttttgctcaggcgttctggtcgaccattcagattgtcccaggactgacaagctcagccaatctcgcaagtttaggccgcctagatggcattcccatcaagcacttcagagtcttcttctttctctgcttttgggttctgtggaaccacaggcatgatgttgttttcagggggctgcaaacatccttgcgtagactagtaactaaatgtatagatgatgcaactctttgagcagagcgtttcaattcggatgataggggcattgtttcctcgtggaaggaaacactagcgtctgcttttcaaaactctgtaatttaacatgtaactgcaagtcttccttcattttataaaattcaggtggggaaactcccccgctcccccctgaactttctaaaaaaaaattatacaatggacaagataataccctccgctaagagctaaatccatatgtcacggtaaatttaaccctccgaagcattaacaacttttttcaatctcaagttgagcatcacgtgcattaaagaaacaaaaagagataaaattaatctacataactagagatgctattgttcaacgaaatcttcaatgatctaaaaaagatgctaacacctagacataataacaagttaatactaattaatgtcaacttgaatactttattattacttccggactactctcctctccgagatagtactatatatttgcacttcagctcccagtggatcaaaaaaaatacattggtcattggtgttctgctggattcattcttcatggcgccctccttccggctctctt

SEQ ID NO: 21872 - DNA, 1501 bp, Oryza sativa
gagctcgtcgccaacacgctcggccagttgagacgccttgccgagtttgtcggatgtccattcacgacggaggagcagaagcacgggtggataggaatatcgtggaggcctgcgcattggagaacatgtccggattagaggtgaatcggtcgggaacgatcaccatagtcgatagcactgtcccaaacaacacggtcttccggcgtggcgtggtcggagattggagaaaccacctgacgccagagatggcaaggaggattgatgagattacaaagagcaagtttaaaggatctggcttgttgttacatccgcagtttttacaagtaaaaagagaataaattaaaacaaactaggagtatatgttttttctttcaaaaaatagtttgtgtgccgttttcggtgtttaatagagatacaatctcttgcgtattcacgagtgaagaaatacatatatgtactggaaatttgtaaatcaaatcattgcaagtaatataataaaatgttgccggttagccgtgagttgggttgttaggttgtttggctttgtggattagtttggtgtacgtaactatcgtcatacagttttcagatcattcatcaaaattcactaataacgttcaaatgatccacactgtttcttgatatgctaaagattattaaacatcctccgaaacatttctataccaccatgtgacactctaataaattagaaataaaaataaaaatactgagggaaaaaagcaaaaaacattaaaccattgattattacttgaaccgaaggaccattcaatgtccaaaacaatttgtttaagagcagtaaaacgagctacctcaattggcatagggaggcaagcaaagagaaactgcgattctagtccaactgtccaaggctataaggatgatatgctacggacctgctaatctgctcttccatttgttttcctccaaattattttttcgagtcacatctatagttagctgaactgatcttacacttagcaactaggagtatgtcgtatatatactttattgagatgattgtccatttccttctagtctagaaagtagtttgcatgatttcatctctgaaaagaaagactgtaattcacaattacatcactaccaaacccttgtttcggtgcgcatagttaattaaagctgatcttactactagacaccatgataaatttgaccctcagaaaaaacaactttttttgcaaggtaaagtttaacccccatgttcatgaaatttctcaacctaacaccataatttgagaggagggaattaaggaatgaaaaataggtcacataagtacggatgtacagactctaacaatcaattaatggtggattatcagtaccagctagcttgagaactctgctgggatttgtctcttctcttagatgtatgtttgcaagttacatctcaatcatatattgtcaggttcacgggactaagactcattattgttttcgtaggactacacacacttcatggctt

SEQ ID NO: 21873 - DNA, 1501 bp, Oryza sativa
cttacaatatttctatatatttttataaattaatcaaactttaaaaggtttaactaaaaaatcaaagtgacttacaatataaaatagatgaagtattatttttgttaaaaacccccgttttagcatcgatcatttcaaagatcatcgttttttgcgagagaatatatgtgtgtggaagtttttgtgtatgtgtgtgcgtgtgtgtggaagagtgagtgtgcgtgcatgtgaacaacacttttttaaggaaagtgtgaagaacactatgtgatgaatctggtattaacccttgaaagttgtgaattcacttatggttaacatattaatcagatgaaagaaaacttatagttatgagtacacttgcacacaaatttgtgtttaatagttgtaataaaatttatgttagtaacatagtatgctagtaacacgtactgtactaaactctttcatctagttatgagtatcttttattagcagtagacacgaattatcaatttatcagtggagtatatgttagtactaacatgctactagtacatgaattctatgtttcacttgaacaaaccacatattcatggaacttgaaagaaagaaagaaagaaagaaagaaagaaaggaaaaaagcaactaacttatggtgatcacctttacaacgaaatggcagcattctgcttccattacccaaaaacaaaatgtttcaaacaacatgaagaaactttctttccatagactaacaggaaaaataactcaaacatctctttacatgtataattgttcaaactgctaagtattgccaactgctccagacaaaaagatcacaaggattcatttctcatccaatctttcaaactactaactaagaagccacattctattgtgtggccatttacactattatgtaaagagatgttcttttctttagggtctcaccatctacttccttggtagccctcaatctggtttctctgtctactgtttctttgctgaatgtacccaccactattccttttccttccagatatgctgcttgggtcctggtatctattcctgttgatcccattgaagctagccctgttatttgatgaatgatgattgttactattattccaattgccccaactagaatccgccaaggcactaccccaaccagagcaatttttactccactcattccaagattcatgctttgttccccagtccatgttggatcttgaatcttgctcccacttgttaacttcggtgggcttttctacatagatgtcccagtttctagattggttctgcctctgctggcacttgttatctgtatcagtgctgcccaatccatcagctgggagtaactcatcatccatctcgaatggtaaccgtaccatattcaggtcagctatcaactcagggtcgatcttgctattgtggtcaaccttgtcaatatacatatcagggtctggcaaagatatgtctgaaggttgaccatggtaattagcccagaatctagcctttg

SEQ ID NO: 21874 - DNA, 1501 bp, Oryza sativa
caccaggtagcaactgacaaacattggggtcaatctcgttggactatggaatactactatgcatggaacttttggcaagcttattaaattatggttttttaaaaaaataatatagaaagaagagatgtggaccatgtggtacctacttagaatgagaaaatatatgcagtacatactgttaagtgatactaatatcttagcaatttttatgcggttagcatccttatttgctaaggtaggacacaggttctagcaaacccaactgccctgttggccagaccctaaatatttgttgtgaaagattatgggtttaacaagggaagaatcacattatatattctacatttcagccgggttatatattctacatttcaggcagatgcacatttcattggtctgtttttctttattagtatagctgcattgtgtttccttttcactagggtttagccggttagcccaatggcatcataactagcatttgatcagaatgaaattttgttaattcgataaaattggtaacgcttagtaccaacagcttaagtgatttcttacttgttacatggtacgcatcatccacaaccacaaaggcacttagcacagtagcgacatactgtagtaaatactcactttctttttctaaattaaaacttatccacaacatttcgcattgcaaatttaaaggtgcaataaaggaaagcacaaactgctaccagaacgtccctgatccggagtccgggaggggaaatatgccagcgtcgcggtgtcaatgacgcggaacccagagtgctgctactcctgcacgggtgatagccgcgacaggggagccggggtccaggcgcaaatacaccaaggactccgcagcctcccgcctcgatctggagtagagaagcgagggctggccggtggagactggcggacatcgccgccgccgccgccgaacggccgacgcgacatggcggatcagtgtggggactgggaagaaggagaaggtggccgaagcctttgcgtatggttgattgggcctttggggcttggagcccataagaactggcccgtcttggcattgttagatggaaaaagtacaccgaaggtccctcaacttgtcagcgggatacaaaatcgtcctcgaaccgcaatacctgatatccggcgtcccttaactaataaaaaccggtcacaataagtccctcaacggttttgatcccgattttatcatatgtggctgctgagtcagcgtgggactcacgcggactcacgcgaaccccacatgtcagtatatccacgtcagcctcctctctctcttccccctcttctctcccttcctcctctctctctctctctctctcaattttctctctggggctctgggcagggcaaccagcgggtggggaggagactgacggggcgaggcgggagaggaggtccggcagccggcgacgcgggagcaggggagcattttgcgaccgttttcttccgctgaatctggtatttgcggcaa

SEQ ID NO: 21875 - DNA, 1501 bp, Oryza sativa
gtcagccttctcaaaagatccctcagttacatgggaagcacactcatgcaagagagggacgagctgcgctaagtgatccaccacaccctgatcttgcacccatagcccatgcatcattttattttctgctctctaggaaaagattggcgcggtcaagtaggaagtattgtttggctgagtttgctggagtaactccaattttatgcacagctacatatgtgatacataaggaaagcactctaactcatgtctttaactgatagaacaaaataaagatttttggttttatatagaattacattaggcaatttggaaggattcacggtataggcaaagttttacatgttggcatgtccgcaatgaaaggaataatataggaatgttcagtttgttctgttcgaatttgtccctttggtttcttcatatccaccaggtagcaactgacaaacattggggtcaatctcgttggactatggaatactactatgcatggaacttttggcaagcttattaaattatggttttttaaaaaaataatatagaaagaagagatgtggaccatgtggtacctacttagaatgagaaaatatatgcagtacatactgttaagtgatactaatatcttagcaatttttatgcggttagcatccttatttgctaaggtaggacacaggttctagcaaacccaactgccctgttggccagaccctaaatatttgttgtgaaagattatgggtttaacaagggaagaatcacattatatattctacatttcagccgggttatatattctacatttcaggcagatgcacatttcattggtctgtttttctttattagtatagctgcattgtgtttccttttcactagggtttagccggttagcccaatggcatcataactagcatttgatcagaatgaaattttgttaattcgataaaattggtaacgcttagtaccaacagcttaagtgatttcttacttgttacatggtacgcatcatccacaaccacaaaggcacttagcacagtagcgacatactgtagtaaatactcactttctttttctaaattaaaacttatccacaacatttcgcattgcaaatttaaaggtgcaataaaggaaagcacaaactgctaccagaacgtccctgatccggagtccgggaggggaaatatgccagcgtcgcggtgtcaatgacgcggaacccagagtgctgctactcctgcacgggtgatagccgcgacaggggagccggggtccaggcgcaaatacaccaaggactccgcagcctcccgcctcgatctggagtagagaagcgagggctggccggtggagactggcggacatcgccgccgccgccgccgaacggccgacgcgacatggcggatcagtgtggggactgggaagaaggagaaggtggccgaagcctttgcgtatggttgattgggcctttggggcttggagcccataagaactggcccgtcttggcattgttaga

SEQ ID NO: 21876 - DNA, 1501 bp, Oryza sativa
ctactctataataaagagacctctattgctgtgatattctgtcttcctgtgataccagcactgtttcctgggactggtatcgattaacaggttaatttggagcgtcacgggctagttccggtcgggactagttcggggcgtgacagttggacaaccaggatggcgattaggcgctaagcgaggttgggtgacgccggtcctcactctcgtctttaatacggcgggccgtgctgtccttggccctctgcctcccccatgccccgcctcaacctcgtcatcgtcggctttcacctccttacttcctgaggccgaagctcgagatggagagaggtgtcatctttgggccaaagctcgagatgaagagaggtgtgtcgtccctaccgtgtgctccggggggtggagagagaaggttttttctttttttatatattttcatgtgacttatatgtggggtccacgtgggtcctatgctgactcaggtgttgtttgttttagcttaagattattgtaatctagattattaagccaaattattttaagctggattataataagccgacataagataagctgttagctgtttgtttctctggattattagttggttgttagttgttagccacccaataatctaaaaaagcacctttagagtggattatcatattatagtaatctggcttatagattgtaataatctatcataataagttatctgcttatttcagcttactcctaataatccagattataataatcctaagctgaatcaaacaggacaggttgactgtattcaacttgccacatcagcgaaaccagtgctgaaggacctaatttaacccggtttaagttaggtgataataaaaatttcttgtattgcggctcagggatgtgacttaaactcgatgaaaagaaaattgtagagacgtaaagtggagttaatccaacgtgcttattatgggggttgctacggcgcgcgtgcgcgccaagaaagggagttggcgagcacttcctcccctttagtcttaactacatatattagtcaatatacttaacactaatgatactaattaagaatatattctggagattttttgggagatttttttctaacagattgaaaattttttaagttagatttgaaaactttcgatttaagttttaaattttaaagtcaaattttaaaaacattcaactcagatttgaaaactttcaactcgagaatcgagattcaaaaactttcaagtccagagttgaaaaatttgaaaactttcaacttgagatttgaaaactttcaactcagatttgagaactttcaactcgagaatcgagatttaaaaactttcaagtccagatttaaaaattttaaaaactttcagtttaagatttgaaaactttaaacttaagatttgaaaactttcaaatcaaaattttaaaactttaaaactcaaaacatgctaaaagattaaaaaaatcagaaaaagtgaggaaagaaaacgaaaaa

SEQ ID NO: 21877 - DNA, 1501 bp, Oryza sativa
cggctcccctgtcgcggctatcacccgtgcaggagtagcagcactctgggttccgcgtcattgacaccgcgacgctggcatatttcccctcccggactccggatcagggacgttctggtagcagtttgtgctttcctttattgcacctttaaatttgcaatgcgaaatgttgtggataagttttaatttagaaaaagaaagtgagtatttactacagtatgtcgctactgtgctaagtgcctttgtggttgtggatgatgcgtaccatgtaacaagtaagaaatcacttaagctgttggtactaagcgttaccaattttatcgaattaacaaaatttcattctgatcaaatgctagttatgatgccattgggctaaccggctaaaccctagtgaaaaggaaacacaatgcagctatactaataaagaaaaacagaccaatgaaatgtgcatctgcctgaaatgtagaatatataacccggctgaaatgtagaatatataatgtgattcttcccttgttaaacccataatctttcacaacaaatatttagggtctggccaacagggcagttgggtttgctagaacctgtgtcctaccttagcaaataaggatgctaaccgcataaaaattgctaagatattagtatcacttaacagtatgtactgcatatattttctcattctaagtaggtaccacatggtccacatctcttctttctatattatttttttaaaaaaccataatttaataagcttgccaaaagttccatgcatagtagtattccatagtccaacgagattgaccccaatgtttgtcagttgctacctggtggatatgaagaaaccaaagggacaaattcgaacagaacaaactgaacattcctatattattcctttcattgcggacatgccaacatgtaaaactttgcctataccgtgaatccttccaaattgcctaatgtaattctatataaaaccaaaaatctttattttgttctatcagttaaagacatgagttagagtgctttccttatgtatcacatatgtagctgtgcataaaattggagttactccagcaaactcagccaaacaatacttcctacttgaccgcgccaatcttttcctagagagcagaaaataaaatgatgcatgggctatgggtgcaagatcagggtgtggtggatcacttagcgcagctcgtccctctcttgcatgagtgtgcttcccatgtaactgagggatcttttgagaaggctgacttcagctttaagaagatcagaatgctcaccatagctgacgggccattgcagcgcctatccacgatcattgttgacagcctagctcaccgccttctctcctccatccagggccttcctggtgcccttatcgatccatctgattactttgagaagtcaaccctccgggctgcacgccacaacttcttcaagctgaacccctacctaagcaccggttttgtcactattaactgggccattatggagg

SEQ ID NO: 21878 - DNA, 1501 bp, Oryza sativa
ccgtggcaattagagagcagcagactacatccaaatttcccactctgggtgctctgttcagcatatgtctggcagctcaaggtacaagctgataatgtgtgtttgcagcaagatttgactcctgcactaaagatatgctaataagttcacttggtgtaaaaaaaaaaggatggtataggtaggacatagaaatatcttttggtgtgaagtatgtaaagaactgaaaggtctgtgttttttttttctctttgaaaattggaaccaacgaaatgggattggcagagatgcttaattcatcatcgatccttgaatgattacccatcatttcgtagttttctctgtttgcaaaatgattatgtttcttagaaaatggtacttatgtttcggcagagtaatctcatatccaaagtttatgcgcctgattaagaggctgagaaactcctatggttatgtatgcaaattaatctcatattcctagcttttcctgcaaaaatagacgagaaaattaggtttggaggtaaaagaacaacaacagcttgggtccaaatgcgaacgtttgctccaagaaaggccccttgcaatcacctacacttcgacgtttgcaacttcagacaaaaccaggttttgtttggactaagaacgcagattttggagctattagtttcattgatcctgtgcttagtcatggactgcaatagactgggagcacaaatagaaaaaaaaaatcgtgactgcaatagactgggagcagaagaaattgatctcaaaattgtcagatagcatctgatccaaatgctggagataaattccaagggaataattccaagctccttagttattccaccaagatacagacgacatctcttagttctatccgaagaagcatccacttcttctttgtcccttcgtcgtcccatgacaacttcgtcgcacaggaacacctgaccttgcaacatttgtctcaaacccaacaatggcgacatgccaatgatgccattgcttgataagcttcacggctctgaaaactggtagcagttgaggctgtgctgcacggacaggggcatgttccaggacgacatgctgtcgtcggcgacgtcatcgccggcgtcgtcggtgtactcgccgtcgccgtcgccgtcgaacgggtcgtgggtgcaggagctgagccatgaccagcagagcgttcggctgatcggcctgctttaccagtgcgccgccgaggtgtccgccggctccttcgaccgcgccaacctctgcctcgagcacatcacgcagctcgcgtccctggacgcgccgcacgcgctccagcgcctcgccgccgtcttcgccgacgcgctcgcgcgcaagctgctcaacctcatcctgggcctctcgcgcgcgctgctgtcgtcggccaactccgccgacgcccacctcgtccccgtcgcgcgccgccacatgttcgacgtgctcccgttcctgaagctcgcgtacctgaccaccaaccatgccatccttgagg

SEQ ID NO: 21879 - DNA, 1501 bp, Oryza sativa
gtttaatgcaggcttcaaagaaatgccgttgtttttgcgattgattttatttaaactcttttctgaaacaactaagggagtgcttctcaaacgacacggatgagacagtgcgtctcgtccggtcggagtatgtgcaatgtatcagtcttttgaattgatcaagattggcacccggccaacagctttcaaacgaccacccgggcctggctgatcccatcagccgcagattttccaaacatcaaacccattccacaacagcaaatttcacaaggcagtagtcaaacaaaactacgctaggaatcacctcacatccgcccatgatcgtgggcacggctgttcgaacagttttaataacctctgcagagggggtacactttacccacacgacattactaacccggatcatccagcccgtgcagaacggccatgactagagaccttaaggctttcatgacaaggcatttcgaaagccgacacaggttcaccatatgccaacgagaggggtcccagaccaacaccagattaggtcccagaccatactgtgccaggaagcccaggggtcctccctgacaccaccccggcgaatccacatgtctcttagcatcatggctcccccgataagctagttactcagctaggggtgtcccattccacccatgtggtcgtacttgtcttatgttcggatgaaattccaaggaaacggtccttaagtgcaagagcgggaaaccgtacacccggtacgttccccggtccgcggttttggaaattcatttagttcgcaagcaccgacccaggtgtcgggttttccaagtcttttgtaaaacctaagttttacccaagatgtttctcagattttaagttttaaggcgaccgtcgatacccgtgcagagtgcacgattaccgaggcgcaactaggtgggtacaagggaacatggtataacaattacaaaggaaggatcagatgcaacaagttaggtaggtccgctaatctgccttgcagacgggacaagcagattaagtgcgatcctatcaatgcataatatttttcaagcaacataattaagttcaaatataggctcaagatgttcaaaggtggcttgcctcgctcgagatcttgagcttgatcctcgaaatcctcgcactgcgggtcttcgggctccgaaactacacgcgaaacgggacaactcagcaaacggcgaaaataaagccctattattgacctctaagcgtgccattagatagatctcgagatttgaggaattttggaagttgaacggagtcaaacggacttacggttgggaagatattgaatttataagattattggatttttggtctaaaggaaaaggatttatttaaatcctttttgaaaaaaaaagaaaagaaaagaaggagggagggaaattagacttccctcgggcggctagggcgcggcctgagagaatggggcggctcggccgagcttaatgggccggccggcccaagaaggcggcccaaggcg

SEQ ID NO: 21880 - DNA, 1501 bp, Oryza sativa
gattcggcccatcgaacccgagggaagcaaaatagacttttgcggagggatttgatttgggaaggatttggattcgggattgaactcgacgatagatcagagatttgagatctgagatgacacggacactagacaacaagcaaagaaacggatttcgcaaataaggtttttaagagatagttttcccgctagacgccacgacggaacgggcgctacaccaaccgcggtatacacacaaagtttatacatatatatacagagtttatacgtatgtatataaagtatatacatatgcacatacatatagagaggagagtctaggggggaaatccaccgcgcaggcgtgcgaccacccgcacagtagcttacagacacacatcttgtagcagcgttctggtgccatcgccgcactcttttcctacaacaaacaccttcctctcctcctgtcgcccggacgatgcccttgatccgctcgacgcatgcaatacacgacgaagaaacctagcccattgtttctccatcacaacgcgtgtagactcgcgcttgctggaggatgcactgaactactgaaagtgttcgatggtatgccttaagagatatctgatgtcctgaaaatgctgtgctggacttcaggagttcgtctggggatcggaagcaggatcatatgccttcaggagttccttcggatgatatataggtaatgaaaaaagctcgatgttttcgcctctgcatctgtccttcgcgatttggctgagtggatggcatgtttagaagcacggagatacacttcgatcagttattctcaagtttggttatggagtataccagagatctttttctgtgcaaaatcagttattataagctattcttgcgcttagcaaccatgcatctcttgaatgcaacactatgcaatctgcagttattttctcactctcaaatccatgaatcggtctatgtaatcaaactagaaactgatattactgctgaactaacaatcacccagtttggtgttttatgttgacaatatataacaggctgtctttatcatttttgatccatatttcttaggacaagattctaaaggtatcttctaatcagtatagtacgttctcacatgtgtcatcctcgctaagaaaaggggcggtaataccccctattaagagctaaactcactgattgacgacatgatacaatttgatcttcagaagaattaataaattcttgtaagctcaagttgatcatcacgtgcattgacaaaagaaaagggagattcatatgaaaacactttagagatgctaacaaggtagttaatgtcaaaatgtcacttccagtttgaacactactcatgtcctcttgacttccgaatctgtctctcctcgcctatatatttgcactttacgctcccacatattcacagaatcacagcatcacaacaccagctaacaaccattagtccttggtgttctgcattcacttttcatggcgccctccttcccgctct

SEQ ID NO: 21881 - DNA, 1501 bp, Oryza sativa
aacaatatatcacatgattatattatgacaaaagaaaaatatatgtttcaatccgttaacactctttgtttcatacgtgatagtgatatgtttcaatatgtgtctttagtgtgttccacaaaattcctgaaactacctaccacttctccctctcctctctctccacctcattcatgcatgcatgctttttagcgagctttaaaacgattttcctcaactatttatccaatctacgatctgatcacacattgtattcgttgtaattaaatctttacaataagatatcacatgattatattatgatgaaaaaaatatatgtttcaatccgttaacactcactgtttcatacgggatagtgaaatgtttcaataggtgtcgttagtatgtttcacaaaattcccgaaactacctgccactactctcgctcctctctctccacctcatgcatgcatgcatttagcgagtttcaaaacgatttttctcctaaactacttatccaatctacgatccgatcacaccattgtatttgttgcaattaaatctttaaaacaagatatcgcatgattatattttgatgaaagaaaaacatatgtttcaatccattaacattagttgttttatatgcaatagcgatatgtttcaacgtgtatcttcaccatgtttcgtaaaatttttaaatgctttgcttatttttttcaccatatataacttgatgttttactcgttagttaacagaaacatttgaccgactgattttttccgggcatcgggcgcccgatgggaagattcctccccatgagagcgaacgtggacattttctatttctttgataaattaatagatgtttactagtactccttttgtcccataaaaaactcaatcttgagtatgtccagatttaaactcaagattgagttttttatgggacaaagggaagggagtaggttgcacgatggcacgatgcatttttggaatgcaatttgcaataattatatcagtgccaaatcccatgtgtcggtatgtgtactatatcaaactagaagccgatattactaagaaacaagttgacagtaacgtacactattatcatgcttgatctatatttttcggagtaagagtagtataatgttatcttctgatcagtatactatgtgtgccatcagtataacgtcatggtaagattaatttgaccctcataagcatgatacttttatgcaagctaacacgctgagcacgatgtgcactaaaaaaaggtcatatatatagagagaggtgtgagaacaactcaattaatgccaggaagttagaatgtcattatcagtttttgaacactgatcatgacttcccgatttgtgtctcttcttttttttcgcgaacaaaatttgtgtctcttcccctatatattaatttgcactactctacacactgcacagagtcacaagaacacgtgttttgttcattgctgtttagtgtggactcttcatggcttcctccttcccgc

SEQ ID NO: 21882 - DNA, 1501 bp, Oryza sativa
ggtccaccgcgggccgctcctcttgcgccgctgactcgtggggccctcctatcggcgccggcctctttgatgacgtcagcgcgtcccttttcctttgagaaattaatcattaatgcgcaataaattcgttaataattctagaaattcatttaaacggctcaaaacttctaaaatccatatctaattcattcgaactccaaattgagccattcaacttgcaaaattcatctaaaattgagctctacatgtttgtttacttttcatgtactgtttccttggtttttattagagtttttccttggtttgcttgccagcgtgtagaatctgtcgtttcggaagatcgcgatcgcaaggataagagttcagaagattgtttgaagaagcaaggcaagtcacacattccccttaagcattttgatcctaatttacaaatgttttatcatttgcaaataaaattgcatgtcttgctaattacatgggaatagggtttacctatctgctcgcttgtgccatgtttacttgatatctgtcctttgtcaatattgggtaataaatcgactagctcatattacttatgtgacctagctagaactatatgcttagccatgcttaattaccactagctcagttgatgggataattacagtattagaccttttagtatcagaatgagctgcgtgctcgagacatctggacatgcttcatggtcgtaattatccaactaaaatacgactgaatggtgggctgtgggtgcatggttttgctagtcgcacacatggcaattaaggaccagttcgcgggaaaccctggaagaattcctcgtacttaccacaagccagcgtgggcaacgactgggcttgtagtgtagctttcctctagctgacgcatctaggcaagggtgggcgtgatggagcggggcgggccctgcgacggcctctgtcgcttccggattcacctaggcacgagaggggactgcccgttgcccgctggggacgggggtgaaacctgaggtgtggtgtgcttggctagagggggttatgcgaaaggttctgtcacggcctctttccggtatgtcgtggtggcatgtcggcgcacgggaacgtgtcgtggagctgtgtcttgtgggtaccgttgtacacctctgatcagagtaaaactattcgaatagccgtgcccgtggttatgggcggtcgaccagattcaccatgattagtcccaccttaataaaccgactcaatgcactgtagttcaggtgggttggttgggcctgttcaacgtggcgtagcattgatcagtggagatttaatgttactttaattactctactgttttactatttgctcaataaaatgtttcacaaccgcctttatgcaaatagccataaaccgtccttgtatccccttgcacgaatgcatcgttggtgtggcttgctgagtacggtggttgtactcagccttgctattattcccctttttcagaagtgtagtgcttctgagctgaa

SEQ ID NO: 21883 - DNA, 1501 bp, Oryza sativa
gaaatgagagagagaatataatttatttcccaagaaaaacacatgcatatactactatttctgggccgaaacgagttgagcatgatgccctcatcccacctgtccgatcaaataacaacgctttatattcggcaccgaaagattgagaggaaaactaacatttttcgcgggtacgtttttcaaatgatttaacagtacgtttttattaaaaaattaaaaaactatattaatatatcttttaaaatttgaatacgctaactactcatcatttacgatcttctcacatcctctcctctcaaacaaactagattcgtcgctgcaacccaacggtctccgtactccggcgagccgccgtcccgctccagacgcggcgcggccgtctcctccggcgccggccaagatcgaggtggatagcaacactgcaacacacataactctagaagtaattaaatatctctctccacggccacgtgcggccatgtgacggcgcgacgtccctctcgtggcctcagccgccctgacatggcacgggcttccccgtgcggcgagcggccggccggccgcgatgcccgccgcggcggccgcgcgcgccacctgcgtcgcttcgtcaactcccccatcctcacctcgctgtaaccctcacagttgcgagataatctccgaaatgccactgctcgtttgtaccgagacgatcctctcacagtggcaatcctgtgataagtcactctgatcaggggcattctcggtgatcaagggtgtaaccctctgtttctgggtcacttcgtcgcaaagtcaacccccaatactatactagaacccttgattgattcgatgatgcagaaggggaattaaggtgtggaaaaagataatgcgggggaagcatccatccatcagtgttgttcagtggtggtagattagattccagctgatccaatctggtccgggaattttttctagatctgacaccacattctggtcaaattcagagatccatgctgctctagtctgtactagagccgtccttggtgaacagttcttcgacactcacctcactctcatcgaggtctcccagcttgaggagcactgaagaaatttctatgttgaggtcagtgatctgatcatctgatcatgcaagctgaacaggattagttagatatgctgcagaaattttattagattttttgcattcttctgcaagtgttactgcatagttgtgttcatccaagttgatactgatctgatcatgcaagctgaaaaggattagttttactgcattgttgtgttcatccaagttgccaagaagtgtgaagattttgatgtcaatcactcacttggtcaaatttgatccaaagcagcgttgctaaattcatctgagttcagattgcgagtttgtgacattgggtttggttttgcgcagcaatggtgtcaagaagtctgcagcttgtcggcgcgttgctgctgccgctgctcgccgtcgtgtcgtcgtttgatccgttccacc

SEQ ID NO: 21884 - DNA, 1501 bp, Oryza sativa
tcttgctctccagctctttgtaactccttcatacacagatccaccagaacacaggagtagggtattacgcttctcagcggcccgaacctgtctacatcgcccgtgtcttgcgcatttgctctctcgcgaaccattccacagatcaagggcttagaacctcacccagcgcccctggccgaaccggcaaaggggggcccgcgcggtctcccggtgaggagccccacgctccgtcaactttgatttcacttgtttcatgttgtgcggtacatggtacccaggtacacacggcaaggccttgggccgtgaagcatggggtgggccgagtgccctaggcccatgcggactgcttggtgattaagaaagggattaaaagacaaggctatagatcttatcgtgtaggcacgcggacaccgcacgatgcacctccccgaatcgtggctgctgcacactactgaacttgtgcaacgccattcgtccaactcattgatcccacggagcatgttgcaccacgcaatgcgaccgggcagctccgcgtcgcgccagcagtgtcgcacgcaacgggccagtccacgctatgccccactgcgccgtttctctcggccgaccccgcaccgctcctctcggccgagctcgagccagcatcgcgctgtgccaccatctttcgcaccaagttgttaacgccaaaatttggtaagcccctaggagaattatcacattatcaatagttggattcctgctatattcggttaagaaaattaatttatcaaatgaagcttatccagaagtgaccgagttcaaggaggatgcggcatgccaagttatctattaattaggaatagtttgttagtttctttttatctttaggaaagtgtgtttagtgtcttataaggactttatgttttccttttatctttagaaaaatttctttcttgtcctataaggactagtatctacccatgggtataaatatgtacacccgaggtcattgtaaatcatctctcgatcaatactactctcggcgcatcgccaccctctttcccgaggtttttacttatcatccggcggaatttggcacctgacgcggggctgcatcggttcagttcaatctccggcgaaggggtaagtcctacgttccgccggccctagtgaatctattggctacgttggtgttgttcaaggctgcatcgcttcgatctcttggatcgctctggtttggttgatatatttgcctacctgatatctcaattctatctctaattgcattatgtttagagacacatcggtttagttggaactgtctcggttaggtctgatcttctgtcttagccgacatatctctacaatcacaatgctgttgtaaatagatttgttctatccatcacattagacagatctattggctcatcgagtattagattatcatatacaatcttgtgctgcatcggttaggttcgacctactagattgttgataatataaatcggttaggttcatgctagtg

SEQ ID NO: 21885 - DNA, 1501 bp, Oryza sativa
ccgctcggggttattccaaatacaagtacttcctttgacttgactcataaaaaaaatcaagctagtatcatactacctccatcctaaaatatttgacgccgttgacttttttaaaaatatttgaccgttcgtcttattcaaaaaatttaagtaattgttaattctttttctatcattttatttattgttaaatatacttttatgtatacatatagttttacacattttacaaaagtttttgaataagacgaacggtcaaacatatttaaaaaaatcaacggcgtcaaatatttagggaaggagggagtatatttttatccagattcgtagtaatatgatatatcatatttgaaattagattgattatttatggacggagagaatacgttgtagaggtgatgctgaactaagaacacactctcactgtaggggtgtggtagtgtggcacaaagttttttttttcacttgtttgatttggagctaaattttcccctgttaatatttttttgatggtgctaaaatcttgataatttctgcgactacaaaatttggtaccataaatttatattagtgagggaaaaaaaagcaaactaaacatcaatgcaatactatttaggccgctaaaattttggttggaaaataattagcttcactccaaacaagttcttagtctttggctgggttgctaaaaattggcatcatgtggcaactttcgtggaagcagctaagtaagcgcattcggcatagattcaccgtttgtctatggtggtcaagcccaggaaaaaatttcacaatatatctttttcttcgttattttgtgtttatataccaatgcgatgaaattttgcacaaatatatctctaccgcataagggttgtggaaccagcggtcgcgcaaaacagcagtgcggaacctatcgatcccgcagcctggaaacgcggaaccgccgcgccgtcatcgctgcatgcaacgtgaatgcatgcatgtatgcaacatatgcacatccatgcatatgtgcttgtttgccgcaccggccgcgcgtcatgagcgcgctggaccgcgccggtcgcgcgggagcgaggaattgcgtgcgggaacgacggttccgcacggacgttccgcgggagcaacggtgccacgcggacgctgcgcgggaagcactgccttgatcccgcatctccattctagggtagagatatattttcacaactcttttctatgcatgtatataaaagcaaaacgttaaaaataaaagtatatattaaaattttattcgtcaagctcatagcaagaccgaaagtggatattggttggacttcacactggtggagaaaccctttgtagtcccggttttcaaaccgggactaccaatccgggactaaagatcgctatctttagtcccggatgaaataactgggactaaagatataccaaccgggactaaaaatcgagctgaccttttttttcatggctctgttgctgtagggtttatatatatata

SEQ ID NO: 21886 - DNA, 1501 bp, Oryza sativa
tcagaggaaattccaaaagaaggtaggagtatgagatattcctctattgtctctctcaatgaacagcttgaaaatacttccaagcaggatttataaaactgacggtaactgtgcttattgctagggtaccaaaaataaaattaaatagattcaaaaaatagtctgaaattttgataaattttgtatggcttctatggtttgttgtggttaccgcaattgccgcatggcaactgtgcaataaacccatcgataagggtaaccttggtttcatgtgatttgaagtgctaacatttaaactcattatggctgtgtttaattcgtgtgctaaattttttttaattatatggatacacatttgaagtattaaacgtagactaataacaaaacaaattacagattctgcctgtaaactgcgagatgaatctattaaacctaattaatccgtcactagtagagtaaatgtttactgtagcaccacattgtcaaatcatggtgtaattaggctcaaaagattcgtcttgcgatttacatgcaaactgtgtaattggttttttttcgtccacatttaatgctccatgcatatgtctaaacatttgatgtgacggaaaagttggaggtttgaatctaaacacggcctatataagaaagccaagcagatggctattgccctctttgtttaggcttaggcttattggcctagacttttaagtcagcttattggcttatatgatttataagccagtggatttaatgtcctaagtttagtagtggagtcatacatctatctcatttaagccaaaaaagcttctccaacctagcttttggcttaatagtgttagaatagcttatggcttcaaaaaagccaaatgaaaaagctacttgtttgttttggcttagacttttcaacttataagttggcttataagcctaaacaaagagggcaatatatatgccttcaggccagtacgcagaatcttatctttggcctggtttagttcccaatttttttcttcaaacttccaacttttccaacacatcaaaactttcttacacacaaacttccaacttttccgtcacatcgttccaatttcaatcaaaatttcaattttagcgtgaactaaacacaccttgtttttgttaacacacttttcaaacaactaaacagtacgtttcgtgtgaaaactttctgtataaaaactgctctaaaatatcaaagaaatccttgtttaaatttgaaataattaaaactcaattaattaccttcttgtttgttgcatttaaaaaaaactttcttgttgaaattggacttgggagccacgagtccacgtgacagaggcagctgtgaagactacgaggcgggcgacgacgaagcttcgctaggcgcatacgtcatcacccctccctcccgacttttccaggaggcttctgccgccgcggcgcggcgcctcgacacaggcgtcgtcctcgtcgcgtcgacttgtatacgcacactgcaacttgc

SEQ ID NO: 21887 - DNA, 1501 bp, Oryza sativa
gagatgtaattaaatactaagaacaataactcaagaaatagcacgactgtagcatagactcatagtggtaagaaggtaagcatttacttgtttctctgctcagttgcgctccgaaggcgatgactgggagggcagaggcaaagaagatatacatggtaggtgccaatatcctaacaatgcatcaacataagcaattcagaaatgaaattaacaagcaacaaaagcagggaatacacactcaatgaattaactgtttgaaacaaaaatcaacctgaagccagagcggaatccagcaacccagtcatgcttgtaccaagctactcggccttcgatatcagcgacgactcccttaaagggagtccttagtagatccatcagctgtacttagctcgagactaaacagaagctgcaatagtaattaaaattcagaaacagtacataaatattacatggattttcaagacacatatttttttgactgaattcaagacacacatattggcatataaaaacatcagaagccccatgtcgtctacaaaatttgcaaactcgggtcaaggcgtcaagctacctcaagacgagtcaaatcgagagaaacctcgaaacaaacttatagccatcaaaatatcagacgtgtgcttaattgcttggtgtgttacttatataacatgcacggtttgaagtataaatatttattttgcgtgtactacgtacaccgcaacataattttccgaacttttgtattcggaggagacgaatatagattttcaacatacactttctacgaagattttaccaaggtgcaaactagttcgacacttgcagcacaactttttagcgtcagtgccacaaaccacttcaaaattgtcgtcaggtaaggtaaccgcggctagctagcttacaaacatgtccgagtacaaccgtacgatccaacacctcctctcatccctcatgcgtggtggggctcggtttaagccagatacatggaaaaccaatggcacgcagtaaaaaaaaaaaaaagcgcaacgctacacctactaattttttcttactaaaattttgatcatttgatttaggtagatagaagttaaaaaaaattaaatgcacacatagcatgacacaaccgtgttactaagagtttagtaagaaaaagttagtgaatatagcctttttcgaaaagaaaattcgaaacacaagttactcatcaattaataggcgataaaaaaattcagaaaacagaaaaaaaaactcgagaagcagacatccaaactgcaaactcgcaaagttttgacagaacaacttgtagtagatccatttgcaagcaaccccacaaaccacatcccggcagccgccgcaccttgcgaacaaacaaacgtagcgttcctcgaagaaatttgccaccgaaatcgatcaaaaaaaaaaacagccatggaaaaaacccaaacaaatcccccccaaacccagcgcaaacaccggcaggcatgcaacgcacagccaccac

SEQ ID NO: 21888 - DNA, 1501 bp, Oryza sativa
ttttcacacgaaacgtactgtttagttgtttgaaaagtgtgttaacaaaaacaaggtgtgtttagttcacgctaaaattgaaattttgattgaaattggaacgatgtgacggaaaagttggaagtttgtgtgtaagaaagttttgatgtgttggaaaagttggaagtttgaagaaaaaaattgggaactaaaccaggccaaagataagattctgcgtactggcctgaaggcatatatattgccctctttgtttaggcttataagccaacttataagttgaaaagtctaagccaaaacaaacaagtagctttttcatttggcttttttgaagccataagctattctaacactattaagccaaaagctaggttggagaagcttttttggcttaaatgagatagatgtatgactccactactaaacttaggacattaaatccactggcttataaatcatataagccaataagctgacttaaaagtctaggccaataagcctaagcctaaacaaagagggcaatagccatctgcttggctttcttatataggccgtgtttagattcaaacctccaacttttccgtcacatcaaatgtttagacatatgcatggagcattaaatgtggacgaaaaaaaaccaattacacagtttgcatgtaaatcgcaagacgaatcttttgagcctaattacaccatgatttgacaatgtggtgctacagtaaacatttactctactagtgacggattaattaggtttaatagattcatctcgcagtttacaggcagaatctgtaatttgttttgttattagtctacgtttaatacttcaaatgtgtatccatataattaaaaaaaatttagcacacgaattaaacacagccataatgagtttaaatgttagcacttcaaatcacatgaaaccaaggttacccttatcgatgggtttattgcacagttgccatgcggcaattgcggtaaccacaacaaaccatagaagccatacaaaatttatcaaaatttcagactattttttgaatctatttaattttatttttggtaccctagcaataagcacagttaccgtcagttttataaatcctgcttggaagtattttcaagctgttcattgagagagacaatagaggaatatctcatactcctaccttcttttggaatttcctctgaccaatttcgaatggatagtatccatagttcttctagaacttccattactacacactacactcccattcacgaggtcaggagtccatagatgacgagtgaacatgcgtcactccaagttgaaagtttattttgctattttcttctccggcatgatcgctccatccggcaagttgatacaagcaaaccggccctccgattgtttaatcgtccacacgtcactctcctttgatccgaagctcattgactcaaacgccataaaacaacttcgccacaattcactagcaacaaaccacagccatggacgacgacaccgccggcc

SEQ ID NO: 21889 - DNA, 1501 bp, Oryza sativa
gttgcaggggcaggcactgtggtgggccagacacatggtgggccagcggcatgcaggcgcatggccgcgcgcggggagcggggccggggggagcacccgattttgctcccccgtccagtcacccagatagcagcatttccccggtatttttataaaggaaaaatataatactggaattgatcatgcgtaaataatatgtctcgtttttttcctcagactgatttgtctgtctacacggtatgatgtgttggatggattgaactttcaagtttaggccgtgttcagttagttggccaattttttttatgtatactgacacatatttgaagtattaaacgtagattaatgacaaaacaaattatagattccgcctgtaaactgcgatacaaatttattaagcttgattaatctgccattagtaaatgtttactatagcaccacattgtcaaatcaggacacaattaggctcaaaatatttgtctcgcaatttacatacaaactgtatagttggtttttttcgtccacatttaatgatccatgcatgtgtctaaatatttgatgcgatgttttttgccaaatttttttaaaatctaaacacagccttgttgttgttttggaattcaaattcgtatgattagcgagcctcatgttgatttgggagtagtagaacagctttcacctggcactccgtacaaccgctcatcctagccgaacgtgtatgacctcgaatgctttcgacaaggacaatcattaaccatgtttgtttcagggccctggcaaatggatcacaacgatttcacatcacttcgtaaaccgtttactccgtcctaaaaaatccaacctaatactctatccgtctcagaatatagtaacctaggagcggatgacgtatcctctctccgtctcagaatatactaacctaggagcggatgacgtatcctagtactggatacgatacaacctaattctataaatttctattcagatttgtttcgttgtgttagaatatgtcatatttcttcattattttttttacgaagagagtagtagatctcacatctcggtagtctattcaaatcaaccttggccgccgtcctatccacggcgagccccacggcccccaaacccgccggccgccggtgggccaccgctccccccacaacaattaattactaactcctcattactaaatgatctctttattaatcccttgtacacctgtaaccactccacagtccaccccaacccagcgtaacgtccactcatcgcgagccgctcaatccaaatccaacggcatcccgcaacccacgtgtccctcaccgcgcgcgagtttgaatttcccaacggctctctcgaccgttgctgccacgctcctgaaaaaaaccaaaaaaaaaaataaaaaaaacacgcatctgtttttattctctcccatctctcccgatctctcgcccatttgccactgatcccgaaacaaacagttggcgccggcgccggcgcgagc

SEQ ID NO: 21890 - DNA, 1501 bp, Oryza sativa
tgtgtgatatatgcttttagtactgctttacccatttaattccttcctcctttgattaatcatgtaaagaatcttcacccattagaacatcaaccagtaaagagagagagagagagagagagagagagagagagaaaagaaaagttgattaattggcccttgtctgttggatgtgagaatctatgaatatcggtatcgataattcccggttgaaatttaggtactaatatagatttcttttgattttttgtaatgcaagttggggagttgggagagagagggtggtgtgattcccacagctaggtatatctggtgattatccccattgcaatatgctttaaaacccaatattaggtaaaatgtaaatattccccaagacacctagctgggttctcttagactcttgcaaggttctctttggactactttgagctttgagctcatctttaattcgatcccttgaatcagacgcaccccggcgttaagctttagttttcccctttttccctgctgcatttgcccggtagattcttagatttgttgtaaagttaaacttaccacagaaatgaggcaggcagcatcttgatctgtaaaaaaaaaaaaggattaatggcaaagaaagatacattgagatcatagcagctgatcagctaggctaaaacagtgtaatttgaacaggacaagaagacgtggctaacaaaagtttcagtttttcagtcacgcatgcatgctgaaaaacaaaactgcatgcatgcagtgtacaaacactgatcagagatattcagaaagcaggcagtacatatttgaatggagcagagagaaatctatatatatatatatatatatatatatatatatatatatatatatatatatatatatatatatatagagagagagagagagagagagagagatctagagagagaatgcaatgcatggtgcaatatatgcaatatggacccatctggtcgtaatgttaggagatatgttgattcccctgttggtacgtagtacatgaaacctcctgcatgcagaggaggagcagaattaacctttttctttttgtttttgtttgcctttgatctttgcaagaagttaccatgcctttgctttatccccctatctctctctctctctctctctgatctctcactactgttgctagctagctatagctgtttagctaagtgtatatgtgcaagatcatacaaagctagcttttccttttcctctaaatccaactttattctcctcttccttctcccaaaactctcccttaaaaagaagctgattccccatctgatccctcatcaaaacccttctcacattcgatctcgatcactcacacttacactcgcagtttgcacagctacttcatctcaagtagtagtagtaatatactagctagatcggtcggctatttgctgtagctagctagcgtgagctagcttggtttgtagagcttgtatacttggagggaggagatcgatagccatgg

SEQ ID NO: 21891 - DNA, 1501 bp, Oryza sativa
tggcgaccgatctatcccaattacttgatttaagtatatatcgacataacgattatatattgttaatgtctacagccgatcgagtagatttagttctttattatctatttataactgccgatcgatgcatatatgacatcggctcaaagataaacgatatgtcatcggcacttagccgatcggctatcgtttatggatttaaccacggtttctttgtctttatttcttgttgattgcaggatcaaatcaactggcacgctagcatacccgaaagcgtgttttggacctgcactgaagtgaagcagatcttccaggcctcgtgtttttcatcaacacgcttttggcacgcctggtgggacccatcagaagtcagaatcacaacagcagttttccccatggccgagaaattgccagcatcgccgtccaggctggtcctagctctgttaaagaaaagatcctgaagctgggtctatctgagattgatgaagacaacattgtgcctatcactctggataaattgacacctgagcagcaaaaagaccttgatacaatgatgcagcaagcacggaatcagttcttgagctcattcacggagtcccgcaagggaacactggttcagaagtacaaagtaaaggtaattgctgatgttcctaggaccggttcttctaaggatgaagaagtgaaacaagcttcagatgatgtgtcacgaccggaaataacccaacgggcgttccttacgtgcgtgtattattccttgtcccaggaggcaaggtacaccaaaagttgatacaattcagagtttaacaagcggaagcgtaaatagataatttattacatgggtagcgaaggcccagcacacaagaagacaaacaaaaaacagcggaagactagggcgacgaccacaggcgcttgacggcaggcacgagctagacaccaaagccttcatcttccaggaactcatcttctgggtttgggaaaaattgagcaagactgagtacaaccaccgtactcaacaagacacacccataagtgcaaaataaatgcaagggagtacaagggagccataatatagggggttagggtttgcagtaaacatcattaaaagtcacttagttgctcaaagctactttgtaaacacgatcctagagctatgcaatattattaatcaaggccgtgaacccatacgaacctgccttaacccaaggcctacgatgattcagactgaactggcaacccgaccctaggtcccagctcgtcccaaccaacccaggccaaccattccacattttagttgttaagcaggttttaagaattaaaacactaacttgggtacattgctaggcttgcccataaccgagggcgcggctattcgaataggttatactctgatcagaggtgtacatctttacccacaagacacatcttcgtcacgtgtaaccacgtgccacataccaccatggtatacggacggaagacgtgacatagtttccaacccatccta

SEQ ID NO: 21892 - DNA, 1501 bp, Oryza sativa
taaaaccgacacatataaactttttctacatccgtgtgatgaaaaaaatatagaactagcatttttaaacactatagatccacatccgtgatgaaaaaaatatagaactagcatctttaaacactatggatgccagttcttaaaaaaaaaaagggcacttatacttataagtaccgacacatataatcctatgtatatattcttatataattcatctcctccactaaatataattaatgctattctctcttttttcattaagccacatcacctcaattatttttagtctttggatgataggtctatggttcaaattgtctcttttttcttctctcataacactatgcgatctcacttgtttttaggatcaaaattcataaatatcaatttattttagttttaataatcatattgcatcttatttgtatatattatgaaacttaattttccacggtaacgcggcggagtattcatctataccaaaccgagccgagccggtgaaccgagcgccatccttatctactcccatccagcgctcgcgtcctatccatttctctcgtctctctccctcgcgtctctatgcctcccctctctctcgcacatctctcgcctggcgctcgctctctccctcgcccggcgctcgctctctctcgtgtgtctctctgcctcccctctctcttgcagcggctgcccagcgaaggcggtggtggcggcggcggcagtgggctccctaacgccagatccagcgagaggggaggcagcgctctccccttcgccagatccggtgagaggggaggtggtgggtttcccacgtgtgttcctttagttctcttcacacgcattacttaggccatgcttctttcagcttaatattattgtaatctagattattgacccagattactataagttggattataataagctgacatagttgttagctgtttgtttatctggattattagctttttgttagttgttagccacccaataatttaaaaaagcacctttagagtggattactagattatagtaatctggcttatagattgtaataatttattataataagctatatgttcgttgcagcttactcataataatccagattataataatcataagctgaatcaaacaggaccttaattgattagaagagcattaattattttaaggtggtttcacatgcatgcatgtctcccgtgggctaaagacccacgtataatttcatcatatctagacatatgtactataagcattaatttatgtgtagattaatccggctaataaaaacacaaagcaaacaaaaagatacaacacattcatactaaagttacactgttctatattttgcaaacttaggccatatatatttgtgtgcaagttcaagtgattgacagataaaaaaaatagacgactaacaaatagcaaaactgtaatttattttaatatcatcaagacacatcagcaacaacttgtatatatggtcaattaatatgta

SEQ ID NO: 21893 - DNA, 1501 bp, Oryza sativa
gaagggaagatctaattttaattaataaattccaatataaaatggggccagataaaatttcattaaatactttgcttaattctataattcctagatttttctgggatttatttgagctaaggaagtaattttaataaatgaaattgcatttcatggataatttaaattgaaaaaggtttttaaaaagtctcttttggctttgggccgaaagtcggcccaaaaacctctctctctctccctcggcccaagccggcccagtccgcagccgcagccgcccgcgcgcgcgctcgttgtcgctgacaggtgggtcccacctgtcagtcttcgtcttcctcgcgccgccgccgccgcccgaaccctagcgccgcgccgccgtcgtctccttccaaatccggccgctcctttccttctccggtgaaatcaaaagaggggaaatgtttcccgagatctcctctaccttttcccttttggaaacatcatctatttcggtttggaaatcggtggattcgagatcgaatcggattcctctctctctcccgaacccgaagtttccttcgcgtcgccggtcgccgtgggccttcgccgccgcctccttgcccctttaaaaggatccccaagcccgccgctacccgtcgccaccctcgccttcgtctctcgccgtcggaagagctctagcgccgtgtgacctagcgccgccgtcgttcgccggcgagcatgcgcgcccgagtcgcccgagccgccgccggtggtgacgtcatcgccgacgtcatcgtcgtcgtttctccgtgagccgccgtagacccgatcgatctcggccgtccgttttggatggatcaatctcggccgttcgttcccgtgaaccgccgccgtgcgcccggtccaccgcaaaccctagttgctgacgcagtaaaccccttttccttttcaaaaataactcattattgcgtcataattcaactaaaatccatataagtgttttaatccgatttaatctttaaaaattcataactaattcatcttagctcggatttagttggttcaagtctctaaatttttctaaaattgagatctacatgttaaaaatatccacatgtactgttcatgcttgtttatgtgctgtttttggtgtttttgctcttttctgtttagattccgacgtttccggagagtccgtttccggaggagaagaatttgaagagttccaaggccagcaaggcaagtcacacagatcccaaacaaccctttgagcatgttgatcccgtttaaagctattgtttctattcaactattgcatttattttcgaatgtcattgggtggaattaacctattgtttgttatagccctttttgttcttgattactttattccttgataccttgggttgttataacttgactagttgggcaatatatatattggttcaactagatgtgttagatataattgcttagccatgcttagaaatattagctcactaatgggatgaatcatatatactac

SEQ ID NO: 21894 - DNA, 1501 bp, Oryza sativa
ttcaaacggccggatttgctcccgcaaatctcgccggcgccattgatggcggccggacctcccggccggtttccttccttccccggccaccctctcccccttccaaccctatttaaaccctccccgcgcctccctcgcccgtttccgccccttgccgcactgtctcctcgccagaatcgagctcgcgccgtcgccctctctctcctccgtcgccgacgaccttcggccggctctctccactcgccgggaccgtttcccgccgcggcgtcgcctcctccggcttcgccgcaccgtcgccgtccccgtccaccccctcatcgagctcgccgaccgccggagcgccaccgtccccgtcgaccggagccgcgccgccgccttcctccgctccggccgcctttttcgtcatcgccgtcgacctagggtgagtcgtggaccgccacctcgtttccccctttccctcccctctctcggccgccgctccgccgtgcctatggccgccgccggcgaccataggggcgcgggcgcgccgcctcccgccggctgcgccgacgtggccgccttcgggcacgccgagcggctgccgcgtggggcccagccgtcagccgcctgcgccctcgggtgcggctgacgcgtagggcccacggcgccggccggtgtgagcccgggtgcacccggtccaccgtggaccgtgaggctgccgcgtgggccccactcccgtggacccggtccgcgcgccctctcccctcggctgacgcaataaaccatttttaaattaaaatttaaatgaagaaattcgtaaatattcatttaaagagcatataaacttcaaatggccataacttggccattcgaactcggaattggaccgttcaagtctctaattttctcttaagaagtcaaaaacccatttttgtgctttgttcctgcttgttatatggagtttattagagtaaaagcctttttcctttccgttggtcgtgtagacgctgcagcttcggaagatccgctctacgtggaggttgaagccgacgtttgggaaagcgagcaaggtaagtcacatcattcttgaacatattgaatcccagtttataaaattattttgatttaaattattacattatcgctttatttaaattcccgcgttatcactgttttatttagccatgcctttttacctttgttatgaccttattattattgttattgttattattaccttgttcaccctagaataaacaaaaccccaactagtggatactgtattcatggtaccactagtatgaatttaggtagatgcttcgctgcttaattaggcaacattaggtggttttacaactctagactttaggaatattcttatcacctggacactatggaatggttggattattgtggaattggattcacacctctccctctattcaaaatcctcaaaatggttttagcctgggctcggggtgcatggttttgatagtagcacctcggccacataaggaccggt

SEQ ID NO: 21895 - DNA, 1501 bp, Oryza sativa
ggggctccgttcccgccaacgaggcggggatgggtttgaggcatcccgcccgccgactttgggttcggatccgtccggaccggacgaaggcggttgggttcgaccaggttttgcattctggtgcgaccgacgaacggcccgagcccacggttggtagctgtgggaccatcctgtatagacacgttcgaagtcatgctgggccagcctttggtattggtagccccgtttttcttttggtattggtattgttttttcttttggtaaacgatcgaaattccttttttttttgttgataggacaaaagttgccgattcactctgataactcctagagttcccttggttcatgttttgtaaaaggaatagttctatcgtataagatttcttattataccctggaaatggatttttgtcctttgaggggacatcctctcattttatgtatggcgttcagaaagttattaaaaaatttattaagatagattaatatatgatatatctttttgtaaacatgcgagttaaaattcgacttatacaatttgaaacaaaaataacaaatttgactgtgaattacgctttctattcatagtcaaatttgttatttttggttttacttgtataagtttaattttaatatgtatatttgtgaagtgacatatcatatattaatctatcctactaaattttttaatgactttttaagtgacatgaaaaagggatatctcttatgggtgtttggcaccctattttcccaaccgatctccctcgttttccgtgcacaagtttttcaaattgctaaacggtgcgtttttttgcaaaaaaatttctatacgaaagttgcttaaaaaatcaaattaatctatttttgaaaaaatagctaatacttaattaatcacgcgctaattgaccgttccgttatccgcgcatatttcggttgggaacatggatgggcgaacacaccctaagggatgatttgagatttccattataccttgttttttacatgtatatagtcttctcaactgttcaccaatgatgatgacggccccatcgtttggctttttctctaataagtcaaaacggggcttattagggaataaaaataaatttgtatataaaatttttatagatgtgttcttggtgacttaaaagtcaatgctgaaaaagaaattacgttgaaaatatctcaaaattaatatcaaaattaagtttgaaaatttaaaatttggctttttttttggctgaataggccatccgatgggagcctgattcttgatgtaaagttgtcaattcctttcgttcttgtagctgttttgtgtttatcttaataaaaatgataaacaggtattgaagtagtccaagaggcaccaaatggcatctctagcatcaaggagattgagatatttttgttgcttggtgggaaaaagatttggcaaccgattaaatttggagagctgtcgccgcgttgaatgcaatcagggagcaagatttggacaagatgt

SEQ ID NO: 21896 - DNA, 1501 bp, Oryza sativa; identical to SEQ ID NO: 21884

SEQ ID NO: 21897 - DNA, 1501 bp, Oryza sativa
ggtgtctagattacgggatatcattatttggggttatatattgcggatgagaggtgggccgctgatggtgacagctcagtacgagtattcctccgtgcctatatataatccttagttaatttcctggggagggtattcctctgtatttagccccggttggatggtcatgacgggctgtcgtaaagaactcgacagtcaggggtggcttctcgaagtaccaggaaggcatcggataaatggtattagctagtatatcagttaactagaatgtatgtatactatgtatattagaagtataggaatagattctctttctcttttctttccacctagcttagattatttattatgaggataagtagaaaagcttgtgtgtcactctacccttggattatcataacccctgcttagaatatgattatcacaagtaatatataaattattagttgagttctctctacatgatctttccacgtgataaaataaatacgatacccttggaatactctcgggtgaaatgctataatggtatattcgtgtgcttgcggatgaactctgtaaccataatataccagaagtatttctgcgccattgctgggaattatatttctagtaacgtcgttaagaaataccaacagtgacttgatctcacttgagcatcaacattattttcatttcttggtatctatttctttcattcaactcaataaaactgttagtcccaatgatctggtagtcaacctccacttgttgaccaaccgatcgcatataaaatgatatgaataaattgatgaaaatcaacaacaccacaaatgtcatatactcacacatatacacaaatgtaaagatctcaattaaataaaattgattaacttggatcacacacatgcataataaaatataagatatacttcccccaaaatatatgcatacaaaatatttcgagtgaaataggtgtatgcataatttttgatgaatccatgggagtttatcctatacaagaaaagaaagcatgtgtaaagagagtatagcttgatttcgatgtgtttcatccttattgagattaaagtcaaccatcaatggatacatttctatcccaactcatatgacatccgagaacaacctatttgccaactcatggaaaaaagtaagtcacagtaacctggtttgtcataaatcaccagaacaacatttacacattattgaccatagatcttttgatcatttccgttttggtgttggatgacaatccaatataaaatatgatcatttcctttttggtgatggatgacaatccaatataaaatatttagagttcctcaccctatttgggaaccattagagagataatttagaacacgaggaatttaacacgtacctctcatcatttttatttttcatattaattgagactatgcaaaataaatgtttatatataaaagataatagtatcatataattggatttggcattagtcaccaaaactaatccaattgcactt

SEQ ID NO: 21898 - DNA, 1501 bp, Oryza sativa
atacattcaattcttggagggcagcctctgttgatagttggagttgcagagccaactataatcatgtacacgtatctctacaactttgccaagaaccagcaagctctgggggaacgactgtatttagcatgggctggatggtaacaactgaatctgaatactatcacgttagcttttcagaaaaaaagttaatgctctcctgatttgcctactgttgacagggtctgcatctggactgcgctcatgttgtttcttctggcaatgttcaatgcttctaatgttattagcaggtttacaagggttgcaggagaactttttgggatgttgattactgttctgttcctgcaacaagccattaaagtatgctatatctaataagctcagttctttctatcttggaagaaaatatttagaccagggcctatctattgcagggaattatagaggaattcaaggtgcctagagatgcagaccatagttcacctatatatcaattccagtggctgtatgtcaacggcctgcttggtgttatcttttcaattgggctgttatacactgcattaaggtcaagaagggcaaggtcatgggtgtatggtcaaggttggtcactttttcatcttatttttatctcatgaatccaattttgagagcaaaccgaactctgggtaatcaaattagcaacaactgttccattaatcatccatccaaccgttagatttatgccaaacatttctttagctgtgttgaagtttggactgggcctgctttagatcaggcttaggttgtgctgggctacaagcttgtgttgtgagcctctcagctttggaccagaccatatgggctccttttttccttcttgagtagacggcttggcttgagatggtgttttgtagcctttatattgacagattcttttttttaatgaacttatattgacagattcttattcctttatattatgtggatagttgctgcacagttttttttctctttgaaagttttaacatttagaaacaaaaacaagaaattactactatcttctctactaatatatacatggcaaagcttttgctttatttcaaaaaaaaaaaaaaactactatgtatgctacatcagtatgtaaatggctccatgattataatttgtaaccattgagaagcacatgtatgtgcactgatcattgtgcgtttgagttgacacttgcagggtggctcagaggcttcattgctgattatggtgtcccacttatggtgattgtttggacagcattctcgtacacgttaccaaaggatgttccttcaggagttcctaggaggctgttcagtccacttccctgggagtcgagttcactgcaacattggacggtagcaaaagtaattagtcaaacttgcttgtgatactggagatgtgaatatttatggtcttcaattttagaagtttcgcacagcttattttgcatggcatcattaataatatcttctctttttttattttcaggatc

SEQ ID NO: 21899 - DNA, 1501 bp, Oryza sativa; identical to SEQ ID NO: 21886

SEQ ID NO: 21900 - DNA, 1501 bp, Oryza sativa
gaaatgtgattaaatactaagaacaataactcaagaaatagcacgactgtagcatagactcatagtggtaagaaggtaagcatttacttgtttctctgctcagttgcgctccgaaggcgatgactgggagggcagaggcaaagaagatatacatggtaggtgccaatatcctaacaatgcatcaacataagcaattcagaaatgaaattaacaagcaacaaaagcagggaatacacactcaatgaattaactgtttgaaacaaaaatcaacctgaagccagagcggaatccagcaacccagtcatgcttgtaccaagctactcggccttcgatatcagcgacgactcccttaaagggagtccttagtagatccatcagctgtacttagctcgagactaaacagaagctgcaatagtaattaaaattcagaaacagtacataaatattacatggattttcaagacacatatttttttgactgaattcaagacacacatattggcatataaaaacatcagaagccccatgtcgtctacaaaatttgcaaactcgggtcaaggcgtcaagctacctcaagacgagtcaaatcgagagaaacctcgaaacaaacttatagccatcaaaatatcagacgtgtgcttaattgcttggtgtgttacttatataacatgcacggtttgaagtataaatatttattttgcgtgtactacgtacaccgcaacataattttccgaacttttgtattcggaggagacgaatatagattttcaacatacactttctacgaagattttaccaaggtgcaaactagttcgacacttgcagcacaactttttagcgtcagtgccacaaaccacttcaaaattgtcgtcaggtaaggtaaccgcggctagctagcttacaaacatgtccgagtacaaccgtacgatccaacacctcctctcatccctcatgcgtggtggggctcggtttaagccagatacatggaaaaccaatggcacgcagtaaaaaaaaaaaaaagcgcaacgctacacctactaattttttcttactaaaattttgatcatttgatttaggtagatagaagttaaaaaaaattaaatgcacacatagcatgacacaaccgtgttactaagagtttagtaagaaaaagttagtgaatatagcctttttcgaaaagaaaattcgaaacacaagttactcatcaattaataggcgataaaaaaattcagaaaacagaaaaaaaaactcgagaagcagacatccaaactgcaaactcgcaaagttttgacagaacaacttgtagtagatccatttgcaagcaaccccacaaaccacatcccggcagccgccgcaccttgcgaacaaacaaacgtagcgttcctcgaagaaatttgccaccgaaatcgatcaaaaaaaaaaacagccatggaaaaaacccaaacaaatcccccccaaacccagcgcaaacaccggcaggcatgcaacgcacagccaccac

SEQ ID NO: 21901 - DNA, 1501 bp, Oryza sativa; identical to SEQ ID NO: 21888

SEQ ID NO: 21902 - DNA, 1501 bp, Oryza sativa
ttgggatggaggttggagtgaaaggagtgacacagtggggaagtgaacaaaaagaggctcaggtgacaaggaattctgtggagacagcagtgtccacattgatgaatgagggggaggctgcacaggggatgagaatgagagcaaaagattttggcataaaggcaaggagggctttggaagagggaggttcttcatataacaacataaggttattgattcaagaaatgggaaacgagcaaaatgcatctggttgatacatatatatgggaataagctttttttattaaaattctagatctgaaagaatgaattggaggatactatcgtacctatatacttgtaaggatgggaggagtccatatttggccctttaactatggtcttgcccggattttcatccctaagaattgtgctcccttcaattccaaatacaagccgtgtaaagacttgtgcataaatatgatttatttattagaaggataacatttatttagtatggaaaatctggaagaatagtaaaaacttctgtattctaaaatgacttgatattgagaaagaatcgtgaagcataaaatggcttacatttgcagcctggcagtccaccagctcctgtagtggaggggatttccaggatccctgcagatgcaaagagggagtattttacaaatgatcagtattattgtatgaggctcgtttgtggcatgattgtttacagtctggattattaaattatatcactttctgtttctgacactcttgcccaagtttcctagttacttctgaatatatgaagataaaaattaggaatagtggtcaagttatgccgtagacttcgaaagaaaaaaaatactgaatagtgagactgcagaggacagggagtatgagtatgtatagcaaccgtggttaacctgaccaaccgcgttgtccggacggctcaaagaatggaataaactcgaggactttggctatgagtccataactataacatgcacaccaaagttgccaaagttcagcgatgctgttatccttttcagcatgagctcaaactggctgatttgataggaggacaagctgctctgcaattatttaattctttttttgaaagaagctgcaattatttgattaatcggcaacattccactttcctccgactccgagatccgaagcatcaggcactactccgtagcacctcaaagcaagtactatgagcatccaagcacaagccccaagatgtcacataggactaaattgtgaggtggaggagagaagaaggatgagagagaaatagtcacctctcatgcaaggggcagcccctacacaaactttaataaacatgtgagagtgttagaaatattagggattgtgtggtagagatgacctattatacatatcacctcttaatttaattatctatgttatgtataaaattagatgcgatagtcacctccaatataaaacttgccctcagactgcttgcagtcatcaactcaaacagcatacg

SEQ ID NO: 21903 - DNA, 1501 bp, Oryza sativa
agtgagaaatgaattttaagtgatgatatactaacttatttttttctctcagttacctgcctctacccaaatattgaaaagacgagagttcgctcttaaaactcctcacccctcaaacttccatcatcttcaaacattccccctccctcctaaccaaacactccctcagcgttctgaatgcaacgtgctattcaattaatcacagaatataactttgactgacttacaaacttagtaccagaaggggataagaagtgaaatccgagtagaaatagggagattcaaaatcacatataggaaagtaagaataaccaacaccttcactcttggataaacgttgtcacaaaatacgtaccgtcaaattttaaaaccttaaatggccaattaataaaaacatcaaagttttacacaatgatgaaatatgtctgttatacctattgatagtgagacatctacatgattttctttattaaagatatgttggtgcaatctctgaaggtgctctatgcacaagtgtacatataagtgcatgcatctgtcatgtgttaaaaaaaagctcagagatgatgagatatgttcattacattaccaaaacaaagcataacaatgaattaagtaccagataaatcttggcaattgggctcttgaaaacctggtgcacagtctcatcatctctactgttctacagaatcacctcccttatcttacctgcatgacaaatgcctcgagaaaaaaaatatagccacgatggcagtagcgaaatatcgtgcaaaaggaggggcagtttcgaccgaggagctacagtgagccgcaagtacgcttttttctgcaggctcatcaatccatgcacactcattattagccctagaactgtagcatcatttcacatttattttctttctctctctctcggccttaatcgcatataacgataattgatatggataattggattggattatatgcagctgtatcacaaattcacaatcccacaatctcattttcttttttactcggtgaaccactaaaacagtgtgaaatgggcagctgtttggcgttttcaagaaagaaaatattgttaaactgaccttttttgacagtcatcttcagttttttttttttgtttaagcccttcctctcctcactcacactgccctgttcatctctttcttttttattcgattcctctattccattccacacgcattgccgctggtagtagaagtatagtatctctccgcgaccgaagattttaaaaaggaagcaatttgcctcttttttttttttggcgcacctcgattagtagtagattttagaggcgaatgtgagcggtcaaatccttcttttttagcttgtgcgcgttgtgttttgtgctctccttttgtcagttcctgaggcgctctctcctgtgcctttgtgtttagcgtgcgtgaccgcgagcgaggtcgaggagtgagagggagtgaggcggcggcggcggcggccatggcgcagcagcagc

SEQ ID NO: 21904 - DNA, 1501 bp, Oryza sativa
ctacatgggaatttttgagaagagtcatatgcatcttcatcagaatgatcagaggtaaatacaatgcttagttgttgcaaccatcatcacaggtttaacaggttctcagattctgttttgtttagtttaccacttgactttataggtttataacctggagaaaaatgtatttctcgttcataaagtgaggaggataaaatgccgtccgagtagatggaaaatactggtttagtaatccaaaataatctagaggttctaaccgtttctaaaacaggctgggtggaatgtcatctaatccaactttacaagaactttttatcggttttgagtagcggaaatgcctatccgtataattatcaggaggaaagcggcaaattccactctacattatttaagatcttgaaggtgtttggtacatcgctctagctaataaaatcttggagtagtagtgccaaactgttcttaggcggcattcgggaggaggggttgtgaacccttcatcctcaacaggcaaaacgaaaaatacgtattattgtatgattaattaagtattaacttttttttaaaaatgattaatatgattttttaaaacagctttcttatataattttttttaaaatacactgtttagcagtttgaaaagcgtgcgcgtggagaacgggagaggtgagttgggtatactggggaagaacacagactttgcaaaaaaaaaagtccccggtgtaattgggaaaaaaaatcattagggatagatggatgtatcattttgtttcacatatttatccctggttactattataagccgtgttgatattttatagccaatcctttttgagtttgatcaagtttataaaaaaatatagcaacattttcaaaacaaaacaaatatattatcataatatattaaatattagttttagtgaaactaatttggttttctttataaacttaatcaaacttaatgaaacttgattagaaaaaaacaaaatataatatcaaacaaagaagtactccctccgtcctataatataaggaattttgagtttttgctcgtagtgtttgaccactcgttttattaaaaaaatttatgtaaatataaaaaacgaaaagttgtgcttaaagtactttggataataatgtaaatcaaaaaaataaataatagttctaaaattttttgaataagatgagtggttaaacagtgcaagtaaaatcttaaaatcctttatattatgggacagaggggtagtatttgtgccttttctgaaagaaaatctaaaaacaagacaataaatgcgccggcaaaagccaaactaacccccgtgtttaaatcgcctcccgtacaagtctcctgcccctaccaataccaacttaacccctcttcttccatctctaatctaatcactcctcccctcttccaccctccccccacctcgtcgcctcgccgtctccacccccaaaaccctagccgccgccgcgctcctcctcctccgccgccgcccgg

SEQ ID NO: 21905 - DNA, 1501 bp, Oryza sativa
cacagtttgaaaaataacttagagatcgaaggaaagagaaaactaccagacggccgggtcctacgtagttgtattgtaaaatacagaatgtagggttccattaaacgattatgttatatagacaactaatcaaaattatacggtaataaatatttagtatatatctatcatttattcgagatatttagatgtgtcaatatatatatcattctaatactcttctcaactatccaactgatcaaacgtacactaatcacgtgctggactgctgggtgctagacttaatttgtgttttggtggttgttttttgttcactacaggagataattccgatccgactcgttggttcgtgacagtctcgtcgcctccgtatatacccattaacatatgaataatggaccgtagattcgtacggacagatttttttctttccttttagccattagattagattagatttgttacattagccggtttttaggagagagagattttaacaaatctaatctaatggctaaaaataatggctccatatgtttgcgcataaatcaatggctagatttttttttccagaatttcttatattttctctaatttattagagcgccacatggcatcatgagagcgtttgtagaatgtcacgtggcagcttgagagcatttgtaaaaagtctaatggatttttagtatataatagaatatgttgtacttgtatatggtgttgcttcctttttttttatctaagttttaacacttttacatgtgagtttgtaagattttatgtgttatatttatttcctgcttagttaaaaaattttattcaacctttatgtaaaagaggactttgattttaaatgtatataataattgaagtttctggaacttcggttgcatcaggaagggctaaaactgccaccctgcagtccaccaactacttcactacctagttctggaccaatgatgaggagtagagcagttgcaagtcctactttaggacatgaacaaattggatcacctggtaattctggaccaatgacaaggagtaggaaaactacaagtccaactttgagacatgaacttagatatgaaatagatcaatacttatgttcaatgatgcaacaagatatagcaatgctctgaatttatgcgatggtctgatttttttttatattatacacttattctatgatggtctgaattgatgttgtcctgcacgtgcatcagtactatcagattttccctacagattgtggctaaaaaattactctgcttgatttcttatagtgcaatgccattcaaccctgaaaagtgaacaatgccattatgtttcactgaaattgaacactggaagtgaattcaaccgagtgaaatttacaatcagtacaaaactttcagtacggaccattccttgctaaaaccatcatcaacagaaccacaaaggttgcagaaccagtcatccaaacaagggttaatatatacttcctccgtttcacaatgtaagt

SEQ ID NO: 21906 - DNA, 1501 bp, Oryza sativa
gaactatatgcttagccatgcttaattgccactagctcagttgatggaataattgcagtattagacctttttagtagcagaacgagctgtgtgctcgagacatccggccatgtttcattggccgtaattattcaactaaaatacgactgaatggtgggctgtggatgcatggttttgctagtcgcacccatggcaattaaagatcagttcacgggatgcactggaagacatacaacgcttgccacaggcgggaatgtgtaactgcctgacttgaagtatagctttcatctaactgacgttcccaggcaagggtgggcgtgatggagttgggttggccggggtgttcggttgatcggcttccggattcaccgtggcacgagagggaactgtcggctgccttgcgagaagtgggggtgaaacctgaggtgtggtgcgattggtcagagggagttatatgaagggtcttgtcacaaccactcgacatggtgacgttttcatcatgggtgcatgatgacacggtgacatgccggtggattgtgtcttctgggtacagtcgtatacctctggccagagtaaaactattcgaatagccgtgcccgcggttatgggcgatcgaccacattgaccatgattagtctcacccctaataaatcgacccaatgcactatagttcaggtgggttggttggacatgttcaacgtggtgtagcgttgatcagtggagatctaatttactctcgctttgaatcctcacgttgagcggcaaaatggcatgtggattatattggctttgaggttcatgcatgtggttagttaagtttttggcgttcacagtaatgtcacgtcacgtaggctacggcaatggatataagatctaagtttttcatagtacaagtgactctaggagtagatttaattttatatttcagccccttgatactttttatattagctctctttttaaaaaatttatgtggaggtcctaaatttacaccgaacaccctagaatccagaacaaagcgaggaaggagagtatagagggctcagatctgatcaccataatagaggaaaaggccgacctaaacctattttgtgaacttttgatagttcaacaagtataacttgatgctttatgtttaatacaaaatatctctactaggatttaaggaagtttcatttatttattaggctgcactccacgccgagcgcaagagattcatggaatgatcttaggagtgaaatttagttcacttaagtagagaatctatttaaaaaacataggataggagcgagaaacccatgagttgatcttaaaaatgaagtttaggtgagtttatttacttaatgtagaagaggtaactaggatatgtcaaacattacctgtgaatttttcgctagccccaacagaggacagtcgcggagatatcatgcgagactgataggcacggctctccaccagcccaaacaatagagtgatcgctggaagatggtttgcaattttg

SEQ ID NO: 21907 - DNA, 1501 bp, Oryza sativa
accaccggccatccttctccctattgggcgcacgcttggaggcctggatagagatagggaagaaagtggagggggggggaagactgggccactaacatattgggcctagccagtgcctcaacccgtatcgccgctccctactactgcctcaacccgtatggctgctccctaatcttcatgcgggccctcactcttcgcgccgtacatgtgactggggctcatccccggtcaatggcgtcctttgggcaaggtcgacacagaccctcggtgtgtgttgtagtccgcgacaagggagtgggaggaggagccgcgatgatggggagggtacgccaagacatgtcgaggggctctcttttatgccctgcaagtcggtactgctcgattctgcacgaccaagctggattaactacttcggtaggtggctacgatgatggctgtcacgtgggataggcggggaggaggtaggccttgtccaccactccactccacgctctccaatcctagatcccaatccaccatgctccaaacccttgttggcgccgcgaccatggcgcaaccgcgacgcaatgaggaggatgtgctcgtgggcttcaccgttgacgagatactgcgacggaccgagggacagatggacgctaggatgctggactccaacattggcatgatctctatggtcgtgcactacttcgtcctgctaccgcttgttgacactagcctcctcacctatgcattgaaagcgagccgtggcagcttcaaccgcatcagcagcctccccgatgtgcacttgcatgacatcgtgtcccacctccccgccaaggactcgcccctaacaaaggttaggtgagctcgccggctgccttccccaccgcccgcctttcgccctcaccttcgatccccacccctcactgggcatcgtggtccacacgtaggcgggcacaccaccccccatgttaggtcgctcctcaactgcactatccatcagctctccaagctgcacctgcgcgctgcttgctcctctcgagagttggagagaaaaggggataagagatggagaagaaagggggaggagtagagtgaggatgacacgtggggctcattttttccccacgtaaacgtctagtcataaaaaaaacagccatctatactgccggaggatctgattttaacgattttaataagttagggggtgaagatttctcgtattgcggtttagagttgccgattaaactcgacggaaagaggaggacgcaatgtggactagttccttcctcttgtaacagaagggtacttacgtggcagcccaatagccaccacgaccctccgattttacggtcggcccagcccattactgagcggaaccacgcgcagccgccagctaaaaccctagctcatctccctccaacgcctccttcctctttcctcctcctcccctcctcggcccttccttcccttcttccctcggcggcggcggcggcggctagcaatcgcgaggaggagaaga

SEQ ID NO: 21908 - DNA, 1501 bp, Oryza sativa
ggcgtgggatggtttcggcggccatggcaattgctgtggggtggctggaggtaggagatgacaggtagggtccatgggtcccacctgtcggggagagagggagagagagttggaagggggaggcagaacagacttgagggagagagagagccgagcgggccgagggaggggaggacttgggccgagcccgaaaaggaggaagggggagttatatttgtttcctttttattttaattgataaaatgaactttgtattgttaaaattatttcttgagctccgaaaattcacaggaaattccaaagagttcattaaggcacagataatattacaaaatattctcggccaatgattttttaaaggaaattttaatttcctctattatttcacttgattaatttgctttcaattttatttaatttctagaaatgctttatttaatgatttttaatcccgaacgaaaaccggggcgttacaatggaggacaagtattgccacggtaggtggtcgcatctggctcaggcgaccaacggagagtattatccaattaaaggattacacttctttatctactaactccagacttgctgttttacaccgtttatgtttaacgtttgaccgtccatcttatttgaatttttttatgattagtatttttattgtcattagatgataaaacataagcaatattttatgtgtgactatttttttaattttttcataaatttttcaaataagacggacaatcaaacgttggacaaaaacccacgactacacttaaattgggacgaaggttatagttgtgaaggtctgtttagagaaccagtttcttcgggatgcactcattaataggcctgtttgagacagctgaattgatggatggatggattatctgatttcttcgtagcaatttgagggtataaacaaataaattaactactacaaaattggaaaaaagttgctttcaaagagtagtccagaaagttttatagaaaattttgctcgatatccatcgtctagaagcttgggaaacgttcaaatgaaaatccaaaatccaaaatcctaaaaaaaagaaacaaagctaagttgtgcctaaactgttttttacaggtgtgttcgttaaggattatatagatatgcaatactataatagaaacagttcaattctcactagaaatttccagctgttctcatttctgacctctctcactagcaagttatcagcagtgcaaacgtgcaataccacaaaaaggacccaaaaaggattgtcgatctacataaccttgtaatcgtaagatcttaagcatggtaaatgtagcaccaaaatgttgcctggctagtcttcccagggacacgccagttggaggaaaaacttccaattggtgacatcatagaacaataagtgcatccactagaaagaacacatcgtatgctcttaaacacatcaaagtgatggatgagtaactaaattagaacaagaaaacgattgtcccctgcaaaagg

SEQ ID NO: 21909 - DNA, 1501 bp, Oryza sativa
ataattgtgtttattattaaatttgagttacaatgaggccctaatacttaaacccttttacgtacatgggacatgtgaactgatatgtctcatgtgcgacttctctttacggttacgcttatagaatacatatgatggtattcagttcgtcagttttttttattgagttcagctcatcgctactttttttctcagcatagtagtgcaagagttacttgaaaacttctaccaaactcttgctaagattagtaagggcctttacaatgcggtgagctgttattcagttcggtcttttcacgtcagagattcggtgtcaatctttgccacgtttgtgggcaggcctaccaaattaaagcccgcatgatcttctttgatcacctgttcttggcgaggggagataaggctacagacgcgttaggagggcgaggcttcgttccactttttctacatgcaccatggacctttgtggcttttctaggtcttaaatcttgatggcctcttgcgccaatcctatacgtgacctgtattgtaaaggccctaacaatgcagatacatggtgtttggcctcgcagtgaacacgtaagaaaaacgcgtacacgtctatgtgagtcgaattcccagttggttgtccggcccttcacagggatgacctgcacctcgcctgcgtccaagatcagatgtccacgcgacacgactccacgcccgtattagatgcgtgatctcatcatatgcctttttaactctatgctcatctgaagctatagacattcgcttgccgctatgcgctgtaggaggtgtagccataattatttgctctttgcatatttgacacataaatacacgcatctaagtagcttgcaatgccctaacaagatctcggtcattcgattcaaccagttggtggttatgaaaaatcaagacgccgtcatagtgtgctactttactttttctaaagtgggataaaattaacaatccttttatctttggtggcaaattaataaatataaagctaaggaaattgcttaaaaaaactatcacaaagttttttttataaaaactttcaaatgtaactatatcaaagtaatagtgaaagtaatagtgtaacttagtaactacattgtaattacgcattgttacattttaacgacactgatagtataattacaatgtaacaatattagtaaactatataacttacgtataaaattgtattatgttttaatcctatatatctataaagttcattcccactaaatgtagttaatgctaattctctcttctctcatgaagccacatcatctcaattgtttttagcctttggatgattcatcaagggtgtaaattccttcttttcacattacctcaatttattttagtatttggatgattcatcaagggtgcaaattgcatctctttcccccaaaaggcacaccatacaacccaatcatttataacttttggataattgataaaggtacaaaaatatataaaaacatgaaaa

SEQ ID NO: 21910 - DNA, 1501 bp, Oryza sativa
tagacatgcatgcgcgagaagagagtgaccttcttgaggtcgctcgcggagaccagcgtgagctccagcaaccggtacgccatcgccggccggcacaggatcaggaggaggatcgtcggagtggaggtggtggaggaggaagggagagaattttgcgtagcctgtggtggcaacgtgcgtgtcctcctcgagttggagaggagcgccatggcgggagttaagaagggattcacggttaggcttggcaggtgtcggtgctgcattgtggcactaagaatagcattgtgcctaaatctcgcatgcttatctttgtgtggtgtggcgttccgctcgggcactcgccgtagaaaattgttgttctgtttttttcctagaggcaccttcaaattaataatgctgcttatctttatatatgcacagtggtggaggacgggaaaaaaaattaggtgtgacggtgtcgccggtgtggcccatggactagcacaaagaaaaaaaaacaatcttaatgcactatattatatgacgcaacattatccgatcatgacgcaatctcaaacatggcaacaagcactagccataggttcacattcatcatccatttgccaaaattgtaaataatacctctaagattccagctgtcagcaatgcatcacatataagaactagagactagtgaggatagatagacatatagaaactgcaaaacaaattgcaaagattaattagtatactatatacttaagattgataacataaagagcaatgattggaataaaatgtgaaggtataccaaacatttatttaattgcttagaggtctaggagatttaggcaattgcatttgcctacttttctttttctgaaatactttttttgattttttttgaaaatcaagtcctttgaatcgatgtagcacaccatcaagtcattgagccaaccatcggacatcttgttgcgtagctccgtcttgataatcttcattacctagaaggccctctcaactgatctagtcgccaccagtaaaagcaatactaactcaatgagacaatataccaatggaaatacaatgtgtctctcaagttcagccatcttttttgctaggcttgctaaatcatgacaaactttgaactcgtcaagccttcgcacataaaggatgaaccaggccaactaattaggcccattctctctctctctctctctctctctctctcgatcgcgccatgttctcactctccctctctcgatcgtgccggtgcggcgcggcgtcctaggaaggaggacgcgccccgggggggtctcactagcagatcaaggtatggcgagcgccacagctcgccataccgagtcatctgccccttatatgcagtgttctggtacgttgaaatgatttgacatcatttgatcaaacctagcctgtcaacatggagccgataaataaatgggaaaagtctgaattacacccctaactattgggtgagtacgaattaccccccccctaaacc

SEQ ID NO: 21911 - DNA, 1501 bp, Oryza sativa
taatttgattgtgtcgacgtttgatgtcgcgattccggtatttgcatagtatggggatcgttggtactaggatatatgcgagattttaataaaagagatggggacgaggaattttatacaggttcgagcccctgaatcgtcaggtaataaccctactcctgttggccgaagccggtcattgctcttattcaccatgatcacaccagtacaatatttaaggtagcctatctaactgttgtcgacttggcggtctgaagtgctgactcgtagtcgacaacagggtagccttcctcctcgaatccacatccggcgagatcaaagacagcgctatgtctctcctgacagtatccgtagacaccgtagggactagccatgcttatctctgaagtcaatatccggcatcttgtcttgtcttggcgtatgttggcttgtatgttgtatcttgatctattgctccgtgtcccctctcctcctatggggtcttgtatttatacccataggtgttcccttgtctaagtagaactagggaaaccaatatggatacaatccgagtagtcattgtcgtttccatgcagaattatggttgtctttctctatccggaactccctccatatcagaggtcagtatccgtataagacatggtatgtggtgggttctgccaagatttagtcaactactattaggtatatggtatccataaccctgacagattatttgtggcttattcttggtttttttttatgcattgtatttgcatgcatataattaaaaatgacaaatcacttatgctcaaataaatttctacaaagtttctcacattctatgaaatagccttctatgaaatattttttcataattttgtttcatattttggtactcaattaaatcagtcaaaacggtcaaatatgtaatgaaacaataacattctcacagatattctatcttttgccaatgaccaacgattgatcctaagaattgccatagattacgtgagttgcatcacacaactatttttcttcctttatgttattaccgttagctaggcttctgtcaacttcagttaaaatgtataaaaatgtaaggagaaacacgtaaatataacattcaaactttgcaactaccactgatgagagaaaatttataggccttaaaaagatgccgagatataccattttttttctttggaaaaaagtagctcccctgtagctctcaagaatggtgaattcacacttccatagaaccagaggtgcacgtgcctgcgtggaaagaacaaacaaatggccctcgcgtaagcaatgacgcaaggcaatagcagccacagacccacagttccgcagccaatatataaatcacaaaagaaacaacgcttatatcaccaaatcccccacactacggtcaacattgtacaataatagacgcccagggtagcaacaaaatgggccgatgagcagcaactatatatgtaccaacaaagtgcagggcaaattcagctgcaagaag

SEQ ID NO: 21912 - DNA, 1501 bp, Oryza sativa
actttcctaaagataaaaggaaactaacaaactattactaattaatagataacttgccatgccgcattctctttgaactcggtctcttctggataagcttcctttagtagatcaatttccttaaccgaatatagcaagaatccaacaactgacgacttggcaactctcataggctaatctcaggatttcaaagccgatgctgactctaagccgatgactacttcgggcttactaaatttcactgttaacacaacccaatggttggatgctttgttctaattttttttatgattttatctaatttagaagtgtcacggattggtttgaaaacatttaaaagatgattaatgggctttaacactgcatgggagtgtggagggaggttttggatgttttttaaagaaaaagatagatatgatgacctaaaataatgtaaattgatggccgaatgtattttttttctaatttaagattactatacaaatgtttagaaatatttatatgatgtttaatggactatttattagtagagaatagatgagagttggttggtgtttatctatggccttttaaggcacgtaaaagagtttttaattttaattatcacggggttaaaaaaaaggaaaggcactgagatgggatggatcattcctatgtacgtccgtgaaagccctgaggcgcgcacggagggggattttatttttattttcctgtaaagataaatctaacgatctaaaataatgagtctaccaatttaaatgaaaatcgattgtcaaatttatctattttattagagtaccacatggtgactcgagagcgtttataggatgccacatggcagcttgagagcgtttgtaggaaatttaatggatttttagtatatcatagatagatagatttgttatacaacatatattgtattaaaatataattttagacctaaaaaatcttatgacgtatagcagatccatcctgaaaccacacggaaaaaagaaagttacattcagatgggccacttcagcccgtgtgcttactgcatgcacacaactcatacaccctttgaactaggaaacttctcttaccatcgttggttcccacaaatcacttggtagtggtggacacagactaactgccaccgccactattggtagtatagattacaaaaacttacatccactaattaactttagttgagccaactaggtcaacactttgaattataataaaaactaaactaatgatcttcctagccttcaaaatgataaaaatgtgacaaatttacagaacacatagctcataaaatcgctccaggatcgaataaaaacttcaagattagtggatggactttgtatatcctaaaaaaaattcccaactccgtaattcatctgaataagctaatttggccaaattgcttggtaactaatgtgacattgtaggagccaagttgtggaaaccactcacactcatcaacaaacagatcttgttttgctaatttgattgt

SEQ ID NO: 21913 - DNA, 1501 bp, Oryza sativa
cacctcatatatattcatgtgcccatgctatttcaaaaaaaaaaaagagagctaaatttacaattttatgttatttggattctagctggattatttagttggttggctacccaaatttaccacacttgtggaagccaaatttgaccaaccaaggcaaacgcttggttcatattattttaatttcttgccgtattttgccaccttcatgggcacaagtctcgttcaccataaaatatgtcatgctcatttctccaatagtttcgtgtcttgtggcaaatgtagattgtgccatccaaacaactagatatatacagttttgtgggaaaaaaaaatctgccaagtctatggttttttttacacatgcctatatagcttttttttttatttgcgcctcacgataacttattgtctgaaatgaagaaaacaatgagctgaaaaaaacaaaactatagtgtgcgctccgtcacaatctgtgagtagtactaagacgtgaccctcaaggcctgaacaatctcattactttttttttcgccccacaaaccattgctattgttccagttgatgtgatataataaaagaagagaagttgctttcgtcccaattcatcaatttataatgttgtggcccacagagatgcgacaacttaaagtatgtaactcgcgtgacctacactagaaactcaggtctacctccatatgttcattgtatggtactaccggcgaatctattactagtaattaatttatacaagattttgacttctctctcgaaataatttcatttttaataatcattccatcagggtttgtgaaattatgaagtaactatgttggaaatagataaagtgagaactagttgcattaagatttgataaagtaggaatattatagtatttttagttttatattaatatgtgtaatatggataaaaaaatgaatttatgttgggagggatgaagggagtttttttctcagaaactgtcactttcgttcagtttgatgtgatataatataaggaaaagtgaagtcgctttcgtcccaattcatcgatttatgtgttgtggcccacatagatgcaataatctacactatgactatggaacctgcgtgacctacaatagaaaaaaaaaaagaaacttatgtacgtctatctccttgtgttcattgcttggtactaccagctagtctattactagtaattaattcatacaagattagatcgaccgctgattggcacaatgccacaatgacaggacctgcccgtccccttccgttagccgggcagacaagcacacgccattgccaaagaagactataatatcccagctagcgaaccatttcggccgggcaaagtcaactaggacaccactactctgccgcgcgcgcgaaagcagaacacactactacagtgacgcaacttccctctgcctataaaaggttcagcggcagaacaagctcagctcagcgcctcgcagccttctttttcatcatttcttgcacaa

SEQ ID NO: 21914 - DNA, 1501 bp, Oryza sativa
ttggtagtgccaaaacttgcttatattttggcactaacaaaatatttgtacggtaacattccaaataggccctaaaaaataataaaattgtattttaccagtcttggagattttaatcttgtatagttttcaatataaaaagatttgataactattgatatttatacaaaaatataaagcacagtataaaatcgccctcccccagggcggcaagggggccgcctgcaaaattccaggccccccgccgcccatttgcaggcggccccccgcacagtacaaaatcgccctagcggagggcggcaagggggccgcctgcaaatttcgttgacggccgtcgcccgagagcgaacggccgtctgccacgtcactttcgccgccctctgggatggcgatttttaaaaatcgccctcccagagggcggtaggcgaccacttatgtcaattttcaaaatggaaaattatttttgtaaaacttttaataaaaaaaattaaaaataaaaaaaattcctgtaaactctatcatttctagtaatggaaatgagaggctttcacgcctcttgataaaaaaaatattctttaattttaaattttaaatttcagttacttctaaattgtattcctatattgattttaaactcttattcccatgtttttctaaatttcgaattttagttatttgtaaattgtatttttatacggactctaaacactacttttcattttattatgtttaatctgaattttagttagttttaaattcctatatggactctatactctacttctaatattccttattttttacttccgaatttctatttttttcttaattgtatttgtatatggactctatagtctacttctaatattccttatttttaatttcaaatttctattatttcctaattgtatttctatatgaactctatactctacttctaaacttctaatgttccttatttttaattctaaatttcagttattttctaattgtatttctatatggactttagtcttctcttctaatatttcttattttttaattccattaatataatagatagatttcatggtctgggactaaaacaaacacagaaacaaaagggttcgtgtaatcgccggtgcggcgtcggggctagctagctagcgtactccatgcatctagcgtctagctactaccgatgtatatagcgtgcaaacccctcccaactccgaagtcaacagccagatcaacacgaatcctctcattcccaagtcaactctgccggatcaatacgaatcctcgcggctcgcgcgctccggttgttaagcagtacgtgttgagtgctaccagaaaagcacatagccattaacatgcatatatacgattcgtaatttgatatgactaattaactacacctcttcttccactataagtactcaagatgccaagctagaagatgtagaagcgagccgaaatagcctcgaaaggaacagaggtgcgttatatagatcgggctgtc

SEQ ID NO: 21915 - DNA, 1501 bp, Oryza sativa
gggcacgtcggggtaccctctcgccgtctccgacaccgcgcaggcttccgccaccagcagcgcgccccgcgccgcccgctgcgcgtagtacgcggcgttgtgcggcccgggcacgttcccgtaggaccggcaccgcgtcaacggcgcaagaacgaccctgcatcagtacgcgcgcgcgcgcacacacaaggcagaagcaaattgaagggatttgcatgaaacgtgcacaggagaacccgatcgatcgacgagaacaatagcatggacacgaacctgtgagcgagatcaaactggcccatcttgtaaggggtcagaagaggggtcgacgcctccattattgtgacagcttcgaccgatggttggattgttttgtttgtgcaagaaatgatgaaaaagaaggctgcgaggcgctgagctgagcttgttctgccgctgaaccttttataggcagagggaagttgcgtcactgtagtagtgtgttctgctttcgcgcgcgcggcagagtagtggtgtcctagttgactttgcccggccgaaatggttcgctagctgggatattatagtcttctttggcaatggcgtgtgcttgtctgcccggctaacggaaggggacgggcaggtcctgtcattgtggcattgtgccaatcagcggtcgatctaatcttgtatgaattaattactagtaatagactagctggtagtaccaagcaatgaacacaaggagatagacgtacataagtttctttttttttttctattgtaggtcacgcaggttccatagtcatagtgtagattattgcatctatgtgggccacaacacataaatcgatgaattgggacgaaagcgacttcacttttccttatattatatcacatcaaactgaacgaaagtgacagtttctgagaaaaaaactcccttcatccctcccaacataaattcatttttttatccatattacacatattaatataaaactaaaaatactataatattcctactttatcaaatcttaatgcaactagttctcactttatctatttccaacatagttacttcataatttcacaaaccctgatggaatgattattaaaaatgaaattatttcgagagagaagtcaaaatcttgtataaattaattactagtaatagattcgccggtagtaccatacaatgaacatatggaggtagacctgagtttctagtgtaggtcacgcgagttacatactttaagttgtcgcatctctgtgggccacaacattataaattgatgaattgggacgaaagcaacttctcttcttttattatatcacatcaactggaacaatagcaatggtttgtggggcgaaaaaaaaagtaatgagattgttcaggccttgagggtcacgtcttagtactactcacagattgtgacggagcgcacactatagttttgtttttttcagctcattgttttcttcatttcagacaataagttatcgtgaggcgcaaataaaaaaaaaa

SEQ ID NO: 21916 - DNA, 1501 bp, Oryza sativa
agacacacatttaaagtattaaacgtagactaataataaaacaaattacaaagactgcctgtaaaccgcgagacaaatttgttaagcctaattaatctatcattaacaaatatttactgtagcactacattgttaaataatagcgtaattagacccaaaagattcgtcttacaatttacatgcaaactatgcaattggtttttctttttatccacatttaatgctccatatatgtgtctaaatatttgatgtgacggaattttcgaaagtttgaaggaaactaaacactgcccgagactcttaccatttttcatggatataaatatgagtacaacatcatatcctcttcctttgcactcgatctcgatcaatagaatgaataggcacgtttttcaagctcctaaacatactttttctagaagcatatattttcaattttattagtatatttaattcatttatatgtataaaaaaggacggaaaacgtgacgatgatgacatgattcaaatttcaaaaaatattgatggcacccaatcgatatcatgaacagtggtgatattttttaattaggtaaagttgtaatgacatggattcaattatcgcaagaaacaaacgctggcttttattctaaagatgtgaagatacaatccgaagcaccatattaccatgttttctaagaaaataagcaagggctctacctgaattagacgaagatggaaaaagggatgaaaacaaccaactttgcctgcaaaacggcaaagagattaacaaagagaaaaaaaaacagaagacctttgttcttttatgagaactcaaaacagaatgcaattaatatccgtgtaccatatattgtttacattccagagcaattaacgaggactccaaacaaacatggcgtaaaggtgacaaacaaaattctctctattatctgaaaagaaaaatctctctgcacctccgggtcctattcgtgcgtatacgtacaataatacatgtgcgtacatatgtacggtgacatcgacgttgctagatacaacaaaaatccttcattatacctgtacatctgtacatgtacgtatacccgtcgtatactagtacaaattgaataataaccgtataataataaaaatatttttcattattttacctgatgctttaccgtgcctttggcttcagaaaaaaaaagaaaaaaaaacaccgagcgactaagagaaggcgaagcactcgccgccggcccgctgtctcgccgcggaaatttcgtcttccccgggattccgcggggaggcggcgcggtaaccgccggcggttattccgtcaatagaatggcggggaccgcgtgggggaggcctgaggagaggaggtgaggcggatggtccgcgccctgtcacgtgcccgcagcctgctcgacggaattccccaccggcgggggcgtgctgcgagttcgtccgtgtccggccatggcgcggaggaggctgttgcgggatacgtccgcatgctggctgg

SEQ ID NO: 21917 - DNA, 1501 bp, Oryza sativa
gaattacaatgactaacctagatgctactactagtacatctcagcaaaaaggactaataataacctattgatggctagagaaacttttaacaacgttcgtgctacataggcaagcttaacttgcgttgcacttgtacggatataatgcgcacacatgtatataggtatagttctaaaaagaaaaaagtaaagttggtatgcaatgcactgtatatggccaacgatgctcgtggtccattcgaccatatgggctttggtcccataaaaacgtagtactacattttattgaattcattatcaaatacattttgatagtatatttgtttagtgtcggaaataatgcttagattttttgtaaatttaatcatactttaaaaagctgacttaggaaaaacttatttaaaaaccttattatatgaaactgatgtagtaatggtcaaagtcacctattcttagtcgaaaggatatttccgctcacttggtttatcaattaagcttttgcaaagtcaaggtaaatacacatacaacatatatgcatgacaccatgtacaaccatatatagatgaacaggagtatacatacctacgttgcttaggtagcaccttgatttaatcaaatgctagctagttgatgccaggtggcacactgcggacggatttgtttgtcagtttccctgcattacacattgtacaggagtgtactacatccacatacaatgaacagtagtagtagcagcagctatatactccagttgcctagtcgtacacaaagtataattaatcacaaaattttcattttatcatggaaaataagtaggcattcataatgcacgtacactccgcacccatacaatgaacagtagtagtagctactagatagttgcctagttgtacacgcagcataattaatcacaagattttcatttttcctaaaaaaaaacaagcagacgtataatgcgcgcacactcatcctacctttaatgagtatcttcagaagattgagcctgttgtcgtcgagaggtacagggtatgtcatctatcactcaaagaataactagtcgtaaatacgagtaccgggttgctgtcaaggggtataggttacgttggctatctcttaaagaataatttgccgtaaatgcgaataccatcaagcctaagacttgcatccatataggctagttacaccacaaaacctaacgtgttaagctacgctccctccacacaaaattttcatttttacccagcaaaaataaatgaatactgaagcatgcagcgctgtacacgagcttcttgtttatcattgcgtatttgtcatcatctaaaaaaaattgcgtatttgtacgcgtacatgcacgtttccatccacaatttcacatccatacgcgggtgacatatattatgcagctctcgtgggcatagctcgccagccaagaacgagctgaagctctcgtgcgcggcgcggccatgaaggcgtcgtcgtcgtcgcaggggcagagcccgag

SEQ ID NO: 21918 - DNA, 1501 bp, Oryza sativa
agctataaataattcaatacagagaaaaattataagttaaaaataatttttagtggatcaaatagtgctaaaactaaaattgtaaatgaaaaaacaaatgaaattagctagaaattgaaaaagcttactttaactcatagatgaaaatttgatccattaattccgaacgggtgcccgtttcattaacataaattagaattttcctattatattcatattactatggtttcaatattatgtgagtgattcaggagcatggttaggttggacaaagaagcaatagcacccaacaggcattgttcatcgtctttcctagccaaaagcgagaaacaaaaaggagggaagatggatgctggtgcttcggtgaaccaataatagtaagtaagatggtaggatgtgtcccacgatgtgactcgtccatagatgatggatattggcaacgaagaaaatcataacagcaagaacgtgaccgataatgacgtggtcccgatagagagagaaactacaacggcgagttctgacgatgaacacgacgtgaatacaaccggtacctcgacggttcatgtaaaatataaatgcatgtgattacgtcagtatgcaatactggtcatcattgatggtttcaattattttatctatatttaaacaatattcttttcttattaagattcggattttaccccaatttcaattagcacgtttttcaaactactaaatggtgttttccgtgcgaaaattttttatacagaagttgctttaaaatatcaaatatatccatttatcaaatttatgataatttaatttaattaatcatgtactaataactttcttattttatttgcatctacttaatcttcatctcaccagtttcgaacaccaccggttacttttagcatttaactacttttgtcagtttctgctgctagtccagcatataaaagctcaaataccacatgatttgttgcatcaactggtcattacagttttcatagaccgtccagagggttaatagaggcagtctaatcctttggaatcaactgatcgatacagttttcaaccagctagaacctactccccccatcttataataaatttatttttgactcctcatttatcctaaaataaactcattttttaagtaaatgtatcagagtttgtgaaaataagaaataattatattaaaaataaataaagtgaagaatatctatattgagatttgataaagtaaaagtattcttatcttttaagttttgtgttgatgtgtgagataggtgaaaaaataatttattttggaatgaaggaagtattagagaagcttagtgatccgataacaaccgtagtcaactaagaaatcttaggttacatccttgcccaacccaaaagagaaaaacatcgagtgattcaaactgccacgttatcaaaagatcatactcatagagtacagatcctgagacagagcatccttgcctgataaagttccattttaagctgcaaacttagg

SEQ ID NO: 21919 - DNA, 1501 bp, Oryza sativa
agggattagcttgtatataggtagagtaacacgctctgggataagcaactggtgcaataacatgttgttaccaactattagccatgtcattgctacatttgccctatttatcctgatatgttgttatgacacaagtcttgacaaaaagaaatggtttcactgccattggtaatactgttactatgatcagcatctacaatatgaaatagggaattaagtaattgttaattgccaaaataattatagctgttaagggtagcagtgtgcgcttaggccatctccaatgctaggtgcttatatgggagcttagaaaagaaaaaacaaaatccattttactacccaaactaatccaatagctagatcacttaatctctgaaatattttttatcctccaaactattgaaaatggcactttacttcttaataacatctcttttttttactctttatacaagactagaaaaaatgcccgtgtgttgcaacgggtgaagtttattttaatcttattattgctatattgtttagttgagatgaaattcactgtagtaattcgcttagatatatatatatatatatattttaaaaaaaatcatgagctgtatttaggagtccgattgtctcaagctagcatgcgagtgtttttaaagaggcttcttatatgactcctttattttcaaaagcgaacgaacttaaaaaccgactcatacacagaaaacgttccaaagtaccgataaaaacttcttcaatttttataagagtagaaatatattttaagataaaactttttataatcatagatggcgctatcattaaagttaaaactacacgaaaattactttgcaccggccaagtagagacgcctcgcgcagatgccatggattaggctgccgaagatgtcaaactgataagtttgcttcaacttcttacataatactttctcagaataagttcatttttcaccaatctcacacatatcaacataaaactgaaaagactagaatacatccactttatcaaattctaattcaattatttgcactttatctgctcccaatgcatttatctggcctctactttcacaaataccgatgtaatgtttatctaaaaaagaacttattttgagataaataggagcagccaaaaataaatggagggagtatatgtctgcttcctctcctctcattgattggtgccagttctttgccgcgtgagcatggtggcaaaacaggataagagaacctgagctgctttcttcgtctcaaaatacagcaatctaagattggatatcgacaggggtgaaaacgggcggatacggtcggattatggcattcccatatcctaacccatatttttctttaaactcggagtcgggtacggttagtgacggataatatatcactcatctcgtattctatcccatattattttcatcaaatcggattcggaaacggatatctatttgtatctctaattcatagatattaaacataataaggtaatt

SEQ ID NO: 21920 - DNA, 1501 bp, Oryza sativa
ccatgtagtaatatgtttactgatgtgttcaatacatagtataagagtaaaaactgagattccttggtctgcgagtaaaacaattaccaccttcctctcgatatagccatgatctcgtagccaccatatagtaatatgtttactgatatgttcaatgtacagtataagagtaaaaaattgatactaagagtattgttgatctgtatcataaaatagtcatacaagtgaaaaaattacaggctcaatcacacacaagcgataaaattactcacaggtgaatcaaactagaaatgaaaaaaaatgattcagctaaaaatccatctggtggctttgctggatcttgctataaggatgaagagaacagtctgtgtcttctgactggtaacacagactggtagtggagagggcaaccagggagcgagtagtagtcgacgatggaataatagaaggatgtagcggtatggtatagagatgagcccgacgttgcgcagccatccatcatctagcaagcacgaaaaaatgtaaaaacattctcgttcatgtcaatagagatgacgagcaaaagaaaaatatcaaacaacctacatcaccgacggactccaccctatcctctacggccagccacatggagcacgatgtgcaaatgtaggacctgtgcagcccatcaattgagatcaggtaatattggagattgcacgttaatttgatttgaaaaaaatattggggcttcatgcatgaagttgaaggagagtatgcagatgcaaatcaaagtgtcatttccttacttgcttattctatcaatgccgccgacgtggtggagtagccgctggttgttgctattggcccaggtgaataccttattgctggttaaggtgctgcccaacgtccggcaacgaggcccgaagcagtgccttcgcctcaaccgccgccggccatcgctcaccggccaccgccatcaaccgccacggtgtcatcgtcctcctccatggtgtgtcgccgatctgtggggtgggatggtggatcgatttagatccaaaaaaaagagaaaaaaaaggaagtgaggcgagagtggttggttgggtacgggaaaaatagaatatataccgaaaacagaaaagttgtttttatcgaagtaaatcatttactccaataatggtcggagcacgatgcgggacgtggggtgggatcagaagcaggggagttgtttttattatcaaagtaaatcgtttactcgaataaaggtgggtggttgaggcgtgcgataggagtaaatcgttgacggagcgtggggctcctcaccgggagaccgcgcaggcccccctttgccggttcggccgggggcgctaagtgaggttcttcgccctcgatctgaggaatgtcagcgagaagaagcgcacaagacacgggccacgtagacaggttcgggccgctgagaagcgtaataccctactcctgtgttctggtggatctgtgtgtgaaggaaaacagagagctccagagc

SEQ ID NO: 21921 - DNA, 1501 bp, Oryza sativa
gtcggcgaggggggtgtagaaccaatcgctcttccagtcgtcccactttttgcgaacgacgcagggaatgtagcggttcagcacctgcccccacggctggaagtagcagccaccgactaccgtcggcggcgacaccggctgtgcggtgaagaaccaccggaacagccggagagacgggtgtaccccgataaacatctcgcacaagtgcgcaaagatggccaatgtcattatcgcgttgggggtgaggtgtgccatctggagatcataaaactccagaatatccatgaaaaaaatagagaatggcgggaccagccccgccattgcgaaagagaggaagaagacggaccgccccgggtagtgtggcgccgggcgtccctcgcccagcgcgaccacctcccggccggtggcagattccggcttgaatcggcgcggcagcccggcctgcctctcgctcacgatgcgggaaagcggcagcacgctaccctcgagcggtgcggagccccgtgccatgacgccggcggaggaggagcttgagagcgagcgagtatggcaaggttagggcgcaggaaacggagagtcagagcacaagtggcgaaggcaagggggagagtggcgagaggaaggaaacaaatcccttccttggcgtctttgtacccttgccaacgctatgcccggctcctcgcttcccgcacccactacctcgccccctcgtttctcgcgcccgcgcctccactaaccccactcgcccgtttgcggcgcacgcgatagatgtgcggccgtggcgtttgagatggggcagatcgtgcgcgcattaaccgcgctcgccaaccgcgaaaaacgccatcatcatgtccccaggcgaaacaaaccggctcgtcccgattcgcgcgctgctcgagtaatgtagcggtcttgaagaggccgctcattattgtcgatcggtttctcccttgccgatgcgcgcgatttgcgaccgttgggtttctgcctgcctgtggggaccggccccacctgtcaccgggcctaaggagtggcatcatgcccgatcgcctccctcgaggggggcggtcgccctggcgtgacgccgggggctactgtcggtgacatggggccgggggtatcgtgactagaggcttgggtagccgcgatcactcacgtggcccgaccccctcgggggggtcgggcccgacggtgacgtggccacctctccctctgtctccccgaggggtcgggccgctcctgtttcggccccgagggctggggcaccccgaccccctgtggtgattggcgccacgtgtgtgggttaggtgagcacagcggcgctcacttaaccgcatttatagcgggttagacgagcgcgtcacgccgcattcaatgcggcgcagcgcatgcttatccgatctgtgaccagtcgcggtatgtgaccggtcacagaccggtcagatcgcgggttaggtggcaacaggcggcctgtcgcacgcctcgccccgtcccgtcggaa

SEQ ID NO: 21922 - DNA, 1501 bp, Oryza sativa
gaagaggccgctcattattgtcgatcggtttctcccttgccgatgcgcgcgatttgcgaccgttgggtttctgcctgcctgtggggaccggccccacctgtcaccgggcctaaggagtggcatcatgcccgatcgcctccctcgaggggggcggtcgccctggcgtgacgccgggggctactgtcggtgacatggggccgggggtatcgtgactagaggcttgggtagccgcgatcactcacgtggcccgaccccctcgggggggtcgggcccgacggtgacgtggccacctctccctctgtctccccgaggggtcgggccgctcctgtttcggccccgagggctggggcaccccgaccccctgtggtgattggcgccacgtgtgtgggttaggtgagcacagcggcgctcacttaaccgcatttatagcgggttagacgagcgcgtcacgccgcattcaatgcggcgcagcgcatgcttatccgatctgtgaccagtcgcggtatgtgaccggtcacagaccggtcagatcgcgggttaggtggcaacaggcggcctgtcgcacgcctcgccccgtcccgtcggaatgatgagagcttcctggttctcgtctctagccggagctggcgtgctgactcctggagttggtatgtcagtcccggtcagatccattccaggcttcagtgcaagcatggcaagaaaatcgctggccattgaatgaagtatgaaacgggcgtccaccgggagagctgacgagcggagcaggaggcgtgtgtactgcttgtcagaggtcatttccggctgtagattagccctcattgtaaaaaacatgtttcttttcttaggcagagagaggcccatgtggtgacccctaaccagataaaaaaaggaggcccaggcctaaggagagaaaaaagggggggggaggtgagaggctggccacttgattggagagcctgaactctctctcgctctagagctctctggctctggagctctctgttttccttcacacacagatccaccagaacacaggagtagggtattacgcttctcagcggcccgaacctgtctacgtggcccgtgtcttgtgcgcttcttctcgctgacattcctcagatcgagggcgaagaacctcacttagcgcccccggccgaaccggcaaaggggggcctgcgcggtctcccggtgaggagccccacgctccgtcaacgatttactcctatcgcacgcctcaaccacccacctttattcgagtaaacgatttactttgataataaaaacaactcccctgcttctgatcccaccccacgtcccgcatcgtgctccgaccattattggagtaaatgatttacttcgataaaaacaacttttctgttttcggtatatattctatttttcccgtacccaaccaaccactctcgcctcacttccttttttttctcttttttttggatctaaatcgatccaccatcccaccccacagatcggcgacacacca

SEQ ID NO: 21923 - DNA, 1501 bp, Oryza sativa
aatgctcggaacggctcctacggtcggtggagtcgaaggcgtcgtcctgctcgtcaccaggtccctctgagcgactcctggagcctggcagataagtctcgccgctgcccagctctgagccactggatctactgctgctgagatcgcagctgccactgggagtagcagacaaccaacctccgttgccactggctggacccctagcggctgatgctggagcgaaggagagagcagacgcgggagctgacacgtgaacgggagctagagctggtactggagctgcaggaactaccggagctgcgagcggaactggaggtgctgcgggagctgctgatggaggtgggttcttgggcgcaagctggatgcgcacgggtgcagtcgtggtcttgtggggcgtagtgcggatccggactcctcctggcgcgggaagaccctttaactgagcattatccctcttcaggcgcgctatctcgtccttcagagcgacgatcctcatgagcttcccatcattcaaggccttggacgccttgtgcaagtctgagtgcatcctatccaatcccctcatcacagcacacatgtgaccaaaggtagtgtcgttctcgccggctgtcggacggaaagtactgacatcatcaccgctggctcgacgagggtgaaatcggtacgccgtgtcgtggaagatgtagttgtggcgctcccgtagtctggccatcatcaggtatgctgcctcctgacaggcgtgatctgctgtgcctccggatgcctcaaccaccatattagctaggcaggtacccacgtagccgtgaacctccaggcgaacacggtgaggaagctcgccactgagcggtggaacagtcgtgtactctggcgcgttggggtagcccaccaccagcgtcatacgtgccaactctgccacaaagtcaatcatgccttctccgcggtggttgggtgggtggccggccatctagagaagacaaaggagtaggatcaatgcatgctcaaatccaaatttaaataaagcaataaaagactcaaataagagaatcgaataagagcaaaattttatgcatagatcgttttgcatgagagcgaataaataagacagactcacataacgataaaatattggggaaattagatacatactaataataacagtaagagcataaataccttgcaacccatgttcctgagctaggacctaatgcatttcacccattaaatcccaactgactgacgaataaatctcaatagttttacaaaaaccctggactgacttgttttgacaaatctcacttaaacgagcgaccaagatttttccccttgaaccacaagaacagatcccaatttttccggaacaaatccaattgcaaagaacatatgcaatgaaaaggattcagagggctcttaggtttttccatttggcttgtcctacggtcaaggtcggctctgataccaacttgtcacgcccagaaattcccgaatagaattccaagcagaa

SEQ ID NO: 21924 - DNA, 1501 bp, Oryza sativa
tgagattcgatgtgttaggtcctcccggggggtctcttttatatcgcaggtcaggtggtctccaagtaggactcggagacatcggaccctgcacgatacagtgatgacccagtcctatacgggtaggaacctttccattggtggacttcgtgatgaattttcttagcgtatacagagaacgtccgtacacgcgcagatgtaccatattgtcgtatagtgtacatccaagggtagagggtataccttatccgtaaccctgacagtagcccccgacttctgcttaaatgaactcatgtaaccgatcgcgacttctgatgtcgaagttgctgtcgttctcaactggtcgatctcagtatgagaaccgtagagacaaggagtggtcgacaacaccatccgaagttcaacggttataagtgaatttaaattgaagtccaaaaaccgcctcgtgcaacggacccagaaatttccggcggccatctctctcctttccttggaattcgcaccgtcgatagtgcgcctatttaagggggttttgggaatccattttagagtccggctgttgcgaaaaactttttagcctccaaacgctcttcgtcttctccgcttccatgcaaaccctaactcgctcgcctcggtttcttctccggcgatctccagcggcgatggacctcgacaagtccacttccaccagtgcgtccttgaagaagttgcaggaggagggcgctctccccagtcgtgggaccatggagagggaactaggaggtactgaacctgaacccgtcttgggccgcatggttgcggttgaggactatattctctgtggttttcttcctccgccatctgagtttttccttcttgtcttgaacttctacggcctttctctgctccatctgaaccccaactccatagccttccttagcattttttctcatctctgtgaggcctacattggggtagagccgtttcttgacctcttccgtttttactacgagttgcactggatggaacctaaaaaggtatccgggtatgctggttttcgacttcgggatggcctgaagtcgcgatacatccctttccagtgcccctcttctcatagcaaatggcgggcgaggtggttctatcttcagatagaagattcggatccagtcttcattgttcctgaggagcaaccagacaagattccgtcttggaccgccaaacccgccttgaccccattcctccagtctttcatcgatatcatcgatgacctccgagtacgagggttgtcgaggtatgaagtcgctgccgacttcattggtagacggatccagccgctccaggctcgagcccatccagcctttgactactctgggccagaggacgcgacccgggtttctcctcggggtatttttcttgtattctgggttcctctcctttcatgcgcattcctcctgacttatcgaaatttggttctcgatctacaggtttgaatagcgcaaccgtggagcatcgtgttggccag

SEQ ID NO: 21925 - DNA, 1501 bp, Oryza sativa
ctcattaggcttgccacagaatgggctagcctgcgccatcatgatgaggctggacttcaagtcgaaatccacgtctcccatgttgatctgcggcccaatggccacattgtcagcagagggagcagcgaattcgcggagagtcttgtttgctacagatctccaggaactattgcagatgagcattggcatcctcattaggcttgccacagaacgggctagcctgcgccatcatgatgaggctggacttcaagtcgaaatccacgtctcccatgttgatctgcggcccaatggccacattgtcagcagagggagcagtgaattcgcggagagtcttgtttgccatagtcttgaaggtcggtggcgctggtacggctgatttctctgtcggtagagttttctgcggagcagcgactcgtggcctgacactccggaagaaagcttctggattttctttgaagttttccggcaagttgaaaccagtcatgcactaccctgtttgcacaacaaaaagtgaaaacaaccaaggttagcctgcaaaggaaaatgattatacagaggtaaatataaagtataagttcaagtaatctctattatgaatcttccccggcaacggcgccagaaatgcttgttgatatttcttaacgacattactagaaatataatccccggcaatggcgccagaaatgcttattggtatttcttaataacattactagaaatataatacccagcaatggcgcagaaatacttctgatatattatggttacagagttcatccgcaagcgcatagatataccattgtagcatttcacccgagagtattccaagggtatcgtatttattttatctcgtgagaagatcatgtagagggaacattgactaataatttatacattacttgtgatgatcatattctaagcaggggttaagataatccaagggtagagtgacacacaatcattcactactcattctcataatatatcatctaagctaagtagatagaaaagaggaagaaaatctattcctatacttctaatatacatagtatacatacattctagttaaccgatatactagctaataccctctatccgatgtcctcctggtacttcgagaagccacccctgactgccgagttccttacgacagcccgtcatgaccatacaaccggggctaaatatggaggaataccctccctaggaaattaacttaggattatataccggcgtggaggaatacccgtactgagctgtcaccatcagcggcccacctctcatccgcaatatataactccaaataatgatatcccgtaatctagacaccacgcctaaactaccagatactactctaatatcatcgtcatgacatagtgtcgaaacatgaattcggcaataataaaacggggtagcgcacgagacctaaaagtggatggatgtggagacaaaggattagacaggttcaggccctctcaatgagaggtaataccctactcctgtt

SEQ ID NO: 21926 - DNA, 695 bp, Oryza sativa
taccacgggcccgaccctcctcgggggagtgccacgttggtaccggcagcctcctccctctggtcttgatacccccagacacatatcaccgacaatgtgaattttaaaatatataattagcttgaatttaaacttatcaccagtctccctctctactaaaacttatcactagctgatgtccctacttcgatgtatttaagcatcagtagcataaatactttaactcatatttttcttgattttaattgccttaatacttgtgccaactcagaataagccatatattttttaaatggcaagaggcttattttggtaggggaaaagaaagaaccaaatgttttttatccgtggcgaaccaatgatgttacctaatatcattcagaaataaagaaaaacatgcataatgtcataatttttgcaaggtatttgaccgctaggcacatagtgatgcaaaacttgttggcaagtgcccacaaataatgccagcttagcggtacttgtgtcatgaaatctaattctgaactctctgtaaaatcatatccaacatttgttgaagttgccttctgagatcgttcactttatcatcgcacgagtcacgagacagatcatttatattacattaaataagaaaatgagattctcagacgagcaggtccttcatttatcatcaagtaaattcattccgtgtgcacagg

SEQ ID NO: 21927 - DNA, 1251 bp, Oryza sativa
cctctccttttgttcgttaggaggctccggagctcgtcccgctgtcgccatcgtcctccgtcgctcgccgtcgtcgatcgttgtcggtgaggcctctcctcctctttctctctctctcccgcaccgtttagccgccgcttagccacgtagctgccgcttcgccgcgacgccgccactctccgccgccggccagtcgccgccggccgccgtcttgcgccgctgccgcatgtgtgccgcgccgtcgcgcgccatggtcgccgggccggtttgcgccgtgcccgcgcgcaccagccatcggttcggccgccgcgtggcgcgccgctccttcccggtccgtggacccgatccgccgtggaccgccctccccgagccgctgaccggtggggcccgcttgtcggcgcccttcctccctctccgagtcactgccatgcgggtcccgcttgccagcgccgcgccccgccttgatgacgtcagccctggaatatattgcgcaataaatgatttaagatttttcttttatagtaataaacacagtgaatcttctaaaattcataactaattcatccgagctccgtttaagcccattcaagtctcagtaaatcaagaaaaatgtgtagaatccattaaaaatggtttcgttctctgtttcagtagtcttatagtctgtttgcaatgtttgctttgtatgtcgctagattccggttcctccgacgctccggtgtacttcgagatagtcaccgaggttcctccagcagcagagcaaggcaagtcatgcttgtcacttgaacatgttgatcctatattgcaaatgctctattattttctttcaaatattgcattgttttataatgttactaggggttgtttacctattgccgtagccatgctattgttgtaccttgtttctttgtcaacttggggttctaacatggttagagttaggactagggattgcttagccatgcctagttcaactagttcacattggggaaaatcctattaatgattagactgtcggttctaatggttttgttgggttagtgacaccgctttggtgttggttaattaaaatgaatcacatggtgggctgtgggtgcatggttttgctggtcgcacccatggcagttaaggaccggttcgcgggatgccctggaagaacttatcgtacttaccacaagccagcgtgggcaacggctgggcttgtagtgtagctttcctctagtcgacgcatccaggcaagggtgggcgtga

SEQ ID NO: 21928 - DNA, 1501 bp, Oryza sativa
agatttattcgtcagtcagttgggatttaatgggtgaaatgcattaggtcctagctcaggaacatgggttgcaaggtatttatgctcttactgttattattagtatgtatctaatttccccaatattttatcgttatgtgagtctgtcttatttattcgctctcatgcaaaacgatctatgcataaaattttgctcttattcgattctcttatttgagtcttttattgctttatttaaatttggatttgagcatgcattgatcctactcctttgtcttctctagatggccggccacccacccaaccaccgcggagaaggcatgattgactttgtggcagagttggcacgtatgacgctggtggtgggctaccccaacgcgccagagtacacgactgttccaccgctcagtggcgagcttcctcaccgtgttcgcctggaggttcacggctacgtgggtacctgcctagctaatatggtggttgaggcatccggaggcacagcagatcacgcctgtcaggaggcagcatacctgatgatggccagactacgggagcgccacaactacatcttccacgacacggcgtaccgatttcaccctcgtcgagccagcggtgatgatgtcagtactttccgtccgacagccggcgagaacgacactacctttggtcacatgtgtgctgtgatgaggggattggataggatgcactcagacttgcacaaggcgtccaaggccttgaatgatgggaagctcatgaggatcgtcgctctgaaggacgagatagcgcgcctgaagagggataatgctcagttaaagggtcttcccgcgccaggaggagtccggatccgcactacgccccacaagaccacgactgcacccgtgcgcatccagcttgcgcccaagaacccacctccatcagcagctcccgcagcacctccagttccgctcgcagctccggtagttcctgcagctccagtaccagctctagctcccgttcacgtgtcagctcccgcgtctgctctctccttcgctccagcatcagccgctaggggtccagccagtggcaacggaggttggttgtctgctactcccagtggcagctgcgatctcagcagcagtagatccagtggctcagagctgggcagcggcgagacttatctgccaggctccaggagtcgctcagagggacctggtgacgagcaggacgacgccttcgactccaccgaccgtaggagccgttccgagcattaggctcattttccattagtttatcgtctgtctagcatttgtttgttagtttgtgtatttaggttgcttgcttgtgggtcagtcgacggtcgatatcatgtgcctatgatatggctgtcttaataaggatttttgcttgctttttaagtgttttaattcagatcagaacaattacagtttaaattcctatataataaagcttagtttttgagcctctatttttcttcttttcccccgtctgcttttcctccaga

SEQ ID NO: 21929 - DNA, 1501 bp, Oryza sativa
cagattttcacaaaatgcacaagtttgaaatgtgtaaatttttattgggtcaggactcaggattatgtgggtatggatcagtgtgctacccacatgttttaggtatgcattgcctcatgatttttgctggttaatggaatatgatggaagcagtaggagttggttgctagggtgaacgaagtggtacttaacttgtagtaaatggtgtttgcaacgccatcttatcttctgccttgcagaggaaaaacaattcggatggaagagagagttgttgcatatattaggctactttataaattatatactataagtaaaaacctttttctcatactgacctatttaggagagggaacaaatctataagtcaaatagtggatggatcacatgcgtgtccatgtttttacatcgattacaaatttgaatattctcatatctgaggttgaatttagatatcatcattgttttaacatgaaatgatccaaaatgccagaacatgaaatgtgcatcctatggagtatttgggaagcactgaaagtacactctgtggagtggcaaaaatgtttttcactctgttttgttagacatgccacatatatcttcattgcattttctagttaaaatagaaaagagcataatacaacatatccaatggaaaacattaaaccatatttgcatctgtcaaatctagatgagtggcttatgaattgggtagcacaacaaagaaacaacagttgtggtcaagccaccatatttgcatccattctatttcagatgtcaaataatttagttagtcagatgtccaaccaaactaggggtatcaatcggatacgaattatctgtagactacacaattctttaggttaaaatatggtttattatttccatcggttaaatagtttttccctctatttgattgtgtatatgtgttctacatttccaaataatgttatctgagccgtttgtattcaataaacaatatacatattttattgtagtttgcctaacagttttttctttttatgttttttccctgttcactcaatttaatataattattagttatgttttctaagaggttaaacgtccttaatatcatactgctacataaattacatggatattgaaaatccaactgaattacttatgtgtttgtttcatatttttattcatcacaacaatcagttttcctttttagtccgtgtgagcgtatttgaatatcttttgttatgtgcttaaaacatgagcatgaatgtgtaaagaccttactcgattcttattagatctgttgacatccctaccccataccgtatttcatgttgccacaattgatgtagcaaatcttcaaagatatctagttgggagatagtgattttcataattttctatgtagcttgaatttagctaggccccattcttgcaacttttattttcttttcttttttaaaagtataatatttgcatgtggtggattccttgacgcaccaaagaccacaagcagtga

SEQ ID NO: 21930 - DNA, 1501 bp, Oryza sativa
ggaggcggcgcccgcgcccctatggtcgccggcggcggccataggcacggcggagcggcggtcgagagaggggaagggaagggggaaagaggcggcggtccacggctcaccctaggttgacggcggcgacggaggaggcggccggagcggagggaggcggccgcgcggctcgggtcgacggggtcgacagcgttccggcagtcggcgaccgaaacggagaggtggacgaggttggcgaggatgcggcgaacccgaaggaggcggcgccgaggtgggaggtggtccggggcgacgacggcggcggaccggagctcggcggcgacggtggagagagagagcgacgtcgcgagctcgaatccggcgaggaggaagggcggcgagaggcggaaacggacggaggaggtgcggggagggtttaaatagggttggaagggggagagagcggccggcggggaaggaataggtgcgggaggtccggccaccatcaatggcgccggcgagatttgcgggggcaaatccgcctgtttgaacgcgagagagaggggaaaaaatggggggaaagggagaggggatcacggggagtgatttcccccactttattgcacgcggggacggcgggaggcggcgggattcgcggcggcggcggcgctaaggcgcgggggaggcggcgggagcagcgggaggaaggggatgacgggtgggccccacccgtcagcaagggtggcgggcgggcccgcccgtcagcggcgcgcgcgcggggagaggccgagtgggccgtggggagaggagagagagggggaggtagatgggccgggccggcccaagggagggaagggggacttttagggtttttctttttataaaataattttaactttgtttatttcttaataatttttatttgtgctctgaaaattccactaaaatttatttacgcattttaggcttttaggaaatttacaaaaatcctctaagccttatttgacttttaactttgcacattttaattgttggaggctttcacacggattttaattattctaggcataatctagaggatgtattttagagtcattttgggacgtgacaattgatttcatatttctcttgtggagcctatccttcagctagccttgcaaagagaggggaacgatgaagaacattaatatcattgtgagatcatggcaaaccgaagaatgcatgcggaatccaaagatcttttgaagcaacaacttccaaaactatagttcgtttgcttaattttcctttatacatgcctttccatgctgaagggcaatttttccactcccaatgcatgcaatctatggatccaagcattccaggaaaacttctctgctctccaagtgcaagtaatctagaagtgtcagcactagttggataacgcaagtactcgtctccgaaaatctcaacaatagctctcacaaaccttttcagactctctatagtggtactatttgcaatttgcagatattcatcttga

SEQ ID NO: 21931 - DNA, 1501 bp, Oryza sativa
ttaaaccactaaattcaccccagaactgatgcacaaggggataaacctcacctagggttttccttttatatcccacgggaaacagcggggaaactccgatctaacccctccttctactcttctcctcctccacgttccatttttccactttgcttcttgatccaagctatgaaggtggagatctagggagagcaaggtctgctagagaggagaggaagcaaaactaagtataggaggtggaggagtcacaaccggcgtcatgggggaagggagggggggatggttcggttcctctcccctagggttttaggtgggggtaagggatttggctaggctcttgggccttgacccaagctaacttgcccacttacaaaggaactttattcaactaattgtggctatcttaataaaccaaaaacattatcttttatttttttaggggtattagaactatagagcgagactgcagatatatactttttatgttaaaccatagtcctcttaaatggtttaattttgatgaatatgattatttgaaatgatcataaatcgattggtaaaatctatccagtgcgtgtgcactgcatgttcttatctagtgacccttttgtgagccgtctgaatcagttgatgatggttgagatatatattcatgggtgttgtactaaccaagagacaaaaaggggaccacttgctagaatatgaggaccatatgctatctaccagttgtcatagcaattcacttgtattttttagatctgtttgaaccaccctactctacttaaagagaaaattccctgtgtacccctgaaagttcacctaatcccttctataccccctgagatttgctcattctctcccatgcccctaaatttcagtttggatcacttctataccccttccgtcaattgaccgttagttgaccgttaaattcacatcataaagtctattttaccctctagtatcaagaaaatataaatttataaagtatattgatggagtgtataaatttattgtatgcgactattatatttatgagtttatttcgtgaggtattatttgcgacggagcggcggcggcaggcgtcagaggggcggcggagcggcacggcggtgtggtcgtggcggcggtgcagggcgtttttagctggtgcgggagcgggcatgagaaggggaggcgcgagtgcggtcgtgagagggggaggcgcgggtgtggtgtctatacgtatgtttacgttggcttcaccatcaccactacgaattttttaagtagtaaagagtaaagatagtgaggaaaaaaataatctatactatatagtatgcatgttagcttagtcaatactcaatagttagcgatgctattaaacttgctctaacccgatgagtgttaatgagtaatgaccggcacaacacgctagcacgtgcggacgaattgcgacgggaaatcaccatggccgagcttcctctctatctacttctccttgctctgctggtcgccgtcc

SEQ ID NO: 21932 - DNA, 1501 bp, Oryza sativa
ggcagccaagacaggctagccgcaggccaccctgcgccttgtaaaaaaacaagaaacaaaaaaatgtagccctctaggggactcgaacctacgacaacacgcacagtattcatgaggaaaccccactgagccactgaagcgttttgccaaacgacgtgcactgtattatatatattaaactgtagcaggtaatggacctgccacctactcgtggtgttcatcataaaattcacgagaatagctgcagatttttacttttaatgcgtgtataaaaatttaaattagtttatctccctcatactaacttcaactttaattattcttttttataaaattttctaaactcatgatctatccatttattgtgctattacaactattatttttgtcatactttcatgtgactttgttttatcaattgaagatttaaatttcaaaaagtggcaacttcaaacaacattttgaagcagtaaatgattgcaaaacaaatcaaacccaaaagacaaattttttttgaactaaattattttgttactaatttgttacttgtatatgttgcatatggtaaaactgaaaatatttgcatatatatagtgtgcgaacaaaaaatatttggagcttgtaggaatttaacctaacacctatagttatccagcaacattcatagctacttcttttagttgattatgtatgcactcacttatacttttcactacaagaaatatattaaaagttaaagcaatttaatcaagtgaattaatcaggaaactaaatttttcctttaaaaatcatggccggaaatatttttgtaaaattctaagcggtctaaattattctctaaaattttccgtgaattttcggagctcaataactagttttaataccacaaaattcatttaacctattaaaataaatggaaaataaattaaaatatctctctgtccttgggccttttttggcccaagtgttactctctccctccctcagcccgcagcctttctctccctcctgggccggcttcccattcccctccttcttcttcgggctgccagcctagcccatttgctcccccctcgccgagaagtccattttagctccctcttctcaattaatttcaaaatataaaaaatccgagtcaaattttatcatactaaataaacttatgtgaaaaagttatcaaaaacaaagttgtataacttaattagatctatcaattttattttggttatttctccatctgactttgattgacctatataaaatttgaattttaaatataagaaaaatcaaataatttttctggtagtaaataatttgaaatgaaaaaaaaatgtcaacaacaaagttgtatgacttatcaagatctacaacttttgttttggtcattttgctatatgacttcatttcaataatttgaatttgaatttcaaattatgacaacttcaaacagcagtttcaaatactaaatgatttcaactgaaaaagtcatcaataacaaagt

SEQ ID NO: 21933 - DNA, 1501 bp, Oryza sativa
gtcaaaaattggtaaaattttcaaataatttcggacaaaaagttgaaaatttcccaaaatttttggaaatttcagttgcaccaaaacttcagaatttcgatgcaaaccgaaagtgaaaaccctaaatttcgatgcaaaccgaaagtgaaaaccctggattagatagctttttaaaaaatcacacagacgaaaagaccaacgatcgacaaaagaggtatactccattaaacggatatgtgtcattattacatctcaaaagagccttacaggcggctgacatgacacacttaattccccactctctatagatttactagtattgcagtgcaaaaaaggcctgcacgtactatttattttcccttagatatacctgacctgcctgatacaaaccaaagtacccgtataaaattattctgcgccacggtatcagtccaaatcaagaaccagtcgctggtaggtatagttgcgtcgttggtgctacacccagagggcacccgcattgcgaagcagcgggacaaggttgccgctgaggtgcagcgacatgaccttgtcggtggagccgacgagcctcccgccgatgaacaccgccggcacggcggggctgcggccgaggagcctcgccagcgccttctccatctccttccccctcgggtcctcgtccagctccaccaccgtcgggttcaccccgagctcgcagaagaggcgcgtcacggtgtggcacatgcagcacgagctcatgctgaagatcaccaccgcccgctgcgccgccagcctgttcaccctgtccattttcttcttgccttcttctcccaagagctaattaattaagctaaactgagagatttttcctctggaaaaatgcagctggtcgcctgctactgctagctaggtatttagcttgagtactagctagctagcttcttgtatgaggctttgattgtgttgtgctttgctttgctttgagctgtgcataggtgaggagcctcctgcctgcttatatagccatggaaaatgtgcgtgcacgacatgagattttgcggcaattcgatcggggaaaagacgaaggttcggataatgtatggccaagcaagcttgctcctcgcgacaccacggtccacggatcgatggatttagtgtggaatatggaatatatggatgacaatggtgatgcagcaaactgatgccgagatggtccttgggaggtgttgataaggccttgaccctcctcttacttttagtagttccattctatcatatttgacaaagctaagtcagaagagagagagagagagagagagagacgctggtggtggtgttcagattaatgccaaaatgaatctttccaaaatttggtattgtcaaaattttggtaaattgcaacgttgccaaattttgataggatagtcttaatacaatattgccaaaatttcatagacattaccaatatttggtaagaaactaaatgcaacaacatgattgtcaattttactaaataatggta

SEQ ID NO: 21934 - DNA, 1501 bp, Oryza sativa
tttgttttaaaaggggcctaaattctttcctggccgactccaaagtatcaagataagtctttctagggtttcagacttagcttggaattgctggtatattctctacaaacacgaagcaagatgtcaatcggcataaaataaagtaccaattacgtgggacggattttaacttacgttcacaagcttggtagacttggataatcttttttgaccaggagataatcgtttttgaccaggagatcacattcctcgcctttttttttgcttgttcaaaattattccgtgtttacggccttcagaatagtgccgctgaattttgacagggggaagggagtctcaggaatcgacgggtcgctacttggtataggatatcatccatggtgttacctggtgcagcgatgtactggtgatgtggtgggaagggacgattgtgcgatggatggttgtgacggtagcagatgaaaactttcgagttattgttaatgggccaatcatctagcccagctaacaaacgtggccctagatttctgagtgcgtttcttctcgtgcaaccattgctcgagctctctagcctccatgctgcaacacacctagcctatttcaatctcctcttgtcccaaaccactgtccaaaaaatatattgttctataatactccaacccgtttagtctgtttcagctcatgagtgttcttatttcggtttagacctgtaaggtccaagtgttcatttagtgataatagtcctatatggagagtcttcataggtttgagactgcttaaatatccaattcactccaaacacaatatcactagattaaccattttacacgaaacaaaaacgaaaatataagcgagttgctatgtgattatgtgaatgtgggtccactcagcgtgtagagtgaactaatgcgagtttgaagacgctgtgttataggttcttgatccacatcccaagaggtataccccaagtccctaattaaccaatcgtcctaccagtttggagatggttttcctaattaagcatatatgtgtttgtgctagagtagatcagggatttcaatttcggtttaagttttttgaaattttagtaattttgccccccccccccttccggcaagcaaaatttgcaccctaattttttttcaaacttttgtgaatttgatcaaaatgtattcaaattcagtcaaaaattggtaaaattttcaaataatttcggacaaaaagttgaaaatttcccaaaatttttggaaatttcagttgcaccaaaacttcagaatttcgatgcaaaccgaaagtgaaaaccctaaatttcgatgcaaaccgaaagtgaaaaccctggattagatagctttttaaaaaatcacacagacgaaaagaccaacgatcgacaaaagaggtatactccattaaacggatatgtgtcattattacatctcaaaagagccttacaggcggctgacatgacacacttaattccccactctctatagatttactagta

SEQ ID NO: 21935 - DNA, 1501 bp, Oryza sativa
ataaatcttggcacagatccaatggtccaaaatatgtaagatttcatccccaaatttctgtcgaatgatatatagttattccgctcttttaaagagagtataatttttaagatccgattacatcattgtatttaggaataagtctgcttcaccccttggggttggtctgcttaacccccctaaagtacgaaaccgaatattctaccccttgaagtatgaaaaccggttcaaataaccccctagagtagttttgttggtagttttgccatgtaaatgattatgtggcagcggtattggcttgcatgacacaaagattagtctagtaaacctaagttgatctaactattgcttttcactcattgatcggcaagcctaaaatatattactccctttatcctataatataaaaaatgatcaaaattggtacgattggcttataatttctcatatactataaggtttattatagcaacaaaattataatcatatgaacgtaaattcaaatgccaatccaatgataatattcccaacaaataaaatttaattcatattatactaattattggtcaaatattatagaagttgaatcttgaaatgcttgtgcgcctcatattatgggttgaatggagtatatattaacactaatttacatcattctcagcctgttttcacttgtgaataaaatgcttagcatgttacaaggccagaaccattgacatgccatcgtgtgcacaacaaaaccacatataaaaccactctaggggttatttaaactggttttgatactttagaggggcagaatacccggtttcgtacttctgggggttatgtagaccaacctcaatacttggggggtgaagtagacttattccttgtatttatttcaattaaaatctttatttataacaacatctcacattattatatctgaaagggtcaattaatgcctagagaggagtagagtagataggtgattaaaacttttaagtaaatgcgaaagaaacttttcagatattccgagaataataatttttttaccaatttacaaatgggccagttttcatagaatagcaccactaatttaccaattattgaatttcagaataatcaattattacagatataaaagacctggttcctttaccccggcgtgtttcccacacgagacacgatcacacgaccgccccaacagcaaaacttccaccccgcgcggccgcgccccaccctatcagcgaaaagggagcaaaaaaaaaaaggaaaaagaaaagaaaaaggcccctccacttttcccatttcgtcatcccccctcctcctcccctcttcgcctccgtccacctcgcgtgcggcgggagggaacccaccgacctcgttcccctccccccacgtacacgacagcgaagagccccccccaagctagggctccccggcggatcctcggcggggtgggtctcgcgccgcccttcccccgattcggcggcggcgccggccgcgatggcgaccc

SEQ ID NO: 21936 - DNA, 836 bp, Oryza sativa
gccgtttcctccgcaccacacggtcgccaccgctccctccctccacaggccggcgtcgccgctcctccctccgcgagccagcgccacgcggatcccctccctccctccacaagccaccgccgccgccgcaacacctcgcggtcgccgccgccagcactcagagagagagagagatggaatacggggagagacgtagatatggatagggtttggtcgagggtattttggtcattacaaaaattaattgtatttctttcttttttaaaaaatgaaaacttaacagtgttaaaaaacagggccaaacggagtgttcgttttaaaaatgtagggtcaaataagcaaactagaaaaagtagggtcatattggtagttacacttcaaaacagggtcaaataagcaattgtcccatactaaataccatattaacacagccttaacttttgtattcattcaaacggttgtatctatctattgatacattaataaatatattcgtcaaatgaattttttttcagtcgtatagagtatcatgaatatacttctgaaatgattgtaacaaaagttttgatggatagacttaagaggtgattcattacctaatgcatatgtaaaaagccaaactgcctttctaataaataatgtatcatggaggcctgttctcgaataaacacgatcactattacccaacgcccaaaaaatgttaaactctcaacaaaaccgtccaagaagagctgcaatgttttacaagctgatctagaaatcatcccaacacatcgaaaaactgtaatttgtacaagcagattgaggagtgagcaatcgagtaaacgagctaacca

SEQ ID NO: 21937 - DNA, 641 bp, Oryza sativa
gggaggactttgggccagacttggcccaaaggaggaaggagggttatttttaggtttttctttttattaaactttgataattgtttttgttgcttaataattatttccggtgctctgaaaattcaagtaaaatttgagggctcattttagaccaaggagaatttaacaaaaattctccgggccacattcgaatttttcttgtacgtattttagtgtttgccaatttcttttcgaattttaattaattctattattccttttagagaatgatttttaatttcgggatgaatttatcaggacgtgacaaagttccgattcgtccctccatcggctgtccttccagatgcatgcaccatattaatagggaaatgattaccatctaccttcatcggcttctttgaatcatcgaatttgatatttcccccttcaatggccacctggatctgctgtctgaaaactttgcagtcattagtagaatgagattcagaattatgccatttgcagtacctccttttgccaagttccttagccgatggaattatatgaccagcaggaagttgaatttgtttctcccgaagcaataaattgaaaattttgtcaaccttggtgatatcaaagtcgaatctttcttcttttccaga

SEQ ID NO: 21938 - DNA, 637 bp, Oryza sativa
gtatagttctagattcgtgtttaccaaatagctttgagcaactaaatatctttaaatgctgtttactgcaaccctaaccctttatattatagctcctttgtactcccttgcatttattctgcacttgtgggtgtgtcttgttgagtacggtggttgtactcagtcttgctcaatttttcccaaacccagaagaggagttcctagaagatgaaggctttggtgtctagctcatgcctgccgtcgagtgcctgtggtcgtcgccctagtcttccgctgtttctcgtttgtctttgtgtgtgctgggccttcgctgcccatgtaataagttatctatttacgcttccgcttgttaaactctgaattgtatcaacttttggtgtaccttgcctcctgggacaaggattaatgcacgcacgtaaggaacgcccgttgggttatttccggtcgtgacaagttggtatcagagcccccttgaccctaggacgagccgtagatcccaagccttagcaagtattttcgaaataaaaatcctttgttacttgtgaaaaccctctagtctctctctgtcctgctgcttcatttatcgtcaaaatctgatcttttaaatgttgcttttctttttgtttttgtttgtaga

SEQ ID NO: 21939 - DNA, 198 bp, Oryza sativa
ttctttccccccccttttccttcttgggccggctcggcccaactccctccccctctctcctctcccccgcggcccatcggctccctccccgcgcgcgcgccgctgacgggcgggcccgcccgccaccctcgctgacgggtggggcccacctgtcatctccctcctcgcgccgcgcccgccgcccgcccgtgccctagc

SEQ ID NO: 21940 - DNA, 726 bp, Oryza sativa
attggagtgtatgggtgcgttcggccaaaaactcactccgtattcgcgcgggacttttgtcaattaatgccaatattggcatatattgagaccccacgggtgcgattgtttttgaccggattgaataagttcaaaaagcatcaaaacatgaattttggacatattgaagtgtattgggtgcgttcgtggcaaaaactcacttcgtgattcgcgcgggtacttttgtcaattaatgccaatattggcatatattgagccccacgggtgcgatgtttttgaccggaatgaaaaagttcaaaaagcgccaaaacttgaattttggacatattggagtgtattgggtgcgttcgtggcaaaaactcacttcgtgattcgcgcgggtacttttgtcaattaataccgatattggcatatgttgagaccccacgggtgcgatatttttgaccggattgaataagttcaaaaagcatccaaacatgaattttggacatattggagtgtattgggtgcgttcgtggcaaaaactcacttcgtgattcgcgcgggtacttttgtcaattaatgccaatattggcatatgttgagccccacgggtgcgatgtttttgaccggattgaataagttcaaaaagcatccaaacatgaattttggacatattggagtgtattgggtgcgttcgtggcaaaaactcacttcgtgattcgcgcgggtacttttgtcaattaa

SEQ ID NO: 21941 - DNA, 429 bp, Oryza sativa
aaaacatccaaacatgaattttggacatattggagtgtattgggtgcgttcgtggcaaaaactcacttcgtgattcgcgcgggtacttttgtcaattaatgccaatattggcatatgttgagaccccacgggtgcgatatttttgaccggattgaaaaagttcaaaaagcaccaaaacatgaattttggacatattggagtgtattgggtgcgttcgtggcaaaaactcacttcgtgattcgcgcgggtacttttgtcaattaataccgatattggcatatgttgagaccccacgggtgcgatgtttttgaccggattgaataagttcaaaaagcatccaaacatgaattttggacatattagagtgtattgggtgcgttcgtggcaaaaactcacttcgtgattcgcgcgggtacttttgtccatcaa

SEQ ID NO: 21942 - DNA, 237 bp, Oryza sativa
atattggagtgtattgggtgcgttcgtggcaaaaactcacttcgtgcttcgcgcgggtacttttgtccattaatgccaatattggcatatattgagccccacgggtgcgatgtttttgaccggaatgaaaaagttcaaaaatcaccaaaacatgaattttggacatattggagtgtactgggtgcgttcgtggcaaaaactcacttcgtgcttcgcgcgggtacttttgtcaattaa

SEQ ID NO: 21943 - DNA, 167 bp, Oryza sativa
taatccaaatatggcatatattaaccttccacgggtgcgatgtttttgaccggaatgaaaaagtccaaaaagcatcaaaacatgaattttgcacatattggagtgtactgggtgcgttcgtggcaaaaactcacttcgtgcttcgcgcgggtacttttgtcaattaa

SEQ ID NO: 21944 - DNA, 202 bp, Oryza sativa
aaactcacttcgtgattcggcgcgggtacttttgtcaattaatacaatattggcatatattagccccacgggtgcgatgtttttgaccggaataaaaagtcaaaaagcaccaaaacatgaattttgaacatattgaagtgtattgggtgcgttcgtggcaaaaactcacttcgtgattcgcgcgggtacttttgtccattaa

SEQ ID NO: 21945 - DNA, 267 bp, Oryza sativa
caaaaagcgccaaaacttgaattttggacatattggagtgtattgggtgcgttcgtggcaaaaactcacttcgtgaatcgcgcgggtacttttgtcaattaataccgatattggcatatgttgagaccccacgggtgcgatatttttgaccggattgaataagttcaaaaagcatccaaacatgaattttggacatattggagtgtattgggtgcgttcgtggcaaaaactcacttcgtgattcgcgcgggtacttttgtccattaa

SEQ ID NO: 21946 - DNA, 989 bp, Oryza sativa
tccagaaatcatgttttggtgctttttgaaatttttcattccggtcaaaaacatcgcacccgtgggggcacaatatttgccaatattgacattaattgacaaaagttcccgcgcgaatcacgaaatgagtttttgccacgaacgcacccaatagactccaatatgtccaaaaatcatgttttggtgctttttcaacattttcattgcggtcaaaaacatcgcacccgtgtgggcccatatatgctaaatattggcacttattgacaaaagttcgtcgcgcgaatcacgaagtgagtttttgccacgaacacacccaatacactccaatatgtccaaaattcatgtttggatgctttttgaacttattcaatccggtcaaaaatatcgcacccgtggggtctcaatatatgccaatattggtattaattgacaaaagtacccgcgcgaatcacgaagtgagtttttgccacgaacgcacccaatacactccaatatggccaaaattcatgttttggtgctttttgaactttttcattccggtcaaaaacatcgcacccgtgggggctcaatatatgccaatattggcattaattgacaaaagttcccgcgcgaatcacgaagtgagttttttccacgaacgcacccaatacactccaatatgtccagaaatcatgttttggtgctttttgaactttttcattccggtcaaaaacatcgcacccgtggaggctcaatatatgccaatattggcattaattgacaaaagtacccgcgcgaatcacgaagtgagtttttgccacgaacgcacccaatacactccaatatgtccaaaattcatgtttggatgctttttgaacttattcaatccggtcaaaaatatcgcacccgtggggtctcaatatatgccaatattggtattaattgacaaaagtacctgcgcgaatcacgaagtgagtttttgccacgaacgcacccaatacactccgaca

SEQ ID NO: 21947 - DNA, 264 bp, Oryza sativa
cgcgaatcacgaagtgagtttttgccaggaactttcccaatacactccaatatgtccaaaattcatgtttggatgctttttgaacttattcaatccggtcaaaaatatcgcacccgtggggtctcaacatatgccaatattggtattaattgacataagtacccgcgcgaatcacgaagtgggtttttgccacgaacgcacccaatacactccaatatgtccaaaattcatgttttggcgctttttgaactttttcattccagt

SEQ ID NO: 21948 - DNA, 1430 bp, Oryza sativa
acatattggagtgtattgggtgcgtttttggcaaaaactcacttcgtgattcgcgcgggtacttttgtcaattaataccaatattggcatatgttgagaccccacgggtgcgatatttttgaccggatggaataagttcaaaaatcatccaaacatgaattttggtcatattggagtgtattgggtgcgttcgtggcaaaaactcacttcgtgattcgcgcgggtacttttgtccattaatgccaatattggcatgtattgagccccacgggtgcgatgtttttgaccggaatgaaaaagttcaaaaagcgccaaaacatgaattttagacatattggagtgtattgggtgcgttcgtggcaaaaactcacttcgtgattcgcgcgggtacttttgtcaattaataccaatattggcatatgttgagaccccacgggtgcgatgtttttgaccggaatgaaaaagttcaaaaagcaccaaaacaagatttctggacatattggagtgtattgggtgcgttcgtggcaaaaactcacttcgtgattcgcgcgggtacttttgtcaattaataccaatattggcatatgttgagaccccatgggtgcggtgtttttgaccgcattgaataagttcaaaaagcatccaaacatgaattttggacatattggagtgtattgggtgcgttcgtggcaaaaactcacttcgtgaatcgcgcgggtacttttgtcaattaataccaatattggcatatgttgagaccccacgggtgcgatatttttgaccggaatgaaaaagttcaaaaagcaccaaaacaagatttctggacatattggagtgtattgggttcgttcgtggcaaaaactcacttcgtgatttgcgcggttacttttgtcaattaataccaatattggcatatattgagaccccacgggtgcgatatttttgaccggattgaatatgttcaaaaagcatccaaacatgaattttggacatgttggagtctattgggtgcgttcgtggtaaaaactcacttcgtgattcgcgcgggtacttttgtccattaatgccaatattggcgtatattgagccccacgggtgcgatgtttttgaccggaatgaaaaagttcaaaaagcaccaaaacatgaattttggacatattggagtgtattgggtgcgttcgtggcaaaaactcacttcgtgattcgcgcgggtacttttgtcaattaataccaatattggcatatgttgagaccccacgggtgcgatatttttgaccggattgaataagttcaaaaagcatccaaacatgaattttggacatattggagtgtattgggtgcgttcgtggcaaaaactcacttcgtgattcgcgcgggtacttttgtccattaatgccaatattggcatatattgagccccacgggtgcga

SEQ ID NO: 21949 - DNA, 346 bp, Oryza sativa
gggtacttttgtcaattaataccaatattggcatatgttgagccccacgggtgcgatatttttgaccggattgaataagttcaaaagcaccaaacatgaattttgaacatattggagtgtagtgggtgcgttcgtgacaaaaactcacttcgtgattcgcgcgggtacttttgtcaattaataccaatattggcatatattgagaccccacgggtgcgatgtttttgaccggaatgaaaaagttcaaaaagcaccaaaacatgaattttggacatattggagtgtattgggtgcgttcgtggcaaaaactcacttcgtgattcgcgcgggtacttttgtcaattaa

SEQ ID NO: 21950 - DNA, 587 bp, Oryza sativa
tgcgttcgtggcaaaaactcacttcgtgattcgcgcgggtacttttgtcaattaataccaatattggcatatattgagaccccacgggtgcgatatttttgaccggattgaatatgttcaaaaagcatccaaacatgaattttggacatattggagtgtattgggtgcgttcgtggcaaaaactcacttcgtgattcgcgcgggtacttttgtcaattaatgccaatattggcatatattgagccccacgggtgcgatgtttttggccggaatgaaaaagttcaaaaagcgccaaaacttgaattttggacatattggagtgtattgggtgcgttcgtggcaaaaactcacttcgtgaatcgcgcgggtacttttgtcaattaataccgatattggcatatgttgagaccccacgggtgcaatatttttgaccggattgaataagttcaaaaagcatccaaacatgaattttggacatatcggagtgtattgggtgcgttcgtggcaaaaactcactttgtgattcgcgcgggtacttttgtcaattaataccaatattggcatatgttgagaccccacgggtgcga

SEQ ID NO: 21951 - DNA, 1501 bp, Oryza sativa
caccgccggttcataccgaaccagcagtgatgaccacttctgtggtagtgattgctgcaatttatctatccatatgatttaacgcgcgcagcttccgcaccgcacacaaacactaacgccgtgccataaacccaaccaatttgatcgaccaccccggcagtcattaattgttttgatttgttacactaaagtattgagatcaactgtaaaaacttgtaagcgtccaaaagtcttgtgttttatgcgaagtgaattccccacaacacgcatggcaattgtttaataactccctccatttcaaaatgtttgacaccgttaactttttagtacgtggttgaccattcgtcttattcaaaaaatttaagtaattatttattcttttcatatcatttgattcattgttaaatatactttcatgtaaacatatagttttacatatttcacaactttttttaataagacgaacggtcaaacatatgctaaaaagtcaacggtgtcaaacactttgaaacggagggagtatatgttggcaacgtcaatgtgatacaactgtctgtgtgttcacttgtctgaaaccaagtggatcagtcaagtaattaattgtataacagatacggtacaattataatgacatccaaagaaacggagccggcaatgcgcatgtcatcttccattccagccggctgattccccaacacctacgcacctctctatcattgaaaacaattagcaaaatataccaggtaacctttcttaacatttaaaactgtgcacttattacaattctaatgcagtttgcggaatattgccttcactattaaattattgatgccgttggctttttagacatggtatttgaccatttgtcttattagaaaagctatataactattatttattttgttgtgacttgttttatcatttaatatattttaacattagtactaaatttttaaataagacgaatggttatcgtcatttccaaaagtaaatttccaaaagtaaacaacgtcgtacatttaaaaatgcaggagtagcagttctttgaaagttcaacggacatctgaaaattattctgaatttgttgttcatgacgattctgtacttctatttgtaatttacatattgcatacttatcctaaactacaaatattctctctgctctccaatctttatttttcatggatagactgcatattaaaggaactaaggttctgacacttggaaacatagcccaagaagtcagtgcaagcaaacatggacagtgacaattatcctagaaaaaaaacatgtacttaaccactggacggcaagccaacattactgcaaaaacataataaatctacgtaacaacaaattaactatcaaaagaagacatctttgacagcaagaggggaaattcttatgatcagatacagatcagatactatatagatgtgacaggctccaattttcgttgatactaatatccatttccatgtcctgacatagctctggatca

SEQ ID NO: 21952 - DNA, 1501 bp, Oryza sativa
ttttaattcaaaacgaaaaagacgatgtgcatgtgtgaaattaccaattttgttttcttttagtagtcatctccgtcgagctggacaccaattaaatttctaaaaattagatagtgcaaaacagtggtaaaaactacgcaagtgcaagtgaaaaataagataaggtttaaaacaggggaatagtaggaaaaaatagaagatcgaaaacttctttgtacgtaaccagctatctggagtattgatcggcaagcttaatttgaattaagcaggaaattaattaataccattctgaattaaatcggtcccgatcagacaatttgtgaccttaattaattagaatggctctcgcctggtcggcagctaattaattgtacttggcgaattaattagtgaaatgggccatttatgggcccaaaattactaggccagatagtccaatggctaaaattaagatctttgcatgcagcaatggtcctcttccaaacatctttatcttttgactagcacatccctcatataaccactttattaggtgtgaattgaccgctttaatctgaacattgaccgtaataattttcaagtataatttcactagttaattagtaaataaagaaattatagttgtactttctacgtttcaaattacaagacacttaaaaaatttttctaactcaaacttttttaactttaattaagggtatagaaaaatataataaaattttaaatataaaacaaatatagtataaaaatatattaacactatatttaataaaatatagtaattttcaagtataatttcactagttaataagtaaataaagaaattatagttttactttctacgtttcaaattacaagacacttaaaattttttttctaaatcaaacttttttaactttaattaggggtatagaaaaatataataaaattttaaatataaaacaaatatagtataaaaatatattaattttatatttaataaaactaatttaatgttatagatgtggtacaattttggataaacacggtaaaactcatgaaagtttaacttagaaaaattaaaatgtctcataatataaaaaaggtagaaataaattgatattcggtgcatagttatactcttgaagagggtccaataatccaattgaattacactgcaattactccttccgtatagtataagtcgttttgactttttaagtcaacatttctttaaaattcataaaagaaaacctttagcaacatctaaaacagtaagctagttttattaaatatatgttgaatatattttaataatatgtttatttcgtgttgaaaatgttactatatatattttaataaacttaattaaacttaaataaatttaactaacaaaacagtcaaaacagcttataatataaaacagatgtactggtatctatttaattaattaatttttacatatccatatatatttattaatactgcttaattaaataaacaaataaaacaataatattgc

SEQ ID NO: 21953 - DNA, 447 bp, Oryza sativa
ggatgactaatattatgataatacaattaaaaagcttaatatttgttacaattttttataagtttttttttgtcggcacgtgctctttatagcctatatacaaatatttgtaaggttttaaggaatgagtttgatttaattttgaattcatatgaaaagcattaaacttatgttcgggtgaccatgactgtgcatgcaactatagcaattttgttgtcaaatatattaaaattaattgttagaaataaaattaatcaaatgaatatacattttgtataagctctaaatagctcaatcttgaccggtgaatctttggttatgatgagggtttatttgtaaaatagtttttacaatagatgcaaaccctaaattatatacataaccttatactttcctatgcttattctttagcttttccttctttctttctttctttcattttctagt

SEQ ID NO: 21954 - DNA, 469 bp, Oryza sativa
cggaaccctaactgtgatggcatttttgggacaaaatcgtttgtacgatggcatttcttggaactcatacttgtcgatggacttttgggacttagacgcttgtcaatggcatttcttggattatctcatatattactgatatatacgggcaatagcgtaggtttaatcttttctttgccatatacttcactgccaatctgatccatatcgcatcagcctgatatgaacgatacgtcatcagcaatccagccgatcggctatcgtttatggatctaactttggctcctttgtttcttgttggttgcaggatcaaaccaactggcacgccttgaacccaaaagcaaaatttaggacctgcactagagtaaagcaaatctctcagaccagtgtgtgtttttcgcatcaacatgcttttggcatgctcagtgggaccgacttcgacatatcttcatcatggtggatatcaagt

SEQ ID NO: 21955 - DNA, 1501 bp, Oryza sativa
tctcaatttggagttgtacttttcatccttcattttggggcacaacgaggcaaagtgtcccttctcatgacaaccacaacatgtaatgtgaggatggttcttactcacatttttctttccatcctttcttaagtatgcatgcttccttgtatatctaggcatgtgccttgtcttcttagcattctccttgtggtggaagccaagtccacacttgtcatttgagctcttttgcttgcttaggatttcgtcaagtgtgttcttccttatgtagtttctatccaagtcttcttttaaatctttgactttggcttgtaattgcttgttttcctctacaaggttagcaacaacatacatagaggaggaagaacaagagttttcatctatgtttgagctataaggtatgtcttgcaagtcatcacaagaggtggacatattagtcttagatgtaatgcatgagctagctacacatggcatatcatcatcaattaaattgcatatgatacctatgtccacctttggcttactaaatgcattgccaatgagaagagactcataagcttcttttatgttcttataagaatcacaaagttccttataagaatttattagctccacatttgagtctttcaaagagagaagagttttctctaaaatttaatttttcttcttctctttggcaatgtatttactagcctccctaagcatgtccaaaacttcatcatatgaaggctcatcaccatcatcatcatcatcatcatcaccattactactttcaatagtaatatcaagagaatctttatttacctcattcttaccatttgccattaagtaatgagatgatgtgaatggtgttgggagctcctcatcatctcttgaggaggtgaagtcttcacccgacatccgtccttatgtgcaaccattctcaacaagtgtgggcatttcatatttttctttaagctttacccacatagcatgtgcactcttgagattgcatacttcactaaaaatgtcatcactcaaagcacaaaatatagcattagtagcttgagcatcgagatgtaggcatttctcttgcccacttgtgggagcacgttcatccaaagcatgagaaaagcccacatctacaatccaccatatttttgggctcatggccctaaaatgagaaatcatgtgaattctccattgtgcataatttgtgctatcaaatataagagggtcaccacccgggtggactatatctctagaagccatccttttctctcggaacggttaagtccataaaaagagaaaccaagctctgataccacttgtaggatcaaggaggccgactagaggggggtgaataggcggttttaaaacttaatggcacttaaacaaaactaacctaagttgctaagcaaggtaaggtgcaaggttaactaagcaactaagttaagttttgcaaacctaggtgatatgggctcaaatatgtctctatggatgtaaattgcacaaatgtaaa

SEQ ID NO: 21956 - DNA, 556 bp, Oryza sativa
atttcttggaactcacacttatcattggcatttctgggatttggatgcttgtcaatggcatttctttgattatcttataatatataatgtaggcttcgaaatacgcttaaacctagtgattcggatagatcggacaacatgccgagatagtataaaccacttatatctaaaggtactttgaagcaaagattatatatattcctagcaaggccttaggcaaatctaacatgtattggctactgttctgatactaatttatactaagataccagtttagattaaaagcaaaatttgctacaggacataaaaaacgtgtaattagctgggagacaccgcaagaacggaaatatgctatagggcatcgcaaaatattggtaattagctgctggacacccgcgggattattttattatatccggagaaattggagagagaaaaaactgtgtaagtacggttctacccttcgaatttttttcttttttttctctatccttctctgttccttcttttccttgttcttttctctctcattctctctctgctcttttcttcaagc

SEQ ID NO: 21957 - DNA, 319 bp, Oryza sativa
gcattgaaaaagttcaaaaagcatcaaaacatgaattttggacatattggagtgtattgggtgcgttcgtggcaaaaactcacttcgtgattcgcgcatgtacttttgtcaattaataccaatattggcatatgttgagaccccacaggtgcgatatttttgacctgattgaataagttcaaaaagcaccaaaacaagatttctggacatattggagtgtattgggtgcgttcgtggcaaaaactcacttcgtgaatcgcgcgggtacttttgtcaattaataccgatattggcatatgttgagaccccacggctgcga

SEQ ID NO: 21958 - DNA, 483 bp, Oryza sativa
gaagttgaagccggcgtttgggaaagcgagcaaggcaagtcacatcatctttgaacatattgaatcctattttgtaaaattatgttgatttaaattattgcattatcactttatttaaattcccgcgttatcactgctttatttagccatgcctatttacctttgttatgaccttaatattgttattgttattatttccttgttcaccctagaataaacaaaaccccaactagtggacaccctactcatggtatcactagtatgattttaggtagatgcttcgctatttaattaggtaacattaggtggttttccaactctagactttgggaatcttcatatcatctggacactttggaattgttggattattgtggaattggattcacaccgctccttctattcaaaatccccaagatggttttaggctgggctcggggtgcatggttttgatagtagcacctcggccatataaggaccggt

SEQ ID NO: 21959 - DNA, 1501 bp, Oryza sativa
taacctacaatcggctaacatctgttaccagaaggcagccgattaggttaaataacgacgttggcttagattatatgagatatccaccactctatgaaacatccagcggcttgattgtctagatattgttcttcttttcatacttaatgctgtatcagttgagtttgatctattaagtcgtgcttagaatttcaatacatgctagatctatttgatcggctatgctatgaatatatatatataatctcattaataatatatatttcgatttaagtgatttatactgtctcggcaaggtgaccgatctatcccaatcacttgattcaagtatatatcgatataaggattatatattattgatgtctacagccgattgagtagatttagttctgatttgtttacttaacacttgccgatcgatttacatatgacatcggctcaaagataaatgatatgttattggcatttagccgatcggctatcatttatggatttaattacggtttctttgtctttgtttcttgttgattgcaggatcaaatcaactggcatgctcacacatctgaaggcgagttttggacctgcactggagttaagtagatctcccaggcctcgtgttttctgtcaacacgcttttggcacgcccagtgggaccgattagaagtcagaaggcagcttccctcatggctgagaaaccttgtcgcgactgagaaaatttcattttcccgaatgctagtgtattaatccccgtcccaggaaaagccggggtacaccatacaaacatgatataaaagacacatctttattatatcgataatatttacattattacaaaggcacttaaggcctgacaatcaaaaataaacagcagcggactagcgggcctacgggtccatcttcacaggcgctcaactggggtataagccaagactccacctaagacttcttctccaaagcttctcttactgaaggggggagaaagatagagcaagaatgagtacaaccacagtactcagcaagccacaccggagatgcataattaatgcaaggggtacaaggggataataatatagaggttaagttttgcagtaaacaacatttaaaagtcacttagttgcccaaagctattttgtaaacacgatcctaaagctacacagtattattaatcaaggtcgtgaacccacatgaacctgccttaacccaaggcctatgatgattcagaccgaactggcaacccgaccctgggtcccagctcgtcccaagccaacccaggccaaccattccacattttagttgttaagaaggttttaagaattaaaacactaacttgggtacattgctcggctagcccataaccgagggcgcggctattcgaatagattatactctgatcagaggtgtacaactttacccacaagacacatcttcctcacgtgcaaccacgtgccacataccaccacggtatacagacggaagacgtgacatagtttccaacccatcc

SEQ ID NO: 21960 - DNA, 312 bp, Oryza sativa
aattcctgcagccctgcatctgcgggtgtgtcttgttgagtacggtggttgtactcagtcttgctcaatttttcccaagcccagatgaggagttcctggaagatgaaggctttggtgtctagctcgtgcctgccggcaagtgcctgtggtcgtcgccctagtcttccgctgtttctcgtttgtctttgtgtgttgggccttcgctgcccgtgtaataattatatttacgcttccgtttgttaaactctgaattgtatcaacttttggtgtaccttgcctcctgggacaaggaacaatacacgcacgtcagga

SEQ ID NO: 21961 - DNA, 303 bp, Oryza sativa
cacgggtgcgatgtttttgaccggaatgaaaaagttcaaaaagcatccaaacatgaattttggacatattggagtgtagtgggtacgttcgtggcaaaaactcacttcgtgattcgcgcgggtacttttgtccattaatgccaatattggcatatattgagcccccacgggtgcgatgtttttgaccggaatgaaaaagttcaaaaagcaccaaaacatgaattttggacatattggagtgtactgggtgcgttcgtggcaaaaactcacttcgtgcttcgcgcgggtacttttgtcaattaa

SEQ ID NO: 21962 - DNA, 286 bp, Oryza sativa
cccgcgcgattcacgaagtgagtttttgccacgaacgctacccaatacactccaatatgtccaaaattcatgtttggatgctttttgaacttattcaatgcggtcaaaaacaccgcacccgtggggtctcaacatatgccaatattggtattaattgacaaaagtacccgcgcgaatcacgaagtgagtttttgccacgaacgcacccaatacactctaatatgtccaaaatccatgtttggatgcttttttaacttattcaatccggtcaaaaacatcgcaccca

SEQ ID NO: 21963 - DNA, 1023 bp, Oryza sativa
  unsure (1)..(1023): unsure at all n locations
gcgcccccnaatgattccataggacacacncatatgaacatagaacgagtttatacctctggttatgtagaggatgtgtgtgctgcatctgcgtaaaccgtaacatgaagtttatgctcaataatgaaattttatatgaacacatagtattcgaattcgactcacttgacatcacagtactatttttggccttacaacggaaggttgtaaagccagcccacctgaactcgaagcgtcatggtaatccactactggaaagatgaatccaagctttttagtatttcattatatcaaactctaatgcggcaaaggaactgtttctgtgatatattgtgtttttaagggataataagcagggtagcttcgttttacttttctgtacctttctatacccttctatttcactaagctctattttatactagtaccagttaacattgaagcaagaagttgatctattctgtctccctctcctgaagtttcttcccttttccctctcaaaaaaaaaaagaagaaaaaagcctctggccttgaccaccggtagttacagacaaatctacttatctaagatcatttctctgttttgtttgatgatgtgttaggtagctggcttttctagctgctatgtttggttttattcaattgaaattggtataataaataccaacttgacagctatggactgttgatttcatgtaactctgcatatcgattttcatgcactatctaatccatccaaagtgctcctagatttgtataagtgcattgaaaatatttgaagaagggagtgttagtttgatgtttcaaagtttttataaatcttgagccacatctgagaaccaattatccatactgtcattcttctttatatgtttattttcctcgacatttattaaaattcttggggaaaatttgtttttcaatacataatatgcacttaactttgttttatttgtttcagaatcaaacaataacgatttggctgaaatacggaatgacaatgttccagcttcaattccacaa

SEQ ID NO: 21964 - DNA, 1501 bp, Oryza sativa
ggcgcggcgggcggggggaaggatggtggcgcgggccgccgttgcagttgcgtgagacgttctgctctctgagctgatatacttccgttcgctacgatgctctgctgggctctgatggtttcactgaactgctctatgttgtgtttgtttgtgtttcttctcgcgtgcagtccaaggcggaatcgccggcgagcgcggcctcctccaagtctgacgggtaaagaattcagcacccctctaattttataattgtgtagtacagaatccatacggtaaccaagcgttcaattatttcttctgttcataagaccgatcgattcagctcaatctgggtttgatttggctggattgtgttggtcttagtctattgtgtgttggggctatactccagttttggagcttggatctgtttaggggttgggctcttgttattctgctcgttaggtgatgcaattttgcagccttccgttcgttgaaagttgatacagggggctagttgaatgttactaagcttgtatgaagaattgaagttagagaacttatgactagaaacagttcatgaagaaattgtttgaagcatccgagaaactaggagtattttatagcggtctttagatttatgaggtctattaccagtagtaggatagatatggcccattattattattatataagaaaagatgaaaggtctagattgattttactaccagtagagaccactgtaaagtgaatttcaatcaacaaagtagaacattcaactgacttgcccatcagctttcagctatggcttctgctgctggctggcattcacaatttgacatatattttcttggatatgagtagggaatgactttggaagcatcaatttaggccttgattgaaacactgatgggacttgcatactgccttatactcctacctgcactgtagacatgtccaatgtttggtgtattgcaaaaaagaaattaggaatttagtttttttcccctttggctattactaatctatataatggacatagggctggaaagcacagaatttataacgtctagccattcaaatttgacattgagctcagtggaatatgctcctcaccgggtgacacaaactgttctgttactccctccagtcatttagttctcccaacgtcagacacattaaagtagagagattagtttccaacccaattggccacttaccatgctattatataggctgcatatactcataaaaaattgcttcaggctgtcaagcttagttggtttacatttactttgtaatgttgactgtaggattatcggtacctgtaacgaatcggttaacactggtattcagaattcagtatttgccctggttcattacaatgcttatatgtgttgtgcacttgtgctagtttaggtgttacatttctgattttttttatcttatccaaataaataacatttcagtgcatagaatatgtaatctaaggcaaattcctaattctgtaacttttattcag

SEQ ID NO: 21965 - DNA, 593 bp, Oryza sativa
  unsure (1)..(593): unsure at all n locations
tgactgtnnaaattagagcagtcgcatagacnnccacccaagttaatgtccgctggtgcattttactcaaacatatttgtatgcaactggtaatgtcatggtaatagttaattgtgacctcatgagtcatgtgcctaaacttaccattcgagagagtccaaattcaagtcagaaactgatacatgtttggaagggacgtcattgtccaccaattttttgagcacacgctcgcgtcgagtgggtcgtactccctttggcctcggaaaaaccaatgcaaatatcacctaagataacgaatcttgacaaccttatatccagattcgttgaggtggtgttacacctcatctaggtttttttttatggaaaaagtataagtgtgtgttgacgctcggtgtttaaatgttgtggtgttgtctggatagtgtttgtgcgctttcaaatgtactctccatcctaaaaaacaatcctaattataaacctggtccatgtatatagctaggatttatatatatttttttacggagggtgtactctttaagaaagaaaaaacaataaccattttttctcaactcatcattatatggttttttagg

SEQ ID NO: 21966 - DNA, 170 bp, Oryza sativa
  unsure (1)..(170): unsure at all n locations
ctgtannnattaganacttagtagccatgtgancancancgaattggataaattgattatcatcaattttggttgaatatgaataactcaacaggtattcactatgtttcaggttgggctccaatatttgtctggtgaggtttctggtggaaatggtcgttgtatagcaa

SEQ ID NO: 21967 - DNA, 1501 bp, Oryza sativa
tactgtagttcaggtttgatagtctctgtaaatatgttccttggaattgttgggttattttcaagctctttccttaagtttgaagatgcgttgttgatctttctttcaagagcaccaagttgtcattttttatgtttgtgtagtactctggtcctaaaacaaatgatgtttaggacaagatttggttaacttttttaaaaagactttgactatcaaattcgtattagaatattttgttaaattcagttagcttctgatattattataatgattttttaggcaaatttgtgcataccattttttcctttttaaactaagaaactcgtaaactgttgatggttgtttaaaaaatttgatcaaatattgttctaaatgtcatatatgtattactggagggagtaatttgttagtaaagaaaagtatcattaaaatgctttggcgaaaaacatactagtacttgtttgaagtggtaaaagtttctctctagattactattgggtgaatagccaaaaatgtcctccaagtttcatacaaggatcagcttagtccataatctattgggtgaatagccaaagatgtcctccaagtttcatacaaggatcggcttagtccttaatgtttcaatctgttcatattacttcttcaagtttttattttaattcaaacttatccttgaacccacataaccaacaattctcttgataaatgtcacttataccccctcattcacatatataagagaaaacaattgcatacaatgaattctttttatagacaatgcatagcaatttatgtaaaacaaaaataaattatatacttacaagtgtatacgatagccattaggctcaagtttcatgtgcacatgttgaaataatgggaaatacatatgtaatgttgtttatttatttttgttttcttttttctagtgtacagttgtatacaaattaaaggcaaaagggacactttctaatagaattgttgactaaaaatagccatatggcaaatcaagtgggtccaaggatgattttaagccaaaacaaatacttagatgacctgtatggacaaaatgaaacctaaagtactaaattgagtcttcagtgaagcttgaggaactaaattagctattcacccattaatatttgcagtaatatttgaaatagtgtggttgctggtgacaaatattttgcctttttcccttcactaaacagctctcttgcctgtcatttctcagttctgcaagatgaaactcaagacaaaagactgaaaaattcagcaacactttgttgaaagggtagtgccacttggcctaggtggatgaggccaaggccacaaggttttagcatcgatgagaccgaggctgaccattgaggtccttccacactgacccaattggcctgcactcggtccatatatacacatttttaacaactcagataagaaacataaccttgcctactactatagctgtttgttttcatgcggatatacctgtttttcatct

SEQ ID NO: 21968 - DNA, 1501 bp, Oryza sativa
tgccggcgtggccgccttcgggcgcgtcccgcggctgccatgtggggcccggccgtcagccgcccgcgccctcgggtgcggctgacgcgtgggaaccacggcgccggccggcgtacgccgcgtgcacccggtccaccgtggaccgtgaggctgccgcgtgggccccactcccgtggacccggtccgcgcgcccctcccctcggctgacgcaataaatccgattttaaattaaaaatttaaatgaagaaattcgcaaatattcatttaaagaacatataaacttcaaatggccataacttggtcatttgaactcggaattggaccgttcaagtctctaatttttccttaagaagtcaagaacccatttttgtgctttgtttctgcttgttatatggattttattagagtaaaagcctttttcttttccgttggtcgtgtagacgctgcagcttcggaagatccgctcttcgtggaagttgaagccgacgtttgggaaagcgagcaaggcaagtcacatcatctttgaacatattgaatcccagtttgtaaaattatgttgatttaaattattgcattaccgctttatttaaattcccgcgttatcactgttttatctagccatgcctatttacctttgttatgaccttattattattgttgttgttattattaccttgttcaccctagaataaacaaaaccccaactagtggacactctactcatagtaccactagtataattttaggtagatgcttcgcaatttaattaggtaacattaggcggttttacaactctagactttgggaatattcatatcacctggacactttggaatggtttggttattgtggaattggcttcacaccgctccttctattcaaaatccccaaaatggttttaggctgggctcggggtgcatggttttgatagtagcacctcggccatacaaggaccggtcttcgggcctctgttgcaaagcactaccgtacttccacatgtctagtgggtaaggcttagtttgtgagtcagtctggttataaacaaaagtacacggatggagatggaagaagtcgggggtcgatggacatctccagggcaaatgaaggctacacgagctgcggcccggtagtcgagatgtcatggcacagggccggtgtcctgctgctaggggctcagtcctacctgcctgtcccgggggttccggccataggtgggattgggtcggtactcttgtctatggctaggatgggttggaaactatgtcacgtcttccgtctgtataccgtggtggtatgtggcacgtggttgcacgtgaggaagatgtgtcttgtgggtaaagttgtacacctctgatcagagtataatctattcgaatagccgcgccctcggttatgggctagccgagcaatgtacccaagttagtgttttaattcttaaaaccttcttaacaactaaaatgtggaatggttggcctgggttggcttgggacgagctgggacc

SEQ ID NO: 21969 - DNA, 464 bp, Oryza sativa
gccttaacccaagggcctatgatgattcagaccgaactggcaacccgaccctgggtcccagctcgtcccaagccaacccaggccaaccattccacattttagttgttaagaaggttttaagaattaaaacactaacttgggtacattgctcggctagcccataaccgagggcgcggctattcgaatagattatactctgatcagaggtgtacaactttacccacaagacacatcttcctcacgtgcaaccacgtgccacataccaccacggtatacagacggaagacgtgacatagtttccaacccatcctagccatagacaagagtaccgacccaatcccacctatggccggaacctccgggacaggtaggcaggattgagcccctagcagcaggacaccagccctgtgccgtgacatctcgactaccgggccgcagctcgtgtagccttcatttatccttga

SEQ ID NO: 21970 - DNA, 442 bp, Oryza sativa
tggataccaaaggatggcataatatagggctcatttgtaaaagcagcatttagcaaacatttgagaattataaaacaatagagtaattaatcatcaatattaatcaacactgaacaacacacccatgctgcacaggtccaaccatcctgaacagccatacccggctgtacagatctatctccaaaccaggagctaatcaaattattacgagttataacatcatttattatggtgagaagtgtgagactaatcacgaaagacattgttagacctgcccataaccgcgggcacaactattcgaatagttttactctggccagaggtgtaccactgtacccataagacacagccccacaacatgtcaccatgtgcctcaataccaccacggtacctcggaaaggagctgtgacagtacccctcgcacaacacaatcctccacagt

SEQ ID NO: 21971 - DNA, 1501 bp, Oryza sativa
gacctggctcataacaattgaaacacacccgctgctcccttccattactgttatcttcttgagactgatcctgctgaaatgacactgattgagtagcttgctcatcattgccttcattgcttgcattagtctctgagttaatctcaccactgatgcccaactgttgtgactgtccttgaccagcagaaaaagattcaccaatttggagtggcttgatacactacctctggctactatcctgtgcctcctggaaaacaatccttcctctcttacgattgtccatcctgttcttcttgtcttccagtcgaattgctttatcaaccaactcctgaaaatcctcatagtcatgagagatcaacataactgacagctcatcctttaagccttccaaaaacttctcctgcctttcctcgtcagtacgcacatcttctggagcatagcgagctagacgattgaactcatgaagatattccgtcactgtacgatccttttgcttaagtgcccggaactcacgcttcttcaaagaaacaactcctgtaggtatgtgcgtcttcttgaatgcttcagtgaactccgcccaagtgattggttgtccttctgctctgttcatccggaaatgatcccaccattctgaagcacgtccttgcaactgatgtgaagcgaaaacaactttctcctgatccgtacactggagcagttccaacttcttctcaacagcgtgcagccaatcacctgcttccactgggttggtagtgctagaaaaagtaggtggcttcacacgaagaaaatcagctaacttgttctgcggcggcggaggattgacattgttgttcccttgctggttctgcatttgttgcactaacatgttgatcaattgggtctgttgagccagcacttgagcaagggttgggttctcttcattgttattgtttccacttccactagtgcgagtgttcaccatctgttgcagattagagaagatagaaggagaggggttacactaaagacaagaccttaaccagtttaacactgatctgatgtgtgtaaaccattatattgttcaagttgattaagcaaacaacctagtatagttacacactcatcattggactactccaatgacgggaatgcaaccatacctacacacaagcaagcaacaaacgttctatcctactaactattcttcaaagacactttggcggcataggttctaaactaggatccaacttcactctatcttgatatctgggcacttcggttcttcctcgatccactttacttgcagaagttgacaacatcgacgccttcgagtttctccatcaagtttaacaactactcacgttgaaagagggaaaagaggagagaacgacaaaacgatttgcgaagaattctagataaggaagaaaagagaaactttcacaaattatgttttcggaaaattagtccttaaggtttgaccatttggcttatcctacagtcgagatggctctgataccaactt

SEQ ID NO: 21972 - DNA, 1501 bp, Oryza sativa
acattaaccgtaccaaccacaagccagcgtgggcaacggctttatcttttgtatagcgtgattcattatagtgtgccagactgtgaagtggcgagaagtccatgggggtcgctggggagtccatgcctctggttgtagagggggtgattatgatccaggaatggtgcactgtggtgagttgtgttatgcaggggataatgtcacagcctctattcgggtactttccagtatcgcgacgcatggttgacatgatgttgaggttgtgtcttgtgggtacagtggtacacctctggccagagtaaaactattcgaatagccgtgcccgcggttatgggcgagttgagcaatgtttttcgtgattagtctcacacctctcacaataattatggatgtaataactggtaataatttgcttagctcctgctttggagattagatctgtatagccgggtatggttgttcaggatggttgggcctgagcagcatgggtgtgctgttcagtgttgattaaaattgatgattaattactctactgttttatttctctcaaatgttttgctaaatgctgcttttgcaaatgagcctatattatgccatcctttggaatctttgtgcacttgcatatttgctgtgtggcttgttgagtatgtcatatgctcattcttgcaataatcaatcaacctcagttgaagataaaggatccggaaggagaagacgtttggcttataccccagttgagctgcctgtgggagtggagccggagcttcgctagattttatttttccgctgcagtttccttcttggtgaggactaagtgcctcttaagtaagtatttatcggtttagttattatgatggatttgtatattaaattgtcagtttgtgtacctcggctgattcctggacgaggattttatgcacaaatcagttcggaaattattagtgaatttccgggcgtgacaagttggtatcagagccatctcgactgtaggataagccaaatggtcaaaccttaaggactaattttccgaaaacataatttgtgaaagtttctcttttcttccttatctagaattcttcgcaaatcgttttgtcgttctctcctcttttccctctttcaacgtgagtagttgttaaacttgatggagaaactcgaaggcgtcgatgttgtcaacttctgcaagtaaagtggatcgaggaagaaccgaagtgcccagatatcaagatagagtgaagttggatcctagtttagaacctatgccgccaaagtgtctttgaagaatagttagtaggatagaacgtttgttgcttgcttgtgtgtaggtatggttgcattcccgtcattggagtagtccaatgatgagtgtgtaactatactaggttgtttgcttaatcaacttgaacaatataatggtttacacacatcagatcagtgttaaactggttaaggtcttgtctttagtgtaacccctctccttctatcttctctaatctgcaacaga

SEQ ID NO: 21973 - DNA, 1082 bp, Oryza sativa
  unsure (1)..(1082): unsure at all n locations
ttcatcgacgattatcgtatctctnttactcataatatcactntccctctcccntttactcgactttanactccgatatgcaccagttggttatcctctcctcaanaaaaaacacaaaaaaatgttnanntttgatttccactggtacagtacttcatcaaagcattgtattttgtctaggtgatactccctcctttttacaatgtaagtcattctagcatatatgtctagattcattaacatcaatatgaatatgggatagatatatatgtctagattcattaatatcaatatgaatgtgggaaatgctagaatgacttacattgtaaaacggaggaagtaatgcttgtattttttttctcaaacatttgctgttctgttggtagtcttcatgaatagtgtttcatatttcattttgtgtagtactgttagcgaataaaactttgtcatttctatctttctatttagaaaacgaactgaatataacatgatcggtatgcctttttcaatcaatggagtaatggcttactgtgccatttgctctttggacttaaacagtatgctctcgaaacttcttcaagacataattatttaaggttgggcatgtgtttcttttggttagtagctaggtgctatgtttttgggtaatggtgacaaatcgtaaagtagaaactaaaggttaatcagctgacaatggtcatcagtaattggaaattttctaacaccctcctttacatgtttgccataatccatgacaacaactttttgtaattcacggcacattgcccttcttgtctatcatctccttaaaatccattttttattctaacttcagaaaacagctgtaccacatttatggcattttcattttcttcagtggagtgtttttttaatgagaactcagtgaagtgttgttatgaaaacattctcaatgctgtgaattatgttctgaggcgcaattgaagccaaaacaataacctttcttgctgtcctgttcttcattacctccagcacaaaatatgcccattgaatacatatcatacaatctatacttgtgttgttgaccttgcaaaccaacagtg

SEQ ID NO: 21974 - DNA, 1035 bp, Oryza sativa
ctcgcagaatatatgcatatggtacgagaaacgctccaaaaaatattggagataagtcacttggagaaagagagagagagaaagagagaggggcactcacagctataggactaggagagaggggtgcctccttccttccttccatgcggctgcgaaagtgggaggctcgtgcaaatcaacgagatatccaacgctttgtttcatcactgggaacaagaatcgtataacaagagttaggggaaaatccaaatacccgcctacaattcattactttttctgctttctactctcctccctacaactcaatattgttcaaaggatttcccaccactattcaattttcacgatttttcgtgatgccctcaatttctcgttatcgtgggccttcaacacatcccacggggtaagttgcctcgtaccatcttggtggcaaaagcgtgcacacctcctttcattttccatctttcgcaagcttaaattccgcaatcgccacttttcaaattggaaagtggaagaagatccgtgtgcttttgccatcaagttggcacgaggcaattgtgcctgcaagtcaccattaaggcccacgataacaagaaatagagtgtattagtagaaatcgtgaaaactaaatagggatgggaaactgaaagagaaattaacttacgtggagtgttttgaacaataatagaattgtagagggaagagtagaaagagtagtgacttatacgtgtatttggatttaaccccaagagtaaatgtcccgttcccgttctcggtaggtttccgaatatatgttatcgaggacgtcactcctctcaagtctcaaccttctaaaccatagtatgtttttaagtgttaaacgggatgcaacatcctaacgagttaacatggatccatatagtcgtacaaaaatgaaaactaaaattaaaaaaaaaaagatccaaacaattattctaccacatggaaacaaaggttgttcaggtcaaaggaatagctacagtcaagttcatcccactgagaaggacaaatatattc

SEQ ID NO: 21975 - DNA, 1501 bp, Oryza sativa
tatttggtattagtaactataggcatgataataatcattgttgtaacagaaaatactacctcaaaaagcattttgttgtaggtgcagtcatctcaaacttcaagtatttcaggacagaagcttccattttcaaaacctgttcgttagaagatgagaataagagacaaggaaataaaaagaacaaagcccaatctatactgggacacagacctcatccttagtgtatgtattgtcagaaatatagcagagctcttctacttggggtgggcatatctcttcatacttactgaaatttgaccatatataaactgaatcagaataaaacataaaaaagaagataaaagaaaaacaagagaacataaacagaagcaaatgggatcttacgaagctataagcaggcaagcgacaccaagtaattgcattttccgccgattgatcaccttgctcgagagataccggtcaatgtaattgactgtgaggtataaggtttcaggtacaagccgatattcttctgtgacctgaattggtacgagtcatgaatgtaatagaaattaaatggatcatttgctgtgcctctagcttctgaaccctgtttttatcctgaaatagagtagcttacttccacaagccagtctattaacactgccctcatgcttgtgtcaatgttcttctgaatggtttccacaaaatctgttgaaggccttttcttggtctgctaaaatgcagcatcacagcacaacagcaacaaacataatatcagattcttttgtgagcaaaacaaacagggaataaccaagtcagtgatgctacgtagcattatattttacaataagaatatgctaagcaagaagctaaatcggaaagcagacaaggatgacgcaatgcatcactctatacaggtgacggaatatggcatgtaaaagaatctatcacctcagccactcgcaagtgcttgtaaatgtcaaaagcaagagttgcacacagctgtggatcctcatggttgttgtcaatgtcgacgatataatcaatttctactgaattacaaccatgcttcgtccatttggatgccacacctgtaaacaaaccgctaatcaccaattctttcataggatgcacaaatggccaaaacagaattgccaattccggcaagaaaacaaacctgcaacatccctgttgtcagaaatatgaagcttatcatctgccaaatgttgcaaggaagataccacttcggagtccccatcatcaaggcaatcaatatcaaggctttccgttgaatcaccagttgacatagcatcttccttagacatagaattgtcagataggccgggtgaacagtcatggtgccccactgacggcacaatggtgggcagataagggttacaagctaattctttctgaagggtactgcctcgatgtggtattgcttgatcaaactggccagaagttggttttgggacagaacccccttctgtgttccaattgcaaaggcttcccaaaaatc

SEQ ID NO: 21976 - DNA, 1501 bp, Oryza sativa
agaatttaatgaacagaggtactccatctattctaaaaaaaactattgttttagctagtgaaaaatacattaacataaggttaaaaagtattaagcccttcattattgtggagagagaatgaggaaggggagaaaatgaggagtataaattatccttcatctttgttgaacttttccctagacctagacaagtggcgtagtaaagttgccatggatattcacctggtcaaatccaggctttggaagtgaccaactagatcgatcaagcgtcgaaaataaaggaacaaagccagctaatcatttcctttctttctccgaggctaacccgtttggttagagattactagaaggcagatatgcattattactgggttccgtggttaatttccttgatacaggtggaaaaggctacttgcacagctattaccactgaatgattacaatttgacgaccaactgcggagtttgttgctaccaatcttaaaaccgaagtaagctattagaaaattaaataacaacaggtcacaatgaatggataattctttggtattatttctgttaaataaacagaagagaaattagtgaggatattatattgaggaccaaccgatatgcattcacttcacttcaatttgcagtacgttgtacatatatattggaaaatgcaaaaaaaaatcaagaactaatcttctcttaattaacaaaataggctgtgttcgattctatgggctgggaacctatctttcacgcggaaaacgaagcagtccattagcacgtgattaattaagtattagctaatttttttaaaaaatagatcaatatgatttttttaaacaactttcatatataaactttttgcaaaaaaagtaccgtttaacagtttaaaaagcgtgcacgtggaacacaagagagaggagttgggaacatcctgtgttgaacacagcctaaatatgcactctattaacgaattggacaagaaattgaagagagtagccatcaggacttgatatattgacaacaataccaaagtccagttcttttccaattatattaaggcagaatgagacgtactcagtgagataatctagtcatcatcgcacgaagtagtagtaataattagcttccactgcctgatcatgccatggtcaggcatcagacacgagtttcgtatgcatgcctttcccaaaaggcaacgatatacaatctgcttgcaaagttgcgatttgtccggtccccggcttctcttggcataattctaagtcttatctgttccctaatttgcagtaatataatacagttaatgatgatcagagcaagtattaccaaggaatatagtacattcaaaaaaacacagtaatagttactcctataaacgtaaacatacacaccctacccctataatctcgtccgaaaaactaaactcacatatcttaaaattaacaaaattattacggacacctcactatcgatgggtatgctgcctattaccactaaaaaaataa

SEQ ID NO: 21977 - DNA, 1501 bp, Oryza sativa
tagccagccggtaggtcacggccggagcatacctacccaaacatacaaagtaatatactccgtcgtgaggtgagcgtagttcaactggctagagtttttatggtggaacgaatccactcgaatttttaagttgtagactgacacgggtgctcgcatctataactaattattattttagtgatagacgatatgcccgtcaacaacgagacacccgtgctaacttcattaatctagaaaaaatatatatactccctctgtcccaaaatggatgacattgttgactttttatataaaatttgaccattcatcttatttaaaaaaattatataaatattatttattttgttctgacttgttttatcatcaaagaaatatttttctaataagatcaatgatcaaatgttacgtgaacatagcttcttcttcttcttgtataaatcgatagaattatatataccaggattgctgaaaaatcaacaaataagatatatacagctacatcctattgtgataagacaacagtgcatagaaaaagaacaacgctattaaattgcatggcaacactgtagatataaccagggttcactttttcgtttttggcctttgtatcgggcagtgccgatatgacaaaatttcagaaatttcggtccaaaatttagaacaaaatttagtcaattttgagcaaatattaccaaaattcatgaaaaattaaaaaaatgaaaaattttggccaaaataatatcatatcggagggatccgaaattttagtccaaaatgtcaaaccctggatataatttcgctgtctccttttataagtttcagtaaatgcaaagcatatggttgtggaatttattgttagtgtactatatatttctactccggatgatcctaattgtatagctagtaataatatctgggattcctgtaactaattgtgttgctagtaatatatatctgcaattcctgttatatatcctgtacaatttgattgcttctatgatcgaatcaataattcatatataggacaaatgattactgcattaacaatccatatatgagttccatatgtcaacttatgtgaattatcagaattcaacaataatgtttcctccacgccggatcgacggtctgctagttcatctacgtccctgccttcatctccctctcctccttgtctatcatttcccctctatctctccttctttcactgctggatgcggtgatgaataggaggcagcggcggagaggacggagaagaagagaagagtcgatggggatggggaggactggctttggtagaggggatggggagaaagaggctgagaccggcgggatgggatggagatgaaggtggcggcgctttgcgtgcaaagagagctaggagtcatcgcgatccgctagggaagggaaggagcgaaatggaaaatgatttaagtttattatctagagacgtggaagtagtaaaagtagatagaggtttcttgaaggaaaaagaagatat

SEQ ID NO: 21978 - DNA, 1501 bp, Oryza sativa
ttaagtccatctccctcgatgtattatctatcacattacgtgatagtccctaaactggtctgccaatttttagctatctggacatagtctaacgctatcactcctgagtttttctgcttgctgacagatttcagtcttctttttaaatgcctaaatgacttcatattgtccttcgaactgttcaccttaataatcaatgtttgattatcacagtttatcaggatagctggtactggtttttcaaccaccggcaaatccatcaggagctcaagaaagccactcggcctcaatcgtggcggtgtctaatattgtgagttctgcttccattgttaacctcgttaagatggtctgcttgcaagacttacagaaaacaacgccaactccaagtgtgaacacatatccacttgtggtttttctcatcagcaccatatgtcaagtttgaatcacaataaccctctagtacttttgggtacctagtatagtgaattccatagcccactgtgcttttaagatagcgcattaccttttccagagtattgccagtgatcatctcccggatttgaaataaaaccggctcatcttgctcgtagcaaatgagatgtgaggcctcgttgcactagccaaatacattaatgaaccaatgatttgggagtatctgcaacattccggcacagggcttaataggattaatagaatactcatatcaacaagttgtaacttcttttccagaagccgattttcaaagaactccagggttaagcatgcttggcctgaagcaatttaggatgggtgactgaccgggaaattcttcccgagtgaggacaaagtgtgcagaaaagacatgtgttggtctgtgagggtgaccgggaaattcttcccgagtgaggacaaagtgtgcagaaaagacatgtgttggtctgtgagggcaatctatgacctatgaaagctgccagatgtaagcgggcccggcctaggagaggcgggacgttacagtatctcagttaatcccatgctattctttgtttttccttaatagtacactaatatcgtaaggagtatgagctggctaagactttctccacatagtgagattgcacaaattgcaatctcaccctcatcgcaacttgcagcctatttggttgcctgtaaatgtcttggagccaggacgagtagatgcaaaagtgccccctcagatatgctaagtaggaacgggcgaattgagcttcgttgcttgtcctggcccaacgcgtgcagcaacgctgcacccgcacgtgcacgtattgcagccgcgtgtgcaagcggtgcgaaggggtcactggtcaccaccttgcccctttctcatttctccccgaaaacgaaaaggctaggttttgttgctgctgcattgctcatcgccgggctcgacctcagctagattcgagaggaaggagatgggcgggaggaaggagaagactaggagaggattctagatttggaagctcacaatcgaccttgtctcgcg

SEQ ID NO: 21979 - DNA, 470 bp, Oryza sativa
aattcctgcagccctaataacaaaacaaattacataatccgcatgtaaactgtgagacaaatttattaatcctaattaatccataattagtaaatatttactgtagcaccatattgtcagatcataacacaattaggattaaaagattcgtctcgtaactcatacgcaaactgtgtaattatttttgggaattatatattttttaaaaatatttacgtgtgtttcgatgtgacgggacaaaaaaaattaccggttcgtttcctttgtttatgtagcctatagtggcaacgcatgctgacgttacggtgtaccgccgtcgaaaaccaccctcgctatctctccgcgttgtcagacgcacgcctcccaccccaccccaccccaccccaaaccaacaaacgccgtgacaaaccgattccacgcacagcacggaggtgggagaggacgacaccccgtcccccccgtgtccagcc

SEQ ID NO: 21980 - DNA, 1501 bp, Oryza sativa
ttttgggtggctgaaaaggtttgttttagtggtaccagtaatactgtagccgagcactttgactcgagttgacttgaattgacgctttaccaggttgctataactatatgttccttcttttcccttttccttcatttgtcttctacaaatcgaatgttcgatattaagagtgtgtttgattgtatctgtttagtctggctcatctttctcatccagattgagctcgtcctagttaaggggatacacatccaattgtttggttgtttgtattagtctagcctggcttgtatgagatattgtttggttgtctgcacgagagatacggttcagaggagaatttgtttggttggttgtatgatacgcatgtatgatgatccagaacttaacttttcatatatcaatcttcttattgttagtaaaacaattcatcaattgagctaatgtagtggcgaaccacgggtggtgttcttttctcctgaagatgaagataaagatgaagattaaatgttttacacaaaacaaggtggtattaacatataattaattgagttttaattattacaaacttgaaaaatatattaatttgatatttttagagcaactttcatatagaaagtttttgcacgaaacacaccgtttagcagtttgaaaaacgtaccacgagtatccaatttttgttggagaaaagaacgaggtttatattagtgactaattacgggcttagagaatgagaacggtagaaaaaaaagaaaaagcgctctcgcgtcccgtcgcactccttgccaccgagcatgacccccactggcagcctgctctggcgagcccgattgctcaccatcgtcgtaatcaccgcatccatcacttcctgccgctcgctgcacgtcttgctccactactctctagtcgcgccgacacgtcgctccctgtcatcgtcgtggtggcgatgattgccgctgttgctcgccgccgtcgtggtggtcgcgatggttgttgctgtgctcgccccgtcgccgtcgtggcaaccagatctgacgggaaatgctggaggtgtcagatgcgaaagggattatgtggcaatagcgcggacaccaaggaatggatgggggaagacatcggtgatcgcgagacaaggtcgattgtgagcttccaaatctagaatcctctcctagtcttctccttcctcccgcccatctccttcctctcgaatctagctgaggtcgagcccggcgatgagcaatgcagcagcaacaaaacctagccttttcgttttcggggagaaatgagaaaggggcaaggtggtgaccagtgaccccttcgcaccgcttgcacacgcggctgcaatacgtgcacgtgcgggtgcagcgttgctgcacgcgttgggccaggacaagcaacgaagctcaattcgcccgttcctacttagcatatctgagggggcacttttgcatctactcgtcctggctccaagacatttacaggcaaccaaataggctgcaagttg

SEQ ID NO: 21981 - DNA, 1501 bp, Oryza sativa
agtgcaacgaggcctcacatctcatttgctacgagcaagatgagccggttttatttcaaatccgggagatgatcactggcaatactctggaaaaggtaatgcgctatcttaaaagcacagtgggctatggaattcactatactaggtacccaaaagtactagagggttattgtgattcaaacttgacatatggtgctgatgagaaaaaccacaagtggatatgtgttcacacttggagttggcgttgttttctgtaagtcttgcaagcagaccatcttaacgaggttaacaatggaagcagaactcacaatattagacaccgccacgattgaggccgagtggctttcttgagctcctgatggatttgccggtggttgaaaaaccagtaccagctatcctgataaactgtgataatcaaacattgattattaaggtgaacagttcgaaggacaatatgaagtcatttaggcatttaaaaagaagactgaaatctgtcagcaagcagaaaaactcaggagtgatagcgttagactatgtccagatagctaaaaattggcagaccagtttagggactatcacgtaatgtgatagataatacatcgagggagatggacttaagacccacttgagttacacaatagtgataacctatcttatgtgatcggatatcctgtgaattaggatgacaaaacaaactattgagtgactgcgaggagagaccctgaaatgggtccatctctatgatgtacttctatccttttctgtacggcaggatggtgtataccttaatgtcatccgtgtggttttcttaggcagagatattgtcctacaaaacatcttacaagcaacacaactatataagttcgactgctagtcacagtctatgatgtttgcgtgatctccagagaaaggcttggaatttgaacataggggacgcaaatggtagcctagtatcagttaaggagttgagtaaagcctgactacacaagactaataattcaaggtatagcccattgttcagttgcggtctggtgtatctccttttctaggtagaagttcaacttaacagtctccaccgaaacactggtataacaaataagtgcagaactgagaacatttcctgtgagccctgaaatttagtagggattgttggaataaataggctaagcccaatttatttccagtaaatttcattggctcacaattaatgttatagcattaataccaccttagaaattcaagtgaaaaaatctcaacttaaatacggagttattagagagcccatattgaccaattgaggtggtggtaggactgctacacgtgcacgcgcgtgccgatccgggtcggccggggcgaggacgaggcttggcttgcgtggccgctctctcgttttgcaacggctgattaattctgtactaacaagcgacttgatttcgctattaaccatataattgaatcggattgattttgagattactcctgaacgttactcgttggtgcg

SEQ ID NO: 21982 - DNA, 358 bp, Oryza sativa
catcagtaattattggtgggaagcctggggggaaagaccctaacttggcttactatatgtcttctccaaggtaagtaaagggtaacaatccccaaccgtggataaaagccccagaagacttcgaaacagctataaacggtaaagaaggtgcttgggtttactccccaccagcaccaacaaatccggctgttggtttaatctgggtggactcttctaaaactccgaaccaaccaaaacgttgggttggtggagaaactggatgggttgccttaaccccagaagaagtaaaagatttaccttggggtcatcatttgtcgaccgccttccgtctccccctctccctcctcccgtcgagagg

SEQ ID NO: 21983 - DNA, 1501 bp, Oryza sativa
aatgaatcgcttgcttctttcccgggtgctagttcctcctcgtccacgcctatgctactctcgcctcctcgcttctgatcgcttgcgcacacgagagatcggaaggagcagggcctccggaaccacaccttcgcctgagatctgcaccgggtaggcgggtgatcaggttttaggggagtgcttcccgcatgactgctcgcccaccatgtctgcgcctggagccgaagctgcctccagcgccgctgctgctggaggagatggcgcgtgtcacaccctgattttcgtcttaggatttataaattatttaataaattactaatagaatttatatgaaatgttcaataattaacaagtgaagttaaaggtgggaaataaaatttcctaaatataaagcatggatggatttaatttttattaaattctccatggttaattatactctctggaatttttttcggatttttcggagctcaattattaattttaatcatacaaagagaagttcagcaattatttaaatattaaattaatcatataatgatctaattataattgttaagtgattttcttgtttacaatcctaaaattataaattgttgtttaaaaggaattattagaaatgatttttaaaagcttaaaagagaagatctattttttttttaatttgttaaatctcaacataaaaatgagctagataaaattttattaaatactatgcttgctcctctattttctagaattttctgggaattatttgagcaagggaagtatttttaataattgcaacaacatttcacaaattgttttatttgaaaaagttcaaaaagaacccctccctaagccgttgggccgaattcggcccaacactctctctctcccgtcggcccagtccaagccgcccgccccctcctcctcgggtcaccgacatgtgggacccacatgtcggacccatcttcctcctccagccgccggccaagccgagccgagccgggtgcgccgtgccgccttgccgcgccgtttcctccccaatctctccccttttcttccgattgtttgaggggtttttatcctctcgttctcctctatctttcccctcaagaattggagcaaatggttgggtatcttgcccgaatcaaactcgttttcgagtttatctccaaaaccgagttttgattttcttggatcgatttctctcgtttggagtccaatctctctaatctaatgctatataaagcatcccctcgtcgccctctttcgtttgccccctctcccgtcctctcccgtgcctcctagccgccgcgccgcgcgtgtcaagccgccgccgccgccggccatcctccggtcgcgccgcgccgccgcgtctgccgtcgccgccgcttgccgccgccgccaagaggtgcgccgtggagtgaggaagcccggccgcccgtccttcttcgccgccggccaccgtagagccgtcgccgccgttcaaccgagccgccgccgcctcttgcgtcat

SEQ ID NO: 21984 - DNA, 484 bp, Oryza sativa
  unsure (1)..(484): unsure at all n locations
cgtgggcnnnnttagaatgactctaccactaggnacagncgttcatcaacttcttcggtagttagggtagtgatttttttttatgatgtggtagattgactacagtcagactcgttgagtcagggcataaccccaaattgtaagtgaaatgtggcaaaacatatctagtgaccatgttacattccttttcttcttctcccatctctttctctctcctcgggcaatcgtagaggcaagataggccggaggacgcaaatgccactaggggcgcgcccagcattggcaaagcagtgtgtggatgttgtccatctcaagcgtgcctgtgtaaacccagtggtcgacggggaaggagccggaggtcggggctgagcccagaaggcaaatccagtcagtcaagcggacaaactcaaggtgacgagcctcccaagggttgagctcccctatccgtgagtccatcgacgcatcaagaatacgagaaccacga

SEQ ID NO: 21985 - DNA, 183 bp, Oryza sativa
gcagcaaattgaagcgtgaacgacctgggcggtaagcggaggtggatgtccgccggcgagaaggaaatggtatacttgcggattcggagccgacgcctggcggcgccgcagcagcagcgccgccagatccgcgctccccttcttccggggtcgcgttgccgccaccgatgcatgcccaggaca

SEQ ID NO: 21986 - DNA, 252 bp, Oryza sativa
aattcctgcagcccaacctctatgacatcattaagttttgtttttcggaaaaatcttaaccctgcaacattcgataggcagacaatttggtagcgctcacttgctcctcaggactggccacattttaagaactttttgattcattgattttagtcagagtgttcatatgatcctgcaaaggtggataaggatactgatagtcgtgtgtacgaccttcagccaaaatgtacccactttaggaatcacaaaaca

SEQ ID NO: 21987 - DNA, 157 bp, Oryza sativa
gatcccccttcttgacttcttaaggaaaaattagagacttgaacggtccaattccgagttcaaatggccaagttatggccatttgaaggggatatgctctttaaatggatatttgcgaatttcttcatttaaattttaattaaaaactcatttattg

SEQ ID NO: 21988 - DNA, 319 bp, Oryza sativa
cggtatgtaaacgatatatggactgctttaacattcgagacatgcatggaagagtctatactggctgtcggtgacgttgcatcatgccatgactcctcggcacggatctgggtcatttgcaggatgcaacgtccacttgagcctatataaacatccatgcctatcatagcagtcaatatatctatactaatgagcggtcattagtaaaattacgtgttaggcaaaataaacgcacggtcacctgtacgctctcaaccaatcatttgattaggatctgcttcatcatctcataatttccattattgtatcgatttttagg

SEQ ID NO: 21989 - DNA, 1501 bp, Oryza sativa
atactaacgaacacagccggccctatatgtagaaattaccaaatgtatgccttatgtggtacgtgatccataagactgataaagaacattgacaaaaagcccaggttacaatcccatcaatgatgaggccaaacaatggaacaacagagtagttaagtcaccgtgactgacctctcccctctctcgttcattatgatggattagtcactaatgtagggttgtcaatgagccgagctcgagcaagctcatctgctcaggctcgagctccagccaagctcgtgataagcctattgttagaattgggctaggcccaatttattctattaaatctcaaaggcccataataagtgttaaggataataataccacctcaggatttaagcgaggaatatctcaacctaaatagggagttattggaggctccctattgactggttgaggtgggggtcggaaagccacacgcgcgcgcgcgccgggccgagggcgtgggcgagggcgagggcatggctgactggcgtcacgtcgctactcttttgcaaccacgaacccacgttcccacgactgcctccgtaacggcgcgtccatgatcccacgttcccacgactgccgactgcctctctcctgatagataaggaggccgcgagtccgatcagaatgaatcacttgcttctttcccgggtgttagttcctcctcctctgcgcctgtgctgctctcgcctcctcgcttctgatcgcttgcgcgcacgagagatcggaaggagcagggcctccggaaccacaccttggcctgagatctgcaccgggtaggcgggtgatcaggtttttagggagtgcttcccgcacgactgctcgcccaccatgtctgcgcctggagccggagctgccgccggcgccgctgctgctggaggagatggcgcgcctggagctggagccggaggtggtgcgccaggagccggtgccgtgaacaacaacaccaacggaggcaattctgcctcacaatctagcggagggccattctcgggtatatccttctcctgttcctgttgttagcgctttactgctatgttcctgttactgatattcatgatgcctttagcatgctactgtgttgctgctatgttcatgatgcgaatgatgcttttagtatgctactggttatgttacatattgttactagatcaccctacactgtttatgccatgattattgtctcaacattttggattaaaatatgccgatttatgaccatatttccaacaatccaaaaaacctgataggtcattttcggtagttggctttgctgctgcactgaaaccatatgcttttgatggttctaactataagagatggaaagcacgtgcactattatggttgacagcgttgcaatgcttctatatttcatggggcaaacgaagtgaaccacctctttctcctgaggaagaggctaagttcgaggcttcggattgcctgttccgtggagcattgatcagttatgtgttcg

SEQ ID NO: 21990 - DNA, 1501 bp, Oryza sativa
gaacactttagataagtcctaacagaacacatcatggtctgaatagtcaatattccaggatgaattgtcgtgctatccttttggatctgggaagaccacatttcagccataagagcatgacatcgaacagaaataaatagcatccagataaaagatgaattactgcaaaacgaattaatggtggtgtaacctgcaactgtgtaatggttctcttttttgtttagagtactgtaaaattaaccaactagctagaagagttgagagggaaaccttcgatcggaggaaaaacttctacgattgtgacatgagatgagactacgatccagtaacatgctagtgagcggaaggagaatgcaagcaatgtttaacttagctcggtgatataaactcaccgttttctaattggatagtaaaagtggaatcgctgtcaccatgaggagattgctgaagacgacctgaccatgttgaaaagtgggagagttatcggggagtgtgcttaattgagagtgtacatgtgcctggctgctcgtggtgacgcgcgcaagtgcaaaggagatgttgcaagacatactgatcatggttaaactgactgttgtagaattggataagatggcatgcaattttagatcatggttaaactgactgttgtagagttggagaagatggcatgcgattttaggtgtaggagtgggggaatgaccctgcgcatcagtgtagggctgtaaaaaagggtcgaggctcgcgagcatgtctcataaaccagggccgaatctgagcccgaacaaaaactcacgaactttaacaaattgagctcaagcttctatcgagcttgactgtgtgtatagtttatattatttgttgaacttattgatttaataaattaatagataaatatataaatatatatatatatatattagtatctattcacacaagcatgttttagcacaatatgattattttaacacttttttactcttttattagtttggttgactagaaaataattatactaatcaagaaattatcatcaaaatatatattatactacttatgaccgagctcggtagttgagctcaatctcaaacgagctcgaaccgagcttgtctaaaagctcgaaggtgtaataggtgttggaaatatggtcataaatcggcatattttaatccaaaatattgagacaataatcatggcataaacaatgtagagtgatctagtgacaacatgtaacataaccagtagcatactaaaagcatcattcgcatcatgaacatagcagtaacgcagtagcatgctaaaggcatcatgaatatcaggaacaggaacatagcagtaaagcgctaacaacaggaacaggagaaggatatacctcgagaatggccctccgctggattgtgaggcagaattgcctccgttagtgttgttgttcgcggcatcggctcctggcgcaccacctccggctcctggcgcaccacctccggctccagctccaggcgcgctg

SEQ ID NO: 21991 - DNA, 1501 bp, Oryza sativa
taggtgcacctttttcttccttaactcgtgttgcattgaactttctacatttgcattagttcttgatgtgcagttgcacttggcgatggcaacttaactttcatatgttcttctttctcacataacttacaatagtggcatgcctcattttctgattcacttaacactttttaggaagttcatgatcctttgattttaggattgggcctactagactcatcggtagtaccaataaatcttgtcatggtcgttcaactcactacaagagaactcatttttactaccggttaacaaccccttttattaccggttgtagcaaccgagaccagtaaatcgagattcaaactcaaaatctctcacctcagcccttacgcgcgttaccatcccacgtactacacacatatgacttggaaagagatgctttctttttgaactaaccctggaggcatctttagtatctgttggtaacaccaaccggaactaaagatgtttctagggacttggacttttagaaccggtactaaaacatctttaataacggtttttaatctaatcgagatatttatgctttggggactaggataaaagattgtttttctagtagtgactattcaaatcattggcaaccgttcagaaactcgtcaagagttggcttttaataattggacatagtatctgtagttttgtgaaatttacttttgttgcttacagcagaagagggtgcccagcgccgtaactaagacagaggcacatatacaaaatacaaacactaacgaatgtaattgagggcccggtggattttaataatcttgcccggtaaatgtccatttcatattataatttttttttggggggttgtccaagtttgacaagttcataaaaaaaacctagcaacatctatattttttctataaaaatttgacttaggacgagactaaaatgacttataatataaaatgaacattgcaacttattggtggtgtttgaaactgatgaagatgaagattaagtttgcacataaaatgagaaaactattagcatatgatattttaaagcagcttctatatagaaagttttcacacggaacatatcgtttagtagtttgaaaagtgtgctaatgaaaatcgaggtaaaatctatatcatattatgttaaaaaagcaattatctatactcctttaaaatgttcctagtggtggtgtttgttctaccaccaccgtctaaacatgtgggacccaaggtccaagccaccaactgcaagaagcatctccgtctctctgatatgttctccaacctcgtgaactcctatttaccaccacaacgaggaccagaaggaggaaggtggttaggcaaatggagcgacaacgggccattttagattgatgccaaaatgtgccctgccaattgtttgacaattcaaatagtagtttgattggtttggattagagccaaagcatcggcaatgctcatacctaatttggtagtactctagaactttcttc

SEQ ID NO: 21992 - DNA, 1501 bp, Oryza sativa
cggtatcgcttctcgaatactccccacgtgtggccaaagtcgattgaggattgggctaggttggctgggctaggaaagggcacctcctcgatttggcttgtcttggtgaagttgggtgaccggaatcgtttgacaccattttgtgatcatctatccttcaccagcacctttgtgataggagttttgggctcactgtgcacttaggtgagtaacatttgttaacaatacagaaaaatgtcttgattgacatgccattaaataatattataaagttgtttatgttggaattataccatttatgtacaacaatttattacctcatggaatgtcacgcccggaatttctatccaaaattccaaacgcttacatgtgtgttaaatcctcgtccaggaatcagctgaggcacacaataacaaattgataatagagtactatcaaactactaattaatattcgcaaaataataaattattacagaggtggatagttcctctcaaaagaataaaattctacgcagcggaaaaacaaaagactaaacagcttccttacaaaaaaagactaaacagctatggcgactccactccacaagcaacttgacccgtacaaagcctaatcctccagatcatcaccttcactgaaatactcctcctctgatgaatgaatattgcaagaatgagcatatgacatactcaacaagccacacagcaaatatgcaagtgcacaggataacaaaggatggtataatatagcttatgtgcttaaacaacatttaataaacatttaagagaatagtaaaacagttaagtaattacgcaatattaaataaacaccatacaacacacccgtgttgcataggcctaacctcatctgaacaaccaaccccggttgtacaaatcaaacctccacaccaggaatataccattccaaaccaggagtcaatttaattatcacaaattatcaccaataatgagtagtgtgggactaatcacgaaaaacattgttaacccacccataaccgcgggcacggctattcgaatagttttactctggccagagatgtaccactgtacccacaagacacagctccacgatatgtcaccatgcgcctcaataccaccacggtacctcggaaaggaactgtgacaatactcctcgcacaacacaactcaccacagtgcaccgttcctggatcataatctccccctcaaaaccagaggcatggactccctagcgacccccacggacttctcgccgcttttcagtctggcaccccataatgaatcatgctatacaaaaggtaaagccgttgcccacgctggcttgtggttggcacggtaaatgtttcacaacagtagctcgcgaaccggtccttaattgtcatgagcacgaccatcaaaaccatgtgctcacaacccaccattaatcaagttttaattatcaattaattatcataacacgattaaccatcgtgagctaccattaaatataaccataaataata

SEQ ID NO: 21993 - DNA, 1382 bp, Oryza sativa
ctccatagaatagtccagcactttcctgtcaccttattaccatcgcatgaattccgtgaaaattatgtagtgttagtaaaccttctccgtttagttctcaggatatgcagagtcctgtaaacgtaactatttatccagcatatttcacctgttggatcaggttccaacaagagtccatgtggaatgcaacctgtttgtactggcatacttgttgtatacggtgtatatgaaaaacaacaagtcgaatggctgagtatgtggacgaactgtggctccgcatagggtcgcacccattcaaataatattatgtgaaaccgtaaatgtgtgtcctaagtgtatgcattattggcaaggtatcatatggcatgtaagcgttaggtcaagcccatatggtgttaaacctaattaaaagagatgtgggtaggcgccacgtaatataaaatccgggatcagcaatagtgagggactttttctgctcggtttagtaagatcagggataatttgtatccggttttgtgataatgggatgaaagtagtcctgggggacaaataggtggatcaaataaaacttattccttccctcaatggatcaaaatccacttccaacaggccgtatgtgctcttgtttgggccttgtttgtgtgggccaaatagagtagtacttaggcggtcacccgtcagtgatttgatttgctaccttccgaatcgaaggacctacaggcggaaaaaaattctctggggcagggccgcagctcccaccccatgaggccccactgtagatgttagccacgtggatgagcacgaatcttggaacagtttcatcttctttcttcttctccccccatctcccgtattcccgacctcctcccggcggcgtcgatgctactttccgccacggtcgccgagttgcttctgtcggtcgctcacctttctctgcccctcccatctcgtcacaggaatttgtaggcatcgccgccactaacctacactagggttgctgggattttaggatcgcgttgtggttccggactaccgccctgccggtgcgtgatcagatcgatctacgggcctggagacgtgcgacctgggatgcatcttctgtgctgctcctagcctccttcctcaaaaatgcatacatcaaatatgaacgttgagaaaagtcctgccttgattagccatggctagtgagattccgtgcaatagagaaatgggaagggagggaagcagcaaagcagctagcaatggaaatcgatcatcacggtgaagaaatatgcaagtaatagattttacttctatcttttaagattaatgatgttgccgtgctgaactgctgattgcgtggacgccgccgggacccgggaggaggtcggaaatacgggaga

SEQ ID NO: 21994 - DNA, 1501 bp, Oryza sativa
tcaaagaggagcgctacgaagacgaccgagtaaatgatctcaaccgactggaagaagcccgagaagcagcattaattcagtcggctcggtatttacaaggattgcggcgctatcacaatcgcaatgtcagatcacgcacatttttagtcggagatatggttttgaggaagattcaatctacgcgagataggcataagttatctccctcatgggaaggaccatttatcatctcccatctaaatccgaccttttctcttgtgttttcctaaaattagttgaggggaaatatttcctttatcttcctctctcgttttccctaagaatcggaacctaaatccttgtattttatccgaatcaaactcgttttcgagtttatctctccaaactaaccctcggattttccggttaaaatcctctcattttgagttcaatctctctcacccgtgcctatataaagcatcccttagtcgtcctcttccgtttgcctcaagttccaagctctaccgttgcccgtagcgccgtcgctgtcattgtcgtcgttccagccgcgccgggccgtggttgtggtcgccgtcgccgcttagcgtcgtcgccgttgggttcgcgcggaggaggagcacctcggccgcccctttgcagccgctgaagaccatcggagagccgtcgtcgctgtcaagtcaagtcgagccgccgttggagttcgtcgccggccttcgttcgtcgtcgtccgtcgttgtttttcgcaccggtgagttcacgtcgccgtcctcttcgcatgggtgtcctcggaagacccagccgagtcctctagctccggcgacctcatggttcagagccatggccggcgatgtgatgacgtcataaatccttttattagtttttctgtattagataaaatcttattaaacttcggaaattcataactaaatcatcgtaactcggattcaagtggttcaagttgctaaattcatctaaaatcgagatctacatgttaaaaatatccacatgtactgtttatgcttttttttgtactgttttgttgattttgttcatttcctttagtttccgacgttccggaggagagcgtttatgttgaggaaggttcagaagcgtttgaggaagctcaaggcaagtcacacagatcccaaacaaccctttgagcatgttgaacccgtttaaagctaatgttttatttcaacttatgcatttttttcgaatgtcatcgggtggtgagcctttcccaattaattatggccgaagatgactttattttcctatgggttataatttgatttgctagaaccttatatattggtttggttcagctaaatgctacatatgataagctcattaatgggatgaatcatatatactgcgttattatttatggttatatttaatggtagctcacgatggttaatcgtgttatgataattaattgataattaaaacttgattaatggtgggttgtgagcacatggttttgatggtcgtgctcatg

SEQ ID NO: 21995 - DNA, 1501 bp, Oryza sativa
atccagaaatagtgcactgtggtgagttgtattgtgcaaaaggtactgtcacgattcccccctttggtggtacttcggggcatggtaacatgtgtggaatcatgtcttgtgggtacagtggtacatctctggccagagtaaaactattcgaatagccgtgcccgcggttatgggcgggttgagcaatgtttttcgtgattagtctcacactactcattaataataataatgtgataataaatttgactcctggtttggaatggataattcctggtttggaggtttgatctgtacgaccggggttggttgttcaggtttggttgggcctgagcagcatgggtgtgctgttcagtgttgattaaaatttctgattaattactctactgttttactactcttaactctttgctaaatgctgctttcgcaaatgagcctatattatgccatcctttggtatacttgtgcacttgcatatttgctgtatggcttgcggagtatgtcatatgctcaccttgcaataatcatcaaaccttagttgaagaaaaaggatccggaaggagaagacgtttggcttataccccagttgagctgcttgtgggagtggagctaaagccatcgctagaccgttaattccgctgctgtttttcttttcttttctaagtatgtaacgttattattatgatggatttgtatattaaattgtcagtttgtgtatctcggctgattcctggacgaggattttatgcacaaataagttcagaaattactagtgaatttccgggcgtgacactcatcaagatctaggacctgtattggaactaagtagatctctcatgcctcattgttggtgtgatcgatgcacatccggcacgtcggacggaaaatttcgtgtcaacactaggatatggggcatttgcaaatttgccaccggttttttcaatattgtaaggatgccactcgaatgacagttctagtgtcatttttgcaattttctagtggcagttttgcaataacaattcaaagtagtggtaaatttgcaattgcccctaaaatgtttaccctttggagagtggaatatcatttccgtatcctatttgccaaaggagtccatagtatttgaataagagcaggtggtgggaaagataagaaatgcttggtggaaccagggtttgcaaaaccgccggtaaccgcggttaccaggcttaccatgggggttcggtaacccttaccggcagtagggtttgccaaattttgagcaaattcaaaaattcgaaaaaaatcaaaaaaaaagcaatgtagtgcttgatttgtagtgtattatggtgaagaaatttcatgaaaaagagtcaattaggacataggaaaaagaaataatgaagtgggcctaagcttgcactggtcatgtggcccattaagacccatacgtggagaaaatatcaccaagtactctcatctctctattttttttgttattatccccaaattctacacacatttaagt

SEQ ID NO: 21996 - DNA, 1501 bp, Oryza sativa
tgctcagataataaagaattctatggaagaaaatcttcaaattgggagtacacttgtttggttctactgtaaatgtggagagtacacatatgctgcaagaattcttgaagcgatgcctgaccgtgatgctatctcatggactgctctgatttccggctacaataatctaggtcataatgttgaagcacttaaatcattagatgatatgctatgggatggtgtaaaaccaaatacatacacttactcctcggctctgaaagcttgtgcaaaattggaggctctgcaatatggaaggaagatccatggttttgttaacaagactcaagatttctccaatgtgtttgtgggaagctcacttatcgatatgtacatgaggtgtggaaaagtcgacgaagcccgaagtgtctttgatgccatgccagaacataaccttgtgacatggaaagtgattattacaggatttgctcagaatggcctctgtgaagaggctttgaagtacatgtacctaatgcaacaagaagggcatgaggttgatgattttgtgctctcaacagttctgacatcatgtggagatcttcaatggaaatccatctccttctctgactcagttgctggttcagtttcagctaggcagtagattagttctcccgtggcaaagaagctagcacttctgtacagttacagagatttgttattgtgcaagatcagaagacatgtagcacaaaaaggtaactcaaggagtgcatacgtgtatatgtacttttaagagtaccactaccttcactaaccatttgccttttgggttcattacaaaccatgcatatcttcagaagaaaaattgtgaaaactttagaatgttttttatgcctgttttaattcccactatggttatctctatcattacaattgcattaacatatgatctgcataataagcataatgcttgcacgcattagcagctaaatcattcttccatatcatccacttatccacttaggctgtgttcggaatcggacgttcccagcgtgcacagtaagtacggaaaacgaagcggttcattagcgtgtgattaattaagtattggctatttttttttcaaaaatggatcaatatgattttttaagcaactttcatatagaaacttttttgcaaaaaacgcaccgtttagtagtttgaaaagagtgcgcgcggaatacaatggagaggggttgggaaccttgagttccaaacacagccttagagttcatgctgtgactgcaaaaaattaaagttcatttggtaattgaattcattatagcaagtgtatgtttttttttcatgaaattgatatattttaacttaaatatgggttttaacatctttatttcatacattctctatttgtttttttattaatctaaaccatcacagtaattcacattcactacaatatgagggcatcttgttcttaaagatcgtaacatgttcttattttatcttgtttctccacaattttcctagt

SEQ ID NO: 21997 - DNA, 1501 bp, Oryza sativa
caacagtccaccaccgctcctctttgtcgccctcacctcctctgtcaggctcctcctgccaccatcgcaggatccacgtagggccgcatgagggagggccccaccgctgctgccccacgcctcctccatcaagctctcgatccgtccctcccgaacccggaggcagccgctcccacctgcggtcggctgctcccgagcctactgtcgctgctcctgctcgtggttggcctctcccgtgcacaccaccggatccgcttaggggacgaccgccaccgtcagatccgcgcgggggagggcccgtcgctgttgccgtcgccccttgcctcctccaccaggctctagatccgcccctcccgagctggaggcaggtttatttacagtccacctgcaacttataagggttcttgtgcagaaaaaatgtttttgtagtggtgaattttaacgatacgacaagcacaacatatgcacttcattaattcttgtattttgatgaacaggcacaccacaacatgaacgagagatggtgggaagaaacccacgtgaggtagctcgaactctcgaggcggtaggattgaaaaacatagttccatcacctccgacccctcttctaggaggaagatgcatagtttgtagtcgcgttccaggaatcctaattcgtgtgcacgcaaggggcgcaagttgcgcacagttttctgctgtgtgacaacaagctcagggtaggggtaggggtaggggtagggttagggtttcagggtggggtgagcgaagggttttgttagggaggggtaagtgggggatcgggcttagagtattggcctgcaaggcggcggcagcggcatcgccggagccgtggggtcggcaacgggcagtaggctagtgttggtggcaagggcaaagcgaggtggagggggggggggaggaggccagctgagcgggacagcaccatcattttgatgccttttggcgccggtgataccaggcgatggcatagtgaggatcgacagcgagaaaaggaactgacttggttgattgaggaagcttttcggagggaggaaggagggggatcgctagatagaggtctttgcagccgccgtcatcgaaggaggaaggcaactcgactgtgattccttttctccaacgatggagctcgcaataaggaggaggaggagactcgctggaaggccatcaccggaggaggggtgtcatcgtcgggcttgtgtggagagagatagggaagggtgcgtgtgattgtgtgaggagataagatggagagagagagaggggaggacacgcggaaagcatgaatcctaaatgactagagagtgtgatagaaggatacattaaggatctagtgacaaaacaattgctgattgaattgagtttgagtcctgtgggaaaggattggtttcagttggtcaaaagggtgattaggttccatggtaaaatctggctaggtgcacatacagaggctaaacatgatgttatgatgtctccacatgaa

SEQ ID NO: 21998 - DNA, 1501 bp, Oryza sativa
attcgtactttttcaaaaaaaaaagacaagctagattggattaatcatctaaaggccacaaacaactaacattgggtcttcatgagagaagggatggatgacaataactctacttggtggggttgacattatcaaattactatattatcaaattactattgagagtatataaaccatgacagttggaatcgtaataattggctgtagctcgtttgagtaaaggctgggatattatattccatcttttagatacttaattaagctttgagaatttctcaaaatctaagtaagcagtgacgttttttctcctttccaatccatgattttaattcagtgagaatcgctaaactgagggcatgcgtttggctcctggttgactttataatcctagccaaattttaaaattagaattaatttatatagtttccccccctttttcagtagccaaatttaaaaattagaatctactccctctattctataatataaggcacaaccacttttcttagatgttctaaatataaggcatgcatacaagcatataattaattatggcatcttctctatttaattattactttttaaaatcctccactctcatgttatctaatcctattggatgcatgcattatatttattagaatgatccaaactacaagatgataataattatttcttggtatttgggttaagagtggttgtgacttatattttggaatggagggagtaattagttttagaactaattaggattttttttccctgttttcagtcctatatgtactgtgcatctcccgtttaggaaaaatgggggtttcgatggtcatgtaggaaatctccgttcaggtgttcagagttcagacgtttgttgacggacaagcggacgtcgatctgggccgtcaacagccagatggacgtccagaactcctcaaggccgtaccctgtgacgtaggcggtgactaagcgggaccttagcttccccaacgcgtgcggcaccgccgtcctgtagcccaccgtgcggaaccaaacaaatcaatccagcatataagctgttatacaaagcttcccaaacacagccaaggccacatcgagcagcgtcgtacaaaccaaagcccctctagactaacaagttaaaaatacagtttgtcaacggtgcaaacaatggcttcacatcgatgagaccaattggcatatgctaataatacatagcagaaataaatttaaacttcaaatccacaagaaaaaaattgcatctctcttacgaggagtatatatatatatatatatatatatatatatatatatatatatatatatatatatatatataattgttgcatatacatgcattagaaaatgtactcatccgtgtgtgtataaatatgggctgtgcaggcgccagaggaagacgcccaagctaatcagctaattaacccgatcacatctagctagctaactaagagtaattaggggctaattagtttcaaagtgaagtgaggcg

SEQ ID NO: 21999 - DNA, 169 bp, Oryza sativa
aattcgggatatattaagtttacttaatatttgtagtaataatggaaatgagaccgtattagaccctaaaaatataccaatttgtcaacaacatgctgtcgagctatgtaaactttgtttggaaagacgaattgatgaacatttaaaactagatttattcgatgatagg

SEQ ID NO: 22000 - DNA, 713 bp, Oryza sativa
tggatgatgatgtggtacaattgcatcttgagctttaaaagttagtggatatcaattttatagtaagataggatgtggctgcacagaaaagagagagtcggtattgtatcagttagtgagaagttgtatagatatatagaattcctcattacataaccgcctgggaaaaccgtgtggccttattaaaaatcatgaccccgttcgtttcaggataaatttttggattaaaatgatacgctttttaaactgctaaacggtgtattttgtgtgaaaattttctatatgaaagttgttctaaaatatcagattaatcctttttcaagtttgtaataattaaagctcaattaatcacacgttattatcacatcgttttacgctaaacacttaatttttatcttcaccttcagaagattcaagaaccactccaagtgtccacgttcactatacagctctcttgcttgtctgttctctctctccacacttcctctctccctcaactcctcttcgcctctcgctttcctgatcttttcctgcattgaccttgattctggtgacgagatagcggcaccaaaggggaggttcatataggcggcgtaggggaggggcacccgtgtccaaggagagggccgacagtggtggaggaacaggactgtggcagcatgagagttccagcacccgaccactcctgctcgttggtttcgtcggtgacgata

SEQ ID NO: 22001 - DNA, 1501 bp, Oryza sativa
ggtatgtcagctaggttaagttatactctagatttagcttggagcccacgctagcctgtgataagtacggttatatcttccagggattcccgagaaccaatccttaattgtcatggcacgacttccaaaaccatacacccacaacccaccattaaagcatatttttgtttaattaaaccttaaccatggtggtacatcatcatatagttaaggactaattatagtgaatctcattatgaactaattgatctaagcatggctaagcattcctaaaccaatcatctagtcaattatatcccaagctatcaatggcataagatatcaacaggctgagtacgataggcatccatcccacatgacattctaaaataatgcaatttaatagaaagcatgggattttataaaataggttcaacatgatcaatgttgtatgtatgacttgcattgctcttgagctgacggaaccgcagcaaccacttcaaaataaactggagcgtcggaactgtcggaatctaaacgacaaacaaagcatacaataatacatcaaataagtctgtggtggatattttaatgaattcactgcaactttaatggattaaaacggagctcagattatttagatatgaattttagaatatgagatgtgtatttactattaaccgaaaaaccttagtccattattacacattaagagaaataagtcaatgagtcaacaccagtaagcaagcctcacgggatatcaactcaatgagtcaacccaccgtgacatgggaccactcaaacggtcaactgaaccgacgaacggaactgatggcttagaacgactctaaaactaaagaacgactcgggacgaccgaacgaacgaggctttggactatacttcatgcgaacgaacgattaacgactagcgaatggctgcggcaagaccggtagacttaactcggtttgcggcaacgacccggtacggcaaacggtaggccggtagcgactcgggttgacgactgcggctaggcaactcggctaccgagcgacaagtggcggtgtcacgatctagcagcgatacgactatggcaaacggtgataaccggcggcagcggtggcagcgcgggacagcggcgacgctcagcggctggcacgacagtgggcggcagcggcgcacggtggtggcactcggcagcgggtggctgcggctagtggttgcggcagcacagcacagcggcggcgcgactgcggctagcggctgcggtggcacggcacagcggcggcggcttgacagtggtgcagcagcggcggcggcacaattaggattagacccactacgcaaataggaaattaaaaacctaaactaggagatcacggttaggaacctcaccaaacctagatgatcggggaggaggagatggcaacgatgatccggcggcacacacggagatgacagcgacgctagacaatgagggattaggttagattaaaccctaggaacctcacacaatgacaaacc

SEQ ID NO: 22002 - DNA, 1501 bp, Oryza sativa
attgtaagtatgtcatagtgagtgagtcgatatgcattctgtaagatataacagaaaatcttaaagatagagcggtagatcattacatatattcaacacatgtattctctcttaacggaaattcttacagttagagcactagatcccacaatttttgataatttgaccctttgcaaaaactaattttacaaatgaaccgccgccaaaacttttttaaaaaatgacccttttgttcagtgccaaatcgtgtggcgctgaacttagacacctcagcgccaaatagcatggcgctgaatgtacgttggcacactaactcagccttccatccgcgttggcacagcattcagcgccagttgacgtggcgctgaagtgtctaagttcagctccatagaattatttggcgttgaaaaaatggtcattttttaaataagttttggcgaaggttcatttgtaaaattagttttttcaaaaggtcaaattgtcaaaatttgtgactaggtccagtccagcccagaaattctgtcttattcgaaacaaaagcaataaatcatttcatatattcaacacatcagaaaacataatgttgggcgggtgctgctgccgctcaggcatgccacgtaggataaaaatagtgcgcgggggtggaaattttgccaaaaaaaaccctctgttttgtgtgtaatttgatgtaggttcctcctacgtggaaacccttctaaaagctgtatattccatgaaaaggagagaaagatcacgaattaggaccgcgctgtgataaatggaagcataggggcttttacgcaaaacgacacccactaaccttaacctcaccccaaaaccctagccgccgccgccacccacgtccccttctcccactcgtcctactctctctgtctccgtctcgtgccgccactgggcgccgcctccaccgttgccaagcgccttcccctcgtggcacgttgtcgtcgtcaccaccgagcgcgccacctctacctctgcctcgcgttgcctcaggccgtctccgacggccgatgtccggatccgatctccatgtggtcggggcaggcggatttgaccgtccacgtcccctcctcgcctcactctctcgctcaccttctccttctccctctgaccacccccgtccagatcccattcgttgccgctccaggtgctgcggatcaaggggcagctcaagacagcaagcttcgtggtggcacacatcggcattgacttgggcagacaacatccatgatagcatgggctattggcggcggcaaccgagctctaaatcttgtagtggcgaagtcttccttgtggcggcagcgaccgcatcttcctggcagcgacgggatcacgggatgttcctggcaacaacagcggcggcaacttctcggaagcagcggtgtgttcccggtgacagcagcggctgcatcttccctgcagcgacggtgtcttccctgcgacggcaacgtcggcgatgacatctctcctggtgcaagtt

SEQ ID NO: 22003 - DNA, 1501 bp, Oryza sativa
aaaactcaagtttaagtaaaactggattattacaaccaaaatatatcatgtctaagtcgttggaccaacgcatggaggggaattgtttctagttaaccttcttgggagatttggatcatataacctccgtttagattttaaaaaagttgacatgtgaggtcatgtgaggtcgctgagactccttcctcaattgagatataaggagaaggtatatgatcaaattttttactgtagctaacctatgtttccatgggtcacccaaaattcatgcacaattgacaattcctcacgtttcgaatcaactctgtaacggaagacccaaccagaacaagaatagggagagaccatggatgacccagaataactcccttgttttgcactaaacttagaagtgcattcttggtccattcatgccctccatcctaacggattattctctcaaccccacgaaccattcaacgcgaagtctgcacgcatttttactcttttcctcccaacaaagcaatcattcccctgttttgctgccaattgcagctttcaagcatggcaagacgaataagagacccttttccttaattttgtttgatcattccctttcagctttgattttcctggtatgacatgaagcattgttcagattatttgttgtctgaagcccttatcaagatttgattccaggtttgtatttccctatctgatcttcaagttgttttcttctgataatgaggttccccatgctgtggtaccggttttatttgatgttgatagccatagcctttcagaatttcctccataatgagtagtcttagcgcaatgcaatttcaacatcccttacaggattcaccatagtgcaaatgacctaaaagtttcgaaattatgagtttaatacatttaaagttgtaaaagcttgctaaatgttcagtttcaaattcattttagatttcaataaacaaagaataagcacaatcaacctaaactgttcatcaagtggctagcaacttgtcaaggaggcctgagagtagcagaacattttttttcatttctttttgataaatgaagctttcttaatctcagacaatttcatcccggtgataaaattatactaagactactcctaatttaagtttttccttttttttaaaaaaaatagattagattaaatccggcctctgcacctttgtggggtatatacagccaaacaaagtcacgagtacgtaagattttgccattacatgggaaaaaaaactaagtttaacagatccggaaagaagaacaaaagattaagcttcgattcttcttctaaaattccaaccaaaagtagagtaaaactccaagactcgttttcttcttcagttttacctgcattgtaatttttttttcattttccagtttttacactttcactcaaattacctatcaaattttgacattctgccctgtgaagtttcagattacctagaaactcaagctttcaataaactaacaacgatggaggacggca

SEQ ID NO: 22004 - DNA, 1501 bp, Oryza sativa
actcttcaattttgaatactgcaagatgtgcagagaccacatgaactaagaatagatttggcgactttttattatgaagaaagcggaacatagcactttacagtatttgtttaaaataaacaaatattgatgttgaaagaagaataatatcaaattttacatggccagtaatttttttcctagaaacatgtgcatgtttcgtaatatgtttttcagtaatgacagtcagatacttctctttgagaatgaaatgttcaatatctgaacatttttggatattcctgtctagtacaatatctttctctctaaatttgtttcttagaaaatgctttcagaattttcaattcattacctgtggctatatattatactttcaaagtgttcaattttaattctcccgcagatatcttctgcagagtaagtttgcacaatttaaagatcaatagttctgctttccactattttcttggtggccgtggtactagtctgtgaaacgagggaagagaaaaccaaagtacaagatcggattcacatcttggactagtgtgaacatgtgcaagggacaagaactaacggacttgggcagcccaagtatttgctggaacatatatggagattattttttgactgacttgctcactgactaccatttgtataagatatttcaatggttataagttactaacaggggttcacaatgcacaacaaagaaaaaagtaaccatgtaaaaatttgagtatcagagtaacttaattttttattttgtaattgaagagcattcagaagaaattactcaccattatctgaagatcaaagtatgaactttcagtattcaaggaacctaacaatagctatgttgataacaaaaatgccaatttatttctatcctgctttcattcagcacatatatggtactaaagttgtgtgatgatgatcgatggtgaccctcacgtcgccctcacgcgggcggctcgggggagaaaaccctagccgcccgcgccgccacctcgccggcctctagccgcctcgccgccgccggagccagccgccggaaaccgcgcggccggccgggaaggcggcggcggggagaacatcctcggggagcccttcctcggcgttggaggcggagcagcgtcgacggggcggtggtcgacggaggcggcggtcgatggaggtggctgcgacggatccgggcacgccggagacggatccgacccccccgggcgcggatgtggccgatgacggtgctctgcgtccggctgccagtggaggcgggcagcgcgtcggctgcggccggcgaggggaggtggtggcagctcgcggcgacggcggccgacggaggcgcgcggaggtggcttccgctgtgcagcggcggagctcgtgcggaggtggctggccggcgacggcggaggctggcggctgcggaggccagcaccgtggtggaggcgctgcggcggccggcagcacgcgtacggtcaggcgtgtgcggggtggctatcac

SEQ ID NO: 22005 - DNA, 364 bp, Oryza sativa
gggaaggagaggatggaagtgacgaatgaacaaagggccccagataacagagccaggctatataccgaggatccgaaaaattggggattaaaaaagtgaacccccccccccccccccccacaaaagaatctggacacggacaacccaacgaatcgaatcctactccattgaagtattcttcaataattctattactcttaataagtttattagtattcctactcccaccttgaattgttcttccattgactagctaattaattagttaattccgtactctaccaaacacttataaatcgacctattcaatttattcaaccaaaatcgattcgccctccaattagatcaactgaaacccaatcgg

SEQ ID NO: 22006 - DNA, 269 bp, Oryza sativa
ctgtgaacaaaaaacatctaaggaggaggatgctcatttatagttaaaggaaacaatgcaacgatgcaaacaacataggtaggacacatttacgagctgaaaccgttgcggtgttcaaattgtatctaaaacttgatttcagacaggaaaatgccaaagtgttttacttaccctgggagggggaacaccagaaccggcgctcctggatcacctctgaaaaaattgctgtttttactttgacgcttgctccttttcttttcttataaagt

SEQ ID NO: 22007 - DNA, 1501 bp, Oryza sativa
aattcctagaaatatttgatgaatcgttcaattccaacttaccattacagtgtcttgctcgagcttaccacaacaaggtgcctagatccccttggatttcgaaaactcttttaaggtccataaatagaaaaaaacagattattatatatatagaaagctgaaccaaacgaaaagaataaaagtaaatatactcatctatcggaataagctaactgttatacttcgcatagcaaaaaaaacaatattattaccgtcaattcgatatattcaagtccgacatcaaaagtacgtcgaaggtaatcaaccaatctgactattacaaaaaaatgtatgttgatggtgaacatatacacaataatactagcgttgcaaatgcgtacactaaaaattcatttttcgttaacatacgccccaatcttgcccgcaacattcccgattccaattcaccattccatttttatttatgaggcaacattccaaatagtattttctttttatagttcaggttatgatggtatcactaatgttttactaactaaaaaaaaatcatccatgtaatagtttctcctatatttgtaatctatcactaacaaccggcactgtccctgataaaaaaaaaagatcgcaacggttatacccattttttaagaaaggtgatcaacaggacgtagcaaattaccgctccatttcacttctaactattttctcaaagatcctcgaatttgttttttgtttattctcgccttattgcttttttttaaattttaatcatgttctctcctgctcccaatttggtttttgcaagaagcactcatccgcgtacgcacttctattatttatcaataagattgcaaatgctatcgatgccatgttgccatgaagaggaaatcactctgttaaaggagaagccctctccgatgtccagttggttttgccgggaacgggaattattttgaaagaaatagatcagtaaaagtttcaccaaaatcctattagaaataagaaagttaagacttttgaaattgtaatcatgcaaataaaaattgacaaccctgtgacgtatcttccaaattactctcccgtttgctctgtcttataacatatcatagatttataatttctttgatggcagttttaactcaattacactcatcctagataataattgcaaatacgattttcatcaataagaaaatagaagtatttgtgttcgttgattacggcataaaaaacttaaaaactttctaatacttgttagaatcggatcatttcgcgcaagaaattcccgctatctctcggagagacttcgggtgagggagatgctaaagaatatcaagacaatttaccattccttactttcgtagtacgttcggcaggtaaaattgcttcgtgaagaaaacgggctcgacaaattacgttcgcaataggttaacacgtgaaaacagttttcgttttcctagagatttcatacctcattttatctcaaagtctgatttttgca

SEQ ID NO: 22008 - DNA, 1501 bp, Oryza sativa
tgatatctcaaagtgtgttggagatttcaatcgacaatgtaatatgtttttgtttaatttcaaatatgctaactctcacataagaaatatattgtttcataaatattgttcgagtttctatggctcacagttatatcctctgtttgataaatgttttgataatatttgtagacaatggcgggttgcaataagaagggtttggaaaattccatggcagacacactgtcatcttttgccttatttagcaggtgttatggatccagagttatggtttgcaaaaagatgtttatcttttgttttgaaagctatgaattccaaaaattatacagtggcacatatagctggaatggccaggtatggagctcattctgtgttgggaggtaacataagattcttgaatgataagtacttcatggataacaatgaaattcaaaagcagtgggctgtgcaatgccaagtgaatgatgagacaatacgaatagttgaacaagtaaaggaattgatcaactcgagggatgattatttatgtaagggtttccttaaccgagaggagtgcgaggaaattatcttgtatttatgcacactctgatcttaccctgttatacatgtattctgttgttgatgttgtttttttgtctttacatatattgtgaatgtgactatttgtagaatatattgtatattttttgttatttttttatatgtgctttttaaagcgaataaagaactcttgaattgaatataaataaatgtgtgaattctttggtcatatttatcaaatatgtaatcttctttcgtagaatcttccattgtagggctcaaggccatgtaccttccagtgtgaatatatagcggactttatgaggaagaaaaaaaacttagcagtaaaggtgggcaagttgaatttgcacctacaaaagtgggaagagctaaaagtgaataagaatatgaatgtgaacaggtatgacgtgtgaaatgtcgtgcgcgtgtgaatatctgtatgtttgtgaggtgcgagcttgtgagtgtgaatgcgaatggttgcggggggggggaattagaagaagggattgaggggtggcagggaatactaacggagggtgcattgtatacaaattgtattttgttatttttcacgagtgatggtaatgaataaattcattatgttttattattattagacaaatttagtgatttcattctattattttccttctttgttcactgctttgtgaataatttatttgtgttatgaaaacaaaatgaagatttgtatttgtacggaagtatttacaagaacaggttaagacagcctacttaaatattagcgattcatttctaggagtcacaaagacggaaaagaaagagtggataactgatgatacttggcaagccatagataaacggaagggtgcgaaaaaacaagccatggaagcaaaatcagacatactgaaagaaaggtaaaagcttcagtaccgagtggcaaacatggtcgtaaaga

SEQ ID NO: 22009 - DNA, 1150 bp, Oryza sativa
ctctgttgaacaaaacagttattaatagtgttagatgtatctacctggaaagctatttcctgctaagcaatattcatgtttatgttaaagtctacaaaatcatatatttgttatttaaccgaaggagtagcattcttcaaactagttggtattgcatgagcaatatcgattatctggagtaattgatttgcattaatcccaagattttggaaataagccaaacgctttatatgtccattatcgaaaatttaatttacagtgcgtatgcctttattaaatagatcataatcaaaaatcattttacgtcttatacatatattatgattatttaatataactggatttacctcctcttcatacaatccatacttcctcatatcctgccaagcctttagcatttcttaataaaatggtggtattttcaatgttaatttggacgtgtcaaggtcacatttaaacagaaatctccctccaactgttctaaaacaaaattgtaaatactattccatccagcacacctatctccatacaataaatatttcagccacatcaaacgttgcgcctttacaaacaatttaaaattcatcatttttaaccctccatgagagtaatccttatacattatctttttctttacgcggtctttacctgcccacaaaaattcaaaattaatgttttccacctaacttaacaaccactgaggaataactttaagtgatgagacatactgtagtttaactttgataatgcatatgtttttaacaattgtattttacccatacgtatgagatctctttgtttccaccatctcaaattttggatgtataatggattttgccttctttttccaataacgtaatcacacacacttacgcacacacgcaaactcgtgcacgcacacgcacgtcccctttaaaacatacaggaccacagtagaatgtgttgtacaagggattggttattttataaaccttacacatatcgtctctgagagagaatcctacgtcatttatatatttacagccctgatagtgggtgcgtgcgtgtaggtgtatgtccagggttgtggagttacatgtaatgtacctgcattatgaaccacaccgttttgcggtattcaacttttatgttcttattttcactatagagt

SEQ ID NO: 22010 - DNA, 174 bp, Oryza sativa
taatatcacgaaatcgaattcttgttatcaagaattaccattgctttacaacataaagttatttcttgataacaagaattgatttattgatataaattaataataaaacggcttgccataagatcgcgccagctcgccacaactcgaggttcaaactcggctaagtgggagcca

SEQ ID NO: 22011 - DNA, 614 bp, Oryza sativa
cagttctcgactcctcgtctggatttagttgtaccgttctcgactcttaatccttgtcctaattcagtcccccccccccctcccgctcgaagcgcgaaacctttttacgtttcattaaatcattagagaaagaagacgattcgtatttccggtctcgactctaaatcctcgtctgaattcagtttctaccctcccgcacgaagcgcggaagcttttacgattcattacatcattaaaaaagaatacgattcgttgtacagttctcggctccttgtctggatttagtttccccccccccccctcccgagcgaagcgcggaagcttttacgtttcacttaatcattagagaaacaagacgattcgttgtacagttctcgattcttaatccttctctgaattcagtcccctcttccccctcctgcacaaagtgcggaagctttgacgtttcattaaattattatagaaagaagacgctgcgttgtaccgttctctactcataatccttttctgaattttaaagatgttctttgtctgctcctttatcttcctacgtcctcttcatgttctctcctctcttttttttttttttttgccgttgttttttgcgggacagc

SEQ ID NO: 22012 - DNA, 1501 bp, Oryza sativa
ttggcatactagatattatcaatctccagtggagtggaattaggtacagggtagttgattcttgggctgcgttcaatactccaacatagcatgtaccattagtctgttaccaatgaagcataaaaacaaaactccaatggaaaaccaattcagttgtgctagaacataactgtacctgatgagaagtcaaaagacagagtcgttttgtcatcatgttctgcgaggtggaacttatttggtgatatcttcgaaaaagccaaaattacggactgtcgagcaatgtgaagagggaatttgacttgaaatactaagtaaatattgtctccatagagcacagctgcagaaggaacgtctgttgtgagcaacttgccttcatctactttaactcctgagctagtctgattacttaagtagtattgcttgatgtatgctctcccttgattatcaatccagccaaccatagcacttgacccaaccatctttccgtcatttgagaaaccaatcccaacccatccagatgaatagggtgctgaaagtacaatgctggtgatgttatcttcactcttcaattttgaatactgcaagatgtgcagagaccacatgaactaagaatagatttggcgactttttattatgaagaaagcggaacatagcactttacagtatttgtttaaaataaacaaatattgatgttgaaagaagaataatatcaaattttacatggccagtaatttttttcctagaaacatgtgcatgtttcgtaatatgtttttcagtaatgacagtcagatacttctctttgagaatgaaatgttcaatatctgaacatttttggatattcctgtctagtacaatatctttctctctaaatttgtttcttagaaaatgctttcagaattttcaattcattacctgtggctatatattatactttcaaagtgttcaattttaattctcccgcagatatcttctgcagagtaagtttgcacaatttaaagatcaatagttctgctttccactattttcttggtggccgtggtactagtctgtgaaacgagggaagagaaaaccaaagtacaagatcggattcacatcttggactagtgtgaacatgtgcaagggacaagaactaacggacttgggcagcccaagtatttgctggaacatatatggagattattttttgactgacttgctcactgactaccatttgtataagatatttcaatggttataagttactaacaggggttcacaatgcacaacaaagaaaaaagtaaccatgtaaaaatttgagtatcagagtaacttaattttttattttgtaattgaagagcattcagaagaaattactcaccattatctgaagatcaaagtatgaactttcagtattcaaggaacctaacaatagctatgttgataacaaaaatgccaatttatttctatcctgctttcattcagcacatatatggtactaaagttgtgtgatgatgatcgatgg

SEQ ID NO: 22013 - DNA, 766 bp, Oryza sativa
ataactaattaaccgtagctccgattcaagtggttcaagttgctaaattcatctaaaatctagatctacatgttaaaaatatccacatgtattgttcatgcttgtttttgtactgttttgttgattttgtttatttgctttagtttccgacgtttcgttggagggcgtttcagttgaggaaggtttagaggtttttgtggaagctcaagacaagtcacacagatcccaaacaaacctttgagcatgttgaacccgtttaaaactaatgttttatttcaacttatgcattattttcgaatgccatcgggtggtgagccttttcccatttaattatggccgaagatgactgtattttcctatgggttataatttgattagctagaaccttatatattggtttggttcagctaaatgctatatatgtataattgcttagccatgcttagaaacataagctcattaatgggatgaatcatactacattattacttatggttatacttaatggtagctcacgatggttaatcgtgttatgttaattaattaataattaaaacctgattaaaggtgggttgtgagcgcatggttttgatggtcgtgctcatgacaattaaggaccggttcacgagctactgttgtgaaacatttaccgtgccaaccacaagccagcgtgggcaacggctttaccttttgtatagcatggttcattatggggtgccagactgagaagcggcgagaagtccgtggggggtcgctggggagtcca

SEQ ID NO: 22014 - DNA, 470 bp, Oryza sativa
  unsure (1)..(470): unsure at all n locations
tggggnnntaagctccgatcacttgtcagnagcncatcaattaatttgtgctaatctttcgccatttcaaaccaaacaaaattcgtacgtattgcgcatgtttcttactccctccgttttaaaatatttgacaccgttgactttttagcacatgtttgaccgctcgtcttattcaaaattttttgtgaaatatgttaactatatgtgtacatgaaagtatatttaataataaatcaaatgatatgaaaagaataaataattatttaaattttttgaataagacaattggtcaaacacgtacttaaaaagtcaacggtgtcaaacattttgaaacggagggagtatatgtgccactgcgcaattataccaactaagaatctccaaaaactctgatctcaactggaacatcattacaacctctgtaccaccactgaacatcacaaataaactctttgctgaacaaaacgaga

SEQ ID NO: 22015 - DNA, 1501 bp, Oryza sativa
attaggagtagtcttagtataattttatcaccgggatgaaattgtctgagattaagaaagcttcatttatcaaaaagaaatgaaaaaaaatgttctgctactctcaggcctccttgacaagttgctagccacttgatgaacagtttaggttgattgtgcttattctttgtttattgaaatctaaaatgaatttgaaactgaacatttagcaagcttttacaactttaaatgtattaaactcataatttcgaaacttttaggtcatttgcactatggtgaatcctgtaagggatgttgaaattgcattgcgctaagactactcattatggaggaaattctgaaaggctatggctatcaacatcaaataaaaccggtaccacagcatggggaacctcattatcagaagaaaacaacttgaagatcagatagggaaatacaaacctggaatcaaatcttgataagggcttcagacaacaaataatctgaacaatgcttcatgtcataccaggaaaatcaaagctgaaagggaatgatcaaacaaaattaaggaaaagggtctcttattcgtcttgccatgcttgaaagctgcaattggcagcaaaacaggggaatgattgctttgttgggaggaaaagagtaaaaatgcgtgcagacttcgcgttgaatggttcgtggggttgagagaataatccgttaggatggagggcatgaatggaccaagaatgcacttctaagtttagtgcaaaacaagggagttattctgggtcatccatggtctctccctattcttgttctggttgggtcttccgttacagagttgattcgaaacgtgaggaattgtcaattgtgcatgaattttgggtgacccatggaaacataggttagctacagtaaaaaatttgatcatataccttctccttatatctcaattgaggaaggagtctcagcgacctcacatgacctcacatgtcaacttttttaaaatctaaacggaggttatatgatccaaatctcccaagaaggttaactagaaacaattcccctccatgcgttggtccaacgacttagacatgatatattttggttgtaataatccagttttacttaaacttgagttttgtcctggttttacgagaaattactactccctttgtttcatattataattcgttttgactttttttttatagtcaacttttttaagtttgatcagtctgtagaaaaatatagaaatattttcaacacaaaacaaatgtattatcaatatatattgcatattagttttaatgaaactaattaggtattataaatgttgctaaatttttctataaactaattaggaaataggtcaaaacgacttataataagaaacagaggtagtacataccaatattggtcgttctgttgttcacttaccggtcaagagtatcaaaggccatcacaagagttatcgatgcagttatgttcaaaaaatcctttcctggttgaacaactgtctcca

SEQ ID NO: 22016 - DNA, 1501 bp, Oryza sativa
cggatccagccactacggtgttgggggcggtcaaatccagtgtccccccgacctcctgacctcaaggaggctggatatggcacccctgtggctcgatgaagaaggtggtggtgtcggtgccaaaccgagcttgtaggtgaagaggttaccgccggcgcttgggggcggccgaagctcaaggtgaaggtggtggcgatgctcgtgagtggagagaaaactcaaccaacgccgaatcgacccaccacgaggttggggccgatcagatctggcgtccccccacctggggacgccggatctggcatccctagggctcgaggatggtgtcgatagtgacaacgatggtggctgcacatactaaaaatttcttacaaatttcttagtaacaaaaatcccatacaaacttctttctaacaaaaaatcttaaccatttgatttagtcaactgaaaattgtaaaaaataataatcaagatttaaccgtaatgtgatacctcaatgtctgtaaaaagttcaaaagtgtactacctccattttagattataagactttctagcattgtccatattcatgtctagattaattaatgcatatataaatgtgggcaatactagaaagtcttataatctgaaaatatctagattcattaacacctatataaatgtgggcaatatttgaaagtcttataatctaaaatgaaagaagtagtacacatatcgttgcccgtctaattcatagacagttaatctaagttgcctcaagagcaacagctcccaatctgcaggtacaaactacacatctgcttccctgtacaaagtagcttatactactacaattagtatagtacaagaaagtaggttaattagttagctgacgagttgggcacgcatgagctcattaactaacctcatgacagcccacgctacaaaaggtcacttcttggtggtagtagctggccttcactatacggaactcccagtactaatatactaggactaatcacctcattagtctggacattaattaggtatattagttaattattaataaattaattaagcagaaaacttaattgccaaatttatactccctccgtactaaatgtttgacgccgttaacctttttaaacatgtttgaccgttcatcttattaaaaaaaatttaagtaattattaattatttttcctattatttgatttattgttaaatatacttttatgcatatatatagttttacatatttcacaaaaattttggaataagacgaacgataaatatattttaaaaagtcaacggtgataaatatttagcaatgaagtgagtactataattaagtactgcttggccaccacttctcacctcacctaccgaccccattagaaaaggcaacctgcatatgcttgctctgccacatccactctatctcactgaatttcatcatctcctacaccaaccactctccaatctccatttcttgcttcataagtactcgatctctcactagctc

SEQ ID NO: 22017 - DNA, 1501 bp, Oryza sativa
tgggatgaatcatactacattattaattatggttatatttaatggtagctcacgatggttaactgtgttatgataattaattgataattaaaacctgattaaaggtgggttgtgagcatatggttttgatggtcatgctcatgacaattaaggaccggttcgcgagctactgttgtgaaacatttaccatgccaaccacaagccagcgtgggcaatggctttaccttttgtatagcatgattcattatggggtgccagactgagaagcggcgagaagtccgtgggggtcgctggggagtccattgcctctggttttgagggggagattatgatccaggaacagtgcactgtggtgagttgtgttgtgtgagaaatattgtcacagttcctttccaaggtactgtggtggtactgaggcgcatggtgacatgttgtggagttgtgtcttgtgggtacagtggtacatctctggctagagtaaaactattcgaatagccgtgcttgcggttatgggtgggtttaacaatgtttttcgtgattagtcccacactactcactattaatgataatactgtgataattaaattgactcctggtttggaatggtatattcctggtatggaggtttgatttgtacaaccggggttggttgttcagatgaggttgggcctatgcaacacgggtgtgttgtatagtgtttatttaatattgcttaattacttaactgttttactattctctcaaatgttaattaaatgctgtttatgcaattgagctgtattatgctatcctttgttatcctgtgcacttgcatatttgctgtgtggcttgttgagtatgtcatatgctcatttttacaatattcattcgtcagaggaggagtactttagtgcaggtgatggtttggaggattaggctttgtccgggtcaagttgctcgtggagtggagtcgccatagctgttctgtcttttgtttttatttccgctgcgtataattttattcttttgagagtaactatccacctctgtaataatttattattttgcgagtattaataattgtttgatagtactctattatcaatttgttattgtatgcctcagttaattcttggacgaggatttaatacacatgtaaacgtttggaattttggatagaaattccggacgtgacaatctcccaggtcagtgtgtattttgcatcaacaccaacaagacaataaactctaaaaactacaactacaagatccgactagtaatcgtgcacgtacaatgcacgttgtgatcaatataaattgaattgagcatattataagcacagaatctgtttatctacatgcattgtgtaaatatcacctttgtctagaatatggtatctgtaaggtctggtagttcataacctaaaatgattaataaaatatctatcacacaaagtacttttgttacattgttgatccattgccaagtcaataagacagtgaaaacacagacaacgatcgag

SEQ ID NO: 22018 - DNA, 1501 bp, Oryza sativa
tttctgggatttatttgagctaaggaagtatttttaataaatggaattgcatttaatgaataatttaaattgaaaaaggtttttaaaatcctcttttggctttgggccgaaagtcggcccaaaacattccctctctctcctcttcggcccagtcagcccgcagccgcccgcgcgcgcgctcggccgctgacaggtgggtcccacctgtcggactcgtcgtcctcctcgcgccgtctcccggccggaaccctagccgagccgcgccgccttctccttccaaatttgctcgcgcctttccttctccggtgaaatcaatagaggggaaatgatcttcgggatctcctctaccttttctcttttggaatcgtcggctagaatcgtttggaaatccctggattcgagttcgattcggatcgatctctctcctccgaaccctagactttccttcatgtcgccggtcgccgtgggccttcgccgccacctccttgcccctataaaaggacccccaagcccgccgctacctgccgccaccctcgccttcgcctctcgtcgccggtagagccctagcaccatgtagcctagcgccgccgtcgtcgccgttcgtccagccatgcgccgccgccgctcccgtcgtcgtcgtcgctcggggaggtcaccgtcgtggtcgccgtctcgtcgccatcctcgtccgcccctccgtcgtcgccgtaggcggaggactgtcgccgtcgtcaagccgaaggttgccgccgcttcttcctcgatgccgtcgccgtccgttgatcttccgccgttgttttggtcaccggtgagttcgccgcgtcgccctctacgtgttggtgtcctccgttcgcgtcgtcgcaccgtcgttcgccggcgagtttgcgcgcccgagccgccgccggtggtgacgtcaccgctgacgtcatcgtcgtcgtctctcgtggtctggccgtggaccgatcgatcttggccgtccgttttggatggatcaatctcggccgttcgtttccgtgagccgccgccatgcacccggttcaccgcgaaccctagccgctgacgcaataaacccctttttccttttcaaaaataattcattattgcgtcataattcaattaaaatctaaataaatgatttaatccgatttaatctttgaaaattcataactaattcatcttagctcggatttagttggttcaagtctccaaatttttctaaaattgagatctacatgttaaaaatatccacatatactgttcatgcttgtttatgtgctgttttggtgttttgctcttttctctttagattccgacgtttccggagagtccgttttcgcaggagaagaatttgaagagttccaaggccagcaaggcaagtcacacagatcccaaacaaccctttgagcatgttgaacctgtttaaagctattgatttattttaacttatgcattgttttcgaatgtcattgggtggtgagcctttcccatttaactatggccg

SEQ ID NO: 22019 - DNA, 1501 bp, Oryza sativa
aaatgatgtttcatttattaaaaataccttccttgttcaaataattcccagaaaaatctagaaaacagataaacaagcaaagtatttaatgaaattttatctagctcaattttatgttgaaattttccctagattattagagttcaacttgtaggcttttaaaaaaataatttctaaaaatgcattaataattgaattattaaattaggcgattttcaaggcatgacagagatctggttagctccagtgcaggtccaagatgttgatgagatgcgggcgtgccagtcagtttgatactgcaactgacaagatatgtaaacagcaaataaaacagccgatcggctgacaagccgatggagtaattccagctgatagctgatattagctgatgtcgataaggttttgagcaatcggctatatgtccaatgcagataattatataaagacaattgaccgatgataataaaatataataataatataatccaatagaaaccaatcgataaataataatatgataggataatgtcacgtccaggaatttagcccaaattttcagactattttgtgtattaaatctctgtccaggaattagccagggtacacaaaacgacaaattaatatacagatccaaacgtaaataaagagtaaaatacttacagaagaggcacttagtcctcacaccgaaacaaaagtagcggcagcggaaaaaggcaatcctagcggggcttcagctccactccataggcaaaactcaactggggtctgagtcttggtcctctaacatcgtcttcggctcagaagcactacacttttgaaaagggggaataatagcaaggctgagtacaaccaccatattcagcaagccacaccaatgatgcagacgtacaaggggatacaagaagggttgtggctatttgcataaaggcggttgtaaagcatttattgagcaaaacagtaaaactgttgattagttaaggtaatattatatctccactaaacaacgctacaccacgttgaataggcccaaccatcccacctaaactaaccagtgcattgagtcgatttattaggggtaagactaatcacggtgaatctgatcgatcgctcataaccgcgggcacgactattcgaatagttttactctggccagaggtgcacaactgtacccataagacacaatccaccggcatgtcaccgcgcccggccggacatatcacaatgtcgagtgattgtgacaagaccattcatataactccctctgaccaagcacaccacacttcaggtttcgccctcactcctcaacaggcagcgggcagccccttctcgtgtctaggcgaatcaacgagccgcaaaggccatcgcagggcccatccgaactccatcacgctcacccttgcctggatgcatcagccggaggaaagctatactacagatcaagcagttacccattcccgcttctggtaacgttgtatgtcttctagggtttcccacgaaccgg

SEQ ID NO: 22020 - DNA, 1501 bp, Oryza sativa
atgtaactagggatggcccagctctaaaaaaaaacatcgggaaccatgtcaaccttattctccgttcgtaattggcttaactaaatttaattagcacccattatcctagcttgcatgtatgtgctatatacccttcgtctttccatcttaaaagaatcatatataaaagctaattaattttctttatttaaatgagtatgcaaactgtgaattagtgtacacattacaatcccgtatatgagtgtagcctccacgtttaatataattgcatatagacattgatacaattttccacgtttcaaacgagagaaattaattaaagtcaaagtataagaaacctatggaaaacgacgacatctgcacgtacggccgcatgtataatttgactgacgcatatatccatatatggagaaatcaatggagactccaagctagcgtgtcgttatatatacacatgagacaagacctacatatgcactctcgtgaggaaaaggaaatccattggtgatttgtcaaaaactcgttcgtgtggccacactgcaatacttgattgattgattaattctacctaataattcaacaaaagcaactgtacatatgtacctagtactacctacgcatccaatatgcacgtggcttgatggcataacacgcgttgttaagatatgctcgctccatcctaaaataaaacatgtattgaaacgatgtgtggacgtgagtataaaatagatcgaaaatatgaataattatggcacatatatgtgggtaagatggtcagaaataaaaaggtgttggaaaaacaggtgtggtggtggagttttgggtgtatgactctatccaccattacgtacgcacatgcaagtgagctaggttttaacaggattttagtgagattggggatataatatgtcgctagtgatctgtttcttaaaatatgtgttagaggcgcattggcgaatgtatgtaaagtgtagtgctacgtgtgtagcgatgtgtgtatgtgtctacagtacaatataaagaaaatgaaaagtggctttgttcataaaactcactcgtgcagtgaagcaaccaaattcagggaggctgatttatacatagattgtataagcccatgcctggaactggaaggcccaatttaaaagaagagcgaattaaggaataagtccattttgcctccctcatctcttgcgcttgtgtgaataacatccctcaaccggaaaaccgtgtataacgcctccttcatctctgaaaaccagagcaaatcacctccctcggtggttttgctggcggtttcgtccgacgtggcattgttgacctggctgacaagctgactcagcgtggtgggactcacatgtcagtgtgtagcgcgctctctctcccttatctctctcttccccggcctttctcttcacacagtgcggctcgtcgacgtgggtcaggcgcaaggtggccgggcggcgcgttgcgacggagagaggtagccgtgcggcggcagtga

SEQ ID NO: 22021 - DNA, 1501 bp, Oryza sativa
gacatactcagcaagccacgcagcaaatatgcaagtgcacaggataacaaaggatggcatagtagggtttcatttgcataaacagcaattaataaacatttcagagtttaataaaatagttaagtagtaattaaacaatattaatccaacgctatacaacataccctgttgcataggcccaaccattctgaacaaccatcccggctgcacagttctatctccaaaccaggaatataccattccaaaccaggagctaatcaaattattaccagttatagcatcttttattatggtgagaagtgtgaaactaatcacgaaagacattgttagacccgcccataaccgcgggcacggctattcgaatagttttactctggccagaggtgtaccactgtacccacaagacacagctccacaacatgttaccatgtgcctcaataccaccatggtacctcggaaaggagctgtgacagtacccctcgcacaacacaatccaccacagtgcaccgttcctggatcataatcacccccttataaacaaggcatggactccccagcgaccctcgtgggcttatctccgccacttctcagtctggtgctccgcaatgaaccatgatatacaaaaggtaaagccgttgcccacgctggcttgtggttggcacggttaatgtttcacaaccgaaactcgtgaaccggtccttaattgtcatgagcacgaccatcaaaaccatgtgctcacaacccaccattatcaagttttagttggcaatttaattaattaaccaatcacgattgaccatcgtgagctatcattaagccatcattaaataatagtgagtcataagttatcccaatagtgtgctaatgtttctaagcacggctaagcaactataaataatatctagctgaaccaatccaatatataaggtccatgctagtcaaattataacccataggaaaataaagtcatcttcggccatagttaaatgggaaaggctcaccacccaatgacattcgaaaacaatgcataagttaaaataaatcaatagctttaaacaggttcaacatgctcaaagggttgtttgggatctgtgtgacttgccttgctggccttggaactcttcaaattcttctcctgcgaaaacggactctccggaaacgtcggaatctaaagagaaaagagcaaaacaccaaaacagcacataaacaagcatgaacagtatatgtggatatttttaacatgtagatctcaattttagaaaaatttggagacttgaaccaactaaatccgagctaagatgaattagttatgaattttcaaagattaaatcggattaaatcatttatttagattttaattgaattatgacgcaataatgaattatttttgaaaaggaaaaaggggtttattgcgtcagcggctagggttcgcggtgaaccgggtgcatggcggcggctcacggaaacgaacggccgagattgatccatccaaaacggacgg

SEQ ID NO: 22022 - DNA, 180 bp, Oryza sativa
  unsure (1)..(180): unsure at all n locations
cctgggtttganttncgagtggattcccgtccttctgcaagnagntcatcacatggatgtttcctagctttgagggatctgtttccttgaagcgatatatgtaaaagccacgatgggggctattcccatctgatcaacacgcatccagcgcacaggactcgtgctgctgtttctcccaga

SEQ ID NO: 22023 - DNA, 1501 bp, Oryza sativa
aaaaaacaaaatttattttttttggattatactcatccttgacaagctatagtttagacccgttagagatgtgagtcatctgtgacgggctatcgtttaggcccgttagagatgagagtcatccgtgacgggtttttgtgttggcacgattaagatgtgtgtcatccgtgatggccggatgcccgattgagatattttaccacatcagcgacctttgctctgcgacggggccctacccaatagagatgaggcttgcagcccgttacagatcaccgaacccgtgctagtgtagacgacacctccgcgctttgccgcggaaaatatatacgcttaaaatgcacaaatttatattgaaaaaatatatttaaaaattataatagcctttctacttataaacatgacttttgttatgttattatccacatggcgtgtcacttcgcccataagatttcaaattctccaaatcatcatgttgtcacattttttggtattatatttcaaacatgaggtatgttgcgtgagaatggtaatgaattaatcaaccatccgttttaaaatacactacatgaatttttcatgtataaatcattcctcaattccccgccgttttgttgaaaaggacctttctacaaactttcaggagatagagcccatcattttgtttatacgtatgtttatccgtctgatttattagcaacaaaaaataatttgtaactaagacttttatatatgtgttcttagtaatttaaaaacaaatgttataaaataaactctaaaataactttttaaattttaaattttggcttataagtataagtataagtatgagaaaaaaatgaggttgtgacactcatgccacccgtgcaccaagatgacaaaaaaatattcttgtcaagaattaaagatgtgccaacaaaattccttgtcaagaattaagatgtgcttcggaggggtaggtggatggatcatcaatcaatcaataactcccctaaccgtactgtttttctcctttttttgaatttttttctggctacctcatttttttacacgtcgtcgtcttgtgattacggctcctcacgagcgtgtctgcgaccgggaaaatgcggtttgctggtaatctcactgttaatcttgcctttgactataccgcgtgactgtttcttccaccgctggtgcccgttttcactgtgcatgtatgccacgtgggatctggttattttgcaaaaaaaaaactgcttgtccatatataaccctcgaattgcctgacagcctgttatggttttccccaaaaaccccttatcctttagagaaatactatgcgaagaagaagagaaaattccgttttgtaaacataataaacacaaggggttttattgaaaaacaaccacacctacccccaatcgcttcccattccccacctcctcccgcccggccaccgtatcgtcacaccaccggtggctgccctcctcgtcgcggatcctgcctccgcttcgttcgccct

SEQ ID NO: 22024 - DNA, 246 bp, Oryza sativa
  unsure (1)..(246): unsure at all n locations
tgggcccttgantacctgaagggacttngacacagncgcccannacatttacttgataatttgttatagatccctggtccttagttctaacgttgtgcgctcttacttagaggacctcttaagaaaacaatattctatatgaagaagcgaaaaaacggaaaattgaaccgcgctctgaaaactagaagtttaggggttgtttttgcaaccctcacccctttccccaaaccctagccgccaccattc

SEQ ID NO: 22025 - DNA, 742 bp, Oryza sativa
gaggcctattacccacacaccctataaagggacttggtaacattgttaagttgagagatagtggtgctaaggttgtcacttcttcaatgccagatctgcaatcaaagataatctgaaaatttgattgaaaacggaccaatatttatggtacaaatagcgaaaaaaatgatctgattgatcccttaattctcccaactatattattagaatttaattacattttaggtgaatggaaatcgtcacaaagcaataaaataactttacattccattccagacatttaagtgttgacagattttttatagcctgttttatgtctttttttcatggaaaaacggttgggaaaattcaaaaatggttgggagaatttactgttaatcactgttagagggtgtcatacatcgaccttttcaaagaaaaccatagatatcttcgtggtttgagaatttttttttcaggattttttgcctgtcagagggttagtacagtaaaaggaataacattatatacaaaaattaagcaatttttttcatcaaccttcgacaatgttaccaagtcactttaatgagcgtgctttgcgcgctgtttagatgattcgcttgctcactaccgcccctccctaaaataagatcctagctctgcgcctgcattaaaatatacagctatgatgctgactaagttaacgaaataattcgtatacaaattatggttggttggactacattattgagtccctggcaga

SEQ ID NO: 22026 - DNA, 1501 bp, Oryza sativa
gtctataacctctcaacagtgctaacagatcaagcataccttggcttctcatcctcaacgggcttaagcacaggacatcactatgttcttggttggagttttgggctgaatattcctgctccaatcattgaccccacaaagctacctaaactgcctaatcttagtccaaaacctcaatccaaactcttagagattgttctaccaatagcatcagcaatattcgtactagctattggtgttgctattgttttactcgtgaggagacatttaaggtataaggaggtacgtgaagattgggaggttgagtatggcccgcaccgtttcgcttacaaagacttatttgatgccactaaaggatttaagaacaaaaacttattctgccatccttggctacaaccctaggagacggccaatttgtgtactacggcttcgctaacagtaatctcctaggctttatcttgcctaacaaccaactgccaaacagttgtttcatgaaaaacggaacattatcatggcaaagcaacgtgaattcagaataaccatcatcgcattaatcaaaatcttcaaaagcaagctcaaagtgatgccctggcacaacgagctgaacttggtcaaaaggaatagatccataacataaaaaggcatcgcttctccgtcaggtcaaatatcacgaacaacacctgcaaacatcaatcaagaattcatctacactaatcaatggtgtcgccagagggcttgctcgagctgaccaatggtacggtcaatcagaaaggccatgccttccacccgactcctttccggctccgtaagccgcccaactccgcggtgcagtccttctccgcctccttagtgtttggcatcgtcgtctctcccttgttgcatgccagcacagagggcatggccttctttcttgccccaagctctaatttttctgatgcgttaccggcacagtacctaggattgttcaattacagtaacaacggcaacttgagcaaccatgtttttgctgttgagatcgacactgcacaaaacaacgagtttatggacatagatggcaaccatgtcggcatcgacatctgcgatcttcactcggcaacatcttcttctgcaggctactacgatgacatcactggttccttccgaaacttgagtctgattagtggcgaggccatgcaaatttggatcaactacgatggagaggcaacatggattgatgtggctttagctccattcaaaatggccagacccaccaagacactcctgtcaatgtcctataacctctcagccgtgctcacaaacgttgcatacgttggtttatcagctgcaacaggtcaaatagaatcgaggcactatatcctaggctggagctttagtatgaatggactagccccacctttcttcacagctcatctaccaaatctacctaaagctcgtgtagatggaaaagctactcagctcatcttgctgccactaatttctcctctagcaactcccacatttg

SEQ ID NO: 22027 - DNA, 1501 bp, Oryza sativa
gtgaaactaatcacgaaaaacattgctcaactcgcccataaccgcgggcacgggtataacatctataattattgtgagaggtgtgagactaatcacgaaaaacattgctcaactcgcccataaccgcgggcacgactattcgaatagttttactctggccagaggtgtaccactgtacccacaagacacagtcccacatcatgtcaccatgtgcctcagtaccaccacggtacctcggaaaggagctgtgacattaccccttgcataacacaacccaccgcagcgcacctttcctggatcataatcaccccctcaaaaaccagaggcatggactccccagcgacccccgtgggcttatctccgccacttctcagtctggtgctccgcaatgaaccatgctatacaaaaggtaaagccgttgcccacgatagcttgtggttggcacggttaatgtttcacaacagtagctcgcgaaccggtccttaattgtcatgagcacgactctcaaaaccatgtgctcacaacccaccattatcaagttttagttggcaagtaattaattaaccaatcacgattgaccatcgtgagctaccattaaaccatccttaaataatgagtcataagttatcccaatagtgtgctaatgtttctaagcatggctaagcaatcatatctaatatctagctgaaccaatatatatagctcaactagtcaagttataatcacccaaggtatcaaggaataaagtagtcaatgcaaacaggccataacaaaggaataggttcacaccacccagtgacattcgaaaataaatgcacagttgaaataaatagagaatttaaatataggatcaacatgctcaaaggattgtgtttaggatctgtgtgacttgccttgcaataatcggtcttcaattaatcttcttgaatacttccggcgcactcacgaaccttcacaacgacggaaatgacaagctaacacgcaaaacgaagaaaaagactaataaaaaccaaataaacaatgcataaaaagtaaacaaacatgtagatcttaattttagatgaattatgagacttgaacggcctcaatctgacttcaaatgaatttattatgaattttacaagattaaatctatttaaagcccatttaaaaagaattaaataaatttaattcaatttatggacaattttaatatgtagatctttattttatataatttttgcaacttgaaccacattaaactgagttcaaatgaattagttatgaatttttaaagattaaatcagattaaaacacttatatggattttaattgaattatgatgcaataatgaattatttttgaaaaggaaaaggaggattattgcgtcagcggctagggtttcgcggtggaccgggcgcacggcagcggttcacgggaacgaacggccgagatcaaccctatccaaaacggacggccgagatcgaacggtccacgaccggctcacgggagaggacgacga

SEQ ID NO: 22028 - DNA, 1501 bp, Oryza sativa
tgagctcctggatctcgggagcggcggcggagggcgccatggctgaggtcgagcacgccggccggcggccggcagcacggaagggtagtgtagtctgctcgccttgttcggtgcttgcttatccactttttgtcattttcttctgttttcagagtagttgatggctgattgtgtggatgattgcagaattggcccacgggttctgatgtacatgccattgaaagaagagatttttacaagcctggaaaggcgatcgagagtactgtattcctttacacttacttcctcccgcccaaaaaaaaatattcctaacatcttaagatagaattagtgaagagtgagaatgactaaaatatctttaatcattgaaaaaatagtaagagtgataggcaggtaaagagtattgaagagataaaacttatcgtttttcatgatgaaggtaggtaggatgatagaaattgattttttaaacaaaatttaaactttagaatttaaatttttttttatggaggaagtacttaacagtgttcatcattagtgctcgctgccatcgtaaatattcaatgtttaagaaaaatatttaattacaattataaacgttttaaaaagatctcaactacttagctaaaaaaatggtttgggaatttgctttgaacaatacttttataagaataatgtgtatggacgatctttgtatgagtgtatgatatagtttcatgaacttttaaaatgtatttttagttgatgtcatgtatgctattccatacattgatgtggtacgctacggtggttcatatgtgtcaatgggacccacgtatcagtcacatatattttggggaaaaaattaaaacgtattttctccattcttttaaaattttacttttaaaagatttacaaacatcttactctcctcttttaattttaattttattttttctatatgactgatatgtgggtttcactgacacctaggtgtcaacgtggcatctagcaacgcacttagtaggttggagtctgtttggatctatatgacattcatgataacttcaaagacaaaaataaaatgtattttgagagttcaggatatggcatattctaaatttactccttttataatgctaattaagttcgtgaatttgcgaatggaaaggggaaaaaaatcagttcttaacactaatccacgttggcaatccaccgtgtcacccaacgtaggtgaaagtggtaaaaaagaagaggaaaacttgtctgttcaatgacataaaaattaagtacgataataggagtgacatttgaagagtcgtcgtttataagagtagcaaattttccaggtcaaataaccatttatttccaagttaattccaatcgtgaagggcacggcgctccagcttacaacctataaaatcaccttaactgcttactaagttaccatactgacagtgcacctgcgcaacgacaagtactagatctacaaaatacaagtcaaccaagaagcgatcgatga

SEQ ID NO: 22029 - DNA, 412 bp, Oryza sativa
ccggcgtgcaccagcgatcgggagagcaggtctccggaacctctgcctttgacgtcctgcaccgggagaaggcggcaataaggtttttgggaagcgcttcgcgcgactgctccctgttcgttcgcgacggctcgccttcctcttcgctcgcgtgtttcgtgccttcgtagacacctgcgaaaagtttcgaccaagcagccgatcttttcgtcacctcggtacgtgttcaatatgttgcgcatatttgatctgttcatgttattctgcgtagtttacatgtgtagatctaatgatgcgttcatgctagttttcatctgtaatgtcatgatttatttatggaataaattaaatctttatatgcccataatctcaacaatccaaaaaccttattataggcactgtgattttacta

SEQ ID NO: 22030 - DNA, 1501 bp, Oryza sativa
gaatatattagcacagacaggcagctagctcctcataagttgtaaccaacacatatggtgtctcactgagatagggaataaaatggtgctccaaattgcattttaggtttgttctcaacttatcatatcttttgcttcctagggatgtatatattacttccatccaccatagaataactgtgtgttagctatgagttagcatgcatgagaatggtaggcattgggacgttatagaatccatggaaagaatatgcatctagttcaattccattatcactgcaaacccttacgcactgggatactcaatcaagctaaggcagggattgctgttcgtgcgcaacagcttctttgtcaatagcatgcaggctctaatgcccatgatgcaaacttactgaacagttccatcccaatgcaaaatatttgagatgcaaagaagaagtacaagatgtaagaccccaagctcatttttcttataaaaattgtaggaataagttgtccttgacaactttgagaattctcactcttttaggtttcatattgcttttccttatgtacagccatatttcgatcaatgagcctttctctccgagatcaagagaactaaagaattcgagagaagattaaattggttaaaatctcggaatcctttttgttccgggacattgtaatttcgaatggccgatcttagtgaggttgtagatttcgaccaaggtatatgtaaaatttcaatatttcgagggtaaaatgcatgtacattcccttagaaagagtagagaaacgtccaggggttttctggttagctccacaagatggtgagctagatgacttgagttcgaaggctcaccccttctaattaattaatattatgtcattttctaatatttacgtcttttctttcttagaaagagcacaagaactgtagtgtaattttatttgcaatacttttgttatatactatttattttccccaagggtgtgtttggagctgttagcatgtggtgatggtgtgtttttattttcctttttgttttcttgattatagcatcccagagtttatgttttttctctactatattcaatgaaattgacacaatcatgtgccggttcgttaaaaaaaaaactttgtttagaggaaacggtaatgctatttgaaaaaccacatagaaggctagaacaacggcagcccatttattattgcagaatgcggcctgttggaccacagcccatctggagaacaacaaaagcatcacggcccaatccaatagcatcacgtgcacacacgctggtggactggtggtctcatctcgtcaactcttgggcccccacatgccagcgacagccaactgcctccggttcaccggacgcggtccacggaacaccaccacctcatttttggcgggaagaattggcgccaagccgcctcctccttcccgccaagaacaccacccccacccaccttgttcttcttctacttgttcccccaaccaaaaccctcgcgccc

SEQ ID NO: 22031 - DNA, 160 bp, Oryza sativa
ggggtggtaaaaggaaggaaagggtttttgtttaagaagccggatctagtgtggcggtaacacgacattcgtgagtgtcaaatccggtgactccaaagggcatgaaggggcaacaatagcggcaaaggggtgtggctcaatccctctctcgacgatcagg

SEQ ID NO: 22032 - DNA, 429 bp, Oryza sativa
cctcctcccccttcactccacctactcttctcttcccccctcctccccggcgaccaccacctcgccgccgccggcgtacgattgcctcccctccctcgtatccccctctccctccccccctcggggtgcgggcatggcgtcgccggccgtcgcgtccccgagccggacccccagcaggggcccccccgccgccgccgccgacaccaccgcgccctccccggcttccccgccgcggcggctcgcttcggcgccgcccgcggtggacgcgtcatcgccggagtccgcgcggtccggggagctcgccgccacgccagacccctcggtgggtgggtcggttgcttcccgtgtcggggattgctgccggaatatcgcctcgattttgggtttgggtttggttctacgcttctactactggttggtgggggtttc

SEQ ID NO: 22033 - DNA, 1501 bp, Oryza sativa
aaacaaatgtagcatacatcaaatccatggaaagtgtggaaaagcgcatatgtggtttgttttgtgttttcatatctatattttctataaagttaaagctcactaagtctaaagctcaatatgcaaatatgccacctcgtcatccacgagcaataactacttatcaaaaaagctcatgcaaacatgcaatatcatccataatttatttaattctacaaatcaaaatgcaaatagatccaatcatcacctctctcatcatttccgcaatatttcaacaaatatatccatcatttttataatagttaacatacattcatccatatatcccgtatcaaagcagagatattatttagtttgttacatgtttactactaataaatccttgctttttatttcttttttccctatcttttgtttcttgtgatataaatcttggccaacaacctaaatttcatgtataatcttttacaaagcctattaaatttatttctctccaaacatggccagacaaatcagttttatttgttactaataattaacatcaagcttactccttgctcgattattgaaaaaaacatatatatttaaaattacttagtaattcccacagcaaagtgcgaggaatcacctagttgtttattaaaaaataatggcgtaaaatcaaaatatttgattcaatgcttctctttgcaaatttagcgtcatatgttggaaacctaatctatctcttcaataaaatcaatattaataatacaaaatcccaacgtacttgtgcaaatcgtgatgggccatattggcaatgtatatcttttattgtgatattatcaactaaatatccttcataggaaaatgctttaaccactcttactttatatgcagtaatcactgctacgaaaactattttcgcatgtggccaaagtagatcttctttgcatgcggccagctgctccgtctacgatcaaaggctattttcaaaggcgggtgaccaactaagttatgttgtcgcctacgaagaatgtttaagcgctaaacaaatcaacagccgcttgacgcctgttgatggtcgttatagaccaatttcaaccgtcaatatactcaaaataaaggagaactagatatgcttacaatgtatatttgttttagaataatttacttgtacttggattctatttgatttcagagattgctatataaagagaaggagaatcgacggaaaacaaacgaacaaccaatcgaaagccgtcgagaggtagatttgtggatagatgggcctacaaatccagagaaataatctcaaaaggcccaaaacaccacgtcactggactgaggaatcaacggggaggaggcctgccaaaaattgggcagattgggccaggtcacggttcggccaaacccccatcacagccgttaaggctagtgtttggcatggacattcaggattcacttccaacaacggctgtagggcatttccgacctttccatctgcaataaccatcatact

SEQ ID NO: 22034 - DNA, 379 bp, Oryza sativa
tttctgtgcagtcggaatcggtttttacatgcggatcttccacccgtctggaatgaggtgtctacgaaaatcgcgattttcgcatgtgggtgacgcacccgcgcgcaaaaatcgcgattttcacgtgcaggcactttagtcgtctgcatgggaaaataaaaaatcaaaacaaaaaaaaaaatcaaaaacgccgtcaccgccatcgtcgccgtcaccactatcgttgccatcaccaccgtcgtcatcgccgccttgcccgaggcccgccgtcgtcgtcccggtggttgccagtgacggatccggcctccctgcggtggccagcgacggatctagcctccccgcggtcgccggcgacggatccgctccgccgcccccacca

SEQ ID NO: 22035 - DNA, 1501 bp, Oryza sativa
cgtcttccttcggcaggtagtcttcggcttacacccttcgcctaagacgcctctgacctggcaaggcactcgtacgactcttcgcctcgtgccgttcttgcttcatagccttcgccacgggtttcggcagatttagtcgaagggcctcatgccatccgccaacacataagtatgtagaatagaactacaaaataagtaagaatcgataagaattgctaatacatatatacaagtaacatccaatctaatcaataaggtcagggattgtcacgcccggaacttctatccaaaattccaaacgcttacatgtgtgttaaatcctcgtccaggaatcagccgaggcacacaataacaaattgataatagagtactcttaaacaactaattaatattcgcaaaatagcaaattattacagaggtggatagttcctctcaaaaaataaaattctacgcagcagaaaataaaacaaactacggaacagctatggcgactccactccacaggcaacttaacccggaccaagcctagtcctccagatcatcaccttcactcaagtacacctcctctaatgaatgaatattgcaagaatgagcatatgacatactcaacaagccacacagcaaatatgcaagtgcataggataacaaaggatggcataatatagctcatttgcataaacagcatttaataaatatttaagagaatagtaaaacagttgaataattaatcagtattaagtaaacaccatacaacacacccgtgttgcatatgcccaacctcatctgaacaaccaaccccggttgtacaaatcaaacctccataccaggaatataccattccaaaccaggagtcaaattaattatcacaattaccatcaatgaataatgtgagactaattacgaaaaacattgttagacccgcccataaccgcgggcacggctattcgaatagttttactctggccagagatgtaccactgtacccacaagacacagttccacaacatgttaccatgcgcctcaataccaccacggtacctcggaaaggaactgtgacaatacccctcgcacaacacaactcaccacagtgcaccatacctggatcataatcaccccctctacaaccagaggcatggactccccagcgaccccccacggacttctcgccgcttctcagtctggcaccccataatgaaccatgctatacaaaaggtaaagccgttgcccacgctggcttgtggttggcacggtaaatgtttcacaacagtagctcgtgaaccggtccttaattgtcatgagcacgaccatcaaaaccatgcgctcacaacccacctttaatcaggttttaattattaattaattaacataacacgattaaccatcgtgagctaccattaagtataaccataagtaataatgtagtatgattcatcccattaatgagcttatgtttctaagcatggctaagcaattatacatatatagcatttagctgaaccaa

SEQ ID NO: 22036 - DNA, 540 bp, Oryza sativa
atatatatatatatatatatatatatatatatatgtggataatgctaaaaagtcttacattctgaaatgaagggagtattaattaagacagatcatacgaattcagcaagtattgttttgtgctgtactgctacagtgcaagagttgttccgcgaataactcatttttccttttgatttttcggtttgagaacgtcgtctagcaccattcaaattaaggaagcctgcagtgcactgtgcactctgcatggtctcctgactaattagcaatctggcgccgtcagctcagctttctcttgtaaaacatactccctccgtaaaaaaaaaaagacaaaccctgggttttcgtattcaatgtttaaccgtctatcttatttgaaaaaattatgaaaaaaattaaaaagacaagtcacgcataaagtattaatcatgttttatcatctaacaacaatgaaaataataattataaaaaaatttcatataagacggacggtcaaacgtttgacataaaaatctagtgtttgtctttttttttttaagg

SEQ ID NO: 22037 - DNA, 1501 bp, Oryza sativa
gctgggtgtcgacctccttgcggagggcttgcacttcttcgacagccatcaccgccttgcctgcacggtctattctgaactttctccaagttatgggggtttggctttgccttggtggctgtccttggatcgccggctgagactggcggacagagaggggaggtggttcggcaacttgcacttgtgcttgagcttgagcagcggcgacggaggctttgtcgtactcagcttgtatagcatgccgtcgctgtcacgactgagaaaaatacattttcccgaacgctagtgtattaatccccgtcccaggaaaagccggggtacaccacacaaacatgatataaaagacacatctttattatatcgataatatttacattattacaaaggcacttaaggcctgacaatcaaaaaataaacagcagcggactagcgggcctacggctccatcttcacaggcgctcaactggggtataagccaggactccacctaggacttcatctccaaagcttctcttactgaaggggggggggggaaagattgagcaaaaatgagtacaaccacagtactcagcaagccacaccggcagatgcatgactaatgcaagggggtacaaggggtaataatataagggttaggttttgcacttaaaagtcacttagttgcccaaagccaattttaaaaagacgatcctagagctacacagtattattaatcaaggccgtgcacccacacgaacctgccttaacccaaggcctacgatgattcagaccgaactggcaacccgaccctgggtcccagctcgtcccaagccaacccaggccaaccattccacattttagttgttgagcaaattttaagaattaaaacactaacttgggtacattgctcggcttgcccataaccgagggcgcggctattcgaatagattatactctgatcagaggtgtacatctttacccacaagacacatcttcctcacgtgtaaccacgtgccacataccaccacggtatacggacggaagacgtgacatagttcccaacccatcctagccataaacaagagtaccgacccaaccccacctacggccggaacccccgggacaggtaggcaggactgagcccccagcagcaggacaccggccctgtgccatgacatctcgactaccgggccgcagctcgtgtagccttcatttgtcctagatatgtccatcgacccccgacttcgtccatctccatccgtgtacttttgtttataaccagactgagccacaaactaagccttacccactagacatgtggaagtacggtagtgctttgcaacagaggcccgagcttcatccttatagtggccggggtgctactttccacaactggcatgcacccaaaccccaccgaaaaacaggttttaggggctttgaaagaggaagagaggggtatgtccaattccaccataagccaaccattccatagtgtccaaatgatatgagaattcccaaagtc

SEQ ID NO: 22038 - DNA, 492 bp, Oryza sativa
  unsure (1)..(492): unsure at all n locations
cgcgcgcccattgagtgtcntctcnntttactgcaagnagttcatcattacaatgacacgtaaaaggagaccagtcattagcacattattaattgagtattaatcatttcaaatttaaaaaataagtttgtttgatttttaagaacacttttatataaaaatcatactgtttagtttgggaaacgtgattacgataaacgaaggggtagtttagcctattgtagaattttctgcgtgaaagattggtaattggacacttttacacatcagccaaagatccaaatgcccgataaaatggacaaaacatgacaatgcatgcgaattacaaagaaacacaaaaacgatgacttagcttatacagagaaagatcgttgctattaagcctaagtaagacaagcacacatccagacgctcgcgtatatattttgattgaattctattatcgacaaaaaagaaaacttgcatattcgagatatgaaccaatcggaacga

SEQ ID NO: 22039 - DNA, 1501 bp, Oryza sativa
aacttcttttacaataatgtatattaacctttagtgtgaaaataatttgtaatttatttataattatcaacaagtttcttggaacatacaaaagtaatacactatggtaaaatcatctttccacccatctcctaatgatgacagagaactaacagaaagagccaataaataaaagacaaaagctgagaatgaaggatataaatgaagtgctatttaggagggcaaataagagaatccgccaactttaaaaggcaaataaatattcttttttattaatttatcttcactcagaatacatatgcagcccatgcaagttcactgccttttttggttcctccactgattcattatcaacatcacatagccattataactaccatgtcaccattgttttcaggtgtcaccattgttttcaggtatagggattgaaatatcatatatgcagacaagcatggacctcgttcactatccctacgtgaaagattttttttttcctttaggcagggatcgaattatccgattataatataatttgttatagatgcacaatggagtgtatggttttctcttttctttttttatttttacctaggctacagctgcacaatttcagttgtaccttgcaggatttatgttgagttttttttaaaaaaatcacttcctccagttccgtagttcttaacattttagacaaggttaagatcaaagattttattattaataatagaaaattatagttaagatctgttttggtgattgtgccattgttctaaacgtaagaatttttttttcttatacactctaaacgtcaaaagtatgtaaccaaagggagtacatacatttctaacaaactggatattttatcaaccagctaataaatgccttatcggctatcgcaatgtgttctcaaccactgcatcgccgtgcaaagaaaattgggacagggacatgtccttagcatacagtacagataaggcaggcttcattcatggtcagattagtatcaaagcacggacaggcaaatcctcaaaccagcatagaatatcactagcaaccacgccactgacaaatgaaaaaggacaattaaacttccatcttgcccggtcaccctaatactctatatccgcatgcgttgcgttcatgcacggtcgtaatatatattatcagaattaattaaatgctcccctaatcacacatcacgtcgcactagaaaacagttaacgaatgatgatactgatgactatagtgatgtggtagcagtaaacaatcaacaggttgcaaaaaaataaacataaaccagatataaatatgacatattctagtacaataaatttaaacaaacttctatctaaatttattatatttgaatatgtagtattatatctgtatcttaagctgcccgcacgctacggcgatcggaaagacaaccaaagacgaaacgtgtcggtttgggcgtttttttggttttttggaggagaggagagacacgccaaggaacgca

SEQ ID NO: 22040 - DNA, 178 bp, Oryza sativa
cagtcgtaatccatgagtaataagagatagtttgtcagcatttttgccatgatttaatgaaaatatcacaaattatttatatgtccagattcatagagtgcaaagatcattttccatcacttcagtgttccctgtataatattgctggctgcatcacatctcttattacttaattttc

SEQ ID NO: 22041 - DNA, 165 bp, Oryza sativa
acatctctatcctatgcactagttcggagagaggagaggaaacgaaaaattctacatgtcacatattacgtccatttgagttcaatttttctatggttggttcttgtgtgtccctaagcgtgaaaaaaatatcaaacaaataaaacaaaaataaaaaatttccga

SEQ ID NO: 22042 - DNA, 1053 bp, Oryza sativa
tatcattcagattcagatgattcgagaaacgtacctttggctacactgtttttagctaacagagagtaggaaaagagcattgtttattttgggggatttgcaattatgacactgcagatattaacctttgctataatgctactagttagctgatatgaattgttggagcttgacaacgtcacaagcagaagcttgcaggttcagaacgtggcactgggtttgcaggtgttgaacagcagcttcagatgttaaagacactggctctctctatcaaatgagagtgactgggacgcaaaaacagcagcagccgtccgttgtttattcagccctgcaggctgcatttctacggcaaaaatcttatttctaacccagaaatcaaacaaccaaataggttgatttgtttttttaatagtaaaagctttcttgaactcagtaagttacattgaggttgattcgttggcctgacaatccgcaaaaataaagactaagaaccgaaatcggaagagctagaaagctcagttaagagatatcatatttttttttaagataatggaagctttattaatctcagtaaaattctatcaagtgaaacaattattctgagagcacctccggcttctgcacccaaagagtgcacacagccaacaagaaagaaacaaaagataaactcatcatccaaatagcagggacaaaaagaacttcaggagccctctaaccgtagcctagaacgccacccatgcgccggggtagaaaactccatggccactagctccaattgttgacaagccgcaatgatagtaccccgcaaattgaccttctgaaggatagcctatgagcggagccaagataacctgcaaaggagaagatatgttttttctttcaaaaaccacattatttctacaaagccaaatagaccaaatagtggttgttgcccctaataagaccaaagatctcaaattgcgtggttgtcttcttatccaatgcccaaacatatgagttgtactattaggtaaactaatattcgaagcaaactggattaaagaccaaactgcg

SEQ ID NO: 22043 - DNA, 1501 bp, Oryza sativa
aggattaattaattaattaattgacgaccgactttcacttttgtgatcgatcagtcctttataaatttctcccacagaggatgaacgccaaaacaacaaaaatctccagcaatacatcaggcgatcgattagtactgatactactttaatcaattccaaaccgaagaaaacaacaacaacataaaacgattcgatcgatctcaactaaactttattaattctctgcatgcgaaagtgataggaaagatcgatcgatcaactgatcagcattagcagcagagcaactgatcgatcatcatcgtcgtcgtcgtcgtcttcgatcgtcgccatctgaaacgtttacgcgtgcctgcatgtgctaatgctctctcttgatcgatcgatcgaataaaacgaaatttataatcgaatatggtgcctccctgcaagttgcagatcgaagtgggtttaggtgctcgatatataccagctgcagctgcatcggatcattcagctgcagttagatagatagatagatgccggccttttcgaacagtatcaggtacgatatgatgcagatcagtgatatatatttggatcattctgccggtaaaaacttttcccgactgctgtagatccctcgtagatgctggtggtagactgcgtgtcggcaaatgtctttcctaacggatagtttgacgctgatagctatttataccgacaaactgagtgctttcatatccatcgatgggaaaataattttgctccttaagagatgtcatatatatagtttcttgcatataatctaaacggttataatttaattttaaaaagttaatcaggtatgtaaatcggtttatatgtaatatatcactcaagaacgatacaagttcaaatccgatttatatgaatacaagttcaaatccgatttatatgagttgtaacacaaacaacacattgaactctatttggtactatttggagaacatgccatgacttgaagaagcgagggacgacatcccctcatgggacgaaattccatctccatcgatctccaacctttttaatttaattcgatccctttttaaaaatgctacctttctttacagatgaggatttgcacctagtacgaaaatgaaagctacaagagatacatgtgtgttgtgtgatcaatgcatatgtaatatctacctatatatatgaatgtgggtgcagcacacatgtacagtgtatccgtgtatggaatatatgatcgaacacgtgtatatataaacgtacagccacaaggtgacaatgcttccaattcttccaattcaagtggccaaagatatatacttatatagttgaatttcatgtgtgcatgcacctgtttagctatatgttaagaatgtgtagcgtgttagatagcgcaaaaggtgatcagattagtatcaaattagagagagacatgcatgcatgtgattagggtaagtcttgaatattcttttagtacatgttgatgactgagagtgtgttggaacat

SEQ ID NO: 22044 - DNA, 1501 bp, Oryza sativa
tacagtttggttaccggccacactttatcatagtttgtcatagacaagtttgatcaacttaacaattgtttggttgaagccacactttgtggcagggttccaaaaaaaaaactaagtctcataaatcaatgattttagaaaagtatggcaaaatcccccttagctaaggtgtagcggtgaaatttgatcaattttttgttatacattgtggctaagtgtggcaggcaacacacaccacctcaagtgccaaaaacgccaaactaaattgtgtgtccatgctaaagaagtggaagactttcgtgctagtttctcatattttcattcggttacattgtacatctaagagacaatgctcccattatttttagatcatttataggattattgccactaattatttactccacctatttaaaaatatgtttcttaaaatactcttttctattagattactagaccacctgttctaagccaatttttaagttactttaaaaaaataatttgtagctgtaattaagtagataatccgtagcaataatttgttaaataatatgtttaaatgggccaattctaaataccctcatcatagtgcacttgaaaggtatccaaaactgacgctggaatggctctttgacaaagtttttttaattgttggctcaagaggtgagttatctagaggaataaataagatattgtttcatacgccactaatgttcttatctcaatactgggcaatgatggaaataacttggaatacttctatgtgaatataaatgatgatgatcgaggcccataaccagcaccaaggaggatgctttatggaaaaattattatcggtaacttggaacttctagaagcagagaaatgagttgatttttatcaaaagataccttattctccttcttgaatcattgtactgttattgttttaagtttctaataaaatactccctccatcccaaaaataaccaattagccaggaattggttctttttgggacggagggagtatatcctaacagtcaatggcggagacaagcctgagatagttagagcttgagccctaggtttgtatcctagactcctgtttaaatctttaaagcattggtgagaattttgaaaatataaggtgtatatataagtcgaaccctactcctacagagtttctggctccgcccatgctgacaacggggcttcctttgctcggttctcaaagaaaatattcttagctcaataaaatgttataaacatataattaaatgccaacgcagatctccttaaaagcttattgtgaagctattgcccaaatgttaaaaaagatagtttgcttttgaaagatcaattagatgccatgtcaattgaaagtgcacttataaccttgacatcttgatcattataaccttgacatcttgatcactccaagcagctatgcctatgcagaggttatcctctgattttgtggccatatgccccctttacctttttgtttttcgctgttgcagt

SEQ ID NO: 22045 - DNA, 406 bp, Oryza sativa
atttttaccttgtgcaaccctgtgcctgattttccctagctaggacctgtttttcttctcatatttcgtttatctctgttgcccggaagttcctggctcaaaaactccggaagttccgggctactcatcactgccaggaagttccggtgttcatcaccaggaggttccgggccctgtcaatttaaccgttgcgtttgttgagaaaatttcaggaaagcctattcaccccccctctaggctacatctctgcacgttcaattggtatcagagcctggtgctcttgattcaagcttcaccgctttgagtgatccacgatgtcggacttaggtggaaaggacggggaaattggtaatgaagatggagcgagcagcaagggaacaccatcacccaagggagccactacacc

SEQ ID NO: 22046 - DNA, 1501 bp, Oryza sativa
ttaatgtcatattgcaaaaatttctttggagaatagtttatatttcctttggactgaaaccccctgatagtatatctaatatggttggaaattggcttagtggtgttgagtcaaaaactaagaatctcatatttgttggagcttctgctttatgttgggctctatggttaagtagaaattaatgatgtttttgataaatctccaactaaatcttatatgcaagtgttctgcagggcaactttctggctccggttctaggcacaacttcaaaagtgtgaagagaacaaggagctcctattttctacatgtcgaaacttagaagttacagtcatgcatattttcgccgactacggatggagattcacaaatagatttcaataattgtttactccttatgtttggctttattatctaagttattttgttgcctgaatgtttgctctttttgagagaatataattggttgtagtttctttgaagcaatggccagatttaatcctattattttaaagaaaagtattcaagaatactagaaagatatgagttaattaaatcttttacctttaacggcaatataatactaaaagaaatagcagaaatgtataggaagaccggccattatctttagtcccgagtgaaataactgggattaaaaattcatctttactcccggttggactgaagatggacaggggccacgtcttttttcttttatttattggttttttgctgcatgtatctattcccccatccaaatcaacacaaatcatccacaacaaaattatccacaaatcatgcacaacaaaatcatccacaatacatacacatccacaatataccaatcaatcacaaatcatccccaaatcaaaaaaaaatctcctgcaaaatatacaaatcattccctacaaataattcacaaaaaaaaatccatagtcgccctttgcgcccgccgccgccggggcggccctccgcacgcgatggccaccgctgcacggctgcatcccctcccagatccggcggaggggaggccgctgcccttcacgcctgccgccatggggggtagcccaccacaccggccgccgcttggcgcggccccgcacgccacagccgccgtcaggcgcagccccatcggctcttcgtgacttagaggcagagaggggaggagcaggaggaggaggagggagaggggtagaggaggagtggaggagggaggaggaggagatgagataaggaggggagagaggggcgctgcgcgtgaggagataagggagagagagaacgcgcgtcgtgtgggccgagagagatatttagtcccggtttgtattatcaaccaggattaaagttctatatttagtcccggctggtagcaccaactaggattaaagttcattgggggccttccaactattaattcgggactagaaatgatcgatttttagtcctggttggttaagatcaaaaagtagcgctcggctttttaaccaggactaaaaaatatttt

SEQ ID NO: 22047 - DNA, 1501 bp, Oryza sativa
aatgagacgggttgtttttacataagaatagcttgtcagaatcctttatccttgctaggtgtgccatcagtagagtcgccatggggacacaacgacgatggagggagaagcaactcgtgctccatcattggatggtggagaagaataaaaatgaagaggctgactcatgggacccacgctgctttctatgctggtaagacacagtggtaaatagttataagaaattatctctcaccagtgataattttatgggttaattggatccatgccactgcaaatgtggcaaattaaaaaaatacaactactattcatcatattggagtacatgccactagaatttaaataaattagaaccatgccactccgtcacgatctatgtcatctccgtcgcatcaccgtctccgttcccgtcctcatccctatccctcaaccgctgtcttcctcgttgctccattctcctccctcgccgatgagctcaagctcacagcagccggcctcgctaggggatgcgagcaacgaggcgtggcattaggcccctcgagctccgccgcctttccttgtagccggtggtggtctccttatccccttcccctaccacctcctctctctctacccccttccttgtcgacgagcttgagctcgcagcagccgacctcacaagagacgagagcaaaacgaaacacgtattattgtatgattaatttagtattaactagttctttttgaaaaatagattaatatgttttttaaacaattttttatagaattttttttaaaaaaatatactccctccatctacttttgatagtcatatttccaaatctaaaatttttatttttgataggcatatttcaatccaacaacttatcctcttactgactttctcgaatttaatgtgtgattctctattcttccacataagattggctatatggacatcgaaaaatataaatattaataaatcgcttgtttacgaggaatgactagtctcagaccgtgtcgcatataatggcaatgcatcgtacggttcgtgtcgccctcacgtatgtgctgcctcctcctctcctgcgtatgcaccacccccgtcttatgggctagcgaattgccggctaatgaatgcgccatctgaagtgagaaaaaagaagtccacatttgaacgagtaatcccggcagatctccgccccatctcaggccacgcctggtcccggccgcgactgactgacctggacctgccacccacgcgccgtaccaacgcaaaagctcagatcaaccgaaccggcaccggaatagtcgtccgtccccgcggggagagtcgcacgcacggcccggcctctcgcgtcgcggtgtcggcgcctcgtcgcgcagaccgcaaccgcgcagctagagcagatccccccgccgcgccgcgtcgtctcgctctcatctcctcccccaaaaagccggaagagagagagagagagagagagagagagagaataattcgaacgcggcatcgcgctgg

SEQ ID NO: 22048 - DNA, 1299 bp, Oryza sativa
  unsure (1)..(1299): unsure at all n locations
tttgaatatttagggatgaagggagtgctttaaatgtttctaccagaagagagtaattaatactcctgccattctataatataaggcacaaccacttttctaaaggttcccataatataaggcatacatgcaagcatgtatttaactatgacatctttntcctttaaacttatactttttttaaatcattcactctcatgctatctaatcttattggatgcatgcattatatttattagaatgatccaaactccaagatgataataattttttcttggtttttgggttaatggtggttgtgccttatattttggaatggaggaagtatatttaataaaatagtttggcgtaatcaaatgacatatcaaatgtcatgactaacgttgagaaaaagaatgggacatatatcatcaatatcaaaccatctaggaattaatattttatccatgaataagtttaggtaaattgatcaaagaccacgccatactcggccggactcacatgtaaaccccataacttagtggaacattatcctccctatcatgcacgaggttttccttatggttttggtgagggttattggcttatcgctattcagtggtaaccgcatggttatcgtgaaaaccatgaggttattgttagaagccatgagaggttttaaataccttggtaatcgtgataatcgtgagattctgcagtcatagtaatgtatatttattgcatgtattgacctttcatacaagagttttgttggtacaatgttatatcctatattattcactatggttaatcgctatgctacactcagagtataatataaagtaaatgtaaggatttagtcaatgatacggtggatgttctccaatactttatcattttatttgcacttaagaaatgtttagattcgtcactgagcatgtcaacgacacacaaagagatgttatagataaaaagttaaaaaaaaccgtgagccatatataacccatattaggatcaccagatccaacaattaattattagataaaaatattccacattaaaatctcaagtaccatccaacccttcggcaagtaaaaagctaatccactttatctaccatcttaaacttattagtcgacgagctacaatatatttcaccgaccgacaaacttataaagaaaaaacggtggatggcgcgcgcgcacgagtcgagcacgagcaccactatgcacccttcgtcacagaagatccggtgcccccaatggtagtagtagcagctgctgctgctgctgctgctgctgcttgctgatgccaccacgc

SEQ ID NO: 22049 - DNA, 1501 bp, Oryza sativa
tatagtaatctctttattaatcttcccagcaagggcgccaaaaatgtttgttagtgtttcttaacgacattatagaaatataaatcccagcaatggcgcataaatattcctggtatattacggttagtgcgcagaaagatccgcaagcgcacggatataccattgtagcatttcaccccgaagtattccaaggtatcgtatttatttaatctcaatggaagattgataagagaagactatactaataattaataatttatatgttacctatataagtcacagtctaagcttgtgttaattaattcaagggtagagtgacacgaagaagaagaagtaagttactctcattaaataaatcctaggctaagtggagaaagaataagaaaagaattcatcctaatacttccagtatacaggtatctttaatttacactatctagtatacaatcatgtagccaataccccctaactaagccctcctggtatttcaagtgaccacccctgattgtcgagtcccttacgacaacccgtcatggccgtccaaccgaaaataaatatggaggagtacccataccatgaaattaacttaggattatatactaacatggaggaatactcgtactgagctgtcaccatcagcggccaacctttgttgtcccgcagcatataacccaaaataatgatatttaataatctaagcaccatgcttaaattatcaaatactactctatatccgctaccatgacatagagcaatcatttgcatggtcattatacccacaccattgcatatctctggtaagctagctacacaattatatcgagataaatgtaaagtgaagtcggtacccaaataataagagtgaagtaaaataccaaaactgaataaagaagcatattccattaattgtgtaagtcttacaaaagagagagaagatactagagccatacccgaattctcctgaagactcgaggactaagaaaactattctatttcctactccactagcactagaatactaactaaacttgagagagagctttgatcttcttgttgagtctgtggagaagtgagtgaggtgagctccttttatagactgagtatgatggttattgcagatggaaaggtcggaaatgccctacagccgttgttggaagtgaatcctgaatgtccatgccaaacactagccttaacggctgtgatgggggtttggccgaaccgtgacctggcccaatctgcccaatttttggcaggcctcctccccgttgattcctcagtccagtgacgtggtgttttgggccttttgagattatttctctggatttgtaggcccatctatccacaaatctacctctcgacggctttcgattggttgttcgtttgttttccgtcgattctccttctctttatatagcaatctctgaaatcaaatagaatccaagtacaagtaaattattctaaaacaaatatacattgtaagcatatctagttctcctttatt

SEQ ID NO: 22050 - DNA, 1501 bp, Oryza sativa
agaaaagctgattttatggccattatttaagggcacaaacgaataaattaaacatcagaaatatgataattaagttgattaaaaggtattttctaaaatattgatggggaattattttacaaaaacatactatttaggaacttacttaaatataagaatttttacatgtttcttaaatgcttatattttgaagcagatgaagtactttatatgtaggaacttgagaagcatactgtgataatccataaggtagtgagaacatagcacacgggttagagttattatttgtgtgactatattttatatgttgtatatgggccctatggtgaagtttggagctgtttttcctccactgcgaggacgaattatggaaaatattattgagaatggtcgcattcgagaatatcttttttaatggagtgctaccttaaattttttgtatcatgaacttcatcgatctgagctgtatgtatgcatgattaacccatattttctagcctttttttttcttttataacattattgaaggccatttctcatatgtatggctaattttgaaaaaaaaaaaggttgtctatgtgttatttatgtgcataatcaatttctccactatatatactaaaccgtgtgaatccaaaccttattatcaaaatgtaaaactaacaatggggaggttttttttttaaaaaaaagatgttttatacatatatacaacaacaagaaccactatgaacatgcttaattttttatatatagatcgccataccacaaggtgagatgtactatctccatttcaaatcaccatcagaacacaggcgaaattcgaagaaaatttaaaaaaagaagaataaaaaagagagaaaggtaggaaatctcttttcctttagatcccaaataggagtaataacactttgagagtttttgagttcacacacggattatttatgtacctaaccgagagcccatcgatctcgcccgatgcgtgcacgttaccgcccggcccgggcccggccctggcccgcagctcgtttgggcccagacggacgcgccgccgccaccggtcgtcgcacgacgaacgcgccctccgccacggccatggcgctcttgcagccgtacaggtcgaggagagagccgaagacgccgccgccgcccccggcggcggcggagagtgaccagcggcgctaggaggatggcggcggcggtggcgccggcggcgcgggaaaaaggtcgtcgatggcggtggtggagcgctccctggtgcactcggcgagcgcggcggcgaaggggtcggagtgtggcgcgtctatggcgccgccgcgctggtggtggtggcgccgtcggtggtggtggcgggacgacgggtgtgccggcgcgcggcggagcggcgccggggggagagggagcggcggcgtgggcggggagttggacgggtggagggaggtcttggggatgccggggtggtgctcccacgagaacgggacgacggaggtggccgtcggcg

SEQ ID NO: 22051 - DNA, 1501 bp, Oryza sativa
gggttaggaacagaagtaggaagcacaagatgagctttgtgctactcatcgatcgcttcttggttgacttgtattttgtagatctagtacttgtcgttgcgcaggtgcactgtcagtatggtaacttagtaagcagttaaggtgattttataggttgtaagctggagcgccgtgcccttcacgattggaattaacttggaaataaatggttatttgacctggaaaatttgctactcttataaacgacgactcttcaaatgtcactcctattatcgtacttaatttttatgtcattgaacagacaagttttcctcttcttttttaccactttcacctacgttgggtgacacggtggattgccaacgtggattagtgttaagaactgatttttttcccctttccattcgcaaattcacgaacttaattagcattataaaaggagtaaatttagaatatgccatatcctgaactctcaaaatacattttatttttgtctttgaagttatcatgaatgtcatatagatccaaacagactccaacctactaagtgcgttgctagatgccacgttgacacctaggtgtcagtgaaacccacatatcagtcatatagaaaaaataaaattaaaattaaaagaggagagtaagatgtttgtaaatcttttaaaagtaaaattttaaaagaatggagaaaatacgttttaattttttccccaaaatatatgtgactgatacgtgggtcccattgacacatatgaaccaccgtagcgtaccacatcaatgtatggaatagcatacatgacatcaactaaaaatacattttaaaagttcatgaaactatatcatacactcatacaaagatcgtccatacacattattcttataaaagtattgttcaaagcaaattcccaaaccatttttttagctaagtagttgagatctttttaaaacgtttataattgtaattaaatatttttcttaaacattgaatatttacgatggcagcgagcactaatgatgaacactgttaagtacttcctccataaaaaaaaatttaaattctaaagtttaaattttgtttaaaaaatcaatttctatcatcctacctaccttcatcatgaaaaacgataagttttatctcttcaatactctttacctgcctatcactcttactattttttcaatgattaaagatattttagtcattctcactcttcactaattctatcttaagatgttaggaatatttttttttgggcgggaggaagtaagtgtaaaggaatacagtactctcgatcgcctttccaggcttgtaaaaatctcttctttcaatggcatgtacatcagaacccgtgggccaattctgcaatcatccacacaatcagccatcaactactctgaaaacagaagaaaatgacaaaaagtggataagcaagcaccgaacaaggcgagcagactacactacccttccgtgctgccggccgccggccggcgtgctcgacct

SEQ ID NO: 22052 - DNA, 469 bp, Oryza sativa
aacttagacacctcagcgccacgtcagctggcgctgaatgccgtgccacgacggatgagagactaagtcagcatgccaacgtacattcagcgccatgctatttggcgctgaggtttctaagttcagcgccacaagatttggcgttgagcaaaagggtcagatttcaaataagttttggcaacggttcatttgtaaaaatagtttctgcaaaggatcgaattatcaaaatttgtggaaaaactgatttggcccgtcaacacagcagacttagattgaatgacagcacacaattttagacttgtcatgaagctacgttgactgaagagcaaggcagccatatctgtatcactataccagcacactgcaacatcgtaatatgcagcttcctgcatgccctattgttgaaccttccctcctctcttccaggttttgtttggagccatgcctgtccctggcgagaatcgtcggt

SEQ ID NO: 22053 - DNA, 876 bp, Oryza sativa
aaaatcgacggtgagattagattgtgcgatgtggcgacttaagagcgtttgtagaagtgacacgtggcggcttaaaagcgtttgtaggaagtttaatggacttttagtatataatagatagataggaacttagcctatcgaacagggccactgcaaccactagactgcatgccctttgacatctgaaatgcttgtttaagcattggtttgtgtaatcaaatatgtattattacatacttaaatccagctaaaaaatgtgttgctagtctgtacatgttgttgggtatagccagtgctgttctgaaacaaccgtgtggccggatcagtcagacaattatatagtcaatcagtgatgttaggcatagtacagtatgcacacactccgcgcttgcaaccaccaatattggtacggattttgagatcctctgcagtcgctacatgtaaatgataatggtatggtacaatcgactgcataggatctctttaaattttctgtaatctgccgctatcctaactggttcgtgtctcttgtctgctatggcttccaggtgatcaccatgtgtactaataatgtttgctttcttctaattaacatgcaatccttttgctcttttacagaaaaaagaatgtgtgaattaatctatgcttttatatctaaaaatattttttaataaggaaatatttatgaagttttttttattatagacattgcttttggtgcacttaatttcaatgcttaccggtaacattaattatatgtatgtatacatattgattaaattagatatagtattaagggtccttatttcaagtttcatcctgagccacggaaacggatcctctgacttaactgagcatgcagttaaatcactaaca

SEQ ID NO: 22054 - DNA, 1501 bp, Oryza sativa
tgacccgtacttttgagaccttcaattccaacttgcaatagtatccaattatttatagttactaatctttcaaaattgaaacgttcatttgcatggatttttaaacaccgctataagagtagaagtagagagcatatagggggttcacgaagtacctcatccgttcaatttttttgttgtttgaaacttcaaatatcattaacgattacctaagtaaaatactgcaaaatcattttttcagcaaatatcatttttgatgtgcccaaaatggtcaaacctattttttaatataaaagaagctattactgaactcccaattacatcaatgtgacaaaaccatactgaaattaactaagatgcaaccaaaacgtttaacaaagaggattgctacggcccaacaggttgtatcgggcggtactggtaccccgcagaaccaaaacacatctaccgttgaatccgggatgggtaggatcgggagagaaaagatgagcaagggtggatgcggcgttcgagtccgttcctggggcggcgcagagcaacaaggcaacgccagtggcgcgggagaggataaagtccggtggcggcgcgcgagagaaaaaagagaacgacggcagcgccggagaggaacaagggaaggacggcggcgcgggagaggaacaagtccggcggcggaagaggaacaagttcggcggtggcggaagaggaataagtccggcggcggcgaggaagaggaacacggcggcggcggcaaaaatcatctagcatagctagggttcgagccgcccaatccagacccatctattgcacacgaagttactcttttacccttccaactctcttctccatgcgggaccacctaagggacatttttggtaccgtgcggtaccacgcaacaccagccattggatcaggccagatccaacggccagcatttggtaccgctatggtaccgcgtggtacgttggacagtaaaaaaactctttaacaatagttcattacaaaaagagaaatcaggaaaatctagggaagtccaattaatcctgagattagatcactgcccatataatttggctgcatgaattttttgtgtgtgtctgtgtgattgaagggagcttactattaaaccctgcataggagattttctatgttctcatttgcgctactaatttgcaggtgcagtgtggaaaaactgctaactgggacacccggtcaattcaaacttagacaaaacaaagcacagctttagactctgacatgaacttcttttctttcttcgagaaagagagtgcccacctctcccatttctagtagcagactagctatttacccgtacacacttgacatgaagctatattgactgaagagcaagtgcaaccacatagcagcacactgcaacaaatgcagcttccccctgttgttaaacctcttccctgaatgatctctctctcaggttttcatagagccatgtctggcatgaaccgttcgagctttcttccactat

SEQ ID NO: 22055 - DNA, 1501 bp, Oryza sativa
ggcatcgggcattgttggttaacaggactgtataatttgtctgatgcttctgcaacttttgctttcactagacgatgacgttactctaatcagccctttttattctttaaaaaaaaaagaagtctcgcaaagacttccttttccaaattgacttcaagagtcaatccattctttttcttccctttgtgaggtgcgatgaacagtgtgcatgcatcgttgttaatttgctacttttaacttttctgtctgttaagaatatttgcaactccatgtttttcaaggtggaaatttcagttttatgtttttatggggccataatatttaaccatttggtattaaaacaaagttaaaaagtattgcatttttcctttaaccaaagaaaatatttaaaacaagctcaatcccacttagggcccctttgaattgcaggaatggaaaaacggaggaataggaaaacgcaggattctaataggaatacaggtgtaaaacagaggattggaaaatacaggaaaaacacaggaatgaccgtttgattggaccacaggaaaaatacaggaatcggatgagagagatagactcagggcccctttgaatcgcagggtagaaaaaaacggaggaataggaaaaacacaggattctgacaggaattgaagtgtaaaacagaggattgcaaaacacaggaatggtcgtttgattggagcgcaggaaaaacgcaggaatcggatgagagagatagactcaaaggaaattttccaagaggttggagctcttgctaaatttcctccaaaatccacatgcaatatgccattccataggaatttcataggatttggaaagcttcaatcctttgaatcaaagggccaaataggaaaatttcctataggatttgaatcctatgaaattcctacataaatcctttaattcaaaggggccctcaaagaaatttttccaataagttggacctcttgctaactttcctccaaaatctctataggatcacccattccataggaattttaaaggatagtataggattcaatcctttgttttaaaagggttttataggaaatttttccataggattgaaatccttcaaatttcctatgcttttcctataaatcaaaggggcccttaggcttttttttttctgactggtagtagcattacatcatgctagaattaaagaagaggacaactgaaggggcaaagaaaaaattgatttccatcttgtcacaactaggccttgtttgaatctgcaatttagtttagcctttttttttttaggagaaatttggtttagctttttggcaacatgtaaaacgagataatccattagcacttagaaacttaagaattgggtttatttgattttttttaacaaacttctatgtaaaatgttcttaaaaacacacaccgtttagcagtttggtaagtgtgctaatggaaaatgagtaagttctattttggagttgaagaaaagaatgcagctggatggtatttg

SEQ ID NO: 22056 - DNA, 1501 bp, Oryza sativa
tagcatccgcttgagggtttgaccaagattggacagtttgtatagtatcattttcattctaatatgctatcacatattgtttagtacgctattcaaacaaaaacaaggtagattatttctacctccatgaaagaagcaaatcaattccgttacaatttcttagtaacatcatcatggaattgcagtaaactgcaaaacacatatattgttgctgtacgcgggcactaacgttactgcacaattttcacaagatgaatgttgcatccgcttgggagtttgaacgagattacacatcatggattcactttgactagttaagcaaaattggtggtggttcgtggcctcccatcgcactcctaatattcccgattcaagcaaacactcaccacccctcgcctctcacatgtcctcctcatcataaagcaaaccatttgttttttctctatgtaaaatttattggttgttattacgttcttgtggtaacattaccaagcaattgcaataacacacttttactgcaaaagttgtagtagttactgcactctcgcagtaacacggatcaaatggtagtaacaataatgctatagtgttactacatgtggaggattaaacttcaaaatgctaacctttgaagagcaatatctcgcaaaatatgcattattttttaaaaccgtttgcgccatgatgctagaaaaaaaagtacttgttaaaagtagatccgtcatgactatattttaactatattttaccgttgttactgcaagtaaactacgcgttactacacaatgaccgtcacgttactgcaccgtctctgcgagacgagagctgaaaaagggtgggtgatgggagaagtcacaggcggatttgacctgaggtttgaccgacgtggaagcactttgactagccttagactaatgtgggagatagatttggcccttagaaggggggtatagaatagctattctatactccgggtgtagaatagtcttttatatatatatatatatatatatatatatatatatatatatatatatatatatatatatatatattcgacatgtataataataaaatccagttaagattttaaaaacaccattaataatttctaacatacttattctaaaaccataaaaatagcatattgttttgcatgaaaatgactattacaaaaacataaatttttaatgtaaaattatggtcaaagtcaaattaattttgaagaacataaaaccgtcaaacattaaatatttatttaagtagtactagcttgtagctacagtagattagctcatcatacaagtctacccatcatcacacactagcaattattatctagagtattttaaatcatatgtaagtgtgccacataattattatacatagtattttaaatataatgcaaatataaatattatctataatttttttgtatttttagaactcaatatgcagacaatgtcaaatcattatcttctcataatttttatattattta

SEQ ID NO: 22057 - DNA, 265 bp, Oryza sativa
tctatcaaccttgttgaactcctcaggactcaaggcggagagaattgcattggaagcttgagcattgcgatggatgagttgctcttgctccaaagtgagctccatgtcttcatgagttacgtcaatacctgtacaaacaactttcaaatacttggatgcaaagagattagatacaactttatcttgtgcttccaagcggcgtaatgtgtcccatcaaattgaggagcacgcccggaaggcacggagacgaagttgtgagagggaa

SEQ ID NO: 22058 - DNA, 174 bp, Oryza sativa
aactggagtaggcagcgcaattgtaggacacgacgtcgatggagcactcaaagtagaccggggccaccggcgtcggctccgacgcaccaacgcaccacccgccccgacgccaccgtgagcggagggaggggggggcgacaccgacgctgcctccgacccaacgtcgccgctagg

SEQ ID NO: 22059 - DNA, 1501 bp, Oryza sativa
aatgtggcagagtttgggttaacactaggccgctatgtcacaagtgaagccccgccaagcttatctgaaattatcgacatcccgtgagtattgaacgttatgacttttgaggtgttttcagccgtctgatcatagcaaacggacaagatcgattgctacagtaaagtgtatccctgtcacgccctaaaaatcgactaaattaataatccatattttaaatcatttctagaaattattttaaaaagccttcaagttaaactctaataatctaggagaaattgtaacataaaactgagttagataaaatctcgataatactttgcttgtttatttattttctagatttttctgggaattatttgagcaaggaaagtatttttaaaagtttttaaaatcctctcctaagctgttggcaacatctctccccctcgtgtgcgtgctgtgcagcccaagccggcccaagccgagctgctcttccccttctcagcccagccgaaaatctaatttgcctccctcagcactgttcatcttctacctctagcagccgaactgagaccgaattggctcggtttttctcctccaaatccaaccttttctcttgtgttttcctaaaatttgttgaggggaaatatttcccttatctacctctttcgtttcccccaagaatcggtttatctctccaaactaacccgaagattttccggtttcgattcctctcgtttggagtcgatctctctcacccatgcctatataaagcatcccctagtcgtcctctttcgtttgccccaagtcccgagccccgccgtcgcttgtagcgcagccgccgcgacgccctagccgccgccgttgccatcgtcgttccagccgccccgcgccgtcgctgtggtggtcgtcgccggtcgccgtcgctatctccgggttcgcgaggagaagccgcgcaccgtccgccccttcgctgccgttgcaagcagccggagcgccgccgtcggcgaggtcgccatccgagccggccgccattgatgacgtcatgctgacgtcatcatctcctatttttcagttttttttaatagattaaaacttcggaaaatcataactaattaaccgtagctccgattcaagtggttcaagttgctaaattcatctaaaatctagatctacatgttaaaaatatccacatgtattgttcatgcttgtttttgtactgttttgttgattttgtttatttgctttagtttccgacgtttcgttggagggcgtttcagttgaggaaggtttagaggtttttgtggaagctcaagacaagtcacacagatcccaaacaaacctttgagcatgttgaacccgtttaaaactaatgttttatttcaacttatgcattattttcgaatgccatcgggtggtgagccttttcccatttaattatggccgaagatgactgtattttcctatgggttataatttgattagctagaaccttatatattggtttggttcagctaaa

SEQ ID NO: 22060 - DNA, 1501 bp, Oryza sativa
tcgcggcgccgcctccgtcgtcggcatcgcagcggcgtgttccacgccatcctcgcctccgtgcagccgctgccggctgccctcgtcgcctcctcgccggccccggtcgtcgtcgtcgtcgtcctctcgtcgctcccggtcgtcgtggcgttcgtccctccgtcgagccgttctcgtccgtcctcggtgtttcgtcaaggtcgctgtagccgtcgtcgtcttcgtcctcggctccgcgtcgtcaagcctcgtgccggccgcgtctcgccttcgtccaaggatcgccgccgaagtcgtcccctcgccgttcgtcttcgtagttcccggccgtctccgccgcgcccgttcgtcgttgtcgttcccacgcctcgtcgcgtggtggtaaggatctctcctctcgctgccccgtcctcgtcctttcggtgtcgccccgtacccgttgtgcggttgtcgaccccggtatccgtgtaccggtgtcggtagtcgttcacgtgtgcgggtggtgaccgtgtagtgtccgtgttagtgtgcccgctcggtagccgcgtggtttccacgtgtgcagcccgtgtggtgtctagtagagtccgtttgtcggccactcgcctcggttgacacacgggatctgcttccgtcgacccgtggaccgtctctgtgtactcggtctaccgcggtcctttaggttgacatgtggggtccgcatgtcaacggcgcagccttcctgtcttttccaggctagcgtttacacatgttttatagttgcaaagcttaattataataatccgcaaatctccatataacagcattaaacttcggatgatcatatcttggtcatacgagctccgaatcgacccgttcaagtctcttaatgtttgttataacctaaagaactgtgtgctttctttttatgtgttgttattgcttctttataggcttgtagctttgcttgtgtgcttcgcgtagcttctgtcgttccggaggttccagaagcgtggttcgcggtcgtcgccgaaggttcggaaggccgttctctcggagcaaggcaagtcacatcatccttgagcatattgaatcccagtttataaaattattttgatttaaattaatgcattatcgctttatttaaattcccgcgttatcactgttttatctagccatgcctatttacctttgttatgaccttatcattgttgttattgttactattaccttgttcaccctaggataaacaaaaccccaactagtgggtactctattcatggtcccactagtatgaatttaggtagatgcttcgctgattaattaggcaacattaggtggtttttataactttagactttgggaattctcatatcatttggacactatggaatggttggcttatggtggaattggacatacccctctcttcctctttcaaagcccctaaaacctgtttttcggtggggtttgggtgcatgccagttgtggaaagtagcaccccggccactataaggatgaa

SEQ ID NO: 22061 - DNA, 1246 bp, Oryza sativa
ctacgtgaaagaggaattcatattttagacagtgtttagaattgtagtgttacgatatgtcatatatgtattagattatactccttttttcatctaaaataactaagcatagagcctgtccagatttattgtattagattatgttaaatctaattcttgacggaaggagtatttatattgtactcttagttacatcgtctgccgaatcattcaatattgctgaattgggtttaggtggtgtttagatccagggacttaattttagtctctatatttagacattaatttagagtattaaatatagactacttacaaaactaattacataaatgaaagctaatttgcaagacaaattttttaagcctaattaatccataattagagaatgtttactgtagcatcacatagtctaatcatagattaattaggctcaatagattcgtctcgcgaattagtccaagattatggatgggttttattaatagtctacgtttaatatttataattaattttcaaacatccgatgtgatagggacttttaaaagttttagtcctatctaaacagggccttagttaacagttgtaccacaagtcttcaggctttccactggaagcaagccagcaacaagtgactgccatgatgattccttaccgctgggtggggcccacacgtcatccgcactgcttctagaaccaagggccatgttcgagcttcgtgcagccgttgacatgtggtccatgctattcgcaaatgcacatcaagtaggtgggtccagtctgattaaaaagatctagcaggaagcctcccctggtctggccacatatgccacctagtttaaatcaacttgggcaaatttgatctgaaatccactcacaagtctgattttataaatagaagagtgtgtatataattcattccgtggattataccgttaaagatcagctgatgtattccattcatttccaaacagataatgtatacagtcaaaccttaaaatcttaaataattgataaaataaagatgtactcagtatatcataattaaatgtttaaaattatactagtatatttatattatgaaaaaattgcaatatatctttttatgtaatttttatatttagaagtatatataaaaaaatgtccgtttcgaattgaagcattcgaattgcacgtttttataaacccgggtttaaatcttcaaatcagatggtggatatttacgcacaaacatcatggggcccacctg

SEQ ID NO: 22062 - DNA, 1501 bp, Oryza sativa
caaagcactaccgtacttccacatgtctagtgggtaaggcttagtttgtggctcagtctggttataaacaaaagtacacggatggagatggacgaagtcgggggtcgatggacatatctaggacaaatgaaggctacacgagctgcggcccggtagtcgagatgtcatggcacagggccggtgtcctgctgctgggggctcagtcctgcctacctgtcccgggggttccggccgtaggtggggttgggtcggtactcttgtttatggctaggatgggttgggaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagttagtgttttaattcttaaaatttgctcaacaactaaaatgtggaatggttggcctgggttggcttgggacgagctgggacccagggtcgggttgccagttcggtctgaatcatcgtaggccttgggttaaggcaggttcgtgtgggtgcacggccttgattaataatactgtgtagctctaggatcgtctttttaaaattggctttgggcaactaagtgacttttaagtgcaaaacctaacccttatattattaccccttgtacccccttgcattagtcatgcatctgccggtgtggcttgctgagtactgtggttgtactcatttttgctcaatctttccccccccccccttcagtaagagaagctttggagatgaagtcctaggtggagtcctggcttataccccagttgagcgcctgtgaagatggagccgtaggcccgctagtccgctgctgtttattttttgattgtcaggccttaagtgcctttgtaataatgtaaatattatcgatataataaagatgtgtcttttatatcatgtttgtgtggtgtaccccggcttttcctgggacggggattaatacactagcgttcgggaaaatgtatttttctcagtcgtgacagcgacggcatgctatacaagctgagtacgacaaagcctccgtcgccgctgctcaagctcaagcacaagtgcaagttgccgaaccacctcccctctctgtccgccagtctcagccggcgatccaaggacagccaccaaggcaaagccaaacccccataacttggagaaagttcagaatagaccgtgcaggcaaggcggtgatggctgtcgaagaagtgcaagccctccgcaaggaggtcgacacccagcaagcgagcaactatcagcagccagcccgcaagaaggtccgaaaggacctctactgcgcctttcacggacgctcttcgcacagcacggagcaatgccgaaacattaggcaacgtggcaacgcgcaagacgcaaggccgcagcaaggaacaactgtcgaagcaccccgcgaagcaattcaggaac

SEQ ID NO: 22063 - DNA, 253 bp, Oryza sativa
agtcacatagataaacattagttaacctacaaagaaaagtatcaatacatgtgtctgcagccttgcactttcgaagttcagctataattttcaccatgttcagagaaaagaagaattactacccatgctggtgaaaccattgatgccaagctatcaataaagagactaattaagaaattaaagccgaccaagtataaatatttggtacacagctgagacaacagaaaacacaactctctggaggaattaacaa

SEQ ID NO: 22064 - DNA, 1501 bp, Oryza sativa
caataattcttttcttgagcgaacctttcaaactatatcatgttgccattggattttaattaagttgtaatgttaaggtactgcctccgtttcacagtataagagattttgattttttttaatcatcttttatatgtgcaagttaatttatgtccatcctgctaattttttccccggttagatgtgcaagttaatttatctttctcaagaaaacgagataaattagaacaaacttttgttaagccacttcatcaaagcctcgttgtagaaacgggtacaaaatgcatatgtaaacaattatgaaacctgaatgtgaacaaactgttttttttagaacgataatgccaaccatgccatattacagaagtttttgtgattgtctcgagtagtctgaaaacacaagtttttttttttctacagaggcaacaagtttgttaagggccttatacagcaatttcatggatgtttgttgccaaatgttaactatttcctctgcatactactacacgcaagtataattatattgcttgatttttatagaagaattatctccgtcccataataattgtatttctaccattcaaattttatcttaaaaaattgtatttctggtaagatgggacacaacaacaaatggaatgtgtacccccaaccttcattttaattaagtttacatatcgaatgtgttgctcaactttccttttaatcaagtatagacatatagaatatgcgcatgcagtgtagttattaaatatatatggttattgtgataaattgtgtttgatgttaatctatctctaatttctagaaatgtaattattatgggatggaggtaatactatgtgagaagtgtaacgtagtacattccacataaataatatcttcacaattgtcaatgtttccatttttttacagcatgttttttttgtgcttaatttctttaccattgcttcctgttcatttatactacattgttggcgctgaaaatcttaatgcatcacgcaattcattttttttttctaggatttggttcaaacatatattttttccctctaggagcatatttttgtgcacaactgatattgcaccgtgtggactttgggcattgattgactagctatgatgctgctggttaggaccttgctttcagtctttccttgtacgtataatgtgccaaattaacttaacgcatccttcagtttggagaactaaaaatagccaactagtttggggtattttagtgatagtaacatttttcatatatgtacctcaatactgtccacacatatacacaatttaaatgcaaaacattacaatctcttattctctttcggttgttcactcggtctacaaggacaggtcaatgaaatatccattgctcatgaggagacaatagatatccatgattccctcaatcactgcttcacacttgtcctatcccttgcctccataaataggtcatgagtatatcatccactcgactcaaattaacgcaaattcg

SEQ ID NO: 22065 - DNA, 1501 bp, Oryza sativa
gcaaaactacaaaaacctaaggaaagggcggagggcctcacacctctaggtgatcctaggcatcgcctccaacctcttcgcccaccgcgtcctctccttcgccctgatctgccgcctccgccttcgccagttgctccagaaggcgcgccttggcagcggaccggccgtctttctgccagaattgttttcgccacgcgcgaagagcgggcgaaatattctgcgcactaatctcccagtcccacttcgcgtaggtagggaactcggcgacgtgctcgcagccgaactgctgcaagaggcctaaggtgaaagccgccgatacacgtgcacagcaatcgcgccgtacgcggtggcgcagtccgaaaccaatccgccagcctgctgggtccactcggagaagtcgaaggctgaggcatcctcgatagggaccccccgcaccttcgcgcccatgtcggtaagggcgaggcggagtgtttggcaagctgttctcgcagattcggtggtcttcgccatctcctgcgaaaaccgctgcgactcctccgcggcactcgcttcggccctgctagccttctggcgaagagactccatcttcggcttagtaaggttgtaatagcgatgagcaccgccgaatgggccttctccttctccagttcggccgtgaggcgatcaacctcggcccaggcctctttccccttgtccaattcggactgaaggcgtttgacctcagttttcgccttcttgagggtgcggaccagggactccacctccaggttcttgcggcttatttcatcatccttggcccgaagacggctcttaaaaccgtcaaaacgggcccgcacggttcgctctttcgaacagtgagccgcaagaatctagatgaaagataggagcgggcgaaaagaaaaaaaggttaactgcgagacgtaaaaaaaagagggaagaggaaaacgaagaaggaagaaaaggcatacccgaaccgccagacttttgatggtggaacacccctcgtcgaactcgttaagttcggtgaacaggctcggggtgccggcgggcaagaaagattgcttactccctccacaaagggaataaggtccggccgggtctcgaagtcaccaggggcgaagtggggcgccgcaagggaatactccgaggcaaatgcttcggcggccgcacacttccccttcgccttggccagcggcgaaatggctggctcgcgcacagggctcccgaaaaccctcgccgcagccgacaagatccgttcggcggaggcggaagccccggcggcggcgctaccgcctgccccagcaacgccgagcggagcaaggggagcagccgaaaggtccaaactgcggccagcaggtgaggtcggagtctcgtcagaagactcgtcgtcgctgaaaacgcgagcgatgtcgaggaatcccttcttttttaagatcttcttgaccagacctcctttcgccgccttgcccgacgagaacgcaactaaggccttcgccccttc

SEQ ID NO: 22066 - DNA, 280 bp, Oryza sativa
ctggccttgctccaatccaaaaggaatgagcttttacggtgttgcccctaagcatgcgactaaaatatattttttgcaatattcaacaagctcctatgagtctgtaaaaaactattgcacggtggcaaaactgcaggagtacaggaatacaggataaggccatataatgttcctggaaattgcaaatataaagcatcggtgttgttttagatcgaattttatttccatggttggaattatcccctttcagcagaaaaaaaaagtggcaggaagtgagaaa

SEQ ID NO: 22067 - DNA, 1501 bp, Oryza sativa
tccgccgccgccgtcacggcctggaggagtagcgccgccgccgcgagcacgaaggacgacgaggctgccattgcttaattagctagattaatgtcgaaacaagatttcggcaataataaaaggggtggctatcaagctaggaaagtggatgagtttgaagacaaggaattttatataggttcaggccttcttattcaacaagtaatatcctactcctgtccggagatgattccgccgagtacgttattgattgtataaattggaaaaaagaatcgcgccccgagaggcacacggaccctccttatataggggaaggagtccgctttacaaaatacagcccatatcctaacggaatatgggattatagataaaatacaatcgtaaccgactaagatctcgggtatttccttgacatacaagtaaaaaactaacccgagtcttcataaagatattctatctatatttggtaccgtatatccgactaaattataactgtcatgtagaaatgggatatccatattctccacagtagcccccgagaccttcgcagttgacaaaacaaccttctcgaaacaaaaaacagcaatccgagtgcttcaattcaacttgctccagtttgccgagtgctaaaatcaaagactgcgaagggcgaaaataaaacatggtgcatcgagtagatgcacctaattaggtatagcccccgactatgtaattagttgaaaaactaaacacgtagtcaagaaccgagtggttttatcaacactccttgaacatatcaaggataaaaaaatatgaaagggccgagtgattaacactcaaaaggtccaaaaatagacatatttgataggaatccgagtaagaaactcttaaaatgattcaccaaacatgataaaaaatcacggtgattaatgggtctaatagcctaggctgtgacccttacaataaccaaaataagcatataacatgctaaaagaataactattagtaaaccagtcatctcaaatcaacccaaacagcttttgcagcctaataaagcttacaaaaatggtataacacctttctgtcgggcaccttttgtttgcatcgtgttaattccaaagaattatcaaaccgcattaaaaagggttttaacagcattggaccacatcattgtgagcacaaattgccaaagcaaaaagtgcctaagtccctaaggatcacaatgggccacgctggaaataaaattgggctgaagtactgtgccggcccaggcctgctagcgctcccgatactctaatatcaccgaagtgaaaaatgtctcttcgtcttccccgccgagactctcaccattttccccatttcctgctacagtacaaactgcgccggccaagctagggttcagcaatccgctccaatccatcctcaaacactccacaaaatttctacccgcattcaccgctccaattccccatccctttccagccgtatctcggaccaaatcaaaccatccagtccacattca

SEQ ID NO: 22068 - DNA, 282 bp, Oryza sativa
  unsure (1)..(282): unsure at all n locations
ggcccaatcaaatatattccactttggcataagttcacattggcttcctcaaatatatatagntttaatctaattcttatctctcaatcgctcctctaattattaaaatcgatgcaaaatgacccccttgatggttttgagagcggtttttttgctaatgtagctcattgacttagtttgaccggctgattcagtgtgagacccatatgtcagtgcatcctcctcttctttctatttttctctctctcctccctcctcttctcttcttggtcttcttggagg

SEQ ID NO: 22069 - DNA, 1501 bp, Oryza sativa
agttaagttttactgaaccatgataactgttatctcatttaactttccacacgatgtactgttaaaagacataataatgcctttaagttgaagcactaaggagtattttcagttttttcaaggtaaagtagggtctaaggactggtttgtggttctcatgcaaggctaggatctgccaactcaagctttagttacaatctagcctagcctgagaacagccttgtttgttttgttgtcatgttacattatgttctacaaaaagctttaaaaattacggcacttttacatgttactaacacgcgcacatctgaattctcttctgcaggagcaggtctctgtaaatttagatgcattaccaaccttggatatgttttgaattgcagggttggatcagtagtttaatgatctcacctacatgctgaggagtgaggagctagaaatgtattgctgacgccaaatggatgtagaaatgcataccaagattactgacagtctgacaccaaacgccgttgagaacattgagcttgagcatctgtaaatgtaacctacttactgctgcgattgtgttatattcagatgtgctgtgatcggatcgagatcctttgacttacttccctctaatatgggtcactgagatgtggatcctctctaatatgggtcactgagatgtggatcctctactcaacggagtcatttgtcaatgactcgaagttagagagaagtaaagttagtatcctcatccgctgtgatctaggcactgtactttgtgttctttttaaatgaacggtcaatggtgcatgttgctgtatgaatcaacttccaacctgcaagaattatttttgcacacattgataacttagggaccctttgaatcgcagggtagaaaaaacggaggaatagaaaaaacacaggattctgacaggaattgaagtgtaaaacagaggattacaaaacacaggaaaaacatataaatagtcgttagattggagcgtataaaaaacacaggaatcggatgagagagatagattcaaaggaaattttttaagaggttggagctcttgctaaatttcctccaaaatccacctgcaatgtgccattccataggaatttcataggatttggaaagcttcaatcctttgaatcaaagggtcaaatagaaaaatttcctataggatttgaatcctatgaaattcctacataaatcctttgattcaaaggcccttaaccccttaacctgtaacatagactgatgaaggccgaaaataaatttgcaggtccgtttcgggaccaggctttcttgttttgttcatggcttttagggagtaccgtgatagcttccatcatttggagcatactcgattagcccactgaatatgaagcattttcatccatttttaatcaagtaatggcagcaaggcactatgtatcaaggaaatggataattcgaacaacaaaaactgaagaacacaaggattaaaaaggtaaccaggatttttttttc

SEQ ID NO: 22070 - DNA, 292 bp, Oryza sativa
cactttcccccgtgttttgtgcacagtacactgcccgccctgccgctcgatcgatctggcctttccgccggaccgccgcgcggcgccccgaccgtcgtgcggccgcaggaggatgcaggcacccttcctttcgccgcttttctcctctggaagaagggctctcccatagacaacggctaagaattacaaggctgcttctttcgggagtagtttttctgttaattttacaagggaaataggtgagatttctgaggtgtaaaaagagaattagtagtgctgtggctggggaaga

SEQ ID NO: 22071 - DNA, 1501 bp, Oryza sativa
tatacccctgccgatcaatggaggcacgtgtagaagaggcatcaaaatttaaataactaaagcatgcatttccaccaagtatctccatccatcctaaaatataaggcagaagattttggtgaataaaacatatcctaataccatgaatatgaatagagagttgtccagattcataaggcttgtttgggggagcttaaaattttgagaagcagcaactgagaaactagctagtgagaatctggagaagctgggaaacccagcttctgtcttctagttcattttccagattctacaaccacaaattcttagaatttggataaaaagctggactgttttggtgagcttctggcaagtggtaagtactggagattctaggagaagctacagctgctaaaagctccccaaacagacccatagtagcagaatgtgtctcatcgaatatcatagtcctttttatattttgggatggagaaaataagtgttaaacaagattgaagaaatctaaaccaagccagctgatcttcacctactgcatctactacttctgtcagcttcctcagagtccatatatatcccaacttgcagcgtgtatgccgtaaaagtatctagtatggactatggattacttcattacaaattaacccattacccatcatatgcaagatcagtgtaatcatgtaatgtaaaggcacaatctcgtgctgttttcccttaaaagaattgtaatgtaaagtgaatactaaactgatgaacacacaagatcagctaaaatcaattaactaatcctccattgctagctagatgtattgcatgccgcatgtgcagatgtgctagcttgcagagctagttgtcttcgtcttcgtcttgtcctttgtctagagatttgtctagggagtagagacgacgatgacgacgacgaaatcatcgaactaaacacaaccaccaccacccccttgcctttttatgtagatcaccctatagctacctagctttaattatatcgataaattacctgtgaagaatatggatattccatatctacatgccagttataatttaatcggatatccggtaccaaatatagatagaatatctttatgaagactcgggttagttttttacttgtatgtcaaggaaatacccgagatcttagtcggtcacaattgtattttatctataatcccatattccgttacgataagagttgtattttgtaaagcggactccttcccctatataaggatggtccgtgtgtctctcggggcgcgattcttttttccaatttatacaatcaataacgtactcggcggaatcatccccggacatgagtagggtattacttcatgaatatgaaggcctgaacctgtataaaattcattgtctccaaaaccatcaactttcctagcttgatagccacccccttttattattgccgaaatcttgtttcgacagttggcgcgccaggtaggggcagcgtcaagtttttgccgactaagtgcga

SEQ ID NO: 22072 - DNA, 755 bp, Oryza sativa
gccgaccgacagggatgacgggggagaaggatagggcggagggtgagcggtggcgaggacgacgaggtagagggaggaggaggcgacgggacggcaaggacgcctacccgcgtgttcgccggaggcggcaacggcgggggcaggtaaagtggcatttcatccggtaggcaacgtattgagtagcattttatccggtgtgttgtattaagtggtattttatccgaacccaatatatagagaggcatatcgtctgttttctctgctaaagcagccccaatacacactatacacggtgtgaattacaggaagtgttgtggtccgtcggtttcctatcggacggacgatggcgacggtggtttcgtacattacattgacgagaatccccttctacagttcgaccgaggccctcgccggcgccggcgccgccacgcccatctccatccccgaccaccacttcttctccggcgagctcgcctcgggagacgaatccgcagctccagaggcagagaatcgaatgctactaccacccgtgaaaggtacggtgtgtcgtgtaccgccttgaaatcttagctggttcgccggtgatcatgccgtgaagccgccgccgcaggcatcttcccggcgagcgagttggtaggggcgcttccactcgcgtagctacgaatcttggccttcccggcggcgattggatggtgcccctgaccctgaggtgaattccaagaagatccaagaaccatcccctccccggatggatg

SEQ ID NO: 22073 - DNA, 405 bp, Oryza sativa
aatggctatatatgaaatttactctgcgttttgaagtgttgtgaccttccatttttggttattatgctagtagaatacatgcttttgacaaagggacaatgattataaagctaaaagtgcttatctaatatctctacatgctactacattaataataaaaaggtggtgagtgctgaaaatataaactgaaaagggtgggaaaaataaatggtaggtaatatcttccctcttggtactggtgtcatgggagctttggtaggactgctgagaagctaaatatccaaagtactcctttatgtttcggttgtattgtagctcaacttatataaaattgtttatgagataaatcttgatgaacaaaattcttactgcaaatgcatttgtttgaatgctgttttctttagg

SEQ ID NO: 22074 - DNA, 1501 bp, Oryza sativa
tcctttgctggaagaacgccgtgcgccaccatctcctttagattatcttccgtcacatcggaggacgcccactggctctcgaagctttctctctcttccgccatgaatgtggactggatggtttgatttggtccgagatacggctggaaagggatggggaattggagcggtgaatgcgggtagaaattttgtggagtgtttgaggatggattggagcggattgctgaaccctagcttggccggcgcagtttgtactgtagcaggaaatggggaaaatggtgagagtctcggcggggaagacgaagagacatttttcacttcggtgatattagagtatcgggagcgctagcaggcctgggccggcacagtacttcagcccaattttatttccagcgtggcccattgtgatccttagggacttaggcactttttgctttggcaatttgtgctcacaatgatgtggtccaatgctgttaaaaccctttttaatgcggtttgataattctttggaattaacacgatgcaaacaaaaggtgcccgacagaaaggtgttataccatttttgtaagctttattaggctgcaaaagctgtttgggttgatttgagatgactggtttactaatagttattcttttagcatgttatatgcttattttggttattgtaagggtcacagcctaggctattagacccattaatcaccgtgattttttatcatgtttggtgaatcattttaagagtttcttactcggattcctatcaaatatgtctatttttggaccttttgagtgttaatcactcggccctttcatatttttttatccttgatatgttcaaggagtgttgataaaaccactcggttcttgactacgtgtttagtttttcaactaattacatagtcgggggctatacctaattaggtgcatctactcgatgcaccatgttttattttcgcccttcgcagtctttgattttagcactcggcaaactggagcaagttgaattgaagcactcggattgctgttttttgtttcgagaaggttgttttgtcaactgcgaaggtctcgggggctactgtggagaatatggatatcccatttctacatgacagttataatttagtcggatatacggtaccaaatatagatagaatatctttatgaagactcgggttagttttttacttgtatgtcaaggaaatacccgagatcttagtcggttacgattgtattttatctataatcccatattccgttaggatatgggctgtattttgtaaagcggactccttcccctatataaggagggtccgtgtgcctctcggggcgcgattcttttttccaatttatacaatcaataacgtactcggcggaatcatctccggacaggagtaggatattacttgttgaataagaaggcctgaacctatataaaattccttgtcttcaaactcatccactttcctagcttgatagccaccccttttattattgccgaaat

SEQ ID NO: 22075 - DNA, 1337 bp, Oryza sativa
tgatcacaaatgagcattagaacttttgagcaatgagctcaaatgcttatttttcttccatttagcgctgagattttccctttcccaatggtttccagtgtgtggaggtatcaggtacctgccttttgtgtttgtatgcttagcccagaatccagatagagtaaaaatccagggactagtagtttagccctctagtccagcgggagcaaactctcgaaagcctctatatacatgaagtgtatattttcagacatggtaccttggacatggacaagtattcatttatttatgcgtgtatgatttagatagtccgtttaccaccccactcccagggttacaatttagaaatactacatgtttgtctatggaaaaaaaaatcctggttacctttttaatccttgtgttcttcagtttttgttgttcgaattatccatttccttgatacatagtgccttgctgccattacttgattaaaaatggatgaaaatgcttcatattcagtgggctaatcgagtatgctccaaatgatggaagctatcacggtactccctaaaagccatgaacaaaacaagaaagcctggtcccgaaacggacctgcaaatttattttcggccttcatcagtctatgttacaggttaaggggttaagggcctttgaatcaaaggatttatgtaggaatttcataggattcaaatcctataggaaatttttctatttgaccctttgattcaaaggattgaagctttccaaatcctatgaaattcctatggaatggcacattgcaggtggattttggaggaaatttagcaagagctccaacctcttaaaaaatttcctttgaatctatctctctcatccgattcctgtgttttttatacgctccaatctaacgactatttatatgtttttcctgtgttttgtaatcctctgttttacacttcaattcctgtcagaatcctgtgttttttctattcctccgttttttctaccctgcgattcaaagggtccctaagttatcaatgtgtgcaaaaataattcttgcaggttggaagttgattcatacagcaacatgcaccattgaccgttcatttaaaaagaacacaaagtacagtgcctagatcacagcggatgaggatactaactttacttctctctaacttcgagtcattgacaaatgactccgttgagtagaggatccacatctcagtgacccatattagagaggatccacatctcagtgacccatattagagggaagtaagtcaaaggatctcgatccgatcacagcacatctgaatataacacaatcgcagcagtaagtaggttacatttacaga

SEQ ID NO: 22076 - DNA, 749 bp, Oryza sativa
gcaatagaccctttttaaaattaaaatttaaatgaagaaatttgcaaatattcatttaaagagcatataaacttcaaatgccataacttggccttttgaattcccggaattggaccgttcaagtctctaatttttccttaagaagtcaagaacccaattttgtgctttgttcctgcttgttatatggagtttattagagtaaaagccttttcttttccgttggttgtgtagacgccgcagcttcggaagatccgctcttcgtggaggttgaagccgacgtttgggaaagcgagcaagacaagtcacatcatcctggaacatattgaatcccagtttacaaaattattttgatttaaatttttacattatcgctttatttaaattcccgcgttatcaatgttttatttagccatgcctatttacctttgttatgaccttattagtattgctattgttattattaccttgttcaccctagaataaacaaaaccccaactagtggacactctactcatggtaccactagtatgattttaggtagatgcttcgctggttaattaggcaacattaggtggttttacaactctagactttgggaatattcatatcacctggacactatggaatggttggattattgtggaattggattcacacctccccctctattcaaaaccctcaaaatggttttaggctgggcttggggtgcatggttttgatagtagcacctcggccatataaggaccggt

SEQ ID NO: 22077 - DNA, 1501 bp, Oryza sativa
gataatatattttttcatcttttagagaaggtattatgagatatcgtattttttatgtaaaatttggtatatcttcaactactagatattccatgataccaaaatttttatgtgtaaataatttagatatctcaagatgggccaaaagtgatcatttttgcatgcggaactctggcccgtctaccaggaaagttatgaaaaaatctctctttttctatgctagtggagcacccgcatacgaaaattcaacttttgcatgcgggtgcttatatcgtccgcacttaaaaataaaaatctgaaaaaattaaaaatcgcaaaaaaattctagccaccgccgccgggctcctccctctgccagcagatccgggcggtgcccgccgcccgctggatccgcgtgggagccgctttcgccacattcgacgtgtgacggagcctgccgccgtgctccatcgctgccgctcgccgcccgactgttccgtgcaaggaagctgtcgttgcctccttcaacgtgcgggggagcccgccaccgtggtccgttgctaccacccactgcccgctgtcagccacgccatccgccgcccattacgaggccggcggaggcggatccgctcgccgcttgccgtcaaccacacagcccgctgctcgttgtcagccgcgtcgcccgccacaaaaatatatttaagaggcccgcctgcgaaacgggcgtctctttgagaggttcgcctgtaaaaataagcttattttagcgtgcgaatccttaagaggaccacttgtgaaaatcgatttttgcgtgcggtcctattaaggagctgtatgcgaaaatggagtacgattttttacatactggactagttacggtctgtctgcaatctaaagaggatcttgtctagaaaaattatttctgtagtagtgcataccgccatggcaaggaatggctcgctctttcatctactcgctggattggagacgtattgtttggcggcggccggtggcggtggcccgtgcggtggccgggcgcaaggaggccagcagcccacggtcgggcggcgacaacagcgactggattttttttattttgtgaatttttgtagtgaatgatgaatggtttgtatattttattggatattttttttgttgatttggggatgatctcacaagatttgtagattgtggatgtgtatgtattggggatgatttttgttgtgcttgatttgtggaaatttttattgggcatgattgatgatttgtgtggatttggctgggggaatagatacaagcagcaaaaagaaccaataaataaaagaaaaaaaacagttgggatgtggcccctatccatctttaaagatggatttttaagcccggttatttcacccgagactaaagatacctatctttagtcctgaattcgtccttcctgttgtaaaacccggagtacaggggttcccaagagggagtaaaacccctttctccactagtgttaactaatttatcctccattata

SEQ ID NO: 22078 - DNA, 1501 bp, Oryza sativa
catccaccgtgatatcaaggcaagcaacgtcctcctcgacagtgagatgaatggtcgactaggcgattttggcctagcacgattacacgaccatggagttgatgcacacacgacatgtgtggcagggaccagaggctacatctcccctgaactagcgaggctgggcaaggcgaccaaggcaaccgacgtgttcgcgttcggtgcattcatcctcgaggtcgcctgtggccgtcgcccgataggcatgaactcatcaggagaattgcaagtgttggtggacttcgtgctcagattctggcagcgagatctgatcctgtgcatgttggataccaggttgggaggagagtttgtgacggaggaggcagagctagtgctcaagcttgggcttctctgctcgcacccgtcgccagcttcaaggccaagcatgaggcttgtgatgcaatatttgtgcggcgatgtgctgttaccggcgatgccggagagttaccggagcatccggagtttcagtgagatgcaggttgaaggtgatcagcttgatgagaatcccttattaagacagtatctgtcggtgcaaacgagtataaccggtctctctggtgggagatgatactgtcaagtgtcaacaactagagtttaattagccgataccaaggagaagagaaatcttgatatggattaaattaagaagagatttaggtaatttgagccagagcagacccgaacagaggtttttagttcagtgaacacacgggaagatcggcctcgatatatatattttgtgattttattattttgcggtttcatttagacttaaagatacgctttatttgtgcgtgtaactacttttataccgagcaggacacaatatgctagccagtccgaattccatcgaaacaggaatggaagctacggctgtgtttagttccacgtcaaaattggaagtttgaagaaattggaatgatgtgacggaaaagttggaagtttgtatgtgtaggaaagttcgatgtgacggaaaagttgaaacggaaaagttgaaagtttgatgaaaaaagttggaatctaaacagggcctgagtagtgatgtgtatgcaccatgcatttatttctctatgtaggtgatgagctcctagtctatgcatcaaacgagaaatgtactcgtgtactccctccgtccaagtatttgacaccgttaattttttaaaatatgtttgatcgtttgtcttattcaaaaaatttaagtaattattaattattttcttatcatttgattcattgttaaatatacttttatgtatacatatagttttacatatttcacaaaagtttttgaataagacgaacggtcaaacatattttaaaaaatcaacggcgtcaaatatttagggacggagggagtatatataagcaatatgtatcatacatgtacaatactatacagtgtgtaagcgcctggtatagctgtttgttcattttccatgcaacttcatatacatatatatat

SEQ ID NO: 22079 - DNA, 487 bp, Oryza sativa
tcccccaattttttaatattactattttcttatcatttgattcattgttaaatatacttttatgtatacatatagttttacatatttcacaaaagtttttgaataagacgaacggtcaaacatattttaaaaaatcaacggcgtcaaatatttagggacggagggagtatatataagcaatatgtatcatacatgtacaatactatacagtgtgtaagcgcctggtatagctgtttgttcattttccatgcaacttcatatacatatatatatatatatatatatatacactcatcatacagctccttgtcattggagctagccggcacacatttttgttgaggtttgctgcacagcatataaaaatgaactgcaccggtaaactgaaaaacggacatatcttgttggttcgttggttggcaagtgtgcgtagcctgctaaaacggcccagcctagagcccacgtactatatgacgggcttagtaga

SEQ ID NO: 22080 - DNA, 525 bp, Oryza sativa
tcgcagtagatcatttcctacaaaattgttaatcactactacaacaatcaaaaagcttaaaagcatcaacagaagctcaaaagatacattaaagggtattttgctacgccattgcggccaatcctccaatctacacgcaaagaatacaccgagaacaccgctctcgtgctactggttcaatgactaaaattttgacaataggaggccccttttgctcgcccatcttcgtttttaggtcaaataccccagcaattgtaaccacagtcacctaaatcctcactgagaaggcataattcaccttgataagatcaaattaggccatccagtctgagatcccgacctagaccactcccatcagagagctccacaaaattctcccgaaggagcgccaagaaccagccagaaaacactcaaatcagcaccggaaccccccaaattcccccaaaccaagaagaattcctcccatccgcacccaaatcacagagatagaaccccgaaacaaagctccctagccaccattccagg

SEQ ID NO: 22081 - DNA, 290 bp, Oryza sativa
ctgcttaaatctgtatgtgacgagtagaatgcgtgctaaaacttgtatggcagatatgtgaaaaaatcgtgactgtagcattagaggaaactagaaacaacaccaattgttccagttgtatttttctgtccatatagttctcgtttggccctgaagagtgaagagtcagaaaagtgtacacgattggtgtttagcgtgatgttgctgttttggaaatttagaacattgggtctcgtgtctacatgattaacaagcttcttagatgattttgatgttctgacttgttatct

SEQ ID NO: 22082 - DNA, 268 bp, Oryza sativa
agtaatttgttgatgcttacattagggacagaggcaacacaaatgcatggtttgagttgttctaattttaatgatgttgcatcaatttttgttgcttcagtgaacggaagccatgttccattgcccatttggttgtaggtgtaacttggctggccggctgggattgtggagcatggagcaaccaagctaatgtgttgtgatcaaatcaaataagcgcatcagtaaccgccgctgccgccaacgcttgttcggatgggcacgttggtga

SEQ ID NO: 22083 - DNA, 386 bp, Oryza sativa
tgattttggggtttttcatcatagtttattttccagcctttgtcttttagatcgctaaaaacacggatataaaaaatttatttgcaaattattttctgtttacaaatatgccgtttcacttattctgtcaataagcgaaacgatgggggtcctaatttcaatgcatgcatgcacaccttgtattatgaaacgtgaaaaaaagtagttgtgccgtatattttggaatggaggtagtagtttgcaagttatttctgaaatttgttctcgtggctatgtgcagtattttgagcactgtttttaaggtgtttaattaggtcctgtttcttcaagagcatttccacaaatcaaatattaggactgctaagaatgtattaatgctttgagta

SEQ ID NO: 22084 - DNA, 163 bp, Oryza sativa
tcctgcagcccttgctgcatgcatgcacttcgccactcctgtcgtcggccatccatgctttgtggcatgaggtgccatacaatttatttccgagatcgcgcggaggggactgggctttggtcaatcgcgagatcgcgagtaatcctagtcgcgtgcgagatca

SEQ ID NO: 22085 - DNA, 395 bp, Oryza sativa
cttcctttaaatccctaggccattatgtaacctccactcaggctgcctcactttgaaccagccaacaagtagagccgcaggctcagaagattattgtctttaacctcccaaagatagaccaatgcccatacgacgtcggagcagatctttcccatcaaatctgactgaattttgctcgatctcccaaaattggttgagggctttcaatccactcgatctactctttccgtcttccaaaatcagaggtaaaactcacgataaaaacaaccggggaagatcgcctatagtcggagattaaatctggtaaattaaaagtcgcatcaaaaggggaaatcatgtagaaaatgatgagagaagagcggggaatcgattttttaatcaattagagtagataa

SEQ ID NO: 22086 - DNA, 165 bp, Oryza sativa
tcttgttgattacaggatgaaatcaactgcacgctcatacattcgaaggcgagctttggacctgcattggagttaagcagatttcccaggcctcgtgttttctatcaacacgcttttggcaggcctagtgggaccgattagaagtcagcaagcaattcttcctca

SEQ ID NO: 22087 - DNA, 512 bp, Oryza sativa
acatatttgcgttatagtttatgaaaccagatgagagatatgtgagttttgtgaacaatgttactaacactttgtcgattaagaaatgtcaaaaataaaagttatagatcttgataagttataacaactttttttttgttgatgactttttagtatttgaaaatgttgttttaaagttgtcatattttcaaattcaaatttaaactgataaaaaaggttacacagaaaaatgaccaaaataaaagttgtaaatcttgataagttatacaactttgttgttgacaaattttccatttgaaatcctttactactcgaaaaattattttgactaataaaatgaattattatactgcagttaattattttgctacaggtcgactcacaaatataaacattccatatgaaaaatagaaaaaaatactaagtcatctcaatcgattacggatgagtcatctgtggcgggcctagttgttatctcaatcgggccctaagttggtgcccgtaacggatga

SEQ ID NO: 22088 - DNA, 172 bp, Oryza sativa
ttatccaatgttagtttctaggtttgtacactatataaactttacagtatatattttcgaagagttttttctaaagaacagatccgatataggacttcttcgcaaaatacccccatccttcctgcaaacagatgggacaggattgccatagctagagcaaagaggaaccaca

SEQ ID NO: 22089 - DNA, 1132 bp, Oryza sativa
gccacgccgccgccgccgtcgccacgccgccgcgccaaccgccgccccgatgccgccacaccgccgttaacgaacgagaacgagaacgatcgaacgaacgagagcgagaacgaacacgtcaacgtacgttgccgcgacaacgtgaacgagaacgagaacgatcgaacgaacgtgaacgagctagggaacgtgaacgagcgaacgaacgaggacgaacgttaacgtgaaatgcaatatatatatatacatgtatatatatacatgtatatatatatacatgtatatatatgtatatatatatatacatatatatatatatatatatatgttacttcgcatttatcctaatacatttttttatcttgcagaaaagacgtgttgtcggagtcgtccgtcaagcctgagtggaagagctagccctagaaggaattggagcaggcaagtgacgtaataatataaatgattgttatatttgtaatgcaattaattaagattattagacctgtaattagacttatcatataagattgtgtagtgttctaatattatttgagttttaatataagattattttattgcaaattagacttagtatgacattattgactacggaattggtgcgactcctaggaattgactattgtagtcttaattagacttagcatatacgcacgaaacacttagcatacattactattttagtcttagcatgtaatattatttgagttttaatataatattactttatttgtaattagacttggtatgtaattattgactacggaattggtgcgacaagtagcaattgactattgtagtcttaattagacttagcatatacgcacgaaacacttagcatatacatgactattttagtattagcatgtaatattatttgagttttaatataagattattttatttgtaattagacttagtatataattatttactagctagggttgtataatatacgtcacctagacttagcttatatcacgatttgtaattagacttagcacgtaaggttgtgtagggttctaatgtacgacatttacacttagcatacatgacttagattgttaaaacataaatgtctcgtgacttagcagatgtttcttgtatcaacaga

SEQ ID NO: 22090 - DNA, 1501 bp, Oryza sativa
tccctcggattcatttggaaacctctcccctaacctcgccggcgccattaatggcggccaggtctcccgcgcccatttccccctcctccggccgccctctctcactcccaaccctatataaaccctccccgagctccccaccgccgtttccgccactcaccgccctcttcccccgccggaatcgagctcgcgccgtcgctctctctctccgccgtcgccgccgagctccggtccaccgccgtcgtcgccccggaccacctcccacctcggcgccgcctccttcggcttcgccgcatcctcaccgacctcgtccacctctccgtttcggtcgccgaccgccggagcaccgtcgaccccgtccacccgagccgcgccgccgccttcctccgctccggtcgccgtttccatcgtcaccgtcgacccggggtgagccgtggaccgccgcttcgtttccccctttccctcccttccctcggccgccgctccgccgtgcctatggccgccgccggcgaccataggggcgcgggcgcgccacctcccgccggccgcaccgccgaggccgtcttcaggcacgcctagcggctgccgcgtggggcccggccgtcagccgcccgcgccctcgggtgcggctgacgcgtggggcccacggcgccggccggtgtgagccgggtgcacccggtccaccgtgggccgtgagactgccgcgtgggtcccactcccgtggacccggtccgcgcgccccctcccccggctgacgcaataaatccatttttaaattaaaatttaaatgaagaaattcgcaaatatccatttaaagagcatataaacttcaaatggccataacttggccatttgaactcggaattggaccgttcaagtctctaatttttccttaagaagtcaagaacccatttttgtgctttgttcctgcttgttatatggagtttattagagtaaaagccttttcttttccgttggtcgtgtagacgctgcagcttcggaagatccgctcttcgtggaagttgaagccgacgtttgggaaagcgagcaaggcaagtcacatcatccttgagcatattgaatcccagtttataaagttattttgatttaaattattgcattgtcgctttacttaaattcccgcattatcactgttttatttagccatgcctacttacctttgttatgaccttattattgctattgttattatttccttgttcaccctagaataaacaaaaccccaactagtggacactctactcatggtaccactagtatgattttaggtagatgcttcgctaattaattaggcaacattaggtggttttacaactctagactttgggaatattcatatcacctggacactatggaatggttggattattgtggaattggattcacacctcccactctattcaaaatcctcaaaatggttttaggctgggctcggggtgcatggttttgatagtagcacctcggccatataaggaccggt

SEQ ID NO: 22091 - DNA, 1501 bp, Oryza sativa
gttcagatttctttttttttgtgcgtggaaaattcagttctatttcttgacccccttgtaatgttttcaatttttttttcaatactgaatacagcctggtgtcaattaagatggcataacttaaaatgctacgatataattaataaaacaatgtatatgaaatcaagaacaatattttcttatacttgtattttctttgctattatcacactacaccatgtcaaagaattgcccacagatgtgtgtgggtaaaaatagagaatcaacatctaaccttctgtctgtcggtaaaagcttgtgacataccatctgtcgggaactctatggttttctaggggcaaactttctgtcgctgattgttaatctcgtgtcaaactgtctgttggaaagaccttccaacccactatctgttggtatataactgctcgtcacctggaccctagatccagcctagctcctcttgattcttcaagccgccgccgcctcactagctttcttccacgcgccgttagacagcagctcgtcggcgacctcctcctcatctcctatctggcgttcggtggcctttcgagggcagagaggcacggtggggtgcatccgcacagattggtgcggagttgcggccaggcgaaggcagctaggcggagtggacaccggatggggcgcaggttgatggacatccggttctagagttatttggggatgacaaaagtacacaaatggttctcgcccatgctatcaaataatcaaaatactaattatactgcaatgattgatattgttgtctgactgtttgttgtatctcactatagataggtctgtcgggaaagctaacatatctaggtcatactgtctgtcggtggattccattaacgacaggctactcagggacacactctttctatcggtaaaggtcttttccgacagataagatgacgtgaaagctggcctctgccgacagatgttctgttggtgcttttaggacatggtgtagtgtcatcttatgaagatggcatctttcaatggaaattactccctctgttttaggttataagacgttttgattttggtcaaagtcaaactactttaagtttgatcaagcttgtagaaaaaagtagtaaaattttcaacctaagacaaatttattatgaaaatatattcaattattgatttgatgaaactaatttagtattataaatattactatatttgtatataaacttaatcaacttgaaacagtttgactttaaccaaaggcaaaactttttatagcctaaaatggagggagtaactacctacattcatttggagcatgtggaagagccatagcacttttagtaaatccagctgtggcaaaaccaactggtcattaatttggagcatgtggaagagctatagcacttttagcaaatccagatgtagcagaagcaactggggatctatcccattccctggaatggtagtgatgctcatgtggtgctcagatatagttgtacaaaac

SEQ ID NO: 22092 - DNA, 908 bp, Oryza sativa
ctaacactttgatatagttgtgaaagatatgtcctgggatcgaattattattaagctaagcttttgctcatggatccatactttaaaggctcataaagttaagattaattaagatatgttctggccaatacatgtataaataagagcctaactaagatcctagatgagggggacttaattttcaatcaacacccactaagttaagcttgagtttatttggatactatagtgaactgtatgtcttgttgtctcggtgacgcataatgttgttgaaaacacatcgcttggggagctattttatttgataaactcgtcagctagtctcaaaatcaaggggagaatgttggttaattttatcggctaatgccggttagttaggataaggataaaatcccaccgattttcctatcctaacaagaaataaactaagagataaatctgttttgtgtgatcggtacaaaatagattcgaattttagattgagaaaacccccgagccccaccagtgtcgcttatataaagaaagagaaggagggaggctgagtgactacttaactctctccaagcataaaccctaattcaatcgtccgatcgattagacactagaaggggttcgtgaggtatctcagtacagaagaaacaaagaagaagaaagaagagaagcaatggcttcatctcacgtcagttagatcaattaatttccgcataagcagaagatgaccatgtttaggctaagattcaattaattagttggattaaagctagggccaccatcatgccgtgcaatcaccgccgctagcttcgccaccgcgggagctacctcggccaccacttcgccctcatagaccgacagccaaatcattacctccaccgcgaaattcaatcgccgtctcttccactgtctctagc

SEQ ID NO: 22093 - DNA, 1501 bp, Oryza sativa
attggcttcttctgctcggcctccttttggcttgaacttcgcatcttctctagcttggcgcgccgcagagcgaatgctctctccccatacttgacaatgcccatgatgaacatgactgatgaggacacccggacaatcgtgccgccgctactgaagaatacattcttgtacagtatatagattgttcccaacacctgcatgaaaaaccctatcatgtcgcgccatgataggatgttgtcttccaaggagtaggaggtgatgttgtccggaccaccagcatggaacatcagcaatgcggcccagatcgtcaccagctgcaccgactgggacgacggtgtgctgccgccgatggaggacagcttgccaagcgcgaacgtcggggcccaattagccaactggtacgccagccacaggaccaacgtctccatgcctgtggctttacggcggcgaacatcggcgaggaagacgaggaggagttgtgccacgaagctggagagtattgccaaccggatcatccacgcattccagaagagctgcaagccaatcatccatccaggcatcgccgaccctgctatagtgaatgggtacatgttagtccacaaggacaaaagattaacgcaaattacatgttaagagatcaaggacaacaactgatccaggatatataaaactgaatgaatatccgttacacctcccagtataatcactgatcaactacgcacctgattgatatcccagtcaagcttggaagctacaaactgctatgatagcagggagttataacaagacgtagaacttgcgcccatctaggatttatgcctctgttgcatgcgctctacatttctatattattagcccaaaggtttaatgcatgtcacagtggatgccagcgtgatcaaaccttttcaatcatccgccttattctaagttacaaggagcgcactgcatgcatgtgcttttgtagccatgtaatagaaacaaactatgggaattaagtaaaggtaacgtacactcatctataattgttttgtacaactatatctgagcaccacatgagcatcactaccattccagggacatgcactctacatttctatattattagcccaaaggtttaatgcatgtcacagtgatcaaaccttttcaatcatccgccttattctaagttacaagcatatactagctaggtacgcactgcatgcatgtgcttttgtagccatgtaatagaaacaaactatgggaattaattaaaggtaacgcactctcatatataattgttttgtacaactatatctgagcaccacatgagcatcactaccattccagggaatgggatagatccccagttgcttctgctacatctggatttgctaaaagtgctatagctcttccacatgctccaaattaatgaccagttggttttgccacagctggatttactaaaagtgctatggctcttccacatgctccaaatgaatgtaggtagttactccctccattt

SEQ ID NO: 22094 - DNA, 1221 bp, Oryza sativa
aaaaaccaacatactgctagatgtgatacattctaatacaacgaatctagatatacatatgtccagatttgttgtattagaatatatcacatctagttctagatttattttttttgacggatggagtaatgtaaaagaaaaataactgatccaatcaaatagatgtgtccaatctcggggtttttaactatttaccactcttacggagtggcatactgagatgccactcttccaaattttgttacacaaacactacatgagagaggtattttcctaattaaagtgccatatcagccagagagacttaaaataacctttttacccctagtttaagaaatatgagaaattatatacaaacatatataagaaaatattatttaggagtatatcttaaaaaaaagagttatcatgggcaaatataggtcgaacaagttcaccataatttataatagattcaacatagggtgaacttgtttaatatatatttgtccgtgataactctttttgagatataatatagtacgtacttactacgttgaatctattattaaattgtagtgaacgtgtccgacgtatattgcttgtgataactcttttttaatacaatatactgtattgaatctattattaaatttggtgaacttgatcaacgtatatttgctcgtgataaatattttttgagatataatatactatgctaaatctattattaaattgtggtgaacttgttcagcgtttatttgcccgtgatagctcttttctaagatataataaacaatattttcttatattgtttgtatatatctctcatatttctcaaattaggggtaaaaaggtcattccaagtccctcttgttgacgtggcactctagttaggaaaaatacctctcttatgtggggtttgtgtaaaaaagtttggaagagtagcatctcaatagtgccactccgtaagagtggcaaatagttaaaaagaacctcaatctccccgtgataaacccagccaaacacgacacgcagaactaaaataaaacacaaggtacaaacaaatccactcaaaagaaaaaagaaagaaaaaacagggtacaaatccgctgctaaacacacagggttttagcagagcttgtgttgtgttgctcatccgacacccaatcccagacggctctgctctgtgtctgtctcctccgctaccttttgcgttttcccccctccaactcctctcta

SEQ ID NO: 22095 - DNA, 1154 bp, Oryza sativa
ccccccccccccccccccccccggcgcactttcagctaaattaaacattgtttcccgctattgttcaccgtccgatctcacactagataagagccaacctaataaaacgccaaaactagccatcttcttgggaacacaagacccacgcaccaacaggtagcggcaaatttcatccattacatgccagaccaaccatatctgtagaagatcaatttcgagctataactagtcgtgaaagaaatgcaagtatggtcgagttaggcaggcagatagacatacgaactacgcttatagatttgagatttccacgtagcgacagtatcaatggcggttgatctttcccaatcaatcgttcacatatttgtacccaaaaaaaaaaccccccacttgacccatctatcgcttgcgcttgtcgataccggccgctgaatattccacaaatccgcctttttttcaaaaaataatcagtgttaacacatataaattaaagatcaaggcgcttaagatgaggataagtaccatgtatcgtctgtgttctgcccagcagcgtcgccgtcacgtgttattcttctgatcatacgagatcacgagacgatggacttaattaactgtgtttgtacgctgcagagtttaatttgcttaaagcctggcctctgattctgcttgtttaattagttctcgtactcagatgtgcatacatttcattgctagtactccaattcggtcctttatcgaggaacattattcggtccatttcgagagaacaatttcaacgcatgccaaagaagggtctcgcgaatgttccaatccatcgaccagcgaacaaacaaaaccttgacgagacgacgatgtaggtaggagcagatagctcgctaggctgttcccttgttctcctccgtacaccggcggccggacgctgcaagtcaaaagccctccactaactataactaacatctcgcccctttttttttggggctagaactagctactccatgcgagtccttgtttggatgggtcgcttggaaatgcagaaaatgcgaccgcattttgacacccttttccgctcggcaaagggtatctgccacggttggcgccgttcacacacgagagaatcgcatgagccaccgtgatttcgatcgatttgctcgcgcagg

SEQ ID NO: 22096 - DNA, 350 bp, Oryza sativa
ctccctccctcccgtcggccggcttgcgctgcctcctctcccgccggccgccccgacgagctcgcctcctccctcgcggcgatggacaacgcatggccgacggcgcgcgaggcgcctggggcggcggcggccatctctctcttgcgcacgctcgcctagcagtccgccgcccttctccccgatgggcgccggcgggagaagagggatcgaagccacgtgcctctccccgtccctcggccgccgcggccctcctcccgtcgtcctccccctccaccgcgccctcccgttccccccccccggcgccgccgcctctacttcctcgccgccgcggccggggacggccgcgccga

SEQ ID NO: 22097 - DNA, 630 bp, Oryza sativa
cgtccgctggttagacgctgtctaccatgcatacaaaaccactctttacgttctgctggtttaaatgtcccaagtgctaccatatgaatctatagattatatcacaagtctacaacggctctatgcaattttgaggcattctgcctttgcttctttgtagggggtttgcttggctgcatgcaactaggcattcgagtttttccatgttttcctgcctaatggatcttccccatttccacgaaacaaaaatagagtaaaaaattgtttctctggagtctggataatggagaatacacagtgaaatgaaaaaaaaaagatcttccatctttcttatttccataaaacaaaaatatttgtttcttcagtgtgaaagaaaaattctacgtgcgttgttgtcatttctctgtttggttggcctcactagatagatgctggagtgttgatcagttgcccgctttatgatcaagaggagaccttacctaataccaatgaacttatgcagaatattagggatgggacaaattatggtgtttggtggagcaaaggtcctcttaatttttatccataagtttgtttcgcaggttattgttttcctttcttctagtctttgtttgttatgtttaccatgca

SEQ ID NO: 22098 - DNA, 603 bp, Oryza sativa
cgaatgagtttgcacgttacaaatgccactgctttctttccgtacgtacaaacgttgtacatgattgaaaacaaaattttcctaatcttcgctggaagaaaaaacatatacatgtacataaaacagacagaaaaaacatacattcaaatatgaatttctacaatataaagataaaatatattacttcccaaatataaatatatttagttaaattaagaactataagaaatatccaatcaatgttcttttaaaccatcttctaaatctatctgttatatactaaaattacattaaactttctctcaaataaattagagaaaccctagaaatctattatatactaaaattctattaaatgtcttgtaaacactactacattatcgcgtgacgctctaataaaattagagaaatcctagaaatttagagtaaaaaaagaaaaccatccaaccttgaatttttacttaaattattagacccgctattttaaacattggattagagctcttaaaattcccatgtgttgacgcgaaaaacacgcactggtctaaatctggcacattaaaattccctagtttaacatatccttaatacccctgtcacagt

SEQ ID NO: 22099 - DNA, 211 bp, Oryza sativa
agtgaaaagattggtaaatccctggtgcattgtacaactaggctaataaaaaggggtccaagataaaccgaatcgaacaccgaagaaaaaaaaccgatatttaggttcggtcctttgattttcgttttgtttttatttggcccaccacaagtcaatcgcgcccctttcttctccccaaagaagcacaagaagaggaagagcttggcgacga

SEQ ID NO: 22100 - DNA, 1501 bp, Oryza sativa
tgctagtaggacgatgatgatgcatgcatgccgttcacataaatcgatcagtattgtttatttttagtgtgttgttcgtctatatgtactttatataatatacaacatgtactatgttttcgttcctttgttattcaatgagttaaacctgattctatcatgcatgccttctattggacaggaggggacacgagctagcccaaggttttcaattggtccaagggattgctgttgcttgatggaagaaaaagtctgagttggaaacaaacttcaatggctcaacacccacttccacgttagtagattttttggggcacacatcagcagcacatggcgatgcttaatgggtatagaaagtgtttattccctcactctgactcagactacgttgcttctcatcttatttttaatttctactactacaatcccgtaatctttcctctttttttcaggctcacccaccgacatttttctagcaccccacgctagctccccctcctttctgagattctagaaaacccagcagcatgtctttgtgtgtgtgattgtgcaagaaagaaagcaaagaaagggaaagggtgaagcaagaaaggggagaatctgatcaatttggtgagctaccccctccttccttcccgctcctaattcccctccctcttgatatggaggaagttgtgcacttgtttaacccgttactttattcttggttggtgtacatgttgtaaggttagggtaggccgagtattccatgtactcatgcttgctgcatcggaattcacacatccagctgttgcgacaacagtatcatcacgagtgtattacgtcaattttatggctattttgtttgttgtttggttaagtttgtatagtgaaatggtcatgatggtggcaggactgttcgaactagtcttgctgcaatatttgaattctaaagaggaaggttccttttttttaaaaaaaaaacccgaatatagaggaaggttggactgtttccatttccatgaggacatcctggagtcttgagtcttgagaggacaaaatacaggtaatcctagtagagtaagctcagctgttcatgttcaaacaaaagaaatattttaatggtttaatctccaacgatgtatccttaagaattgtaaactcattcggggtttggtggtgacattgattacagtgctaaagaatatttttcgtggtactccggtccagtcagctgccccccttttggtgccatgaaacctcactctttgcattctttctgttgcatgagtccaaagataataccaccagatctactacagttaaaagtgcttatctgctccatcaaaaagagaactagtactacaagcatggtatccaaagcgatcaattgagacaataacaatcctgaaagattgttttcatagcaggtgctttcagagtttctgtcatttgctctggcatgcaaggatttagctatttagcatgaaaactgcttatgcgttgatgtaaacacgtcacc

SEQ ID NO: 22101 - DNA, 832 bp, Oryza sativa
tattaccggtgaccctcgtaattcagtggtttcagacacctagcttgagtccggcgaaaaaggaggcatcatctccagacaatgtcaaagtgagcactaatttccattcacacacttgtagtaaggtcagccacctgatcagtgtcttttcactcagcgatatatttcttttttgctgggaatgctaaagttggtcagcacatctgtgttgtttatcatcgacagcaacaatcgccaatgaacgatgaaagtttttttttgtttgaaggtcccaacttaactcactcgattttcacatgcacatttttttaattactgaacggtgttttttttaacaaaaatctatatgaaatctatatgaaagttaatttaaattttatattcatattaattttatttttttaaaaaaactaaaacttaattaatcatacgttaatgagttatgtcattttgcatgaactagggatgaatacctaacccaagcaacgacctcagccttaagtcgccgacgctgaccaactttgaccatttgccgtggcagttcatgccttcatgaacccagaactgacagtggaatatgttctcattgttgcagacttgcggtggatgctaccacgcgatgacacgagtactaaagttgcgagatggagtaatataccgacatactccaaggctactatgcgtctatgcctaaatgaacttttaatatggacagcttgacaaaaccgtactaatggctttcagtgaaggactagtaaaatgagaataaatatggcatggcacacagagaaatggtaatcttgggtggctggttaatacggaattaaagtca

SEQ ID NO: 22102 - DNA, 1501 bp, Oryza sativa
agctggatgtgtgaattccgatgcagcaagcatgagtacatggaatactcggcctaccctaaccttacaacatgtacaccaaccaagaataaagtaacgggttaaacaagtgcacaacttcctccatatcaagagggaggggaattaggagcgggaaggaaggagggggtagctcaccaaattgatcagattctcccctttcttgcttcaccctttccctttctttgctttctttcttgcacaatcacacacacaaagacatgctgctgggttttctagaatctcagaaaggagggggagctagcgtggggtgctagaaaaatgtcggtgggtgagcctgaaaaaaagaggaaagattacgggattgtagtagtagaaattaaaaataagatgagaagcaacgtagtctgagtcagagtgagggaataaacactttctatacccattaagcatcgccatgtgctgctgatgtgtgccccaaaaaatctactaacgtggaagtgggtgttgagccattgaagtttgtttccaactcagactttttcttccatcaagcaacagcaatcccttggaccaattgaaaaccttgggctagctcgtgtcccctcctgtccaatagaaggcatgcatgatagaatcaggtttaactcattgaataacaaaggaacgaaaacatagtacatgttgtatattatataaagtacatatagacgaacaacacactaaaaataaacaatactgatcgatttatgtgaacggcatgcatgcatcatcatcgtcctactagcaaaactaacaaataccttattcatatatcaatacacaattatacaacaccgtagatgctgtaataaaaaactttttttttgctgttaccacatacgtatttcagaaagatgtaccatcaaggacacccaccaaatcggaggcgaagaaaaacccctacctatgcgcgcccaactcacgcatctggtacactcaccgggtacaaccaacaatcccatttccaaaaacaaatcgaactgaaaaaaaaataaaagatgaaacaataaacaaaaccagacacagaaaaaaggaaagggaataggacgaggagcactgggagtgaagtatacctacctaccaaatccagccccgtgggggggagggcctttgcaaatggcagccactcaaccaacctccgctcctcctctcgtctcatcgcaccaactcggtcaaatggcccagagggatccgggtcaatggggccctcccctcctctccctctccctcgtataaaaccaaccaaccaccaccctcctctctctccttgctcacgaaaaagctcccacaaagcatcacctgcaaccagcccccgctcatctccatcttcctcctccctccctcgctcctgtgcttcttctcttcatcaacaagagagctttccctcgatctgtgtgtgtatatatatagagagagagggactgatctgggtgtagcgagctaggtagcctagctagca

SEQ ID NO: 22103 - DNA, 1501 bp, Oryza sativa
agaagataaatattgtattagctatataagagatagaatcatgatccgatcatgacaacatggcgatggatgaatcgacaagcatattactgatcactgatcgatcgatgtgtgtataataacatatatctatatggtgtatatgcaggtggtcactgatcgccgggaggctgccggggaggacggacaacgagatcaagaactactggaacacgcacatcaagcgcaagctcctcgcccgcggcgtcgacccgcagacgcaccgcccgctcaatgccgccgccgaccaccaccagcagcagcagctccaggcgccacggcggttcgccgccgcgccagccggccaccaccaccaccaccctgaccatttcgccgtcctctccaactcgccggaggcctgcagccacagcagcgacgacgagcccagctccgccacgccgccgccgccgccgcgtcacctcggcatcgacctcaacctttccatcagcctagctccttaccagccgcaggatcagaccagcgagccgatgaagcaggaggaggacgacgaagcgtcagcgacggcgaacggcgccggcaatgcagcgatgacgacgacggcgacgacggcggcggtgtgcctgtgcttgaaccgcctcgggctccacggcggcgaggtgtgcagctgcggacgcggcggcgccccctccatgcaggccagcacacacatgtttagattcatcacgccgctaggaggaagccaccacaacagtagtagcacaacaatgacataattaattaagttgagggaggagatatatatacactacttaattcgcaattaaaacccagccacacatgcttagctctttgtaatattcatcaggaaatgtgatctctttctcttttttttttatttcccctcatttgcagcctcggccagagtgatcatcatgcttcatcgatcatcattcatcagggtgacatggttcatgagttagttttagttgttatttctttcttgtcttcctctagtttcttttaacccatatagatagttttttttagggcaagacatgggttgttgatgatctaccattagatctaaacatgcccttttggagacctcataagaatgcatcactcaacacatagctttccaaacactttatttccctcatgcatgctagtagcccttttgcaacttgtttttatgtctccttttatatggagatgctcttgattggccaaagatgagggaggtaaggagtgagtggtacatactgatgaaagtgaaggagggtgcatgctgtggttgtggtgctgctggtggttatgggaagttaggtttcttgatgaatgtttgcaatcacatgagcagccagtgagaaaaggaggcacagtttttaaagaaaaaaaataaagaaaaggtttgtcttgtagatagagaggagggagatcagggggccaggggggagagaatggagagcatgtgagatgctctctcttttttgggggggtt

SEQ ID NO: 22104 - DNA, 1501 bp, Oryza sativa
ttggagcttaattaattaattactggcttgcagcagctggtttatagtattgtttctagctatatatgtgagggccgtgtgtgggatgtgatttgcatctttcgatggcgacttaattaattcgatgatatatttcattgcatatgcatacggatccagcctctgtctatactgtacgattccacatacgtatatgtacggttaagtcagtatatatacttttagatagtcgcgtgtgcttttcgagttcggtagctatattttagattgtaaaaacaagtcagaggctaattttataatctagaaatacttatttccccatatataagcgtatgttaaatattgatggtgtaatctacttatatgtcaggaaacatcattgcttgctttctggcgctttcttctacatatcagtagaggaaaatggaaaaaaaaagatgaattttgatgttgtagtttgctatattcagcatatataccatcagttatacatatgcagatcttgctaaaaccaaaataaaaatagaactgtaaggagatattgtgcttctcggtctatttacttacagtttgttgagaagtaatacgagcaagcaaatgtatatatatatttctttagaactgcaaggagatgcatatacatgtgtgattcaaacacacgtactgcacattcaaactataaaaacaacttgattgccgtagaagttaaaagggagacatatccatgggtttcggattctaaatcaatctatgtgtaaatgaaactttagtatagtaggaaataggttttcaaaaaaaaaagtatagtaggaaatagtatgtgtatatgcctttttaacccttaattacaagttgttataattcagtgttaacaaagtcacggactcacagagtgtgcccttacacaatttcagactaatttgtaaatgcatcgatcgtcacattttatgtggttcaattatctgacacagttaattaatggtggccgatcgatgtatgctcttctagctttccagctatatgcgtatgtaataaatgaataaaacgtgtaggatgaaatgtgaatacgcatcattgtaattaatttgattaatgctagtaaaaaatctgcaaatttgtctttttgaaattaaaatatgccttataaaattaatggacccaggcccctagggcaaaatatattggggcacaaaatcatgtccatatatacattcttatttgaaagtagactctgaaacaaaatatgcccatataaatcaagggaggttacaactaactgcatttgcttatgcgtacatctggattgtaacttctatgttttgtacatacgatgattaattgtattcgagcttcttaattgtacatctattaactaactagttttgcagatgtcatattgtgggagcacgttcactgacgcagcgagctcgatgcccaaggagatggtggccgccatggccgatgatggggagagcttgaacccaaacacggtggttggcgc

SEQ ID NO: 22105 - DNA, 1501 bp, Oryza sativa
atcgatcatgactcgaggtcaaacttcgctgacgatgccatgaaagaccaagccactgcacatcatcagttcagttcagttcagatgatgagaatcttgaagattgcatgaatgaagaaaatgattagtgtgtgagataattttgattgatgtactttgaagattgcatgaatgaagaaaatgattcagtttgtgattcaacaattccttttatcacaatatttcattaatactctgctttatgtacaaactatatcaaaaataatatttatgttagttctgctctcatgtgttaattccaaactattaaatttatcgatcgattgagtcgatgtcgctgccgtgtttcaatttgtgtgcactttgctgctgccgccgccgtcggccgtgctgctgtgcaatgccgcttttttgccgtgttggtgcgtgcgtgctagtaatacgttacgtcgatctgccgtcgtcggccgtctgcggctgccgccgtctctatttcctgtgatgtgttcgtctccacctgcgtgtgtgagtcgcggctcgcgactgccggcatccttccgcgtgcgagattagcgatagccagttactacctccgtttcaggttataagattttctagctagcattgcccacattcatataggtgttaatgaatctagacacacatatatatttagattcattaacatatatatgaatatgggcaatgctagaaagtcttataatatgaaacggaggaagtaattagtttcatacggttttgaaggtagatgtgctccaagatttgtgcacgccaggtggcaagatctcgatagaggtgccatgcaagctttgtggcatggggtgccatacaattttttccccttttttcttgctaatagatggaaacataattgatcatgcagactggcgcgaacgaaaaaaattccggaagtcttgcgtattttttaagtagggttaaagatagatatagattagaaaaaatgtccgtgtattgcaacgggaaaaaaattatcgagcaataatttgatcatattaaaatctacttgtttagtgctaacccttaatttgtgggcctcaaacaggagaggaattacttgaactacatatatgaaccaccaatattactccaatcctatcatgatctagatggaggcttttggaataagattctgaaatagctttcagttaatgccttctcaacacagttagcagctaaaatccagcaagcacttggaacacctagcctgcagccaactaatgagaacaaatttgtactttacaaaagctaaacacctcaaatggcttcagccattcattctctcaccgtcttggagcacacccaccgcaccgtcgttcaaccaacgcacgacgcgccaagaacagcggtgtcgccactcgccaccgccaaccggccgagcagcccgccgtgtcggcctcgcgtcccttgcaagcagtggcgtagctaggaaattttcattgggtagtcctacttcacaaat

SEQ ID NO: 22106 - DNA, 1501 bp, Oryza sativa
ttgtggtaagatctcaaaaagtaattaatgttcagtgcctacagtaagtaaacatctttcttcctaacccctttgccaaaatcaatgctgagagctccactgtagggcttcaattttatttcttctcctgaatttgtaatgagaacaaaacttagattttcctcatagagaaatcctataagtgcactaataaattattgaaaagtacctttgttatatgcgattacatcctccgcaagaagcagaaaactagttgttaatattgttggcccagcaccaccagtgcctgcagtataataaaagaatctagaaaaaggatttagcaacatactagcatagattctgatgaatacgacaacgctttccatacttcatgactagtttgacctttaatttttccaggaaataaataactcctaaccttaatctttcaggttcaccagcattttcacttctagcagcatgaacaagctcagcagccatcactgttccaaaagaagaaaacagtgtatttctaagcactcaaaaaattaagatatgaagcttacctagctagatcaaaacattgtcttcatagtttactgctagatcatgtctctaactctctattatgtatttgatatcttcaatcttcatattaatacatgacactaatcaagttggtgattttacacatatgtaaactgcctcaaagagcaatggatactatccatgagtactgatggaaattgtgaaagagcacatgatgatatctggacagtgtaacttgaaaaatatcaaagtaaactgatatgtttgatagaaatgcgaagtaagaccattgctcactccaggatagatgccggcagttgtaatagctgggataccgcaatcttttgcttgttcatggaaaccctttgctctccacgaatagtctgtatcatcacaaacatcaatatatgccgtctgtaaaaaaaaaaaagttaaggatgtcactaatttcaacgtgttattaaacttatgcatttgatgatcaggcgttgcacatttctaaccttggtcgctattgctgcctgtaggacagtgcactcattctccctttggaaaggtccagcagcatgaacaactaaatccacatctggggcaaaaaaagaaaaactagaatggtcaaacatcagaagaagtttgtggatgacttttcaaaatatttgcaacaatcttttgaaatcatacggccggtgttccaacttaaaagcacaacataagcaggtagttccattactaaccctgtagcacttcctccagcatgttcctgtcgcgaatatctacttggacaaactctgattcatccccgagtttagatgccaaagattcacctttctccctgaccaaaaaaaaaggatactcgacaaatggtcatgctactataatcgtctcattgtacagatggaactgcacaatattgcaggcatccagccaggatgctattgacagaagaaagaaattgttcccactattgaag

SEQ ID NO: 22107 - DNA, 761 bp, Oryza sativa
aaaaggaaaaaggaaaagaatttccagggattaaatattgcttgtgctcaattttaattggtaaaattatttttagagctctgaaaattccactaaaaatcttgtaagcgtatttcgacaatgtagaactcaagaaaaattccacatgccaaatccgattattattggcatcaattcattagggttttctcttgcttttacacgatattttctctggtggattataaattcaatttaggcttgggaaagaacttcagggtgtgacaggtagcttgtgaagttgtatttggataaagtgaagacaattaatgtgtgtatttttctatattcttggtatctccaaaaaaaattatatatggaatagtactacatgtaaaatctcatttacaactagaattgttactataagagaaactttctttaagagaagctaatgttttttttttttccataagggactttctagaagtacagtttgttaaatgtatacaactacaatggtcgacgttccagttcgcatgcacacccagcagcccagaatgaattgaacccgtggtcggcggcggcgcatcccgccggcaagccaaaggggaaagtttcaccggagcaaacgcaagaccgattcgtcacgggctcgcggctagggcatcctgtagggttcatgataccatttcaagcatcctcatggcatggcgcggcgcatctaggtggccaacggcgaattagcggcggaaccaggtgaacacgagtgtggggaaata

SEQ ID NO: 22108 - DNA, 1072 bp, Oryza sativa
aggtggcgcaaggtggccgacaatgacaacaatagtaggttgccatatccgatatcaatgtggctagatctgacaccccgatagtggattccacagaggttgaggagagcaaactacaacataacaacgagagcttggatgcgtcgtgactcggcttggtccatatggaggcgaggcggcaagatgcggctatagaggagggggtgcagcctgaaagatctattccctagaattgcctttgtaagaggagattggaagatctattaccctaagagtgtggtgattattttggtgatttatgacaacacatgttggaagatataggttgagttccgacatcaagctgaaagattgaaggtagaagatggacattacagcttgatgaggagcaagtaaagatattgacgatacggggacacggggtatgagtggctatatatggcaagatcgtgaagggcaatcaagactcggctacaatggatcatgaggaggtgaagggaaagcaagaggcttggcgccgatggactcaatctggtggtgaagggcgagcaaagactttgtcacgatggatcgtgcgaggccatttgaagccatgagtaatccacataaattatttgaagagcgcaagatggaatgccgaagatcaataggatgtaattcgttgatgaacatcaagccaaaagccaaagtggtcattgatcaagacaaatatatagtcaattttggattaatgtgcttaatgagttataggtgagaatagtcctagtagtgagatggcgttggtgttggcaactgtcaaggtaaagcaagaagatgacaagaaaacattcctagtggtatagatttcctatttgcatttgagtatacgaattccgtactattaagagtgatgcattgttgatgtgtttgtttatctctcggtactcaaagtgacccatgcaagtgttaccttgagagaaaccagagccttaaactaacctatgagtggttcagagcttggttgggttggataactgtcagggttacgggtaaggtataccctctacccttcgatatacgtcacatatcgata

SEQ ID NO: 22109 - DNA, 1501 bp, Oryza sativa
gtatatttgctagatccagttgttcatgaacatatccatctaatgtcttcaatcacatgctttgtgtattttatcttcagtactaaacatgagttgtttgattttctaataattaacagggacgacgacatgatgtgaactgcaaaaatttgtagaataacatagtgccataaaaaatatgacagtcaacgtttgcataaagtggacattggcaaatcatatatatataagagtgtcaggttttctgttcactgttgcgtaagctaccgatgcttaattaattttcagatttttgatgcagtggttagcgcctgatctctgccgccattacaacatctgggccccacattaccatatgcattagccttgtctgaaatggttattagcttcagcatctcaccttattgcagaatattcctccaaaagagtatgaagacagtcaaatgatcaattctacgcagcatataccgatcttgcactagctagctagttagtttcctccataaatagttcaaaacgtcatgggtaactgctcaatcaaaaagttaatgtcattccaactgaaaagcaatcaagaagttaatgtcattatattccaactgaaaagcactctatgagtctaaaaggtacgcatcttagagcaagtttaatagtatagccaactactagctccaattcatctatgagtaaatttactgtgtacccctgaaagttcactcaatccctttcatacccctgaaatttacccgatcccttctatactcctgaaatttcaatttgattccttgtatgcccccaccgttacattttccatcatttcactgttacgtttggttgcaaatgtcatttttacccttgatgctttaggtttaaatataagctccaaaaacaattgaaaattttatttgagtgcacagtatgtgtattttataaaactaatgagactaaataattagtgcagaaaattttgacataaattttaaaaataaaataaatgtaataaattaaatttttatttgaaattttaataagacaatggatttttttatcgggagcattcataaaaaaaatgttgtgaacatgggtagtcctatctttatatgaatgctcctcatttttatgacttcttttaaaaaaataaatacgtatttttttatttcattatctaaaaatattttttggaataaataatacatcgcacaacaaactcataactataatagtctcatgcgagaagcttttatatttttaataatgtaattcatgaatttctttgttcatccaagggtaaaatggtcatttttatagaaaatacacagtcaactaacagtcaactgacgggaggggtatgcaagggatcaaaatcaaattttgggggtacacaaggaagtaagcaaaattcaagggtatagaagggattaggtaaaatttcaggggtatataagggattttctctttatctatagtcaatctaatagctcattcatacaatagttacata

SEQ ID NO: 22110 - DNA, 298 bp, Oryza sativa
cccagctgcttcttgatcatcgcagatgcccagctttggtcgttgtcgtacctcgcacctccaccctgttgccaccatccatgcaccacaaggagctccaaaacgtccaagcggttgggaggagtcctctcgctgctcggatgctagcacgccccgtggctcggatccctacccctagcgaggacgcaccagatccagtcgctcaccgcggcagggctgcggtcgccgttgatgccaacttgaatagccaggaacacagcctcaaccaccgcccacgcggcccacttttgcgactagg

SEQ ID NO: 22111 - DNA, 406 bp, Oryza sativa
tttaaataaaacgaatgatcaaacgttggtcgaaaagtcaacggtgtcatacattaaaatacggaggagcactacttactagattgagttttgacgtcatatgtccatattgctcattcgggcttccgtcattctcagccgccaaccatctcccccaaaccagaataattgctacctctgatatgggttgacatgttcccagcccagtttcacaaacccaacatgaaatcgaaaaagtctaatttagttccctttgtaaatgtcagatctaattcatatctttcaaccacaaacctggttatatcgatttttccaactattaaaaccgtgcaaaatgactctctcaactattttgaacgtgacgtccacatagtatcccaatcatcggagaaataaaaaatagaca

SEQ ID NO: 22112 - DNA, 1501 bp, Oryza sativa
accagctcaacgcattcaacgcatcacatcgttcttgacaggatttggtcgtcaagtgatagctttgaggttgagtgaggatgggaagaccatagaagcaatgagtgttcatggtgatgtcaggaagttgttcaagtctattagcgaagttgaagaaaaggatgggaacctctggataggatctgttttgtcaccttttcttgggctttatcgtatatagtttaatacatagagagagaatgcataagttataaaggtagtgaagataatagtatacaagcgtggtgttatgatatgaagcatatgtaacaaaataatagatctagcatttagtgagtgttcaaaataatggttgccaatttttattgaaaaagctaatgtctatcatcattaccagcaacgagacttaagattacaatggtatgaataaaaaaccacctgaacaactctatatttctaattagaaagctatgtattgtgcagtaatgttaggttgtttatgagtttttttttcacctattcgataagatattgagtctggtttgtatcgtaaagttttgattgctctttttttctttaactaatcaaaatatgaattatgacgtagattgtgttgatttccttttgaattttttatgctacttaaacttagcataagcacaatttccattgcgtgtaattattttgtgaagaactcgagcctgactgattttaagaaaaaaatttacctttggccctcaagtcttaaaaccgtcgaacaaaagataaagccaaaatcagattaaaaggccatatttgagcgatcaaaagtggatttgtttatttgtattgtataagatcacaatgtgaaccaaaagaaacacagcaaaagcctcacactactgtgctgtgaacaacatcctttctcccaaattctgcctttgatatgcgtatgtgacaaacaaccttaccttggcaagctaggctactcctgtcatccatcttcagacttcagagcttcaaaaagaagttggttggtttggttgttttacacaagcttgccaattgctcatgtcatgtggtcactccccaagtcaccagcatcaccactctcgcatgctccatttctcccccgagccttgtgtgcaagtccgacttgtcttcttcgccgcaaaaaccacgccgccatcacagcattcgtgcatcccacgaaacccccgttgtcatgtccagataagagctccccctctgactcacacacacatcaccgagaagcagagcaagtgcatctccctctcccaccatttgattcgattcccctaaacccccgagtcgtcgacgccacaaaccccggcgaccaccatggcctcctccctcctctcctccccaaaaccctcctccttctcctccgcaaaccccacctccactccacgcccacgcgcccaaactctctcccccttccgcgccgccgccccacgcttctcccatggcctcgccaccgccgccgccgccgcaaacccta

SEQ ID NO: 22113 - DNA, 1501 bp, Oryza sativa
tctgtcgatgtttcgccactgcgaaccatcggcggggtgtctcagcatcccgtcctgttgaagctcttcagcgtgccatcgcaacattctagcattccccttgttcctgaacaaacgccttagccgtggtattatagggaaataccacatcaccttagcaggaattctcttctttgttagctgcccgtcaacttctcctggatcgtcccgtctaatcttgtatcgtagtgctttgcaaacagggcatgcttctaggttctcatactcctcaccgcgatataggatacaatcgttcggacatgcgtgaatcttatgaacttccagtcctaacgggcagactatcttcttagcctcgtacgttgtctcgggcaatttgtttccccccggaagaatgttcttgacgagtttcaataaatcgccaaatgccttgtcactaaccccattttttgccttccattgcaacaactctagagtggtatccaactttttgtgcccctgctcgcaacctgggtacaacgaagttctgtggtcctccaacatcttgtccaatttatgggcctccttttcactttcgcagtcttccctggcgtcctgcaacatctgaccaagatcatccgcaacgtcgttaccatcagcagctatttcctcctcgctcgtttgatttccttcaaatccaacatactgagcaaagtccggaatattgtcgtcttccacttcatcttcttccatttcaacaccttgctctacgtgggatgtccaacaattatagcttggcatgaaccccgactcaaacaagtggaaatgaatagtcctggatgcagaatactccttctgattcttacacttattgcatggacaacaaataaaacccctttgcctggtagcttcgggcactctcaaaaaatagtgcacgccgtcaataaactctttggaccgccggtcagcgtacatccattgccgatccatctacatgagtcaaaaaaaccgcacataaataattattcttacaataatgacagtcatacaataattataagatatctttattcatacaaaaatcataaaatattacaccaaataattcttaaaaactatttgtaaagttttaaactaattttaatgtgttttacttcttttaatttttattttagtttgttttctattatttaatattaactttcactagagttttccttctcaactattttataaaaccttgtttagcaaatgaactaaatttctatatattctttcttccccacacacattttctctctcatcaacttacaactaaattttggagacaaaaaaagtgtgcaaaacataggtgcaaatgtagtatgacaaaaaaaaacattggaggatgaagttgcaaaccttttaggcacctccgatttgtatgtaatcacaaaaataaattcaatagaaattttggcatgacctcccctcttttttgaagaaattttgaagcttgctcgggcagctggaggaggaagaagac

SEQ ID NO: 22114 - DNA, 185 bp, Oryza sativa
gtggttcgatccgccgctcgccgctgtcgtcaacagtccgttccggccggcgtagtagtttacctcccgccggcccgagtggcagctacgtaggcgccacgtcggcgccagttcggccaagaccgggtcgagccgaccccggtcagtccctccccgtgcgcgtgttccaccgcgagccgtgagga

SEQ ID NO: 22115 - DNA, 1501 bp, Oryza sativa
atattttgacaaaaagttggtgcatactttgcaagtgctttttactggaagttctactcaaggacaatataattaacttaattgtattataattttaaatttttaaattatagttatgaatatattatttgccttaatacttttcaattttaacttaataattctagaatttacagttaataaatataaataagttgtaattgttgccatgtatgtagtcttagttttagtcttttctagattaaatagctccattgaaaataacaaatacaaaatcgtgtttgatttaattccttatagtatgttgataaataattaatcaagtcctggtcttaacttgatttggggtcttaattatgttgtttttattattcaataactctgaaatttgaataataaggactccctcctttcaaaaatataaccaacttctaaaactcaaattttattccaaatatagcaatcaaatacttgtaaaagtttacttttactactaaactacgtatactaccccccactatcatttagctttattataccctcaactactctgagcctattcctcacccatcccgagtaggcaaccaattctttttatcctgctacttaatatatacccatacccaaggctaaaacttgctatattttgggatggggaaatatcaagttgtatttgacttaaagtattaatttagtgattttggaaattcaaaattgataattgcaagtcgtatatgatataagatcttattttgatttgagctctcacctatatggatggcttgatttatttattgcttcttattaatgtgggaatttgcttgaagtaccatatagtactatagattatatatatatatatatatatatatatatatatatatattactaaattatttttttttgaaaataaacatctctcctatcaatatatatttgtgtgcataagagcaggtacaatagcaggctataaaccagctgcaaacatattttaaggagataaataaggagagagaagagcagcgggctacagatttgtagccagctgtagtacggactccaagacacaatgtgtgtatgataagtgggaccaggtattaatagtgtactatgtaactattgtatgaatgagctattagattgactatagataaagagaaaatcccttatatacccctgaaattttacctaatcccttctatacccttgaattttgcttacttccttgtgtacccccaaaatttgattttgatcccttgcatacccctcccgtcagttgactgttagttgactgtgtattttctataaaaatgaccattttacccttggatgaacaaagaaattcatgaattacattattaaaaatataaaagcttctcgcatgagactattatagttatgagtttgttgtgcgatgtattatttattccaaaaaatatttttagataatgaaataaaaaaatacgtatttatttttttaaaagaagtcataaaaatgagg

SEQ ID NO: 22116 - DNA, 521 bp, Oryza sativa
taaaagctccaatgcttgacttgcatgcttagatttacattcagagatcctttaatcttgaaataggcttttgtgtagtgtgaatccctgcaacaaatcacaatgttaatctagaagcaacttccttgtgtcacccaatttcttcaggaatactgaatacaaatagcactgctgttgtttttttcgtggaatggcttattccaattgtaaacttgtaatacactgctggtatggagtatggacatatcatagctgacaaaactgatcattgaacatggatttctcttattgtttctattggatagataatagttactggcacttcttgattctgtcttgtgatggtattcaattaaacatggtctttcttttacttgtgctgtgatgggcatttcaatatttcagtgctaatttctatgaaaatatttcgcatgttgcaaaatatcatagaaaaaaaagggcatattacaacaatttgtccttctaaccatgtacaccagcatttggctaattcctcggaa

SEQ ID NO: 22117 - DNA, 900 bp, Oryza sativa
tgtttctagcgaaatgtacgttctcttgaaaaatttctgaccaaaatatatgaccttgtttttcctctataaatcaaacaatttcacatgaaaattctatgcattttttcacataaattaagctctctatctctctgttatgagataggagtaatgttttttttaagaatctgtttgctcatataaactctactggcttgattctaaacttgggtgggtggtttccgttaccacatcctgttgataagcccgttaccgtgataactgacctttagggagaccttgtttcaactatcactctggttatggaattgtgtttttttaaaaatcggtttgctatgaagttaatgaatttcatgcaaactctactagcatgattctaaacttggataggcggttaccgttatcgcacctcattgataagcctggttaccgcggtaactgatgttaagggagaccttgatttaaactctctcttattacgcaattatgctttttaagaatctatgtgcttatataagcttgtgaattccatgcaaactttactagcatgattctaaacttggtccatacgttacacggtttccgttaccgtatcccgttgataagtccggttaccgcgataaccgacaataatgaagacctttgacttggatttgagctaatgagacaagcattagtagcttccaatccagatgatatccttccatgtttgtaccaacattgaccaatgatggctaccaagtgtactaatgtactgacattttcttagggccccaacaacataaaattgaccggagtagaccacctcatcagtgtgggcccagcggcgcagccaccacaaaatcccctgcgtgtcttccgagttttaaaaccgaacagccaaaaagaagaccaaag

SEQ ID NO: 22118 - DNA, 948 bp, Oryza sativa
catgtcatgtatgcagcatgttggaaaagagtgagagcaatttggcatgcagtcaaaccagctgggcatttcgccttgttggtagggagaatctcatcagttgttctagtgctctataatggagtacacatgcatgccttcagaatactctaatctttttttcttgtacatatatgtctaatgtgctatcctgttcttgcttcgtctcttaaaaaaaggattattttgttcttgccatattttgctactacttaatagtaactaccgtctcaatgtttttgaaaaaaaaagttgctcgctgtatctgttgggcttggaatgtggaacaatgaaattgttgattagcgtatgtattgctgtactttcccatagtgtaaggtgtttcctgtgaatgttacttcttgtatgtctggcggtggcccctttggatacttagcagtacacaagcttgatttgacagaaactaaaccagacaagtcttattagtggtcaaactttgcatacattacatatacatagttacataccatataccatttgcacaatttaaaattttgacgtgtgttatatatcctgatcttatgaactcccaactcaaaaggtttaacactaaattcacgaaaaggtttaacactaaggatgcaatggatcgatgatttagtactcccagaacaaaaaagttttgacagtaatgatattggatccatgctgatagattaggatggggtttctagtaaccatgcaagcaattgctgttttcattactcaacaaactaattaagttcacatagttcttcctttatttgacttggggggaaatagaacaaaagatttttatgatgtattgatgtctcaatcttagcatttttttggacgtgccttgatatgcaggttactatgacctggtgtttgcgcgtcttgtagtccctgtggtttcctttttcaagg

SEQ ID NO: 22119 - DNA, 651 bp, Oryza sativa
tgtggtcttttctagaaggaattgtgagttggatcttggtggtcactcaattctagaaaatgacctagaagtgttgagttgaaggctgtggacttcttctgggatctttgcataagtgaggcaaggggttaatcgagacccggctctttgagcacctcaacggagagtaggatccgtgtgatccgaacttcgggaaaaaatcgcctgtctctcttgtgcatgatttgtgtttgaatctgctggtatcttgtgatttacatcttgtgcaaccttgtgcctgattgtctctagctaggacttgttttgcttccccaaattttgattttctctgttgcccggaatttcctagctcaagaactccggaagttccgggctgctcatctctgccaggaagttccggtgttcttcaccaggaggttccgggccctgttaatttaaccgctgcgattgttgagaaaatttcaggaaagcctattcaccccccctctaggctacatctctgtgcgttcaattggtatcagatcaaggtgctcttgattcaagcttcaccgctttgagtgatccacgatgtcggacttagggggaaaggacggggaaattggaaatgaagatggagcgagcaacaagggaactccatcacccaaggggagc

SEQ ID NO: 22120 - DNA, 893 bp, Oryza sativa
taacctacaatcggctaacatctattaatagaaggcagccgattaggttaaatagcgacgttgtcctagattatataagatatttaccactttatgaaacatccagcggcttgattgtctagatattgttcttcttttcatacttaatgatgcatcagttgagtttgatctattaagttgtgcttagaatatcaatctctagcctgtcctctggttgccgattagggtagtatcagagtttcagccgatcttatctgatttaaccatattcgatctatgtgcctcagtgacatgttaaatccgccctttatgtcaagatcttactgcatttaagtatattaagcttttgtttggtatattatacttgtcttgatatctttatatagagtagtatcggagaattagccgatacatgctagatctatctgatcggctatgctataaacatatataatcctgttattaatatatatttcggtctaagtgatttatactgtctcggcatggtggccgatctatcccaattacttgatttaagtatatattaatataagaactatatatcgttaatatctacagccgatcgaatagatttagttccttactgtctatttataaccaccgatcgattcatatatgacatcggctcaaagataaatgatatgtcatcggcacctagccgatcggctatcatttatagatttaaccacgaattctttgtctctatttcttgttgattacaggatgaaatcaactgcacgctcatacattcgaaggcgagctttggacctgcattggagttaagcagatttcccaggcctcgtgttttctatcaacacgcttttggcaggcctagtgggaccgattagaagtcagcaagcaattcttcctca

SEQ ID NO: 22121 - DNA, 1501 bp, Oryza sativa
acatgctatcaacacaacacaaatctaagtgacgcatccccaatcatgacaccaacatgagatgcatatacatttgcttggattattgtcacggattgtttatttgattaatataatgattaatattttgaagactaaacttaaaaatagtttagaataggttgtctaatcactgtagtggagagaaagtttttttttttaagaaatcatattttttaagaagtgaggagcaaataatccgtggtaaaaatcttgagaaaaattataaaaggagcagggccattttctcgtagcaggtggccaggtgctagaggcaacacaattacacaagcgcaaaacccatatgtaagagttaaaaatcacaagcttatcttcacgccttttcaatccaagtcctggaaggacctgttaatgatttcgataaaaccagtggtgggcctagcaaagaagagacgatcccttgcaaatgcgaaagcttcccaagtgggccccacgcaccagtgtcacagcgccaaaacgccgtcgtccgccgcattcccgctaacgcacaagtgcacaacaccatctctcaacaaaaaaaaaaaaaagaattcgaaatttcgaggacattttgatttgatctcttgatttttactcccatttcaaaatctctcggggggcaatggagctcaccgccgccaccgcgggagcgacccgtgccaccggaggattcctcgggaccagccgtcgccggccgcaatcggtgagctcccgcgaacgcatctacagttagttctctccagcttttctactccatctagggtttgtttgcttgttgctgcgtgtgatgtgaggtttgaggggttttgccgcgggatcgggggagcaatccgtggggttaagcggatgggggaagggggggggggggagcaatccgttgcagatgatgtggtagtttccatcgggtgttgtctctgctctgctgttcgcgtcattccacagagtagaggagattcggcgccgggattgcgattttggttcgccattggcggcgtcgttgattctcgtcgtgtcagctctggtacgttgggttgttggttgcctgcctccccacgcccgcgacctgctcggtggtttggctgatcggtgatcagcaccgtcttggcagtttggcatacgccgcagccacaattgcatcgtctcttgtctgtgtgggggggggggggggggagcatttgcacggcgacaacagcaaaaatgtaatattcaccaagaaggggtggtttcagtgttagtcctttgggattttgatcagctgcagcgattcacactgtttgatgaaaacaaaacaatgaacacacagaaaatagggaaaccctgtatttaatgaatatttacaaatacatgagggctcccgcaggagttcgccttttgccttcgcgagaaatgcttaatgaaaaggtatgctgactggagattgcgtgcagttcgctgattcccggcgcctagcaatgaggctacc

SEQ ID NO: 22122 - DNA, 1501 bp, Oryza sativa
cctgctacccagagaaatgttcttgtaaaactcttctcgcccatggagccacaatatatctttcaactatctgctccacggggcaaattttacgagccacctccttcatcggagcctatttaacacctggctatgaaattcgtcccgaattcatcattacggttagggagaaatctttctctagtctagaccaggaaatctcctatcatcacctgcgagagtttgagcatctgtgttcgtgcctcttgatccaaggcatgccacgggagactattaaatggaaattgtttccgttctctcttcaagagagagcaaaacaatggtacatttacaccgttgggagtgtgagtggtagctggaatgaattgcgagacagattttgtgcctcacattctttcctgttagtcgtattactttcctccggatcgaagtcctcagctttcggtagaataataagaaatcaataggtgcagcttgggccagatttgttactctggtacagtctagtcccaaccttgccatacccgattttgcattactgcaacatttccatacgggtttggataaggagtctgcactttacctcaacataactgctggaggtcattcatgcacaaaacccccgtcgaaggaaaggaaattctcgatagaatatccaaaaataccttcgggcagtgatttgaaccccctccagaggcatctgtgtcaggtacggaggaacctgaaccgtcaacatcatcagatctaatgaggaatcctcccgggaactatctccagatattgaagaaattcatgatccgggatgtgctcccaaattcagggacgatcttctcgaatattacggccacctattctctagccaactctcgatccaatagaatatggatatctaaaggaaacagttcgggagctgacatcaatcatgagtgacgaatggctaaaggaggcagagctttcttccgaagtaattctaataaatatcgctcctcgaaccattccctatcacttagaagggaataatgttggtatcctttacagtccatcagtctgtgccaatattgtctcaaaatcctttgtattcactattctgagtgacaaggcaattacaccgacaaacaaattcttcgagcaccctaacgggagtcttattgaagaattaggtattgtacaagacgtgcctgtcattcatgatggcaaggaggcaatcttggattattcatgtttttgaaatccaagattttgatgttctaataagacatccaatcgagaaacttctcatcaatactcctcgattaggtagcctcaaattctctttaggagggtcaatttctttgttccattctcgcagtcaagaaaagccttgactgatacccttcctgaagaagatatcgtggaggacataatggttgttcttccattttagctgctcaaatcatcttctaaacaagacgctctggattttatccaagaaaaagaagagtcggttgagatctttgaatta

SEQ ID NO: 22123 - DNA, 1373 bp, Oryza sativa
tatattttggcatatatttcaatataaaatcatgctgaatatcacacgttgtctgctgaaatgcatattatttctagtgattaactgagtgtaaaccacatgagctaacaatttatatgcaaagcagtagcaaaccatccgtagacaatagcaagaacaatacctctgtataagccatatcatgaaaggagaagacacaataaagaattatggaggacatcaagggccaattgctcaataagctcttcttgcagtccaaactaccattttggtcagccttttcttctggatcaatcaaatggctctccaaagcttcaacagtttgagatctatttgcatcagctttatgcttgtgtaatgtctcctaaaatacatttcaagatactttacaaccatacaaaaagaattaatacaaagtaccaaagaattatcctttctcactatgagtcatgctaaatattgatatttctgctaatgcacaagtttttaagagaaaggaaatataaatttgacttaaaaaagtaacaaaagagactattaattcctgatgaaatggaacaaccacattaggataaaatgcatattatctccgttataattactagtaactgattttggttgctaagcatgcagcaaaacttttgatttcttttttcagatccatgtcataagatcttccacagtgcaaatatatcaaatacaactaaatatatgtcaaattacactgattgcatattttgtgaagctagcaattatggaatctgacttaccggcatccatatgcagcctatgagaacaacagcagcaaagactgatatgcacaagcagggtaagaaatatgggaacctgaaaattttccaacaaaagtaagtattctgtagatgaatcataaaaaacattttgttgggcgttggtacacaagatagaataccttgcaaacagtgagtcaggggaaaagacattgggaaatttctctgcaggctgccataaaagaaatcgtattaaatgtagccacattgttaaaaaaaaatccctaacactgttcaattctctgtgacatacctgtgaaaggtagcctccaatagctggaccaattataagacctattccccatgccgtactaacctaatattaaaaaaaatcaaaatcaacacaatttaaacagaaaaaaattaataacagaacagtatggcatgtatttacaagtgacaatgcaagagcttcatgttcaggtcggcaaacttcaatagcataggcctgaaaggacaaatataaattgatcaagatcaacatgaccaggtacaagcattggaggaaaaaaaaacatgaccaggtacaagtacaacaaaggaaagtttcaactttattgtacc

SEQ ID NO: 22124 - DNA, 577 bp, Oryza sativa
attctagcactttttggtggagagagagagtgatccaaagcatttttttggcacaatttgctactatggactagcaaatggcaaatggcaaattgctaacttttgctagtgtttagatccaaaatggtaaaaagtgctttaaaatgataaaacttttactattttggaggatctaaacagtgcctgagccgctagtagatcattgacaaggatagttgcaaacggacgctgcatccactgaccatttgtggggaagacattggatcacttgtgcttctagaaggtgaccccaccacaaaaaaaccaacacttcacccaaaagccataaaaaactcacccgagccagccgagaatgacgtctgaaagggaggtgcgagagatgagatgcggtgggggactagagcaattgccaaaagcacaggccaggaatttgtgaaaagaagaagaagacacgggctgctgtctttttgggctgatgtcatgtgggctaccaaccaccaactaccaccgcccagtgtttgcatccagccatccattcccaagccctctgcttatcctctccctgtccgtccacagc

SEQ ID NO: 22125 - DNA, 156 bp, Oryza sativa
tatattttggcatatatttcaatataaaatcatgctgaatatcacacgttgtctgctgaaatgcatattatttctagtgattaactgagtgtaaaccacatgagctaacaatttatatgcaaagcagtagcaaaccatccgtagacaatagcaaga

SEQ ID NO: 22126 - DNA, 982 bp, Oryza sativa
tctgactagacgcagtacataccgttctgtttaagaagattggcagcaactcaaaacaggtggcaattcgactttgaattagtgcagctatgcctgtgtttagtcaagcgtaaagttagattttggttgaaattggagatgatgtgactgaaaagttatgtgtatgacaggttgatgtgatagaaaaagactgaaatttggatccaaactttggatctaaacacagcctatacatgatgtaacgtgagaaagtttattcgtctctcaaggaaacactcctttatttttttatacggtttgaaaaatcacaaaaatattaataaaaagtagatcaataatacaatatataaataaaatacaagctcaaattcagctagaaatgaaaataataaattgactccgaataaaatgtgtcattcatagttaaatttattttttaattatatatatcaaattgaaattacataattgtcgagtgacacccccacatatttaattaatcttaatattttttattaaaattattaatgattttttaaaatggcatacaccgacatacacaagtaaagaaacgtagcctcgaacaacaaaagtccatcttacaatcatatactatttggacaacggaaagcctgtttcgtcttctactcttcttcccgtggcttttctgttccatgcgttttctgctctgctcctagaggtaagaccgccagcctctctacttgatcgccacggaaacggaagggaatccacatcagctagttgcgagcatcacgtgccccattcactctctttatttattgctgattcccgatcgatcgatcgatcagcaggcaatatataggcgtagttaatcgatctcaacaactacccatcagttattcaatacaatacagccattcagacagagccaaggtctatcgagtcagagagatcgacacagcgagcgagattggtgaattgatgggcgaccatggacgcc

SEQ ID NO: 22127 - DNA, 404 bp, Oryza sativa
aatggagtatagatttgttgaagcattgacacattagctgctatggtggcaaaaggcatgtgtaaaaccttatcgggtttatttagatggtattagatagttcatggggttatctagacactttcgcagtcagagggctaagtagatcaaccctgacagctaagtggtagcttggactggaaactttttttgcatgtaataagtcctgtaaacaatgttaaccaatcgaaaagatatcagtttatctcttggtgtacttaatatatttacatttcatatcgtgagatattagcaattcataaagtgtgagtgaaactaaacagagaatgtgaagaacaaagaaattcatctagtctaactgtagagcatgctactgttgtttaattcgggcctttcacccatca

SEQ ID NO: 22128 - DNA, 477 bp, Oryza sativa
attcctgcagcccatatacgtgcaaacacaaacttttcatatgtgtataaaatttttttatacatgatgtatttttcaattttttttgactttttaatacgaactgtcgacgaaatgggaatgggtgtacccatttcaccgtcaaaacaataaagcaccttttaacgagggaactaatagaaggacatggtcgtgggccccaactatagggtttgagaatgcggctcgaggttagccgcggatcgggccatacccgagaccccgatctaagaatggccaaatggctagccaagttaaattttaacaagtataaagaaaaaatgcccttcaatagcctctccatcatgttagctaagccatccagatggccaaatctcacccctcaatggccaaacttggagagtcaccctgcctggctattcgtggcccccaccactccctctcccacccccatctctctctcggtctctccctagc

SEQ ID NO: 22129 - DNA, 1501 bp, Oryza sativa
aaggaaaaggactagcctaaaatggaagaagtggctatattcgtattagagccaaagagaatatcacgcttcacgttatagatggccatatggcccggggcccgatggcctggccgaagacacggccattttgctgggcctaagcacggcatggcctgactggtgtcaagtccgtgtcggcatggcccgatagttgggccatgcctaggccgatgccttggcacggtgggccggcccggcacggcacgatagaagaaaatagtatagggatccaaaatagacttaatcaacaatataaggcaatgccaaaagagaggtgtaatacaaaatagacttatttctagtcatataagacaacccaaagagttgagggatgaaaaatagacttattctatgaagaaacacgatggtttgtcgtgccttccggctggaccggcatggcccgagtcttatagggttgtgcctgggacgtgtgtgcagcccgtgagctggcacgacacggcctaacatataggttgggccgtgcttgcccgactgacctcggccgaggtacggccgtgcttgggccgtgccgagccgggcggtccatttggccacctatacttcgcgtggcatgggattggtcagagtaaactgatcgcgtgggggtgggtgaacgcgagcgctcgtccattagctttttcgaatataacatgaataataaggagattggagaggcagtcaagcaggaagcgaagcatgcatgaacacgtaggagtataaatgaagcagtgatcgataggaggcgcgtacgtacatgagacgaggatgatgatccagatgtggaagaagcgcatgtaggggatgcccgggttgaccgccttgttgcgctccacggcgcaggcggggcagccctcatggtattggtacgccgtctccagcaccagcaatggcgtcgcagcgtcgcctgcagccatctcagcttcttcctctcctcttgcttgctgttcctgagctcctgactccagggtgggatgatgagatgtcttggttcacaaccaaactgatttattatgtcggtcgatagcgaactgacgttggctcgattcgccattaattactattgcgatcttgagcctgcgtggcattgctgttagtctcacactcgagctcaattaatctccatctccaccgcgagtccgacgaaaaataaatgtagtgcacagcacacagcgtatcaatggcgactgtttttgaatgtgagagattagcagatggtgatggactgatggctatggttatgtctctgttgctgtttaatttgctgatgtctctgccatggcaccatggcaagatgcacatatgcaatttgggcctagtttagcttcaaaagtttacaggcctcgtgagaaaggcccatcctaacatcccctctctgttgtcatcgtcttcctttcctttcctttcctttccttggcggccggccatggcctatggctttctctgccgtaactcgagttgt

SEQ ID NO: 22130 - DNA, 829 bp, Oryza sativa
ttctttaaaggctgcgtacgagagcagttataagctaaaaactatggttgtgtttagtttcacatcagaattggaagtttggttaaaattagaatgatgtaacggaaatgttggaagtttatgtttataggaaagttttgatgtgatgaaaaagttgaaagtttgaaggattattttggaactaaacacggcctataagagaaaaaaaaaagaccatcatttttcgtgcgtacgttttccaaacggttaaacactgtgatttttaatatttttttagaaaagttgtttaaaaaaataatattaattcatttttaagtttaaaattatcaatacttaatttgttacacactaatagttaacctcgttttgcatgtcttctcaatcttctctatttcttttcttctaaaaatggaatattctcttcaatagaaaataccgttttgatgcctgataaactgaaaaaaaagtttttgagactaggtatactactttcgataggatatctctgaggaagaaaaaaaacttattaatacagctacagtatagttgtaatataatatattgtaagctacaacgcaacttttatataatttggttggaaataaacaagaaatgtggcacgacgagtagcttggaaggctgacacatataaacaacagtaccttttttaaatctctgatacaagaaaagaaatagcccttattttcttgaggttgtaaaaaaatgtattgtttttttttctacggcgtgaaacatggcattggtaaaattgatgaagtggatatagatgctctggctactccattattgtccttgtggtttgtggtga

SEQ ID NO: 22131 - DNA, 314 bp, Oryza sativa
ttaatgtcatattgcaaaaatttctttggagaatagtttatatttcctttggactgaaaccccctgatagtatatctaatatggttggaaattggcttagtggtgttgagtcaaaaactaagaatctcatatttgttggagcttctgctttatgttgggctctatggttaagtagaaattaatgatgtttttgataaatctccaactaaatcttatatgcaagtgttctgcagggcaactttctggctccggttctaggcacaacttcaaaagtgtgaagagaacaaggagctcctattttctacatgtcgaaa

SEQ ID NO: 22132 - DNA, 1501 bp, Oryza sativa
attcaatccacgcgattaacccgagttaatgcgattaatcgaggaggatttgtagcgcatgcgagagttacattcggagaattcaatccgcgcgattaaccccgttagcagaggatttgtagcgcatgcgagagttacgttcggagaattcaatccgcgcgattaaccccgttagcggaggatttgtagcgcatgcgagagttacgttcggataattcaatccgcacaattaacccgagttaatgcgattaatcgcggaggatttgtagcgcatgcgagagttacattcggagaattcaatccgcacgattaacccgagttaatacaccagaatataatgcgattaatcacggaggatttgtagcgcatgcgagagttacgttcagagaattcaatccgcacgactaacccgagttaatgcgattaatcgcggatgatttgtagcgcatgcgagagttacgttcggagaatttaatcggcgcgaggcatgcgagagttacgttcggagaattcaatccacacgattaacccgagttaatgcgattaatcacggaggatttgtagcgcatgcgagagttacgttcggagaattcaatccgcgcgattaacccgagttaatacaccagaattaatcatcgtccgttacaaaacaagagagagagcatccgcgcgattaacccgagttaatgcgattaatcatggagtatttgtagcgcatgcgagagttacgttcggagaattcaatccgtactattaacccgagttaatacacagctcggttaactactagctccatatttaagttgagatctcttcacttaaattttcaaggtgatattattacccatagcactaaatttaggccattgaaatttattgggatttaatttggcctagcccattaatctaatagacatctatcaattcccttaatttttcgatagaaagttttaaattttacatggaagtttatttcacatatagatttcttttcaatatgtaagtaaacaaaatctttttcttaattatcattattattctaaactaacttggttagttatgggagaagaaaaaatgcatgccaccactctattagttacgggagaggagaaaacgcagggcaccactcggttagttacgaataggcatctgcatggcacggtcagccatggagcatcggtcttctcgagctggccgccgccgaatccgtcaatgtacactcgaagtgggtctcctatttgtggagactaaaaatagcagattgtgtggatctggcgtgctgatcagttacccaaaatcaaagctacattacctaccgtgctcttgcgtttacacttggcatactgcctgcttcttctttttttatataaatatatagaagtagtgccaggttgatggagagaaactaaacgggcgctctcgtacactgaagacaacacactccgcacactgaagacaacacactcgcacaaaacaccacgcacgcctgccattgctggat

SEQ ID NO: 22133 - DNA, 377 bp, Oryza sativa
atttccattagcaagaagacttaagtaaggggataacaactggactagtacgcatatctagtggttaattaccaaataattgttaaaataagtctattgtttcccaattggccattttttttgaaaacttgctatagttataatataattaaattgcatacaactatatattatagttatatatactatagttctttttaaaagtattttttttaaaaaaaaacttatgacagtgcaattaaacattgttaatccctccattctaaaatgtattgtatatcatagccttttacacgggctctagtgaggcaagcccatcgctgcgagagttcggtgactcgacctttcctcccccatcttccccctcttctataagg

SEQ ID NO: 22134 - DNA, 1501 bp, Oryza sativa
aggattaattaattaattaattgacgaccgactttcacttttgtgatcgatcagtcctttataaatttctcccacagaggatgaacgacaaaacaacaaaaatctccagcaatacatcaggcgatcgattagtactgatactactttaatcaattccaaaccgaagaaaacaacaacaacataaaacgattcgatcgatctcaactaaactttattaattctctgcatgcgaaagtgataggaaagatcgatcgatcaactgatcagcattagcagcagagcaactgatcgatcatcatcgtcgtcgtcgtcgtcttcgatcgtcgccatctgaaacgtttacgcgtgcctgcatgtgctaatgctctctcttgatcgatcgatcgaataaaacgaaatttataatcgaatatggtgcctccctgcaagttgcagatcgaagtgggtttaggtgctcgatatataccagctgcagctgcatcggatcattcagctgcagttagatagatagatagatgccggccttttcgaacagtatcaggtacgatatgatgcagatcagtgatatatatttggatcattctgccggtaaaaacttttcccgactgctgtagatccctcgtagatgctggtggtagactgcgtgtcggcaaatgtctttcctaacggatagtttgacgctgatagctatttataccgacaaactgagtgctttcatatccatcgatgggaaaataattttgctccttaagagatgtcatatatatagtttcttgcatataatctaaacggttataatttaattttaaaaagttaatcaggtatgtaaatcggtttatatgtaatatatcactcaagaacgatacaagttcaaatccgatttatatgaatacaagttcaaatccgatttatatgagttgtaacacaaacaacacattgaactctatttggtactatttggagaacatgccatgacttgaagaagcgagggacgacatcccctcatgggacgaaattccatctccatcgatctccaacctttttaatttaattcgatccctttttaaaaatgctacctttctttacagatgaggatttgcacctagtacgaaaatgaaagctacaagagatacatgtgtgttgtgtgatcaatgcatatgtaatatctacctatatatatgaatgtgggtgcagcacacatgtacagtgtatccgtgtatggaatatatgatcgaacacgtgtatatataaacgtacagccacaaggtgacaatgcttccaattcttccaattcaagtggccaaagatatatacttatatagttgaatttcatgtgtgcatgcacctgtttagctatatgttaagaatgtgtagcgtgttagatagcgcaaaaggtgatcagattagtatcaaattagagagagacatgcatgcatgtgattagggtaagtcttgaatattcttttagtacatgttgatgactgagagtgtgttggaacat

SEQ ID NO: 22135 - DNA, 786 bp, Oryza sativa
tctcctctagaagtaagcaactcgtcactggtcaaacgaacataaatggttttttttctcagtgatataattacaaatgtgattatgtgagtttatgacatatgagatactgctggcaagatttttacattgttaaaaactgccaatgattaacgatgtggagtatgtggataatattaggcaatctacgccctaagcccctaatatagtcacattatggatatataaaatagttgactggctatcttctactccacttggtatatatggttgttgctttgacttaatatcttaattggtattcgtaaccggtagcgttcatacccattttgatacctattcgtcccgtatttatgcccgctgtgtttgtattcatattcgacactatccatatccgacccgattctaattatcaatcacctatcaagacaaatcggacgctacgatgagacatgaaaacacccgatcctattctgacctcgatatatatgtggaatcgttttgcgccatatgtattgaaattgcacgggagacacggtcaaagccaaggttaagataaggctaacaaaatataggttagaatatgagaaatgcgagatctgaccgaaactaatccgatttcatccctatgagggagtagtagttgtttggtttttttgattgtgtagaattggatttttgtaaaagattgtataaaaacgaaaaaaccccttgtcgtcttctccattgcgacactgaaactcaggcggcgccaccagccagagtcccacgacgttgctctgctag

SEQ ID NO: 22136 - DNA, 1501 bp, Oryza sativa
acctgctcacagcttcctattcaggatttaagagtacctaagacgttattttttgcgggaaagcttaaagaaaagttaatgagccacaagaaaaataagaaaaagagaaggttcactcaaacgctagagattagagattattttaacttgtaaccaaatctaaatctcaagaaacatggaagtctaagagatggttcactcaaacttcactcaaactctagagattattttaacttgtaaccaaatctaaatctcaaggaaacatggaaatcaatagacgtagcaagacctgggcataacagtagcccaaatgaattcagcatcaaccagtgttatggataacggttggtacggccgtatattcgggcgttaatacggtggcgccgacccctccgtcacgaatgagcaaaacgctgatcattaatcgtttaaggacgtataatcaccgtcattagcaattaatcagccgtttccgactaatcagccgaataaacgggccaaatcatgtgacaaggccagaaggccctgccagccagcccatgatactgcccattagttgtgtaacctagcaatatatagctacagaacgtcgttttagtgtcacttatatagtgttacatgcttttggtatttcctttatgcgttacgagccaaacctatcactatatgttcagacatatattttactatatgccgagttaatgccatgttatccttatttttatttaagaatagtaggtatatatgtagttatatgcatttatctatcaaaaataataagctattatgagttatgtacatatatttgtccaaaacgttaaatttccgtcaaattccgattattcgcccgtactccgattattcgtttagcggaaccatctccgtccgacatccatattccgtcatccacaacactggcatcaacaagagatagatgtccacaaggagcaaggtgttactttaactgcatttatttacatttatatttgagcaaggtgttactttaactgcatttatttacatttatatttgtccttgtcctcgcatccaagaaaactcactcttggatttatgactaaatatctaaccatacaattagattgtccttgtcctcgcatccaagaaaactcactcttggatttatgactaaatatctaaccatacaattagattgcctagctacaacattctgccaatctgccaataactaatcactaagaaaaaaagcaacaatctactcccatgggccaaaatttcagccggttatcactgctaaccggtttttgaattcaaaaatttggacctaaacatctattggattttttatataaaaaaaattggacctaaacatctatccaataaaaaccagccaacaccggtaaccggtctggaagggtactacacgggtggctctttgctgtgctcgtcggcgacgcaggtggctacctgtgctttctcggtgtcgtcgccggcctgcagctcacgacgagacacgaacttg

SEQ ID NO: 22137 - DNA, 233 bp, Oryza sativa
tactccactgttaggcacctaggccacattggtgttccatagtatatacattgactgttttacactaggcaaattccacacttggccgtcatcacattccatatttccagcaccagcagtatatttaaaagtaggaatcttctgtttcataaaaaaatacaaatattaagctgacgaagccattataatattttaactggaagtcgcttaacctttttttcctttatttatat

SEQ ID NO: 22138 - DNA, 227 bp, Oryza sativa
ctatcatttgtacgaagtgagcgtagctcaactagtttgcatggttttccttgtggtgcaactagcaccaagactcaagttctatatttaacacgggtgctcgtatttaaggttaactatatttcagtggtagacaacatactcgtcaacagcgagacgcctatgatgatttcgtcaatctcaagatataccggcatagtcttctcgagatgctcacagagatagga

SEQ ID NO: 22139 - DNA, 1501 bp, Oryza sativa
atcctatttttttgcaagcgaatttatgtgtggaagtttgtgtgtatgtgtgtgaaaaacacttttatttaaggaaagtgtgaaaaacactttgtgatgaatctagtattaacccttgacagttgcgagtacgcttatggttaacaaattaatcagatgaaagaagacttagggcattcccaacccaatgactaggatgatgtccatagcattaaataagctgccacctaggataaaaaatgaaatggcaagtgaataaatgagaaaagagaaggaaaccatatattgcatgagatatggtttctacacaacgtccaagatatcatgtgagataagtagcattaaatttaagtatggaatagtagtgtttgcattgaaagagtagtgtctagtactagtttcttgatgatgtggagtttatggaaattatgtctagtgtcttgggttggaaatgcccttatggttgagtacacttgcacacaaatttatgtttggtagttgcaaaatttatgttagtaacacatactgtaccagactctttcatctggttatgacttatgagtatctttattagcactagacacgaattatcaatatatcagtatatgttagtactaacatgctaccagtacatgaattctatgtttcacttgaacaaactacatattcatggagcttgaaagaaagaaagagaaaaaaaacaactaacttatggcgatcacctttacaacgaaatggcagcattctgcttccattacccaaaaacatcatgtctcaagcgacatgaagaaactttctttctagagaaggaaaaaactcgagcatctctttacatagatcatttgttctaactgccaactattgctaactgctctagtctccagacaaaagttcattctgatccaatctttcgcactactaagaggccacattctattgtgtggtcatttaccccctttacactattatcaaatggagaccattctcttgtcttatatggtctcaccatctaggagtacttccttggtagccctcagtctggtttctctgtctactgtttctttgctgaatgtgcccaccactattccttttccttccagatatgctgtttgggtcctggtatctattcctgttgaccccattgaagctatccctgtagtctccagacaaaagttcattctgatccaatctttcgcactactaagaggccacattctattgtgtggtcatttaccccctttacactattatcaaatggagaccattctcttgtcttatatggtctcaccatctaggagtacttccttggtagccctcagtctggtttctctgtctactgtttctttgctgaatgtgcccaccactattccttttccttccagatatgctgtttgggtcctggtatctattcctgttgaccccattgaagctatccctgttatttgatgaatgatgattgttactattattccaattgccccaactagaatccgccaaggca

SEQ ID NO: 22140 - DNA, 1501 bp, Oryza sativa
actataaaatgggcaagataatgcatcttgctaagagctaatccactcatcaatgtcatagtaaaatacgacgcgttaggttgccagtcatattttgtcatagtttactatgtccaagattatataggtttcactaacttagcaactactccattcgtttcatcttatcaatcgttttgacattttatcaaatctatctataaaaataattagcaataatactaaattagtttcattaaatataacattgaatgtattttgatatacatcgttctcacgattgtcatcaatcataatacaatgagcaagataataccaccatctgctatcactatacaatggacaagatctccttctcagctacaacatctccttctcgctttgagtgatttcgtactaagttgatcaactgaacgaaaggggagccctcaatgctccacacgccaccatcttgaagtccaagcaaatctacgagtacttgcatgaagaccgccaagacgaccaaaattggaaaataatttggaaaagtaaatctcctccgaagattcagttcttcatttggttattatctaaagaacgcctccccacaaagcagaacctgtacaaaaagaaaattgtttcgtccgtgaactgcgatctttgtggtgttttagaagaaaatgcttttcatttctgtgttgattgctctttttctcagacgttctggtcgaccatttagattgtcccaggactgacaagctcagccaatctcgcaagtttaggccgcctagatggcattcccatcaagcacttcagagtcttcttctttctctgcttttggggcctgtggaaccacaggcatgatgttgttttcaaggggctgcaaacatccttgcgtagactagtaactaaatgtatagatgatgcaactctttgggcaaagcgtttcaattcggatgataggggcattgtttcctcgtggaaggaaacactatcgtctgcttttcgaaactctgtaatctaagatgtaactgcaagtcttcattcctttcataaaattcaggtggggaaactccccccccccccccccccgaactttgtaaagaaaaaactatacaatggacaaaataatgccctcccctaaaagctaaatccatatgtcacggtaaatttaaccctccgaagcattaacaacttttttcaagctcaagttgagcatcacgtgcattaaagaaagaaaaagagataaaattaatctacataactagagatgctattgttcaacgaaatctttgatgatctaaaaaagatgctaacacctagacataataacaagttaatactaattaatgtcaacttgaatactttattattacttccggactactctcctctccgagatagtactatatatttgcacttcatactcccagagagtatgattggatcaaagaaaaaatacattgctcattaactggtgttctgctggattcattcttcatggcgccctccttccggctct

SEQ ID NO: 22141 - DNA, 541 bp, Oryza sativa
ctacgtgaaatctattaactacagggacatgaggaaaacgaacttccgagagcggagtaaactaaggctgtgttcgaatggacatcttgcctaaaactttcaatgacacgtaaaaggagaccagtcattagcacattattaattgagtattaatcatttcaaatttaaaaaataagtttgtttgatttttaagaacacttttatataaaaatcatactgtttagtttgggaaacgtgattacgataaacgaaggggtagtttagcctattgtagaattttctgcgtgaaagattgtaattggacacttttacacatcagccaaagatccaaatgcccgataaaatggacaaaacatgacaatgcatgcgaattacaaagaaacacaaaaacgatgacttagcttatacagagaaagatcgttgctattaagcctaagtaagacaagcacacatccagacgctcgcgtatatattttgattgaattctattatcgacaaaaaagaaaacttgcatattcgagatatgaaccaatcggaacga

SEQ ID NO: 22142 - DNA, 309 bp, Oryza sativa
ccttatatttagggacggtgggtgtcataggtagtgggccgaggggtcgaggccctagggataaggatagagttggttggataggattagactgggtcctccctccatctatataaggatggtttgtatcatcattctaattaagcaatgaatcaagattagtctctcccaacctaagtccccctctcatccctagcagccgtcgccgcccggctatcctctcggcggtgtttaccccctatgaatcctaacccataacagtgggagtattgttttaattttctaaaatcaccacttttattcataatg

SEQ ID NO: 22143 - DNA, 1501 bp, Oryza sativa
gctggaccaggccgcgcccgtcgtgtcccaaacagaaagatccccgacctggtcagtgtcggacgttgacaaggtcaaaccacatcgcatattggagttgaaatactatttccgtgctctttcttctcgtatcggcgttgacaaatttggtcccggttagatcctctggtaaaattttacaccctatcacatcgaatgtttagtcatatgtatggagtattaaatataaatagaaaatatgtagattacgtgtaaattgcgagataaatcttttaagactaattgcgccatgatttgataatatgatgttacagtaaacatttgctaatgacagattaattatgcttaataaattcgtcttacggttttcatgtatccgatgtgatatcaaactttacaccttagatctaaacatagccaaaagaatggaatcaggaatggcaagcacaggactgacgtgggggtttctccctcccctcgtgcatctcggagtgaaccggggtacatcttcgatcactggctgacgcgctgagcaatcactagtactcctacagtcctactactactacagagcagagcgagagacgggaggcaaggaggcctcacgctaccctgcagaatgttgtgagaacgacgtggcttaaaccgtgcatcactttccattccctaccccgagaaccaacatgcgttttaattgccgatcttatcttttcacttcgcttatacgtaaacctatcagtcaaaatttaaatttttaactttaaatttaaagttgattttaggttttttttattttagtttattttttagtctttctttcttttagactgttaagacatgtatataaaagtttttttcgtaaattatttttcatttgtaaaaatgatgtttgtcttatttccacaaataagacaaaaggccggcacttacagttttttcagatatacatcgcgttatttcaactccactgggcccaagccgcacaccgccagctttcatttggcaaattgtgagggtctacttagcaatcttaactttagaaatgaagtgtagaatacagtttgcgagcgactggaccccactcgttttagtttattttttaaagcactttaactcactccactcttttctaataggagtaagagttgtgattatttggttagacttcagccaaaaaaaaaattgttagagctagagcctgaaactggagccttaccgaacaatccattactattcactaccacctttatcccaagcaaatgcattgtaacggagatactaatactactacgtctgcatatgcggtatgcccaacagcaacctcaaaactaatagtaacttgtttgtttttgttttaggtgaaatattaaatgtgtaattataggtgagggtgtatgtattgtgagcgtgtacaagtttgtactgttttcttaaaaagaataattagcgtaatagtacttgtagttcattacggtggttatgaaaataatacatcgcatca

SEQ ID NO: 22144 - DNA, 1501 bp, Oryza sativa
tgcaaatgctacacaataaatgaaattaatataaataaagtaacaagttgccaacaagaagaagtaatgccaattttcaattttcacaattgctgttgccagaccttcactcatgagagctgaacacatccaaaatggtgttccccgatctacagcttgctgcaataaaccactttgcataaataagaaaaaggaatccatgcaagatccaaataaaccagaagtgtagaaacaaaattaattaattaagtttctctttctagcctttctgtttagaggtaactacatctttcaccattacgactatcttgtgcgctgctttaaattaattaacttgcatttaattatccacgtcaccaagcgcacgagctcgaccccactgtgaaaacatatttctatggtgccttcgtcgtggtagttatattaattaagtgcaatactgtaggtaaagtgcgagcagtcaatctcagatgaacagttaattaattagatatagcatgtcatcagcctatgacaatgtgtgtggtcaagccatcaaggacacaaaaagattaacaaatgggcgagagagaggtgaaagtgatatgtcgtcaaactctgcaactaatattatgtgcagctggtggttatatacatgataacctatatcttcctagctactatatcatatatgcccaaattatagctttgacatctccaatgggacaaaggcttggtggtaaaattaataattactactccacttaattcctggttatttgattaaactaatcacccattggttgtggtcaagcacacaggagattcaagggcataatctctggaaaatactaaagagaaaaagagcatgactttgcctttaattgagcttttgtcccccatatatatattgaatattatttgttgtgtatgtgataacaaaatcgattttgatccccaccatggaatctgcttggaagaagggtcatgaaaatgacatcattgcgcatgtcatttaatttacccttattgatttggtatatcctaattttcacaatggagagaaagagagagtgagaggaagagggtcctccaccatgggaattaatctactctttttactaaagttttgcatgattttagctttttctttcacaccttttctctgcttgtgatatgatgccgaaacgtcaggcccggtcccagcacgattgaaatatataaatgtacaccgtcactagttgtgcatatattttatatgcttgtgtaaacaagtaactataaatttaaacgactccgtttggagtgtacggattttttttctctgattaatagaagaactatttcagtaaaagcaagccccttatctatcaatcttttttgcaaccattatgtaggtcatcgatatctaactaaatccaaggcatgctatatgtcacttgttttctttcgggagtgaaacaaatgatgtgttcacaactttgacattttaaaaattgtatttaattttgtgttgatcctt

SEQ ID NO: 22145 - DNA, 1501 bp, Oryza sativa
ttttgtctggagactagagcagttagcaatagttggcagttagaacaaatgatctatgtaaagagatgctcgagttttttccttctctagaaagaaagtttcttcatgtcgcttgagacatgatgtttttgggtaatggaagcagaatgctgccatttcgttgtaaaggtgatcgccataagttagttgttttttttctctttctttctttcaagctccatgaatatgtagtttgttcaagtgaaacatagaattcatgtactggtagcatgttagtactaacatatactgatatattgataattcgtgtctagtgctaataaagatactcataagtcataaccagatgaaagagtctggtacagtatgtgttactaacataaattttgcaactaccaaacataaatttgtgtgcaagtgtactcaaccataagggcatttccaacccaagacactagacataatttccataaactccacatcatcaagaaactagtactagacactactctttcaatgcaaacactactattccatacttaaatttaatgctacttatctcacatgatatcttggacgttgtgtagaaaccatatctcatgcaatatatggtttccttctcttttctcatttattcacttgccatttcattttttatcctaggtggcagcttatttaatgctatggacatcatcctagtcattgggttgggaatgccctaagtcttctttcatctgattaatttgttaaccataagcgtactcgcaactgtcaagggttaatactagattcatcacaaagtgtttttcacactttccttaaataaaagtgtttttcacacacatacacacaaacttccacacataaattcgcttgcaaaaaaataggatctttttttaatgttcgatgctgaaacaggggctttaacaaaaataatacttaaaaaccattttatattatacaagtcgctttgacttttcacttagtcaaacttctaaaagtttgatcatgtttataaaaaaaatctagcaacatttctaacacaaaacaaataaaatatatttaatatcatatttaaagaaactaatttggtattatagatattgctaagtttttatataaatttagttttatactaggaaaagtatcaaaaagatttataatattaaatggagttaggagtgttgtgttaccttagggtgaaaacaaaccgtaaggggtgttatgcaaaaactaggatcaccttcatgacaaaaatagcccgaaacaagggcctttttgtaaacattactgccagtccgtcagcgcgcggaacacagcgatctctgccgttggatcgatcatcaacgctccatcggagcaacgccgccccgtcaacaaatgcggcgcctcccccctcccccctcccgacgtttcccgtttcccttccttcgcgcggcgctgctccggtagggtttttagccggcgatctctcccctctcgcgcgctcggcgactgagaa

SEQ ID NO: 22146 - DNA, 1501 bp, Oryza sativa
gccacttgcgtatatatatgtcagtatgtcactagctcagctgtgttgctattaacatttgaagtgtgcgtacgcgtgccaatctgttgaggcatgcaatgcttgatttgttgagctgccagaaattcaaccgtgcatacgtgcgaggggtctcagttgtacgggagacaaaaatacctactacgagtactaggaaccggacgtatatacgttcagatgaagcaggtatacgtagacagtggtcgagattgcgtggcacgcgccgcgctgtgctgcgcgcgggaatggattactccgactccgatcgattccgagtcctaatcaatctcgttgtgcctcacatcgtccactataataaaatctggtactcatccagttgttgcaacaacgcaaaagctggtctgactgctgcaggcgatggatccgccggctcgcagattgatggattctcgggcggcggcgcagttggcggcgccactttctgatccatacgcggcagaaaaattcgaagacctactccgagaattgggggtcgaccctagtatccacactgtagtccgtagcgccgggagatggatggatccggcagcggcggcagcgcgagttccgatgagattccaccgcacgctccaacgcctaggaatcgaccccaacagcgatgcccggagcatccgcgacatgctacaagagttccgtcgaggggtgtaccagggagaggtgtactgggctggccgagtgatcaggcctcgtccttcgcccatgctaggacgacgtcgccgcgccgccgacggggatgccccgatgcaagatgtcgcgagatgtcctcctgggcctcgcgctgacgaaggcgtgcgacgcgaggcaggaggagtgcgccgtgtgcctcagggacttcgaggagaaagacatgctgaggacgatgccgtgtaaccactccttccacgagatctgcctcttccgttggctcagcgaaagctgcctctgtcctctctgccgctacgcgctgcccaagcagcagcaggttcaaagctgctgatgatgctatttatgtttcggttcaccaacagatccgtttgtaacttgtaagcatattgccatcgatatagaagtagaatcatgttctcatcgatgtatagcagggcagttcatcatcagaaggttcctaattaaaacatttcttatcctccactggatttaactagtattgcctgcaacgcaaggccctgtcttggctaacaagccgaaacaacttgccactcatgtgcctatccctatcatggtcaggcacacggttcttcacaatatacgtataatttaagaattgcattgatcttcaaagtaattaattagtggattgatagaagtttaatcgacttgacattgcaattataaattgctttggagatccagtgtcccagtatataatgccaggtgaacactcctcttccatcaaccagcttgctaccaagtcgatcaatggcaatggactcttactactgtt

SEQ ID NO: 22147 - DNA, 1501 bp, Oryza sativa
gtcagccagtgatcgaagatgtaccccggttcactccgagatgcacgaggggagggagaaacccccacgtcagtcctgtgcttgccattcctgattccattcttttggctatgtttagatctaaggtgtaaagtttgatatcacatcggatacatgaaaaccgtaagacgaatttattaagcataattaatctgtcattagcaaatgtttactgtaacatcatattatcaaatcatggcgcaattagtcttaaaagatttatctcgcaatttacacgtaatctacatattttctatttatatttaatactccatacatatgactaaacattcgatgtgatagggtgtaaaattttaccagaggatctaaccgggaccaaatttgtcaacgccgatacgagaagaaagagcacggaaatagtatttcaactccaatatgcgatgtggtttgaccttgtcaacgtccgacactgaccaggtcggggatctttctgtttgggacacgacgggcgcggcctggtccagcacactgcagcaaagaggatggttggattggaattggatccatctcacgcggcagctttgctttatctgtggctgccaacatcagcagcatgagccgccgccggctccgttggttcaggggacggagacgggcgaggccaccgaggctgtgacgcacatgggaaacataactctgccttcccctttcctttgttttttcttctttcttttgggctttccaggcgtggcgtttttgcgtgtgcgtcctctacgtctctcgatttcacgttcacgtcgctcctgttactactagtagcagtattatgtagagagagctgtttgttatctgtccaaagacgatggtgcacgagagcctgggataaccacttctactggaaaggaacccctaaaaggtgagtgagagtatctatcgatcgctcattcgctcgtacggcgaggtgctgggtgctggtccactctactcgtctttgctgttgtttatccaaagtgatcttgtttgagctgtcacggctaattcaaagctttctaacatagctgagatgaaatctgaatttatgacggattattccacacatagatgatagatttcaaatcatttttaggctacggccgtgtttagaccgtgtttagttccccctattcccaactttccatcaaatcacatcacatcaaaaacttttctacacataaactttcaacttttttccaaactctcaactttcttcaaacttccaacttttttcagaaactaaatacacccttagttcacccccaactaccccaaacttccaactttccatcacatctaaaatttttctacacacatactgtatgtttagttcctgaaaaaagttggaagtttgggaaaggttggaagtttagaaaaaaagttagaagtttatgtgtgtaggaaagttttggatgtgatgtgatggccctgtttggatccaagggttagagttagtttgagctagttg

SEQ ID NO: 22148 - DNA, 1501 bp, Oryza sativa
ctttttctctttagtattttccagagattatgcccttgaatctcctgtgtgcttgaccacaaccaatgggtgattagtttaatcaaataaccaggaattaagtggagtagtaattattaattttaccaccaagcctttgtcccattggagatgtcaaagctataatttgggcatatatgatatagtagctaggaagatataggttatcatgtatataaccaccagctgcacataatattagttgcagagtttgacgacatatcactttcacctctctctcgcccatttgttaatctttttgtgtccttgatggcttgaccacacacattgtcataggctgatgacatgctatatctaattaattaactgttcatctgagattgactgctcgcactttacctacagtattgcacttaattaatataactaccacgacgaaggcaccatagaaatatgttttcacagtggggtcgagctcgtgcgcttggtgacgtggataattaaatgcaagttaattaatttaaagcagcgcacaagatagtcgtaatggtgaaagatgtagttacctctaaacagaaaggctagaaagagaaacttaattaattaattttgtttctacacttctggtttatttggatcttgcatggattcctttttcttatttatgcaaagtggtttattgcagcaagctgtagatcggggaacaccattttggatgtgttcagctctcatgagtgaaggtctggcaacagcaattgtgaaaattgaaaattggcattacttcttcttgttggcaacttgttactttatttatattaatttcatttattgtgtagcatttgcaaaaatgtatccaccacttaaaaaaaaccaattttcacaacacccctttttatttttgcagacggcataaaaaaatacacacatgtagaagtcgatctttataggtggttaggctaggagagttgtctgcaaaaataactatatttttataggcgctcactactacaggaatgatttttcgtacaggagtcattttagattgcagatgaaccgtaagtggtcgcgtctgtaaaaatcgtgttctattttcgcttgcggctgtttaaaatgaccgcacggaaaaatcaattttcgcaggcgggccacttaacaggtctacacgcaaaaataggcttattttcgcgtgtggacatatcaagtgacttgcacacaaaaatagccacccaccttttaatcccgccgtcgccgccccacacccactcctcccatctccctctcagatcccatcgccctctccgtcccacacccactcctcccatatccttctacgtcccacacccacctcctccctctccctttcaccctcctcctcccatctcccggcaacggcagcggtggcggcctcggctagggcggcggaggtggcggcatcgggttggagcagcggaggcagcggcggaggcgagtgcggcatcagccatggtgggggcggcggagc

SEQ ID NO: 22149 - DNA, 1501 bp, Oryza sativa
tctctgatcgttctggatcccccccaaaaaatcaatcccccttctaagtgggcaaggtcctccttttatacctcaaggggataccacatgcaccatctctctcttttttgtggggacttatcctatcttttcttaaacagacggagacttgtatggttgccgtccgaatgaccttctgatgggacggcccatacctacctccacttccgccggaagcaggcgcgacgtgggaacacagctgtttgccgacgacatgaccagtgtcagaccggtcacaaatcggtcattcttgtccaccacgcgtcagtttagcaatctgcatgtccacccttcttcatacaatttcttgcttgtaatggttgggatgaagcctggcatatacctgaccaggaccaacgtgccatctccaggagctagcacgctggctctggctagggacgagtgcctagagactctcatcctgacgggacggggcgaggcgtgtgtcagatcgcctgttgccacctaacccgcaatctgaccggtctgtgaccagtcacagaccggataaacgagcgcgctgtactgcattacgtgcggcgtgacgtgctcacccaaaccgcaataaatgcggttaggtgagccccgctgcgctcacctaacccatacacgcggcgcaaaacccacaaggggtcggggcgcctcggccctcggggccgaggcgggagcggtccgacccctcggggagacaaagagaagggcggccgtatcaccctcgggcccgaccccccccccccccccgagggggttaggccacgtgggtgatcgtgtctgcctcaagtctctaagtcatgatactcccggtcccatgtcaccgacagtaggtattcagcatttgatgcactgcaacttgtaagcgatatggatgactattttcactgtgagcattgcaaagaacaacttcttccagaaagtgaaaagcttactttggatgaagttgtgtgtggtggtgacaatgcaataaagcataagcacgataaactaaaggatatgcagcaaagaatggaggttattactttttattcagttagaaatttgtttccaaatttgggagcatagatcaaacataaatgatgttagaattgttcagtttttagtacagcttacatactataactattggaaaacaattaaatttgtttcgcctttgtcagaaagactaaattagtgtatctgcattttggccaataatcagattgttatccagtaaattgtgcataaactttctataattttttacattgcacttagataatacataatttaacatctatttaaccattattgcatttgtgataatagcacgataacaatatagcatttcattgttgtgagaaggactttctttgacatgaaccatatatatagtttcaatatctatagcagagatggaaatatttctatagattggttatgtcatctatgaagcatcacttcgctgatcacttgtatatgtttatat

SEQ ID NO: 22150 - DNA, 1055 bp, Oryza sativa
actaaaattgtggtaatagatacatgttgccacaattgtaaaatcgttgctagccgtggtaataaacaacgtggtaataggttattgcaacgatttttattttgtggtaataaatttagatgttgccacggaatggatgtggcaaaaagtcatattgcaacacttcacagcgttgtaataaaaattattgccaccactccatatgtggcattagttttacgtaccaaattaaaagtttaaatattaatctatcatcctatctatttgtatacttatttttttgattttgtgtcttggctaagattcaaacccaaacctatccttcacgcgtgctctcctttaccaactcatctacgtatcaattttgttggaaaatgcatatcgttccatttgagcctagctaaatgagatttgaatcatagatttgaatatctaaaagatttcaaatgaaaaagttatcacctataaaattgtagatctcgtcgagagctataatttccatataaaatttgtctcaatccgtgtccatatgaaaaaattaagttaaattatgagacgacaatctttttattgcaacgaatttgttgatcgtggcaacaaaaaatagtgaaaagtaccatgtactatataaattgccacaaaaattaaaattgtggcgatagaacatgttttttttgcaacagtacgattttttgtggcgatatcttattttctattgcaacaaaagtacgaaataaaacaacgattatagatcgttgcaataaaaaataattatttgccacagaaaaattatcattgcaatagtataatatattgctacgaattatttttttgttgcaataatttggtggcaatagctcaattatcttgtagtgtgcttcgtacgcatttgatccctaacagaaacaacgaaattatatgaagtactctatcagttctaaaataaataaaatatgatatattctctgtctatattcataatactataatgtgtcactttcataataaatttgtttattttaaaatgaaaaggttagtatatatagtacttaata

SEQ ID NO: 22151 - DNA, 1501 bp, Oryza sativa
catattaaacagtttcctggaatatgcatatttcattaaatctgactatctatttgtgcccgtggaatttttgttgttttttgtgatggttgttgtataggtctctttagacaccatttgcgccacacactcatgtatagccattttcttacatatatgaaggcggctctgttttcctatgtactaaaaaattagccttctatttacactattttgcttggtacactggatcacttcgagtgtgcagtactgctaaataaggagtaactttaggttcactttatgaacgtaagcatccaaagagcttaagacaatcaacattcacaggatcattagtgacagcacgaggtgacctgaacattgcttgaactcttttgttttctgggtggtgtggttggaggtgcaatcaatatgaacgtccagtcattagtcatctttgtttgttaatctgattgtcagttttttttttgccccttctcaccttgtgttgtgttatgtcatagcagtcaccaaaaggagtaaacatatctaacaatgtctctggcaccgctggtgatgtgcatccttttactaaaggaggagagaaagcaaagatgcacacacattcctactgttgtttggactatgctcaggttactcattgattgaacatttaattttcaatgcaattgcttctctcctcttattctcttcttaatgaaatgacacgcaattctcttgcttgtttgaggaaaagaattacttctctaatgaaagagaaacttgcccggcgaaaaaatgaaagagaaacttgttagctgaaatttttcgcatacacaagatatttggccgctcacatttatccacaaagcacatgagtgggacatgtagcgctatatctatttcttatgtttttacgtgtggcagagctcaatgagatttgatatagactctgtgcatggaaacttattttaacattgtaaaactgcatgggccaaaaatcacacaagcggaccttctcatataatcttcaattgaacattgcagtttttctgcatgcatggtggttgttttgattaaattgatctctcttccataggttggcaaatctaagtcacttggctttattagaattattaggacagaatcctactgaaaatttgttgaacagaaagtgagacaaatctctctcaccacagcgttagcgataacattacccatctttagtcatagaataaaatctgcttgtaccttacccatcccatgatccaaaaatgtcttttgatctggtcataatctgatatagattttaatgtgcatatttttctgaaatacaggtatatgatgttgtaagacataggatacaccgcatgaggaaaaaattaaaagatgagttagatgacagagatacagttcagcattatgtatgtcctaactgtaaaagaaggtactaagtatacttctgattattctggatatatagtaccattaaaaaaaatgaagcttacattattgtctctgt

SEQ ID NO: 22152 - DNA, 296 bp, Oryza sativa
tgcatggataaatacatagagccgtacataattggatttattagcatgtgttttgttgagacgccacatctgttccgacatgctttatcatacactaggttgaatttgatttgtcgatagatagaggcgtacacaattggatttatcatgcatgttaatgagaacgtctaatctgttccgacaagcctatacgtgaggttgagtttgatttttgggtagattattgagtctgatttgttacaacattcttattgatttggactcttgcaaaagacaaaattaaacaaacggagaaa

SEQ ID NO: 22153 - DNA, 1501 bp, Oryza sativa
atctgattgagcaaccgaaagtccagccgggcatccaacactgaagaatactagcagtcaactctccataaatcaaaaaaagtttcatacttgtacctaatttagcaaggaaacctacccttgaggtggtgtttgatacactactgtgtgaaaacagaagtcagcgaagactagatcatcattagatccacttatggattgatattttgaagcaacattgtcacccaccttatgtgtgttacattcaccaatagcctgacaacaagatttaaaaaaacagagaaaaactagcaagctttttaggatgcagatacaccaaaggaagaaaagaaaactatgagtaacttatcaaaaatcattatagacttgactaaattcaatgccatgggctgatgatagaaaaaagctgataatgatcaatttagtatgtgcatcaactttatgattttgactggaagggtgagatttggttgttgccagtccatgtgtaacctagtaaactacataattttgccggatcctttccttgaattcttcaatggaaaccatttaaaccaatgtacatatttttgctgatcatgtgtaatcgtgtaaactctgtggtggacagcagtcttaattaaattgtgacaaaccttcaccacaagtctcaagatgattccctgatgctgctctgtaacatttgatatgttgattaaaagatcaggtgctatgcttcccttgtcctgttacagaatgttaacttcatgttgttggctttgcagaaaaggtaaaacagcctagagaaaatgagaaacaaacgaagcagaataggatacctcacttagcagacgttcaaatgccatctcaatataaacaatgcaaaaattccggactattgtggaggaagtagattcagtataaatcctccataaatccagcatgggcagtgaaatctcaggcctgtgcttcacccgtttgttaatgtggctgagaatttccataacctaatggagtccaaaaatggtattattttccattacatgccattgtctaattgacatggaaattatgctatagaatcatgcaaagaactgaaggaaaacaggactggcactctgctactctgaactggttcaggttacagtaacaaatgcaagtaattcttgcaacataaagcacaatagtctctctaattacgtcgtttagaagattatgtgtacatgaacaaatcactaaaacagtataataggcactgttgctcgaatttcatcaaattgaagcaggaacattgtaaacatcaccaaccaagagaccaactaaaccaaccgaagcagaataatgacacctacacatatgtctcacatacaaacttcaatagattcaggacctgaggaacggtatacttacgagcttgcggacggatgcggcgggggaggcgagcgaggtgatggcgtaggggaggacgcgggcgagcagcggcgcgagccgcgcgtcttcggcgagggccagccgcgtcagc

SEQ ID NO: 22154 - DNA, 316 bp, Oryza sativa
cccccccccccccccacccaaaattcccaaaccgacttggctttcgctacgcccagcttcggccgcgctccaatatatcgcgttgcggaccaaatcacctccaaaattttttcactcgttttccccttccttccgccgcccctactcgctcggtgttgggcggcgggcgtcccactcccaccacctcgaggcgagggggctagggtttccgccatggaggacgacgagtacgaggaggggatggagatggagatgggcgggcaccaccacccgcaccacggcggcgggtacggcgccgaagagtacggggccgtcg

SEQ ID NO: 22155 - DNA, 622 bp, Oryza sativa
gcaggagaagagtttgaagagttccaaggccagcaagacaagtcacacagatcccaaacaaccctttgagcatgttgatcctgtttaaagctattgtttctattcaactactgcatatatttttgaatgtcattgggtggaaataacctattgttttgttatagccctttttgttcttgattactttattctttgataccgtgggttattataatttgactagttgagctttacatattagttcagctagatattagatatgattgcttagccatgcttagaaacattagcacactactagaataacttatgcttcactattatttaatgataacttaatgatagatcatgatggttaatcatgattggttaagtaattaatttgccaactaaaacctgataatggtgggttgtgagcatatggttttgatggtcgtgctcatgacaattaaggaccggttcacgattttcggttgtgaaacatttaccatgccaaccacaagccagcgtgggcaacggctttactttctgtatagtatggttcatcgtagagcaccagactgtgaagtggcggagataagccaacgggggtcgctggggagtccataccttgtttataagg

SEQ ID NO: 22156 - DNA, 1501 bp, Oryza sativa
aatccgggcatgaactgttatctgtttgtctctcttttctctcaatttgacaattgtagaactttcgtgctaactgagtcacatcgcataactcacgaattcacaaattgtaattgcttgattgaaactagctactggacttttcatatttagtactagttaaatagtcacacattcgtgtgactataacctcctgctctgctagatgataatcaaccaaacttttggtttccaaagtatgacaatagaaacacggtcccttgtatatgattattcgatttgctggtggctttgatctggggattagtcaagcacctcagttagtggaaaaaaaataatcacgttcagaatccaacccaggcaaggaccgaagcattaactccgattgtggaatcattcataaaactaaaagtccttgaaaaaatttcaagcttaattagaacagaacatgggatatttatttaccagagaagtaagaaaaagaaaattgataggggctgaagtaaaaaacagcaggaatgcagacatgagaaagaatactgataagggccgaagtaccaaatgcttttattgctaatttggatgtcttaataccctgaatatgtgatgtcacatccgcatatcggcatgagtttcaaaaaacattctcctgcatgtgtgcgcctaaacagaattagctgcttaatgagctggggttcaccacccaggataaccttcactaagctccgccactagacggagttagtacgaaatgaaggggcagagttagtacaaaataaaagggtatcactcctttattttactttaatttggatcgagttaaggctgatgtaagtatttaagtttggacagagggtgcaaataggatggaaatatatgaagtatagattaaaaatattttgaaccgggttgttaggcaccccctcagctccactctacgaccaagcaaccgtctggtctactattcttgatccatttcgtgatttcagacatgatcaaaccatccgattatctttctcttttgcagtacaaatacaaatttgtcggtacggcagcacagtactactgtgtactagcagaaaatgaaatcaatagagttgctataaaacattgaccaaggtctctcccgctccccgctctatagatacatgtccatatcgtccgaagcttcctactcaaacatttctcaattaacctccattggattaaataattgatcttcgagttggtcttctgaagtctgcaacgcaagtccctatcttgggcaacaagaacaaacaatttggcatacatgtgccaatccatggccttacacactctttagtacagttcacaatattttagcattcatctcagagtaggactttcaattaaacagctcaacatctctgaactctgaagcgtagataggcagatagctcaacatataaaagcagtagcaaatgcatgtccatatatgtcaaccaacagcgaaagtagcaattaattcagtcagttgaaa

SEQ ID NO: 22157 - DNA, 1501 bp, Oryza sativa
aagagtccattgccattgatcgacttggtagcaagctggttgatggaagaggagtgttcacctggcattatatactgggacactggatctccaaagcaatttataattgcaatgtcaagtcgattaaacttctatcaatccactaattaattactttgaagatcaatgcaattcttaaattatacgtatattgtgaagaaccgtgtgcctgaccatgatagggataggcacatgagtggcaagttgtttcggcttgttagccaagacagggccttgcgttgcaggcaatactagttaaatccagtggaggataagaaatgttttaattaggaaccttctgatgatgaactgccctgctatacatcgatgagaacatgattctacttctatatcgatggcaatatgcttacaagttacaaacggatctgttggtgaaccgaaacataaatagcatcatcagcagctttgaacctgctgctgcttgggcagcgcgtagcggcagagaggacagaggcagctttcgctgagccaacggaagaggcagatctcgtggaaggagtggttacacggcatcgtcctcagcatgtctttctcctcgaagtccctgaggcacacggcgcactcctcctgcctcgcgtcgcacgccttcgtcagcgcgaggcccaggaggacatctcgcgacatcttgcatcggggcatccccgtcggcggcgcggcgacgtcgtcctagcatgggcgaaggacgaggcctgatcactcggccagcccagtacacctctccctggtacacccctcgacggaactcttgtagcatgtcgcggatgctccgggcatcgctgttggggtcgattcctaggcgttggagcgtgcggtggaatctcatcggaactcgcgctgccgccgctgccggatccatccatctcccggcgctacggactacagtgtggatactagggtcgacccccaattctcggagtaggtcttcgaatttttctgccgcgtatggatcagaaagtggcgccgccaactgcgccgccgcccgagaatccatcaatctgcgagccggcggatccatcgcctgcagcagtcagaccagcttttgcgttgttgcaacaactggatgagtaccagattttattatagtggacgatgtgaggcacaacgagattgattaggactcggaatcgatcggagtcggagtaatccattcccgcgcgcagcacagcgcggcgcgtgccacgcaatctcgaccactgtctacgtatacctgcttcatctgaacgtatatacgtccggttcctagtactcgtagtaggtatttttgtctcccgtacaactgagacccctcgcacgtatgcacggttgaatttctggcagctcaacaaatcaagcattgcatgcctcaacagattggcacgcgtacgcacacttcaaatgttaatagcaacacagctgagctagtgacatactgacatatatatacgcaagtggcggctgccgt

SEQ ID NO: 22158 - DNA, 729 bp, Oryza sativa
tagaagagaagatctaattttaaataataaattccaatataaaagtgggccagataaaattttattaaatactttgcttgattctatagttcctagatttttctgggatttatttgaaccaaggaagtatttttaataaatggaattgcatttcatgaataatttaaattgaaaaggttttaaaaatcctccttttggctttgggccgaaagtcggcccaaaaccgccctctctctctttcccggcctagtcggcccagtctgcccgcagctgcccgcgcgcgcgcgcccttggccgctgacaggtgggtcccacctgtcggacccatcgtcctcctcgcgcccgaaccctagccgagccgcgccgccgccgcccttccaattcggccgcgcctttccttctcctgtgaaatcaatagaggggaaatgatccccttgatctcctctatcttttctcttttggaatcgtcgcctaattcggtttggaaatcatcggatttgagtttgattcggattcgttttcttctcccgaaccctaactttccctcgccttcgccttccaccgccggtagagctctagcgccgtgggccttcctcgccgccccctagccgctataaaaggacccccgagccctcctctctccgccgccaccctcgccttagctcgccgccgctcgtagcgctctaaccgcgttcaactgtgcgccgccgtcgccgccgcgagtttagc

SEQ ID NO: 22159 - DNA, 1501 bp, Oryza sativa
ccaatagttatagtatgtaagctgtactaaaaactgaacaattctaacatcatttatgtttgatctatgctcccaaatttggaaacaaatttctaactgaataaaaagtaataacctccattctttgctgcatatcctttagtttatcgtgcttatgctttattgcattgtcaccaccacacacaacttcatccaaagtaagcttttcactttctggaagaagttgttctttgcaatgctcacagtgaaaatagtcatccatatcgcttacaagttgcagtgcatcaaatgctgaatacctactgtcggtgacatgggaccgggagtatcatgacttagagacttgaggcagacacgatcacccacgtggcctaaccccctcggggggggggggggggtcgggcccgagggtgatacggccgcccttctctttgtctccccgaggggtcggaccgctcccgcctcggccccgagggccgaggcgccccgaccccttgtgggttttgcgccgcgtgtatgggttaggtgagcgcagcggggctcacctaaccgcatttattgcggtttgggtgagcacgtcacgccgcacgtaatgcagtacagcgcgctcgtttatccggtctgtgactggtcacagaccggtcagattgcgggttaggtggcaacaggcgatctgacacacgcctcgccccgtcccgtcaggatgagagtctctaggcactcgtccctagccagagccagcgtgctagctcctggagatggcacgttggtcctggtcaggtatatgccaggcttcatcccaaccattacaagcaagaaattgtatgaagaagggtggacatgcagattgctaaactgacgcgtggtggacaagaatgaccgatttgtgaccggtctgacactggtcatgtcgtcggcaaacagctgtgttcccacgtcgcgcctgcttccggcggaagtggaggtaggtatgggccgtcccatcagaaggtcattcggacggcaaccatacaagtctccgtctgtttaagaaaagataggataagtccccacaaaaaagagagagatggtgcatgtggtatccccttgaggtataaaaggaggaccttgcccacttagaagggggattgattttttgggggggatccagaacgatcagagagggagagagtaagagctctctggttctccagctcttttgtagcttcttcgtacatagattcaccaaaacacaggagtagggtattacgcttctcagcggcccgaacctgtatacatcgcccgtgtcttgtgtgtttccattatcgcgaaccttccacacaccgagagcttagaatctcacccagggcccccggccgaaccggcaaaggggggcctgcgcggtctcccggtgaggagccccacgctccgtcatctggcgcgccaggtagggggttctgcgtgtgttcttctaagctctcgcactctttcgtgtgcgccaagcttttcctgttcagcccaa

SEQ ID NO: 22160 - DNA, 228 bp, Oryza sativa
caaagattaaatcagattaaatcatttatatagattttaatggaattatgacgcaataatgaattatttttgaaaagaaaaaggggattattgcatcagcggctagggtttacggtggaccgggtgcacggcggcggctcacggaaacgaacggccgaggtcgatcctatccaaaacgaacggcgagatctaatcggttcatcgcgggtccacggcgaccggcaacga

SEQ ID NO: 22161 - DNA, 1501 bp, Oryza sativa
ctgtactgttatgctacttctaattcacgtggatatttgatgaattgcaccagattcgaaaattaccatggattgttatgtgcaattgggtatataactgctggttgtttaaaagaatcttatgtaagtttatgcttctttcatgatactattttttttgcagtttgtttatgtcatttctttgctacatgtgctttacatgaaagtttagtgcattcgctgttcacttgacaccgttaaacctatcttgaatataatttaatggtgttatatcagaacgacttgatggacatcccattagtaataccatccatgagaatcctttttgttattctctagtactaagaatatgatagcgaaatggactagtgtaagacggttcttgtttggagtgtcatgtgagggacagaattgcaggcagggaaagaatgagagtagtacttctctttccataagttaaatgtgttttgagattggggattcgaagaaagaaagggatgaattacattataatttacctatgccatacaatgttcagttgttcacaaaactataggacaacacaagaaactatgttgatttttatttttattctctctctgtttttttcctaatataaatctttagttaattttagggtattcccgtgctggtttcttgggcggttaatgtgccaaagtggctggggtgccccagggaagaaggcacaagggagtctgtagctaggcagttaagaattctaatccactgggttaagtttggcttgcattcctaactagagatgaactgacaaaggcgatctaccatgctggcaaaataagtccatagctcagtaaaccaacgcattacctattttgttgtgtccttcctcgtgtttagatggtggcaagaatggtgctttttcatcagtcttcgataatcctttgcactgtaaaaatatatgtaatgaatgcaactgagggctactgtgctgttattttttatgaatatgtacagataactgaagaaatagtgcagaaatcaattgatgttcttgtaaaagttgtcgagtctgagggttcagcattggcatccactgcgatggaagctcttggtcatattggtctccgttgtttattgccttctattaatcgaaattcctctcaaggtaaaatgtgtttcctcgcacttctgatagacgtgaactgtgctactcaccagcttcctctactatgtatttgtttaagctaatttcgtttgacttgcagctgcacttttaacaatcctgaatgagaagctggctaagctgctttcagaaaatgatactaaagctaaacaaaagattttgatatcgctgggacacctatcttggaacgagttgtcatttgcacacctgaataatgcattggacttaatttttagtctttcacgctctaaggtagttcttttgataaattcaaaatttgtggttgaaaatattctatatttgacaatattctattcctaaatatcattattcagg

SEQ ID NO: 22162 - DNA, 1501 bp, Oryza sativa
agtgtttattgcaggcttcaaggaaaggctgttatttttgcaatttattttatttgaactcttttctaaaacgactaggtgagtgcttctcaaacgactcggatgagacagtgcgtctcgtccggtcggagtatgtgcaatgcatcaatctttagaattgaaacaagattggcacccggccaacagcttttcaaacggccacccgggccaacaacttttcaaacggccacccgggcctagctgatcccgtcagctgctgatttttcaaacatcgaatccccttttcacaacagcaatttcacaagcagtagtcaaacaaaactacgctaggaatcacctcacatccgcccatgaccatgggcacggctgttcgaacagtttgttaacctctgcagagggggtacactttacccacacgacattactaacccggatcacccagcccgtggggatcagccacgtcgggagacctccaagctttcatgacaaggcatttcgaaagccgatacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgccttatgtttggatgaaattccaaggaaatcggtccttaagtgcgagagcgggaaatcgtacacccggtacgttccccggtccgcggttttggaaattcatttagttcgcaagcaccgacccaggtgtcgggttttccaagtcttttgtaaaactccagttttacccaagttgttactcagattttaagtttgaaggcgaccgtcgatactcgcacagagtgcacgaatatcgaggcgcaactgggtggttacaaggggacatggtgtaacaattaacaaggaaaggatcaaatgcaacaatttaggtaggtctgtcaatctgccttgcagacgggacaacagatttagtgtgatcctatcaatgcataatatttcgcaagcaatataattaaatttcaaatataggctcaagatgttcaaaggtggcttgccttgctcgcgatccggagcttgatgctcgaaatcctcgcactgcgggtcttcgggctccggaactacacgcgaaacggaacaactcaacaaacggcgaaaataaagcctattaaagacctctaagcgtgccactagatagatctcaagatttgggaaattttagaagttgaacggagtcaaacggaattacggttgggaagatattgaatttctaagattattggatttttgtctaaaggaaaaggatttatttaaatccctttttttggaaaagaaaaagaaaagaagggagggagggaatatagacttttctcgggtggctatggtgcggcccaagagatttggggcggctcggccgagcttaa

SEQ ID NO: 22163 - DNA, 159 bp, Oryza sativa
aagttcatcaggaaattgctactgtagcaagaagaggtactagctgtaacaggtgagctttgtccaggttagatgaattctgcagatcgatgaacattcacatactcctgttgcctgctccctgtcaaagctttttttttttaacattcctgtcaaagc

SEQ ID NO: 22164 - DNA, 1501 bp, Oryza sativa
actgcgcccccgcgcacgcgttgtcgtcgtcaccgacgccgacgtgtaggaacttggggtagagcgcgtcgatggcagggccgtcgaggcctagcaccacgacggcggacgctgccggggcgccgccgtcgtcgtcgtcgtcggcgaggagcacggcagctgcgccggccttggcgcggacgcagatgtaggaggcgagcatgacggtggagatgaagacgaggacgccgacggcgatggcgatgccgtagccgaggcacacggcgccgccgacgtccgctgcggcgggcgcgaaggaggcggcgtcgggcgaagatgcgggcgcgaaggagatgggcgcgtgcattcgtagcagcagtcgcgcgtgcatttcagtgtgagcaaataaaatggaagagatggagacagcagctgcagggaagtggggcttgcggctggacagtggcacgaacgagctgcgatgcgagcggcgtatgagtcggaatggcgtgacaaaatttaaggcggagttggtagaagctgatccgaatcgattctgaatttggatggcgagagtgcgtacgtgcagtggcagtgagagtgaagtactgaaggtgaaccaggaattactcggatcacacagccacatagattactaaattacagggcttatagggttacagcaacagttgatatattcttgcgcaaatgctcaccgtgcaatcacgtggctcgcgttcatcgtgatttatgaagcaggaagaggaccacattgcaaattgcaagcttgaacaatgtaaatggagtacaatcgtaaatgaatgtaagcacaagtaatcactcgaggcgggacgacagtcgagacagtaggttgttggcatcacaggaagccacagagaagtagacaaccaactcgaatcagttcttctatgggaccatgaatctgaccacaagccccacggccctccgcgtgctgttttctgcctaaaaaatgctccaggaaacggatcataaatcgctatcagtcgaataatcactcgtataatatttgcgtcccataatttgcagaaaatgaataagaactgtactccagtttgaatccaagttatgtgccaatgctaaataacaactggagaaaaaaattgtaatagcatccgatcaagttgctgttcaacaaacaatcccacgatggcgccatgttacttgacattagcatcaatctatcctatccacccaccaaatagcgcgaatctcactgaactgcggggaccacatctaccaacattctcagcactcgacgccggcgcacgcggcgcggcggaaccctggcggcaggtccggcgcgcggctccacttgccgccggcgatgtcgtacaccagcaccatcccttccaacgcgccgccgccggcattgtgacccctcacggccgcagcgctcaccacggccgccaccctgttggttcctaggccggccatcgccacgcgcaccgccatgccgagccccaccgaccccctcggcatc

SEQ ID NO: 22165 - DNA, 1501 bp, Oryza sativa
gcctgcggtaaaaaagaagggtatcacaatttgtgcattgacactacatataattagttaacacgaaaaaagatgaatattgaaacgagagaaaaaaatgttttagagagagagagggggaagataatagatttaagactaaattctttgtgatcataattggacaattgaagcagcttctccaattgctgatttccatctctagtaatcaaagttttcttatttacgaaaaggcaagggctctgcctcatgcattaaataaaggaagaagagtcatagtaagagagagtgaggagtggaagccgccttctcacacaagcccgagcatatgcacgctaggaaaaactcaatagacttgacagatgtacactccggggtgcaaaagataggattaaaggaggagaaaaaaagaatacagaggcaagggcctagtagtcaaaactgcacgttcaaaactgagcaagcagcattataaaaataaaatgtgggacatcaacgagtaccaagtaacactacaatatgaggaggcaaaatgttctctcagcagttccacatggataatgagtcataagaaatcataaaggagtactcagtatatttgtttcataatgttgtgtacaaacttgatccagttggtgatagtgttgattaaccattatttgccatagatttgataaacgacaaaccatgagtagcagttactccaaaacagtccctcagggatcataacaaaattgctcatcactcactctaaaaaaaatcttcaaatgcttgtttgagcacttaacgggacgttgtagccaaccagcaagaaacgaaataatcaatttaaccttgaaaaataaatcctagaccatgccataaatttgaaatgcacaggcacaaaaggtctgcattaattatctcggtcactgtaaattctccttgcctaaaatcacaagaggccaagagggagcagtattcaacatggaggtttcctcattggcactagcgagtagaaactagcatcatcaatcaatcaggtgagtgaaaccaacacaatagaacaggtcatgaaacatgtacagaaacacatgcaacagggcacattgatcattgatcagtgacagcaccgaggtcaggactttggttgaggatttaggtttggtctcacctggtgagggcgtcgaggacaacgacggcaagcccacagttgtcgccgcgagcggacttggggtctctggccagcgagacgttgtcgtagaatgcgcgcgccaccatcctcaccatcctgcaatgccagccaaaaattcccaaaccaaaaccagtaaaattacacctcccgcggatgccagctatcatcaatgcatcatggatacacggaggggagcacagcgggaggatccgcaccggttcaagggctccatggaggccatggcggcgacggcggcgatggcgagcggcggttggggtttcgcgggttttcgccgcgatcaggaggttttagccgctgcagcgcagg

SEQ ID NO: 22166 - DNA, 1501 bp, Oryza sativa
ttgtcaccatgctcatcaactccgatatgtcaaggatgacacccgcaagcctcttggggaagatcaacaccaatgacatgtacaagttgaagaagaaggagatggaggaagcctcaccttccaagaagtgcattgctctccaagccgaagttgaagataagggcaagggcaaggtgaatgaagtcaatgaggacttggaggaagagatttcccttcttgctagaaggttcaatgatctcttgggaaggagaaaggagagagaaagtggctccaactcaaataggagaagaaatagaagacccaacaagactctctccaacttgaggtgctttgagtgtggtgagaagggacactttgcttccaagtgcccttccaaggatgatgatggagacaagtcatccaagaagaagagtggaggctacaagctcatgaagaagcttaagaaagaaggcaagaagattgaggcattcatcggggaatgggactcaaatgaggagagctccgcctcatccgggtctgaggaagaaggtggtgatgatgcaagctccaagaagaagaagatggccgttgttgccatcaaggaggctccatcactcttctctccactttgtctcatggcaaagggctcctctaaggtaacatctcttagtgatagtgagagtgatgatgattgtgatgatgtttcctatgatgagcttgtgagtatgtttgaggagctctatgcttatagtgagaaggagattgtcaagttcaaggccctaaagaaggatcatgcttcttttgaggctttgtatgaggagctaaagacttctcatgagagactcaccatttctcatgagaagcttaaggaagctcatgacaacctcctttccactacttaacatagagctctcattgatgttggcatatcttgtgatttgcttgatgatagtgctacttgccatattgctcatgttgcatcatctagcatttctacctcttgtgatgatcttgtagatatgcctagctctagctctagctcttgtatttccatttgtgatgcctcacttgttgttgagaacaatgagcttaagtagcaagtggccaagctcaataagagtttggagaggtgcttcaagggtaagaacactcttgacaagattttgagtgagcaacggtgcatccttaacaaggagggacttggattcattccaaagaagggtaagaaaccttctcaccgtgccactcgttttgtcaagagcaatggtaagtattgctccaagtgccgtgaggttgggcatttggtgaatgattgccctggtggtaagcctcctaagacatgcatgtttgattctcattatatgcttaggaaggctcatgatggtagcattgttgctagatatgtgggttcccctatactcgatggtaaaaagaatgccatttgggtgcccaaagctttggtctctaacctccaaggacccaaacaagtttgggtacctaaaagagcttgatcttcttttgt

SEQ ID NO: 22167 - DNA, 1501 bp, Oryza sativa
ttatcgaatgactaatatgtaattgacatgcaagcaaatgcgttctatttcctgtcaaagtgtcaatatattactcggcatatgatgtatatattttcttttttttttgtgaggaaactaaatttggccattttgtttcattcatgcagctggcccaaaggatacacgaattgaacatgtgctggagaaaacctatgatgccaaggctggaattgggatgcctgatctataggttagtgctgtctgggttgcagagttcattgtatgtgtggcaacaccccagttcagatagcaggaagtctttcttcaactttgcacctgtattgctctcgaaataattttgttatggtcattgaaaaaacattaccccacatgtttttagtctctgctttggttagaatctttatcccactggaaatgcacatacagttggtaaaaaaagttcaaatcatatattctgttctgatgacgcctaagccgcggcaggggcttcttctgccacatcatctctcttcttcttgtcgcacggcggctcggaaacctgcggcgccggctgctgctgcacgaaagcagcggattcctggcgcgccgcggaatccggaggcgcccgcggggacacgtacatccggcagatgacgggctcctcgtcgccggcgacggcttgctgccggcagcagtggtgctcctccatcagccagtcggtgtagctcccgtccttcttgaaacggaagttctgcgtctcgccgaccttgacccccgccttgttcttcacctccttgctgttctgcctcacccaggtgccagcccccgccgttcgctctttcttggtgctactccccttgtgccgcttgcagctagtgaagaagaacctgccgcctttctcgcacctgggcaccggcgcgaactttccggcgaggtcactgggctcgctgccgtaaacatcagcgcggcagatgaatttctcggtgtctttcattggcttgccggcgatcagccgtggcaggtagaaggtgatgagatcctctgcagacgggttgaaacgaaagcctaaactgagcatcttctcgacgtgtttctccatcaaatcgaaatttcgtaagcggatcggagaaacgaaaacacgtatgcattgcgcgggaaacttgtttaactacagagacattgcgatgtagacatgtactacgtgacggtgagatggatacaggatttcgacacaaattcagacatagaagcagacaccgattcaaacttggaatcgattcagtggctatcgacgaagctcttgacggcgtcgacgagctcccgcgcccgcgccgccgcgacggggtgggactccacggcgaaccagttgaggtagaacacgtggccgatcccgcggccgtggctgaccaccgtttccactgccttgcccgcgcgcgccatggcctcgccgtactccacctgcgcgtcgcggagcatgtcctcctccgcgaccatcaccagcatcggcggcagctgggct

SEQ ID NO: 22168 - DNA, 678 bp, Oryza sativa
agaagaaaaggggaagaaatgggagggcaacggggagcaggagaaagagacggggagaagagagattggatggcgttaggaggatgagaggaggtggggatggagagaccaaggcttaaggcggtgggagcaagcggaggggaggacgagggcgtcgacgcggaggaggcggcgcaggggcgaggccccctgctccgacgaaggcatcgtggatctccgccgccgcccccgccgccggagaggttggtcgccggcgccgcagatctggagctcggatcggagtcggaggagacgcgtgcgggtgggtgaagggatgatgggattggggatattttttttcctcctctctctaaaaattctttttttccttctcttctttccgaatacttctctcttgacggttgacgcagtgtgtggagggagggggttatatatactccatgacatccgggtggataaggggacacgtgtgcacgcgcttgtctgtaaggccctgtccaggaattttttacactgtcttaaagaaaatctttacttaaaaaaggctatactatccactccgatgagatgattgtgcaaaaaatagaacgactattgtagtgagtacctttttaatcctattttttgtttcaataactcctcttcagttaacgtgaattaccagtactacagtataga

SEQ ID NO: 22169 - DNA, 286 bp, Oryza sativa
acctaaaactaattataaaccataatactctatcgcatcgttaccgcttacattgttttacctaaaattgattgtaaaccataattcttattggacagaaaataaattttatatgtattttagcgacttaaaaactaacattaaaaaataaactatgatgaaaaaacatcaaaatcaactctaaaattaagatttaaaatttaaattttaggtacagctaagctgaagggcaaacgatagtgctcacctcgattgggttttatattatttccttttttttggaagg

SEQ ID NO: 22170 - DNA, 1501 bp, Oryza sativa
ccataggtttttggtgcgaaacgaaacaaatccgaaaggaataagtttacgttgactcctttaaccagtggccgaatctaattctaaccacaatacggatatcttgaccccaaactattaaaactggtgtaatttaactcccttagtagttttggagggtggttttgctgatgtgacatcaatgtggcaatattgaccgggtcttcgttcacgtggcgttgatgtagcgcttaagtagaattagaattaaaaagggtatgtgtaggaccaatttacacaaaggatgacatgtggggccctctcctccccttcttcctctctctctcccttctctctttatctgactatatatgacagtggggacggcggcggcgtccggtggttggcagcggcggcggaggtggggagaggcgggtggttgccgcttgctaggtgggagcagcgtgttggggccagaggaagggcggcgacagtggcaagcggagacattggcgtggtgggtagcgaagacggaggcatccggtggtgcgcacagatgtcttccttggtgtcaccacccgcctcccttgccatgtcgaccgcgtccacatcgggtggagccacacccccaccgctcttcttctacagctggatcgacgcccgtccttgccgccgccatggcgtgcaggccggccatgtgctccccatccgccctcgcgccgctgcgccaccgccttttcctcctcggctacgtgtgcaacgcagctccctcagggcgccgttgctccccaccccgccgccgccgctcccaccgccgctccacccaggtgaagagaaaggccccatgggaggggggagggagaaagagagataagagagagaggggggaggagggagaagggaaggagagagaggggatgacatgtgggcccgtataataagtgggtcccacaattatttttgtgtgagtgacaaatgggtactacatatattttttaattctaataccacataaatgttggatgaagactgggtcaacaccgccacgtcagcaaaacagttaaagttaaattgcactggttttaatagttaggggtcgagatattcgtactgtggttcagggatacgaattagataaggtcactagtaaagggagtcactcccgaacttattccaatccgaaaccttttgaaggaaacggcccaattaaatgcccgaatcattcttctcggcccactctgatctgtccagcatcacattcgccgctagcgccggctccctcgccgccgccgccacccccatctccgccgcaaccaaggtttgaagcttactgggagggagggggagcccaggagcgagccgctggctgggtagagaggagggatctagtcgagagagatggggtggaaggctgcggagaagctcatcagacactggaagatcctccgcggtgacaacgtaattatctttccccgtcctcgcattcctcttcgcccctctcctctttctagcaaaatctcca

SEQ ID NO: 22171 - DNA, 240 bp, Oryza sativa
aacaatattttttgaatagatcctcggtgccagttttgttgacattgaccactctatacatcttgactgtttgggacgtgatgatgttggctgccagtgtcattagcgctgagtgctgagatgttaagatctcgacctcgacgctacagtcatcgagtcattccaagatcaagttagtttaagaatctatttgtaaaataaatttatagaacaatcaaaatataggggaaaaaaccagca

SEQ ID NO: 22172 - DNA, 1501 bp, Oryza sativa
ctcacaagctcatcataggaaacatcatcacaatcatcatcactctcactatcactaagagatgttaccttagaggagccctttgccatgagacaaagtggagagaagagtgatggagcctccttgatggcaacaacggccatcttcttcttcttggagcttgcatcatcaccaccttcttcctcagacccggatgaggcggagctctcctcatttgagtcccattccccgatgaatgcctcaatcttcttgccttctttcttaagcttcttcatgagcttgtagcctccactcttcttcttggatgacttgtctccatcatcatccttggaagggcacttggaagcaaagtgtcccttctcaccacactcaaagcacctcaagttggagagagtcttgttgggtcttctatttcttctcctatttgagttggagccactttctctctcctttctccttcccaagagatcattgaaccttctagcaagaagggaaatctcttcctccaagtcctcattgacttcattcaccttgcccttgcccttatcttcaacttcggcttggagagcaatgcacttcttggaaggtgaggcttcctccatctccttcttcttcaacttgtacatgtcattggtgttgatcttccccaagaggcttgcgggtgtcatccttgacatatcggagttgatgagcatggtgacaagggtctcatatttctccggtagagccctaagcatcttttgggcaacctcaagatcggtgtagtttgccccaaaccccttgagaccattcacaatgacattgagcctcccatacatgtcattcacactctcatgaggcaacatggagaatgtctcatattggatattgaggaaatgaagcttggcatccttgtactcgcttgtgccctcatggatctccgtcaacttgttctaaatctcatatgcggtctcaaggttgctcactctatcgaactcctcttggctcaaagagttgaacaaagcattcatggcttgggcattgagtttgaggttgcagtgatcaatctccgtcaagggcgtgccggtgatagcaaagcctacatccacaatactccaaatatggaagctcatagctttgaggtgagtagacattttaattttccaagtggagtagtttgtgtcattaaacatgggagccttccctacatggttcacctcgttcgacatcttctctctaggcggtgaagcctaatcaagagagatcaagctccgataccacttgtaggatcgagatgtcgactagagggggggtgaataggcgatttaaaactaaatgacacctaatcaaaactaacctaagttgctaggctttgtgagggtgaactctaactaagcaactaagttatgttttgcaaacctagggtgataatggctcaattatatctctaggaaagtaaatcacactcctatgtcaatgtttagcaatcctagggtgatatgatctcaagtatatctctaga

SEQ ID NO: 22173 - DNA, 173 bp, Oryza sativa
ccccccccccccccccccgctgtccgtcaccagcccacgctatcggtgataaagggagggggacgaaggactagctcctgtctccgaccaataccaccggcactcatcgctgccaccaagttcattgtcatagccaaccccactacggcgctgggaatccctcgtccggcagc

SEQ ID NO: 22174 - DNA, 228 bp, Oryza sativa
tgcaaatatggtgtgaagtgggtgtgcgtgtgccaactcgttgtttcttgcagctgtaaatttttgacggaatgatcattttttgctccagctgtgacaatttgggccattacgtttacacctatataaaagactggagccaaaactggatagtattgaattgtagatttgtagctaaaatgagcattttcagatggtagttacccagtttttacttatttttatagt

SEQ ID NO: 22175 - DNA, 1501 bp, Oryza sativa
aagcagcatataactatgaaagtctgaaaatcgatccttggtttcggattaaaatagatattctaaaataaacaaggaggaatattggacctttttattctatttaatcaattcctcatcccaattttttttggattttattgttttgactggatttaagcgagtcagtacaaatttatagaatcagtgggctgtaagcatctcatcagccacttggtacacgctacatgtgttaacttgggactagactatgcttagatggctcatcactacatttgtattttttttgttagcaaaatgacctcaggacatgtcatctcaaatagatagcatcgtgatgtgattgtttagggactcaatggtctataatttctaggtaatgaggcttggtggtaggatttcattgtcaccagcagttaaagtaaccttagccattacttgtatccttactatctggttcaatggcaaacatgttttatgtttgttgagctataatgtttctatagttctttttactgctcattcatgaaatggtacttatgaaattgaaagttgactgtatcacattgctccactgaaggggcctatttctgttcccttaaacatcaaatagcctttgtttcccttttttttggcaacataagaggttagaggggtctctattcctgttgtttcgattaagatcattacaaggttggtttccttgtacctatttgcaatcaatgacagtgttccccattgtttttgcagagatttggatcctcggttacaggttgcactgaaaggatatctggtggcaagaggcgttaattccaaactggcaagctcacttcaccaccatttggttgagaaggagcggtggcaatatatgaactggctgaaaactttggaagacatgttcagcagtcattgacaaaaatatttccagcactgaagaccattgaaatgttccccgtcaaatacgcacactttttgttgtggaaatgcatagatcagctagctttgtggaatgcaattgtcgtgcttaatttagttccgtggaattgaccacgaaatcaccatagtttggtcgaatctaattttttttaaatttccagctatggttggaacttggaaccttcgtgaaccagcaaccatccaaatatcgatggttgatcaagtgtgaacacggtttgtttcggttgaaaaacaaaaatgacaaataatttatttttactgtgctccatggaagcatggaagatggaacatgacgtaaaatcacagctgcacaactggttgctgctaacgacgaatcatcgaggattagccgattaggacggtgaagcgtgtctgcttcggctagcgataagaacgtcctctaaaaaaaaagaaaaagcgataagaacgtcctctaaaaaaaaaagaaaaagcgataagaacgtccccaccatgacaccggaaaaagcgccagataacatcgcctagtctcgtctccgactccgaccgcgacaagaataggcgg

SEQ ID NO: 22176 - DNA, 1501 bp, Oryza sativa
tttgattatttgtggacgattttttttctcgttcaatgccccgtcgcttactagccagagccgaagtagaggcgagactagccgaaggcgagggccggtcgaaggcggaggcggggactggccggaagcggagtcagagatgtggaccgcggattggcacggggagcatgtagccgccgtctcctctcttgtctgacttccatcaccacgggacagcctcctacggtcctaccagtgcccaccgtcctctctgcatctcccactgtgctctccacgctgcccactgcatgctgccccaaatgagatatgaagagaggtggaaagagaaagaagtaaaaattagtccacgtggattccacgttgactcagcccaccatgtcagctaaaattgggtataatattacctatgaccttgagtgacatggtattgtgagttggggtaatttcaggctcgaagacaagttgaggtatcaaaagtgaacttattctctattcggccgttcttacatgggcttgtttgtaggctcagtgggccaaattaaatatgcagcaaaggccgtaattgggctgttttttatgtgggctaacaaaaaggcccgtttgtacacagcatattttcacctggactggaccgtgcgccgcggtcaaacatttttttagcgtggttcatcaaacatgattgaccgaccaaaataaaacttagcttcagagagatgcaataacagcatcattagtgatcttgccaaatatgtcgcgctccaggtacaggagcaaattcgtcgaaaaagttaagaattggtagttgatgcaaggtagtattttgttgcaggagttcgttctatggatcatctgcttaacttgtactggcagtatctatgcataatgcagctacttttgctctcctttactgttatgttctgtgtgcatcctgctttggctctttggaaatctgaatgtttttatcatgttggagtaaatgggatgcatggacagagctatttctgattagtgattacagtttacctggttgaagcattcctttgctgagtaccaatgtatgtaccatgtggcacgtatttgtttggcgtattgatcctaaaacaaaagcagaaatttgaatgccatttggggggcactattatgctaatgttaaaatctcagtttaggggatgaaccgacggagatcaaactctgaataaaacaaccatctaggtttccgttttcttcacgaaaaaaattaccaggttgagtaatggggtcgaataaaatgcataaagacttttttaaatgacagttcatgtttggaacacatgcaactttactatattcctttgttccgaatgagggggtggtaccgcaccgtgaaatcctctgaaaaggaatatttagtcattttcacgaggctatcggcctcaagataaatgctttgaactaacttttcaagaaaaaaaatataatgcacaggtccttttagaaaggccaccacagtgccaaactgagc

SEQ ID NO: 22177 - DNA, 1501 bp, Oryza sativa
tgatacggacctactgtgcgtctgtgcccagtacgatggagcaatagcataaataacctgattttttgtcttaattgtttggcaccgatgagcaaatgaacgggacgaaacatgtagagcgatctaaacaagaggagaactgtattatgtgtcacgatctgatggcaaaagacaggacatacaacggttactgaatactgaacaatgaacacacaaaccaaaagcagttcttttttgttagctaaatgttgttcttgctaggcaaatcgacccacgagcacgatgagatgcggtagaaagagagaggggatcaaacagaaaaaccgtgatatcttgaaatggagaacgatgtgaggggaatggattagagcggctagttcgtggttagttagtacctgggtggagcggaccttggccttgtccaaggagcggcgctcgaggtcgggcacccagcggaagcggcggcggcgattcttgacgatggtgccgacggcttgccgccatcgccgctgcgcctcctcggacgggttcttggccggcacatcgaagttctcctgcaggtacctgtccagcttctccatctccggccgcggccggtgagcacgcacacgcagcgcagtctaccactccactttccactactactctgctctgcccggccggagaggaaggggagagagggaaaggagttatttttttctccaaagcttacaacttcttggtctaataaaagaagacaactgcatatgccctgtatgtttgggataaagaatatggaaaatggcaggcgatcggatcgccattttctaattgaatctttctttcctgtgtgaattgtactgaattagattcaaattcgtttgtttttgacgagagattgatattgaccaggcgattccattaaaaaaaaaagatattgactaggcgatggctaggactttccgttaactcgaatttatggatggatggatccgacgaatccggtggactctgacggctaagggcacacaactgattttgcttgccttgctgtttccgtcctctgatggaagagcacagtaactcggcgctttgctgtgttcgcccgatgatgaatgaatgtttaggtactgagcgataatgctgagaaagcaccatatatatcgccgcaggagtagttgcaaagtgaagcgacatggatgacatttgacgggtaccactcacactgtcacaatgctttaagctactgttggttagcttggtgttcgtcagtaagcctcgtctttggaatgacagaaaagattgggacctaaacaagctgaatcaaatttttatcaggaaatggcacaaattataacacaggtatagattgtcccacaagataatgaagacagactttgctggactccaacaaccacatgaatttgcacttccaaaagtgcctacaaacaggtttctagcaattctcactcaaattcttccaactttaactctgtacatcgcagtatccttctaaaaactt

SEQ ID NO: 22178 - DNA, 1501 bp, Oryza sativa
gtcaagttgacccctggatgatgtatcttattgttacttacccctctaaattgttagctagaattcaaattgtcaaggcctgattgagcacaaattctcccacttaattgacatgtctcaccgctcgctgcctatgctttgtaggtatagacgctttgatgcgcacacagtgacgataatgattgtaacatgataatacccaccggttagcaggtaaactagacaatacaagagagaacattgcaatataggagtctactacattcattcaaaaataaataaatctaagatatgatgagatattttctagtacaataaatttgaagaaagccttgtctaaatttgttgaactaaaattatcacattttactctaggatgtttattttgagacatataaagcctgttcactttgatgctattttcaaccttactaaattttagtaaagttaccaaaaaagtggctacatttagtttgttgccaaattttggtaactatataagaaatcctgccaaaattttgataagttgccaaatttttggcaataccaaattttgataaggttttttttggcatcaacgtaaacaggcccatagtgtagttgatatgagtcgtgacaagacatgcactagccaggaaggtcgcagtggcagatgagatggcttccattcccgttaaaaaaaaaaaccatgcagaactattttctgttgtggcacattggcagcgcccgaatgaagggccacgtcagctcctttgtccggtgcgtaacggttaaaagcggtggacccatccaacatggccggaccggaccggaccacccgctgccactatcaaccaccacagtatgccacttccactgtccaaccttgtcttgttaagagcaagtttagcgcccctttgaattataggaatgaaaaaacggagaaataagaaaaatatagtattttaatatgaatgtaagtgtaaaacagaggattgtagaacacagagaaaacgtagaaatgaccgtttgattagaccacaggaaaaacacaggaatttgaggagagataaagactcaaagattctatgaatttcctttgaatcaaaggggaccttaatagtataacgcaactaacaactctaatttatctataatcaatgtaatagctaattcatacaatagttatttactatactattaatatatagtttcacctgtcatatacatattacgtcttagagtccgtgctgtagttgtctatatatcggtagaccgctgctcttttatcttattttttatcttattaaaatatatttatagctggctaatagtctattattgttgtacctgctctaatgctaatgctaatctaagaggaatcccatcaaatcagcgagtaagggttcaccaatcaccattgacgccactctttcccccctcccgagcacagagcagagagagagagagagagagagagcgctgcggaggagaccgatgccgccgccgccgccggagccgg

SEQ ID NO: 22179 - DNA, 1501 bp, Oryza sativa
tttagctttttaataatatcattggcagtttaaaactagtccttattgctaaatcctctcaaggtaaactaccaataatatcacaaataaccatcttctattttattttgaaaagatggaaaatcacaaactgagtactcagtctaactacaatctctagattagggataggaaatgaactaaaggtcaagtatttaggtattgccatattgcaagaccgatggctccgccactgaacatatcaaggccatatgtatatagggaccgtggccagaggagaaatttgagggtatgccacctcattcgcatgcctttgaattttcgccacctaatctgtgtgcccttgcaaaagtgccactggaggtgctaatcttttgatttcgtgccattttcgtcgaaggagggtaggaggcggtggtccttggtggcggcgggcggtatctgtaatgccccgatttttgttcggggttaaaaatcattaaataatacattttctagaaattaaataaaagttaaagcaatttaattaagtgaattataggggaaattaaaattttcctttaaaaatcattggccggaaatattttataatattctctgtgccctaatatactctccagattttcccgcgaattttcggagctcaagaagtaattttaaagtcacaaacatcatttatccaattatataaaaagaaaacaaataatttccccttcctccctttcgggctcggcccaagtcctccccctcttccttcccggcctggccgccctccccttccctctctctctcggcccgctcggccccctttccttctcaagtccacattgcctcccccagccggcctcgcctttccctctccgacaggtgggaccggtgggccccacctgtcatccccaacctccctccatccggccggctgcaaccgccatggccgccggtttcaccccacgacgccgcgcttcccgcgctccacctcacctcgcgaacgcgtggactcgatccccacctcctcctcccctatttcccccactccgccccgcaaaatcagcgccgaaccgccgccaacctccccacgtcggcgccccacattgccggccgatcccacctctcctggccacgatctccatccccgagccctatataaagcaccctcgtgctctcctcttccgtttccccctcctccccgagctcctcgcaccctctcccgtgctccccgcgcgagcccgcgctccgccgctcgtcgccgtgcctccagccgccgcttcccgctgtcgccgcactgcgccgccgccaccactagcttcgtcacgccgcgctgcaccccgacatccattcgtcctccctgaagcctcgccgtagcgctgcttccaccgccgacccgagccacttccgcctcccgccggcgagcgtcgtcttgcccggccatgccgccgctacccacagcgccgccacgccctaccgcaccccgtctaccactcctcttccccaatccatcgcc

SEQ ID NO: 22180 - DNA, 1501 bp, Oryza sativa
agtttacttgcatgtattctgttttctaaaccagagtatttagtcactctagtcaagtggccattttacacctaagttattatcataaaattgtgttccctattaatcggggttttccattttgctagtattttattagatacgtcaagcataaatagactgcgaacttgtaacagtgttggcacgtactgcacatatgctcgttgctgacataatctattctacaacaggtcgtaatgattgatggtcgtgaaattggtgacgggaaaataggtccggtcacaagacaaatccagaatgcatacaaagtcataactgcaggttctggagtaacaatacccagaaatgccgatgaataacaggtgtatatgccttcctggtctacctgccggaaccagtataaagcaaacttgattgttagagaaataaatgtgaaaagatgcatcactaaattgtcgtgccaattggaaaatgtgtatgaagcatgtactctgtttttcttagactcagtaggggttttcgccaaaattgcagatttcatttgtggacgattatgaattcaataaacatgtccaatgctagtagctcagtttggcactgtggtggcctttctaaaaggacctgtgcattatattttttttcttgaaaagttagttcaaagcatttatcttgaggccgatagcctcgtgaaaatgactaaatattccttttcagaggatttcacggtgcggtaccaccccctcattcggaacaaaggaatatagtaaagttgcatgtgttccaaacatgaactgtcatttaaaaaagtctttatgcattttattcgaccccattactcaacctggtaatttttttcgtgaagaaaacggaaacctagatggttgttttattcagagtttgatctccgtcggttcatcccctaaactgagattttaacattagcataatagtgccccccaaatggcattcaaatttctgcttttgttttaggatcaatacgccaaacaaatacgtgccacatggtacatacattggtactcagcaaaggaatgcttcaaccaggtaaactgtaatcactaatcagaaatagctctgtccatgcatcccatttactccaacatgataaaaacattcagatttccaaagagccaaagcaggatgcacacagaacataacagtaaaggagagcaaaagtagctgcattatgcatagatactgccagtacaagttaagcagatgatccatagaacgaactcctgcaacaaaatactaccttgcatcaactaccaattcttaactttttcgacgaatttgctcctgtacctggagcgcgacatatttggcaagatcactaatgatgctgttattgcatctctctgaagctaagttttattttggtcggtcaatcatgtttgatgaaccacgctaaaaaaatgtttgaccgcggcgcacggtccagtccaggtgaaaatatgctgtgtacaaacgggcctttttgtta

SEQ ID NO: 22181 - DNA, 1501 bp, Oryza sativa
taaatggaccgcatacgaaaatgggactatttttccagacgtgaccaattatggtctgcctataatctaagtgggttcttgtataggaaaattgttttttagtagtgtgtgttacttgtttatctttgaggggtctttatgtaaatcatactgcatgtgtatatgtctgtcctaccataggcaacttaatctctctttatttgaaagatgtggtgtccactcatgtatgttgtatgtaaacctcttatattgaataaatgcatgagttttttttttgaaaaaaatgctaacacttaatccagcgaacgagcagtgaaaaaaaaaagtaaaaatggttttgaagcaacttatatcatcagatcaagtgctgaaaggttagcatatatttgtgaatttggacacatttattaaacatatgcatgggtaatgggtttatgtatggatctaatcaaaacccaaaagagtaaagtgcggcgtcagtctctaaatatgttcttatttggtctctaaactctcaagttgtattttcgggtctccgaatttattaaagtatgatattcttgtcctaaattattataacatttttggatcctacgtgatgttgacgtggcatgtcccacgggtgttaactctttcttttctccatttttcttcttttcttcctttcttattcatatggcaaaaaaaaaaggaaaagaaaagaaagaataaaatctgcgatcggaatatttatatatggcatgtcatgttactcctacatgggattccagaggtgtcgtgacaatttgagatcgaataacatactttaaccagttcaattattcgaaaataaaatttttaagagttcagggacctaattgacacaaacgagtaaatttagacaagggacgtgtactttactgaaacggaaaatatcttagagcaggtataatagcagactattagccagctataaatatattttaataagataaacgatgagagagaagaacatcaggctacagatatgtagcagctgcagcacggactccaagatacactgtgtgtatgacacgtgggaccatatattaaattggctattagattggctatagataaattggagctagtagtagacttagctcttataacgtgaaacacatgaagatatcggctttagttagtcttgagacagtcctgcagtcgcacgctaacaaactataaactggcgtacatcccttggtgatgcctctaattaagcacgccgcacaaaccggccataggtagatatatagagctaattaagataacagattaccttgcgtatttcccatacgtatcatatcaggtcacatatatatacttataatttcttgtaggagaagcatttggttgatcagtaattataacctccgccatcgaagacagaggtaattaatatcgtcttgttcctccggattaagcgcgcaacgtacctgcagctacgctagcaaagcgatcgagatcgatatggaggacagca

SEQ ID NO: 22182 - DNA, 1501 bp, Oryza sativa
gagtcagatggagaaatgaccaaaataaaaattttgcacctcgatgagttctacaactttgattttggtgacttttccatttgaaatcatttaataaccctaatttgatatcctggcctagggcataataggattaatagaatactcatacaacatgttacaactatttttccgaaagccaatctccatagaactttgacgttaagtgtgcttagtctggagcaatttcgggatgggtgaccgaccgggaagtttgaacttcccgcgtgggtgcacacgagtgagggctagccaaaaaataaagtttatttatttttggaatatactcatctgtgacgggcattaactctagcataagttaatgcccgtcacagatgactcatctgtgatgggctagtcatctgtgatgggctagtcatctgtgacgggccatagttaatgcccgtcacagataagggtcatctgtgacgggcactagttgtggcccgattgagataggtcatctgtgacgggctatagtttgactggtcgtctgggtcaaagctatcggtgacgggctttacttagggcccgattgagatagaatcatctgtaacggccgtttgttcgattgagatagctcttaacatcagtgacttctagcctgtgacggacgccatgcccgattgagatggggcttaccgcccgattgagatgaggatatccgttctagtgccgtgccatatcccgaacatccctcgatcgaatgacagctaactcactgaaaaactgcggcattggcgatgtggtttcgctgcttggtcatcactgctccgtcgtcggcttgccgggaaaggactccgtgttagtgatatttgaagggcaatttgatctatccaacggctattgttagtcaactgcatgggatttagggaattgcagttgactgactttagcaaatacgaactgaaactccaacgaagaagcaaattaacttaattaataagttgagcagcctgtaggcctgtagttggttttggacatggacattccaaccacattactatatatcaacctataagttattggagcaaaatagtaatcctccattccagagagatttgataggacacaccattttatcggaagtgttaggtgcgaagaaggccaccattttctgtcgatcgagctttattaaagctagaccgagacgaaacgactcaccaagactaagtgaaagactcaaattaacatactacaacaaattaaagacgacttgagccaatcaacgatggcgtcaagccagcgcgtccacacgacgtacgtatgcgcgcagagtttgcaaggccaggtcatccatgctcgccgtgaatccgtgctgcgtctataaaacacaaacgcagcatagccagttcatttcacattttcactgctacgtactcgatcatctggccagctgctgccatggcaacattgccacaaatggccgcgaccaaggagcgtcaagaggcggctaacccga

SEQ ID NO: 22183 - DNA, 501 bp, Oryza sativa
ttttttttttttttcccccaaaaaattttttaaatatgggaaaccccaaatttaagggccaaattctggccagaaccagagcagaggtagatacttagaaaggttgcattgacaggtgtaccacagttggtaatggtacataaccttatcggcttgtttggcaacttgagggaagaggattgggagtttacacgagaaaattgatggtgagattaagatgggaatttgatttttcatctcagtctcttgtttggtagaggtggtggaaattgatagggagtttagttggagattagatcattaatgaaaatggatggttgagatttgtttaggcgaagtaaaggaggaattccctcctaattacctgcccctacccaggtattgaaaaggagggagttcattcctcaattccccatccccatcccaccaaaattcccatgtcccccaaccaaacaaaacagttaatagcctcatccttttaaactcccaatccctcctaga

SEQ ID NO: 22184 - DNA, 1114 bp, Oryza sativa
gaaaatttttaaacgtgaacgagaacgacaatgaacgtgaacgagaacgaacgtgaatgagaacgagcgaacgaacgtgaacgagctagggaacatgaacgagcgaacgaacgtgaacgtgaaatgcaatatatatatgttacttcgcatttatcctaatacatattttttgtatcttgtagaaaagacgtgttgtcggagtcgtccctcaagccggagtggaagagctagccctagaagtaattcgtgcagacaagtgacgtaataatataaatgattgttatatttgtaatgcaattaagaatattagacttgtaattagacttagcatataagattgtgtagtgttctaatattatttgagttttaatataagattattttattgcaaattagacttagtatgtaattattgagtacggaattggtgcgactcctagcaattgactattgtagtcttaattagacttagcatatacgcacgaaacacttagcatacatggctattttagtcttagcatgtaatattatttgagttttaatataagattattttatttgtaattagacttactatataattattgactacggaattggtgcgactcctagcaattgacaattttagtcttaattagacttagcatatacgacagttacacttagcatgcatgactctttcagtcttagcatgtaatattatttgagttttaatataagattactttatttgtaattagacttagtatgtaattattgactacggaattggtgcgactcctagcaattgactattgtagtcttaattagacttagcatatacgcacgaaacacttagcatatagatgactattttagtcttagcatgtaatattatttgagttttaatataagattattttatttgtaattagacttagtatataattatttactagctagggttgtataatatacgtcacctagacttagcttatatcacgatttgtaattagacttagcacgtaaggttgtgtagggttctaatgtacgacatttacacttagcatacatgacttagattgttaaaacataaatgtctcgtgacttagcagatgtttcttgtatcaacaga

SEQ ID NO: 22185 - DNA, 1501 bp, Oryza sativa
ctgggtggagcggcggtgggagcggcggcggcggggtggggagcaacggcgccctgagggagctgcgttgcacacgtagccgaggaggaaaaggcggtggcgcagcggcgcgagggcggatggggagcacatggccggcctgcacgccatggcggcggcaaggacgggcgtcgatccagctgtagaagaagagcggtgggggtgtggctccacccgatgtggacgcggtcgacatggcaagggaggcgggtggtgacaccaaggaagacatctgtgcgcaccaccggatgcctccgtcttcgctacccaccacgccaatgtctccgcttgccactgtcgccgcccttcctctggccccaacacgctgctcccacctagcaagcggcaaccacccgcctctccccacctccgccgccgctgccaaccaccggacgccgccgccgtccccactgtcatatatagtcagataaagagagaagggagagagagaggaagaaggggaggagagggccccacatgtcatcctttgtgtaaattggtcctacacataccctttttaattctaattctacttaagcgctacatcaacgccacgtgaacgaagacccggtcaatattgccacattgatgtcacatcagcaaaaccaccctccaaaactactaagggagttaaattacaccagttttaatagtttggggtcaagatatccgtattgtggttagaattagattcggccactggttaaaggagtcaacgtaaacttattcctttcggatttgtttcgtttcgcaccaaaaacctatgggcttatggtgggttttgtgaaatcctctccggcctatatatagtcatctatctctcctctctcgatttggaaaaagaaaaaaacagtttctggtaggcattctcgaacgagatatgagtaatgaaatcgaagaggcgtgttgagtgagctcaaatcatcggagttcccattcaattgccttttgtttgtcaactgtgcaggttgatgctggcatgctgttagccagcttagcacacgttcttgtcaaatactcgagtgacaagaggtgttatgcagttgattctgtttctgattaatcttaaattgttaatcctcggatccaacgcacaagcagttgaccagttgagcaaagtagcaactgagtagtgtgtatcaacgacccttctcttcgcagcaaccagcaataccattaccagtacagttcagcaactaatcgtgagctgattagctgaagcacataacacgtaaagcgtccatgacgatggagaaacgcacgtcaccgcaacaaccgccaactttattacccaccaactgctcgacgcatttcctctacgcgcgcgcgcccaccaccgccggcgtcacacctcgccagccgcatcaaagcttccgctcctacctcgcccaaatgggcggcaccggcgacgatggcgccaaggcccctgcggccgccgcggccatggacgtcgtgtcgtcgt

SEQ ID NO: 22186 - DNA, 1501 bp, Oryza sativa
ttaagtatgaatttagttttaactcgtttcaataatacttatgttaatctggtagtggttagtaacaaagttagcaaattgttttcaactatattaaacacaagacgatactggttattccagctatgttcattcattgttgttaggagcaacatggttttgttgttaggagcaagaaacaaattcgacatctgatatctgatcgacggccatggttagttgatggcacagttttctgctcccctatctgttttcgtaggactgttgatacgtcgctgttcgtttgttagttcttcgttgtcttcatgtccaaagtaatttggaaatggtaggaacatctgtgtatatataagaattaaattagactagatcaactgttcatgattcatactaaacctttttgtgatgtatgacaatgcaactgaatttgccacgcaagcaagctcaacgctggtgctctgtggctgcaggcatccaggtggagcccctcccgtagcgaagccgcctcatattaaagacgcagagcacaaacctacaaaaaaaaaagatcgaatcattgaagaagtctctctaaagtgtaaaacgcaactaatcttcgtcctcttcccagacagccttgttgttgaatagagcaatttggcattgcatagccatcaatttacattatcttaaatctcatatggaataaaatattttttccgaattacctcatccggtttaatatatgacgtttagacatgcgtttcatcattcatgtaaactaattattttttattacaagtatgtaaaaaaaagtcatgcctaaagcacttataataatagaacaaaccacaaaaaaaaagtgataactatattttttaaataaaacaagtaaacaaatatacattaaaagtcaacagcgttagacattaaaaaccggcggaaccatatggcaattataccgatttatatgaaattcttgtattccgtattttttgcgggataacttataacacacttgtaacacaagtatagcttccatgaaaaagaaaaaaaacacaagcagctaacaaaaaaaaaaatggaggaaattggtgaaccaagaatgggcagggcagccatgcacctgtttgttgttgttgtcgtcgtcgtcttctcctaccttccctcccgtccctccaccgcgcatgcacgtacgtacccgccattgctgctgccaaccctattcctctctcttccaccgctccgccttcctttgatcctttccccaccatctccaatggtggcccccctcgtcgcctagagcaccgaccccaacgttgcccaaggaccagggtggccacctctcctcctccccccgccgcggtcccccctcgccgccggctcgccggcgacgaagacgtcgtcgtgcccccaccaccaccaccaccactcggccacccaccggtccttgtccaattcgctctctccacccccgcccgccgcgcggtcgtcgtagcaacggccgcgggcaccgccacca

SEQ ID NO: 22187 - DNA, 1501 bp, Oryza sativa
cgcctgtaaactgcgagacgaatttattaagcctaattaatccgtcattagcaaatgtttactgtagcatcacattgtcaaattattgtataattaggctcaaaagattcgtgtcgtaatttacatacaaactgtgcaattggttttttatctatatttaatgattcatacatgtgtctaaatatttgttgtgacgggaatttttggaagtttgaaagaaacaaaacactgccgtgcatttcgccgcacattggaggcccatcaagattttatatggccgccatggtccaaggcctcagggacatttcctgtattgggctgagccggactcttcgtcaaggatgaatttgtaatcagtgaaaaaatcgaggggctggatgcaaatctccattcccatcgtattcctctccttccagctcgagactagggctcgcaggtggcttattccccctaatttgctcgggaccagaccacacctccccaaggtgagaaccaaatctctgattccaatcttgttacgttcttggttgttctttgccttgcgatttgggagcggcagcagcagtaaggcgctcgtcaagatctcttcttttcaattgttggggtcgcgctagttcgtcgaaatttatcctttccgattgctggattgcgtcatttcgttaatatttctccttcccaatacctatcttgtgctatttggaaacgagagcactaatctacttcttcgatctaatatgtttgtacaggcccttgtatataaacgaacaaactttactcatatattcagtccattaattttaggtcctaatagttgttttttaacttatgcgaaaattgcaatgtgctgaacagtgcaggtgatatctctttcttaacgaaaaatagagtcagcatgtaattatctatatggtacttaagatcctaaaaattaagcaagggctaggttgattgcttgctgtttgaaaattgttccagttagcattttgctccattctttgttattagtcagactctcaactgctgtcatgttatttactcaggaattagatttttacttcagatatcatattatgcaaattgtattctatttctcatcgtgcttttatctctgtgcctttttcttttcttttcctttcccttccatttcacggaatatattggcatcatcagcttgttgattattcttcgcattgcatcatctttgcttcccctcttttgcatgctcttgctgtccatgctgattggggattgtatcttgagaacctccccgtgtaatcctttgtaaccataccactgtttcctcatttgttccatatacattttctttctatccagttggatacccatggctgcatcctgtttgacattattgcataacaagtactcttgtttatttggttgtttttcttcctatccttgtatcatcactttgctctcccaatattgttggctcctttgctctttccaaagttgccttggaactttgagcttttcaagatgc

SEQ ID NO: 22188 - DNA, 1501 bp, Oryza sativa
aagacggaaatcagtggcatatccttaatcaatattagtaaaatttaaattctgctaaaagtccacatataagtgtgatattttaggtactaggatttaaacccaggctttccaggtatatgttcttttcgagcaaatataatactggattattgaacgtctgaaacatgcttcccttttaaattgtgccattgttaaagaaaaactttataagaagtaattcattcgtttaaccccttgaacaatgatcacaaatcatccatttatgtatacccatttaactatttagaaaaaaaaataaagtcagccactactcatcttttctaaaactataagcatttctaagctacaaatctacataattgtctatgattgtatgtcataagattgagatagcgattatacaacttttgctaattatgaatagagattcacaaatatacttcaataaatatatactccttatcctatattggttatttgttattttagttgggtgtttttaattttatttaaaatacacttgtttagagtgctacgttataataataggctgtaggtttattctattctattatttttgaaagaaaaaaaagcaatggctagcgatagatggatagatggcgcactgcgatggcgacgaaaaaattcaagcaggaggtggcgccggtggtgcaggggaactgggcaacgtctccaactctagtctagagagctatagcggcgtgccacgtgtcccattttacctattactagaatactagattattaacctgttgcttgtttgtggttgactcctgagaaagttggagaaggttgttcatattattgtcaaaataaatcttattaaatttttataagttgacaatatcattaaaattttaacataatttattatgtgtttaaaaaaatttaacaacaaactaaatgtaagaattttttaataattttgtcaaaaaaaataatatggttaaatatatcgttgaacagccccgtagaattagggctagtcgattgccatataaagaaataaaaataagtaaaagctaacatttagcaattttgatgtttttaatgtgatttttttcattattaactttttaagagataaaaaatgatttagtcgttacgatttataataagcttttatcattcgatgtggcacttactttcaacgcaagtactcttaattttaaataaacaagtaaaaactctaacgaaaaaaaaagctatctgattttgatctctccatttttaagttattttttttgactttcgacaagctcctaccgtatagattaaaaaaaagaaaaaaaaaaacagagtcgcttacatatatatggcccagaggcagtgattgtcacatcacatgcacgagacacccgcgcgctctcatttttttttcaactacatacaaactcaaatcctcctcttcttcgacctcgcctcctcctccgccgccgccgccgcatttcgccgatggggatgtcctcgccggtga

SEQ ID NO: 22189 - DNA, 1463 bp, Oryza sativa
caaattccggaatattgtcgtcttccacttcatcttcttccatttcaacatcttgctctccgtgggatgtccaacaattatagcttggcatgaaccccgactcaacaagtggaaatgaatagtcctggatgtagaatactccttctgattcttacaattattgcatggataacaaataaaacccctttgcctgttagcttcggccactctcaaaaaatagtgcacgccgtcaataaactctttggaccgccggtcagtgtacatccattgccgatccatctacatgagtcaaaaaaaaccatacacaaataattattcttacaataatgacagtcatacaataattataagatatctttattcatacaaaaatcataaaatattacaccaaataattcttaaaaactatttgtaaagttttaaactaattttaatgtgttttacttcttttaattttcattttagtttgttttctattatttaagattaactttcactagagttttccttctcaactattttataaaaccttgtttagcaaatgaactaaatttctatatattctttcttccccacacacattttctctctcatcaacttacaactaaattttggagacaaaaaaagtgtgcaaaacataggtgcaaatatagtatgacaaaataaaacattggaggatgaagttgcaaacattttaggcacctccgatttgtatgtaatcaccaaaataaattcaatataaattttggcatgacctcccctcttttttgaagaaattttgaagcttgctcgggcagctggaggaggaagaagacatatatataggggtgggactttagtcccagttggtagcaccaaccggggctaaagatcacaaggatctttagccccggttggtattaccaaccgggactaaagttacgatttttagtcccggttggtaatcccgggggggcctgacatgccctgacagcattcgaaccgagattaaagatgatctttagttgttaccaaccgggactaaagatcaaatatgcccgttacccttttgaaccgggactaaagatcatctttagccccggtttttattgcatccgggactattgtggaaatcggccgatcaacgaaagatggtttctccaccagtgcggtctcccaaaagtaactttgacaactattttctattataatatatatgaaaatatcaacaaatatatggttttattgaagtacattttaaggcaaatctacacatatggtttttatatttttaagataaatattttagaaattatttgcagtcaaatattttaaagtttgattttacccttgtccaaaacgactaatattatcagcccggagggagtagaatatgtagcatcatgttctacatgtataaaactgtcatcaggtaaattaattttcaggcattctgttacaccatatctaactcttttactagg

SEQ ID NO: 22190 - DNA, 1501 bp, Oryza sativa
caaaaaaaccgacctttatggacaaccgataggaacaatatttcagtttggtccgaatcatagggaatgtacgtgtgtgctttactaattcaagttattataagcctcaatttaagaaatgagcttaggacatgtaacttctatagtcctagacagcgttgcaacgcacggacatcttgctaatatatagtgaattcatgcaatttgattgatttttgttcatgaagagtaaataaataattaatagctatgagaagacatccttgaaataacaaatccattttctggtgccttttctgccgctacttaattccttcccagctagctggtcatgatcatcatctgcgatctcgatcgaccattagttacagcagtgcatggaacgcaagaagaacaccgccgcagaatgcaaaaatcgctgccgttgcgtctttacccctgcagttgagcagcaaattaattaagcacgcgatataaatataatcaataaatttcaacagaagaagagctcatagtatatcatgcagcgtctcgatcgattaattacgtggaagcctccttaaggtctgagataatctgatcgatgcctctccgtgaaacgtaaaaccgtccaagttctcttggccgtttaatcagaactgttccgcgatctttgtaagcctgtccgatcgaaaagaatgcattaattaaggtccattatttaatcacaataatatatggttattactacctctatcctaaaataacagtagtagtgagaatccatgtccaatgtttaaccgtccatcttatttaaaaaatttatgaaattttttttaaaaaaatagtcacacaaaaagtactagtcatgttttgtcatgtattaacaatgcaaatactaatcataaatttttttaaataatgaatagtataaaactagactttttttgggacgaaggggagtagcaaacagaaatttcacaagatctgtcaacaaatttcgctccaactgatgaacgaaaattgacggattacctcaccaacaacagtaaatgttgtgccggttggaagaacccgctcagttcgctccaatccaactacctgtagaatcaagaactcatcatcatgaagataaattatttctctcttttttgacaaaaaatattaaattttgatcgatccaagtgtcagcagaagtactccctccgtaaaaaaaaacaacctaggaggaaatgtgatccattctagtacaacgaatctgaaaatgtgtcacatctatttctaggttggttttttttttttggaacggagggagtagttaaggtttagtagttaacctttaccgaaccttcttgtccacagacttggcacctactgcataattgtttgttctcctcaaagacgctgctctcacgattcagagtaaaaccagttgccttatgtgcttcaacaacatgcaaacgcccggtagcatcttcctagtaaaagagttagatatggtgtaacagaatgcctgaaaatt

SEQ ID NO: 22191 - DNA, 461 bp, Oryza sativa
tgatcttggtgagatgttgtagcacgccagggaggactgcgaaagtgaaaaggaggcccataaattggacaagatgttggaggaccacagaacttcgttgtacccaggttgcgagcaggggcacaaaaagttggataccactttggagttcttgcaatggaaggcaaaaaatggggttagtgacaaggcatttggcgatttattgaaactcgtcaagaacattcttccggggggaaacaaattgcccgagacaacgtacgaggctaagaaaatagtctgcccgttaggactggaagttcataagattcacgcatgtccgaacgattgtatcctatatcgcggtgaggagtatgagaacctagaagcatgccctgtttgcaaagcactacgatacaagattagacgagacgatccaggagaagttgacgagcagctaacaaagaagagaattcctgctaagg

SEQ ID NO: 22192 - DNA, 1501 bp, Oryza sativa
gaaatatagctcagaaattttccaagtgagtctagcaaaggtgcagtggaaaaagagatgagtatcagtttctgggctgttgcagcgagagcaagaatctgaaatgtttgaaactttagagtgaaggttagcagcagttggaagagcatgtcttagggcagtagcagtgcggtagcgcacttgaggagcccaaggcctccagctagactagaaaccggttagagaaccacacctcacaatgcatgtgtcttagacagtatctatgttagtgggtcccacccatattagtaggacccacccatccctcttttcacttccatctctccctcccatgcatgcaagcatgtgaggggaccactcacagtttcccttttggcatgaggaaaccgcaccctggctaggggatgcaatccttagcaaagatatgggtcccgccaccttttttcattcacatcagattttgaactagctggcaaacgaggtaaccctccagctaggagtactgtgaagagccttataagtctccaaatgaaagttttgaccttaggaggaatgcattttgtagaccaagtttttagaaggatactgcgatgtacagagttaaagttggaagaatttgagtgagaattgctagaaacctgtttgtaggcacttttggaagtgcaaattcatgtggttgttggagtccagcaaagtctgtcttcattatcttgtgggacaatctatacctgtgttataatttgtgccatttcctgataaaaatttgattcagcttgtttaggtcccaatcttttctgtcattccaaagacgaggcttactgacgaacaccaagctaaccaacagtagcttaaagcattgtgacagtgtgagtggtacccgtcaaatgtcatccatgtcgcttcactttgcaactactcctgcggcgatatatatggtgctttctcagcattatcgctcagtacctaaacattcattcatcatcgggcgaacacagcaaagcgccgagttactgtgctcttccatcagaggacggaaacagcaaggcaagcaaaatcagttgtgtgcccttagccgtcagagtccaccggattcgtcggatccatccatccataaattcgagttaacggaaagtcctagccatcgcctagtcaatatcttttttttttaatggaatcgcctggtcaatatcaatctctcgtcaaaaacaaacgaatttgaatctaattcagtacaattcacacaggaaagaaagattcaattagaaaatggcgatccgatcgcctgccattttccatattctttatcccaaacatacagggcatatgcagttgtcttcttttattagaccaagaagttgtaagctttggagaaaaaaataactcctttccctctctccccttcctctccggccgggcagagcagagtagtagtggaaagtggagtggtagactgcgctgcgtgtgcgtgctcaccggccgcggccggagatggagaagctgg

SEQ ID NO: 22193 - DNA, 1501 bp, Oryza sativa
ttttggattttttttagataatgattggatgattggataagctaatagcttgaacaattactaagaaagcaatctgcaaaacataattggagtcatcttactcaatgaagttatcatattcaatggctttgttcttgcccccagtcttgtcaaactttgacacaagcaagtctagcacagttggagaaactgaatatcccagactgagaagagcatcacgcaattctgttgcatcaattttaccacttcggtcacgatcaaacctctcgaaaatggactgcacagtacaagcagaaaatgcacgtattcagtttcaacagtaacttcattagttccaccgcacagaagaaaaggaaagctgaagctgtagcatctcaccctccaattctgaagactgtaaaacacagaggtaaattccttgggacctgaaaggatcaaagacacatattcaatgtggtttacataaaaacgaataatataagaaatgcttaagttcaaagtacagtatctagcaatccagtatttgttaaatcaggtgcatttcacaggttagaactaaaagtccaaaattccatatacaagctcactagctgatagcctgaaacatagcactggtttcagagtatacactgctcaagcaattcaaagctcatgattcaatctctagttctctacacagaaaacagatgccaaaagaataggacaaatggcattgattaaagttgcaaatatctagttttcagtttagcagtaatttgaaattgtaaatagaactgacaaacaaaagttagtatacaaggtaacatgtataaactgccaaagtagcatgcccttttactggagtaaacccaaaattctttctacatcacaagccgggagaacttacaagttcattgtgcaaataaaccagtatatgtgtctatgctgtaccaaagtagaccacaacaaaatgagctaggattttccacaattctattgaatcctatcccacaaagaaattgatgcaatttaagaaacttaattaaaagaacccgcatcccaacacctaaaagtaaactccagcttttaacaagttgccactatatcgttgcccccaccacgttcccccgtcttcctcccaaacgacaagtcctggccgtatgatgcaaacactgactacagccctggctggaagactccatctccgcatcggaagccaaaagtcgcatactggcatcgcaaataccgtgggaagcttgataatcccgcggagagccacgtgccaatcgcgtgccactcgtttgactacacatcgcccaaagcacaaccaccattacgtatgccgctgaccaggacaacgcgcacgatagcaaccatggagcgatcagactaacgcacaccatccccaaggccagaactattcaattcgcgggtgagaggatgaaacgatgaacttaccaatcttgcggacgttggtgttggtgaagaggtacatgaggaggtggacggtgcggaggctgaa

SEQ ID NO: 22194 - DNA, 1229 bp, Oryza sativa
ccgccgcttctagttgggcgggcagggttcaaaatctgttttcgctatttgtattagggataccgagaggacctaaattttggtgatttcagtctgaaaaaataattggaaattttaacaaaatttggctaaatgaaaacaaaccaaaaaaccatgcgaataatttcatatcaggggatctgatagaccccaaatttcagaaagtttagtcagaaattttaaaccctgcatggggagggtgggagccagaagcggcgaagctcatcctgggttgtcggacgaaatggccaaggtgcctggcgcgcatgtgagccggagacgttccgacgacgaccagggaagctgaggacgttgtgttccttgtcttggccacacccgtgcgtgggggcgatgagaccggtggcggtgatggagtgcgtacgtgctggccgcgacgaacctcaccatgggcgagtggcggcacatggatttcacgggagaggaggtggaggcgtgtggtggcgacacaacacagtgatcccggactcccggggcttcttcggttgggaagcaacgagacatcgtctacgtagctgatggctacaacgaggccaagaacgtgctctgctcctcctacgcatatgacatcgctgccgacgcctagcgcgcgtgctcccggacaagttcaaggagtgcgacgatcgagcagctggtagccatagggaatgagtggcaccttcgtctttctcgctacgctatttttccttgtggacttggggaggaagctacccatcggatgtccgatgccccaaaataattggacggtcaaatgttacagttgaccaacaagtgaaacattaagttatactagaaaaaatgcccgtgcgttgcaacgggtaaactaaaattatacaaaatataaaaatattagatgattagggtttagttttacatgatatgagctctttaagaaaatctattcataatgaaataaaaacaattcaacttaagggacctcaagtgaacttattctgtgcgtgcacgtggcccatgaggcgggctacagtgtgggcggcatgagaacatattcggggacgactttagggacataaagtaaacttattctctgaggagattacaagcggcccaatagtgtgggcagcctaggaacgctggagaagctgagccgttcgatctgatggacggtcttaattgatcacgacctatataaaagttcaatgattcaaacc

SEQ ID NO: 22195 - DNA, 1501 bp, Oryza sativa
gacaggtggggcccaccggtcccacctgtcggagagggaaaggcgaggccggctgggggaggcaatgtggacttgagaaggaaagggggccgagcgggccgagagagagagggaaggggagggcggccaggccgggaaggaagagggggaggacttgggccgagcccgaaagggaggaaggggaaattatttgttttctttttatataattggataaatgatgtttgtgactttaaaattacttcttgagctccgaaaattcgcgggaaaatctggagagtatattagggcacagagaatattataaaatatttccggccaatgatttttaaaggaaaattttaatttcccctataattcacttaattaaattgctttaacttttatttaatttctagaaaatgtattatttaatgatttttaaccccgaacaaaaatcggggcattacagataccgcccgccgccaccaaggaccaccgcctcctaccctccttcgacgaaaatggcacgaaatcaaaagattagcacctccagtggcacttttgcaagggcacacagattaggtggcgaaaattcaaaggcatgcgaatgaggtggcataccctcaaatttctcctctggccacggtccctatatacatatggccttgatatgttcagtggcggagccatcggtcttgcaatatggcaatacctaaatacttgacctttagttcatttcctatccctaatctagagattgtagttagactgagtactcagtttgtgattttccatcttttcaaaataaaatagaagatggttatttgtgatattattggtagtttaccttgagaggatttagcaataaggactagttttaaactgccaatgatattattaaaaagctaaaatttagttcttttgaagaggactagtttacacattgattattatcgaccgtgaatattttatctcctttcctattgacactggttaggtcttacacacccaacctgaaatcccgctttgtcattgggtacgttgtgtcatctcacctccggatagttcatactgaggcccaagatttctgggtatgtttggattgatgccctaccaaaattttggtagtgccaaatcttggacaagttttggtactacgaaaattttggtagggtagagttgaaaatgtttatttggattgaagccaaaatttgcccataagagataagttcataggcaaagccaaatttatggcataggtagagttttagtagaaatgtttagtttgcaaccctactaaaattttggtagggcaaattttagtagggtaacaatccaaattggcccagagttaagtcagcccatcttaagcgatctacagggagggaggaaacagcagttagatggatggataatccgataggcgaccgaaccaacggcccaccggcttccacgtacccaaccaaacaagcaccgccttgcgccagccatccctgagagcacagagcactctaacacc

SEQ ID NO: 22196 - DNA, 446 bp, Oryza sativa
ccgccgcttctagttgggcgggcagggttcaaaatctgttttcgctatttgtattagggataccgagaggacctaaattttggtgatttcagtctgaaaaaataattggaaattttaacaaaatttggctaaatgaaaacaaaccaaaaaaccatgcgaataatttcatatcaggggatctgatagaccccaaatttcagaaagtttagtcagaaattttaaaccctgcatggggagggtgggagccagaagcggcgaagctcatcctgggttgtcggacgaaatggccaaggtgcctggcgcgcatgtgagccggagacgttccgacgacgaccagggaagctgaggacgttgtgttccttgtcttggccacacccgtgcgtgggggcgatgagaccggtggcggtgatggagtgcgtacgtgctggccgcgacgaacctcacca

SEQ ID NO: 22197 - DNA, 1501 bp, Oryza sativa
atttcctgtaaaaattaaaggtcaaactagtcatgaagtatggaaagcgttgtcgtattcatcagaatctatgctagtatgttgctaaatcctttttctagattcttttattatactgcaggcactggtggtgctgggccaacaatattaacaactagttttctgcttcttgcggaggatgtaatcgcatataacaaaggtacttttcgataatttattagtgcacttataggatttctctatgaggaaaatctaagttttgttctcattacaaattcaggagaagaaataaagttgaagccctacagtggagctctcagcattgattttggcaaaggggttaggaagaaagatgtttacttactgtaggcactgaacattaattactttttgagatcttaccacaataaggaaaaaccactttggttagaattcaaaatggaagctaataaattttatattatgccactaatccaggaatttgcctgaggtgaagagtgcttataaggttttaggtgtgcctactgttagtgctcgcttcggtactgctccttttttctggaattggggaatgcaggccttcgcaaactttttacctgttgtatgtcttacttctcaaattatgcactatcaatttacttctttcagacacaaccggtgctattagtattctagtactagtaaactctactaaaaaaaatagaagttttaacttttaagcaaccaattgcttacattttattttattatttaattatgtagttggtgaaatcaactaatactattattactgttaaaccaacatggtttgcttgttttctgctgaaatcttaaaaatgggataatattaaactggtgatttggtgctaatgcggattacacctgactgcaacttgttcgtgttcaggaattcttgagggatagaaataaggttctaaaattggttggatttgttgatccttttgtccgagctatcgatggtattgctggagagcgtgtttccatgagagtaagtacctaaagctgtgttctggaggtgaggttgggaactcacttcatgcacccgcaaaattaattatttacttttttttttgaaaaaatgtattaatatgattttttaaagcaacttttgtatagaaattttttgcctgtgtgttttagaagtactagtttcttccaaggctccaagctatttccagagttaactgcatactctttcaagctgtggccagaataggtatttgaatgccagttttaaaatatttgttcagccaatttttcttcagttttttaaaataatttactttctaaactttgatttgatcaattataagattgattttatcacttcttcaaaaagggagcgaagtatggaccatgtaactctcaatagccatcgatttccacaaaatattggtacactgagactattgtttttactagttactggccaagatttgtttccttggtccaggttagcagcctagaagcatactacttc

SEQ ID NO: 22198 - DNA, 1074 bp, Oryza sativa
cggcaccatttaggatttctgtagtagtggaggcactgcagcgggccatgaatgcatggccagcatatcaaggtcaccacgaacctgagcaccggccgagcctcgcgccacctaactccggcggtagcaacaaggtgcgggcgttgcacgcagcgttggcaaagacagcggtgcaagtccggcaaccacggcgagcttagcacaaggtcgaccggcggcacaccaagcatgacgatgagcagcggggcgacaaaggtggcctgttgaaactaactgaggtgtttaacaaaattcatgacggatggcattgttctaattttgaaatagtacagtggcatccacccaatttcacgaacagtaatgacgtattcttaattgaacaaatttgcaatggcatccatcaaattaaccctatcaataataaagagccaacttaagagactattctttgtatgagtgctgtttttctctgatgtgaagtatttgagagcccctctacctttaaacatgtcctaaatactgaatcacaacttcacaagtttctaaaaaaaaaagttaagcaattctaggaatgtgccatatgatcgatgtggactagagagcttccagccctgtcctttcttaaatatttgaaagtatgtgaggcttttgtaaaacacttgctcccaagtctaataattaaatagtttctgtggggtataagaaaactgtataatattacttttataactattaagaaagcaacatgtttgtcgtttagaaagcaatcatttaattttaagtagcaaaggtttctttcaactggagttagttggagcacggtgtatgtctcgaattgtaccatgcctgtacacgtgctctttcgaaacatcaacattttggaattatgagcattaattaatttttcaggtgtgtacaatatgaggtactgcaacttcataattagcactaattaaaatatcagtgttaattaatcgcgagtctcggttaactaacgtacgctagtggtgcactacagtaggaaaaaaaaaatctaatcttggatagcatagaccttgtgaaaaattaattcca

SEQ ID NO: 22199 - DNA, 1501 bp, Oryza sativa
gattgcatgacatactgcagaaaatggcaccaaggagcttacccaaatgagccctccgctgactagaggttaaggcttctaaggtattgctcaaaactcagttacctgtcaaattgttgtcaacgacaaaggaaaagacggttgcccttgtacaaagctcactagagataggtgatatggctggcacaaccttgaccttactagatctggcgcggtggtggaaactagcccgtagactatgaagaatgccaccaagaggagcacctatgcactctctgtggaaaccagggcaaggatgaccagccccgatgacctccctgggaaccaaaagaataaagctacccaaataacatgacctaatgaaaagatctaactatatttttttaaaaaggaatcaacacgagactgtgttatttcattaaaaatagagggaacaaagtataacccttaggggtaacgaaagaaagaaactggaaaagaaagatctgactattactgtggatttacaaggagggtggagacccaacccctctacctcccatcaccagtgacagggccataggaactgaggagaaagaggggtcgaggaggaagaaaaaagcctttctctctctatcatctagagttcacgagaacacttaagaaaccttgaggcaattgttttcaaggactcgtaaagtcacgtttggaagagctaaatgttcttggaagctgatgattgatgggaatatagagatcccatgttttccagcttccgattagtagttcatttttaaattccatagttactaattcttataatctagatagagagttgagtattctggattctagaagtagttgcggctgcaataaagccctgaagccaaatagggcatatagatgtatttgcttttgaattttattttgagaatatttttctctgccacttttgtttcgcggcctgattagctttacacaattgctatgaaactctattaacttgtttgttcaagagctaagactatattgttcttgccatatgggtgtctcgtgtttctttgttacgagtgttaaataagcagtgcaatggctcttgtatttttgactttttgtctctcgagaggacatcccctcattttagacattcgtctcttataggcattgccacatagtccttctcattctatcactcgactttgatcccatgcatgtccctacagctaaaagaaaacactcgcattgcttgtggccatgaattttcgctcccattttacagctctccccacagcaaacgacattgcaggcttgcagcggtagagctcaacgtgtggctgtgcttttccttcccccacgccattgcaccggaccagcttcgcatcttcccctcccactcccagcagcgaaggaaaaatcccgggagatcacagctggcccaatcacgtctccccgcgccaccccctatccaccttaccccacccctccttatcttcctccctgcttgccacccgccaaaaaaaac

SEQ ID NO: 22200 - DNA, 181 bp, Oryza sativa
atagacctatctgattaagttatctagcaaaggtggtacctctgtatagtggtttttcttaagtcctcgcgcaggaggcaaatttatgccgtgaagggcaactgtgatatttatcgaggcgcaggtaaatatatgagatgaattgtgcacaaattgtttgtgaaccctgattgcgatgaca

SEQ ID NO: 22201 - DNA, 1501 bp, Oryza sativa
attttgttctgcacgcagaaaggccttgatttctctgaagaactggtggtgctggctggatttcttcaggtaagatatttgcattaccttcatgcacagtatatatgtctgaagaaacaaacgagcaaagtttacatatatggggggaaataatctgaatgctgtattattgatagataagtctaggtgagattatttgcagggcttgatatgaacataattgcacgcgcgtgtggaggagaaggggcttgcaaaagacagccaatattgctgagatcaaatatgcaacactgtaactgatcgatagcacaactctcttaatttctgaacatttgggctctgaaatcaaaagtgggagcctaatgcacacagttctcttaatctgtaattctctgaacatatatgtgtgtgaaagtttggttgatgttatcttgatcgttccagttccagaagtatgtgttgatcgaacgaggaagaaattttcaattcaaatcttgcctgttcctattctcccagcgaaaaagtgtgaagagagtaaggagttcatactatttgcatgtcgaagcttaaaggttatggtcatacatattttcgttaactacggatgaagatttacaaatagacttcaataattgtttactccttatgtgttggttttgtttcgatgttgtcggattgttatgctctcttgagagaattttgtattaagcggttgtagcttcttttgaagtaaatgccgaaatttttttatattatctgaaaaaaaaaattcctccagcgaaaagtctcacagacaattgtttcccacccaattggcgttgcgcgtactcaatcggattactcacattggttcccgagttggattggtagcgatccacctaggggctgtctttcgaatgaaacataaatacgagggctatttctgagaaaaggccgcacaaacttggaaatacacgttgaccaagttcacttgcctgtaataactctttttagatataatatataatattttcttacataggtttgtatataatctctcatatttctcaaactagaggtgaaaaagtcattttaagtcactctcgctgacatgacactctaaataggaaaaaagctatctctcccatggtgtttccgtaataaaaaaattagaagagtggtatctcgatagtgccactcgtaagagtggcaaatagttaaaaaaaacccatattccttccgtcgtctccgactccgaacatcctctccggcggccggcggccatcgtcgttgcctctcggtactcccgcccatgaccgctgccacgacctagcaatggggaggctttcctgtatcaaacgccttcctcgattcgctctccggcgcggcgtctccgatgctttcctccgtccccttctccgcaccgcattcctcctccgccgccgccgccgtctcagcaccgcggagagcactcatcctccgcggcggggacgcttccgtcgggaccccgattctgatgaga

SEQ ID NO: 22202 - DNA, 1501 bp, Oryza sativa
taataggaggtagcgggctcctccacctcctgccccgtcaccgctcgagccactggatggcaccggtgcaacctagggaagtcgctggatctggggcctgtgcccttggttccgactgtgggtgacgggcctcccactggccggcaagcggatggtggtggcggtagagagggctccccctcctagcgtgcggacatcaacaacagctcctgctcacagggcaacgacaatgccctcgggatgacgacggcgcgactgcagcaggccggcccgttcgacggagtggtggcgacgcggttccgcaggcaatggcattgaggggtccagtggaagacggtggcagtagggcttttgctttgctggtcagcaacgaggggtgatgggccactggttctgggacatccggacatccggtgtctctgttggtggtgatggcggttccagttcctggtggttgggtgtggccatgatgcaggagagaaggtcatctcagcacgctgcaatgctaaagtttgcttgcacacttgagagcgggcgcaacatcgatagttggttgtcttcatagtggtaggttggtggaggcctaggcaaaagcgtgaatggcgacgctagcgggcgtcgattcctccttggagacgtccttttggtttctctatcgtgtcgtgcttggagctaacccatagcaactatgctccactttggcttctatgggtggcttttgggaattcggagctgctgcgtcgtgttgacgagcttggtaacgatgactcaaagctatggtcggttctaagaggttctgtatgctgtcctttagggtagtcggagctgctacgcggttacgagcttggcaacgatgacttaagtcagagtataactgtcatgtttcgctccattgtagagttgcaagcttgttggtttgcaagtctctcctgatccctagcgtttcttgatgaagttggagttgcccgatcgcgtgggtacctgtgtgatgacgataatgccatgtctccgcccatgtgagggagcctttgcttgtcttctcggttgcttctttttgcaaatcttgtggtgaacaacatttacttagtgaacctagctgttctgcttttgcggccttgtagtttaggttggttagttgtgagtttgttgtagttgtgattttcgtcccatttttcctaattaactgtgcactgtaaggtttagtctcgttttgtccttagaatgagtcaccttctaacgtcgataacggcctaaacgttcgaaaaaaaagacatgcgttaaaaagtcaatgacgttaagcgaatgcccttcttggtagttttaaactttttttccatacttgtacacttcaaataaaacgtgatcttaactacttaaaaaatctgcaagtttcttatcatcacatgcgatttcgtcagtcgccttttggcatgcgtataactgggccatggaaacatgctaggctccatgtttgccacgtgcataagataagagacttagc

SEQ ID NO: 22203 - DNA, 1501 bp, Oryza sativa
cggttggaacagtactagccacctggaaatcaaccatttctaccatactgttccaatctaagttcattatattttatgcagtccaattaggcagggctaagcaaagctagcatatctggtttgctatgttcaggttacgcattcgaaatcatgaatgactaatgcatgagataatggagatatagaataaaggataattatgctcaaaggagagagataataacttgccttgctccaacgcaaataaattcaagataagcaacctgattatccgatcctcgaaataccacaggttgccatccaaaagataatagactctactaagaaagacgaagaaccaaattcaataaaagtcataaaataacgagaaaacgataaacggtaaagagggcttggttttaggatatagcctatctcttttataggacatagggattattgagctaatattatatgtggaggttctaaagggttggaggctagaggggattaagcaactaatgtcgcttatatttcatgtgtgggttttggtttcttggagagtaggagatatattgaataatctaactggttaagtggatatgtggctagtattgatcgaggttggctttggtagaagaatagctaggatttagttgttctcgagtcgatgctgaaataggatagcatatcggctcgtatttcatgtatatgctatgggtagttggagggtaaatggttgagattatagctggtgggggtctggcttcaattgtctaagccgatatcaaggtaagataaatatcggctagggtttgggtgttcgctagtcatcgctaaagcatgacgactaggtttggtatcttctctagtcggtgtcaatagacaatataacggctagagggatgggaggtttgtgcaggtttagcgaggcggaagtgttactccgacaaccgtgagtggcggcggagcggctaggatcacacagggcccgaaagctaactgtgcagtgtgctatggtggtcgagggaatagtgaagctccgaccgttgtacgcagcgaggcgtaagatgccaggagcagcacttcgacctttggtttgggttttgtcaggctttacaaccaacggttcgacgtcagggccaatagaccgcaaacgtccccatggaagacgtaaagttccaaccggccgcattttagtggctaataggtattttggggtaaaagaaagtatttgaaaaaggcaaatataaattcaaatgatatttgaataaattcaaataaaattataaaatagcaaattaggtatcaaaatatagcttttgaatttagatgaatttagatctaggtttcattggaattggatctacggtttaggagatatgggcttctaaagaattggatttgaattaaatagggaaaataggagagttactgtgcaggggcccacctgtcagtgtttgttttcttttctttttctttctcttcttcttcctcccgtatcttccttcttctttttcag

SEQ ID NO: 22204 - DNA, 274 bp, Oryza sativa
ggggtcgggccgctcccgtttcgaccccgagggctggggcgccccgaccccctgtgggtttggcgccacgtgtgtgggttaggtgagcacagcggcgctcacctaaccgcgtttatcgcgggttggacgagcgtcccacaccgcatttaatgcagcgcagcacactcgttcggtccgtgacaggtcacagtgtgtgaccggttacagaccggtcagatcgcgggttaggtggcaacaggcggcctttcgcacgcctcgccccgtcccgtcggaa

SEQ ID NO: 22205 - DNA, 1501 bp, Oryza sativa
gtgatcaagagagagggatttgggagctagggttttgcccctctccccggtcggcgcttcatccggtgcggggacgattggagccgtccattaaatcggacgactcagattcgcccagcgtcaggccgttgctgccgttgattacgctgcgcccaatggaccgcggaagtgcatcggaccgtccccgcatacgtcggccgcgctcagctgctcagcttgcgggccgtcgaattgactctaactcgctgaagatgggccagctcaagtttaggccggcttgggaagacctaggccgaaagcaaaattgatcaaacaatgtggctcacatttttcaaattaaagtccgttggataaactcttaagtagtctagaaaaataaatctagaactaaatcctaaatcctatgctaattgatcaaattagactcggttctacctatttattaatgtatcaaattagacttgatttttacagatttaaggttttcaaggtgcaacactatcaaacggtgtttttgccgttgcaacgcaatggcactattgctagttattcttaaaataccagtcggggcaaccacaaaaaggccaggtcgccaccttctggccgagcccagcacagctagcagcccacagccaagccaggccggctaggacgcctgctggtcaagcagccagccaagccagccaagccgtgcgcccatgcgggccatgcctgcctttgccttgcgccgctgctcgtagcagcacgagctgccgccgctacaccgtgacgaaccagtctcgcgctcaatcgtgtggactgtagcgccagtgccgtgagccgtgtcgaccgtggtcgccctccaaagtctcgcgccgacgcacgcccacgaccgcgagcatgatgcagcgccgcgcctgctatactccagtgtgctgctcctgcgcactcgtcgccacaccacgccgggcaaacgactccgtcccatcacgtcgcctccggtcccgctcttgaccaccgcccgcccttcaagccggagcctgccgtgcgccgctgccgcacgcaaagcaccacgtcgcacccgagccgcgagcgacgccgacgcctccctcgcattcgcatcagccctgtggcgcaaacagggcaagggccctttttctgcccggaatcgcgctgcgtcgtaccccgaccatcaaatccaacggccccacctcacgtcacgatctcacggacaggaaaccaaaggacaagtccacgacaccattgcttccctgccccatcccgcgtcggaagccttaccaactgccccacgccgcgagatcgtcgttcatcccaaagcctgtctgccaactgccaagcgcatccttcccagcctcgctccccaccctatcgttcatcctgtccacccagagccattgccacacacacaccgaccggtgctgtcgtgcttcctctcctttcagacaaagcaaaaatttaatttccttccagtggagaacctcgaagtcaaagaacaacgtgt

SEQ ID NO: 22206 - DNA, 1501 bp, Oryza sativa
aggtaaaaagttgtccactgtagttcaaggaggcccacattgtcagtgacacaagggcagaggttttgggtttagcaaggtaacccgagccgagagaggggtgggtgggcgtggtgtgtgtgtgcgcgtgtctgtgccaccttgtgctctgctcctctgattcatcaagaaaaaacagaggaagaaagggaggaaaaaaaaaagcagagtgcatccggtgagttggaattgggcgagcgcttagatctatccatccatccacatgaactgaccaccacgacgacgacgacgacgatttttaccagaaatgctttatttaagacgtccgacccggaagaatataccggacgggaccctcacatttaactaagcagagaaacaaagtagtactcgatagaagcatacatcagcaaactttttagttacgcatgtgtaaaggactcacacaatagaatagttattttttcaaccaaagccaacaaccaacaaccatttgaaacattaaaatttccttttctcttaaactatttatctagtctgtaatctgatctgttgtatttatggcaattaaatcttcttaacaagacctcatatgaatatatttcgataaaaaaatacatatgtttcaaccgttaaaatcaaatgtttcacgcatgagaaacaaatgtctcaatttttaattcgactttgttgcacatttaaagttttgtgttgcaacagattattaaatgttgcacatcctattatctaggtatttcaataagttttttcaaatgtttcactagtttatttgcaaatgttgcaatagcgttcttttgatgtttcagtaaataggtatgatgtttcagtacttataactcaactgttttatttatggtataaaaatgtttcatatgttttttcaacgtaatatactcatgtgagatcttgttataaaaatttaattacaacgatataattagatcatagatcatatagataggttaggagaaaaatcatttcaaaaattgctaaagagtgtacatgtatatagtaggaaagagatggtgcatagtgcatggtttgcgtgaatcctgttatctgctcagaattgcaacgggtagggcttccgatcttttgagttttatcggacgtccgagctgtagccttctccggttttttactttaatagtattgatatctaatttggaacttttattggcatgatggttatatcttgtatgttgctatcttatgctctgacaagaattctaaagcaattagaattttaaaagaattattatacgactccttatgtatttttaaaagtaaacgatcttgaaaaccgactcaaatacaaataatttatcaaaatatcagcggaaacatatttaatttttataatagtagagatagagatagatatataattaaaagtaacgtccacgcatcgtacgtcgctacgaataataagaactcttagatccgatatatattacatgggtaaagataaagaaatata

SEQ ID NO: 22207 - DNA, 236 bp, Oryza sativa
ggatactagatagtttttgaagatttaaatgttaacaagttgtctctgtacctttcctctagcacagcttgatgaattgctagctccctagtcactttacatgctgaaatcttggtcggctttggcatttcataccaattccaccttgcattttttaaatgtctgatgtctcatgttagaatctagaacacatgggagctaaaaaatttatggtgaacctttcattgtgctgcagg

SEQ ID NO: 22208 - DNA, 1501 bp, Oryza sativa
tcaagatgtgagacacgtgccgggactaaggaagagtttgatttcgcttgggagcctacatgagataggttggttgtatcaggtggattctgataggaagaccatgaatatcatgaaggacggcaagactgttatgattggtgagaggacaagctcatgtttgtacaagttacaagggagtgctgttgcaggtggagtcatggaagatgggtatgctggtgttgctgtgcacgatcctgaaggcggcgagcctggcgtaagctcgtcgggcggctcggcgtgagctgcggcagaaccaactcaagtcctggtacacgaaggttcgagctagtaacagattcggattggcgtggcatattcgccaaggtggagtttgttagagtttgtgtcgaatatgtgtacgtagtcggttacagtttaggacttggagttgtaataggtattaggactagagtatgagttggactctatcctaggttctctcataaatagaggagcgtgcctgttgtaaccgcatagcgacttagcatagcgagagggagcggctgccggcggcgaccggccgttagtcgttgtaactctgatacgctgtatatgctggatcggggaggagcgcccgtaatcagtaccccggagatgtaggccttggctgaactccgttaccaaatatcgtgtctcggtgtcgtcatcgttttggatctcctatggtgttttcttccgcggtttggtttccggtgtgatttcggggccggttttataacaccacgcatgccacacgctcgcacgcgcacgcacgaggacgaacgacgaacgaatgcacggacgacacctccagcttcccgcctccgtatttccttcgtttctcaactagaaggctcaagactggaggcaaaagaagcgcaatttcaacctatttcacctcctcaaatccgcccctactcccactaactcaatcgtcgtcaccggaggaaaattccccgaaactctaataccggcgccattgattgagctccaaaattcatcgcatacatcgccaatcctctgaaattgaaggtaaaattggattctccatgccgagtactccatttcccctctcattacacatccaatccatcgccggaatgctgccggcgctgcctcccggcgtcgccgctctgttcggccgcagccagccgcatggcgcgccgccgctccagggcgccctagctttggccgtcgccaccctgggactcctctcgcctcactaaacctcaccaggccgcctcccgcaccggagtttgccggagtcgccgccaccatggccgcctccgcctcctattactgcccgccgccgccagcctcgccaccggcgcttctctcgctgccgaccacaaaaacggaatcgcctcgacccctagataacaaaatcggcgcccccttgtccaaaaccggcctcctctgccgccggcaatgtgggattccggccagttcatgtgcagaacgagaagaacaggaaatccaa

SEQ ID NO: 22209 - DNA, 572 bp, Oryza sativa
ccaaccgggactaaagtcccacccctatatatatatgtcttcttcctcctccagctgcccgagcaagcttcaaaatttcttcaaaaaagaggggaggtcatgccaaaatttctattgaatttattttggtgattacatacaaatcggaggtgcctaaaaggtttgcaacttcatcctccaatgtttttttttgtcatactacattttcacctatgttttgcacactttttttgtctccaaaatttagttgtaagttgatgagagagaaaatgtgtgtggggaagaaagaatatatagaaatttagttcatttgctaaacaaggttttataaaatagttgagaaggaaaactctagtgaaagttaatcttaaataatagaaaacaaactaaaatgaaaattaaaagaagtaaaacacattaaaattagtttaaaactttacaaatagtttttaagaattatttggtgtaatattttatgatttttgtatgaataaagatatcttataattattgtatgactgtcattattgtaagaataattatttgtgtacggtttttttgactcatgtaga

SEQ ID NO: 22210 - DNA, 269 bp, Oryza sativa
ccctgatggtgagaggtttacaaccattttattctccatggtgaatatatattaaccatccccatcacctaataggtgaattcaccgcggggaagcgtgaacgggggccattgccatctctactccccaccctctcgttcatcctgtccacccagagccattgccacacacacacaccgacaggtgccctcgtgcttcctctcctttcagacaaagcaaaaaattaatttccttccagtggagaacctcgaagtcaaagaacaacgtgt

SEQ ID NO: 22211 - DNA, 996 bp, Oryza sativa
ccactgtaaactgtttttgttttctttggctgaatcaggttctatccggctctacgttgcactttgaaagcagaggaagcatcatgagacttcttccaaaagctcgtaattaaagcatcaataatgctacagctaccaggcatcacaataaagctacagctaccaggcaggagtactacttgccatgtgtctttctgtcagcaatttattctatcgaagggaagaaaatctggtagggcgaaagtccatccggtaggattggagccatggtttcgcttaggccgaggttagttctaaactttttctttaaacttttaactttttcatcacatcaaaacttttctacacacataaacttcgaactttttcgtcacaacgttccaatttcaatcaaattttcaattttggcgtgaactaaacacacccttaataagcgaaacggcatatttacaaacgaaaaataagttataaacaaaatttgtatatacgtgttctttgcaatctaaaagcaaagattgaaaaataaacttcgatgaaaaaaatcttaaaatcagctctaaatttaaaattgaaaattcaaattttagttaataatcataaacataagagatgagtccgtctcagtcataatctcgtgcaggacacgtgcctcagtcataatctcaaaggctcgaagcatcccctcaaaaatcgtattaattactaatgtcattagcaacaaaagtgacttcgacgtggacttgttcttccagcgcatatggactttctcccagcggggcgctagtcgcggcaccagcggcaattacgtgaggacattgttgttcgagtacagcagagtgccggcgataccgtgtgggacggcggtggcggaacattttcgacagcaacaaagcgccgcgcttggctcgtgttcggcgcgggaggtcaccgcccgccatgccgcgcttccctttccaggccgtgtcgccgccacacgccacggcaagcgaaggattc

SEQ ID NO: 22212 - DNA, 1501 bp, Oryza sativa
atgttttattttctctaatttaagagggccatgcagttatttagaaatatttgtacgatgtttaacgtactaaaaatagaggatagagatagagcttgctacatctagtaggttgatgtctatctatggattttttaggctaaaaaaataattttaattattatggaaataagaaaagaaaggaacggagggagggtatgttaggtacatgcgtgagaacgccgtacagaggtgtggacagagcgatattttttttaagatagatctaatgatctaaaataaaaggctcactaatttaaatgaaaatcgatgaccaaatttttctgtttatagggtgtcacgtgacgactcgagagtgtttatagggtgccacgtaatggattataaatgtttgttggaagtttagtggaaattacgatcttcaaggtatctaattattgattttttttatatactagtaatatgtccgtgcgttgcaccgggtcgtggtatgttggataaagtttaactcaactattgtttggagcactccaatgtggcgataagcatgggtgacttgtataataatcgcagaggtatttttattttgaataattattgcactgtacacgtgtatggttcgaagaatgtaatgcgttaacataatgattgtaccacgggaggaataaacagtgaatgttccgatcactttcacgcaaaaagaggacggaagtttgtttgattaaataggtaagttttagaccaataataatcaggacggataaaataatacttttataatggtcatgcgtgctttcttactctgtcaattatgctttcttactgtcaattattatgttattagagcatgtacaatagtaggctataagtcggttgcaaacatattttaagaagttaaatagagaaagaatagcagcgggctacagatttatagacagctgtagcacgggaaacagtgtgagtataacaggtaggatcaggtattcaggtattaatagtgtagtatgtaactattgtatgaataagctattagattggctatagatgaattagagttagtagttggctatactattaaacttgctcttgcgtgtgatccagttcccaaaatcatatgtggactcgggtggagatcgaccgtgtgacatttggatgatcgatagcgcgcataatcttaatatgtcgtgtctcacgaatttttttttatttttttacaatcgacatttttttacgtcaaacaaatattaaagtggaagtttcctgtgtgttttatgtcaatgataaaaatcaataataaaagaaaataccactcgtctgtgatactgaagtttaagtttgtacgtatatctaaacattttttagtggaaatcaattccgtggattagcactatctaggaacttgaccgttgtagttttcttttctttttttttttaaaaaaaacgaaagctcgtagttcattaccgagagcaaatatctgtagccggtcggagtgcttccatc

SEQ ID NO: 22213 - DNA, 1121 bp, Oryza sativa
tacgttgccgcgagaacgtgaacgagaacgagaacgatcgaacgaacgagagcgagaacgaacacgtcaacgtacgttgccgcgagaacggaacgagaacgagaacgagaacgatcgaacgaacgagagcgagaacgagaatgatcgaacgaagacaagcgagaacgagggaacgaacgtgaatgagaacaagcgaacgaacgtgaatgagaacgagcgaacgaacgaggacgaacgttaacgtgaaatgcaatatatatatatatatatatatatatatatatatatatatatatatatatatatatatatatattacttcgcatttatcctaatacatctttttgtatcttgcagaaaagacgtgttgtcggagtcgtccgtcaagcctgagtggaagagctagccctagaaggaattggagcaggcaagtgacgtaataatataaatgattgttatatttgtaatgcaattaattaagattattagacctgtaattagacttatcatataagattgtgtagtgttctaatattatttgagttttaatataagattattttattgcaaattagacttagtatgacattattgactacggaattggtgcgactcctagcaattgactattgtagtcttaattagacttagcatatacgcacgaaacacttagcatacatgactattttagtcttagcatgtaatattatttgagttttaatataagattactttatttgtaattagacttagtatgtaattattgactacggaattggtgcgacaagtagcaattgactattgtagtcttaattagacttagcatatacgcacgaaacacttagcatatacatgactattttagtcttagcatgtaatattatttgagttttaatataagattattttatttgtaattagacttagtatataattatttactagctagggttgtataatatacgtcacctagacttagcttatatcacgatttgtaattagacttagcacgtaaggttgtgtagggttctaatgtacgacatttacacttagcatacatgacttagattgttaaaacataaatgtctcgtgacttagcagatgtttcttgtatcaacaga

SEQ ID NO: 22214 - DNA, 285 bp, Oryza sativa
caagcactgatactatttttatcgtttgacttcaaactctgatagttcgattcctttattaaattcggaaggattgcagcaagcacattattgtacggtaaattgattgactaatactgtaggacttttagagtctgaggttatgaagaaaaaaacggatcgtcacatggctaggctatatatcttcactcattaaggtttactctaccttgtctatatatatgctcctctgactttcttgcgaatggtccatataaacctgtcctggtttgcatgatgactagg

SEQ ID NO: 22215 - DNA, 1501 bp, Oryza sativa
aagtccgaccaccccaatgaggagcagaactagaagatcatagtaaacctcatcgataggtatcatgactgcataggtgcaagaaagattcaaagtatacatccaagaatacaagttatctatcagcagttgaccaatcgggtatccgaaacttttgaaaggaataaggaaagaataaagttcctatacttctacttgtactcttcagaaatctcgaggacgagatttatttaagggggcaggtttgtaacatactgaaaattagctattttctaattatgcatcatgccggttcttatgttcttattaaccttctaaacctaggaaaatataattagagagagacctcctaaaactaacttgcataaaatccctctttgatatttaaaagcttttgtgattttcatttaaaattatcttgggatatttcttgatttggttttaatttaaaaccttctattgacaaaattccttttattcaaatttagtttaaaaaccctttccacttttatgaattatggtccaagaaattctccatcattgtcctagaacctaaaccaagtgattccaattttataggaattaattgtcgatccatcctttgattcgaaacctatccttaactttcttccaaatccaaattccttcctttcgatctagccactaatttaattcatgtggcttgataccctctttggcacaataataatatttttttgaataattgctcttgtgctaagaaggatatatttttattttatttccctcttccaaattaatctccttttagcctcaaataattttctaaatccatgtcaggcagtttgtggctaaaaatcctatttatttcctctctttgttttcttacctcattcccaaaaatattttgaggaattatattaattccctcccatttgagtctttaatatttagaccacattattgcactcaaatatttaggaaatatctcttttgaaagttatctccaaaaatagattcatttcaaaagttagccacctaaattccttccaaatattaatttggattcaaacttccttcctcaaatatcttccaaaattcaaaaataacttctatttgcttttgggccaaaattcccttttcttcttctatcggcccatctccctcttggcccaggacggcccagccaacccttccagctgagccgcccctctcctctctgtgggcgccaatgccaggtgccctgggcgccgttgtcgtgcgccgtgatttgcgccgccgccgacgccgtgccgtaccttcctctgccgccgccaacatccttccgtcgccgttaagaaatcaagtcggcgttgttagattaatgggctaggcccaattaaatcctaataaattccattggcccacattaagtgctatgggtaataataccagctttgaaatctaagtgaagagttctcaacttaaatacggagctagtggaaagtctctgttgaccggttgagatggtgcgcggacaacc

SEQ ID NO: 22216 - DNA, 1501 bp, Oryza sativa
aaactgtaaccgactacgtacacatattcgacacaaactctaacaaactccaccttggcgaatatgccacgccaatccgaatctgttactagctcgaaccttcgtgtaccaggacttgagttggttctgccgcagctcacgccgagccgcccgacgagcctacgccaggctcgccgccttcaggatcgtgcacagcaacaccagcatacccatcttccatgactccacctgcaacagcactcccttgtaacttgtacaaacatgagcttgtcctctcaccaatcataacagtcttgccgtccttcatgatattcatggtcttcctatcagaatccacctgatacaaccaacctatctcatgtaggctcccaagcgaaatcaaactcttccttagtcccggcacgtgtctcacatcttgaacttgacatcgcccattccaacaacacgataactcgtgtcatcgcccaagtaaacaacaccaaaatcaccagatttgtatgaagagaactactcccgctccgatgtcacgtgataggaactagctgagtccaacatccacgcttctccagacttctcgttagacactgtaagaatctcatgactactgctatctgaatcatcaccacgagctgctaaacttgcaatgccatctttcctcttcttcagtaacggacaattcctccttatatgtccaaactcatgacacttatagcaccgtgcccccttctccttgctcttcaacacccccgcttcatgatcatgctttgccttgaccagcaaactctcagcctgagaagcctccattgcctcgtttttctttgatcttctcaagtctcgtgcaagcaacgacgaaattatctcctcagttttgatagtatccttgccgtgcatcagggtagtcaccacatgttcatacgacggtggaagcgagcacagaagaattatggccttgtcttcatcatccagtttcacatctaacttacttagatccacaaccaactgattgaagacgtccacgtgcttcctaagatctgactcctcttgcatctgcaaaccatacagctattgtttgagatacaacttactcgtcagcgacttggacatatacaggcttgccaacttgtcccaaatttccttcggcgttttttcatccatgacctgatacatgactgttaacagtggaatttggaaagcccgaagtagtcatcggcttagagtcagcatcggcttcgaagtcctgagattagccgatgagagttgtcaagtcgtcagttgtcggattcttgctatattcggttaaggaaattgatctactaaaggaagcttatccagaagagaccgagttcaaagagaatgcggcatggcaagttatctattaattaggaatagtttgttagtttccttttatctttaggaaagtgtgtttagttataaggactttatcttttccttttatctttaggaaagtttctttcttgtccaacaaggacttgtatcaacc

SEQ ID NO: 22217 - DNA, 1501 bp, Oryza sativa
gtgatcaagagagagggatttgggagctagggttttgcccctctccccggtcggcgcttcatccggtgcggggacgattggagccgtccattaaatcggacgactcagattcgcccagcgtcaggccgttgctgccgttgattacgctgcgcccaatggaccgcggaagtgcatcggaccgtccccgcatacgtcggccgcgctcagctgctcagcttgcgggccgtcgaattgactctaactcgctgaagatgggccagctcaagtttaggccggcttgggaagacctaggccgaaagcaaaattgatcaaacaatgtggctcacatttttcaaattaaagtccgttggataaactcttaagtagtctagaaaaataaatctagaactaaatcctaaatcctatgctaattgatcaaattagactcggttctacctatttattaatgtatcaaattagacttgatttttacagatttaaggttttcaaggtgcaacactatcaaacggtgtttttgccgttgcaacgcaatggcactattgctagttattcttaaaataccagtcggggcaaccacaaaaaggccaggtcgccaccttctggccgagcccagcacagctagcagcccacagccaagccaggccggctaggacgcctgctggtcaagcagccagccaagccagccaagccgtgcgcccatgcgggccatgcctgcctttgccttgcgccgctgctcgtagcagcacgagctgccgccgctacaccgtgacgaaccagtctcgcgctcaatcgtgtggactgtagcgccagtgccgtgagccgtgtcgaccgtggtcgccctccaaagtctcgcgccgacgcacgcccacgaccgcgagcatgatgcagcgccgcgcctgctatactccagtgtgctgctcctgcgcactcgtcgccacaccacgccgggcaaacgactccgtcccatcacgtcgcctccggtcccgctcttgaccaccgcccgccctccaagccggagcctgccgtgcgccgctgccgcacgcaaagcaccacgtcgcacccgagccgcgagcgacgccgacgcctccctcgcattcgcatcagccctgtggcgcaaacagggcaagggccctttttctgcccggaatcgcgctgcgtcgtaccccgaccatcaaatccaacggccccacctcacgtcacgatctcacggacaggaaaccaaaggacaagtccacgacaccattgcttccctgccccatcccgcgtcggaagccttaccaactgccccacgccgcgagatcgtcgttcatcccaaagcctgtctgccaactgccaagcgcatccttcccagcctcgctccccaccctatcgttcatcctgtccacccagagccattgccacacacacaccgaccggtgctgtcgtgcttcctctcctttcagacaaagcaaaaatttaatttccttccagtggagaacctcgaagtcaaagaacaacgtgt

SEQ ID NO: 22218 - DNA, 1501 bp, Oryza sativa
aggagaaagagaagaaaaggaaccatggaagagctggctagacctgatatgtggaggtccattaatggttttctccccataaagataatttaaatttcaattatcataaggataaaactaagagaaaaggatgaacgacgcacaccacatggggatagggagggccggatatttttcttaaaaaaataattgatatgatgacctaaaataatgcgttgcatgtttaagtcgaaaccgatagtcaggtgttttgttttttatcataattttgtacgattcttttaacttatgagagacctgtatagtggcttagaaatatttataggatgtttaatgtataagtctttaacattgtttgggtggggagcgtggaaagaaggtttggtattgtcttaaataaaaatctaataacaacctaaatggtacgtccatcggtttaagtcgaaaccaatgattagatgttttgttctgaaatttttaagatttttctctaatttagaagtgtcacatagtgttttagaaacatttataaggatggctaatgggttttaatgctgcataggatcgcggtgggagtttaggatgttttttttttgtaagaaaaagatatatctaataacctaaaataatgtaaacgttactcgaatgttttatttttttagattttctctaatttagtagtcctatatggatgtttaggaatatcccttctttctataaagttaagaccaaagctgcctcttcaattcgccacgtcatcaacattatattagccgttcgatcaatatgtacatcagatatacaccattggatcccttatcctcttgcccagcatgcatggtaatcaccttgctccttcccattcccctcccttaatcacatgcattaatttacagtagaaacagccaaatcaattgagccaggaggtgcgatggttaataagattcatgtgcctcttgcgattctcttccaaaccttttaataagcccctttacaatccccactataaccaagtctcttcccctttgcatgaatcttttcatcgtatgttggattctatttggtaagcctgaatttaacatttattttaaccagattctatttgagtacacattatgatttgaaccaagcatgagcactatgaaagttttgtccattggtttctctgaacttcaagaaagaatccctatcctatgcatttattgttgttttagtttcttaagaaaagattcgtcatacttgcagccaatacttatatgtcctatcactaatttatttgagtagttgggaaggatatagaggattacaatatagctgtcctgacatagcgagaagcagcttaacttgctcggtatgtattttgttttcaggttcaaacaatacaatctaattgtccatactaatatgcatatttacatacgttctcaaatgtgcctgcagcgaagcgcggggtttcatctagtttatatgatgtgtaatgaacttattaggagaggctaga

SEQ ID NO: 22219 - DNA, 1501 bp, Oryza sativa
caacgacggcacatcgatcaaagccaacgcacgcacgcaagcaatgtcgtcgcaatcgatctcaggccagagcatgcaagataatggactaacgcggcggcagcgacggcagcaggaggtcccagggctcagcgcggtacaagtcgacgtcgcggatgaaggcggaggtgaagccggcgacgagcaccatggatacattccgccgcgggagtggccgcagttggcgacgacgacgcgactctcctcctcgcctcctctgccgctcccgccatcctcgccatctcctctgccgcgacaagctcgagccccggtgaccgacgtcgccccgtgccacttcgccacgtcctcgccgtcctccgccgctcccaccgcgagtgccgccgcagtcgctcccgctatcctcgccatctcctccgccacgatgagcgagacagtgaggttggcatgcgccgcaacgcggggaagcagagtaaggaagggcgcacgtcgcccacggcggagcaggtctgagaaggtcgggcgtgggaagagaacgacaagggcggcattgccgaagctgtgccgattagatttggatcggtgctgccaccgccgttccctgtcgtcgtcgtccgcgttgcctggggattggggcgtggaggagaaggaggagttccgaggccacggcgagctccgacgtggggctccaacacggtggcatgcgttgcggcgctggaaggagaggattgtgagagaagagatataactgacatgtgggtccaaggacatttttgacatttcacgcgatttctctccccccttcgaccgaaaattattattctaatcgatacggtgtccattgacaaattaccacgtttacggagtgttttcccccaaaagtatgtttgggcggtgtcctacggccaaaaccacgaaaccaaagtgtactatagcaaaatttacctttatatattggacgaggcccaatagtaatttcaataaaaaacattctttaaagtcctctatgacttctcttctcttgattattctaataaattataaaatcctataaattttgaaaagaattaaaatatctggttattggttttcacttaaattagtagattcattattgtagatggtttagaaatacaccgactatggacttcaattatagatggtcatatgggtcgaggcccgatggcccacccaaacccggtaattttggcccagcacagcccgacttcggtcatgcccgtgtcggccggggcccaatagccgtgccgtgcctgggctgctacctcggcacgctgggccggcacgtcccggcccgaagtttagggatacgaaacatacttattctcaaccatatgtaaggcacataacaaagaatagggaggcaaaatagatatattatatggcacggcccaaagagtcgggacgtaaaatagacttatttagctatatatatgtcacatcccaaagaggatggaaggaaaatagacttattttaaaaaagtca

SEQ ID NO: 22220 - DNA, 1501 bp, Oryza sativa
gagttgaaagatttcaaaatttgacttcaaagtttaaatcataagttgaaagtttttaaatctaacttgaaagttttcaatttattagaaaaaaaaagttattgtaggtacttaattatgattagcactaatcactaatcacgttatcattagtgctaatcacatggttagtgactggacagcgtacgcgcgggttaggaatcccaaatcaaaccaccacacgtattaacccaacatatatgtactcctttagtttttttctgcatcaaaccagtagcagggttaattgattttctctcttcaatttggttgacacaaatttgcaaagaatcaccggcaaaagagataggtgccttggtcacatcagctcgcctgagaaaattattttttagtagtgtaatgaggtgtttgtacatcaactcaactatatttgagatctggtgtgcacatataccttcaagtaggtaaggaaaaaagtcatttgaccatatagattatattatcattttatatatttgtagctaaataaaatataaaatttcttgaaagaaataataacatttacaatatttattattacctccgtcccaaaatataacaatttttagctatgaaactagaaaatagtctgtccagattcatagctagaaatacttatactttggaataggggaagtatgtaaatatatgtagatataacttttggacatacgttgctaggggctaaatctgattgtgagtaatcctatatacttatatagttcatccccactaagttaacgctatttctcttttctcattaagccacgtcaccctaattatttctagcctttatacgatagatctatagtttaaattgtctcttctttattctctcataacaccatgcaatttcaattatttttaggctcaaaattcataagtatcaatttgttttagttttaataattatattacatcttatttatacatattatgtaacttgatttcccgcatcaacgcggctggatactcatctattatttacaacatttactcccaatgcttttaaatagtgaagcctcaaaatgatattatctgatctatcttgagaggcatgccgcctcccaagaaattagaggaaacacattaaaagtccatcaaacatcctatagtattttatatatgacaaattttgctacaggacacttcgcctgtcggaactcacttttagaggaaaacgctccataaacgtggtaatttgctaatagacaccacaccgattaaaataataattttcggttgaagaagagagagaaatcgcgggaaatgtcaaaaatatccttgggcccacatgacagcactgctatctctcctctctcacatgtcacgccttgggagatgaaggagagggtgcccctgttcatgccgccgtggccctgttcgtcctcgttcccgatggccacctgaagctcctcgtgcagaagaagtaaccgcaccgctcctcctcctactcctcagc

SEQ ID NO: 22221 - DNA, 1501 bp, Oryza sativa
gggttggctcccgcaggtggccattctcgcgcacgcgtccatcggcacgttcctgagccactacggctggaactcggtgctggagagcacggcacacggcgtgcccgtcgtcgcgtggccactcaacgcccaagtgctggaggagtggggctcgtgtgtcgagctgtgccgcgggaacgcgccggactcaccggcgctggagcgtgaaagggtggccgaggtcgtggagatggtgatagggagcatggagatggcggccaagacacgacagtgcgtgaagaagattcaggaaatgattgctccagcactggaggacggtggttcgtccatgaacacattgaaggaattcttcgccttgctgacgctgcgggatcgtactatgcccatgaaattatgaaaccaagaggaataatttactatttttagcattttgtccaactttggactacagtgtctattttatggttgtatatggatggacggtcgatgcaaaggtatttaaggcctctacacttactcttaatttttagttttaacccttctgagttttgatgttaaattatactattgttgaaaatattgtatctttttttcggaaacattcatgaaagaagaatgcttctgagttgccttcgtcctcgtttgttgtatagcaatctccttcaaacttctctaggtatataagcttctctaactcaaaattttacttaactgttaattttaaaatgtttttaagatgtcttattaatatatcatggtgtacttgtagtctacttcgtatatattagcattattatatttacggtgtttatctattttttttagtcggaccacccataccgtaaatcctagatacgctggtggatcgtcctccttccacttttgcccaccacacacagcatgtttgctccatttgtgtaaccaccggatccaatattcctcaattacgctcctagtccatccctaattaggcctaatctattacaactgacatgtctttaatattggaacaagaattaagggtctgtttggtagagctcttgaagctaaagcccaaccaaacagtttcaactccattcaaaatgggagtgaaattggctacattgctctcacaaaataaactagaaaaatagacctagtttttggctgctccacaactatattttagacccaattcataaagttaattttatgagttggagccctgccaaatagatcctaaatgtaattatacaccagatgacatacaattatacaaatgattgcatctaagattatctgtaagtaaataggcatttactaccttcattccaaatataagaagttctaggtttgaacatgagaactataaaaagtatgtgaaatcgaatagtggtggattatgattggttaacaagaagacgtaggtagaaaaattaaataggagagagttgtgatctcggttgagaaaataatgtaggtggtattatatttatgataaattttaaatacttagatgtta

SEQ ID NO: 22222 - DNA, 1501 bp, Oryza sativa
ccgtgttcttggctcgcatcctttcctcgaacccttccgggaaccactcgtctgtggccccgctgatatcgtcaccattagtggatgaggagccccgctgcttctgtaaattcatagtcccattcccagcaaccccatttctagcatcaattcacatattccatcacagccaattcatatagacccattcccagcatcatatcagccaattcacattcatattctatcacagcacagccaattcacaaaatcaaacacatatacattcacatccacaacccattcacatatatgtcattcacatccatttttctctccaaaccgccgacatgcatcaaaacctgcaaaaataagttataaattggaacaattttatatgtaactagaaatgcaagtatatacagagacgagctacctaggactttactctgaagaatataattgtattacaaagaatatttacaaaaatcaaatgtttgtctcatatgcattgcaaatgttctgccattccgagacgagctacctaggacttcactctaaacatccctttcgatgacaagatatcatctagtatgaattgtgctatctcctctctaatgatttcgaagttgatttccggaatccttgaaataaattcctgcatgttcggcgccaagttagtctacatacttgtaaatttgtcgtcctatgtgtgtataaacaattgaattacacacctcagggtcgagcaatgtcaccttgtctgcgaagctcctcatgttatggcagacatggaacccacactggtcgctaacttgttgacgtattgggaagtctttcttgtgaccgagtttgggatgcccatccttatgcctcccgcctcttgccacgtattggtcccatgcctcgttcaaggcagattcgatggccgaccaatcgtatatttctggcttgatattggagttaaggtagtgtaccaaactccacttcggcgttattaccagaagaatccaatgtcgcctgcgaaattattaaattgccagttacatactacagttgtacgcgttgagtatttgagtataagtacggtacacgcttactattgattgtaggcgcacataatgaagtccttgtcttgacgggcaaataagcagtccttgatataggccaccatgtttgctcgatcgtttttcagcattgtctcgttgacgacagctggatcgagtaaggcaacatggggtgctttacgatggacatgcttccaggttaacctacgagcaagacaagagtcagggtaagtgtaatttatggacagtcactaccatatcgcgtaccaagaaatacttacaaggagtagcacttaaggaggttggtgtcgatcgctcgcaccctgtagaggtcccatagatctttgaagtctacggcgatgaaggcagtaggcccgaggaacggctgaccatcgtgctggcccaacatggaggtctctctattcttcctccttgcgttggacttctccatgtag

SEQ ID NO: 22223 - DNA, 1501 bp, Oryza sativa
ttggctcgcatcctttcctcgaacccttccgggaaccactcgtctgtggccccgctgatatcgtcaccattagtggatgaggagccccgctgcttctgtaaattcatagtcccattcccagcaaccccatttctagcatcaattcacatattccatcacagccaattcatatagacccattcccagcatcatatcagccaattcacattcatattctatcacagcacagccaattcacaaaatcaaacacatatacattcacatccacaacccattcacatatatgtcattcacatccatttttctctccaaaccgccgacatgcatcaaaacctgcaaaaataagttataaattggaacaattttatatgtaactagaaatgcaagtatatacagagacgagctacctaggactttactctgaagaatataattgtattacaaagaatatttacaaaaatcaaatgtttgtctcatatgcattgcaaatgttctgccattccgagacgagctacctaggacttcactctaaacatccctttcgatgacaagatatcatctagtatgaattgtgctatctcctctctaatgatttcgaagttgatttccggaatccttgaaataaattcctgcatgttcggcgccaagttagtctacatacttgtaaatttgtcgtcctatgtgtgtataaacaattgaattacacacctcagggtcgagcaatgtcaccttgtctgcgaagctcctcatgttatggcagacatggaacccacactggtcgctaacttgttgacgtattgggaagtctttcttgtgaccgagtttgggatgcccatccttatgcctcccgcctcttgccacgtattggtcccatgcctcgttcaaggcagattcgatggccgaccaatcgtatatttctggcttgatattggagttaaggtagtgtaccaaactccacttcggcgttattaccagaagaatccaatgtcgcctgcgaaattattaaattgccagttacatactacagttgtacgcgttgagtatttgagtataagtacggtacacgcttactattgattgtaggcgcacataatgaagtccttgtcttgacgggcaaataagcagtccttgatataggccaccatgtttgctcgatcgtttttcagcattgtctcgttgacgacagctggatcgagtaaggcaacatggggtgctttacgatggacatgcttccaggttaacctacgagcaagacaagagtcagggtaagtgtaatttatggacagtcactaccatatcgcgtaccaagaaatacttacaaggagtagcacttaaggaggttggtgtcgatcgctcgcaccctgtagaggtcccatagatctttgaagtctacggcgatgaaggcagtaggcccgaggaacggctgaccatcgtgctggcccaacatggaggtctctctattcttcctccttgcgttggacttctccatgtagtacccgtg

SEQ ID NO: 22224 - DNA, 1103 bp, Oryza sativa
aaaggaaaatgttcagtgtttcaggaatccctgagacaaattttgttggaaaggaaatgttcagtgtttcaggaatccctgagacagattttcacactgataattttagttcagagattgttctgaaccaggaacttcatgaattggactgaaccatggcatcacttgtcacaatttgattagtacagcaagtttgcaactttagattagatattgtttctgaacataatgatatattttttttaaaaaaaaatactgcactcagctgaccaatttcatattgccattcaccagcaaaattttgaggaattgtattccactcttccgggtccaatctttagtgatacgatggctaaatccatcgtcaatttcataacatggacaagtacaccatattaaactttgggcaactgctcaattgaagccgaagagctctaatgatgcttttgtgaacaacagtttgacatgaacagaacaaagccacccgttggtggtgataggactgtttgagtacatgctaagaaatacaaaagtttctattacccatctaaaaattgaatttctgctaccaactttttcattcactagaaaaaaatacccgtgtgttgcaacgggaaaaattaaaattacattaaaatttgggtaattaggattttctatattcatgatctgagcattattcatgcagatgatttgttatcgttcaatagcacttacacaagcatgtgcaatgccggaggtcctgtaacctaattttatcttagctctttggatgaagcataaccgatgaagttaaacgtgtatattaagggagttgattggactttttcctaaataggctacacatgtgcatacaggctccaatatgcgtgcacgtgggctaactgggtcaagtgggccgcaacgcgttgtatgatcttttttttttcgaacgaagaagaattgatcttttgcctccgattccgattacttctgatgtctgataatgttcgtgtcggaatcaacattcctctggcagcagttttcgcctatataagcaccggttttgcagataaaacattaaaagaagagaggaatagaggttgacaacaccacgctgacta

SEQ ID NO: 22225 - DNA, 1501 bp, Oryza sativa
attcatatatatgctaatgaatctaattagcatctatattaatatggacaatgctagaaagtcttacattgtaaaacggaggaagtactaaccaagagcaagaacaatatagtgtatgatatcggcgttttggagagaatgtcacattatgagcgaggatatatttatataccattcaataaaatatttaatacactatttataccatttcgtacaatacatctgttctaaaatatagcaacttttggctatacatagagatatactcttgtttaaattaaatgtactgtggaagttgtaatattaaaagaccctcattgttatttaacaaaatagaatacaaagaaaacaaaattttggttttattaagggtagcgcagtaatcgtacaaaatacaaggacttgtgtgcaaaatatccttctctccggctctcccacaccaaatcctctcaccccccacctgcgccccgcgcctctcgccgccgccgccgccggcgacgacgaatttcttccacccgcatccccctcctcctagcaagctagccgacggcaacgcctcccggttccccctatgaactgacgtcgagacctcatcccggccgccaccagcgccaacgccgctcctcctcctccacgagccggtgcctggatatttctggatctgaggccggcccgtggctgcaggactgcgtgcaccattcttccgacccgacgttctgccgccgcgcgcctccatgccctccggatcaagctccccctgtattagggtggggttttttgcctgggttggcgagcgaggcaagatgctgtggtgggacacgctgctctgctctgctctggcgtacggcgtacctatacgagagaaccaagtgccgcctccgtcagccgtgaggtgctcatggagggcaagcccatccccaccgagctccgcaacaaagacctccaggaccaggaaagagcaggttagtgagctcctgtttctcaacgtttccgctccatctccatcgctgctgccttttctgcttcttctttttcatctatatggctgggtgtgtggtgaattttgcttcagccccaagtatccgcgtagacaatgagtattgacggtggcacgctccacgtgccaagattctcctggccatgtcttgcaatccgagcacggcttgcaatccaagcgtgcccctgatttagtttgtcgaggtgcggcggcctttgaccaggcaacaaattgttcttcacaagttgaattggacacatttggttgacaatgataatcagtaattactgtccattcgctaggaagtcaaacccataattcctgtctcgcaaagactaaactatggtagtcatatttagtatagttcaaaggcaaccttcacaattgaatctattctaaaaaagttcgaagcagtcactaatgaaaatcttgaactactttaattctaacatagttccagaaaagattggtgaagtatactttgaactattctagaaaaagtaa

SEQ ID NO: 22226 - DNA, 1501 bp, Oryza sativa
cctcgagcgggcgctcgcgcttccgtgacatcgcgcgcggattttggggaggttttgggagggtggggaagaagcgaagcggaggtggtgtggtggtagtagttggtagcagcagcagcagcagcagcgaatggcggggtgggcgatggattctgagtgggatggactgcacacgcttttatgaggggattgggcgaagtggagggaagaggaaaaatgtgggggttgtcgtgttggagacgaaactttcgtgtgcctggctctctctcggtggcgctcaaccggggcggaagcagcgccccctaccggctaccgcgttgtgcaccaacgcggcgtggtggaaattttggattggcccgtgggccgggtggtgcatgggagattgggagctatagctcgggtatccacgaccacgtcggcctcgacgttgacatctatgttagtttagtactttctctgtttttttatttaacattggttagttcaaattaactaaacattacacattgaggctgtgtttagttcagcgtaaagtttagattttagttaaaattagagatgatgtgactgaaaagttgtgtatgtatgacagtttgatgtgatgtaaaaggactgaagtttggatcacagcctgagagatataggtaggagtaataaactactccctccgtcctaaaataaagatatttttagaccctgacactgtctccgatatgttattttgaccaataatacctactaaagtaagatgttttaaataaaaaaagagttgcatattatgatagtttgtttaatgataaatatagcaacattaattttgcattattgattttttcatttgtttgctattaatggtcaaagttaaaaatgtttgacttgtatgctataaatgcttatattttgggacggagggagtaaatcgttttaacttttcttaagttgattttttaagtttgactaaatttatataaaaacataccaacattttcaaaaaacaaacacgatgtaaaaatatattcaatattaggtttaatgaaactaacttcgtattataagagagttgctatattttctctataaatttgatcaaaatcatataagtttaactttaaaaatcaaagctgcttataatataaaacaggaagagtgatactttatttctactatcactaccctaaaatataacgcattgttggtattcagtagttacttaccatttagaaaaaaaaagttagaatgtttaagaatgtgagtccttaagaatgatatcgacttggagcagttcctgttagttctcaggacctgtttaattcgcggatgaaaattttcggcgtgtcacatcagatatacggacacacatttgaagtattaaacgtagactaataataaaacaaattacagattccatctgaaaactgcgagacgaaattattaaacctaattaatccgtcattagcaaatgtttactgtagtaccacattgttaaattatggctcaatta

SEQ ID NO: 22227 - DNA, 1501 bp, Oryza sativa
tggggattccactagccaggatctagcagcctcaaatcaaatttcttgtcacctcttccttaacgtccttcatcgatccaacaagacaactctttcacgaccatctgagtaccgttgccactatggttatctggattttggattcatctttctatttgtttcttaatagctgcaaccatacatgatttgccatttgggtagagcatggaccacttgtgcaactctagttgacaggattgcattctaagctctttagattcaatggtgaactccgctgaaatcctttgccgagtctgataacgcttatatacaccaaaatctatggctcagcaagaaacctctgctttgagccgtttccgtggagatagccaaaagagattgccagcctgtcaagtggtacacacgttgaatgcggtccaaggatgtcaagtagtatgcatgttgaatgagatccaaggacgtagttgtcgtggcaatgccgtagctccaaatcgacctgctactctactattgtttggtttcattaggaatagattgcttccttagttcagtaaactgagccctccataaagttgcatggttcaatactttcaactaataagtacgacgatgtgttgtgtgtgtgttgggggggggggagggggggtgttaatgtaacctgccccctcaatctgtcatgtgtaataaaaatgttactccctacattctaaaatataggctcaatcacttttaacacaaagaccaattcaaaatttaccttgatgcatataagcaatgtgatcggagggggaaggggttaatggtgtaggatttaaagtgccagtaatatatgcatgcatgcacgtattatattatgagacacgataaaaagtatccgtgacttatatttttgagatggaatgagtatgagttctgaaaataattttaaaaaaataatacagtggcccagccaaatttcccttgacacgcacctaaattaggcgcacccagttatcacaccaaatctgtcagttgagagttaggacctctctggcaagtagacgtggcctaagtgactaaaaggcaatgtatttcttattaattgtctctcatgttcatgtacatgaagggtttagggaaagatagttaaatcatggagggttttttttggttaatgtgcatatacgtagggatatctgaaatttactaaaagaaaatatttcacgtgtacgatatacattatcgttaacttcaatgatcatcatcgagctgcttttcacgagtttgcactttgcatgacaaggcaccacatgttttgtcacagtcgtcacatgtctcatctctgcaaccaacttctctttagctcgaaaataaatcaatctcgtacgaaatatgacacatcattatttaaataaatcaatctcatatgagatgtgagacacatgctaatagacatatctaaattaatagtattaagatgtatcacatacaatatgagtttaatatattttgaaacgcagga

SEQ ID NO: 22228 - DNA, 1501 bp, Oryza sativa
atgttgtctgaatttgaataaattgattttcagttgaacggtgaatccgggatgacaggagacaatatttgctgaatttccaagcacaggtatagattatccagagtgctgaatttccacagttcagtttcttaataaaacactttgcatacttccattggatactggacagcaaaagcaactatacaataggacaaagaaaaaaaaattcagaatgaattgatctgtacttagatcttagtaggaaagaaaaaacaactcatattctgatgttggcgttgatttgcattcctcatacctgtgacctgtgcattttacatcatcaagtttgttattctcacgcaaaggtctaagccgtacaatcttacgcagacattatccataccacacctaatggctgaaaggcaaaattctctttctcctcaaaatttttctccctaagcatggtacttcctagttcctatgccttgagaccttgaccctggtaattttgttgggatttgagagattatatatcagcaagcgctgctctcttgagtaataaagaaataatttgcattagttagtcagtccatgctatttataacagaacatttttcatatcattctcgttcttattcataaaggtgaaaaactagtaaaagcagatttatcagcaaattctagcaagttgctttgttctgattccttcacagttatttgatattttccttggattttctacagaattccatagtattttatatctaagactacaggcttgttcagattggtaccattttaaaccataccattatttagtaaaattgacaatcatgttgttgcatttagtttcttaccaaatattggtaatgtctatgaaattttggcaatattgtattaagactatcctatcaaaatttggcaacgttgcaatttaccaaaattttgacaataccaaattttggaaagattcattttggcattaatctgaacaccaccaccagcgtctctctctctctctctctctctcttctgacttagctttgtcaaatatgatagaatggaactactaaaagtaagaggagggtcaaggccttatcaacacctcccaaggaccatctcggcatcagtttgctgcatcaccattgtcatccatatattccatattccacactaaatccatcgatccgtggaccgtggtgtcgcgaggagcaagcttgcttggccatacattatccgaaccttcgtcttttccccgatcgaattgccgcaaaatctcatgtcgtgcacgcacattttccatggctatataagcaggcaggaggctcctcacctatgcacagctcaaagcaaagcaaagcacaacacaatcaaagcctcatacaagaagctagctagctagtactcaagctaaatacctagctagcagtagcaggcgaccagctgcatttttccagaggaaaaatctctcagtttagcttaattaattagctcttgggagaagaaggcaagaagaaaa

SEQ ID NO: 22229 - DNA, 1501 bp, Oryza sativa
atggagaaggcgctggcgaggctcctcggccgcagccccgccgtgccggcggtgttcatcggcgggaggctcgtcggctccaccgacaaggtcatgtcgctgcacctcagcggcaaccttgtcccgctgcttcgcaatgcgggtgccctctgggtgtagcaccaacgacgcaactatacctaccagcgactggttcttgatttggactgataccgtggcgcagaataattttatacgggtactttggtttgtatcaggcaggtcaggtatatctaagggaaaataaatagtacgtgcaggccttttttgcactgcaatactagtaaatctatagagagtggggaattaagtgtgtcatgtcagccgcctgtaaggctcttttgagatgtaataatgacacatatccgtttaatggagtatacctcttttgtcgatcgttggtcttttcgtctgtgtgattttttaaaaagctatctaatccagggttttcactttcggtttgcatcgaaatttagggttttcactttcggtttgcatcgaaattctgaagttttggtgcaactgaaatttccaaaaattttgggaaattttcaactttttgtccgaaattatttgaaaattttaccaatttttgactgaatttgaatacattttgatcaaattcacaaaagtttgaaaaaaaattagggtgcaaattttgcttgccggaaggggggggggggcaaaattactaaaatttcaaaaaacttaaaccgaaattgaaatccctgatctactctagcacaaacacatatatgcttaattaggaaaaccatctccaaactggtaggacgattggttaattagggacttggggtatacctcttgggatgtggatcaagaacctataacacagcgtcttcaaactcgcattagttcactctacacgctgagtggacccacattcacataatcacatagcaactcgcttatattttcgtttttgtttcgtgtaaaatggttaatctagtgatattgtgtttggagtgaattggatatttaagcagtctcaaacctatgaagactctccatataggactattatcactaaatgaacacttggaccttacaggtctaaaccgaaataagaacactcatgagctgaaacagactaaacgggttggagtattatagaacaatatattttttggacagtggtttgggacaagaggagattgaaataggctaggtgtgttgcagcatggaggctagagagctcgagcaatggttgcacgagaagaaacgcactcagaaatctagggccacgtttgttagctgggctagatgattggcccattaacaataactcgaaagttttcatctgctaccgtcacaaccatccatcgcacaatcgtcccttcccaccacatcaccagtacatcgctgcaccaggtaacaccatggatgatatcctataccaagtagcgacccgtcgattcctgagactcccttccccctgtca

SEQ ID NO: 22230 - DNA, 1501 bp, Oryza sativa
atctttgctttggtagtgcctgtgctttccagtttgctctgagaatggggtcttgttggcaagttatgaattggaacttgtaagaacttttgtgctaagtagatacctgtgctggttctcttccagattatagaatcttcattctgtattgatagttgaatgtttgatagaagattgccaagttgcaccagctcgtgtatggcttccccattgtcaatctgtctaagcgaaaacacccagtggttatcgtcaagttcggttgctagattcttgttttttcctgttgccaactgaaagaggtttggggcaatttctttggggcacattccttggagccaattatccttctagaaaagaattttttgcccatttccaatgacaatttgggtgcaggcttggaagagttgcaaatcttttgcattgcatggtaattccatgtcattccatggtctgttacaatcatgccatcttatccataaccatctcacttgaagggctgatgaaaatctttccaagtcaaggattcccaaccctcctagttccctcggcatgcagacgatctgccagtttacaaggcttttttccggctttacattctctgcaacattaatgaagttgcacttgctgtagatctagccactattatattgccaacataaataagcacaaaaattgtgatgtctcctttagtataaaagaataaggatgtatctgctccttgatggtttaaacccaagctcatgaaattttatacttaactaggctcgtggtgcttgtttcaagccatacagagccttgtctaacttacatatataagttttgagttaacaccaagcacttatacaaactcaaaaccacaactctctcgcatacacacacacgaaaatcatggatttggggagaaaccactgagtgtccgtctcgcacaggaacatggtagaacgactcatcttggatgcttcttgactcacccacacatttgcatcgaacccgttagctcgatcggacggctacacaattgctagtagatcggacaaccatggaaggcgtcattgcttaataaagaacgagaacgctctctgttaagatttcacaatttaatatggttataattgtaatctcacatatccttctccttattttctgttgtattccgtctaaggcatagttcatattcttattgcccacattgcaacttatcaggaatggctttggtatgattctgtaaaaaaaaaaaaggcaggccgtggatttcctccaaactcaatcgaagcagacgaacgatccaaactgcctccgcacattccagaaacagaagggccccacacgacccccgtttcctcccctatttatttccgccgtctcccccgcgagatcgattgatcgaatcgaagaaaccccaaaccccaccaaaaccctcgccccacgcctccttcgtccacaagcctcgcgcgcggcggcggtggcggcggcggcggcgtaggcgtgatgaatatgtcgc

SEQ ID NO: 22231 - DNA, 1501 bp, Oryza sativa
ggtggttctcgaggaaccgacggagcgcggtgaggatgggggtctcctggggggcgtagccggggcggtagtaggaggtgagctcctcgtcggcggcctcctggtttggcatgaggctgaacttggcgtggcgcaccagcagcgagtagagcgcgaacgtgccgccctcgccgttgtcgtcggcggcgagcacgatgaagacgtacttgaggagcgggatgagggtcagcgtccagaacactagggagaagacgccgaacacgatctcctcgtcctggaaccgccggagcgacccgatgatgaaggtgctcttgtacacgtacagcggcgacgtgctcaggtcgccgtacaccacgccgcagctctggtacgccagcagcagcacatgcctgtagtagctcctccagtgaccctgtacccgtaattaattctactgattatttattattttatcagattattactttcattcttcgtattatggccctgtttagttcccaaaaactttttcctaaaaacatcgcattgaatcttttgacacatacatggagaattaagtatagataaatcaaaaaactaattgcacagttagagggaaatcgcgagacgaatcttttgagtctaattagtccatgattagccataaatgctacagtaacccacatgtgctaatgacggattaattaggctcaaaagattcgtctcgcggtttccaggtgagttatgaaattagttttttttattcgtgtccgaaaaccccttccgacatccggtcaaacgtctgatgtgacacccaaaaattttcttttcgcgaactaaacaggcccaatatatggagaaatacgtgcttatttaatttagggaagattgcaaaaatcaccctaaatatatcatcctaagttcgagatttcttcatgtaaaacgacttgttacaaattccatgtcttaactcaccttgtttcgatatatattcctcccaattaccattgtttgcgcgttttttctcctcgtgtcttacttggtttagtgtattttttgatggacatgacccaaccacatcttttgcacaatgtaagggcatgtttggttcaatactaaacttaaccataccaaatacttggcattactcaaaaactgtcatccatttgttttatatccaaataatttgtcatgccaaattatttggtttttggcatacttcataggtagcaaataaaacacataccaaaacattagcatccctttgtggtaacaaaccaaattcaaagcctagccaaaaacatttggtaacaatccaagcactttgcagaaaaataaataaataaaaaaaatgaggcaatgatcaaatcttgccatgccaaataaattggcaaggccaacaatggccaagaaccaaacatgtcctaagtttttttttttaatctggttcggctgaggagagacaaaatcggtaggaaaaaaaagctgtccattttccttccatcattggtcgcactaaagt

SEQ ID NO: 22232 - DNA, 1501 bp, Oryza sativa
cggagtctcatcagctttggtgggtcctcctttccagcactggtttgccatagtttctccccttgaatgaagattccttttatctctgggtctacaattcctgccttaaagtggggagggctagcaggcggggatttgatacaatagcaacccttactgcgtggacaatctggaaggagaggaacaatagggtcttcaactctcagcaaaggccctggtcagagatagcccgagctatgacggaagcgactctctggcggttggcacacgaggtgctgccggtgctaaccatttaggtcttgttctaggtcgtttccttctgatgtcgcgagaataggcttaagctttttattgttctcctgttttcgcatccccctcctaattttcttgtttggcttcgcttgtacatactctttatttctcttaatacaaatatgcgtgccttgcgtattcccaaacaaaaaaaaaactctggtagtaatatatttttttgtcatatcccttgtacattctataagtttgttgaattgtattttaggatggcaatctgtggatgataaatcaaacccgtgatatgaagcttttagtttttccagactttttagtactactatttgctagatgattctgagtagatacaattgctgatggttttgattaatttttagacaatgtgatagttttgtactttttcttaaatatatttcatatatgacatggatcaaatggacagaatttgggaaatttaatttgattaacatgaatttaataatttattaacacaaattttatagtgccgtagcgttagcacggacagattactagtagtgtaaaattttaaatcttcttgtaaaatttagaagcacgaggactaaaatgagaagtgcccaaaagggtaggttttttttagaggtgttgcctcagcgcctacctgttatttgaggccattggataggagtgggcctatattgttcatgccctcgtgcgcgtacacaatcatagtttcacatagtagaaatggtgcttaagacttttaaactttcgttcttcactgtccaaatatatgctaattaaggttggaaactagaaaacaatagaaaaaattcaactacaaaataagttctacaatttaaatttctaacttgtaaaagtcaaattcttgttatgccttatataggctaacgagcatgcaatgagtttatacatacggatcgtatcatctgaattaagaaacaacaggggcattattgacagggaccaatcaaccaatgttacgaacgcgcacgtgattgatggatggagctaaccgcgcgtgcccgacaccgctggttgttgttagctacaaacgtaacacatgcatgcaccgatccatggatggagcaaagcggcggcagcgccggagtataaatctacccgcgctctgcctgcctcgccatcaccggccgccgatcgagtacgtgcgcacgcagctcatctactagcctacttcgggagggcgaca

SEQ ID NO: 22233 - DNA, 1501 bp, Oryza sativa
ccccgtggcagccgtcggcgagcttcttagctgcgacggattagccggaaacgcagccgaggccacgccatctctcgcagtggcggcagcatcatcgacgccatggcgccggccaagccgctgctcttggattttgtctctgccgtgctctccagaatcaagaccaagagcaggagcaaggccaagcctgagacaagcagcagcaatcccggcacaaactcatgtttcctattgttattgccccgttgctgccaacaatcagaagctgttgttggtgttgcaggcgtcgctgctgaggccttagctgtacttgtagtttgatgaaattgcgaggagattggaaggaagcagccgtcaagacagaactcatcatcatcgtgttgtttgtttgtctgtctgtttgatgacggcaaggaattgacataggcccctgttaaagactaatcttcagtaaacataggcccgcttggtttggtttttaaggagaggaaccaggaatggattgtaatttgcttgcttgcctaccaaacaaaacagtggaagaggatgccaatctgcgcatggattttgtctctgccgtgctctccaaaaccaaaaccaagagcaggagcaatgccaagcctgagacaagcagcagcaatcccggcgcggcgatggagatcgagaagcctgaagaggcggcgcggcccgtcaccatggaggtggacgggaagcccgagaagaatgaggtctcgaagaaggccagatggcggggaaggtcgccgtgcagtccctggagaagtactacggcgaccgcgcctaccaattcctgttctactctgagccaaccgccgcagcgcatgcgtccaccccgcggcccgtcgccggcctccaagctgctcccccgccgctcctcctccgtcgctcgccgcccgcgcgcagctcttcccccgccgcaccagccagcccgcatgagaaaattgggagagagagaggaggaagggaaagaagaggggaaagagatggtgacgtggtcaccctgatgtatggggcccacgtgggtcccacattgagtcagctgccacgtcggataaaaccggagtcaaaactattaatggaacttagtttgcactttttataagttggagtatgtgttgtatccggttttgctgtttaaggacgattttgtaacttgatgacaagttgagggaccttcgatgtactttttccttttcttcattgctggttttttctccctccaacctcaaatggggcggtgtggcccgattccagatgccttctcgtacaccgattccagatgaaacgaatcaatgggccggccggcgggcccgctatagctacaccaccccccagtccaccacacgacgcgcgctacattctccacctctccaccattccaaactgccaagtggcaacaaacctactactaaaccctaaaaatcccaattcccacccgacccgacaccactcctctcctcctccgccgccgccgccgcctcct

SEQ ID NO: 22234 - DNA, 1501 bp, Oryza sativa
caagccggcaaccttcccatgtgtgtaccgcactccatcttcataaaactgagagaggtagtctatggagagcggattgtgagtgtgctcctcatgcaagtcatcttcaaagttcaagcgaatattgaggagccgccggaattgcctcctagagatagaacactggagggtgtcggacatccacttcatctcactattgtctccagccacccacactgtagcataaaactgccggatcaaatcttcattgtagtcttgcttgagagtaacaatccgatcaatgctaacagtcttgaagagatcctgcaacccctcaaactctggacattgatgtctctccaagaaatccccttatgctctgcaaaagctttccctgcataaacttgctcatacacactcttctggaaagcggtgtgaaaacggggatccggggtgtcccgaggcctcaaaaactgatcatggtgcctcaagatggtatattgtgatggattcctcatgttcacaacaaactggatggagggatcaatgtgcatatatcatcacttccttcatcctcatcctctccacttctactgacatcatctccactttcctcctcactatccccctcaacattggcctcaacctcttcatcactttgagcgtactcatctccgctcgattcctcaggctcactcacgggattcggagtgggtgcacgacgatcatggcgagtgcggggaggcatcactgtcaaagagcaaaggatgatagatattagcaataattctagaaacaatttggagaggtgaaaatttgcctatatcctgtggaggggtggtcagaccacagccagtagggcggtcagaccgacgatatcaggccggtcagaccgcctgccggtggccggtcagaccgacgactgacggccggtcaaaccgcgcgcacacgccggtcagaccggcggctgacccacagtcagaccgcctgtgtctccgggcagacctcctcccacaagttcaagcatccaaaaattttcacatctactcatttgagtctaaaaattgctagaacaatattgcacaagagtggaactagaacatcaaagggttggacctatttcatcaagattggaataactacccatagccctagggtgaaatagattgatttgagagaatgcacaagagggagagtgatttaccggttggaggagttgaatcaaaccaagaaactaccctctattggtgcaaatcgaagaacacctcgtgcttcacctagagttccatgccatggatcaaaaactcaacaaaaacacaaactaatccatggaatagagagaggaagcggaggagaatcacttacggtgtaaccggagagaaatccgcggtcaaaccgaatggatttgatggagggaggtggctagggtttgggagaggagagatgagtttttttcgagttggggaagaagatggttgaatgggaggagattaggtcgggtaggggaagaagggagaagaaa

SEQ ID NO: 22235 - DNA, 1501 bp, Oryza sativa
taatccaagctttgcagaggcacttcgtagaaattcggctatcaaagctcgaccaacacataggcaacttaagaaggatctaatcgagcacatatggcaacgctacggaaacaaagaaaattagacaaaaagcattgtaactatatataatataattattatatatatggtttctaaaaattattgtaatcgcgtttctattatttaatcttcatatttattctatcaattagccacacaatggtacatacaaatacatttatagttgatctaagctacatgcaaagcattaaacagcttacagatggcccctctgtttgtgggttgtatgagctgtctttatatctatctgtatgagaatttcgagtttctgcagacgacccaccgtctgtgggttgtacatgcccttatgagaaagtggccgcgcgaccagctagtttgcgtgccttatgagtgcacgaaccacggaaccagctgatttaagaatctttgatgcatgttttgttttcgtcaccactattacaatacggttttttttcgtgatagttaaaataggttttaacaggctgtcaatagggtcaccagagaccaaaggccaaaaaaagaaacataattttcactgatcgatcaagttttctcgaaataaattgccggttacgttcagcatctccaattaattaaggtgcacgtacagatatctataaacgcgaatattagagaatggcctaatattaaataattagaaaatatgagactttgaactcaggtcgtttagctcaccatcttgtagagctagctagaatatccctaggtatttctagtacatatctcttggcactactacaaaatagggattcggtgctggttgggaaacccccttcagtgccggttttcctaatcggcaccatgaaggcgacacaaatcacaggagattaaagatgccggcttcaaaaccagcacctttgagacgcacacgaaccaaaaaaagatcggccgatgcatcaagccgtcaagccgatcccaaataatacctaaatcccaaaattgcatcaaatccatgaacacatgaactaaaatgcatcaaatccatgaacacatctagatcatattcaacaaattacagaggaaataatacaaaacacaaaggaggagggacaagaaggggaggggaagagatcgattcgcggcctccaaccgccatcctcctgccgctcgccgccaccgcatcgcccttccgccggccgcggcctccgcctccccttccgtcggatctggcggaggggagggtgcggccgccgctgccacctccgccggctagccgccaaccgcgggagagaagggagggagagagaggaaagggatggagagagagagaggacgcgagtggatgcatggatgaggagggaccgagggagttgaaccttatcgatcgcctcatgctggaggggcccaccggctcggctcaattcataagtgtcggtttttaatttaccgacaccta

SEQ ID NO: 22236 - DNA, 1501 bp, Oryza sativa
gcacttgtagtagccatatatgaacctcagccagttctggtatgaagatatgaagtttctgcttatttagtattctgtgacaaacttgttaaattctgaaattctgtgacaaacttgttaaatttagcacttgtagtagccatatatgaacctcagccatatatgttcagttttctgctcattcatgctttttttttctgaaattcagttttctgcatattcagtagccatatatgaacctcagccatatatgttcagtatcaatgttcagtatactggtagttttgccgtgttttcccttactcagtacccagccatatatgaacctcagccaaattcagttttctgcttattcagtacccatatatgttcagttctcccttactcagttttgctctataggccataatgtaaattctgaaattatggtatcctggtagtttcagtttcaggtatcctggtaattaaattctgaaatccaattaaatgtgaaactgcgcatgattttctaaatggtaatgacagtgctttgtgaacttgacactgtgtgtgtgaactgaaactgatcgcagaggatgatatttttagtgtgaactgaaactgaaactgtgtgtgtgaactgaaactgtgctttgtgaacttgaatgtgaactgaaactgcgcatgattttctgaattgtgtgtgtgaacttgaatgtgaatggaatggtcatctttttagtggtgccggagttgatcagttttctgaaattcaatgctgaacttgaatgtaaatgtgaatggtcatcttttaagtggtgctggagttgatcagttgatcagtttagccgctgtagtgcgacgttgatctttttagtagcttgaatgtgccacttgaatgtaaatgtaaatgctgaatttgaatgtagcttgaatgctagtagttgatcagtttagtggtgccgatcagtttttgtaaatatgaatggtcatatttttttattctataaaacatcgttgttctgtgcgctcctctgtacactactccaccatccaaacacttgcatcaaacaaggtgtatcgtaactctttgaatggagccgcacgaagaagatgaagtcgaagatgccgaagagtttgaagaggtgttcaccgtggaagacttaatcgtagaggatgatatttttgaagaaatagtagcagagggattcaaggccgacatggacagagaagcatcgaagcatcgactgtacatcgccgacgtcgacagagtggaccaaggaggtacataccaaggaatcgagaacaaggtcatgatgatcttgttgctaattatttttccgcaaatctgctaattatttttccgcaaatcctatctacaccgatgacatgttccgtaggagatttaggatgaataagccattgttcctgcgtatcgtgcatgcacttagcgattggtccccttatttcacccaaagagtcgatgctattggtagaaatagtcattcaccacttcaaaagt

SEQ ID NO: 22237 - DNA, 1501 bp, Oryza sativa
gtcgacttatgtcaagatgtacagggggtaatacacaaaattcaaagtacacgtttcctgctttgggttaaatttaaactgatgaggaatacaatgaccatgaccatgtttcaggtcaagcgagagtgacatcaatgcacaacacggcacaaaatgcagaacacggcacaaccgtggactctctgactctctctcctcatttgcagcttggctgccaagaaagcttataggacccaggtcccagcatatgcatacctctgctccaagcctccaatgctatataaaagcctccagctgcaaactcttccaacagaacagcacaagaaacacaacgacacagtagctcatcaaagttgaaacaaactagcagaggaaatccggctccagtttgtggttcagttcatcgatcacacagtcgtttttgtagtaactgtttagtcatgggaggcaagaagaggaaatccggctccagtttgtggttggccgtggcgtcttggttcgcgcgattgggctcaaaggtggtggcgagctctggctccgccggtggccgcgcagggtatgatgcggctggcgagatggtcagggcggctaaacatttctccagcgctcataagataaactttggttgagtacaatagtactcaagtatcatgtttttgtacataatagatttatatatgtggttttcgctttgactttattgtagcacaagtgtacatgtatagtgacaatgcattagatttggggttaaaagttgtttgcttggagcacctgtaattaattgtttgctgtttaatggacaaataggtcctcaaattactacagtatttgtgataaatagaaaggcaccgatgaaaaacttaaatattataggatttcagatgcacttggggagcatcatcggagcgaggattgcgtgtttcacactgataaataaaacatttttccagacgagtgattgcccgattatacacccccatacaaaagatatcacgacattacgtaaaaaacctggcatatttcttctttttagaaatatagtacaaacgtacacatgtgcacactcctcttcaattcctggtttgtacaatttgtcacaaaactacatatttaaaaacttgttttataaaactatagatttaatatcttcatttatcacaaaactaaaggtttaatgtctttattatcacaaactacatattttagcattgttgaaacctatagttttgtgataatggagacactaaatctatagttttgtgataaatgaagatactaaatgtgtagttctgtgataaatgaaaacactaactctgtattttgtaataaatgaagacactaaatatatagttttgtgaaacaagttcttaaatctgtagttttgtgatatattgtgtaaagtatctgtagttttgtaataaacaaagatactaaatctgtagttttatgataagatcgtgtaaagtacatgtagttttataaaatttactctaatatcatt

SEQ ID NO: 22238 - DNA, 1501 bp, Oryza sativa
gataaccacaacttcactcggtactaagataagccatcccatgcctagcaagtggaagtacgtagggtgcttgaatatacatcaacatgttccgtccttggtgaccggacatggctacttgcatcggggaaaacactatcccatcatcgtcctatcacccgtccaagtcatgtatattctcaaatttaatcgaatgtcatattcttagtactcgtaattattctgggcatgaacaccaatcaactgatcagtttaggaagcacgatcgtttggtaatttctactatctatgtcccaaattagtggtcgctttgactttttacttgcaacgtttgaccattcattttatttaaaaaattagtgcaaatataaaaataggataagtcatattaaagtacttttgataataaagcaagtcacaaaatataaataataattccataagtttttgaataagaggaatggtcaaatcttacaaagaaaaactcaaaatgacaactattttgggtcagaggtacgtaagtatcctattttactgcttgtttctgaaaaactttacaatatgtgttgtcagtgtacgaagcaaataaaatgattgggctaaagttacttaattctctcaggtgtaggaaagtttcggagagctgcccatcatggaaaagctgtcgtggttaactggctctccttgctaatactaagtcaatagtaaaccacgctttattttgacttcttccatgcatgggttcgtttccatttcttatactacctccgtttaatgagcgaccatataacgacttcaaattatctgtgctttctagtggcgtttggctagccagactggagtggatatgatgcaaataaactgtattctctttgactatctacctagctagctatcacatatatatataatatacgtagtgtcatcataccaagaaaaccgcagttaagcatgtgaaacattttatcaatcgggtgagtttctctgaagaagctgccacggtgatgctgatgcctgcctatttatatatgcttttaaaatcaaggaaacaactaacgttcctatcacagtactatcactctttgatatcgtcgttaattatattagtacagcactacagctcctcttcttgaacaagcagcagatagctatcctggtccattcctagtgcatgcatgtctgcatgtcttggtcagcaagctcttgcctcgaacgtgtccatcgatgccaaggtgtgcacaagagtgcataatttgaattgtacacgtttcctgatttaagtgaaactaaatatataccgagtattaactgaccatgaccaagtttcaggtcaagtgatagcgacattataattcaagatcatctctcgatcctcagagtcagaagtcagaacactgcaggtctctctctgattctctcacttgcagcttggtcgccaagcaagtaattaagcacgaagcaagtgtgcagcttccagcttaattacctcagctgctcgcat

SEQ ID NO: 22239 - DNA, 1501 bp, Oryza sativa
ggtgtgtaccgaaggtggagatgtgggacctcgtagtatttagtttgttctaagatcaatttaatccaatggtttataatattggaccgatcgatttaagtgaaaatcatactttgttttttttcttagaatttctaatattttctctaatttatttgagcaccacgtgacagcttatggtattttaagaaattttaatggacttaccacatgtaattagaatattaaccatataatatatatgtatgggatatatgttaatattcatttagctttgtccatgtttatatacatgtagagagaaattaaatatgttgctagcaagccattagatgtctaattaatagcaattaattttgacacctatttacaattgtttacattagctcttatatgttcatcttacgactttgattatgcgttgataaccaatttactgatcaccatgactcgcatgaaaaaaatatgtactacttagggtttagagtttaggacaactgaaattgatgaattatctgatttatgtgatagctatttgagattataaacaaataaattaacttctaaaaagttaaaaagttatttaagaaaagcaccatttaggaacttggaaagcgtggagcatgcaaacgaaaacccaaaagatggaatcaaggaaaatatagggccttaaactcccttataacacttttatcctagtaagagttctattgatattcgttaatattgtgctcacatttataatataatgatttcattcaattgtacgaacaaataatacaaaatctgaatacatcaaaacacaatacattataattattatgcaatcaactctcgattttggcttaaacagagctaagtgttcccacggtgcttaattcttctctcacggcatcacacctttaattttcttttcatgttattaacaaaatcggtagcactacaatggtcgtgatcacctgagatgcctcagacatgacattctgtcacacgtccgaaaggcaaaggtgtagacgtgcattatgcagcgggccaaaaagagaactttagacactttagttattaacaatagatccgatgatttaaataatgggtccactggttctagtgtaaatgtaaattagttaatatatattttaaattgttaatttaatgggtacacaatataatggtgtagattttattttaaaacaatttattatttgagaataatagtccaaagtaattaaaaaaatagatccaatgatttaaataatggatttatctgtttaagtgcatctatatattagttaatatagatcttaaatagtttatttaataggtacacaatataattatgtaaattttattttaaaatagtgcattatttgaaaataatagtacaaagtaatgagtacaccgatttaagtggaaactatcttattgatttactaggtaaacatataatatgttgtaaattttattttcaaagattatagagctaatttatttacgtgtgttt

SEQ ID NO: 22240 - DNA, 275 bp, Oryza sativa
cccgggtttataagctcatcacgcgtgcagtccattaagaggaccacatggaaaaaatcgatttttccgtgcggttctcttaaatggactgcacgtgtaaatgagcttattttcccagacgggaacaccgttatggtccgtctgaaatctaaatgggtccatatccaggaaaatcattttttaagtagtgtcagcctcagatcgcttgccagccatctatcccattcactggcgtccgccgccgccgctatgctcctcctccctggccctgtggt

SEQ ID NO: 22241 - DNA, 1501 bp, Oryza sativa
agatcaacaccaatgacatgtacaagttgaagaagaaggagatggaggaagcctcaccctccaagaagtgcattgctctccaagccgaagttgaagacaagagcaagagcaaggtgaatgaagtcaatgaggacttggaggaagagatggtccttcttgctagaaagttcaatgatctcttgggaaggagaatggagagaggaagggactccaactcaaataggagaagaaatagaagacccaacaagactctctccaacttgaggtgttttgagtgtggtgagaagggacactttgcttccaagtgcccttccaaggatgatgatggagacaagtcatccaagaagaagagtggaggctacaagctcatgaagaagcttaagaaggaagggaagaagatcgaggctttcatcggggaatgggactcaaatgaggagagctccacctcatccgggtccgaggaagaaggtggtgatgatgcaagctccaagaagaagaagatggccgttgttgccatcaaggaggctccatcactcttcgctccactttgtctcatggcaaagagctcctctaaggtaacatctcttagtgatagtgagagtgatgatgattgtgatgatgtttcctatgatgaacttgtgagtatatttgaggagcttcatgcttatagtgaaaaggagattgtcaagttcaaggccctaaagaaggatcatgcttctttagaggtcttgtatgaggagctaaagacctctcatgagagactcaccatttctcatgagaagcttaaggaagctcatgacaacctcctttccactactcaacatggagctctcattgatgttagcatatcttgtgatttgcttgatgatagtgctacttgccatattgcttatgttgcatcatctagcatttctaccttttgtgatgatcttgtggatatgcctaactctagctctagctcttgtatttctatttgtgatgcctcacttgttgttgagaacaatgagcttaaggagcaagtggccaagctcaacaagagtttggagaggtgcttcaagggtaagaacactcttgacaaaattttgagtgagcaacggtgcatccttaacaaggagggacttggattcattccaaataagggtaagaaaccttctcaccgtgccactcgttttgtcaagagcaatggtaagtattgctccaagtgccgtgaggttgggcatttggtgaatggttgccccggtggtaagccttctaagacatgcatgtttgattctcattatatgcttaggaaggctcatgatggtagcattgttgctagatatgtgggttctcctatactcggtggtaaaaagaatgccatttgggtgcccaaagttttggtctctaacctccaaggacccaaacaagtttgggtacctaaaagagcttgatcttctcttgtaggtgaactaccgcaccgatggaagccattgggtgcttgatagtggatgcactcaacata

SEQ ID NO: 22242 - DNA, 1501 bp, Oryza sativa
ttaatgatggataaagatggtaccagtcagtagctgcatgacgtaggagacggtgatggccccagcagctgagttgatgaactcggcagactgtttgtcgaagtaatgaatgacgacttgaactatgtaactgaacaaaatggtattcaactattcatgcaaatggggaatgatggagtgagggtgaagtagaagaaacggggttggaagggaagagtgggcataggtgttcaccttgaaaggagagacggtagatcagcttgtctgaacaacagcagcgcctaacgatggagacagatacgccctggacgcttcaggagttgggatccggaaggctcaaatgattcgcatgatatgggtaaataccacatctcgagctcgagctcgcagaccatcgagatgatgctatgtattgatgctgccaatatggcaatcgatgtgggacgaactgccattgatgggccgatgacgatggaggaaaaaacctgcgagggcgcaagaagagtgagaagaagagaaggggagggaaagagaggggcacgcacgccatgccctcactccgttgcgtgaggcggggaaccggcgcccggctgcgtgcgccgatgcgtcgccgtccgcccgtgagagggctacagcagcgtggcggcggatgaggccatatgcgagcgggccgcgagcgctgctagggttttggctgtgtggggatatgttgggaagatcttgaccgtctgttgtcctctcatcgatctgatggtggtggaagaaccggcaccgtaggccaggtggacgactggatcgatcccaatgcggcatcgaacggcgccatggtaggtgaaactcggacgtgattaaccggaagaacggggtgtttttggaaaaaaaaaccaatgacgtggcgcccaaattttccagcactcccacgacgtttagagagattaatattttggagatgctcaatgtaacctgcaaatttttttttagaaaacttaaccgtcctcccacagctataaaacatcaaatatgtgtcggcactataggtgccggaagtgctaaaaccagcacctataagccttttcccacttccatgggttgaaatcgcaaaaaacggctctaaataagaaccgacacctattctataggtgttggttttcttaaaaaaccgatacctttaatatattataggtgtcggtaaattaaaaaccgacacttatgaattgagccgagccggtgggcccctccagcatgaggcgatcgataaggttcaactccctcggtccctcctcatccatgcatccactcgcgtcctctctctctctccatccctttcctctctctccctcccttctctcccgcggttggcggctagccggcggaggtggcagcggcggccgcaccctcccctccgccagatccgacggaaggggaggcggaggccgcggccggcggaagggcgatgcggtggcggcgagcggcaggaggatggcggttggaggccgcgaat

SEQ ID NO: 22243 - DNA, 1501 bp, Oryza sativa
gaaatttgtgggcgagcgcggccgcacgcgggatccgttcgcccgtcgcctggggatgacggcgctctacagcgcgtgggctcgcgtcgactccacctgggagaacgggatgaactcgtcgcgtcgggaggcgccgggctgcccgtctctgcgcgtgcacgggttttttttgcaaaatcaccaacacacagacggggcgaggagacgggttgtacatgccctaagtcataaagcctgcatgcagcccagctgacctgctgctgtacacgtggtagagagaaacgaccacggtcctcctgttcacaaggttttacacgaaaaactgtaaacagcgcacgattcctctctacacaatcaattaatgttaattacccttttcatatatacagaccatcgtccataatttaccttttttacacatgctaaactaccaaaatgggcatgcaaatatgcggactaattaatcatgacatcagcctcatttcaggttcacagcttgccatgcaaaacatgcagagttatatttattaacattaaagaatattcagtgaaaaaaacattactcaatctattgtactgtttgaactcatgacaattaaagattttttaaaaaaaatcaagacgtgtcttgttcattctggaggtgtagtaatatactccctccgttttttaatagatgacaccgttgactttttctcacatgtttgaccattcgtcttattcaaaaaatttatgcaaatgtataaattataaatcacacttaaagtattatgagtgataaaacaactcataacaaaataaattataattacgtaaattttttgaataagatgaatggtcaaacatatgagaaaaagtcaacggcgtcatctattaaaaacggaagtagtattaccatgtcaactggacacaaaatgaagaacatatacaccaatttgatcgcagtgaccaattctaacgactatatatcgatataatcgtatacaaatacaattgtatatatggaaatagagatatgagttgtataaaatctatatttaataaaaaatctagcctaaaaaatccgctatatttttatttttaatccctttgacgaattatacaaaagatgctctcaattcttttgtcgatctcacgccaagccacatatatgagttcaaagctgaagttaacacgataggtagcctcgtgctttttctgaggcgacaaatatcgtctccattggtctgtcagtaacaaaaaccctctaattaacaccctttcatcttgtactttaatttcacctcttcacacaaactgtatatgctgtcttttacttgacttgtagtgcaaccttccactgtcacacatgacgcctccatctgcaatggcatcttaattaatcatcagtaactccaatttccaaatagcacgtacgcatgcatgcgtccatgccatctccttcatctgctcgatcgatcactctcagatagattgattgattttactatctcgatcgagt

SEQ ID NO: 22244 - DNA, 1501 bp, Oryza sativa
atgcccgtgcgttgcaacgggtgaaggctattttaatcatattattgttatatggtttaggtaaggtgaaattcactatgtcaactcgcttggatgtattattttttaaaatcatgagctgcgattaggagtctgatagtctcaaattaacatgcgtgtttttttaaagagatttcttatacgactctttctgtatttccaaaaacgaatgaacttaagaatcaactcaaatacagacatgtatttcaaaaagcgaatgaacttaaaaaccaacttatacacggatgacgtaccaaagtactagcaaaaacatatttgattttttataatagcagagagtagagatataatctagttaaggtaaaattcattgtgagaattcgcttggatatatagttttctagaaaatcatgagttgcaattaggagtccgatcatctcaagttagcatgcgagttttttttaaaaaagagatttcttatatgactccttctgtatttccaaaaaggaacgaacttaaaacctgactcaaatacagatatgtattttcaaaagcaaacgaacttaaaaactgactcatacgcagatgacgtaccaaagtactggcaaaaacatcttcaatttttataatagtaaagatttcacaaaactacatatactttgaccaaattatcacaaaactacacatttagagtgatatatcacaaaactacaaatttaacactaaatttcacatagaactacagatttaaggtagagtatcgtaaaactatagatttagcaataaaattatcacaaaactacaggttcagtgataatttaatcataaaacttacacgtgtataactcaaacataacactagtgctaaggatttaaactctaaaatatgtagttttgtgataactttgttattaaatctgtagttttgcgatactccaccttaactctatagttttgtgataaatttagtgctaaatatgtagttttgtgatacatcactataaattgtgataatttgatcaaagtatatatagttttgtgaaatttactatatttttttttcagtttctggactaactttggaaggaggctttctttgggagcaaataagtttattgatagaaataaatttaccctatacttcttacttttttccttaaatccttccatacataaagtagatttagcatctatctctttcatgcgttacacacttttcatcaaattgtggagcgaaattatctttggaagtatttgtcctatatctcttttctctccataaatcttgcaaaacggttggatttatttttatctctctcgcacacagatagacttttcaataattctagtagtctaactttggaagttaagcatctttagcagcacttaacttcattagcacacttactgtttccataaattttgggcatgtgagatcttttcaaaagtttacttttaatgaagaaactgatcacttccccacttttcctgtctttcatgt

SEQ ID NO: 22245 - DNA, 1501 bp, Oryza sativa
gccggtgacaaagttgcacagccgtagaggcgaagaaaccaatcggcagtagtcaggtcagccagcaatgaagatgaaggcgaccaacaataatggtagcggtataaaccagacgtagaggcgagggcactagtcagcagcagacgagacgaccggcgatgaagacgataaggccaatcaacactggcagaatcatgcagccatggaagtgaagaaactagtcggcagtagacgtagacagcttgcgttgaagatgatgacgcctattagcggtgacggcgacgtagccagccgtaaagaagatagcatcagttggcgtcataacaagccagctgtgcaggcggaaacatcagtcgacggtggacgaggcggccggtcggtgaagacgtagacgcccaacaacggcggcataataggctagccgtgcaggcggagacaccagtcgacagcagacgaggcggccggtcggtgaagacgtagatgcccaacaacggcggcataataggccggccgtgcaggcggagacaccagtcggcagcgacgaaggcaagccggtcgttgaagacgtagacgctcaacaacggcagcataataggccagccgtgcaggcggagacaccagtcggtggcagacgaaggcagccggtcggtgaagacgtagatgcccaacaacggcggcataataggccagccgtgcaggcggagacaccagtcggcagcagatgaaggcagccggtcggtgaagacgtagacgcccaacaacggcggcataataggccagccgtgcaggcagaaacaccagtcggcagcggcgaaggcaagccggtcggtgaagacgtagacgcccaacaacggtggcataataggccagccgtgtaggcggagacaccagtcggcggcgacgaaggcaagccggtcggtgatgttctgactgatccatttctgaagcgtaggagataagctttgaaagccatgaatccctattatgcatatctggatctggatcctgcagaacaaacatataggatgagtagtatctgatgtaaatataatactcgagaaaaatttaagtattttaaaatatttataaatatgtatttctcctcttgtcaattttgatttccccgagcagatgactccgtacgtttaaacactctgtccgactagtcatagcccccaagcatcgggagtcagcctaggcacttcccaaacatgcatatgagtgacatgagtttgtcattaatggaataaagtttcacgaatcataatttactactcgggtacttttgcaattgtaaagagcagaaaataaatttatcttatctctatgcttttgatttattctgaataatacttagaaccttgcgttactcagtccatccaacgagcccccgggtgctaggaatcggcccaaaggcaactatccatcgacaaaccaaacggaaagcataggaagatagaactccataactcgataggtacttttgtactcagattatgtc

SEQ ID NO: 22246 - DNA, 1501 bp, Oryza sativa
gattctctctgtgtttacaaagtgcaccaacagcaatccttacaaaaatttcgactaaactcgaaaccctaactcaaaactcaactcaattgctgtgaaaagcgataccgagaagcctcacgctccccctctatttatacccgaggtaggcatcctaaagccacaaaccaaactcatactaagagtcctaaacaccttaggaaaccctctaatacaagaaagaaactttacataaccaatcgtaccaaatttggactccttccaaattcgactccgcatcccatacgcacacaatacctccatcgtatgacatatggaatctccatcaaccacatgcatcaactctagccttagtatcccgcatgatctctgattaccacggacgtcgtcttatccccaagccgactcccggtccatcaccgcaaatactcttccgagacatcgagtcacctacatatgaattaaacaaagaaaccatattccaagaccaagctatctccaacttgactcattagtagcaaacaacagtattacatacgtatagtatccatctagaagctataatcatgaaataatcacggatatccaaacaaataacccaaaaccgaaactgacacagcgtcggccggtctgaccgcggactggccggtccgaccgctcgatcaccgccggtctgaccggcatacatagcccggtctgaccggtcacataaaatgataaatctgcgatcacctgtgaatccaatcatctccaaaaccactttgtgaataaattccaaataacaaaaccaataatctgcaatgccaatcgttcatcacagaataataatcaaaaacacctttgattttacactctacttctctttcttatatgggacaccttacttatctacttaggaattttgtcatacatataacatttgattctatataggacttggtagcatactagcaaataggatgaatattcaaacatcataacaaaggttaatggagggagtatataacaatataatctgaccgcaaatatcgtggaggaaaaacatttaaaacttgccaatgaaaagtgaattcacactcaacctacatcatatatttgttttttcaagtatgtcattaaacctctctaagcaattgtgattagtaaaaaactagtggctaacccgttgttgaaacatgaattcggcaataataaaaggggtagcgcacgagacctaaaagtggatggatgcggagacaaaggatttagacaggttcaggccctctcaatgagaggtaataccctactcctgtttggggatttgaatccgccgagtgtgtatagatctgacgatctagttgtctcatatgcctcttagagggccttctgccaaccttatataggatggggggcaggattacaagatagaaaccttaaccaatacggtatcggtttcctaaatctactttacaatattatcaaaccaggactttaggccgttccgtaatatacaaggaaacgt

SEQ ID NO: 22247 - DNA, 1501 bp, Oryza sativa
acttcttccggatacatgcaacatgaattcgtgatcatgggtctattttctatgctcaaagactggactatttattattccccgtaagggttatcaatcgaatacttgcgctagtcgggattcaattattatatctatttaggagtatcccataagggataatcactcagatcagaagctattcatatgagctacacttggtctatatcactcggaagatttattactcgggagcatgttacatgcgtcatccttcaaagggtgtcgaaggcatattttttggcctaggcctaatatgtctgcagcccatattttcaggtgtggcctgtcacgttcttttagggacttaggcatctttttgcttacgcaaaagtgcacgtgattatgtgcccaataccttaaaatccttttataccgcagttactcaactttttaggagttggtacaatgcatcttaaaaggtgtcaaacagtaaagctttatatagctgctccgctgactttttatatagtcatgacactgtttgggttcatcaatccattgattagatacaatatcattgcttttcgccacgtaagtgtgcatttttattgtccaatattatggcttaagctgattatatatcttggccattttccaggcgggtggtaaacacgttatgagttaatttactcggatttcacaccacatatgccatatatttccaggtgtggtgaaaccatgtgtcttttagggacttaagcacatctgttaaagcagtgtgcgcatggcgtatgcccaatacattagaaatttctttattcgcaacatacaagcttctttatagctgttttgctatgtgaattttcaatgatgtagccaactttaggttacattcatcatattttacaaagcagtcggtatatcactcggatcatgttattcagggattcacaccgcatatgctacatattaatatcaagtcgcttggttgactataattatcgaaaccacttggttagttagattatttattccttgactatatgcttagtttgttcagctaaccacatagtcgggggctacacctattaggtgcatctagtcgatgcacctaactttatttttcagccctccacagtcttcatatttggaaaaagtactcgggagatcatggcgaagatgattgaagcactcggctttagagtaatctggttcgagagaagattatcttttcgactgtgaaggtctcaggggctactgtggagattatgggtaccccatacccacacggcatggttatccgactagttataggggataacttatatctatgtaatatgtaacagatcatgatttgggtgttacgtttccttgtatattacggaacggcctaaagtcctggtttgataatattgtaaagtagatttaggaaaccgataccgtattggttaaggtttctatcttgtaatcctgccccccatcctatataaggttggcagaaggccctctaagaggcata

SEQ ID NO: 22248 - DNA, 1133 bp, Oryza sativa
ttaaaatatcttattcccaatgatgatgattgttcaaattgtgaggttttaatgaatgagatttcaaaatttagagatgttaatgctgcacatggtttgaaaaatagatcttctcttgcttgtagttttactttgcacacacgcactttggatgagttgtttttaactaaaaagttgttgcaaaaatatcaaattggttttcatgctagtttgatgtttaacatgatttctgctaaaaaagttaaaacaacctcatgatgttttggattgctcaacatgtaatttgaataagttgaaattgaaagattctttaggttgtgttgagtacatggaagatgttgtgaaaaacaatgaagtgctttattgcaccaaatgtcgtaaaagcaaaggtgtcatggtgattgtgaaaattgtgctaatttggaaaaagaggtttcttatttgaaaaattctttgctaagattttctgatggtaaaaagaacctcaacatgattttggatcaatcaaaggttagcacacataaccgtggtttagtttttaatccttatgctcataattctagacatcctcctattgtgttaggtgttggtgctagaagtggtgagattttggttaaacctgattctaacaaaactgtgtttagatctgctggtatcatatctaccttgaatgcatctttttcaaaatccaatgttgtgcattcaaaatctcctgttgttgcttgtgttgctaaatcttctaatgctaccaatctgtctaatcatcgtgaaaaatatacttgttctttttgtggaaaagatgaacatattgttggtttttgtttcagattagctcataaacagaaaaaggagagagagattgcttttgcaaaatcaaagtggcaaaaatcgggttttccctcgaggaaaccggtcagaccgcagtgggtcccgcggtcggaccggtgaccggtcagactggctactgagcgtcggtcagactggcggtacagaggcggtcagaccggccactgtacctcggtcagaccggcctcggaggaaattttccgaaaattctataattgattttgcacgtggatatatgcctattggatcttctagtcatgtgtctcagtactggattcctaaatttt

SEQ ID NO: 22249 - DNA, 1501 bp, Oryza sativa
cccatcttgattatacatatcccactacatatttcatagcatacccgaaaactacttttatagctacccatttacggagtagcatttagcagttcttaagtaagctactacacatgttgagaaccatgataatctcaggtctaaggattcaacaccaacactaaatgagatcactgatgacacaacacatatggctcttgcagtgtctcatgttgggtctatccaataacatgttcaccaacatgtgtccacattattaatttggtatctctataccatgatccatgagacatgatcatcaattaaaacatgtgctgatcatataaacatatttgttccacatatgatatttgattagggatcctttagaaatagtaacaaacaacataaagagtctcatgaaagaatcacatattcattaaccaataaggagttatctatttcaaggaacaatgtcggataaatatgtaaacaaagtatgtgatacaatcatctctatgattgcctctagggcatatcactaacaggaaggagcagcagggcctcgctggagatcaaaacgcggcggcgagctcggtcttcatggcgacgaagtgcttcccggggtcttcggctttggggagatggctgctgagcttgctattgaccttgcggagccgagagaggtggcggcgctgactggcgacggccgaagcgacggcgcacggcggctggagcggcggccgaaggtagagagagaaggggctcccggggagagcaattccggcgacggcggaagacaggacttgagggagaggtagaggacaacgagggggtcctttatataggcacgggagctcgggtccaggcccaaatcgacggaaaaactacgggaaattctagggatcttcgccggaaaaaggaaagattgatccgcgaaattggaaaggatttccgtagaaacttttggggatttcttggggaaaaggaagaggagattaagaggattccattcccagaactaatttggaaataggagcaacggggaggtcggatttggaaggaggaggcggcggcagtgcatgcgcacggcggacagtcggctcttcctgagctggaagatgaacagtggcgcaggaaggcaaaccagacttttggctgggcttctattgcacagcccgatagaaggaggaatgcaaaccagactttgggaagggataaggccggccgaatagaaggaagaatgggcgaggactaaaggtgaactggtgtgattatggtgaataagagcaataccggcttcggccaacaggatgtagggctattacttgacaattcaggggcccgaaactatataaaaatccctgtctccatctcttttaccttagtctcgcgtatatcctagtaccaacgatcatcatactatgcaaataccggaatcgcgacataaaacgtcgacagtggcgcgccaggtagggcgatttttggtgcttcaaggtttcgatgagatgggtttacgaga

SEQ ID NO: 22250 - DNA, 781 bp, Oryza sativa
aaccatagagacatggagccttcgataatgtcgaatagaattttcctaaaatcaatactcagaaaagaatattagatagaaatagcccccgagcgaacgctcaaagggtaacatgttataatatgtatggaaaaccgaaaatgcattaaacttacagaccaatgttttgtatatgagcgtctactcttttaccgacttcgatcagtcagtttgttgagttatacactctccctagcccctagccttattgtcggcgaattgttcttggaggataaggctcttggacctttcacctgcctcggttgaacaagcactgatcctagcccccagccgtgaagttggaaaatccattttcgattacacggcttggttaatacgcacggcgagaactcttacacgaccagatcttacatggtctttcgtctctaaaggatccgacaaagccttatccgctctgggcgtccccagccgaagtttccttaggttcctcagaggctttgtcaagacggcgtaaagggacattaggataggtttcaacgctaggtgtcttttgtggtaagggatctctgggtaaaacacttggcgatattgtgcacctgatatcaactttgttgaagtagaggtaatgggagaatcactacacctctggtcagaaccaggtagtagtcgtaactcaaccactagaattaaatgtacgagagatcgctacaattgactggttgaggaccagtgagtaggtgtctctcgatcatttgaagtcgtagtacgaggaccgctgcgt

SEQ ID NO: 22251 - DNA, 1501 bp, Oryza sativa
gaactttgttccgcaaatcaataggcacattatgaactcctaacagggtaaccaagttctcttaagtagactttgaacggatgaaatcaagaatcgtatcatgaactcagcaggatttcacctcaccaaacttgacgttatacctttggttcgatcgaaaatgtattgatcacccataaaggagcaggaaagatgatgtgagcgaattgaagagggagattgatcacccatagaggagcaggaaagatgatgtgagtgaattgcaacgcacgggtgtggagattatgggtaccccatacccacacggcatggttatccgactagttataggagataacttttatctatgtaatatgtaacagatcatgacttgggtattacgtttccttgtatattacggaacggcctaaagttctggtttgataatattgtaaagtagatttaggaaaccgataccgtattggttaaggtttctatcttgtaatcctgccccccatcctatataaggtgggcaggaggccctctagggggcatataagacaactagatcgtcagatctatatacactcggcggattcaaatccccaaacaggtgtagggtattacctctcattgagagggcctgaatctgtctaaatcctttgtctcggcatccatccacttttaggtctcgtgcgctaccccttttattattgccgaatttatgtttcaacagttggcgcgccaggtagttgtacgccgagtttcctattgaggagtgcgatggaatcaattttatgagtcgccagcttcgcctttgcctcaggagctttgacttcctcgccatcgacaacttcaacaagcctcgctctttgactttgattcaaatcagtcggggaagatctaatctagctaaggaggataacaaccactctaccacggcgagtttaagattcgatctactatggccgccgccagcgtcaccttcgtcagcacgctttttcgcttcagagagaaactttatcgtcaggagaataaccggatactactgttaacaggatcgtcgatagcatgggccgcgtgccttggacgatacacggcatgctacaaagtttgcagtcctgatcttgcaacatatgtggtgtacggttggctacgcacgcgcatcatggtctggctgactacttcgatcgccaaacagtccggccagcatctttcctcgatctcacagcgacataatcaggggcttcgtagcagctctcttattacatgcatctactcatcatcaccatgtattgcatggctgcctgctacaagccaaccaatcaagattccttaatctacaggctgctaccaacaatcgtaggcttgatctactggagcaaatacagatgcatgcttgcacgttcttttatctcctaatcagatatgatttgtatttacatgtccgactatgcgacagccatataacaggcacgttgtttccgatatcactgacacgatcttcatggacatggacttc

SEQ ID NO: 22252 - DNA, 1501 bp, Oryza sativa
tcctcaaagatgaggtttgcgatcgttgtcttccctaatcccccaattccaacaatggagatggtccttagatgctcggatgccacatgcccatcatctttcatcaacagatcgatgagctccttcttcggctgatcaaccccaactagagatgacacatcctgaaagatggtaagagctctttggtctacggtcgcattagctgtcctcatcaaactgatcccaccattcatatatcgcgcattcctctcccccacttctttgatttgtgccttgaactcagcaatcatcttggcaatccgacgccgggccatggtcttggtcagcaaattcctgcatttgacgatgaacccatccggattagcggatccgtcgacgacatggagcatgaactcgtcgaggctgtcctcgatgtcgtaggagagctcccgcacctccctcgtccaggccttgtcctgagggtcagcgttcccctcctccgaatccgacatcctgaggaggaacgcgtgcatggcggcgaactcgtcggcgaggaaactgatctggccgcgcaccccttcgaattcgccggccatggcggcgagcttcaccaggacggacttgagtgccccggtggccgcggtcaccagaaacccctccatatgctcctcgaccgtacgcaaagaaagatcctgcgaaacagaagcagaagcagatctagatcagcaggtggggaatcaacacgaaccgcaaaagacggcgggggcgaatgttgattgatggccggagctcaccgccgtgatcctggggaagctcggcggcgagctggaagagttccacgcagcagcagcagagactgatcagtggtcagtggagtggtggtcaactggtcatagacgaagaggacgagaacatgtttgactcgcagcagacggagcaggtggagaagtcgataggccgggcccacagcgagccagcgagttggttgctttgctctctccatttccaaattttactcatcgttttttattttttatttttattttctagcagtgcagaccatgggtttgagatgaaatgaatatactgtgagtagagccctataagggctaattgagtttacgattttctgttagcacgtttttcaaatactatttctgtctcattttaagtatagttatagtttttatgtccaacgtttgatcgtttatcttatgtgaaaaaattataaaaacaattagtcacacataaagtatcatctaataacaacaaaaatactaatcgtaatttttttttcaaaataaaacggacggtcaaacgttaaacataaatacaaaactacagtctatctaggaaagctaaaaacaaagagtatgagttaggaaagctaagtgccaaaatcagccttattgcacctgctctaatacacttgttgatttcggcaatcaaaatgtctttatttgtgggcgagcatacataacaacttcatgctcctctttaagtggacatttcaaaaagcttt

SEQ ID NO: 22253 - DNA, 1501 bp, Oryza sativa
  unsure (1)..(1501): unsure at all n locations
tgggtatggggtacccataatatccacagtagcccctgagaccttcgcagtcgaaaagataatcttctctcgaaccatattactccaaagcggagtgcttcaatcatctttgtcatggtctcccgagtacttttaccaaatctgaagattgtggagggcttgaaaataagtcaggtgcaccgactagatgcacctaataggtgtagcccccgacnatgtggttaagtgaacaaaccaagcatatagtcaaggaataaataatccaaccaaccgagtggttttgataatcgtaatcaaccaagtgacttgatatcaatatatagcatatgcggtgtgaatcctccaaataacatgatccgagtgatataccaactgctttgtaaaatatgatgagtgatatagcaaaatagctataaagaagcttgtatattgtgaataaaggaatttccaaagtattgggcatacgccatgcgcacactgctttaacagatgtgcttaagtccctagaagacacatggtttcaccacacctagaaatatatggcatatgtggtgtaaaatccgagtaaataaactcataaaggatttaccaaccgcctagaaaatgaccacaatatataatcagcctaagccataatattggtcaataaaaatgcacacttacgtggcgaaaagcaatgatattgtatccaatcaattgcttaaaaacccaaacagcaccttgacttatatataaaaaagtcagcgggacagctatataaagctttactatttgacaccttttaagatgcattgtaccaactcctaaaaagttaagtaactgcggtataaaaggattttaaggtattgggcacttgatcacgcgcactttggcctaagcaaaaagtgcctaagtccctaaaagaacgtgacaggccacacctgaaaatatgggctgcagacatattaggcctaggccaaaacatatgccttcgacaccctttaaaggatgacgcatataacatgctcccgagtaataaatcttccgggtaatatagaccaagcgtagctcatatgaatagcttctgatctgagtggttatcccttatgggatactccaaaatagatgtaacaattgaatcccgactggcgcaagtattcagttgataacccttacggggaataataaatagtccagtctttgagcatataaaatagacccatgatcatgaattcatgttgcatgtatccggagcaagtccaaattgaagatataatacttgtatttgagctagtaagcccctgagcacgtagtcacaattgttcattgatggtagctgacgcagttggcatagagacaagacaaccaatatagagagaatattgcccaccagaggtggcaaaaatattggtggtagtgaagatagtgataccaatcaaaagtactgaagtcgcatagccatggaggcgaagaaaccagtcggcggcagtcaggtcagccagcaatgaatatgaaggcgctc

SEQ ID NO: 22254 - DNA, 1501 bp, Oryza sativa
gttgcccccgactctttagttagttgggaaacaactgaacatagagtcgaaaactttagcttcttgtcgtcgagtagtcattgcttgagtgaagatgcatgttgaagatatccgagtagaaatattgaagattggaataccacttgttgtagtaaaataacatggcatcatatttggtgacgcatgccgatataacgaagctcttgtagacgtcgtggctggtgaagtagcaaaactagcgaagtagcggcaatagagtttgtcggtgccggtgacaaagttgcacagccgtagaggcgaagaaaccaatcggcagtagtcaggtcagccagcaatgaagatgaaggcgaccaacaataatggtagcggtataaaccagacgtagaggcgagggcactagagtcagcagcagacgagacgaccggcgatgaagacgataaggccaatcaacactggcagaatcatgcagccatggaagtgaagaaactagtcggcagtagacgtagacagcttgcgttgaagatgatgacgcctattagcggtgacggcgacgtagccagccgtaaagaagatagcatcagttggcgtcataacaagccagctgtgcaggcggaaacaccagtcgacggtggacgaggcagccggtcggtgaagacgtagatgcccaacaacggcggcataataggccaaccgtgcaggcggagacaccagtcggcagcagatgaaggcagccggtcggtgaagacgtagacgcccaacaacggcggcataataggccagccgtgcaggcagaaacaccagtcggcagcggcgaaagcaagccggtcggtgaagacgtagacgcccaacaacggtggcataataggccagccgtgtaggcggagacaccagtcggcggcgacgaaggcaagccggtcggtgatgttctgactgatccatttctgaagcgtaggagataagctttgaaagccatgaatccctattatgcatatctggatctggatcctgcagaacaaacatataggatgagtagtatctgatgtaaatataatactcgagaaaaatttaagtattttaaaatatttataaatatgtatttctcctcttgtcaattttgatttccccgagcagatgactccgtacgtttaaacactctgtccgactagtcatagcccccaagcatcgggagtcagcctaggcacttcccaaacatgcatatgagtgacatgagtttgtcattaatggaataaagtttcacgaatcataatttactactcgggtacttttgcaattgtaaagagcagaaaataaatttatcttatctctatgcttttgatttattctgaataatacttagaaccttgcgttactcagtccatccaacgagcccccgggtgctaggaatcggcccaaaggcaactatccatcgacaaaccaaacggaaagcataggaagatagaactccataactcgataggtacttttgtactcagattatgtc

SEQ ID NO: 22255 - DNA, 1501 bp, Oryza sativa
taaacgatcaaacgttggacataaaaactataactatacttaaaatgagacagaaatagtatttgaaaaacgtgctaacagaaaatcgtaaactcaattagcccttatagggctctactcacagtatattcatttcatctcaaacccatggtctgcactgctagaaaataaaaataaaaaataaaaaacgatgagtaaaatttggaaatggagagagcaaagcaaccaactcgctggctcgctgtgggcccggcctatcgacttctccacctgctccgtctgctgcgagtcaaacatgttctcgtcctcttcgtctatgaccagttgaccaccactccactgaccactgatcagtctctgctgctgctgcgtggaactcttccagctcgccgccgagcttccccaggatcacggcggtgagctccggccatcaatcaacattcgcccccgccgtcttttgcggttcgtgttgattccccacctgctgatctagatctgcttctgcttctgtttcgcaggatctttctttgcgtacggtcgaggagcatatggaggggtttctggtgaccgcggccaccggggcactcaagtccgtcctggtgaagctcgccgccatggccggcgaattcgaaggggtgcgcggccagatcagtttcctcgccgacgagttcgccgccatgcacgcgttcctcctcaggatgtcggattcggaggaggggaacgctgaccctcaggacaaggcctggacgagggaggtgcgggagctctcctacgacatcgaggacagcctcgacgagttcatgctccatgtcgtcgacggatccgctaatccggatgggttcatcgtcaaatgcaggaatttgctgaccaagaccatggcccggcgtcggattgccaagatgattgctgagttcaaggcacaaatcaaagaagtgggggagaggaatgcgcgatatatgaatggtgggatcagtttgatgaggacagctaatgcgaccgtagaccaaagagctcttaccatctttcaggatgtgtcatctctagttggggttgatcagccgaagaaggagctcatcgatctgttgatgaaagatgatgggcatgtggcatccgagcatctaaggaccatctccattgttggaattgggggattagggaagacaacgatcgcaaacctcatctttgaggagctgagggagcaattcgattgttctgcttttgtgtctgtgtcaagaaaccctgtgtggatattatgggtaccccatacccatacggcatggttatccgactagtcataggggataacttatatctatgggatatgtaatagatcatgactcgggtattacgtttccttatatattacggaacagcctaaagtcctggtttgataatattgtaaagtagatttaggaaaccgataccgtattggttaaggtttctatcttgtaatcctgccccccaccctatataaggtgggcaggaggccctctagggggca

SEQ ID NO: 22256 - DNA, 1501 bp, Oryza sativa
  unsure (1)..(1501): unsure at all n locations
ctcaaatacaagtattatatcttcaatttggacttgctccggatacatgcaacatgaattcatgatcatgggtctattttatatgctcaaagactggactatttattattccccgtaagggttatcaactgaatacttgcgccagtcgggattcaattgttacatctattttggagtatcccataagggataaccactcagatcagaagctattcatatgagctacgcttggtctatattacccggaagatttattactcgggagcatgttatatgcgtcatcctttaaagggtgtcgaaggcatatgttttggcctaggcctaatatgtctgcagcccatattttcaggtgtggcctgtcacgttcttttagggacttaggcactttttgcttaggccaaagtgcgcgtgatcaagtgcccaataccttaaaatccttttataccgcagttacttaactttttaggagttggtacaatgcatcttaaaaggtgtcaaatagtaaagctttatatagctgtcccgctgacttttttatatataagtcaaggtgctgtttgggtttttaagcaattgattggatacaatatcattgcttttcgccacgtaagtgtgcatttttattgaccaatattatggcttaggctgattatatattgtggtcattttctaggcggttggtaaatcctttatgagtttatttactcggattttacaccacatatgccatatatttctaggtgtggtgaaaccatgtgtcttctagggacttaagcacatctgttaaagcagtgtgcgcatggcgtatgcccaatactttggaaattcctttattcacaatatacaagcttctttatagctattttgctatatcactcatcatattttacaaagcagttggtatatcactcggatcatgttatttggaggattcacaccgcatatgctatatattgatatcaagtcacttggttgattacgattatcaaaaccactcggttggttggattatttattccttgactatatgcttggtttgttcacttaaccacatngtcgggggctacacctattaggtgcatctagtcggtgcacctgacttattttcaagccctccacaatcttcagatttggtaaaagtactcgggagaccatgacaaagatgattgaagcactccgctttggagtaatatggttcgagagaagattatcttttcgactgcgaaggtctcaggggctactgtggatattatgggtaccccatacccatacggcatggttatccgactagtcataggggataacttatatctatgggatatgtaatagatcatgactcgggtattacgtttcccttatatattacggaacagcctaaagtcctggtttgataatattgtaaagtagatttaggaaaccgataccgtattggttaaggtttctatcttgtaatcctgccccccaccctatataaggtgggcaggaggccctctagggggca

SEQ ID NO: 22257 - DNA, 1501 bp, Oryza sativa; identical to SEQ ID NO: 20420

SEQ ID NO: 22258 - DNA, 1501 bp, Oryza sativa
caacactggcagaatcatgcagccatggaagtgaagaaactagtcggcagtagacgtagacagcttgcgttgaagatgatgacgcctattagcggtgacggcgacgtagccagccgtaaagaagatagcatcagttggcgtcataacaagccagctgtgcaggcggaaacatcagtcgacggtggacgaggcggccggtcggtgaagacgtatacgcccaacaacggcggcataataggccaaccgtgcaggcggaaacaccagtcggcggcggacgaggcggccggtcggtgaagacgtagacacccaacaacggcagcataataggcccgccgtgcaggcgtaaacaccagtcggcggcggacgaggcggccggtcggtgaagacgtagacgcccaacaacggcggcataataggctagccgtgcaggcggagacaccagtcgacagcagacgaggcggccggtcggtgaagacgtagatgcccaacaacggcggcataataggccggccgtgcaggcggagacaccagtcggcagcgacgaaggcaagccggtcgttgaagacgtagacgctcaacaacggcagcataataggccagccgtgcaggcggagacaccagtcggtggcagacgaaggcagccggtcggtgaagacgtagatgcccaacaacggcggcataataggccagccgtgcaggcggagacaccagtcggcagcagatgaaggcagccggtcggtgaagacgtagacgcccaacaacggcggcataataggccagccgtgcaggcagaaacaccagtcggcagcggcgaaggcaagccggtcggtgaagacgtagacgcccaacaacggtggcataataggccagccgtgtaggcggagacaccagtcggcggcgacgaaggcaagccggtcggtgatgttctgactgatccatttctgaagcgtaggagataagctttgaaagccatgaatccctattatgcatatctggatctggatcctgcagaacaaacatataggatgagtagtatctgatgtaaatataatactcgagaaaaatttaagtattttaaaatatttataaatatgtatttctcctcttgtcaattttgatttccccgagcagatgactccgtacgtttaaacactctgtccgactagtcatagcccccaagcatcgggagtcagcctaggcacttcccaaacatgcatatgagtgacatgagtttgtcattaatggaataaagtttcacgaatcataatttactactcgggtacttttgcaattgtaaagagcagaaaataaatttatcttatctctatgcttttgatttattctgaataatacttagaaccttgcgttactcagtccatccaacgagcccccgggtgctaggaatcggcccaaaggcaactatccatcgacaaaccaaacggaaagcataggaagatagaactccataactcgataggtacttttgtactcagattatgtc

SEQ ID NO: 22259 - DNA, 1501 bp, Oryza sativa; identical to SEQ ID NO: 22246

SEQ ID NO: 22260 - DNA, 1501 bp, Oryza sativa; identical to SEQ ID NO: 22252

SEQ ID NO: 22261 - DNA, 1501 bp, Oryza sativa
tgctgaacatttgctgttccgtcgaggagatagagactgattttgcattaatcgcagtgaaggtgacttggtcgacttttaatatgaaaagttggctctgtgatgagtgggctaaaagtggggcgggttatgcccctaacccaacgggctggcccgcatcactaaccatgcctgccttgactgatgcgggccaaagcggcagcctgcactaacccaacgggcaatgatgtcgcattgctcaccattccagtccaggggaagtccatatcgctgctagcgagagatgatgcatggctagctcccttcgctcccctcagctaccattgtaagtttgtaagtggatcttgcttggtggtagtaaaaagaatatggccattgcagccatggccgcccgaggaaacgatgacagcatcgatctatatgcattcttcacgaatcagccgggttttttcagtgcttttgcttcaggagttccaagcacaggcggatgcaaaagcatgacctggcgataatggcatggtgttcgaagaacgctagagagcaggaagatgacattttagtgtgataacaaacacaaaaatgtaatgcatgaacggcaaggaatgcatcgaatgcatgtcgcagacagaatcacactgattttgccatgaacttcatcgaacacggaataatacagcaatgaaaggcttcgacagcagttcttgcctggttttatgtatcataaaaaaagcgctgcatctgacagcactgatgatggacgtccatcgtttttgccctgattcgtgtaataacccaaaagagaaggtcaaagtggctgcttcaaagctccagtgtggagatccatttgctgcaattttgttgcttgcctcaacaagcgccattgaattctgttactgcctcacttaggaaaggccgtaaaaacttcaatgataaatcgtactagcatatttcaaacacactgcaattaccaacattgtccagagcaccaaacttctcattgaaactaagagaaagtcttgactaagtactacccccatcccatatatttgaaatttttcagaaatatccacccaaagtgcttcagcaaacacaaccagggaaaaaacaaagagagaactttgttccgcaaatcaataggcacattatgaactcctaacagggtaaccaagttctcttaagtagactttgaacggatgaaatcaagaatcgtatcatgaactcagcaggatttcacctcaccaaacttgacgttatacctttggttcgatcgaaaatgtattgatcacccataaaggagcaggaaagatgatgtgagcgaattgaagagggagattgatcacccatagaggagcaggaaagatgatgtgagtgaattgcaacgcacgggtgtgagattatgggtaccccatacccacacggcatggttatccgactagttataggagataacttttatctatgtaatatgtaacagatcatgacttgggtattacgtttcctt

SEQ ID NO: 22262 - DNA, 1501 bp, Oryza sativa
tctctcccttccatgcgtgctttttctcctctcccttccgcgcgtgctttttttaatctttaatcctggttggtataaataaccgggactaaagtaaagtactgatctttagtcacggttgttaacactaaccgggactaaaaatactagggtatctaccacgacctgacaatgaatgaacagggactaaagatgaccaaccgggactaaaaatggtttttagtcccggtttttggatgaactagggctattgtggtttttgcgcaacccacaaaagatggtttctccagttgtatatgattcaataaaacaagatcgtggactgcaatgtataatttttaaatttacggacttaagtgacatcttcactcaagtttaagaaccggccatatattttactcctatataaatatgaaactcgcatggtcctgtgttgttcgtttaaaaaataaacattgtaagaaaaccataacgatccaacaatcatgcaacaagttgagagtagttgcaagaattgatgagcccttcagtaccatgctgagagtcggatatttattatatatagtagcttagctaggcggctgttgtgctgaaacagtgaatgtatttagagatggatttgtgaaacacggggactaaattttcgtgcccgttgaatccatctgagacattggatctgagacattggatcgtctgagttacctgagatacttccgtaagggcatgtacaacggcaactaagagtggacacagagttgttgacgaggtaagtttgctgacagggaaaaaaaagcgagaaagaaagagaaacatggatagttgttatgttgataacgcctttacatcgacacttaacgtttataaaatgaaactttgttgtacgagaatatagaaaaggaaataattattagaatattttatcattaaggatagtctttaatttttactatactccaccgccgtcgacacccctcccctccggcggatctggggagggaaggaaggggaggggagggcggccagctgtcggatccgcgctcccctctggccgtgctgccgctgatggccctcccctccgccggatctggggagggaaggaaggggaggggaggggagccagatctcggggggagagggcggccagctgccggatccgtgcgggggttggccgccgcccgcgggatcccgcgcaccgtcgccatgccgccgccgggactcgggaggagaggagagaaagaggggaaatttaaagtgggtaggagggaaagagagtggtattttcgcgtgcggtgatttttccgtgcggtcctcttaaatggaccgcacgcgaaaatgagcttattttaccagacacgaccagttatggtccgtctgcaatctagctaaatgggtccatgtccaggaaaatcgttttttattagtgtagctatgcctaaaccttattatgatgatatataagatggctgcatccgagcttgccaacccctatgcgcactcgcac

SEQ ID NO: 22263 - DNA, 1501 bp, Oryza sativa
ttttttgttcaaggggggatttctttatttttaaaagtgagaaaagttttctttttgattttgagcacgatgtgtactttggtacgaagtgtgctttttaccacttttgtgctctctaccacatttgtttttatttttccaaacaacaaaacatttttgatgggtttgccaatgtgttcatcaaggggtagattgtaaaatcaaagtgttttttattcttattctgtgatgaacaattggcatttgagatttttggttttgaaatttggagattattggtgaagtagttttggagatgattggagttacaggtgatatacaggtgttactggtttgtcaggaccggtcagatcgggcatgtgttgccggtcaaaccagcggtgatcgagtggtcagaccggctcagcccacggtctgatcggcccagcccgtggtctgaccggccgactccggtttcgggttgatttgttcggatagttgtgattgtttcatgtttatggcttctagatggatactatgcatatgtaataccgttgtttactaacaataagtcaagttggagatagcttgatctcggaatatggtttctttgtttgattcatgtgttggtgacttgatgcctcgggagagtattgccggtgatggatcgggagtcgacttggggataaggcgatgtccgtgatggtcagatatcatgcaggatacttaggtgtcacaccccgaactagtcctgagcggaattagcccgtgacgctccaatttaacctgttaatcgataccagtcccaggaaacagtgctggtatcacaggaagtcagaatatcagagcaacagaagtctctttattatagagtaggagtacagtcatgttgggctgcggacagatcccgagctcacaactacattacaagagggaagcggaagccaagacttggaccaaacatcacaggcgcgacttgggaactaggccaaaaccctaaaactcatcgtagccgacttgctcctggaagaactcctcgtcagcgggatctacttcatcttcttcagcaactgggggggattatttatatagagcaagggtgagtacaggagtactcagcaagccatgggaaataagtgtttaatgcaggcttcaaggaaaggctgttgtttttgcaattgattttacttaaactcttttctgaaaacaactaagtgagtgcttctcaaacgacacggatgagacagtgcgtctcgtccggtcggagtatgtgcaatgtatcagtcttttgaattgatcaaggttggcacccggccaacagctttcaaacggccacccgagcctggctgatcccatcagccgcagattttccaaacatcaatcccaaacctcatcagcaaatttcacaaagcagtagtcaaacaaaactacgctagaaatcacctcacatccgcccatgaccgtgggcacagctgttcgaacagtttaataacctctgcagagggggtacactttacccaca

SEQ ID NO: 22264 - DNA, 1501 bp, Oryza sativa
atctcaaaaccagataaaattatccatcaaccaaaaagaatagatataattcacagctttcatccctgtttaatcatggttttaacttcatatggttcgctttatttttccgtgatgtttgctgtcttatttggactacactcgatatgaagtgctaaattgtaataatgggttgtagctctcttgagcaaaggccgggatgtttatttctttataaaaaaaatggtgtaaagatagatgggagtatggacttgtcaacacaagagtatggaggtattgtgggtgtcatctgtacctcttttagatgccatctgttttaatcactattcctgttccgcacaggcgcaccgacaagcaaggtggcgcgtgtttttggcccacacccacatgtgcggttttgacccaccagctacaagcaattccgaattttgataagttcacgattccgccccactagaccaccagttacgtgtgcgttgttagagtgggatcgggaaaggttatgatttgctcaaataattagttttttattatcacggatttaattaaggtaaccttttcttttattttattcataggaagttgtttcttttttatataaaaaatttaaaaatatatactaaaatttgctaactttcaaataaaatttaaaagtacttcctataaaaatatgaaactaaaatttaaaattttcaactaaaaatttagaactaacaactagattttgaaaattttcaactcaaaatttgaactttcaagtaaaattttaaaagatttcaactcaaaatttaaactatcaagtctaattttgaaaacttttaactcaatttttgaactttcaagttaaattttgaaaacattttactcgtttcaaaacttttcaacttaactatttgtttactattttcattataaaaactataattaacacgaatcaattcgcttagcactgtaattagcactaatagcgtgtgagctatcctacttcctccgtttcacaatgtgtctagattcatcaacatctacatgaatgtggacaatgttagaaagtcttatattgtgaaacggagaaagtggctattttcattataaaaactacaattaacacgaatcaattcgcttagcactgcaattagcactaatagcgtgcaagctatcatagcgatgcgacactatgcacaataaggaaaagcgtgtataaaaacaaaaaagacaaccgagtccaagatgcacggtactccctccgtcccaaaaaaagacaacctagtactaggatatgtcacatcgtagtaaattttttttaaggacggaggaagtatttattttcttggcgcaccactgcccaaaaggaaccccctttcggagtctgagtgatctccgtcctaagaccctgtttagatgggactaaaacttttaagtccatatcacatcgaatgtttagatattaattataaatattaaacgtagactattaataaaacccatccataatcttggacta

SEQ ID NO: 22265 - DNA, 1501 bp, Oryza sativa
ctcctaaaactatctcaactcttattgaagctatggagatattttcaccctgcggctatcaatatgaaatatctacggtccagcaagcaatgcaaacttgtatttacatgcagttggtccatttaaaacctgccaacatcgaattgttgccctcagaaatgctattgaagtagaacatggaagcaactcatttacctagcgaccctacaaataaggggatccggtgacctggttggagagcttgcagccgtggacggagaggaagaacatggcgacaaatcctgcatggtgccctatcatcagtcatttagaataaaaagattgtacaaggcctgttgcttttgatagattgtcttttggaggtgctcataggggtagggtgtgtgtgcgcgcgttcataggggtgagtgtgcgcatgttgtgagcgcctgcgtttgtactgtgtttctcaacaaaaaatcagtacactgataaaaaattggaggcataaaagcagaacaaaatgaagcccaaatttagtgtacgatagcatcttgcatctggaaaaaggagtaggctaacattatagggtatattacaatcttgttggttccagctgttaatcatctggcctattttatacaacaaacccttcaatccttaccaatctagtttgctgagatgcagtagtacttgtggcaccgcaatgaagataccctatatgaatcaaggttgttcacctgaacagggcaaaaatatattaacaatctcatttgtaaaagggagtaatctagattgcttgcagctaatccaattttcgttgatatgaaactaaaaaattgagtaaataccccagatgcattagaccagatttcataatacagtgagtactgaaaaatcactatatccatctaaaaaatattgattatatagtaagtgtatcacttcatcaccagttataattcaatgagaaatacttgacatgtgttaatatcagacatctaatgtaaaatcaaaggtgtttttattattattttgtgatgaacaattggcatcggagattattggttttattatttggaattaatttgcgaagtggttttggagatgattggattttacaagtgaatttacaggatgctgtcattttatgtgaccggtcagaccgggctctggtagccggtcagaccggcggtatgcgtgcggtcagaccggccagcccgcggtctgaccgaccgactctgtgtcggtttcggtttcgggttgtttgtttggatatccgtgattgtttcatgattatggcttctagatggatactatacgtatgtaatgctgttgtttgctactaatgagtcaagttgggatagtttggtctcggaatatggtttgttttgtttatttcatgtgtaggtgactcgatgtctcgggagagtatttgcggtgatggaccgggagtcggcttggggataagacgacgtccgtggtggtcagacatcatgcgggatacttaggctagagttga

SEQ ID NO: 22266 - DNA, 1501 bp, Oryza sativa
ggattcgtccggattcatcccgcaatcgtcgccggcgtcttcaatggcggccgagatctccgcgcgcgattcctctctccccggccgcgctctccccctcccgttgctatttattcgatccccgtgcttcgctcttccgtttccgccgctcgccgctcgctctcgccgtcggattcgtgctcgcgccgtgctcctctctctccgccgtcgccgccgagctccgttccgccgccgccgccgctccggacttcctccttactcggcgacacctccgtccgcttcgccgtgttgccgccgactccgtccgcgcctcctcctcgcccgaacatcgccggagcaccgtcgccctcgtcatcccgagccgcgccgccgtcttcttccgcttcggccgccgttcccgtcgtcgccgtcgaccggggtgagccgaagaccgttccgttcgcttcccccttccctcctctctctcgggtgccactccgccgcgccgttggtcgccggcggcgaccatcggggcgcgggtgcgcgtcctcctcccgtcggccgtgccggcgaggccgccttcggcgcgccctcgcggctgccaggtgggcccggccgtcagccgcccgcgcccgcgggtgcggctgacgcgcgggacccacggcgccgaccgccgccagccgcgtgctcccggtccaccgtggaccgagaggctgacgcgtgggccccactcccgtggacccggtccgcgcgccctctcccctcggctgacgcaataattcgattttaaattaaaatttaaatgaagaaattcgcaaatatccatttaaagagcatataaacttcaaatggccatatcttggccatttgaactcggaattggaccgttcaagtctctaatttttccttaagatgtaaagaacccatttttgtgctttgttcctgcttgttatttggagtttattagagtaaaagcctttttcttttccgttggtcgtgtagacgctgcagcttcggaagatccgctcttcgtggaagttgaagccggtgtttgggaaagcgagcaaggcaagtcacatcatccttgagcatattgaatcccagtttataaaattattttgatttaaattaatgcattaccgctttatttaaattcccgcgttatcactgttttatttagccatgcctatttacctttgttaagacattattattgctattgttattattaccttgttcaccctagaataaataaaaccctaactagtggacactctatttatggttccactagtatgaatttaggtagatgcttcgctgattaattaggcaacattaggtggttttataactttagactttgggaattctcatatcatttggacactatggaatggttggcttatgttggaattggacacacacctctcttcctctttcaaaacccctaaaacctgttttcggtggggtttgggtgcatgccagttgtgggaagtagcaccccggccactataaggattaa

SEQ ID NO: 22267 - DNA, 1501 bp, Oryza sativa
tttagccatgcctatttacctttgttaagacattattattgctattgttattattaccttgttcaccctagaataaataaaaccctaactagtggacactctatttatggttccactagtatgaatttaggtagatgcttcgctgattaattaggcaacattaggtggttttataactttagactttgggaattctcatatcatttggacactatggaatggttggcttatgttggaattggacacacacctctcttcctctttcaaaacccctaaaacctgttttcggtggggtttgggtgcatgccagttgtgggaagtagcaccccggccactataaggattaagctcgggcctctgttgcaaagcactaccgtacttccacatgtctaatgggtaaggcttagtttgtggctcagtctagtcataaacaaaagtacacggattggagatggatgaagtcgggtgtcgatggacattctccaggacaaatgaaggctacacgagctgcggcccggtagtcgagatgtcatatggcagagggttggtgccctgctgctaggggctcagttctgcctgcctgtcccgggtatcccggccgtaggtgggattgggtcggtactcttgtttatggctaggatgggttgggaactatgtcacgtcttccgtccgtataccgtggtggtatgtggcacgtgtttgcacgtgaggaagatgtgtcctgtgggtaaagatgtacacctctgatcagagtaaatctattcgaatagccgagccctcggatatgggcaagcctagcaatgtacccaagtcagtgttttaattcttaaaatttgctcaacaactaaaatatggaatggttggcctgggttggcttgggacgagctgggacccaggtcgggttgccagttcggtccgaatcatcgtaggccttgggttaaggcaggttcgtgagggttcacggccttgtttaataatactgtgtagctctaggatcgtctttacaaaatggctttgggcaactaagtgtcttttaaatgctgtttactgcaaaacttaatccctatattattattcccttgtacctcccttgcattaattatgcatccgccggtgtggcttgctgagtactgtggttgtactcattcttgctcaatccttcccctcttcagtaagagaagctttggagaagatgtcttaggtggagtcctggcttataccccagttgagcgcctgtgaagatggagccgtaggcccgctagtccgctgctgtttatttttgattgtcaggcctgaagcgcctttgtaataatgtaaatattatcgatataataaagatgtgtcttttatatcatgtttgtgtggtgtaccccggcttttcctgggacggggattaatacactagcgttcgggaaaaggcaattttcccggtcgcgacaagctggtatcagagccatctcgactgtaggataagccaagtggataaaacctaaggacatat

SEQ ID NO: 22268 - DNA, 1501 bp, Oryza sativa; identical to SEQ ID NO: 22266

SEQ ID NO: 22269 - DNA, 1501 bp, Oryza sativa
tcggcatcgactggaactactccatcagcttatcagccgatcggctatttgatctgctattgtatatcttgtgagttgcaggatcaaactgattggcacacccgcatctcatcaacctttggacctgcactggagttaagcaaatctcccaggccaccgtgttttcacatcaacaaccatattctaaaccattttttaagcagattcgaagcgggtgcggatatgtgcgcatgcagagcggattgtttcggatgttggaaatggtgcggagtcggtgcagactcggttcgggaaacaaattaaatttatcagatgttagatgtttatacaatcaatacaacattgagttatcaatgcaagggacagcaatacaataatcattaaacgacctttcataaacttaagtgtaagatgagacggcaaaagcctcaaacaaggaagtttaggttaattgataaattaggtcattggatgggccgactcatgttatatgcccagatagagtggttacatgggttgatattttcggattatccggcaaacgacctatgggataatccgatagaaataccagataatccgcatttatcggtttttagagataccacatccgaatcagaatccgcaccttactatccgcattcgcatccatatccgccgatttctaaaattccataccatcctcgtttaggacggatttggaacggatcagatcggatataatccgatccattttcacccctacctttcattgtatcaccgttagtctcccataaactatgtgaaaagtccatttcacacttagaataatatatgcaaaaatacactttatgtgtggtgcaatggagtatagttaagggtaggctaatagtgatggtaaaaggggaagaaaaaaccacttgttcgatagcatcttgtggaacttttatttgtcaatattactcagcaagtcatacaggaataggggtatgatgcaaggattcaacaagggatagctaagcaggttcatttgcataaagcgagcatttataaacagaagctgaaagattcaaacagttgtaattattaattaaacatcctctgtccagcgctaacccacgttgcgacaggcccaaccatccacctaaattatccaaattcaaaagattacactaaggtgagactaatcacggtgaatctggttgaccgcccgtaaccgcgggcacggctattcgaatagttttactctgatcagagctgtacaactgtacccacaagacacagccccacgacacgtttccgtgcgcccacatgccaccacgacatatcagaaagaggccgtgacaggacccttcgcataaccccctctagccaagcacaccacacctcaggtttcacccccgtccccagcgggcaacgggcagtcccctctcgtgcctaggtgaatccggaagcgacagaggccgtcgcagggcccgccccgctccatcacgcccacccttgcctggatgcgtcgactaga

SEQ ID NO: 22270 - DNA, 1501 bp, Oryza sativa
ggtagcatttggctcgggtgcctggtgggaaggaaaatatcgggcgccctgcgccccacatccctcctttctctctcggtctcatctattcccctcctttatctctctcttcaccatttctctcctctctatcccctttgatctgtgaggaggcaaaggtggaggcaaggtagtgacaggcagaaacataaggcaagatatcggcaggacaaggcggtggctaataggggtgacggtggcaggcagctgcagtggcggcaatgtagacttagctgagtctatgcaacaacggcggcaatggctatgtcctgagtggctgtaggagtgggtggtggtggtggtttgtagggcatcatcagccaaatcatcatcttcggcagctgcacgccatcattagccacgtctcctccgtggcttgggcagcatctaccgtcgatgatccggctaacctgaagtggatttagctggtcttttttcgggtgattgtttcaatgttttcattctatgtatatggttgtttcattagtcagatcaaagtgtttcacttggatttttttatggtgtttcaatttttgtcttcgatttcactcggaacttgttgatctttcaatggctttaaatcattagttttatttattgaaccaaattgtttcatctggcgatccgattgcgtttcacttttttcaagaactaaaacattctttcacttagtgctgaaacactctttcataaggggtaaaataatgcctgatttttaggaaaaatcgggcacccgatttgtagtcatttcatcacaacagacacatacggtcagatgcagaacaaagcattactatctactagcttctcgaatatatatgacattttaaaatgtgtacagttaaaccatcaaatcttaaatcattaatatatgtaaatataactccctctttcctagaatattataacctagtaccactaatctaaaacgacatcctgtcgttaggggtggaaacggatcggattcggacggatagtggtcacaccattgttaacagtgaaatttggtaagccccgaagtcctgatcggcctagagttagtattggcttcagagttctggaatcagccgatgagagtcatcaagtcgctagtaatcagattaagaaaattaatcaattaaagaaagcttatctagaagagaccgtgttcaaggaagatgtggcatggcagtttatctattaattaggaagagtttgtgtttccttttatctttaggaaagtgtgtttagtgtcccataaggattttatgttttctttttatctttcgaaaagtttctttcttgtccaacaaggactagtatctacccatgggtataaatatgtacatatgtggtaattttaatttatctcatagatcaatacagctactcttggcgtatagccaccctctttcccgaggtttttatttatcatccggcgaaaccttagcacttgacgcggggttgcatcggctttcgatct

SEQ ID NO: 22271 - DNA, 1501 bp, Oryza sativa
gtataatgttgtgatatctttgtatgttaagatttaggatttagtgggttataattttatggtaagataggattccctaatgcattgcagcagtcacgacatatgaagtggcataggtcagcgcatatgttcgaaattgtttgtttgttgaaccggtttgctacataaggattatttgagggatctgtgaaaaaaaacgaagacaatgaaagtcaggaaatgaaatgtgactaaataatctatgtagagaacaatctccggacttacgttattgttgtttgttgtgcatctcctgttgaccctaagcatcttgcacacttaatatccacataggttagtgcctagggttgcttgaaacacaacaaacatgataataacaccagtcagtttaaaaatagtaatgattacaacaatttgtgtgcatggcacacgccattacataccggccagtccgtcttcacatgaagctttttcctctgcacatcctttactggcctgtgatgtttgacataaaatttacgtgctctgtgccgataaaacatttatttgtgttactttcaaatttcggaacggcaattaggtactgaggtggtatgttactacgttgaaattcgaaatagtgaggaactccatataggctttcttggatagtgtgccagatcaagcgcgacgaccaagtggtccctcggatataccgggaataaaatatagtggtcctgcaaacaagatagatgaattagagatgacatttgctagttatcttgtattacaagaaaaaaaataatcaaatggaagagatgctgcttatataagagcgtaagggaccattatgatgtttttgtctcagtgcatgagaattgcggttcccaagtagcaagctacttcaatcttcttccttgtgcaatttcttgatatatgcttgtgttcctccggtgtcttatctgttagttccgggctattagcaagaagctgtacagtttgttgtgtggcctgcaaatccttgttggctcgatatagccaacgagttgcctcgctctttctgtgtcgtagaactgtgacctatggaatgcagcttgattgaaaaggaagtttctttcacacatttcacttacaacaaactagtgtaaaaacacttacacgcaaaatgcaacaacgagattgatgtccatcttatcgagcttgaagagggcgtgtaggtcccggaaattgatgataaagatctcattggttttactcatgaaatcgtctcgtgggaccttgacactaatgaagcttagggcctttctagataccttgaggtaccattcatgcatcaccctcatctgtcgtggtagattattcataatgtaccatggtaagaatgacttgtcatatttatattcttggggcacatctacagatagccaagattgcaactcatccttggcccatactactgacttctaggaattttacagctcagcaacatcttctttcttcttctttgcccaacctctcccac

SEQ ID NO: 22272 - DNA, 1501 bp, Oryza sativa
acgtcatcatcgtttttctttttcctgtttttctaatagattaaatcttcggaaattcataactaaatcatcgtaactcggttttgagtggttcaagttgctaaattcatctaaaatcaaaatcatgatctacatgtttgtttactttatatgtactgtttatgcttgttttttactgtttatttggtttttattagtctttttcttggttttgcgtgttagcctgtcgtttccgtcgttgcgaaggttcgtgagtgcgccggaagtattcaagaagattaattgaagaccgattattgcaaggcaagtcacacagatcctaaacacaatcctttgagcatgttgatcctatatttaaattctctatttatttcaactgtgcatttattttcgaatgtcactgggtggtgtgaatctattcctttgttatggcctgtttgcattgattactctattccttgataccttgggatattataatttgactagttgagctttatatatattggttcaactagatgttagatataattgcttagccatgcttagaaacattagctcactaatgggatgaatcatatatactacattattatttatggttatatttaatggtagctcacgatggttaatcgtgttatgataattaattggtaattaaaatatgattaatggtgggttgtaagcacatggttttgaaggtcgtgctcatggcaatgaaggaccggttcgcgagctactgttgtgaaacattaaccgtgccaaccacaagccagcgtgggcaacggctttaccttttgtatagcatagttcattgcggagcaccagactgagaagtggcggagataagcccacgggggtcgctggggagtccatgccctgttttataagggggtaattatgatccaggaatggtgcactgtggtgagttgtgttgtgcagagggtattgttacagcctctattcgggtactttccagtatcgcgacgcatggtagacatgatgttgaggctgtgtcttgtgggtacagtggtacacctctggccagagtaaaactattcgaatagccgtacccgcggttatgggcgggttgagcaatgtttttcgtgattagtctcacacctctcacaattattatggatgttatacctggtaataatttgcttagctcctggtttggagttagatctgtacagccgggtatggttgttcaggatggttgggcctgtgtagcatgggtgtgttgttcagtgttgattaaaatttctgattaattactccactgttttacttctcttaaatgttttgctaaatgctgcttttgcaaatgagcctatattatgccatcctttggtatccttgtgcacttgcatatttgctgtgtagcttgttgagtatgtcatatgctcattcttgcaataatcaatcaacctcagttgaagaaaaaggatccagaaggagaagacgtttggcttatactcattcttgcaataatcaatca

SEQ ID NO: 22273 - DNA, 1501 bp, Oryza sativa
cttgattgcttttatttgtgtcgtgaaaagaggatagtgtataactggtttcaacttaccggaaaactttaacgagaatccatagtccttcttccggagagtcaagcctcgtgtcatccctccacagaagaggctctcttaaaagaaactagccatcccaacgtcaccaagtttcatgaatagggccaagaagacccttcgcgaattcgctgctccgtctgctgacaacgtgcctgttgacccggctgtcaacatgggacacatcgacttcgatcttaagagcagcctgataactatggcgcaggcaagcccgttctgtggcaagctgaacgaggacgcaagcgctcatctgcaacaatttctagagatctacagcacctacactgtaaagggtgtcagttcggacgctgtcaggcttcgtctgttttcattctcactcctggggaaggcgaagcaatggttctatgcgaaccggatgacagtcaacacttgggacagatgctccaccgcgttcctctcaaaattcttccagatgggcaagaccaatgcctttcgtaggagaacatcaagcttccagcagactagggatgagacgatattctcgaagcatgggaacgtctgcaggagtatgtggccacctgtcctcatcatggaatggacgactgactcattctgcaaagattctacaatggactcattccctcatctggaaatcatctggatgctactgctgggggtgccttcttctcaaagacggtccgtgcggccattgatcttattgagaagatggtatccaacatgggatggagcgaagaacgactctagaccagacaacgcggcatgcattctgtcaaggagacggagatgtttgctgctaaactgcatctcctgatgaagagactggacgatcaggagaaggccaaaccgcaagccactgtcaaggcattagactcgcacatcacatgcaaggtctgcgagaacactggtcactcagggaatcattgcccggagacccgtgaggaagccatgttcatggggaataatggctaccggccgcaaggaagccaggggtggaaccagccccgaccatactatcaaggaggcaacaacggcaacaataacaataacagtaacttcaatcagccctccgtgaaggacttagtttttgcgcaggctaaaacaaatgatgctataaacaaaaagcttgccttgaatgttaaagttcttgagaatataaatgtcaagctagaaggctttgcttccgctttccaaaaccagctgagcttcaacaaaatgatagactctgctggtgcaactagactctttagtacctatgaaggagacgggaaggattccggggcagcccgaaccttccctaaaaaaatgttaaggcgataaccacgaggggaggaaaatccactcaggatccgccatatcctaacactatagggaccaagcaagctagaaaggaggcacagcccgctagcataaatgaacccga

SEQ ID NO: 22274 - DNA, 1501 bp, Oryza sativa
tggtatcatcatcattagtattgctagtgttgttgtctgcattgcgtccatcttcttggggcggaaactcttgatgcgcaacagaagatccggtgatctgaagtggctcagtgcgctgtctttggttaccacctggaaatactggcatgttgacaatccttctcttgcagttcgtcatccgattatgctcactttcgagttgcatggctttgtccacaagtttctcgaaatcttcataatcctctagaagtagttgcactgcaagctcatcttttaacccctgaagaaacttctcttgtttgtcttcatccgtttccacatcttctggtgcatagtgagccaaacgatagaactcgtgtaggtactctgtgacggtcaaatctccttgcttcaggtagcgaaactctcgttttcttagtgtgatcattcctgcgggaacatgtgatctcttgaatacagatgaaaactcgttccaggtgatggtatgtccttctggccgtgatgcttcgtagctatcccaccactctgaagccggtccaaccagctgatgagttgcgaagccaacccgctcctggtcggtgcactgaatcaaccctagcttcttctcgattgtgcgcaaccaatcactggcttccataggatcgacggcaatggcaaaggttggaggctcagttttgagaaattctgataatttgcactgttgctggactgtaggcacttgaacgttggttgcccctgctgggttgttccaattctgtaatagttgaaaggttgttgccaacatgttggtttggttaaccacaacttggattagctctggtgaggtttcgttgatgcttttctcattcccattggcttgggttcttgagtcatcggatccatcattcccgtagcctttgttaccagtgttatccatctgtcacaaggtagaggttgagaggggaagcatacaaggaaagaatagaccagaactagggacaagaccttaaaggaactaactctttttgttgatgtgttgtttgttttgcttattctgcaagttgattaagcaaacaacctagcatggttacatcacaacccactgatgcaaaccacgcgctacacacacaagcaaggaacacacgactaacaacactaccctatagggtggcttaggttcagcgacaggttctccaagatcttcactcctgcttcacagctggcttcactgcttcctccacttcgctagcggatcctgcagtctttcggagcttcggcaaacaactgacgacatcttcttcttcacaaagctaaccaactagtactagttgaaatctgaagaaggaagaagagggtaaaccttttgcaaatagcattaggggaaggagaaaaagaggaactttcacaaatagttttatttataaaatatgtccttaggttttatccacttggcttatcctacagtcgagatggctctgataccagcttgtcgcgaccgggaaaattgccttttcccgaacgc

SEQ ID NO: 22275 - DNA, 1501 bp, Oryza sativa
atcaaatctgcttcatatctagctgagaataaagccctatccaaaccctatttttcctactgtattacgatgcaacccatgttatttttccgcgctaactattggagacgggcaacgcacacacgcgcgagagggggaagagggaatcgcacgattgatggacgaaaataagtgtgacgaacggaaatttatgaatctttatattagttaagatatggtcgattgggaaggcacccaacatccaacaattgaattatctgctgtttactttgttctatttataccttctatttctttgcttttttgctcagaaagtaatctttcgtcgtcatgtaagtacgatagttatcttcttttatctaaaaatattctttacaaatgtaaattagtttttgattccatgaaagtgaattgattgctttcattaaccggttttgatcttaattttaacgactctattaattataccgtaagccgttaggtaatcttttgttgaaaaaaaaagcgtcaatacttctcaactcgagagaccagcactccatcttcactaatcataaattcacaattcctaatctctgttgttcgtgtagtagcagcaagaagcaatttccgatataattgtaaatgatgttttagagaatattaagtatggttgtcgaagtgacaactgcgtacgtcgaaggacgtggatactcaatagtcactggaaacggtgaagtgtattatctttcttttattttttctggatccccgttacatggccctaggagcctatttataaccctattactagttcccctattggggtttaggtttaacaggggaatttacatggttgcccttatgaaagggacatttacatgggtatatagtgtaattaaggtatatgggcccctaatgggccgactggcgaacgctggcccagtggcctccgggcttgatcggctgagatggcctcttgggcctccttgaagttggacttgctacggcaaagtcatccgccttcgccatacactcttcgccatatagtcttcgcccaacatgccttcaaccttgtgggataccggtgcgattcttcacccttcgccatctttgcttcatagtcttcgccatgggggcttcacctcaacagactcgacgtcttgggcttgaacccacccctggttgcatggtttcggcaggtccggtcgaagggtctcatgacataccgccaacaagcccctcacgggcaagagtgagataggagcttcggctgagaccgtgcaaaccatgtggtatggtatggggcgccccctttggaccgacgctcctgccgaaacctattctggagtcctgcagagaaagtgtgcattatgtgtacgtgtacttttatggttagtaacgttttctaggtttcgcgtcttgcgaacggcgaaaccgtttttaattttctctaggccaaaatgaacagtgatgggctttccctcttacgattgggtggggagacgaaccgtcgcctggg

SEQ ID NO: 22276 - DNA, 1501 bp, Oryza sativa
caataccctcaaggaggcgaaggctgagaataagcggctccaagctgaattggagaaggggagcgaggcgaaggctgagatagagcgcctcaaggctgagctcaaaaaggagcaagcacattctaccgctctaaccgattactacaatctcatcgagccgaagatttaggctcttcgcctagaggtcagcaaagcggaggcgaacaccgaacccaaaggaggcggcggtgaagcttggtgatgatggaagtgttgggatacgcgtaggctacgatagcataaatcaaaattttctatcgcgtaaaccaggaaccatgcaagtattagatcatagatcgttaccactcgacgcgctgcacagcggaagaagacgctgagaagtcgaaggaactctcgcgaagtagcgcgcgtcgatgtagaggaagtagtcgatcgcaccggctcgaccttctcctcctcgtgctttctcctcgccgtattcccacgccgatcagcaccgcaaaccagcggcgtctctaccggtatccacacgtacagggacggaacgccacgcgcagatgtgcttgcacccgcgcgtggctagggttttgctcggggagggaagtgatggctagggtttctcacgtattgcaatacctccgccggtcacacccctcacgaatatataggatccatcactcgggcctccaaggcccataggactcctattcggatccctatccgaattaagcttatattggatccctatcaaatccccttattccggcccattaagcatgcgaccctgtatgttcatatatactcggctgtaatctgaaaactccttttcggtccacgcgtcaacagcggcccctagcagaacgtattgacccaccgggcatacataaagatcatatcggttgaacctctagtgtatacttgtataaacccctttgcctcacgatatcgattaagctcaaggctagatatgtggcatcctctaatagctaatcattcactcgaacctgttgatagattatataacttgtgattgacccctcaatcacctttggcatggctatgcacttccataatctacaacatcgaggggcctagagatatctctccataggaggggcaaatcccatcttgattatacatatcccactacatatttcatagcatacccgaaaactacttttatagctacccatttacggagtagcatttagcagttcttaagtaagctactacacatgttgagaaccatgataatctcaggtctaaggattcaacaccaacactaaatgagatcactgatgacacaacacatatggctcttgcagtgtctcatgttgggtctatccaataacatgttcaccaacatgtgtccacattattaatttggtatctctataccatgatccatgagacatgatcatcaattaaaacatgtgctgatcatataaacatatttgttccacatatgatatttgattagggatcctttagaaatagtaac

SEQ ID NO: 22277 - DNA, 1501 bp, Oryza sativa
tgctacaagttgggtgtgtgagtcatgctagccacatgagatgcgcatgtaataaaccaattccagcgcctccataggtgttcgagagtcgaggtacgactacagcaataacgcagcggtcctcgtactacgacttcaaatgatcgagagacacctactcactggtcctcaaccagtcaattgtagcgatctctcgtacatttaattctagtggttgagttacgactactacctggttctgaccagaggtgtagtgattctcccattacctctacttcaacaaagttgatatcaggtgcacaatatcgccaagtgttttacccagagatcccttaccacaaaagacacctagcgttgaaacctatcctaatgtccctttacgccgtcttgacaaagcctctgaggaacctaaggaaacttcggctggggacgcccagagcggataaggctttgtcggatcctttagagacgaaagaccatgtaagatctggtcgtgtaagagttctcgccgtgcgtattaaccaagccgtgtaatcgaaaatggattttccaacttcacggctgggggctaggatcagtgcttgttcaaccgaggcaggtgaaaggtccaagagccttatcctccaagaacaattcgccgacaataaggctaggggctagggagagtgtataactcaacaaactgactgatcgaagtcggtaaaagagtagacgctcatatacaaaacattggtctgtaagtttaatgcattttcggttttccatacatattataacatgttaccctttgagcgttcgctcgggggctatttctatctaatattcttttctgagtattgattttaggaaaattctattcgacattatcgaaggctccatgtctctatggttctacaccaagatcgactaaggcgagtacgacaaaattcgacaaggcttcgtcgctgattctacgccttctcgatcactcgagaacagttggtggatctcgacaaggaatacggaatgaagaaatggtgtacccaccgagataaaatttcttgacttcaatccaaattctcgattacagcaagacgggagacttagtcgtatgctttgaactttcttggttgacgtcagagattgactcagacacaccctttaggtgcccgcacgaggctgataaaggaagtctaacgttatctctgaattcaccaagaacggtcacatgagctcgataacaattactctaaggtctgcgcgcggttgagaatatgaatttgttcatttgcatcgaagtctggggctactgtcagggttatggataccacatacctaatagtagttgactaaatctcggcaggacccaccatataccatgtcctatacggaaagaacctgtggatatgggaagagttccggataaggaaagacaactagagttctacatggaaacgacaaggactactcggattgtatccatatttgttcccctagttctacttgcacaaggggataccta

SEQ ID NO: 22278 - DNA, 1501 bp, Oryza sativa
ggtcttttgggcacgccttgttaagttctgtgaaattgacacacatgcgccctttgccgtttgatttccgcaccagtatcgaattcgccaaccactcggggtgatcgatctcctggatcaccccagatttgagcagcttttgcacttcggctttcgctgcttcttggcgattagcagacatcttgcgcagcttctatttccttggcttggcattcggcctgaccgccagatgatgcatgatgagatatggcgaaacacctaccacctcgtcggggccccaggcgcagatatcaatgtttttcttgagcacctccaggatgttctcaacttctctttcgcccatgtcgcccccagcgatacaagtcttgtgggattggcatcatcgacctgcaccttgatcaccctgccatgaggggcgcgcttcggcgtgtgcttcgcccggtcatgcggttcggcctcatcattgtggactgctctgttgattacggccaaatcgccctttgatgtagccgaaggttgaagcccattgaccacgatcactcttgcagggccaggcatcttgagcttgagataattgtggcgggagatggcttcgaacttgttcaaggttgcgcgactgaagatggcattatagttgtatgggatgtcgacaacgtcaaacagtatttgctctttgcgcctcttttcacttgtgccgaaggctaccaccaattgtacttggcctaggacttgaactgcttctccgtcaaaaccgcgaagcgaggccggtgcttgggtgagggctagggttggcatccccatcctggcatatgcttcggcgaagatgacgtcggtcgaacttcctccgtcgactatgattcgccggacttcgaagccaactacctcggccgagatcaccagggggtcttgatgcgggaacagcactccttcggcatattttggcccgaaggaaatctactgattcaagtatcacggggcctcttcgcttgccgaagtgatgttgtgcgccattcgcagctgcatcttcttttgctgttttgacagttgattcggcgggtcaacctttgtaatcacttggattactctgcgctgcacatcttggcgctgttcggccgggggtgcttgctcttgaacagcttcgtgaggtgcttcaacagctactccttgttgcggttttggatcttgcgcgttgccatgctgtcgaatgtttcggcattgatcggtggtgtgcgaacagcgtccatggaaggcgcagtaaaggtcttttctgaccttcttgcgaacgggctgttgatggctacttgcttgctgggcgtcgaactccttgcggagggcttgaacttcttcaacaaccatcacggccttgcgtggatggtcggttctgaatttcctccaagtcatgggagcttgacctggccttggcggttgtcacaccccaaagttctcctcccaagcctaaaatttaatttataaatgaccctaagaaaatgcaggtgcaaat

SEQ ID NO: 22279 - DNA, 1501 bp, Oryza sativa
gctttcaccaactttcactggccatctctctcactcaagagtcacggtcggcacatgctagaggccgagatcctggctaggagtctgtttcaggagttttttccaaacagtttaattaacttttcattcagattttgagaagctataattatagaattcagaaaattaattagaaaatataattaagttgagaaacttagtttctcagaagctgactaccaaccggctgtttcttaaaactttaaactacccaaacataccgtacgaccgaccaaggtttgaaatttcagtaatttcgaccccatcggcaaacacaaatctccccaaaagttccatttttttatcaaatatttctaaatctgttcaaattcagtcaaaatacgttacaaattcaaatcacttcggtctgaaaaatccagaaatcacgacatttccaaatttcggtaaccaccgaaatttcggtggggaccaaaattgaaaccttgagagtgacccggcctgacttgcgcacggggtaacatcgtcggatcgaacgacacgccaccacacaggatggataagctagcgtgcggcggcctcaaatatcatccgcgtcaacgtcgtcctcttcctcttcctcttcctctcggtgcctcaaatttcttccgcgactctcattagtcctcggatgccggccggtgtcgatcgatcggcaagctatagatagacagatgtggcacggtcgatcgacaagcaagcgggcgtcgctgtcgggctcgtgtcttttgtcacctggtaatattgtaccgatcgacgatcgagcttgctgccgaagtcgatgggcatttgaggggacgctctcttgtctccttgctctctctctctctcattccatgtacagggtaaacgatgaattggatggacactaatagttgccttatcgtacagcttccactgatgcagcttgatcctctgacctttctcctcacttaattaatgggtctgtctcctaaaataagtaataacaatttgtagagttaggtacagacattaaggaaatagttggaattaaatataggagaatatcgtgattttctattaaagaagacacggcaaaggaggtccccgttgttattgcatgctttatttaatatataaagaaaaatgtaattacaatagaaatattaaaaaacactgatccaatacatggctacatctttatctctctctctctctctgctagcttgaaaaggagtagaagatctccttttaagagacacctccaagacgacatggaaactggcttgctttcaaaaataaaaccatttctcactttccaaacttttcaagtcaccattaaaattttctcgataaagcatctttctcggtagcgaagatagacaccaaacattatattctccaaattgtctgatgttttccagaaaatcctaacaacggcccagcaaatcttgaaaaggggcactcaaaatttagatgcaacatggtctccacaattccatgt

SEQ ID NO: 22280 - DNA, 1501 bp, Oryza sativa
attttacgattagaaaaatatctgaattacccactgaactatcacgacattatgaattgtcctctaaatcccaaaatcagacttttaaaccccgaactatttataccagacaaaataacccccgcgaatcaatccgatgcagttttgtcctacattacgtacgtacgcgtggcaatccagttagcatttttctttttaaaaataagtggggtggagcagttagactctcacctctctctttactctcttccccgaccattaacgacattgacgacggcgccgtcgtcgccactccctcttcctttcttcctcgctatcgaccacggtaggtgacggcattagcaggggagaggtgcttgcctgtttccgccgtgtcggtgatatgggcccgggggtacctatgctgaggggaagggatcctttcccgtcagccacgtggccgcgtggcccaggccccacatcggggggttggacgcacggacggtgaatagcccaggagcgtccgcgctcccccagggggctcggggtatctcgccatatccctcggccccgaggggctgccttacctcgaggccctcgctcggcgccacgtggtgaccgcgagggggatcgagcaggcgggaacgcggggactgccaggcgcatttatgggcagcgccccaaccgcccaccggaagacgtgcgtcaagcagccttgaccggtctgcgaccggcgtgcgatcggtgacagacggatgtgacaggcggcagcgcacccacgccctaccctgtatcaggcgacgtgggggcaggtataccccgtcccatcgacagcaggggatcgacgtgcaggtcggtgcaccccacgcgcgtgaacccacgaagtctccaaaaatgtatgagggaatgataggggatgtcccccgtgtcaggcgaaggacttcgctagggaccacctgaggacgagcgcacacttcacttccggccaaaggattgggaagctgttcaacccagaccgatgtgggcccctctccaaggtagggaccgtagcggcggtgtatgtggtatctccttgaactataaatggaggaccttgcccagcgagcaaaggacgactcttaagaactctagctctaggaagagactagaaaaaccctagttgttttccctgagatttggattccttgtaacttctcgaagatcaacccatatataggagtagggtattacgcttcatagcaacccaaacctggataatctctcgtccccgtctggattaccatccactttgcgagcttagccccgagcgaatccgattcgctaagtagagatagcgctcctgatcatcacgcctaatcctctggccgaactcacaaagggggggtctcacgtcctcccgctagagatggtcactcctcgacagctggcgcgcaaggtaggggaaatcccgcgcgtttgtgaaggagccgtttttcttccgccccaagtttccttccatcctcaacgaccatggtcgaggtag

SEQ ID NO: 22281 - DNA, 1136 bp, Oryza sativa
cctgcagcccattcgagaaatacacgtaatcaaacgatttgtttaacctgacgattttctccttgacccatgaggacatgagtcacgtcgcaccattaagctccaaaaaatatgagacaaaattgctgacaggatcacaggattgggttcagtctcgatttgccgatcgaacccttggaagctgtgggctaatcacaggtgcatgtggcacacagtaaattgcactaaaacagagggctaacttgtcacgtatcgcaacttgcaacgtacagtacccttttgtcggaaaaagttaacctaaatttagatgcgatgtaaactaatacaataatctaaatatatatttttttaaattcattgtactctactgtgtcataacaaattctagtttatttgtttttcctttttgcgcaggaagtaagttctcagagcaagtttaacagatgaactcactatcacttatcagtctatcttagaggggcgaatgcctttttctcgtgaaagggagatgcctaatcgtatcggttactgtgtgatagtctgacaaccatatggcgtcccatgagaacaaggataaatcagctataaacttatcttaaaaaagagaaaaaatgcgttagctctcgtatagtaagagttaactctatacgtgttttaagataaacacattgaatgtataagtaagagaaatagtgaagagaagaaaatttaaaggtaacttaatctattatatatatatatatagtaaatttgtttggtgctccatggtgcccgggcaccattgttgaaattgagtatatacctaattcaaatgcaattaaaactttttcaattacttaggtattaacattaactactttactaacaagtttaaagcaagtttgaactgaatttgaacttgtttttgttagatgttgattctaggtatatagcatccatacatataattagttaggtatgtaatcatggattgtgaaataaagttaaatttgagttgttttgttgataagtataggtatgaatcaaattattataactaggtatatactcacaatttgaaaattttgaaaaatttgagtgattttgtgcattagataccatggtgcccgggcaccatggtgccccatatgagtgtc

SEQ ID NO: 22282 - DNA, 1501 bp, Oryza sativa
gactgctctaatgacgtgtatagacgaaatctccgaaagcaaatgtatcatgacagttataaatatgagagttttcttgcaaaatcatgtaaagttataaatcctgcgaaattttcctcaactattaacaactgccatacgttgcaacaaacttatcatcttcgtttcaaaataaacttacagtacttaataaaaatgtgacacaatctagtacaacgaatctgagcatctctatccccatacaatgttagctataactacaagaggaggaccaagacaacggagagagatcccatatcaaaacttcaactcaatatccagttgaattagccagagaaaagctttcccaaatcttgtaactttgcaaataagagatccaaagatgaacacgacaggagtagaatgttacatttccgagcgatcgatctaaacctatatgaaccacatgtttcattatttttcttccaaccacggactcacatctgtacacatgctccctggctgaatccagaaaggggttggacatttctatgctattggaagtttggaactcaggctccggttgctcgatctcatcgtcgtgggcaatcaacgatgtttctctgtcagacatatagaagagaaagctctcatttttgcatgcacatttctcaagcgaccagacatcatgtttttttaaaaaatataaaaaatattttaaaatacatcaatttatattaaaatttaaaatagtaaaatacttcactaatcgtatgttacactgtaaacttagccaggtatcgtaagcgcgtggtaattggagttgagacctgagacgtggcatctggcacgcgaatgagtcacgtaaattggccttgtttagttggggaaaatttttaggtttggttatcacatcggatatacagacacacatttgaagtattaaatgttgtctaataacaaaacaaattacagattccgctagaaaaccgcgagatgaatttattaagcctaattattccatcattagcaaatgtttactgtagcatcacattgtcaaatcatgacgcaattagacttaaaagattcgtcttgcaatttacacgtaatttgtatattttttcctacatttaatcctctatgcatttgttcaaacgctcgatgttacagcgtgaatttttttattttggaaacttaaacagggccatacgagaaggaaaaaaaaaatccgcgacccatcggagcaaaaaccacaccggcaccggcaccgcgcgaacggccgcggctcgcgccacgccgacgctctcccgccacaaccgcgggattccccccccccccccccccaccgaacttacctaagcgtcgcctctcgtcttttttcccgtgcaacgttgcaagtgaaatcatcaatcgtgcgtgcgctgcgcccgaccatggagctcgcggtcagagcagccgccgcggcctcctgctcctccggcgcctcgctccagctcccgcgggcccgagccccgctccgcct

SEQ ID NO: 22283 - DNA, 1501 bp, Oryza sativa
aagtgaacagaccctatgataaaaaaaaattagtgagggttttatgggagctctcatggttttattgccagtaggagtctcgagcccccaccgtcccacgctagatccgctcttgactgattgaaatttgcaaatctaccatcgatgtggtgactttatttaccaagttgaaatcctaccgaaatatggctgtgtgtattcttggttgatgcatagaccgaaagttatacttccatttgtaataataataataataataatgataataataataataataataataataataataataataataataataataataatgaaaaccgttgtttgggttctcagtccatttgactgtggatgtatgcatgatcaattacattctaccattaaaatatgcaaacctgaacgcttcaagtaatttcttgatgctccatctaccatccactagcaatccctccatttctgccattccattcactaaccaaagtttaggggactccagagttcagagttccttcaaacttcgcgacaaagtttagcggacttatgtcttttttttacgcgttaagatacaaattttatcttgattttttatcactctttttaaactgataaaacaatatatttcatacaaaaactttctatataaatttttttttaaaatatcagataaatctatttttaggttttaaataaaaagctcaattaatcatgagctaatgcatttatcgttttgtatgctcgtacttaatgttcattcatcgcaagttcgaacggaacgtttagacagatctaagatctgtggttagcagctcaaccgaactacatgatcccctgcatgtatcagctagctatttgggctccgcaaattacacacaaggcgatagaaactaccacattaattagaaggaagtataattatgaattgcatatgtagattgatttgttgtatgtattagatagtttttcgaaacattacaaccgtatgaaaaatataagtgcactcgaaaagagtcccaaaccattagaaccgtatggaaaagagacgataataaaactatatataaacaaatgataaggatgaatagcaaatagaactatatattcaaatacataatggggcctacacatgtaagttgcacagccaattgaactggttccaaaaataattaattgtttgggttcaaactcttattatatgaacagtagtgcccaaagatgttggggtgcttcactagggggaatatccaaatatgtagcgcaaactctatatacagtgcaaacctgaaaattaccgtacaatagaaaaaatggatgtttgggatttatccatatacatcaccatgagtaaaacttttactcatggttaaaatttggagtgaaaattttactccgtgtgatgtagacaaatcttagacgtctatttttggatcctatgctagtttttaggtttgcactatatattttccccttcaataactcgtagatagcagctacgtgc

SEQ ID NO: 22284 - DNA, 1216 bp, Oryza sativa
cggcagtggcattctctttttttttaatttgtgatgattcactgagatgtatttgactgagaagttacaaatttgtgattcattgtttggatctgtgatgtatttgagtaatttcttaggatattgtgatgtatttatttgtgtgtataagtaactttgatttgtgatgtagatttgagatgttacttcgatttgtggattgggggtttgatttggaatatgtatcccacgtgatttgggagaaaataaaaaagaaaaaaaaagaaaaaggggatcatctcactgccgtaaccctctctttagtcccggttggtgttactaacagggactaaagatctatttttagtcccgggtatttgaactgggactaaagatagcgatctttagtcccggattggtagtcccagtttgaaaaccgggactacatggggttgcgaaccgtgactaaaaagcatttctccaccagtgcttcctcctactctgaaaattcaaatatatattctcgactattctagaaacaaaagttaataagaggctgtgcctctgtggtggtactatgctgctgtgaaacatgtggaaattagtcaaacaatagtcttattatgtgtgacttctagtattcttatgcgtttggattagggcataaactgcagaggagccacagtgaagttgcattaggcccatctctacaccattagatgaaactccgtgaaagtccaatggtccagatcaggttctacagtaaaatacgctacagtacaccatctgacctgtcatactgagggttactgtttctacggtaattaggtggtaccccgcgctttgctgcggattcatagatgagtatatgttaaatattgtcgaaatgatgaaagttgaaatgttgagaaaatagtgcgaggaagatgatttgacacatacttgttgatctctatgatataatattatatatgacgtgtcatgtttgcatgggaattaaaataagctggaatagtaattgctagtgagtgaagatgtgtcatgcgtgcatggaattttaaatgggctagaatagtactagtgggtgatgatgtggcatgcttgcatgttgagctttagcttctaataattgttagtgggtaccaattatatagaaagtatagatctactgcagactagtatggctaaagactcaagacactgttgtaatagtgtctttctgctgttacaacaaaga

SEQ ID NO: 22285 - DNA, 1501 bp, Oryza sativa
ttgtcgaaatgatgaaagttgaaatgttgagaaaatagtgcgaggaagatgatttgacacatacttgttgatctctatgatataatattatatatgacgtgtcatgtttgcatgggaattaaaataagctggaatagtaattgctagtgagtgaagatgtgtcatgcgtgcatggaattttaaatgggctagaatagtactagtgggtgatgatgtggcatgcttgcatgttgagctttagcttctaataattgttagtgggtaccaattatatagaaagtatagatctactgcagactagtatggctaaagactcaagacactgttgtaatagtgtctttctgctgttacaacaaagactagggctgtcaacgagcgagctcggctcctaagcacaagctcgagtcaagcctattgcaccttcgagcttttaggcaagctcggctcgagctcgttcgagctcgagctaagctaccgagctcagtaataagtagtgtaagatatattttagtgataatccattgataagtataattattttctaattaattaataaaagagtaaaaaatgattaaaataaatatattgtgctaacacatgctaatttattgtgtaaatagatactaattaatatatatatatatatatatatatatatatatatatatatatatatatatatatatatatatatatatccattagtttattaaatcaataaggtaaacaaacaatataaactatacgctatgtataagctcggtaaactcagtagaagctcaagctcggctcgataaagctcgcaagtttttgctcaagctcgggtttggctcgtttggagctcgaatcgagcctagaattagccaagctcgagctacttgcaagcttcgaccttttttgacagccctaacagagactattattatacaagttctccctcgtaatttactccattcaaattcatattactaacatatgtctaatttatactctctctccgtcctaaaatataagcatttgtaggatagtattaagtcaaacatttttaacttttaataattaataaaaaagattaatcatgtaaaatcgatgttactagatttatcattaaacgaattatcataatatgtaactctttttatttaaaacatcttatttttatagatattatatattgatcaaaatagtatctctaagactatatcgaagtctaaaatacttatattttagtacagaggagtttcgtatattttcagacggagagtaccagatgcgttcaggaagtcttgacattgcattgcatgtcgatagcatcgcatgtcgatagcagcttataaataggcaaccacggacaagacgagcttgcagctatctactgtagcaaccactgtaacgtgcaacacttcagttcagcagcaaagcaaataaaaacaacacaaagcttctctgttctttctctcctcacgatcgaacaccatggcggcggagctcgttcacctcc

SEQ ID NO: 22286 - DNA, 1501 bp, Oryza sativa
atatgtgggctataaacagggaccctaaatattggagccaagcagaagagtttattccagagagatttgagaatgctggtattaatttcaaaggaacaaactttgagtatatgccatttggagcagggcgacgcatgtgtcctgggatggcgtttggtctagcaacgttagagctcgcacttgcgagtctcttgtaccattttgactggaagctacccgacggggtagagattgacatgaaggagcaaagtggggtcacaacacggcgagtacacgaccttatgcttgttcctatcatccgagtgccattaccagtgtagacgcacgtagctgctatctacgagttattgaaggggaaaatatatagtgcaaacctaaaaactagcataggatccaaaaatagacgtctaagatttgtctacatcacacggagtaaaattttcactccaaattttaaccatgagtaaaagttttactcatggtgatgtatatggataaatcccaaacatccattttttctattgtacggtaattttcaggtttgcactgtatatagagtttgcgctacatatttggatattccccctagtgaagcaccccaacatctttgggcactactgttcatataataagagtttgaacccaaacaattaattatttttggaaccagttcaattggctgtgcaacttacatgtgtaggccccattatgtatttgaatatatagttctatttgctattcatccttatcatttgtttatatatagttttattatcgtctcttttccatacggttctaatggtttgggactcttttcgagtgcacttatatttttcatacggttgtaatgtttcgaaaaactatctaatacatacaacaaatcaatctacatatgcaattcataattatacttccttctaattaatgtggtagtttctatcgccttgtgtgtaatttgcggagcccaaatagctagctgatacatgcaggggatcatgtagttcggttgagctgctaaccacagatcttagatctgtctaaacgttccgttcgaacttgcgatgaatgaacattaagtacgagcatacaaaacgataaatgcattagctcatgattaattgagctttttatttaaaacctaaaaatagatttatctgatattttaaaaaaaaatttatatagaaagtttttgtatgaaatatattgttttatcagtttaaaaagagtgataaaaaatcaagataaaatttgtatcttaacgcgtaaaaaaaagacataagtccgctaaactttgtcgcgaagtttgaaggaactctgaactctggagtcccctaaactttggttagtgaatggaatggcagaaatggagggattgctagtggatggtagatggagcatcaagaaattacttgaagcgttcaggtttgcatattttaatggtagaatgtaattgatcatgcatacatccacagtcaaatggactgagaacccaaacaacggt

SEQ ID NO: 22287 - DNA, 186 bp, Oryza sativa
tgtccccgccgccatcgcgctttgagattcgtgcgactgacgttggaggcccgtacgtggcgcggatcgaggggaatcgcccccccccccggtccctggctggactccacctctccgcgacgcgctcctctcctggcgaattttttgtttatttatatttgggagtaattggctgcgctcagctcc

SEQ ID NO: 22288 - DNA, 1501 bp, Oryza sativa
gtaacggagcctgaaaaaaagagtatgatggattgaaaatacaagtatttatatgttagatgggatcatggaacaccatttgtacttacaaagctcggtaaaaactacttacatcaacagagtatgcacttccaagaaagaaactgataaacaaagcacataacaaaggagctgatttggatctgattccaatggcaatgctctagcaaaaggaaacaaaatgtgaggaaggtgtattgacataaaacctgttttattcaaactagaataattgattctttattcctggcgttgaacctaatataccatgatcaaggacgtgagtactaacactgctccagttgccactgaaaattctcctgacgccaacggaaggctgggcttattgacctccaaaaagaagtatgatttaatcacaatgatactacatatcacatgatagaagaaaatgttttcaaacagcaagtaaaaaatcaccttatcaatctggatgtcatatagttgattcaggcctacaacatagatattcatacataaagaagaggataaagcctgcacataaggaaaaataaatggctgttgtatatctatagaccattaagaagataactttaagcatctgttgagcacagggttcatcaggaatttaatttaaaacatctcttgagcacagcattcattacaaaatttatgtatgatacctcaagaaatccccataatgctttcatagtaaaatcatctaggctcctcattggcaggagagaaactgaagtgattcctattatctgacaaacaatccaagaacaataagcagtagctagacaacatgcatccgaaactgccatacaaaattgaatgaaactcacagtgccaaaaattgtgtggggtcggcaaaaccgataaaaagctcccagtttctggggaacttctttgcaaatttcttcaaactcagtggcgatggattcgtgctgatcaccagcaatggcatagcatctcacttggaggactggagaatgttgtcttttttgcctccttatgcttcttgtgagactggtagcatttaaaattgcacttagttttacttgtgaagttgtcatagtgggctatcgaaaatattaaccccagatttacgagagtgcttgcctttgacactggtgtagagcagaattttccaccgacaatttacctgtaatgtgtaattgaggacaagtgtttagtacattagtcactttggacaaaattatattttaacaacttatgtttcatgggggaaagtgcacactaacatctctaaattattcatccattttatcaacaaggtattttatttctcctaaaagaagaggaaaaaaaatacagttactgaaaaggacacaactatgaatttgttaattaggataaacttcatttcagaaatatgcaccttcgaattcttctaaaacttagtggctgaaaaattgaggacatattaatcagtaatgccctatatttgcaaattttg

SEQ ID NO: 22289 - DNA, 1501 bp, Oryza sativa
ttgagcggcttcttctccagttctcgatttttagctttttgatactttctactactagtagtactaagtactatagcttggtgatgtaccccactgtgcatgccgtgttgtcgtgacagtgctagtgtgtggtgtccagcactgcagagcggtctcgacgcgactctcgcgtatgtacgtggagggtattctccccgcacagctaactccggatagttgccggtcgaagcgactgttattatggttcaggacttgccgtttgccctgaaattaggcgtgtggagctgtattttttttaaaaaaaaattgatcatgtttgtacagtattagagtatcttcagcgataatttctattttaaaactcctataatttaaatagggctgctctcatttcttcggtccaaacaatgtcctcaacttgtgcacactactggctgcaggcggcggcggccgtggactcgtttgagatgtataatttctttttttgagaatttatgattcagtgtatggattcaatctgagatatatttgatttgtgctatatttttaggatttatgatgtgaatatatgatttgagatgttatgctttgatttgaggatttggggtttgattgggatatgcatcccatccgatttgggagaaaattgaaggaaaaatcatctagcaaaaaacaatgaaaaaagaaaagaaaaggtggcaaccgagattgccgttgttttcctctttagtcccggttggagttaccaaccggatctttagtcccggttatttcacccgggactaaagataccaaccgggacaacagtaggttcccaaccggtgacaaagatgggttcccaacagtggcagtagtctccatttattagcccctatttattttctcatttatttcaatatacactctatatttatgattagtttagcccacaacaattcaaaaataaatatttctaattcatataattcaacagtatttaaattcacaatttaaattcaaattcaaaatttaatgtttaatgtagtgcataatcaagattatactatttaacagatcaaagcattcaccaagattctggactaaacatgaagtccgatcgaaaactaaacaaaaagaatacaaccgtatcactgaaccgcggtgaactgcttataccgagagcctgttcagcatagctccagctctagctccacctaaaataggagcggagctaggtgtagctctcacaaaataaactaaagaaatggaattgggtttagatagctccacaactccacttcagataaaatttaggagttggagctctatcgaacatgccctaaaacaccacaactaaaattaaaccgtagtgatcctactgtcctacactcctactggtagaagacacattaaacagcagagtgagaattactaacacatagaggctccaaatgccaaattttttaaccgtggaaatggcatatcctaaataacaaataacttatagaatccaacgtattcc

SEQ ID NO: 22290 - DNA, 1501 bp, Oryza sativa
tctcgtaaaaaatcaactagtattagatacgacctagtactacaaatttggatttatttatgtccgtactagaatgtatcacattcagtcctatattcgcttttttttggacggagagagtacatttgaatagctggactgggatatcctggtattgatgaagttaccatgaatgttttgttatcctctaccactgaaagaataattaatagttaatacgagcacaatctgattagacatattccaacctaaaaatctaatcagtttaactatgcttacttcgctggtatgcattttatgtagtactcctaagagattttatggtaaaactaagacggtttcaaaataaattcgcgtgcacggtgtacgtgatttctccaaaatttatttcggcgctgtaaggactttgcaacggtgttattttgagaaaataaataaatattggaattgcacttattcatataaaaattataaactatcgtaccctctgcagtgactttgaacgtgaaggtggtttctatagtaaaatctctcacatcagcgaaggacgcatcattttctcaataaataatacagagaatgaactgtatagtacgacgatgatgattcccaattaagcgctgaaatttccagttaaccaaccgattgatgattcatggttgctgggcgttagggcactacggtatcatcagacttattttatttccttctcaaacttaatagtggcgtccacatctcacaaacacagctcttcagtatatagatcagagatgtgcctgaacacctgcacaaattaacccaagctccaacagcttgtgttttcttctttgaaaaataacagcttatgatttcaagattattaaacatgtgtaaacactggggcaagatatgttgatatatgatctgttgagccacagttgataagactgaaaagaagataaacaaagcaactaaaattatgaatataacccttatacatgtacagtattatttatgccataaaagttgaggctaggaaatataccatgataataaaattcaaaatcaactgtaaaattaaattcaaaatttaatatttggatgtgactaataaaccaacaatcagatgatgaaaacaatagctctaagttttttttcgatgtgactaataaaccaacaaacaatttttcgggacaaaacctaaggctgaaaaatatggtaagacgagaaaactcaaaatcagctttaaaaccaaaatcacaatttaaattttagatgtggctaacaagtactaatagacaataatactatctccgtttttaatagatgacgctgttgactttttatcacatgtttgaccattcgtcttattcaaaaaatttacgtaattataatttattttgttatgagttgttttattacttatagtactttaaatgtgatttatatcttatacatttgcataaaatttttgaataaaatgaatggtcaaatatgtgagaaaaagtcaacggcattatct

SEQ ID NO: 22291 - DNA, 1501 bp, Oryza sativa
acatcatattagccatatatttgccgtttaccggtacaccacataaataatatataagtataaataaaagcactcatgtcaaagtttacaaaatttcacataataatccattcctaaatttgtaataacagtggctaacctgatatttgcaattttattttattttggggggccaaaacaaacaagcctctaagcaagatgacaaatttatcgataaaaaaactagtttaggagagttctcaattttagattacgaaattttaaatgaaggtgtgaaccatgagcttgtttggtaggaatccaattactaaatataactctaagaagagtctatagtgtagttgttgagcagctcgaaccatcgctccacacttctagtttgttttctcatatcactgcagcctgctctgttttcttttgaggtggagttcagaaaccatttcaggtgtgtttaccattgctccaactgctaaatttaactttaggagttagatctacagttgtggagcagactaaacctaactccatctctctagttcattttatgagagcactctagtaagctccactccctttttaggtggatctaaaattgtttggatctatttgacagaactccaacgattaaatttaactatacgagttaggtctactaaagctctaaaagagattgatcatgggagtttcatttttactcccagtcctttgtttagtagtagaggtggaaataatggggagtatggataagaattaaattttaagtgatgatgcacgactcatatttatcttgtcatacttagaaagtataattatctcccaattaactaccctacacagttattgaaaaggtgggagttcacccttaaactctcctttccaatcccttctaaaactcccacattatccaagcaaataatagacatatcaccaacagattacctataatatttctccaaaaaattgtttataggtttcctaaactgaaaatagtaagtgaaaaaactcctccctccaacagatagctttaaattcaatccccaaagcttaaaagtgggccattctgttaaactaccaacagtaaattccgttttttttttcctttcacgcgtagaaagatcgctatctcccacgcgcggcaacgggaggagagaggtgggagtgcgagattgtgagcgagtttcgcgcccgcatataaacggagcgagtaatcgggagaagggaacaccaaaactcaggtaggaaagtaggggatctgttatagctggtttttagactaaaattcttcaaaatcagttttgggattgagataggtatactgttggtgatcctcgaaaataattccataaccaaactggccgtaaatggacaggtgagagctgaaaccagcccaagattcttgggggcgatcgatgggtacaacgaccaaacggggattctggcccacccaaatgaggcccataacagtttctctcaattgcgacactgggcctaaacggcccaa

SEQ ID NO: 22292 - DNA, 1501 bp, Oryza sativa
gcatgggactgtgtttgagcaaatgcataagcaatgcaagaatctgataatactaccagcatggaagtggtgatgggttgtccatgcactccactgaaatatattgtggaaaaggaaacaataaaaatgtacaagttggaaacacattgagacaagcaaagttgcctaaaaggaagacttataagttgttatcaattttatctttacatgacgatgctaaatactctggccacagtaggtttagatagacgcattcatgattatgatggacttcttccctcaagggtacagtttttttcccccaaataaatagatcaaatttcacatgcaattcaacaagttatttgaaattgagttatattcaccatacaactctatgactatttataaatatacaattgttgtccatatgtatttgcagtaagctaggccattaaaatttcatcccaccaaaatagatggtgtacctttttttcttatatgacaaacacaataatttcaagacttcaaaagaggcgacgaagtggctcattttaggtctctctttatggtagtaaaaatatttttcttacccatgaatgcataattgtctgtcactgatcttaaatattaatgaagaatagattcaaatcattagtatgtaaaaaccaaccgaaagtatagaatacacggatcatgatgctatatctttcgatattcccgagaagagctattatctcacaacaatcttgttgacgtcagatatctttgacgctcatatcatggtttagtgcgtagaaacattgacttatagtcttggccgtatccgttgattctatctatacgatatgcattggatgcttatcttttcgagtacacacgtaaaccatatcttgtagatatgtttattacgccattactaagatattgcataacattaaatcgctattgaggcattgacgatagacaataacatcttgccagataaagatcactattactgtcttaccacataaagctctctgtttttttaccagaaacataaagctctctgttgtagcacatatctgttttaacccaaataccaaccgtaacacataccttcttctacaataacctataacccatacacacaaaattttcccaacttttaaacgaaaaaccaatcttctccagccatccaaaagcaaaaaatcaagctaagaaaacccccaaacaaccaaatagaaacctccaaattaacctaagaaaaaccgacgccgataagtgacaacccattttttttccaaaaataataaaataatataacaaagaaaacgagcaaccgaagcgagccaagggtttttgagtacaaacgcaccgtcccccagtctagtctactcctcccctccccttcccccttccctccctccctccactcctctccccccttcgcctccacctccgcaacaacaaatactactacgcaaaaaaattccctaacctcgcaagcagcagcagcgactccgccgaggaggaggag

SEQ ID NO: 22293 - DNA, 1501 bp, Oryza sativa
ttgatttgaggattttctttaacttgggtgctgcagataagaggggatcggaattcagggctcggtttggaacgaggaaactgtcctggggaggtatacagagattcgtgttttcgttctatatttagtatgttttttcaataaaaatcaacattccaggcatccgggttgggttgttcgtagatcaaatccagctagcctagatgcaccacaaatagaagaagatgggggataaagcataaaaccttaaaacatttgaactgcatgcgcatgataattgcaggatcaaacatgtattcaagtttttcactatgaagaaaaagattgtacatttgggttcctagttctccggaagagtttcaggatcttgcgatccttttaattgtatagggcggatctagcatgaaggcggtagagtctcgagcctccactacttacgtgaggaccatgggagcccctgcgaagcccccactaaaattattgggtttgttggaaccatgacaccctatatttgcaaaatttgagatatgccacccgtatctcaatgacatgtaagacccacatgagtcaatgacatgtgggtcagggtggcatatcacaaattttgtaaaatttgtgtggcatggttcaaattgtcccaaaatttgcaaatatagggcattactgattaatatgtcctcaatttttcagccactaagttttagaagaattcgaaggtgcatatttctgaaatgaagtttatcctaattaacaaattcatagttgtgtccttttcagtaactgtattttttttcctcttcttttaggagaaataaaataccttgttgataaaatggatgaataatttagagatgttagtgtgcactttcccccatgaaacataagttgttaaaatataattttgtccaaagtgactaatgtactaaacacttgtcctcaattacacattacaggtaaattgtcggtggaaaattctgctctacaccagtgtcaaaggcaagcactctcgtaaatctggggttaatattttcgatagcccactatgacaacttcacaagtaaaactaagtgcaattttaaatgctaccagtctcacaagaagcataaggaggcaaaaaagacaacattctccagtcctccaagtgagatgctatgccattgctggtgatcagcacgaatccatcgccactgagtttgaagaaatttgcaaagaagttccccagaaactgggagctttttatcggttttgccgaccccacacaatttttggcactgtgagtttcattcaattttgtatggcagtttcggatgcatgttgtctagctactgcttattgttcttggattgtttgtcagataataggaatcacttcagtttctctcctgccaatgaggagcctagatgattttactatgaaagcattatggggatttcttgaggtatcatacataaattttgtaatgaatgctgtgctcaagagatgttttaaattaaattcctga

SEQ ID NO: 22294 - DNA, 1501 bp, Oryza sativa
tttgtttcaaaatatgacaacttccccatctactcgttgacattcgcaactatatcttatttaatttctttacctacttattcattaaaaccaatcacaaccatacatcatttaatttcacctctccttttaactaatgtaaaaaagtatgtaaattttttgaagtgcttatatagttatattttaggatgggcggaatggtttatagctataaactccacaaaaaatacataggagtagcaacaaacacacacgtttaatcagccgaaatcccacatgaaaacagagcgtcttatcttatctgcatccaactgtactccagcatgatccacaacaccactcacctcatgattttcgttgtattcgttccagtcccaaaaccagcgagatggatgcacaagcaaccggtcactggttggtctctaccgtaccgaagtcgacaggaacagaagcagttattatatccaagagaaagagaaaaataaaatcttgacacgaacaaaaacccgactcgccgcacgtctccggaaaacgatttttttttcgaaacaaagaaaaaatggggaaacaaatccagtggcatttttcttttttttttttcgccgccaccggcagccgcttttatagcacacacccgtcaccacacggaaaccccagccaaggctactgccaccttaccttgcgtactacgcctcacttttaccaaactgacccctgcacctccactcaccgacagatgggacccactaaaggatagaaacgtcctttcctatccggcacagtgcgcgaaagggcggaaagggttcactgggccccactgcgtccaaggtttggcgtcccgccaccacccacgcacgcggggtacccggtcactgacgtatggggcccggctggtgggccccacgtgtaagtgggggtgggatgggagaggaaggaagggtctcgcggcgcgtcgtgtgccatgtacaggtggtggtgagtagtactagtggtgggaatggattattttattggccatatgtgggcttttattccgcgcgtttaaaaacccggacgccacgccgtgggctcggttcgcctccacgcccccctcatttcctcctcgctcctcccccaccattcccacatctctccctcgccttcctcctctctctctctccacatctccctctcgcttccacgcctcctccgctttggcggcttcttctctagggttcgtctcgactcgactcgtcgaagggaagctgctcccatgaccgcggccgacgctgaggcgtgcgcggtggccgcggcggcggacatcatctgctcgctccgcggggccgacctcgccgggtggacgccgccgtgggggacggctgccgcgaaggggaaggaggtggtggtggaggaggaggaggaggagctggcgtggccgacggtggcacgggggaagcggtcgcggtcgtcgcggcgccgctcgccgtcggggtcggggtcggcggcgaccaaggggaggtgg

SEQ ID NO: 22295 - DNA, 1501 bp, Oryza sativa
cactccctccctccctcccaactgctacaacaacaagtcctcgtcctcgtcctcgtcttcgtcttcctcctccacctcgcgcgctgcagcagcagcagcggtgcgcgtgatggcgttccactaccaggaccacgcgctggcgatggacgccgcggctgcggcggcggagacgggcggccaccaccaccctgggttcgtcggggcgggaggagttgtggggggaggaggaggaggagggtgggagcgggagaaggccgccatcgcggcgcacccgctgtacgagcggctgctggaggcgcacgtcgcgtgcctccgcgtcgccacccccgtcgaccagctgccccgcatcgacgcgcagattgcggcgcgccccccgccgctggccgccgccacggccgcagcggcggccgcggcggccggaggggcgccgtccggcggcgaggagctcgacctcttcatggtgagggctaaattattattagtagtagtagtagtagtagcgccaatcaaatccccccctctctttctccagggcgttttactcttatttttgccaagctatgaggtttgcgtggtgtgtctctgtatcgcttttgcgatcaaattctcctcgcgtgagagtttcttgtacgattggtatgtgaaatattattctggatgagcgatatcgaaaattggggctggaaagggaaatgaaattggctttttttttttgaaaccgaagccaggataagctggtgttatattaaggaggagagagtatttacaagaaattggctagtggaattaggagtgaaatttggaaggaaaaaaataattctcgaaaactcaagcttcatttcattaagaagcagcagaagtatgtacagtacaagtgtacaacagagcggtccacaaagaaggaaccctgtagaaaaaacatcaccaaaattttgacttttggaagggttggattgattttgtcggagtagcaatggttccgaccatcgtttttgaaatatagtcctttgaattgaatatgctaaaattcatcacttatttctcattccttggtgtttgtttgcatccctagttggctagttgttgaagaagctctaagttatacttccattatctagtccttgtttgatttagattattgagtgtattattgctgtggattatgtccttcgtcatagggatacattaaatatttcaataaataaacttaacaaataggttaaaacaagtggtctaagtaagtaatatactagaagaaagattttttgagaaaatacttcttttgaagcatggagcaaataatccgttttcagtaatccggtgaataagctaaagggaacatggtatcaattaatattgtttcttgcatacaatttctgttagctaagtttatgatcagttgcctcttttttaaaaagtcattttgtttatcaggtactcttctttgcttggaaatgacaatcttcctaaggcaattttttttacttaataaaaaaatgtt

SEQ ID NO: 22296 - DNA, 1501 bp, Oryza sativa
tgtttccttttccacaatatatttcagtggagtgcatggacaacccatcaccacttccatgctggtagtattatcagattcttgcattgcttatgcatttgctcaaacacagtcccatgcattcttacacacaaagccactacttactagtttggcaccactacacccaacatttaccaaggttgaaagttaaaaactctagaaaatcagagtggtgttgctaaaaacacaaagagagcaactatacatgattatacatatattattgttttttactggcatacaggtattattttactcagccatagtggtggctgcctgtctataacaaaaaccacagatctactccagtcacacaagaacaaaattgaagagcctcgacctgaccttaggtggcatacatttactggcaccccctcattaaaaggacaactgggcctacaggaatgcaccccagcagaatcttaaagtagttcagttcattaataggatgctttaggttgtaattggagcacctgatccctcctagtaccatgacagaagggggagtgctttgctttagcctttagcatcatcctcctgcagaagtagcatcctaggagagtatgccatcctcttttcatccatagaacacatgattctccaagctttccatagaagtggaactatttcttactaatatttatgcattttgcgactaaaatgaaaaaggaaaacgaacgcgaaatacttataagttcattataaaaatgatcgcgtcttcgctcttataggtatttcttttatgtgctaaaactaagtgtttttttatgtgaaaagaaggcagttccaagcattatggtggattaatcttgctggtcccgacagaagaaagatgaaacctaagaaactgtccaactaggacggcaaagcgagtgttaaacaaaatggaagaagatgggagaaggacgtcgccatgggtggcacagcgtggggcctccggagctcgtgtccccaatcaggggtgttggtgtccgccccaacatctccattgggcaagaggatactccactttatcaagtcctttgccagcttcctcacaggtggtgtaatcatcagcattgatcatctttaaccaccacctagtagccaatactcaaatacagtacctgctatctgtgtggagagatgggtgagtggtagtaggagaaatttgagcaagctgcagttagatgtaggacagagtacagtagctatctactatgtggacagatgaatgagagtagtaggataaatttgaggaataagcggttatctatagtatttgtcatgaatttcctttgattaacgtgtaacgcgcaaaaaaaatcagctgaaaatgacggaggtagtaaaattttagagttcagataaatctaactatggtgatgatttaatatgaaaattctattttgaatctccatgatttcaataaaattgtaccgtaggtttttcaaagaacctgaacaactgaccgggttgc

SEQ ID NO: 22297 - DNA, 1501 bp, Oryza sativa
actgctctaatgacgtgtatagacgaaatctccgaaagcaaatgtatcatgacagttataaatatgagagttttcttgcaaaatcatgtaaagttataaatcctgcgaaattttcctcaactattaacaactgccatacgttgcaacaaacttatcatcttcgtttcaaaataaacttacagtacttaataaaaatgtgacacaatctagtacaacgaatctgagcatctctatccccatacaatgttagctataactacaagaggaggaccaagacaacggagagagatcccatatcaaaacttcaactcaatatccagttgaattagccagagaaaagctttcccaaatcttgtaactttgcaaataagagatccaaagatgaacacgacaggagtagaatgttacatttccgagcgatcgatctaaacctatatgaaccacatgtttcattatttttcttccaaccacggactcacatctgtacacatgctccctggctgaatccagaaaggggttggacatttctatgctattggaagtttggaactcaggctccggttgctcgatctcatcgtcgtgggcaatcaacgatgtttctctgtcagacatatagaagagaaagctctcatttttgcatgcacatttctcaagcgaccagacatcatgtttttttaaaaaatataaaaaatattttaaaatacatcaatttatattaaaatttaaaatagtaaaatacttcactaatcgtatgttacactgtaaacttagccaggtatcgtaagcgcgtggtaattggagttgagacctgagacgtggcatctggcacgcgaatgagtcacgtaaattggccttgtttagttggggaaaatttttaggtttggttatcacatcggatatacagacacacatttgaagtattaaatgttgtctaataacaaaacaaattacagattccgctagaaaaccgcgagatgaatttattaagcctaattattccatcattagcaaatgtttactgtagcatcacattgtcaaatcatgacgcaattagacttaaaagattcgtcttgcaatttacacgtaatttgtatattttttcctacatttaatcctctatgcatttgttcaaacgctcgatgttacagcgtgaatttttttattttggaaacttaaacagggccatacgagaaggaaaaaaaaaatccgcgacccatcggagcaaaaaccacaccggcaccggcaccgcgcgaacggccgcggctcgcgccacgccgacgctctcccgccacaaccgcgggattcccccccccccccccccccaccgaacttacctaagcgtcgcctctcgtcttttttcccgtgcaacgttgcaagtgaaatcatcaatcgtgcgtgcgctgcgcccgaccatggagctcgcggtcagagcagccgccgcggcctcctgctcctccggcgcctcgctccagctcccgcgggcccgagccccgctccgcct

SEQ ID NO: 22298 - DNA, 1501 bp, Oryza sativa
tgatgctgccggagttcccgccgccggcggggttggtggtgtttgacgcggcggtgttctccggcccgtacttcctgtgcttggtctccttcgtgaacgggacgctgctgcgcggggaactcgtcgccgacggcgccaagtcggcgatggccgtgacgggattgggcatgtggtgggtgatcttcccggtgatcgccggcgtcgtcctccacagcctcgtcgtcgccctcttcgtctactggctcaccggcttagccatggccggcgtcctcggctacaccctcgccgtctatgaccactacaatgagctcatgtgcaccataaggtcagttgttgcgtatcacaagtatgacaatatagtcaccatgacaaaacgattttgctatacatttatcgatattttttcttctaaatatatatatatatatataattatagtataattacattgtaacttatatttgatccatttaatcgcaatgtaagttgtatgtaccaccatatctgctacaagtagcccatacgcatccaggagtggaggcagtccaatgtatctaggactttgagccataggattgtttcccgaatcttgttaaaattctctcaaatcaccatgtaaattttggaaataaaaaaaagaacaactgattagttgagtctaacttagttttattctttgataatttctggctccatgcctccatcactgtgagcatcgaagaatggtggatgcaggatttcaaaactaagtaatcccaaccccatatatcgatttattttaaagatttttttaagtatccacatgaataaagtattaggcctagctagttgcatcgagtacatacataaatgatatatcagaaattccatgtgatcaatcagttctattttggtgtaaaatgctttcaattaacaaccaacaactaaatacaaaacatcttcacttttttttcatgtcattttggtgtgatatatctcaattacaggagccaacctcggacagcagccgacgcttccggcttgctggtggggcgggaaacttgtgatgcttgccctgctcaaatcgacgaaaatgccagcgtcagactctcccatcaagaaggttgcttcagcgtttcaggccattgcccatcttgccgttgctctaggggtcatgggcctctgattcgattttgagtcccatctttgttgacgtctaaattaattgtgagcatccctgtttcaatttggaacattttaaattgttcgtgccatgtatgtgtgtgaatatatataaacgttaaactatggaagggaagcaatatgtggatttttttcttttttttttcttttttatcatcgacaggagtgatggagtcttttactaataaatgaggagatgacaagtatgatgctctctcgttagtcgtgatgggtactccctccgtcccaaaaaaagttttttttttacggagggagtacgactgtttgtaggaaaactaaaggttttatatgacttagc

SEQ ID NO: 22299 - DNA, 300 bp, Oryza sativa
atccatgtcaactataactttttgtgacaccttactaatcattgccactaataccctgttcccacttactaatttcaagaagtagagcaatgaaatgaagccatttggaccggagttccaccacccattaaaacacattaaaaatggttccgggtttcccttttaagtttccaaataaaaaaaatttgcctcattagacgccctattttcagcgatcctcaaagtcaacacctgatccccactttacaccagtgaacacctgatcaagaactaaacccaactatattttcttggctgcag

SEQ ID NO: 22300 - DNA, 1501 bp, Oryza sativa
gcgctcgtgcacgtcaactaaattatcaggtgagttctttcttgagttcatattcctcgtctttataccccggagacgcgtgcactcgtattttactcaggaacgatggagaggatccaaagggaagaggattcgcgcggggtggattcggactgcagggtagcgccaacttctgacggccgccacgacttcatgcaaactccgatttgggcgtgcaagtacttcatggaaagcttatcaagtctactttcaaatggatccagccacatgtccatatctgttctggagcggccgcaattgtcattttactcccgactattttctgtccatggtgttgcgtcacctcttttggcccaatgggctgtgtatccaagttgggcccattaggggcgcgtcctagggttggagcacgaccctatggtcgttcttcccctctttttatacctctagtcgccgccaagaacaggcgggttttgatgttagagatagcttcttgctaccagctcgcagcgcgcgtgttggctaaaccgcccgtctgcctgtaatcggaaccccaccatattgagtttgatagtgaaactttcatctttatctagcaatttcagtgcttgtcctacttgttcttgcttgttcttcgattacttgcaggacgagtgccctcgtggccgggttgacgcgcaccacaagttcgcggcgaccattggagacggtgtatcggttgctaaggcgcagcgtctttggacagttgtagtcgggccgtgaacgtcgtcttcatctaatcgagttatcccttacctctcatcgaaagatcgggccacaaaccgtagcgggttcgcatcagttttggtaccagctgttttgatggatttgaaactgatccgagccatccatcaaaatgagcggctcggatcaatcccgcattgggctggcctccatctctgggatgcagcactactgggccgcatgcagcccatgaagcactaacgacgtgcgattgagttgttgggccacattcggtatggttagtctttttcttttaaaaaaaagcaacaagtccactttagctctctcaattatatctcctatctaattcataggaaaaaactaaaaataaaaattacccaacaaaatacaattacccaacaagaggaagttagtcttttttttaattgctacaaaacctttgttgatgttaaatctggtaaacaagaaatatattgttttcaacatgttgtttattggcatatttatatcaagaataccttactcatatcacaaattaaatcctaaaaatatttattgtgattttagttaaaattattccgttgcaacgcactgttgaataataatttattatgagctactatatttctctctattatttgagactttttctagtgagcaaaaaataccaaagcagtgtgaaaataacttcggttaaaaacaaatatttttagttttaatacaccgtagcgaagcatcggcattttgctatagaaag

SEQ ID NO: 22301 - DNA, 1501 bp, Oryza sativa
agtgcttgtcctacttgttcttgcttgttcttcgattgcttgcaggacgagtgccctcgtggccgggttgacgcgcaccacaagttcgcggcgaccattggagacggtgtgtcggttgctaaggcgcagcgtctttggacagttgtagtcgggccgtgaacgtcgtcttcatctaatcgagttatcccttacctctcatggaaagatcgggccacaaaccctagcgggttcgcatcaggtggtatcagagcgtggttcatcggtgagagaatttacccttcccttcgtcattaattttttttcctatagcccagaaaagaccaaaaaaaaatagtagattagttttcccgtgatcctatagaccattgtgcctttttactagtactgcttagttaaggcttgttgagtttttgattgcatcggttgtgttaatttgctggtcttagtgttaagcgattagagtttcgagttcttgccaccaccgcacatcgccaccttcatcaattttgccgtcatcaccaccgtcaccaccgtcgcagtcacccactaaatcactttctatttgtgtttgatttgctgccgatagcttttgtgagttgccttgtatcctgccgccactagaaaggaaatagaaccctgattcgagtgaccttccttaaaacagtcatatctttttcatacggactcgaaattaggcttataatatatccacggacatctacaaaaaaagttacatccgattctccctggcattgccgggttcggcaaatttaaaatcgccaaattcctcttgcaaaattctgtttttgtggcgagaagcttcgggacctattcgcatagaactttgaaaaaaattctacaagcttcatactttgtccgtttgagataagattttctgtggttggttctagtgtgctcctggttgtgaaaaaaatatcaaaagaaaaaaataaaaaaaaagttgtgtctctctcctcagcactagagagagcaagcaaaaaaaaaaaaaaggatccagcgagcacaccccaccattccccctttgtcaccaccttccaccaccggttcttgttttcgttgctgtttgggtttgtgttttgtggcatcctttgtggttaggctcgcgtctctacttcaactagcctaggaccagcactgtacactatacccttgagcgattattcaatttgctttggctaacgtggtttctagttttctcttgagcattgctttcagcccaccaacagctccaccacaaacccgactacagcttgacaggtcttgttgctacagcaccgatacacctcgttccacggttgctaacttgtgggttgctgtccccctcctgtgggcaaggtaagaactggtaagagcttgtgagacaagctgcgagtgaagtgagaatgagcgtcttgcaaaagctacatcccaatagttgtgtagggcttacattacatcctccattgttttgttgtccttcatttctaaaccatggcaggtc

SEQ ID NO: 22302 - DNA, 1501 bp, Oryza sativa
ccatgctcatcaattccgatatgtcaaggatgacacccgcaagcctcttggggaagatcaacaccaatgacatgtacaagttgaagaagaaggagatggaggaagcctcaccttccaagaagtgtattgctctccaagccgaagttgaagacaagggcaagggtaaggtgaatgaagccaatgaggacttggaggaagagattgcccttcttgctagaaggttcaatgatctcttgggaaggagaaaggagagaggaaggggctccaactccaataggagaagaaatagaagacccaacaagactctctccaacttgaggtgctttgagtgtggtgagaagggacactttgcttccaagtgcccttccaaggatgatgatggggacaagtcatccaagaagaagagtggaggctacaagctcatgaagaagctcaagaaggaaggcaagaagattgaggccttcatcggggaatgggactcaaatgaggagagctccgcctcatccgggtccgaggaagaaggtggtgatgatgcaagctccaagaagaagaagatggccgttgttgccatcaaggtaacatctcttagtgatagtgagagtgatgatgattgtgatgatgtttcctatgatgagcttgtgagtatgtttgaggagctccatgcttatagtgagaagtagattgtcaagttcaaggccctaaagaaggatcatgcttctttggaggtcttgtatgaggagctaaagacttctcatgagagactcaccatttctcatgagaagcttaaggaagctcatgacaacctcatttccactactcaacttggagctctcattgatgttggcatatcttgtgatttgcttgatgatagtgctactcgccatattgctcatgttgcatcatctagcatttctacctcttgtgatgatcttgtggatatgtctagctctagctctagctcttgtgtttctatttgtgatgcctcacttgttgttgagaagaatgagcttaaggagcaaatggctaagctcaacaagagcttggagaggtgcttcaagggtaagaacactcttgacaagattttgagtgagcaacggtgcatccttaacaaggagggacttggattcattccaaagaagggtaagaaaccttctcaccgtgccactcgttttgttaagagcaatggtaagtattgctccaagtgtcgtgaggttggacatttggtgaatgattgccccggtggtaagcctcctaagacttgcatgtttgattctcattatatgcttaggaaggcttatgatgcaagcattgttgctagatatgtggattaccctatactcggtggaaaaaagaatgccatttgggtgcccaaagctttggtctctaacctccaagtacccaaacaagtttgggtacctaaaagagcttgatcttcttttgtaggtgaactaccacaccggtgggagccattgggtgcttgatagtggatgcactcaacaca

SEQ ID NO: 22303 - DNA, 1063 bp, Oryza sativa
tccactcccatctatgagagactctatccacctatgcttcaaataaaattttctcttaaattactcatccgatctacgatccgattacaccgttgtgttcataataattaaatctttataacaagatctcatatgactattttgatgaaaaatcacaaattacttttatgatatgtctaaattacttttagatttcactaagttacatcttagacatataaaagtaaattcagcaaaacctaaaggtaatttacatatattatagaagtaacttagaacaaaagaaagtaactttaatgcatgcatttttcattggacatgactaaacagctagtcgtagttggtttataatccatctagtgtctcctttcgacttgaataatgcaatagtatgtatcttatgtgtgttgaagttaacattgaacttacttttaaaatttgttaaacttatgtgtgttgctctgtattgattaaataaagttttctatataaattcatattttatccctacaatgaatttacttctaatgtcgtgacaaagttacttccgttttgttttaagttacttttataatatatatatataaattacttttagactttattaaatttacttttatatatctaagaaataatttagtcaaatctaaaagtaacttaaacatataataaaagtaacttacgtatataataaaagtaatttacaaatataaatattttttcatcgtaatataatcatgtaagatcttgttgtgaagatttaattgtaacgaacacaatgatgtaattggattgtagatcggataaataatttgagagaaaattttatttgaagagaaaacaggcatacatgtctatatcaatctttactgttacgtgggtgtgtcagcctatctacagtcaagtactagtggagaaagcgataacgtaagccgaaaatgaaaagataacgagattggacggtgggagatgcatcgcgcgattagactaaaatgagagcgtgcattgtttagattttacgtactatatatgatgatggggatgaggagggggattggtagga

SEQ ID NO: 22304 - DNA, 1501 bp, Oryza sativa
agttttcaaattacattgattttgcaaaagttttgacttatgatgacttgggcattttgaaaatactactagcaccactagttgatttgctcacatataaaagattaaaaggaagtagagcacatgcaagagtgcaaaactcccccttaatgtcacatactccattttcgcaaagaagaaccaaatggcaataaatccaaagcataagagcaaatgagagcaaatatacacaatgcaaaagaagcaaccatggtgcaccatctcaagccacatttcagaaatctatgacatttaactcattcctcaacttgcaaaagcgggtttcatcaagaggcttgttaaagatgtcggctagttgatcctcggttcttatgtggctaatgactatgtcacacttggcaacatggtctcttaggaagtgatggcaaatgtcaatatgcttggttctagaatgttggaccgggttattggctatctttatggcactatcattgtcacataggagtggggttttggtgaaggatatgccatagtccaacaaggtttgtttcatccaaagcaattgggcacaacaactacctgccgaaacatatcccgcctcggcggtagagagggctacggagttttgtttcttggatgaccatgacacaagggatctaccaagcatttggcaactaccggatgtgctctttctatccactttgcaaccggcataatccgaatcggaatagccaacaagtttaaacttagcaccttttgggtaccacaagccaatagtagaggaatgctttaaatatcttagaatccttttcacggccactaagtgacactccttaggagcggattgaaaccgtgcacacatgcaaacactaaacatgatatccggcctagatgcggtaaggtaaagcaagctaccaatcatggaacgataaagctttaagtctaccggtttacctccctcattaaggtcgagatgtccgttggttgccataggtgtcttgatgggcttcgcatcctccaagccaaacctcttgagtagatccttgatgtacttggtttggctcacgaacatcccatccttgagttgcttgatttgaagtccaaggaagaagctcaactctccaatcatggacatctcaaattccctagacatcatatcaccaaattccttgcaaaatacctcattagtagaaccgaatatgatatcatcaacataaatttgacacacaaagaagtcatcaccaatgatttttgtgaaaagggtggtgtcaacttttccaattttgaaatcctttaacaaaagaaaatctctcaatctttcataccaagccctaggagcttgttttaaaccataaagagcttttgaattgggtgccaagagagcccccttgctgctggtgggagagtatttatactcccacccaccaaaactagccgttgggggcgaaatcccccaactctgtgctctgccggtctgaccggaggtatgtggccggtcaga

SEQ ID NO: 22305 - DNA, 1501 bp, Oryza sativa
agctccgtttcaggtggttcaagttgctaaatttttctaaaataaagatctacatattaaaattgtccataaattgaattaaatttatttaattctttttaaatgggctttaattagatttaatcttgtaaaattcataataaattcatttggagtcagaataaggccgttcaagtctcataattcatctaaaatcatgatctacatgtttgtttactttatatgtattgtttatttggtttttattagtctttttcttcgttttgcgtgttagcttgttgtttccgtcgttgcgaaggttcgtgagtgcgttggaagtgatcaagaaggttaattgaagatcgattattgcaaggcaagtcacacagatcctaaacacaatcctttgagcatgttgatcctatatttaaattctctatttatttcaactgtgcatttattttcgaatgtcaccgggtggtgtgaacttattcctttgttatggccaatttgcattgaatgccctattccttgataccttgggtaataaattgattagcatgaaccttatatattggattggttcagctaaatgctatatatatgtttgcttagccatgcttagaaacataagctaactaaaggggttaaatctaaattatataattcttattaattatggttatatttaatggtagctcacgatgattaatcgtgtgatgttaattaattgataattaaaatctggttaaggtgggttgtgagcatatggttttgatggttgtgctcatgacaattaaggaccagttcgcgagctactgttgtgagacattaaccgtgccaaccacaagccagcgtgggcaacggttttatcttttgtatagggtgattcattatagtgcgccagactgagaagtggcgagaagtccacgggggtcgctggggagtccgtgccttgtttataagggggtgattatgatccaggaatggtgcactgttttgagttgtgttgtggaaagggtattgtcacgatttccccctttgcaatgccgtggtggtatttcggggcatggcaacatgtgtggaatcgtgtcttgtgggtacagtggtacacctctggccagagtaaaactattcgaatagccgtgcccgcggttatgggcgagttgagcaatgtttttcgtgattagtttcacactactcatcaatgttaataatgtgagaattaatttgactcctggtttggaatggataattcctagtttggaggtttgatctgtacgaccggggttggttgttcaggtttggttgggcctgagcagcatgggtgtgctgttcagtgttgattaaaagtggtgattaattactctactgttttactactcttaaatctttgctaaatgctgcttttgcaaatgagcctatattatgccatcctttggtatccttgtgcacttgcatacttgctgtgtggcttgttgagtatgtcatatgctcattcttgcaataatcatcaaaccgc

SEQ ID NO: 22306 - DNA, 257 bp, Oryza sativa
attttcagaggctttatctgtttttgtgctcagcatgaaagttgtagacaattttgtctagatgtccgaagttgtattatttgctagtttccgttagacggtttgtgagttactcataaaacagtaatggaacagctataggttatttaatacaaatcggtaaaaggtttatatgttataggtttcgattttagtaaatatcccctgtaaccatcgttagttgaatatagtggtttatgtgtagttttgctccacag

SEQ ID NO: 22307 - DNA, 1501 bp, Oryza sativa
cttgggatgatattgctatggatttcgtagttgggctacctcgaactccatgagcaaaggacgccatctgggtggttgtagatcgtctgagtaaggtggcacatttcattcctatccgcaccacttattctgcgagtgacttggcaccgatctatacacgcgaggtagtgaggttacatggtgtgcctcgctcgattgtttatgatagggatgctaagttttcttctaagttctgggaatctgtgcaagaggcatttgatactcaattgaaattcagtacggcttttcaccctcagactgatggtcaatctgagcggactattcaaactttagaggatatgttgagatcatgtatcctttcatggaaaggcagttgggaggatcatttgccgcttgtagaatttgcttacaacaatagtttccatgctagcattcaaatggcaccatatgaggcactttatggaagaaagtgtcgatccccattgtgttgggattccataggggagagaactattttaggacccgattgggtacaacagaccacagaacggatagtagaaatacgacaacacatgcttgcagctcaaagtaggcagaagagctacgccgatgtcagaagacgagaattagagtttgaagtgggcgatcaagtacttctaaaggtatctccaaccaaaggtgttgtgagatttggaacgaaaggcaaactcagccctaagtatattggtccattctcgatagtggaaagagttggaatcctagcgtatcgccttgagttaccagagtccatgaaaggtgtacatgatgtattccatatttccatgttgagaaaatatttgagagaccctgaacatcatgttgccgtagagccgatgaccattgagcaagatttgacatttgagtctcatcctgtaagaatattagaggaatctgagagggtgctcaggcatagaactatcaagtatgtcaaggttctctggacgcaccagaccgagcgagaggccacatgggaacttgagtcacagatgcgggagaagtatccagagttattcacgtctggtgagttatataagtcctacctatgagttcctttctatacttgtccgaggtataactggacgaattcgagggcgaattcgattgaaggacggaggaatgtaatatcccgtgttctagagtatgattgggcgaatttgagggcgaattcgatcgaaggggggaagaatgtaataccccgagttttaaattaatatatcttgcggaatattagagcaaacgcgtaaaagttcaacttttaaaccattgttcgtataggcgatcgggaaccgtggatgcctagagctcgccgagtagtgcaaaatagactataaatttatagtaatcggagtccgaacgaagtcccgaggattgaatagatgtgagccgttagatcttatttagtctctttatataacaaaccaaaaaaaaaacaaacgaaaaaaaaaagaaacaggagcgattc

SEQ ID NO: 22308 - DNA, 206 bp, Oryza sativa
aaaaaccggaaacagatcgtcttaaatataaattagaaacaactatagactaaaacggattacctagcagtactaatgtataaggaaaacgaagaatttggaaatattcaccaaattccccaaatttcccttctatcaaatttccccttctttccttccttcctgttcttctctgccttctctccctccttcctgttcgttgcagg

SEQ ID NO: 22309 - DNA, 1501 bp, Oryza sativa
ccgttggacgtgaagctgcattaggctgagaaccccactgcctaggtttagatgatggttgagtgacctgattttgtttgtacttcttgaaaggtggtcgctgtgagttctcacccccttcctaatgagctctcttctgctcattaccagtgacattgccagaacgattcttctgcgcagtagtaatttggagctcaacctccatccctcgagcctcctcaactgcattgaggtatatagtaggcgggtttcttcccatcacttctctataccgagcattgagccctcgaaagaacttcctagccttctcacgctcatcacttgccacgctaggcacaaagcgtacaatactgctgaactcccgttcatactcatcaacagtcttgcttccctgttggatattgtttaactcatcactcatcttgtccctaaatgattctggataatacttagctctgaactgctgaagaaaaacttcccaagtaatagcaccacgatcagggttccacgcttcaacaactccatcccaccaaatgtccgcctaaccagtcaactgaaaaggcatgaaagtaaccttctcctcaggagtcattctagatcccctcatatacttctccatcttgcataaccagtctgcagcattaacgggagtaccagacccatcaaatgtgtctaagcgcatggatgtccatctagtgagtgtcatcccccgagcagctcgaggagcatcatcagagacagcagctgagtggctaccaccctccacctcttccatgtgctcatcctccatctggttcgaggatgctgcctcattatggagacctctaccacgacctcttccacggcctccagcacggcccctaccacgacctccacgattaggaataggggattcagcaaccgagttgttcccaacctctttattatcctgagtattttcaacttcttcattatggtggcccctaccacgacctctacctccgcctctcccgcgccctctgttagccaaccgaacactcactctaggcggcatacctatatcaaacacaagcatttacacgtcattagtttaacaataggttagacaatggcatgcaaggaaacacaatcatacacatatatatgcagcagaaacataaatgctaggaatgacccatgctcccattcctattgtgcaccagtgtgtcaagtttttttagatgtttatatataacccaagttctactcttattatttcctaccctaagagaaaatatatttttttaattggttaggaactctagttcaaaattttatgttgatttatatatctcattacccagtcacttcccatggacctaccgcccgctctgataccaactgtaacaccccaggtaaccacgtacctagaatgccacaccaaattacactcaaaaactaagtcctaaaattattagaaatttcggcagagtctcccctaaaaatacggacatcacgacaggcagttataagaaaggtcaat

SEQ ID NO: 22310 - DNA, 370 bp, Oryza sativa
cgcgatagggcctctgacaacactacaacggctagtttcctagccgtgcaagagtagcacggtgtgaccggccacatacctccggtcagaccggcagagcacagagttgggggatttcgcccccaacggctagttttggtgggtgggagtataaatactcccccaccagcagcaagggggctctcttggcacccaattcaattgcacctctctcacacaacattgagcttagtgttcatccattgtagtggttgagattgatttagccaagagtcaagtgcatttgcttccattgtagagctagtgtggcacttgatcatctccacgccaagtcattgcttgttactcttggagattgccgcctcctaga

SEQ ID NO: 22311 - DNA, 1501 bp, Oryza sativa
cttcatatgtacatgttctttatctgctagctagtctaatccaggtaactataggcaatgttttgcatcacatagatggcaacatcatatgacctattaaccttatctaggtttgacatgagaagtccatatattatgttttacttgggtgccatcttatagttatcagtgagctttattattgatttattctaatttacctggtgtttttgtccttcaatgcagcccatatctaatgaattgaatttgtatctttattgtgatgtgcatctgttgtatcacacgtattattgtaacttcaggacattagaaataaataagtttgtaatttgatagcaactttgaatgatgttcggcattgccacaagatattatttattctgactgacaatcttataacacaaaaaattgaccaatcttaatgaatgatgttcagtattgcggtattgccgtaagatattatttattctgtgacaatcttataacacaaaattttgaccaatctactgagaaacttgcaagcatttcctgctactgaaaaagcatttatgttaaaaataacaatgctgaggaagacaagcatttcttgaatgtgataatataggcagctgaaatttgtaccagattatgtatactatcgtatacttgtttctaacttattataaacatgtataattaatgtggaattttaggcacaaatctctaaggaggcaatgtacatttgacaaaacgcatgaggacctcatcattgcttaaaaagtacttcatctgtttcacaatataagtcattctaacattttccacattcgtattgatattaatgaatctagatagcatcaatatgaatgtgggaaatgctagaatgacttacattgggaaacggagggagtagtatataagatattctctgcatgggtgaaaaacgaacactctaaaatggttcttatgctaactgatgtgaagaaaactttgtgcggaattataaataataagaatatgtttcaaattgtatgtgtttattactactgctatcttatagcttcacagatttaaacaattggcatcatagggctcatttggcttggtacccaacgaaattagttttggcactaccaatgttttaatagagttggggtataaaagctatattaatttaggtaaatattggcattaatctaaatattcagaaagtactatttaaatttaccaactattttgcagggcaagtttaggcatcaaaccaaaatagcccatagtttgatggactactatctttttgcaatacttttatatatgattattctcaaactaaacatggattttgatgtatttccagtttgtaaaatagaacatctctgacctcaaaatccatgcattttaacaaaatatcactttcttttccaaatgtttccaatcagcttctgtctactttctgataggcggctaggagaaagcatataccgatggaactgaataacaatgaacaccagtctcttctgcg

SEQ ID NO: 22312 - DNA, 1501 bp, Oryza sativa
aatagctaacccctacgtgaggatccctctactctctcaaaccgcgctttagtaaccctgtatttctctggtagttcaagctgcacaacacggctaggtggagttagaacccttctggtgtctatacattctctgtattgacatctccttggtggttcctgggggaaagaatagatgtgaagcgaacaaagttagtaaatgttgtcagaaaacaaggattcatgataatcaaaatattcttaccatgaaatcatcgtcaagaatatttggacaaataaagaaccttcgacccaatgtcgtaggctttatggaacgaagaacctgacaacgatcaccgcacctgcatcttggacgggcttcccatggagggagtgctgtagttagcacccgccagtcgcactgttgttcacgacattgtcgttcgtaagccgcttttctctgcaagtattgctcagtactttcggatgtgaaataccagcgtccttgtaaacaagtggttaggtcgagaatgggattttctgtatcgatccactcaatgtatgcgcaaactgtagtgcgggtctgacgaatagagtagtattacgaagaataaaacaattgcccatacagaatgaataagcatatgcagataatagaatatctcacggtcatagttagggcacctaaaaaagcgccttgctcgaatatcaggattcctcgaagccattagttggcatcggtcactacataggcagagaggacgctggcaccaaggtggtagtaggtatacacaaggatcgctatgcagttcggatcctcaacgcctaggcgtctagccattgacgaaagctggtaggatttgtaatggagcaagtggggaagagagtactgaatgtggctgagttatgaaagattgtgaggcctcactcgttaaggcgacttatataggcacaaaaaattgcagtgatatccctaacatgtcaacgtcgtggggcacggtgggtacgcctgattggcgccgaaagttacattggtcgtatgcgggcaatggcaggcaattagtggtatcgcacgtgaataaaggaggctgcatcggtgcggcagaaagtagtcgtgcatgcgccgaaaggtatcgtgcattcgtaaaaagtaacagcaaagttcagggatgagaacccgaataacaacaacgtattcattacacaagcatacagtactagcatgtgaagtaaataaacaaagagaagtctgttctactggccctgccccgcgccgcgaccacgcttggtccttcgggcctgtgcttgcacgtggtcctaggagtacgtaaaacgatccagtggcacagcacgggtagcacgagtgtttggcgacggagtggacagcgactggtcctgcgtctgcacaggcggtgcgcctcccagctgtgaggggccgatgacgtcctttgtcgagcctgaagcgaagtcgaaatcggtgatgtcgaagagcaaggtggaagccaccccgtagtccgacgagg

SEQ ID NO: 22313 - DNA, 836 bp, Oryza sativa
gacttatccctaggaacccaatcggtaataccaagttttccctcttttaaagatcgaacccaatcaagttcaacccgaaaccaaaacttcgtcgaaccaaaattaaacaaaaaagggtgccaatgcgccgaaattatattgaacgtgtgttgttaaaaattacatagggctcagggtctatttatacccgagaattacaatatatgcccataccggacacgactattatctctaccaaactctaagataccataagtctttgcggcagacttttgcccatatttatctataaggaatctacacaaaatatcctaattaatagatacaattgccttcccaggactttatccgtgcgtggcaatcatcttgaagtacatcaacttgaacccaatatcgcgtacaagtcgtattgtcggaatcggctgtatcggcttacttagcccgactcaaacccagccgatcctagccgtagccgatctggacctccagccgattcctgctctgtttccgaactcgatctccgcctccgacttcgctttgatccaatcctctttcctgacacagatgttaccaaatttggttgttaacacgagccaagtggacaagtcctttcaggcgaaagaggaaggaatgaagaggtatcttcgcattcgataggaaaagtgttacaccgggataacggtcgaacacctacctcgggatcagaacaaagaagctgacaccttgccgagatctgctgcttgtggtggactgcatgcgataggaatctttttcaaagtcctgtacgcaccaagtgtgcccgctgagagcctggatgtcatggcaatcgaccaagt

SEQ ID NO: 22314 - DNA, 1501 bp, Oryza sativa
atgacattttctccattaaattattacttttttaaaatcctccactctcatgttatttaattctattggacgcatgcattatatttagtaggatgatccaaactacaagatgataataattatttttttgtctttgggttaagggtggttgtgcctcatattttggaatggagggagtaaaatatgttcagatttcttctttttttgtgtatgtggaaagttcagttctatttcttgacccccttgtaatgttttcaatttttttttaatactgaatacagcctggggtcaattaagatgacataacttaaaatactacgagataattaataaaacaatgtatatgaaatcaataacaatattttcttatacttgtgttttctctgctattaggccatcttatgaagatggcatctttcaatggaaattactccctccgttttaggttataggacgttttgattttggtcaaagtcaaactactttaagtttggccaagacaaatttattatgaaaatatattcaattattgatttgatgaaactaatttagtattatgaatattactatatttatatataaacttaatcaacttgaaacagtttgattttgaccaaagtcaaactatcttataacctgaaccggaaggagtaactacctacattcatttggagcatgtggaagagctatagcacttttagtaaatccagatgtagcagaagcaactggggatctatcccattccctggaatggtagtgatgctcatgtggtgctcagatatagttgtacaaaacaattatagatgagagtgcgttacctttaattaattcccatagtttatttctattacatggctacaaattaaagcacatgcatgcagtgcgtacctagctagtatatccttgtaacttagaataaggcggatgattgaaaaggtttgatcacgctggcatccactatggcatgcattaaacctttgtgctaataatatagtagaaatgcagagtgcatgccacagatgcataaatcctagatgggcgcaagttctacgtcaaacaggtttagaatagaatcaaagaatatttcaagaaaaaaaaatcacccgcgtgcaaatattcttaacaaaaattcaaacaacattatattaaaagcccatgcatgtgcgcgggctatctttctagttataaaaatgctcattttttgagacggatggagtatatgatataacgttaattctaatactactagacctgttcagatccataataatagagtgtatcacgttttgtaccaagttaactaattttaggacaggagagtaggtgggattccatctgtctatggttataaaagtacgtaccctcggccaagccgccatagctaattagaccatcaatcacattaatgccgaattcgtactcttgttgctagctgtagcaatgtcgcagctcctccgccctggctacctcggcctcctcctcttcttactctccatgctgc

SEQ ID NO: 22315 - DNA, 251 bp, Oryza sativa
ttagtaattaaattgccacttaaaccctgataatggtgggttgtgagcacatggttttgatggtcgtgctcatgacaattaaggaccggttcacgattttcagttgtgaaacattaaccgtgccaaccacaagccagcgtgggcaacgactttactttccgtatagtatggttcattgtagagcaccagactatgaagtggcggagataagcccacgggggtcgctggggagtccatgcgttgtttacaag

SEQ ID NO: 22316 - DNA, 1096 bp, Oryza sativa
ttagtaattaaattgccacttaaaccctgataatggtgggttgtgagcacatggttttgatggtcgtgctcatgacaattaaggaccggttcacgattttcagttgtgaaacattaaccgtgccaaccacaagccagcgtgggcaacgactttactttccgtatagtatggttcattgtagagcaccagactatgaagtggcggagataagcccacgggggtcgctggggagtccatgcgttgtttacaagggggtgattatgatccgggaacggtgcattgctttgaattatgttatgcagagggtattgtcacaatctctattcgggtacttgttaactatcgcgacgcatggttgacatgatgttgaggttgtgtcttgtgtgtacagtggtacacctctggccagagttaaactattcgaatagccgtgccagcggttatgggcgggtctaacaatatctttcgtgattagtttcacagttctcaccatattaaatgatgttgttagtaacctgttagctcctggtttggaatggtatattcctggtttggagatagaactgtgcagccgggattggttgttcagaatggttgggcctatgcaacagggtatgttgtatagcgttggattaatactgtttaattaatactctactgttttattaaattctgaaatatttattaaatgctatttatgcaaatgagactatactatgccatcctttgttatcctatgcacttgcatatttgctgcgtggcttgctgagaatgtcatatactcaccttacaatcattcattagaggagttctacagtgatgctgatggtgtggaagattaggcgtagccctggtcaagttgcctgtggagtggagtcgtctgcgctgcttaccttattttttccgctgcttagaactttattgtttgagaggaactatctacctctgtaatgacattttattcgcttattaattagagtaataattgtactctattatcaaattgttattgtgtgcctcggctgattcctggacgagggtttacacacatgtaagcgtttggaattttggatagaaattccgggcgtgacaaata

SEQ ID NO: 22317 - DNA, 326 bp, Oryza sativa
cgcatggtaatgtgtgggtaaaattccccacatttgccgaagagaaaggattaaagttaaagaaatggtgcaatgcagggtactcacaagccgagcgaagtcctggtcgcggtgcctggggtaaaggttttagtgctcccacgtggctgttgtcaaaggaacaaagggtttttggggaaaaaacccctttcccctttaaaagggttaaccggggttggcgtggcttggtaccagcgtaggtaggcttcgtacgcctcctctgtgtgtggctctccctcgtgctccacgacctcctcggttgcgagcaaccagtccttaacaaaagc

SEQ ID NO: 22318 - DNA, 1199 bp, Oryza sativa
  unsure (1)..(1199): unsure at all n locations
cccgaacagacatgttgacaagattatccatatnaannnctcaaaaaaannnnnnngtgatggttaaaannnnnnnnttgtaancaacgcatggactccccagggaccncngtgggcttatctccgccacttcacagtctggtgctctacagtgaaccatactatacagaagggggggtttttaaaaaaaaaaaaaaaaggggccccccgggggtttttggcccacacgctgagcttgtgagttggcacggtaaatgtttcacaaccgaaaatcgtgaacccgtccttaattgtcatgagcacgaccatcaaaaccatgtgctcacaacccaccattatcaggttttagttggcaatttaattaattaaccaatcacgattgaccatcgtgagctatcattaagccatcattaaataatagtgaatcataaactatcccatttatatgagctagtgcctctaagcatggctaagcatcctattcactttaactaaaaccatataatgttctagctaatcaaattattaaccaagtgacaaagaatagggaatcaatagcaaaagggctataacaaggcaataggttatttccacccaatgacattcaaaaataaatgcaatagttgaatagaaacaatagctttaaacgggatcaacatgctcaaagggttgttttgggatctgtgcgacttgccttgctggccttggaactcttcaaaatcttctcctgcgaaatcggactctccgggaacgtcagaatctaaggaaaaaagagcaaaaacaccaaaacagcacataaacaagcatgaacagtacatatgtatatttttaacatgtagatctcaattttagaaaaatttagagacttgaaccaactaaatccaagctaagatgaattagttatgaattttcaaagattaaatcggatgaaatcatttatatagattttaattgaattatgacgcaataatgaattatttttgaaaaggaaaagaggattattgcgtcagcgggctcgggttcacggtggaccgggtgcacagcggcggtctacggaacggacggccgagatctactcgatccaaaacgaacggccgaggtcgacttgatctaccgccggtctatgggaaacggcgacgatgacgtcagcggtgatgtcaccaccggcggcggcttgggcacgcatgctcgccggttgc

SEQ ID NO: 22319 - DNA, 176 bp, Oryza sativa
  unsure (1)..(176): unsure at all n locations
tcaattttcagaaaatgtntaataaaaaaataccatcttagaacaacccgaaatacttgtatttaagaacccccatatttcgattgttcccacgtttcatcattnnnncaagtgttgtgaagctgtttcccttttggttaactttgtttcttgcttgttcttcgattgcttgtagg

SEQ ID NO: 22320 - DNA, 337 bp, Oryza sativa
agatctgtgtgacttgccttgctggccttggaactcttcgaaatcttctcctgcaaattcggacgctccgagaacgtcggaatctcaggagaaaagagcaaaatcaccaaaacagcacataaacaagcatgaacagtacatgtggatatttttaacatgtagatctcaattttagaaaaatttagagacttgaaccaactaaatccgagctaagatgaattagttatgaattttcaaagattaaatcggattaaatcctttatatagattttaattgaattatgacgcaataatgaattatttttgaaaaggaaaagaggattattgcgtcagcggc

SEQ ID NO: 22321 - DNA, 1501 bp, Oryza sativa
ctctccctcggattcgtttggaaacctctcccctaacctcgccggcgccattaatggcggccgggtctcccacgcccgttccccacctctccggccgccctctctcactcccaaccctatataaaccctccccgagctccccaccaccgtttccgccactcaccgccctctctccccgccggaatcgagctcgcgccgtcgctctctctctccgccgtcgccgccgagctccggtccgccgccgtcgtcgccccgaccacctcccacctcggcgccgcctccttcggcttagccgcatcctcgccgacctcgtccacctctccgtttcggtcgccgaccgccggagcaccgtcgaccccgtccacccgagccgcgccgccgccttcctccgctccggtcgccgtttccgtcgtcgccgtcgacccggggtgagccgtggacagccgcttcgtttccccctttccctcccctctctcggccgccgctccgccgtgcctatggccaccgccggcgaccataggggcgcgggcgcgccgcctcccgtcgctgcgccagcgtggccgccttcgggcgcaccgagcggctgccgcgtggggcccggccgtcagccgcccgcgccctcgggtccagctgacgcgtgggacccacggcgccggccggtgtgagcccgggtgtgcccggtccaccgtggaccgtggggctgccgcgtgggccccactcctgtggacccggtccgcgcgcccctcccctcggctgacgcaataaacctttttttaattaaaatttaaatgaataaattcgcaaatattcatttaaagagcatataaacttcaaatggccataacttggccatttgaactcggaattggaccgttcatgtctctaatttttccttatgaagtcaagaacccatttttgtgctttgtttcagcttgttatgtggagttttttagagtaaaagcattttcttttccgttggtcgtgtagacgctgcagcttcggaagatccgctcttcgtggaggttgaagccgacgtttgggaaagcgagcagggcaagtcacatcatccttgaacatattgaatcccagtttataaaattattttgatttaaattattgcattatcgctttatttaaattcccgtgttatcactgttttatctagccatgcctatttacctttgttatgaccttattattgttattgttattatttccttgttcaccctagaataaacaaaaccccaactagtggacactctactcatggtaccactagtatgattttaggtagatgcttcgctggttaattaggcaacattaagtggttttacaactctagactgtgggattttctcatcacctggacattatggaatggtttgattattgtggaattggattcacaccgccccctctattcaaaatccccaaaatggttttaggctgggctcggggtgcatggttttgatagtagcacctcggccatataaggaccggt

SEQ ID NO: 22322 - DNA, 1501 bp, Oryza sativa
tatagccatggtttgggaccaatccttctccagacttgaccatgaaaaatctataccaccatctgcgagagtttgagcaaccgtgctcgtgcatgatgatttcaggcatgacacaagaaactctaaataggaagttgttcccgttctctcatagagcgcaaaacaatggtatattatttccatagttagtacaaatggtaattgggaggagctaagagacaaatttttatcttggttttttccctttgtcccatgtcttcccctagagaagagagattctttactttcgacaaaatgagaaggagtctattggtatagcttgggctaggttctcgcttttagtgcgatctaacctagacttgtccattcctgatcatgtgttgctacaacacttctgtttgggtttagacaaggagtttgaccattatcttgacattacggctgaaggatcttttgcccatgaaacactagctagccgaaggaagggaaaccttatatcacatcttagaaaacacttccttcgttgccatatatgagcccctccaagaggtaagcacgtccagcaatgaggtgtccaagcctatacaaattgcatattactctgcgcatccataatacattttgcacatttgcccgtttctagtctaaaattcccattcttgctccttccttttcccatctcctcaacaactccaaaccagagtccccattccatagttcccatttgctcccaatcctaaggttaatgtgagaagtgatgtgagtgagggtgagctagcttggggcttctagctacgtcgtcttccttgtcgcggagacggccacaacggcgacgcctcccatgacccatcaggggcggctgctgtgtcgctgtcggcaacagctgctacaccgccctcaaggttttcgacaagactcagctactgtcgcacgcactgggagctgtctgtgctctactgcctcgcatgcccacaagcacagctgcaggcttgcaatgaggaagaagaaatttgttggttgtttgacttgtttccttgaaataaggtacatacactactagaaaatcgatttttcatggcgtttggaaaatatttttcatggcggccatgtggaaaaaccgccagcgcagaaaatcgtgggggtggggggtcaagggccgccagcggaaacacatcttcgccagcggtctacttaagaaggccgccagcgaagattggatatcttctctggcgtctctcttaagctcatgccaatgaaggtattgtatcttcgctggcggtaaggggatgcggcccgccagcgaagatgtaggtgtctttgctggcggccctcttaacataacgccagcgaagataccatatctccgctggcggtgtggtgacgtggaccgccagcgaagatacctatatcttcgctggcggcgtccttaagcctccgccacctcaaatcattttcaatggcagttcaaacgaaccgacatatgatgaccgccagggaaaat

SEQ ID NO: 22323 - DNA, 1501 bp, Oryza sativa
tgattgtatctgcagaacgtatggttgtagttagatatagaacataaacagatcagtaaggaagatttagcgagtccttggaataattgtcaaaaaagatatggttctgaaagatctgaaatgatcttcagtattcgattttaggcatgcagattcagtaaatgctatggtagagtaagttgagctatctataagaactaataatgtatagatgtgggagaggataagggataagagtaaggtggaatcgaagagtatcataagtaattatacgggggtctatcggtgcatcaacgctaggtcatgcgcatggtccctagggcgtgacgacaagcaccggttaggccggttaggggtgtggtttagggttagggttaggtttatagttttgggggtagggtgggggaggagtcgacaacgagcggtgtgctattgttggtgacatagacaaagcaagatgaatgggagagtgaggagattgaccgcgtggggtggtagcactacattaatgcctttcgtcattggcgaggtgttgtggtggtacggtggtgggtgggaggaataactgaccactagttttagagcgagcttggcaggggaggatgaggggattcgctggagagtgtccctcagcgttggcggtgttggaggagagctttcattgttgatgaggacatcactagctagctcagatatgatcatgactaccttatgtatgcatcgaccaaaggtgcatgctttctatgtgagatttacgtgctatatatttgaacaaacattattgcgctatgagttttgcatcttctcgttcgcaaaaataattgcatgggtcaaggaatgaacaacggactcacgaagtgctcggatgatcaataaaattgattggggaccaatacaagaccttctccaagtgtactccatcattaccgcgtcacttttggtccatacaaggcaaaagatgaagttcaacacgttttttattcggattcggatatcctaacaacatcaaattcaaacggaccgtcgttgatttagaaggaatttcagggctcatgagtacttgttggaaaactgatgtagtctactttttgatgcttttggtcccacgttaaaattccatctcaactattgggaatctgtaaaacaagccacgtatcacatccagttcgagtctgatttaggccttggactttgtaattgtgttgtgggctaaacccaatagctggacgtcctagggctaaccctagaacacccctaatcatatttactcagtagtcatcataatttagagttgggttttgcttagattatttatgtaattgcagtttcaccattagttcggtttgtggaaccccaattgtgagatcttaatcattcatctgcaaattgagttatagtctaccttgttcttgtttgtgttcttcaattcgcatgcaggggttagccttctcggcaaggtcaactggacaatgcacgattggtaaccagaggagacatggtg

SEQ ID NO: 22324 - DNA, 519 bp, Oryza sativa
tgacgggaacgacgaccggagggaggcgaggcgatggggcggcgttccaagagtcttcgggcagcgaggagacgtggtcgatgatgaaggtgacgagatgaagccgacagcagcgacggcgcagtgaggcaatgctccggcgaggagggagggctaccagagagcaaggatgaaggctacatcaccactgctcaccagcgaggacgagtttccggcggtctccaggagaaacggaggtgaggccggggaagaggaggccgctgcgaagccgatggtggcgacgccgggctccgatgaggacccgaccgccggcgaggggcggccggagttgcacgacagcggcggcacgggaagaaggcagcacagcggccagggagagaggaggaggagggctgcggtgtgtggggagagaggaggcggtcagggctcccttttatacgccggggtggaggagggggatggccgggagaggaggggaaagaccagggagctcgctggccggtcatcaatgacggccac

SEQ ID NO: 22325 - DNA, 1501 bp, Oryza sativa
tagaaagaaggtgggttcggaaagtctttgatttgccttctcattctttgaacagcttccacttttatcttgaatgatctaaccagatccttcaatagtgaatcatgtaatctttcaataataaatcatgcgttccttttccgttctatgtttctctagtactcgtgtcgatttttgtcatagtcaatagcttggtttcaccctgattcttccatttttagcttttatctgagttgcgagcacttggaggtgttgcttcaattctgagtctgagatctacaacatttgtatatgtctttgatttggacaggggaggaggagatgaattagggttaaggggtctgcacgaatcttaaagcatatctaatggtccaaaatttaaaagataggaggtagaattttttgtaaacaaatatgtagatagtttctttttagtatggcccagcccatatgttccaatgagagatgttggcaacgcatctgcgcggaataggctttctcacttaaaagtgataggagtcagtacaagtaggatagagagtattgtatgccctggattttgcgcacgagctacggtttgcatcatgttcaagttcacatatggtgaacacaatttactctacaaataaattatgataaaaatctgcgaaatgacattgacaagcgtcccaatccatgaaatgcctcgacaaacccaacttcctagaaataccatcgtacaagcgcttgtgtcccagaaataccgtcgctgttaagtttccattagtagacctccgttaagtgttataaaatatcattttacccctacaaattgttgaaagatgattacaacttttactctttctgacaatgtacaataatttagtttaaagagcaaactacaaattagtataagctaatggaaagagtaaaagttttagtcaacttttaacaattcatatgggtaaaatgatctttttatagcacttaacggagggatgctaacggaaacttaatggcgatgtcatttctagaataaaaacgcttgtacgattgcatttctaggaagttggggataacatttctgaattggagcgcttgtcaatgatatttcttggattttctcataaattatttaaaaaacttcacatacaaaatataaattacttttggttacactgttatttttatgaaatttgccactggacccacctatcaaggctcacatgttatatacagcgagtgacaaattcttaattgccacattttaaaagtggcaaatagttaaatgtcgctatttttatacggcaatcagtttttaaaaccgaagcggctgacaaggtgtacaatatttctttcttttataaaactggctaatggaagttcacttttgtttaatttaatgaaaaaacagaattactttaagaaaaaggagattcggtgttcgagcctcagtggctgaactgaactgaacttacaaaaactgaccgttatctcttctccgcctcacctttcccccctc

SEQ ID NO: 22326 - DNA, 252 bp, Oryza sativa
gttaaattaaaccaatagtttcttgtaaatcaatgaagaagtggtgaatggatcaatttcccgaagaattggcgaattaattggtatgggttgggggtcgggacttttgtacttaagtttcatgtgcgctcttctcttcatggggagggaacatcaaggctacatctgaatttaaagatgaggggatccaaataagaataaattatgttggcaataaggtacgaccttaaatggaatttagatagcaacaaa

SEQ ID NO: 22327 - DNA, 1501 bp, Oryza sativa
ccgccgtcctcccgcatgtcgcacgcgccgccgccgccgcagcgccgccgcccgctccccagctccgccgccgacgccaagaactgccgcgccgtcaccatcgccatcgcaaccgagagaggaggaggaggggagtgaggagggcgatggatattggatgggagggcggcgcgtggaggtggtggagaatcgtgcgagcgtgagcgggtgacaagtgtaggcaatgcagcgcctcgtgctgtgtcgagtggtgggagagacaagtgtaagggatacccttgccgctgggcacgcgggcaagggaaggcagaggccggtggactggacagttttgaaaaaaacaaaattggcgcaaaagattttgaaatggtgtttggtttgcctcgtgagatcgtgtcatccgtgtctccgcctctcaggcagcggcgaagccacatgagtattaggggtggaaacgagccgagccggctcgcagtgggtcgtaataaattagatttggcttatcttagctcagttaagaaaacaagctaaaacttaagctcggctcgactcgtttcctggctcgaactaaactcgagccgacttgcatgccttcctattgaaacacctcttcaaatatattttgtaattattaaaaaaaaataagaacaaatcatcaacatataaaatttaagtttatatattcaattcttcaaaatcttaatgataaattttaagttgacaaataataactccataaaaagtaaaataatggatataaacatatgatggcctagctcgtgagccagctcggctcggctcatttaagcaacgagctgaaaaggaggcttggacttggctcgtttggcttacgagccgagccaagccaaccaggctcgagccaagctcgagctttttttccacccctagccacagaacaatgagctaaattaataagggtttaatttttttcataattacataacattttttttaaatatataatgagagttatggggttaacatagggcttcaaccttagctgccctatgcctattaacattcttggtcatagaaagcaaaaccaatggagagtatctacgtgttatttacgagtagtttggaataaattattaactgaactattatagtggactagatgtttgcagatcagatggtttcagactatatccgaacccatggtcctatttggtttcattgctagattgactcgtccactagattgacgagtttctttttataaaataccagacaacattagagcggctacgactattagccagctataaacatattttaatgagataaaagataagaagagaagcgggctacagatctgtagccagctgcagcacggactccaagacaaaatgtgtgtatgacgggtgtgtcgaggagtgatcctctctagcgggagatcgtgagatccccttttgtgagttcggccgagggaaagggttcgcctctcgagatcgtatatccgccctcagggtttctagat

SEQ ID NO: 22328 - DNA, 311 bp, Oryza sativa
  unsure (1)..(311): unsure at all n locations
cctcactcactcaccaccatcaatcataatcaaccgactgatcgtcacaatcatcgattctcgaatgaccttggtcttatgaacgtcgttngatgaannnnncccccccnccccccagcgccnccggtgatttgcattcgccgnagcncancactcaagcttgcatgctggttctggtaataattatgtactcccctctagcgtggatatggtccgatacagcgattatggttctatcagtgatcctgttatgctctctttggaaatatatactattcaaaaatgttagattgagctaacgggtgatcttt

SEQ ID NO: 22329 - DNA, 1276 bp, Oryza sativa
  unsure (1)..(1276): unsure at all n locations
cctcactcactcaccaccatcaatcataatcaaccgactgatcgtcacaatcatcgattctcgaatgaccttggtcttatgaacgtcgttngatgaannnnncccccccnccccccagcgccnccggtgatttgcattcgccgnagcncancactcaagcttgcatgctggttctggtaataattatgtactcccctctagcgtggatatggtccgatacagcgattatggttctatcagtgatcctgttatgctctctttggaaatatatactattcaaaaatgttagattgagctaacgggtgatcttttctgggcttgcaggagtttggattccatctttctgtgctggaggttgacaggctttggtgacaacatggtgctgtgtaggtgatatgctaagcagctagtgatcatcagtacaatgggcggtgttcaaatggcattagattggagtctgtttccttttcttctgtaattagaccaacaatatcagtcatgtggtagtagtagtagtggccgaacaaaacagtagcaacgccatgaagtatgaactacccccgtccgtccgtgctaggctggtagttttatggttgttatccactctgttcatgtgtgtttagttcaaagaaaatctgttccgagtcgggatgatcagcaaatgattttgttcttctatgcactgagaatccagatgcatttatcctaattgcttgtctaattctcccttgtgctgcatactatgtttgtgaagttatttgaggttaacgatgtggttactaacatgcttagggcttgttcttttaatcccaaaatggattgaaggagattgggggagaacataggtgtggaattttatcctccaattccctcaatccccttggtctggggattaaacgaacgaggccaagtgtttgggcaaccacacgaggatattattatcttatcaagtgtcgtatcatctggtatgaacaatattgatcaccagggttagcattgcaattcgtacaggaaaccggatctaggttgcattggcatcacaaatcatgcacacaagaccatttgcacgtactcacactttccaaagtataacaagaatagcgattttatgggatgattaattgttattgttaagcatacaaaactgctttcctttttccgtattccttcatacattaagaacacccaaacatctcggggcccacgtcctccagaatggatttcgccgtaatttatgtcaatttgatcatcaatctaccactacaacttaaaaagt

SEQ ID NO: 22330 - DNA, 1501 bp, Oryza sativa
ggtggagggatgaccaggagaggaggtggaagaaaaccctagtttttgtggacctctaatgggctgtaaagatacaaggcccaagcccaagtttctaatgcgaaaactattttagccattctgagcagcttgggcggaatctgatgctgaggccacacatagttgaaagtagacgacgagatctttccaacaagtactcatttgccccatcgcacttcggagtgaagagcattgacttcaccaaatcaacgctgcttatgctgtttgcgatctggttcctctctcatattcctaacaagtagatcacaacaaccacttagtagcacccaattttgataagcacttgtatgattagctaggaacgactttacctaataattaagttcacgagctcgagctctagtgattggtccttactgtgcaataggcatggttgtatcgttggaaaggatgtcctcatcagccaggattacaatgtacagaccttgttccttacggactagaccttatagatatattacaatagtaaccaactaggattacaggatattttcttgatataagttaacataattcccgaatccttttctaaacatattctacccatatagactatcccttgtaaatatccatgctgtgtgggtatgtggtacccataatgtccacggtatcgcgcatagcataggtgcgagaccaaagcgctctcgcgcctttggagcacgagaccgcgtgattagcggtgccgctttttgattagcgatagtgttattgccttcgcgccgccgttaagcgagatcgccgtctcactaaacaaaagagagaaggctgtatatttacgtaaatctttcccaaatcagtatattcttgtgatttcggtaaaaaaaacatttttttcaattttttttcgttgttgcgcgcatgtgcgatcggcacagcgaggagcaacaaggcacggggtcgaggcgggtccggtgcaccgcggtgctcgggagcactttgcggctcacgggagaagaaaggagctgtatggcgcttgtcctggcccgctgtgtccgtcaggcttgcccgcggacggttgcggcgcacgagagcgacaaggccgacacggcgctgaagtgaggcggcgcacgggacggaggctgctcgcgcgaacaaatcctggcgtggttgacacggcgcaggacacgcgcgctgtgccaggacacgaaataaaggcggcaacgcaatcatgtgtgcgtgcgtggctaaacgagtcggttggctaggcctggaaggctcggctagcggctcacgggttttggtatttcttgacgacattagtagaaatataattccaagcaatgacgcagaaatacttctggttctggtatattatggttacagagttcatccgcaagcacacggatataccattgtagcatttaacccgagagtattccaagggtatcgtatttattttatcccgtgggaagatcatgtaaagagagattgactaataatt

SEQ ID NO: 22331 - DNA, 1501 bp, Oryza sativa
gaggctgctcgcgcgaacaaatcctggcgtggttgacacggcgcaggacacgcgcgctgtgccaggacacgaaataaaggcggcaacgcaatcatgtgtgcgtgcgtggctaaacgagtcggttggctaggcctggaaggctcggctagcggctcacgggttttggtatttcttgacgacattagtagaaatataattccaagcaatgacgcagaaatacttctggttctggtatattatggttacagagttcatccgcaagcacacggatataccattgtagcatttaacccgagagtattccaagggtatcgtatttattttatcccgtgggaagatcatgtaaagagagattgactaataatttatatattacttgtgataatcatattctaagcaggggttaagataatccaagggtagagtgacacacaagcattaacaactcattctcataataaataatctaagctaggtggaaagaaaagagaaaggaaatctattcctatacttaatagtatacatagtatagtatacatacattctagttaactgatatactagctaataccctctatccgatgccctcttggtacttcgagaagccacccctgactgccgagtttctttcgacagcccgtcatgatcatacaaccggggctaaatacgaaggaataccctccccaggaaattaactgtcggagatatgggtccgggggtatgtgaagtagaggggagttaccttccctccagccacgtggctctgcaagctggctgtcacgcccggaaattcactagtaatttccgaactaatttgtgcataaaatcctcgtctaggaatcagccgaggtacacaaactgacaatttaatatacaaatccatcataataataacgttacatacttacaaaagaaaagaaaaacagcagcggaataacagtctagcgatggcttcagctccactcccacaggcagctcaactggggtataagccaaacgtcttctccttctggatcctttttcttcaactgaggtttaatgattattgcaagaatgagcatatgacatactcaacaagccacacagcaaatatgcaagtacacaaggataccaaaggatggcataatatagtctcatttgcgaaagcagcatttagtaaagatttaagagtagtgaaacagtagagtaattaatcatcaattttaatcaacactgaacagcaccccaatgctgcacagggccaaccatcctgaacaaccgtacccggctgtacagatctaactccaaaccaggagctaaacaaattattaccagttattgcatcaataattatttgtgagagttgtgagactaatcaaaaaaacattgctcaacccgcccataaccgcgggcacggctattcgaatagttttactctggccagaggtgtaccactgtacctacaagacacgattccacacatgttgccatgccccgaagtaccaccacggcactgcaaagg

SEQ ID NO: 22332 - DNA, 1501 bp, Oryza sativa
aacatcaagaaatttaatcaagcaatatatcatgatgctcatgtatatcagaagtactaaattatgttactgtaaccaagcaacgtaaaatatgttatttagttaattatgaaactttgttaatagcagtccggctattacacattactctattagcattgctactcaaatagtattatttcataatgatcaattatactgagcaactcattgaggcttagttaatttatgcgcattcagcatcatatcattataaaaacaaatgaaaacccacaaaacatatataagaagtagaacatttactaccacgaaggaatgaaccatatcttcagggctcaccacacacgtccatcatccatatgtagtgcccgatataatttttcaacaaagacaaatctaccggtcatatattagctaagttttgcaggatttaattaaatttctgcttgcaaaagcatctggatttaatgatatggttttcatttttcagttttgagtgggccggccgagtggcgtgtcgtcacttattagaatgaatttgaactccaaggattgataccagaaaagcgaaattaattaacgtggagaagcatatcatcgaacttttacagtatgaagttatcatcagatctctaatatggaaaaggaaaaggattgtacccctctgtttggtaattgtggttccaactttcgtaagaacaattatgtaatccttgattatggtacttaattaagaagatactaataggtatcatagtccatattatagaaatttactctgaggtaccacacaaacgtttaatttctagctaatgcaaatttgtgaaacctctcaatactttcttaagtatcataaaaacaccctaatttggtacattcaggtaacatactctctctattttaaatgtcgttgactttttaagatacatttgaccatttgtcttattcaatatatatatatatataattattatttattttattgtgatttgatttattatcaaatgttctttaagcatgattcaaatatttttatatttacataaaaaattaaataatacaaatgatcaaacgttgataaaaaaatcaacggtatcataaattaaaaaacggaggtaataatacttataaaagatgtggtccatctaaattattttacactaaaaagtgatgacacctatcaataccatgttcctatttgtgtgttcatttctactctacatgacttcagccggataaattagcagctatcagtgatttcggattggggtgtaattgagattttgaaaagccggtattttcagtaaaaaaaaaaagcacacctgtatgatttgacgtttaatactacattgctttagtttgtggagtacgtcctataaagaaaaccgtagaagatttcccaggaaagaaatggaatcgaagcttaggttaatttagtttagctaagcttgctcgtacaacttgatccattacttaagcaccaaacagtgatctacctctg

SEQ ID NO: 22333 - DNA, 1031 bp, Oryza sativa
agcgaagatttgcgggggcaaatccccctgtttgaacgcgagagagaaaggggaaaatggggggaaagggagaggggatcgcaaggagtaattccccccactttattgcacgcggggaccgcgggaggcggcggtattcccggcggcggcagcgctagggcgcgggggaggtggcaggaacggcggaaggaaggggatgacgggtgggccccacccgtcagcgaggatggcgggcgggcccgcccgtcagcggcgcgcgcggggagaggccggatgggccgcggggagaggagagagagagggggggagagatgggccgggccggcccaagggagggaagagggactttttagggtttttctttttataaaacctttttaactttgtttatttcttaacaattattatttgtgctctgaaaattccactaaaatttatttacgtatttcaggcttttaggaaatatacaaaaatcctctaagccttatttgacttttaactttgcacattttaattgttggaggttttcacacggattttaattattctaggcataatttaaaggataaattttagggtcgttttgggacgtgacatcctcccctggtcctcctctttccatttcatggtattttgggctgatttactgatgtttcgataaagttcacaacccatccttgtatggatacagaattctcctcactttagtctagatttcctcaaaaatggagtttatcacctgcatacaaatatataccaacacttgtgaaatatgtgagattaaacacctatcactatgttggatgttttattatgtgaactttatgcagatgttggcggtatgagattggcttgtaacaaccgccaacagcgaaagccaagcttgggggggagacatctctccccccactgaggtaacttgtatcacattgcatatttccctttccaattgcatcttataaaacttaaaaaaaacaacataaaaatttgcaaaatagaaaatgccaaaaagataggataggtttgagtca

SEQ ID NO: 22334 - DNA, 790 bp, Oryza sativa
  unsure (1)..(790): unsure at all n locations
cgctgctgncnagtggatttgcttctactgcaagtagttcatcagtgaccggtctgtgaccggcctattgctgtcacatccgattggtagggtaatcatgtccccacgtcgcctctgtatccggcggagtgggcgtaggtatgatccgtcacatcggagcgtcgctcgaggaagggctgccgcaagtcctcactcatttatgagggaatgacagggttgttccccgtgtcaggcgggggacgacgccgggttccactcgagaaccggttgctgcttagcttccgggagaaggcatggattgaaacccagtcaaagtggagtgggatccccctcccatggagggtaggtagaggcggcgcatgtggtatccccttgaactataaaaggaggaccttgcccactgagatcgggggacgactcccagaaaacctgaactccaggagaaagaaagcgaaaacgctctccggagtgaggaaacctttgtaaaactcatccataatcccaaacacagtagtagggttttacgctccatagcggcccgaacctgtataatccgactgtgtgcaagctagccgttagtcttagggacgaacgagtgatttccaagaggcgagcctctgcccccggccgaactcacaaaagggggctcttacgactccccgctatcgaggatcttccctcgacagctggcgcgccaggtagggggcagttgcgcgtttcgagaagaaatcgctttcttccgtcccaagtttctccaggccttagccgatgatggacgaggtcctggagg

SEQ ID NO: 22335 - DNA, 1501 bp, Oryza sativa
cacatgtatttcagggaaaattgtctgttggaaccatggcatcttttattggttacacattcacactgacattcgctgtaagtatcagattttacttattgcatgactttttgtagcttgatgtgtttattgtattttggtcatcttacttgtcagaacatgcattttaggttcaaggagctgttaatactcttggtgatctacgtgggacatttgcttctgtagaaagaataaattctattctatcagcagaggacattgatgattcacttgcatatggtttagccaaagaactagaagattcaaatggtgcagtgcacgaaaatggcactgctaacaaacattacatgtcagcactaaaatcatcaagcagctgtagtaatcttgcctggtctggtgacattcacctagaaggtctgctcgccactattcatatttgttttatacatgcagttctttttccatttcaaaatatttttatgcatatgcatatttctttcatactataatcttctatacaataatttttcttaagtaatttgtctctagttccactaggcaagatgaagaagttcagaactgggatgccaaaaagagccaatttgcatctcacataataggttaatttccttttgtatcataaaaactactagattaagacaacaaaggggacactctcctcttcaaatgttgctggagtcatatcacttgcttgcctaaactacatttgttttagcttatgtagcatttacatggataagtttatgtcgatgtggcatccatgtagacaaataactcagcaaagctcaatgatataaaatagctctggctgtcagctatctcagccaaaactcatggggctttactttggtactgcctacacccagttagctctgcacttgaaaagccaaatcagccactgaactcttttgtgtcagttgcccctgtttgatttttctattcatgaagctttcatcttccttgaatattgattcatgcaaatgcgtagcgccatgacagagcaaccagagtaggcaggtctagtctgtgagcctcaagacaactccactcatgtacatgtcacaggggcagggtagtatggggttgtggtggctggtagttttgagctatagagcataaggcaaggacatcaagcagtcgcactgaagctctaatgtttgtgcagaaggggcacaaagtaggtagccttgctatgtccaatgagaactagctagtatttctgaattgtaaacgtccaggcaacaggttgtttagcgtggaaacaagctcctccagtgcctaatatctaagtaagaagaaaactccatgaaaagcaagaacgaaaacaaattgagctgtatgaagcataaaagtccacatctttattatcaaagacagaaatttgtcaacaccttcatgtggtgtagctcaaagttgctgaagccaagcaattttgcaaatgatggctcgagacatgcactgtaccaggatgaggcaacaa

SEQ ID NO: 22336 - DNA, 1501 bp, Oryza sativa
cagcatgtttgacatattaataactgaatgttaaccagaaaacatttcattacccaaagactaacctttatttaatgcaacccaacaaaatagtataagatattagtcctttttgcgcgaatataagatattagtccttatcctgctggtgaacatttaatttgttactaccttactggtggccattgcatactccctttatttggcactaacctgtactggtcgccttcctccatcttattttaggtttctactttaccataaatacctgtaatcttttcagtttttcacaacgtaatgcttatctgctaaaaaaactgagtgtttcagttgcaatggagaaagttagtacaagattctatgcatatccaagagtgttcaggttaagaagtgcagggctaaaaacctcatattttaaatttggccatattaaacctaacaaataacataaaagtatttctgggataaaaaggaaatttaaaatatgaagctcatcatcccacaccatcctgaatttgaaatattacagatgacatttgaccatatggacatggcttcgtcaaaggccttcaagtaaggagtactaaacagcattctgtatcttttctacctaattaagctgtacacttaaatcctattcagggtaacaggttctttcagaaatacttgccgcaaccaaaattatagttactcattcccttctgctatgatggctagtgatgcaaggaatacaacatgtatggattgggaaaatatcatcaggactgaagtcactgaactgtgattcaaaactcaaactcaactccagacctaaaacattcagacctcaatttcagtgataaaagtgcagatcatgtcatgcattgcaccacctctgttcgtaacaaggcactgaatggttctaagttctaacgttcagtgcacgggatttgatcgtcataaatgcatcaaaaaataaaataaaaagtgtcaactttccatagaaacaacaaggttcgttgctgttagtatctgtggagattatggataccccatatctacacgacagttataatttagtcggatatatggtaccaaatatagatataatatctctatgagtactcgggttaattctaaacttatatgtcaagaaaatacccgggatcctagtcggttacgattgtattttatgtgtaatcccatattccgttaggatatgtactgtattttgtaaagcggactccttcccctatataaggagggtccatgtgcctcttggggcgcgattcttttttcccagtttatacaatcaataacatactcggcggaatcatccccggacaggagtagggtattacttcttgaataagaaggcctgaacctgtataaaattctttgtctccgaacccatccactttcctaacttgatagccacccccttttattattgccgaaatcttgtttcgacagttggcgcgccaggtagggtagcgtcaagttttttgccgactaagtgcga

SEQ ID NO: 22337 - DNA, 1501 bp, Oryza sativa
tgaattcacatgtgttatctataaatttcagatgtttcatatagattgtccttgggatactgtcgaaacaagatttcggcaataataaaagggggtggctatcaagttaggaaagtggatgggtttggagacaaagaattttatacaggttcaggccttcttattcaagaagtaataccctattcctgtccggggatgattccgccgagtatgttattgattgtataaactgggaaaaaagaatcgcgccctaagaggcacacggaccctccttatataggggaaggagtccgctttacaaaatacagtccatatcctaacggaatatgggattacagataaaatacaatcgtaaccgactaggatcccgggtattttcttgacatacaagtttagaatctaacccgagtactcatagagatattctatctatatttggtaccatatatccgactaaattataactgtcgtgtagatatggggtatccataatctccacagtagcccccgaaaccttcgcagttgacagtaatagccttctcgaaacaaaaaacagtaatccgagtgcttcaattcaacttgccgagtgctaaaatcaaagactacgaagggcaaaaataaaacatggtgcatcgagtagatgcacctaattaggtgtagcccctgactatgtgattagttgaaaaaactaaacatatagtcaagaaccgagtggttatatagcgaagcacgcatggtacttagtaagatacccagccgactgcttctcaacttgaacataccaagaacaaaaatacaagaagggccgagtgataaacactcaaaggtccaaaaataggcatatttgataggaatctgagtaagaaactcgtaaaatgatccaccaaatatgataaagatcatggcaattaggaagtttaatagcctaggctataacccttaccataatcaaaataagcatataacatgctaggagaatgactactaataaatcagtcatctcaaattaacccaacagcttttgtagcctaaaaaagcttacaaaaatagtataacacctttctgtcgggtacctttttatgtgcatcataataattccaaagaattattgaattgcgttaaaaaagattttaacagcatcgggtcacatcattgtgagcacatattgccaaagcaaaaagcgcttaagtccctagggatcacaacgggccacgctgaaaacaaaattgggctgaagtaccgtacaggcccaggcccattagtactcccgataccctaaaaacaccgaagtccaaacgtcatttcgtcttccccgccgagactctcgccattccccgctccatgctacagtacagaaccgcgccgacgaagttagggttcatcaatctgctccaatcctccctcaaaaacttcacaaaatttctccccgcgtccaccgctccaattccccattccactctagccatatctcggaccaaattaaaccatccagttacattca

SEQ ID NO: 22338 - DNA, 1501 bp, Oryza sativa
cctgggagacactggaggggggaaatccactgcgcgggagtgcaactacccgtgtagtatcccccacacaatgtcttataagtcggactcactcaagaatagtgaaaaagaaacaacgactgaaaacctatgcggtacagtaactttgaacattgaagaaatcaagaaaatgccaacaactcccattacacaaatataagtatttctaagataaatataagtatttttaggttatttagtacatggtagggattaatagttacaagaaaatattttaggttgtgttctgtagctggtgagagaagatttctctagttctctacgtgcacgctttccaaattaatgaacaatgtgttttacaaaaaacaatctataggaaagttgctttaaaaatcacattaatttgtttttaaaatttaaaatagttaatactcaattaataacacactaatggttcacttcattttacatatgttctcaatcttccattttcatgtcaaatcaaacatagccagtgtccgttgtcaaggagatatgttagggcattagggggtgagagatggttaaagtgcgacagtgtttggaggtaaaatatgaaaaagatataaataagaagtgatttgatgtgataagtaataccgtatatattttttatatttgtgaataaattccaaatactttaaaatataggtacagccatatggcggattccctacaaaagagagaatactcagataggccagggtacaggggttccctataaaggtatggcgcattaaagacgcacaatcgacacaaatcaaatttatacttctccaaattaaaatatgagaaaaatcaaagaattgcacaaacgtcctaatccaagaaataccatcgacgaacccaacttgaaaatgtcatcgtacaaacgcttttgtcacagaaatactgttaccgttagatttccgttaataaaactccactaagtgctataaaagactattttacccatatgaattgttgaaaaccaattaaaacttttgctctttccatcaacttactataatttagagcaacctacaaattgtaagctgacggaaaaagaaaaacttttaattaacttttaataatttgttgagatagaatcgtctttttatagcacttaattaagcattgctgacggaaacctaacggcgattgtatggctattgtacttgatgtgatttgatgatataagtaatactgtataattttttaatatttgtgaataaattccaaatactttgaaatacagatacaggtagagttatttgtttttaactttcaggtacaggtagagtagattcgatttgatgatgtgaggctgagatccaaagaacagccctatttttttttgtctagtgataagcctccgcagccctcggtcctatatatatccatgcatggtacggtaataatcaaggaagcagcaagctagctaaagctagcccagtcatggagaaagagcagcaagccggcc

SEQ ID NO: 22339 - DNA, 1501 bp, Oryza sativa
ttttcataaatggacggaggtttgtatagttgccgtccgagtcaccttctgatgagacggcccacaactacctccactttcgccgggagcaggtgcgacgtggaatcgtggctgtctgctgacgacatgaccggtatcagaccagtcacgtcggtcattcttgtccaccacgtgtcagcttagcaatctacatgctcgcccttcttcacacaacatcttgcctgtaatggtttaggatgaagcctggcatatatctgaccaggactaacgtgccatctctgggaggtaacacgctagctccagctggggacgagcgcctagaagccctcgtcctgacgggatggggcgaggcgtgcgtcagatcgcctgtcgccacctaacccgcgatctgaccggtctgtgactggtcacagaccggataaacaagtgcactgcactgcgttacatgcggcgtgacacgctcagccaaaccgcaataaatgtggttaggtgagccccactgtgctcacctaacccatacacgcggagcaaaaacccacgaggggtcggggcgcctcggcactcggggccgaggggggtgcggcccgaccccctcggggggactaagaggagggcgaacgcatcaccctcgggcccgacgtccctcgggggtaccaggccacgtgtgcgattgtgtctgcctcaaacctctagtcatgatactcctgatcccatgtcaccgacagttaattactctggtttaatagaaatatcattctgagtaattaagatttactttgtgagaattaattattggttagttcctaattagcatgcaggatcattgttcactatagtccattaatttataatgattgcattagtgtttggccggcactagaatagttattaatatcatagacgcggtgtctaggtagttaatttccagtgattgcttcatatcccatagtaggtttgaggtgggtgtagagttggtgacaaccctcaattacactgaagtcctccctgtccgagtacgcggtagagccatatctgggagcagcgggctggccagtgcccgaagtatcgcgttaggattaaattaagctttccatagacattgtctcccactagtaaatcctctctaccctttgcctatctttgcttcgtgtccttagatgaacctggtaaagagttaacacacacgttccctgcagaaatcgataccttggaatactctcgggtcaagtgctacatcggtatcttccgtgcgcttgcaaattctatctgcgacgttaagaaataccaacaagcatttctagagccgttgccggagaacggttgttgtttatctctgcaccttgttcatcctcatatcctttttacttttctttcttctaccttcacccctgctacccagagaaatgttcttgtaaaactcttctcgcccatggagccacaatatatctttcaactatctgctccacggggcaaattttacgagccacctccttcatcggag

SEQ ID NO: 22340 - DNA, 1233 bp, Oryza sativa
  unsure (1)..(1233): unsure at all n locations
gtaaatgtgacggaagctttttctttttttctttttacccaaacacagcatggagagcctcctactgtaattttccattataaagagaaagttatgtacaacaggcaaaaaataatttttgagggaaaaataattacaaggagaatgaagaatgtacaacattggttatgctaaaagtcctagctatgatgtctaagtggttttttttcttttttttttttttgctctgaacacatgcacacgcaaagcaaaatcctctttgaaatgggaaaaagctttgatgtggcaatgccatgccacaggatagcaacatacaatgtggcacctcttaccacataaatagtgttgtatgaagctttgcggtggtaatgtcaaagaatattggcatggtcaaaaggttcaggttaaaaaaaaagtttgacattgttcgttgttaaaaaaaatgcttttttaaaaaaattaaataacaaaagattcagctctaattcacctatggggcgatacagtacatacantccccctcggggggactaagaggagggcgaacgcatcaccctcgggcccgacgtccctcgggggtaccaggccacgtgtgcgattgtgtctgcctcaaacctctagtcatgatactcctgatcccatgtcaccgacagtagcccccggcgttatgccagggcgatcgccctctttaagggaaacggtcgggcgtgacgccactcttaagacctggtgacaggtgggaccggtctccacaattgggcagaaaaccaacggtcacaaaccacgcacatcggcaatggtaactctgctgtcaacaatgagcggtctcttcaagactgccacattacttgagtagcacacgaatctggacatggcgattcgtttcgtctaaagatatggtaacgtcgcttcggtcggcgagcgtaattaatgcgcgcacgatatgatctatctcgactgccacaaccgcatacccacctcatgcgccgcaagcgggcgaatgggattagtggaagcgtgggcgcgagaaacgagggggcgaaatagtgggcgcgagaagcgaggagccgggcacagcgttggcaagagtataaaggcactgaggaagggatctgtttccttcctttcgccattattccccttgtcttcgccgcttgcgccctaactccttctttcctgtgccctaccttcgccacacgcgctcgctcttaatcttctcttcctccggcgcca

SEQ ID NO: 22341 - DNA, 1501 bp, Oryza sativa
gccagcccgctgctcccagatatggctctaccgcgtactcggacagggaggacttcagtgtaattgagggttgtcaccaactctacacccacctcaaacctactatgggatatgaagcaatcactggaaattaactacctagacaccgcgtctatgatattaataactattctagtgccggccaaacactaatgcaatcattataaattaatggactatagtgaacaatgatcctgcatgctaattaggaactaaccaataattaattctcacaaagtaaatcttaattactcagaatgatatttctattaaaccagagtaattaactgtcggtgacatgggatcaggagtatcatgactagaggtttgaggcagacacaatcgcacacgtggcctggtacccccgagggacgtcgggcccgagggtgatgcgttcgccctcctcttagtccccccgagggggtcgggccgcacccccctcggccccgagtgccgaggcgccccgacccctcgtgggtttttgctccgcgtgtatgggttaggtgagcacagtggggctcacctaaccacatttattgcggtttggctgagcgtgtcacgccgcatgtaacgcagtgcagtgcacttgtttatccggtctgtgaccagtcacagaccggtcagatcgcgggttaggtggcgacaggcgatctgacgcacgcctcgccccatcccgtcaggacgagggcttctaggcgctcgtccccagctggagctagcgtgttacctcccagagatggcacgttagtcctggtcagatatatgccaggcttcatcctaaaccattacaggcaagatgttgtgtgaagaagggcgagcatgtagattgctaagctgacacgtggtggacaagaatgaccgacgtgactggtctgataccggtcatgtcgtcagcagacagccacgattccacgtcgcacctgctcccggcgaaagtggaggtagttgtgggccgtctcatcagaaggtgactcggacggcaactatacaaacctccgtccatttatgaaaaggggggggggtaagtccccacaaaaaagagagaaattgtgcatgtggtatccccttaagatataaaaggaggaccttgcccactgagaggggggactggacttttccagattagaaacccagaacaagggagaggctggctgatactttgtagctccttcatacacagatctcccaaaacacaggagtagggtattacgcttctcagcggcccgaacctgtatacatcgcccgtgtcttgtgtgtttcctgtctcgcgagccttccacatacagagagcttagaatctctccctgagtccccggccgaaccggcaaaggggggcctgcgcggtctcccggtgaggagccccacgctccgtcatctggcgcgccaggtagggggctctgcgagggattttctgagctctcgcactctttcgtgtgcgccaagtttttcctgttcagcccaa

SEQ ID NO: 22342 - DNA, 606 bp, Oryza sativa
acatgatggagaggctattgaagggcattttttctttatacttgttaaaatttaacttggctagccatttggccattcttagatcggggtctcgggtctggcccgatccgcggctaacctcgagccgcattctcaaaccctatagttggggcccacgaccatgtccttctattagttccctcgttaaaaggtgctttattgttttgacggtgaaatgggtacacccattcccatttcgtcgacagttcgtattaaaaagtcaaaaaaaattgaaaaatacatcatgtataaaaaaattttatacacatatgaaaagtttgtgtttgcacgtatatatcccgtacgcataaaaaaaccaataaaaagggaaggaaaaaacaaaaaaaaataccgaataaaaaaaaggcccacgcgcggccctcgtctcggcgaattagcaattttgcacaaaagatgaagtgaacggagcgatgtttaatgggccgggcccgtgctgtggtaggctggacctctcaactaaagaaaaaggatattataaaaagagagagagtgtgttcctcttctcttagccccaaatttgcgatccaatcccctcctccttggtca

SEQ ID NO: 22343 - DNA, 390 bp, Oryza sativa
agtgcacggatcgctccgaaaatgtggccgcggccgcgactctcccgtccgcaggacggcacaatcgggcatgatcttgtgggaaaggataaggtgcctgtctgccgtgatgcggaaggaagggagcactgtgtcgctggggtcttaagccatggtgcccgacgaaaaagtgccgaagagcgtggcgcgtggaacagtgtaaagtggcgagaatattagggttcgagaagcgaaaggacgagtgggattttgagatagtactcctataccagaagaaacccaccgaaggcccaataaagtggaagcatataaccctatgcccttgtaaggtaaccctagggctaaccaccagcttcctcccaatccccaaatccaccgcgcagacacgca

SEQ ID NO: 22344 - DNA, 209 bp, Oryza sativa
aatcagtcctatgctaatcacgttaagtgcggctaattaagaacttgacaccgcaacgctgtacgcgggcgttcggcgcggctctttcatcctacttatatatcctagggtgtagggttttggtcggcaccgcctctcctcctcctcctccttcttcctcgcgccgcgtctcgtccccctcaccgccgctccactgccccgccgccccg

SEQ ID NO: 22345 - DNA, 1501 bp, Oryza sativa
attttagaagtcagttggaagggatgttcatgaagaagtttgaaagcttcgacaacattatagttcgtatagatggcttaccgaaaattgacaggttcacttaattgatttgtacactattttactttgactttgtgttatacctgtttatgcaactattatgtttgttacatttgcagattaatgtcacttgaggcttttgtgaaattgcctggaaatcattttgttgaaccaagaactttattcgctactgggagttcattaactgttgcaagtggtacaagagttggaagaatcatagcaacaggtgcgcttcaagaaatattgaaggcacatgctagtcgcaacagctggaatggcagttttaaaagaaagaacattttagtaagaaatggttgctattctgaaatctctatgcctttccatgctgagttcagcagggactctatgctcaatgattatatagcatattttgatgaagtgatctccctatttgaattaaaaggagtaggatgtcctgccttttttccttggatgcggaagtccttgttaagattcatgccagctccttctccatccttctgcgatgaattcaggcattttcaatgctttgcaatggcgcaatttgctttgaagcgtcctgtcgttaggattgggttcctttcaaatctttacaggctccggagatgtgcaaatcgacaagttagaaaaactctacttgccattcttaggagcttatcattaagatcagactggagggttattgttctattgcacagccatcccattctggtaaaagtgtacctattcaacaaaaaaaaggataaggaaggaaatggtggtggaaagacaaaggaaggaaatggtgagaattctaaggatcagaaaggtggtgaaaaaacaaatgatgcagattacaagatggcaaagttgacgaagtatgataattcagctaaccatcttgttatttacactcgccacgtgattgaacacgggatggatccagcacaacttgaggtaatacattctatcttttatttgtttttttttcttaacttgaacttgaatcctaacagaacattaaatttcttagagcgatgatgaagtcttggaagatgaaatgtatcaactagacgatgaatcaattgagatgctttcagagctagatttgctgtattcacattacctggagttgaatgacatgttggaagagttgttctacagtggtatgatgacgaaagaactttggcaagtgtaagtattttgttctcctaaaatctatcaatctaatccaaattaaaacataaaggagaactaactgtgagttcttttgtaggttcgaggagatattggatgtacacaacatggtggagcctctgtagtgactagatacacttttaatcactgatgtacgtctttattcatgaatgatgtatgtttttgcttatgaaacaaaatcatgagactcgtgtttatagtgtggtttttcttttgcaacagt

SEQ ID NO: 22346 - DNA, 1501 bp, Oryza sativa
agctgagttctttccccaactttcccaactcacctccctcgttttccgcgtgcatgcttttcaaactgctaaatggtgcgttttttgcaaaaaaaaattatacgtaagttgcttaaaaaaatcatattaatccatttttcaaaaaaaaaataacaaatacttatttaatcataagaaaatgcgtcgctccgttttgtgtgcgcaggaggtgagttcccaacctcacctcccgaacacagcctaaagtgttttgtgtgcacgggaggtgagttcccaacctcacctcccgaacacagcctaaagtgactgtatttgagatttatgagcatgctacagtttgtagcttattattgtaccataataagttaactttcttaggaacaaaatcagtcttatacaaattttgtcacatccagtcaataaccattggaatacacatgtaccgagaagcatattttcctgtttaccctacagcttacatttttagaagccacttaaactctgtccatcaacagtgataagtgtaagatcacagttgaagtccaggctctgttatgcttcatgccttcaaaaactacatgccctcaaaatagttttagtcagtgtcatactgtttacaacatgcaatgttattgagacactaaaatagtgaaattcaacctccttcatcacattggagtattggatatcagctttaagcctttacttgctagataatgtcttttactgctagtaaaacttcattgcaaaacatgcctgagttcaactcaaacacattcaaagcaagtagcaccaacacattggaaaaagaaaaggaactcaaaacactaaaaacatgcgaagaagaatctgcacacttatacagttctgcagcttcttctcctttattagttactagactagtttaacatgttgttgcagacttgcagtggtacagcaaagtaacaatattaagccagacattaacacattacccactctatatctcaattaaacatgtcctagtatataatgcatacatatctttgttctttgtggaaagagaaatttgtacgtcacagatcaggctacatcgaaacaaaggcagtgcaaacaatggttatggctagggaaattctagaatccaaatcaatctagagaagaagaagaccagaggcatcagaatgaaacgaagttcatccttacaggggtagctctgggttacaagatttaagccagcaaaaaatcagcgacctgccgctaagtagccagcaggacccccaatttatatataatcaatcatgaactagttggctaccggaacatcaatcctagatcaatctggcaaatagtagtccacaaacttaattgagcactagcacatgagaagtcaagaatggcatgaacaaagaaagctacgtgttgggactaatcgattggaaaaaagtgaagcaagaatgactcacgaggatgacgcggtgggcggggacggcgggggtgtcggggcgggcgggcgcatcgg

SEQ ID NO: 22347 - DNA, 1501 bp, Oryza sativa
aattccattgccttgtcacacttgcaggacccaccacatggccctcacaagaatgattacaatgccaccaaagacatcatgatgcaatagttcgcaaaacttcatggtcttagcggaaggtgaaaaatgtctgaatctgctataattgtttggacgatgagagttatgctgagatgcagtttattctgaacttgtgaacatatttccacagacaaaatggcaaacaaagtgggtcaatcatgttttacaattccgcatagcatatttcaactacagtccaattcatgaagtgtacgaatagggaacttagtttttttttaaacgaaaagcggcaaaagacttaccgaatatattagaaggaataaaagtcacagtacagacagggaaacaaagaaagcaactagcacgttaaaagagtcatgctatgaattcagaaggtcgaacattgactcttaaaactctttgggccatcagataggccttttagatagatctatttggtctatatttttcctttactaaaaaggccacctgattttcattccgcgagctttgctgaaaaattcttcgattgcgctcaagccgaacgttccactaacttgatggttcccgaggatcttcttcttcatggtccctgacgaaatgtggcaatcccaatagggaacttagttgatggccttctgggtgatgacgaacctaagaagcctaggagatgaaataactcaattttatagatgtttcgtaattaaaaaaatcaacgtaaaatggtgagggaagaacctacacgaggtgaccatcgtacaaagatccaatgttgaacggtgaccagttacatgtactctctcccaaaaatctcatatatcattctttggtttttccaaaaatctaagtcctatttgtagtcactttgtgctaaataaaattgttaatcggaaaccaagaagtcattctaatacttattggttgcatgttcattggtttgccatatggtgagtgagttaattgcttcttggtattgatgcaaaaataaataggtctcaaatttttggaaggagggagtataatgtaatatgattcctggagagatctgaataacttggttaatcatgtctactagcttgagaaatggtgagcaaagaacttagcagattgagactattttgtaattgaaaaattcccggtgcttcctaggccaaactattatggcgataagccacttgaaaaatcttatctccatcaattctccttctctttctcagcctgagatccttattcatattgccttttataggtcaggaaaagggatatggtgatgtaataagtgagctttagtgcaccgtcagatgtggagaatgggatgtttccattgtcttataacgaaatcgttaaattatatatggcagttatataaatattaaggataagatatgtttagagtccttcattattagcgaacagttgactatgcattgaaatcagctttcttgtctctatcgttgta

SEQ ID NO: 22348 - DNA, 1501 bp, Oryza sativa
atcaatcacctgcacctaatctctatagaccatagtgtatatacctgcttcgtctagatatttaattggttcccaaatctataactcaacaaatacgatagctattctaaataatttggcatggccaaataaactaactacaagccaaattatgattcaaacagattcaccaataatgttaagtatatatgtgtgagttagtatgctaagggcagtttagtatttaatttcctcctcctattgtacacaatttatatgtgctctttgagcttatccaaggtaacaattcaatcccccattttttttcttctctgaaattaacaaccaaaactgtccgtcagatacaaaatggatgatggatgagtggacagggcaaaatgattagcaaataagacagcaatatgagttcatggacatagatcattccagtgacttgttattgcgatgatatctctacgcttgggaggcaccaggaggcgtgagttgtatgctgtcctatacgaggcatccagtgcatgcatcgtctcatagaaggtcggacctattgtacccatatcgacaaaagggaacggttgtcggcggcattgacagagggtcgttgtaactttgaaacgttgtaatatgctggatcagaaatgagtatccgtaatcagtgtcataggcatgtagacttttgctaaacctcattaacaaatattgtgtctcggtgtcgtcatcttgattggttctcctatgatgttacttttgcgtttggtttctaatggtgattttggactgattttataacagttaaatcaatagtgctgtaatatactacttaaatatgtagttttgtgatagtatgatcaaaatatttatagttttacaaaatttactcaaatatttaatcatgcttttccctattttcttgatggtttagcctggcccatcgcgagaaagatccattttcttagctaggtagttgtgatatcacagggatttggctatggatgttgcagcataaaggtaggtgcgacagtagcaccagctacgggaggtgttcataagtatacgccaaagttaatgtaaatatataaaataattttttgtgatattgtaaggtagacacgcaagagtgcacaagtcaatataggcagaagtacctataagctagtgtgtccctttaacacaagcacaaattaaagcacacaaagagagacattagctgttaatccctaacctcactagctaatttctaaaaaaaaaaacacccggcccgtattgtgagcactaaagatttaaatttattgatatatatatatatattgaaaattatatgctactaccgggagtagctactccctctctatgtgccctcaattcgatcgctactaatgccaatgactgttaccgggtctaatgaatcgaatactcccacccgttattggattatgggttattccactaacccgatccagtaagcggagagagtaactactcccggtagtagcaaataggtggt

SEQ ID NO: 22349 - DNA, 1501 bp, Oryza sativa
accaccccgtggccgccatggtgcgcgaccttccgcttccagagcggcgactgtgcgcgtgcgtggtgacgaactttgaaggctcatgtgagtatgatgagccaacggcttcggttgtacgtacatgtgattagttgaattctttttaaattgcaattaattgaaaagaattagaccttagcttccatgtctaattttaattctgacatatcgattttttcccatcgcatatgtatattcaccaccatttccaaaaaaattcacaacaatcttaacagctgatctctactattaaaaacatatatgtgggatccatttgtcattaaaaaaaatgtaggcccacttgtcatcctctcctccctcaccttccttatcttctccattctctcttccttgtgcagttgggtggtgagggcgggaggtggaggagagggcaacagcgagcagcagtagggcgccgctcgttggcaagcagtgctgtggcgaaggtgaaggagagggcagtagtgggcggcagctgggcgctgctcgacggaggggccagagggaggcctttactccatcgccggctttgctgacgacgctgccggtggcccctcctttgccgccagagaggggaatggtgtgccgtcagtgcggagagggtgatggtgaattggcgtgccgctgggggaacggggaacggggaatggtgtgtcgccactgttggagatggggctaggggatcggcagctcttcgccttcacctctacctccacctcctgcctagatgggttctgcgagctcgagctgtcgtgcttcgtgatggatggggccgatgctcctctccctcctttgccgtgcgatttcctagagatcctaacatccaaggagagccgccccgtcactccggctctcgcccgcccaccgtcattgccgctattccagcgcccatcctctcgctccgacggccgaaggggattgaaagagagagaagggggagggggaggaggaagaaggagagagagagagtgtgtgacacgtgggcgtcgaaaaaatttgtgttaatgacaaatgggtcccacgtatatgtttttatttttaatgctacctaagcaccacatcaacgtcaaccttgccatgtagacttcacatcagcgaaaccaccctccaaaaccatcgagggtgtaaaattacaccgggttttaatagttggagggtcgagatatccgtattacggtttaagggtaagaatcggattcagagtaactagtaaagggagtcaaagtgaacttaatcctacggcgacagagggccagaccgctagagatcaggtcgagcggcccaaatgcacagcacagcccttggattttgctacacatacacaccttcccgacccgaccaaacgccgccttctccagcttccttcctcctcttccactaccctcccctcatcgccgccttcggaagccctagcgaagcgagcgcccaggcggcggcggcggaggaggagcgagcgcca

SEQ ID NO: 22350 - DNA, 1501 bp, Oryza sativa
tatcggactccctcctaacccccctctccgcccgcgcccccgaacgtaccagtaaaccctaagctaggtgcgaaactgtaacggcggaagcgagcgagggagggtgggggagaggcgaaccccatgtccatgtcgttgtagtcgtcctccgccatggcgctcgctcctcctccgccgccgccgcctgggcgctcgcttcgctagggcttccgaaggcggcgatgaggggagggtagtggaagaggaggaaggaagctggagaaggcggcgtttggtcgggtcgggaaggtgtgtatgtgtagcaaaatccaagggctgtgctgtgcatttgggccgctcgacctgatctctagcggtctggccctctgtcgccgtaggattaagttcactttgactccctttactagttactctgaatccgattcttacccttaaaccgtaatacggatatctcgaccctccaactattaaaacccggtgtaattttacaccctcgatggttttggagggtggtttcgctgatgtgaagtctacatggcaaggttgacgttgatgtggtgcttaggtagcattaaaaataaaaacatatacgtgggacccatttgtcattaacacaaattttttcgacgcccacgtgtcacacactctctctctctccttcttcctcctccccctcccccttctctctctttcaatccccttcggccgtcggagcgagaggatgggcgctggaatagcggcaatgacggtgggcgggcgagagccggagtgacggggcggctctccttggatgttaggatctctaggaaatcgcacggcaaaggagggagaggagcatcggccccatccatcacgaagcacgacagctcgagctcgcagaacccatctaggcaggaggtggaggtagaggtgaaggcgaagagctgccgatcccctagccccatctccaacagtggcgacacaccattccccgttccccgttcccccagcggcacgccaattcaccatcaccctctccgcactgacggcacaccattcccctctctggcggcaaaggaggggccaccggcagcgtcgtcagcaaagccggcgatggagtaaaggcctccctctggcccctccgtcgagcagcgcccagctgccgcccactactgccctctccttcaccttcgccacagcactgcttgccaacgagcggcgccctactgctgctcgctgttgccctctcctccacctcccgccctcaccacccaactgcacaaggaagagagaatggagaagataaggaaggtgagggaggagaggatgacaagtgggcctacattttttttaatgacaaatggatcccacatatatgtttttaatagtagagatcagctgttaagattgttgtgaatttttttggaaatggtggtgaatatacatatgcgatgggaaaaaatcgatatgtcagaattaaaattagacatggaagctaaggtctaattcttttcaattaatt

SEQ ID NO: 22351 - DNA, 1501 bp, Oryza sativa
gatggcaccgaaaatttttaaaattggaactatgcctctacgtgactctttctatcctccctgtcctctctcacgccaccatcctcaccgtcacgctgccctcatcctaccaccaccgccgcggccgacctcgcgctgcctccttcgttgacaacgacggcaggggcaacgacgcgccgaccagcggagcacggcggtggcagcatgcgggatggcttggcggcggctccggactccgacgagtcggcggcggtttgattccctccaagacccggcgtgcatgcggatggttctcgttagtgaggtcacaaggatggttcatgcacaaggaatcgacacgaagctcaccgaagcaataggaattgaagattgtggccatcggtcggagtcgaggaagaagacgccgatctccctccttggtgcaccgatccatatggttcttggagcatcttgaagaggacatcggggctaggctactggcgaaggagctcggcttggttaggttcacattggccggaatggcaacgacgtcatggaggcggtgttcggtgcgcgctcccgagccgcggtggcgtggtcgcgttcgcgatcatccatagcatgaaaatgggcgaggttagcggggatggaaccggtgtggtgaggagatgatggaacaaggaaaagatgaaggcatccacggagacattggagaatggagacattggagcgctctctccctcgacttgctcggttcgggaatggagtaggatataggacgacacgactgggaggagatgaaggcaagcctccccgtgcgtgcgctgctggggccaagctcgtggagccccatctcgctcctcatgctcctctcccggcggcgacgctatgcggcgtgagagaggacggggaggacagaaagagtaacggggaggacggaaagagcgacgaagtgatatggtttcaattttaaaaattttcagtggcatccagctgataacacgaatagtagtggtatttttttttaatttgccatatttgcaatgacatggatccaattaaccctttttaggggagtacacacaacgactcattttgctatcttcataataaattgagttgtgaacatcatttaaatactataaataattgcacccattgctcctcctctcgtgaagttcctctctaatataaataattgttgccattgattattttccttctcaaagttacagccacgtttagaacccgtgattccttttcgaatatttacgtgtacataacaaattcctgtaaaatttccacaaatatcttactatcaaatctggtgtgacctgtcatctgaaaaaagaaaaaactgccgtgacctgaaatgacaagtggacaaaagacgtgataaataaaccctgcctaaatgggaattaaacaacagccagccagccaagccagccagcgctggatgacgactgtccacaacaccacgagagcacgagcaaaaaaaacccaactaattttcttttct

SEQ ID NO: 22352 - DNA, 1501 bp, Oryza sativa
cacacatatctccattgcaacaaatcactcacatattttggaaaccctctgttaaaggaatttggtttattttttgttccaccaaaaatattttatctagtgcactcacaatgtttcactatatatagatctaatgttgcagtgaactgaaatactccattgcaacaaatcacccacatattttggaaaccttctattaagagaatttggtttattttttgttccactaacaatgtttcatctagtgcactcacaatgtttcactatgtatagatctaatgttgcagtgaactgaaatactctattgcaaaaaatcacccacatattttggaaaccctcgaattcgttttattttttgttccaccaaaaatgtttcacctagtatactcacaatgtttcactatgtatagatctaatgttgcggtgaactgaaacattatttcgctatttgctgaaacattgtttttatataaggtgaaacaacacccaatttaaacgagtgaaacattttcgatctacttagtgaaacaattccgatatacttggtggaacatcgtgcaatatttaaaaataattaaataataagctaaattttttttcgtccgaatatatctatgtgtagtcttgtttgatttaattgcaacgaatttaatggtacaatcgaatcattatttagataagtaatttaagagaaaaatcaatttaaaataattttgcacgtaaatcggacgctgacatcagcgcccgattttaatcccctcccattgggcgcgagtctcctccataaaataggtaacataaactgatattttagagtattattttatcgaagcgcaccgttagaagtggcaatccattaattttcttgtaatattactccctccattccataatataagacacaaccactttttttaatgttccataatataaggcatacatgcatatagaccattaactatgatctcttctccattaaattattacttttttaaaacatccactgtcatgttctctaattctattggatgcatgcattatatttattagggtgatctaaactacaagatgataataattattttcttagtctttgggttagaggtgattatgccttatattttagaatgggtggagtactatttactaatgctgtcccgttttacccaccatcgcaaagccacgaaggcggcgatggccgttgcgttgggccggcccaattctctgctccgattcctcaaactgtcacctacccatgcagttaatgcaaaccaaccaagcaaaaacgcgagggaaaggaggagatcaggagatggcgccgccgatggagcgccggtcgccgtcgctcgcggagtctcgtcagtggacgcggcgcttcctccgcggcctcggcgtggacgggaccctcccggccgccgcggagctccccgccgcctactccgcgctcgtccgcggcgtcctctccgccgccgtctccgtcgtccccgccaccccggcctcg

SEQ ID NO: 22353 - DNA, 1014 bp, Oryza sativa
  unsure (1)..(1014): unsure at all n locations
tgtcttttttggaaggatgtacatgaggaaagacaggatatcatatatttttttttaaataacgtgggctctgcttagtactaatgagtgtancgttcgcatgtttttttttagcaagacacactcacgtggggaaaagaatgaaccttttttttaaaaaaaaaaaaagtagcgcatcgctggttagaggtattacgctagcacgtgtagtctagtcgcgtccttctgaaagtgcttataagaatatggtatacatgtgtattcatatgttcaaacaataaaaaatggcgtgtgttttgtggaaaaaaaactcgtcgtatagaacagatataaccatagccagttactcttatttaatcttagatggatacgtggcagaaagtagtgggcggtggaaaagtaggaggtgcgtggcccgcaattttcggaagaatccctagctgcgctcgtcgcccctaccttctagacaagggtatgatgacatgtaccgatcccaaaacaatcagtatcagatacgatgacatctagcaccccaaagcgatggttttggttgctatctgcaattgtccaaatgtctaatactatattatatgtggaaaagtcgtgtaacttcattgacgttggcatattgtactatcagtacgtcctgtggtcggggtctaagatcatatttttcggtgtgagttagaactaatctcctatacacgaaaaaaaaataaattagcacataattaattaagtatttgttaaaaaaacttaaaatggattaatgtgttttttaaagtatttttcatgtaattttttttttacaaaaattgaaccgtttaatgtggaagtgtaagttgggaaacacagtacaaatagacacttataacatgcgcacttttatccctacaaacacacacggacacccttctatgtggtaatataattatgtgaggagagtgagacgggtaaccaaacgcccattcttacccgtaattttttagcttatagatattgtagtgaaccaag

SEQ ID NO: 22354 - DNA, 1501 bp, Oryza sativa
atcaccatttggcttcagttccagtcaaaattttgctctgcgtgcttaaactaaatttagagatcgaacatgctatgaagattatcgaactaatggctactatgtgctaacatgcagtatctgcatagcgcggcgatgactgaaatatttgagcacattggtttatcagagaagcagacaatgtcctctcaaaagaagaatcatggacaattcacccgaggaacacaacgatcagggcctgattaagtcataaacccagtgctcaacaaaatctgcttggtaaagacccatcttccaaaatccatggattataagtgtcaggaataggagagtgctccacgacggttgcaacagtcgggatgccatatatcagtattcagggttgttgtataatactctaccattgccgtgttttactgttgagatcatcacaacgctatcttaagtcctatctggccctgtttgtcacaattttccttccttttgtactcgcacaaaaaaatgggagagggttccctttgtttttcagtccacatgccactaattgctggtgctaaattcaatataacccgcacatcgaccattattgcgcaaggaatcctgcatctgtgtgtgacatggtgatctcactttcatccatcttgtttttttctactcaagagcaattgagcaaagagcagagcaagatgaaaacatgagggcagaacagaagagcaaaacaaagcattttttctgtacttgttttttttttttacataataagtgatgattgagtccgcccaacaagaagcccatatttcaccgggcgatatgttttggcccatactttgccgtcagttttgtgggcccacttaaagtgatgggccgatttaactggcccacgcggtgaaggagcagcccatatatataataaaaaggaataagttcactttaggttcctcaaaattgacattgagtatcaactttgatcttaagacagtatggctcttggttttattcaatactacctttactcttttagaattaatatttgaaaatgtatttgtaaatattgtatgaaataacacaaattaaagttgtatagttgactgaaagtgacatattaattagctttagaaaatttagggccccaatttacattttgttccgggccccaaaatcctgaagacggccctgctgcctgcctactttaagttgtggagaacacaaaacaaatacatgagctgatcatcttcttaatcatatatccttcaaatcatatgcttgattgatgtgccacgttggacgaaaccggaagtcgtactgcattgagaccaaagttgacacgatattgggagttggggaatgaactgtgtctggtatttcggttcaaagatgaatttcatactcgacgttaaattgaaggacctaaagtgaataaaaaaaccaccaatgcctcccaggcctaccactggacaggctcaactccatgagctccccttgttcatagtctctaaatatc

SEQ ID NO: 22355 - DNA, 1501 bp, Oryza sativa
attgtagcagtttggaatgttttagataattcttaaatcggtttgtcttcagcaacattgaatggttgaaaaatataatataatcatgtagggttccttttaaatgcacaagaatcagttcaattcccatcggaaatggtaagaattcccttattccaaatgtatgaatagagcaatgtgggcaatgtgagaaaggagtgataccgtgaccaaggtatgaatggactagatcaatggcaagatgctttgtacttcttggtagaaattcattttttttccttctctttcacactctacttcggagtatcaggatatttaatgaaaactatctaaagaggtgaagtactgggtgatcatagcttaagctatgagctttgggattggtatttgctgctgaactgcttatagtaggtttaccttattctgcttggccaccattaaccaataaatgctgaaggaattttagcaattccaaattccaatgcaggcgattttgcacataccagctgtaaggaaatgaaatcaataaagctttcatttagttgttataaactaacagtattgaaacaattcagcaaaacatctgaagttccataagtaatactctcctatcagcaacatttggggcctttttcacaagtaatttatttttttgtttggtgtgtttaaggcttatcgtaccacttaaatccttaaatccatgatgtgctacacccaatgttcaccccacctgtgcatcaggtccatggcttgtatttacagcgttcttgcagtactctcatgaacaggcaacactgatgcaacccaatcaagttacctactccactgtcctaccaaggcacacaacagaggtaccatgccactatacacagagaggatcctgagcctggtcatgcatgcgactctcagtcccttgacttgtttagtcccctccctccctttggtcaggactatccacccttgccttggtaagttcataatgtgttttccagtctaaaataattactattacttactgacccgagttagtagttgactggtacacatgattgcccaaaacaaatatggttgcttacatacaaaaatcagtatgtggctgttataccatattttgatatttacatggattacctagaagaaacggtagacttccttccttcctgggtgtacattatctcatgtctatggtaagtgaaaacctgcacaaggtaattctagtaagcatattatgtttgtgtatataatcaaaggataaaaaaacagtaaaatagatacatctcggaatgacctgagaatagtcacattaggaagctctgacagtattccattgtgaaattatcccaaacagctgaattaatcaaatgccagataaaaatcttgccattttaaaatcgatgatggatcattgcaaattgtgtcatcaccattgcaatcttgttccactaatgaaacaagaagttccatcattctttgcatctctcttgactgatggagcatcata

SEQ ID NO: 22356 - DNA, 311 bp, Oryza sativa
agttcaataacaatggtcctctctctctctctctctctctatctctctctctctctctctctctctctctctgtaaagcatttgtgtccattgatctatatatcatatgatctaagcccatcatttaaatccagaacttagctctggaaaaactagaaccgtgtatttaatgctaatctttcttgagagtgggcctatctaacattgtgatagatcatatccccatatatataaagtggtagtgatcgatgagattatgacagaccaatgaatcattgaattgttctccttcatctcctgcttccaatagt

SEQ ID NO: 22357 - DNA, 1501 bp, Oryza sativa
gagaattcgctttgatatatattttttctagaaaatcatgagctgagtctgaaagttagcatgcaagttttttaaagagatctcttataatactgctcctatattttcagaggcgaacgaaattaaaaaccgactaattcatggatgacatactaaagtaccaacaaaaacatcttcaatttttataacatactagaaaaaatgcccgtgcgttgcaacggtaaatactattttaattttattattgttataaggtttagctatggtaaaattcaccgtgggaattcggttggatatttttttctttgaaaatcataagctgcaattaggagtctatatttcatctcaagttagtatgcgagttttttttaaagaggtttcttatacgtctccttttatatttccaaaagcaaataatcttaaaattcaactcaaacatggatctgtatttctaaaatcgaatgaacttaaaaaccaactcaaagaaagataacgtatgcaaaagtatcttcaattttaatttttataacagtagagatatatataatagtttcgttgtgagaattcacttggatatatatttttctagaaaatcatgagttgcaattataagtccgatcatcttttaagttagtatgcaagtttttttaaagagatttcttataagattcctcattatttccaaaaacgaatgaatttaaaatccgactcaaatacatatctatattttaaaaagcaaaaggacttagaaaccgatcatacacggatgatgttccaaagtacagtcaaaaacatatttaatttttataatagtagagagatatgcatatgtatggaacaagttaaaaataattttaggaaggagggactatatccggaagtaaaagttaaagttatttttataagagtaaggttgtgttctttctccttctttcccaactcacttttttttcgcacgcacgcttttaaactgctaaacaatactttatccgtctcataatacaatggattttaggtggatatgacacatcatgtctgtgtcacatccacttaaaatatcttatattatgggacggaaggaagtatattctttttaaaagttttctataggaaagctgttttaaaaaatcataataatcgagttttcgagcttttgagattaatagttaattaatcacgttttaacgggtaccaccatttttcgtgtgggggagttggaacctcccgagtatcgtttaggaccgttttccgtgtgatcggcagcggcacagccatacgcccatacccataccccggacgcagacgatcgcaaaccctctcttgcccagttgagttgccagtgcagtgccagctcctctcgtgatgcccgtacaccacgcccgcggtatccgaggaagaggaccccacttacagtggaccccacctaccagtcttgtcccatggaccaatcccacgcggtgcacagtgagtgccacagcacagagtgagagaaagaagcagc

SEQ ID NO: 22358 - DNA, 460 bp, Oryza sativa
gctgctgctcgtcgtcgtttgtgcaattaggcaataggcttaccgaatcaactatttctcctcaaaccatataaaatcaaatagatttatttttaaatatataatggttgcatcgatggtatattttgttttaagtgctgctgaaaatgtaaaggcatgccctcgggtggtgttattttctcctgaagataaagattaagtgttttacgtaaaataaggtggtattaatgtatgattaattaagttttaattattacaaacttgaaaaacaaattaatttgacgttttagaaccactttcatataggaatttttttttcacgaaacgcaccgtttagcggtttaaaaacgtgccacgagtatccagaattttatccaatttcattcgagaagtttaatagcagatacaataaagatgagtcagcgggtgataaattgatccacattacctcaattctagg

SEQ ID NO: 22359 - DNA, 1501 bp, Oryza sativa
ggagggggcaactccttctttttatattagtatagaaattggttattagatcggttataggtgaattggagcttgtaatgggctatactattaaacttgctcttatatcgaactagcctataaagaacgggaaaactccttgaaaaaaacatgtagaagattgcaaataatattatcatcaacacatgaggggtatctctaaggcaagtataataacatcatgcgagcatactattagccggtccaacttagcattaatgtgctatgggtaacctttgtaaagcttaaccgagcatcgtagggcttacttcatcacacatagctgtctttactttagtactttagaaggggagctcacatgaaaattaatgtaacttcttttttaaacttttctttgttttttcatggtactatcaaagggctcctattatttttccatattttttaattcctttaggatttgagaatcgtctacttcaatttttatgtttttttattcctagtttttttctatcctgtaaataaaagagaccttaagattaggaagaggtcttaaacattatttgcgtttaccacaaataaaaataatgccctgagaaccagccaccatggatgatggatgggatagatcgatctccaaatacactatgaattattcaaagaagcgacatcctatgtataaccgatcactacgggagaagttatttttgctgggtcaggctatttccacaatagtcccggtttaaaaaagaggccggccatctttagtcccagattttccctcccggttcgctacctaggggttacaaaccaggagagataaagggtttctccggtggctgtaattttcaagcgatatgtggcgacctcactacaaatcgggcgcccctactactgtgtgctgcctgacatacttacatgcacaacctccatgcatgtgaactaacgtactacctctattttttaatagatgacaccgttgactttttctcacatgtttgaccattcgtcttattcaaaaattttatgcaaataaataagatataaatcacacttaaagtactatgagtgataaaacaactgataacaaaataaattataattacataaattttttgaataagacgaatagtcaaacatgtgagaaaaagttaatggcgtcatctattaaaaaaaacggagggagtagctatatcccctttcactcatctcacttgtaaaaacaaacttttaaacgatttttctattaaaacaattatacgatctaaatcgttatattccctataactaaatccctacaatcagatctcacgcaagtatattttgataaaaaaatcaaccattgtttcactctttatagaacattgtttcagtttactgtataaaatattttaaagaaatacaacatttaaaacggctaactgcaacatcaacaaacacttatatgaaacattaagtccgaacaagtgaaacacaaaaataatcatatgaaatatatgtt

SEQ ID NO: 22360 - DNA, 409 bp, Oryza sativa
tgaattcatgtagatccagctttgcacatcaagacattagtttttatgatgaaatactgcaagaatctatcttatgagtagaatggaacgagaaattggataaacaatacaataaaacacatgcaaaatgcttatataaccttagaatcccattgaaaaaaaaaaaggtgaagggagatgccaaccttgccaactcgagattcaggtaaggcacagattcaagggttaattggatccatggcatgccattgcatatttgtctagtcagaaaaatgccattacaattcgtctattcgtagccgtgccactgaaattttacaaaattagaatcgtgccactaccgtcatgttttccatccatctccttgatttttcatcttctttatccagtcttctctctcctctctaga

SEQ ID NO: 22361 - DNA, 1501 bp, Oryza sativa
aaaccactcctcaaatagacactgctgctgcttgagtgggagggttagtagggcctgtcctagattttcctccaaagatcttacatccagacctttggagcatcgctgaagccagccgaaatcaagcaacatcgggctgaaccatccgtagaagaggaggctcctcagctctccacggcactgaacttttcctttgccgagtgcgatgaaaacactagcagatattcggcttagttcatacctcatcatgggtgatgcctgctcatgtatcctgatgagcctgtcttgctttgcccacagctccacaaactcttcagccatgtcaatattcacaagaatgtccaagagccagttgaggttctctgtctgctgagagattctctcaataaatggtttactgcccttgataactaatgcttgagcagtgtggtttgtagcctctgttgcttcgtcataaagatccactagtgaatttaaacaggcataacagatattatacaggctctctctgtttagccctgccatgtctttttggtagacagaacttttgcttagaaggccatttaccaaagattgcatatcttttcttgcaccactgttggtgctgctcgtgactgattggataagatgcactgtgaggtcttctgagctgctccagctgtgaggccgcaatctagccagaacatcttgggatattgcttcatcaaaagtacatcttgcaaagagattcttgagcttctcctcctcgttctcattccatggaactgcttctatgtatgacaaacacaatttaactcctctttcaaacatgattgatgaagacacctgcaattaaagcattaataaacaaattatgtacgtgattaattagttggcatttaataaactcattaccaatgcaagaaagaagcatttaataacatattattctgtaaatccccacttgagaaatatacatgctagaattgaaaagatgttacaaagatattggacagcaatggtggctgctttatttggatcactagatagcaattatgggcaacaggaatacttgcttttaattgcgggcctagatgcattcaaaccactaaatgcatttgtagctgactttcatagctgtagaatgtgatctaatggacatcaagccatagaatgtgtatggttacaagacttatagtgattgtattattatctaatccatgatttaacatattaaacaaacaataccagcatgcaaacaattcacatagaaagtgagtgatctacaacatctaatatggttataattatatacttacatatcactttgcataacttacatgaaagcaatggtttaataaaagcattagatgatattaaatcactaatatcccaggtcaaatgcttctcacacaatcatatcatattagtttcactcgaatgctagagctatcgttgtttggcatatgctgattataagccgtaacggcttatcagcgatcaaaaaatattccgttcgtaa

SEQ ID NO: 22362 - DNA, 1063 bp, Oryza sativa
gtgaaatttcttttacattataggttgcatcaatgtgcttttagccttttactaacaatacagaacacctgggtgtgtggctactctctgcagtaaacatggtcctctcctcctttctatttttgtaatggatttgctgtagtattgattctcttgcagtacttatagatacaactactgtgctatgtaaaaaaaatgaggatgcatgcaaatggtcaatggacttaactatcctttgtaacttggaatttgtaaacatgatatgctacactgtatcacttaaatctgtgtgcccaatcaattttagatcaattgcctaatttatgtttctttttgaactataaatcaattgtcaattgacatgctgctatggatgtactgcagttccaattctcatgttatatcttgatgtggaagttcaatcctcatgcaagtgattctacaactactgcatcttaatttgtacagtatgactctacaactactgcagatgacctgatgtagagtcacttcaccatagtcatgagtcaagttagatgttccacaactggttaagatgctgttttatttgcagaaaaagcattttgtcacatatacaagatgtggcagaatttatagtaaaactgtgatgattgtatagattgtctgatggcctgattgttgtgcatgttccttgtcctgaccattatttttcttagggagtgcataaaaaattgcactcactgtgaaactatggttcagctttcattttactaggagacttttatggtatgtactgcattcagtttttggttcattaatattgttccatattcatattctaattgagaaatactagcctgctttcccttttttagggtgttggtttctgtttccttcatctggcatattaaatgggttgagtgttgacgtatatgatatgttggatatctactttcactcaatgcacgatgccaatttgaagtttaccagtttgaaatgtgcacattttaaattatttattacttggaactttatatacccttcattttcttaacccaataccttgatatgcaggatttga

SEQ ID NO: 22363 - DNA, 621 bp, Oryza sativa
attcctgcagcagtttttgatgccccatgcatcctctgccttttaaaagaacaggtaaaaattcatatctggagtacttactgtaattgctgctgcaatctaatggctttccgggaaaaaatcgcattaagttaaatgctttggacatactcggtcttaatttttctctgcagtgcgtatagagcatttaacttctgcacaaactgacttgacaaatggtgaccactggtctgcctggccacttttaaatgcacttacattgcacggctttcacttaatatgtaggtgttttgttactgtttgttgatcagaagttcataacacaatcatggctttgcatactactagctatagggggtaaaccctttcaaaatgcactgggagggcacagttgctaccctgctgatctactctgtcatttatgtcttgttcacatcacccgtaggagccaggcggttcctggaactgcgaggtctcccttgcagaaacaaataagatccaagcaagatctttagctttgcaattggtttgttttgaatgaatggtagcgactctaggaactgcaatatttatggtgcaattttatgatcatacgttacccattttatggtcatttcatga

SEQ ID NO: 22364 - DNA, 283 bp, Oryza sativa
actctggagtatctcatttcaaatcgtggcgtctctgttttattgagctatagcggtatactatagccttctttcccctgttcgcctacagtttttcaactttcaacaactcccgagttgatctttgcgtctcctattagttccattgtttcagcactggagtaatagttctagctgctgttcttgaatccttttatccacgctctctacacattttttttgacgcctctgttcgtggcattcgtcgtgctgcagataggttgattcaccatgggccgcgcga

SEQ ID NO: 22365 - DNA, 571 bp, Oryza sativa
caattcctgagaactaagaggctaagaaaattccaatttctccccagtcccaggaagtggtggagagattcagcaccttttaagcccaaatgctggtaaatcccaagcacagaacaactataccagtgcaggtgatttatcatatgaagggatctccagttgctacagtttggagcaagaattatcatcctcagtcagtttgccacgctagctatatatgtaacatggagtgttgagttatcacatattttctacgaagtgttatgttacgtagttcagtccagagaagagtttttgcatgtttcacttcctgtatacttgcagcatgtatgtgtagcccatgtgagttgatagaatgacagttgtattctactataattatttgtgatcaatatccttgtaaggaatgacatggtattgtaatattgtatttaagctacggtggcaaagtgaacaagttcagtaataattttattactccattgccaatgtcttgctcagtaagggtcaccaataggtatctgactaataactcagtttgtagtatgctggatctttttttccacatagc

SEQ ID NO: 22366 - DNA, 1501 bp, Oryza sativa
catgcgtccgcacgaggtcgtccggcccccatgcccgcgacctcacgctcaatttttcctccacgaatggtcagcacaacacgtgaggatttgtcgaaaagtctatccagaaccctttttttttcattttccttcgtttattgatcggatggatagcgacagcagtttgttcttcctcctctggtcataactcattaatctctctatataggttttggtttgatcattcgttggatccagggggcaggttcagtgcacccagagaatggttgggcccaggcgcagctgggaatccgtttcggtgtccagacggggcaacgcaaaggcaaacatcttcttctgtctttctttctcctttccttttttttttttttaagaaaggaacatctgaactcttcataaactgacaaagttcttcttcgcaattcatccattcagatactattagcgtagtgcaatcaatcgatattgaggtgcaattcgaagttctcaaaaaaaaaaaggtgcaatttgaattactagtaggtgctgagatgcaatgtcaacccctctgaacgtacgacgttgtaaacttctaaactttaatggagaagagcagcgatgacgatctctctctagaagagtccacacctcaagttttactggtggtattaactggcaactggcaagcaggtagtagtactattcaatgacaacgatgctgtcgcgtgtaaatccacgtggcatggtaattttccatgaaatggtagtttgagcatgtggggaagcgtacgagctcaaatcaaattaggaaatcaccctgaagtttcacctgtcgcccctccctctcgattgcgactagattgccgctggtttttcttcaaccgtggagcattgacgggtggagtccggcgagtcatagacgaagaattgaatcactttagattcggtaatctaaagtgaaacaaattcgctttcttgccctctctcgcgtggcggtgtgtcaaacctggaaagtccagtggaaagaatttcgtgcgtgcacacattttaatcgcgttcgtatatgttctgtgagaatagtttcgtccgtcttgttttctcctgcgtcacaattgtcccgtattatctcatacttcatcagtgaataatttcatgagtattgttgactgtagtatatacattagacagggtataagctactaaagaggtgccccgtacgagaaaatctaaaactaattaacacttaactcaaaagctataaaatcatttgtcatgtagttagatgctgacgtttaggctacagtgttgcacccaatccaatcgcaaaacaatttagaaaccattaattaaatcacgtgggggataataacgcaggaaagttcaacgaaaccagaagcgagacgacaaaagacgacgcactcccactctactatatattctggcgcgaacccgactccctccacaattccgctagtccgagtcaaaacaaaatcaaattcaaattcacgggataattcaa

SEQ ID NO: 22367 - DNA, 1443 bp, Oryza sativa
tccatccgtccaaaaagaaactcaattcaaaaaagatgtgagaaaaaaaaaatcaattacacagtttacattgcgagataaatcttttagagagaatcacttatatgccactaaaaattgatttgattccttatatgctattgaaaattggttcttcccttatatgccattaatctaaatttgcacaccctatcatgctactcccgtcagttggccgttaattttcaagaaaaaaagacgtatttacccttttgagtatagggcatgcctaacaactcagagagggtaaatatgtcttttttacttgagagttaacggtcaacacatggtcaattgatggtagtggcatgagagggtgtacaaatttggaccaatgatatataagagaatagccaattttcagtggcatataagggatcagaccaatttccagtggcatataagggattatctcaatcttttaagcataattacgccatgatattacaacgtgatgctacagtaaacattttctaatgatttgttttgttattagtctatatttaatacttcaaatgtgtgtcagtatacttcaaagtttttacacccaaataactaagcacacccatagacagaataactgattaaaaaacatgaatttatttatattattgaagtgaattgtacttcttacctacttgtactcacccatcccctacgagtgtgtttgcataatgggaaatgggggtgggattgggattgggaaataaatgaagggttaggattaaatggaagggggagaatgaatagttagaatttaaagatgggtgggaaattatttccttttcccatttgccaaacactacctattcggttaaacaagtgaccaagagtaggagattgcttaataacacatacttaagccagaaaaacataagtatgaaataatatagcggatgttaaatcttataaccgaaccgaacccggggtttaaaaaaacggaaccaatgtctagtccgacgatataattaacttgagaaccaaaggaaaaatgagctaatataattaacttgagaaaaatcatttaaaccaaatgattttctactgaaccaaagtaaaaatgagctggcttgattaaatccccgatgtacaaggtctgtattttttaaaaccctacctaattcttaaatattttcataccagaaatatataaaaagtgagcacatggcaaaaaagttgggcccgttactacctttactgcatacatgcatgcgcgcctgactatttgggctagtcgctacaatagttttagaaacgaaacaaatatatttttatgtgttgattaaatcaaaattctcaataaaatacactagtactcaacgttacttattttattgaaccggtcggattcaccggttggaacacaggtcgggttcagagtggcaatcagtaggtcgtcccagg

SEQ ID NO: 22368 - DNA, 1383 bp, Oryza sativa
tgtctggttttcgggttggggggggggggggtgggtgggtgggtaatttggtcgagtgcaatagttcagggggtaattcatatttttttcctctctagtttcacaatgccggcaattattttcgtcatctgtaatgaagtaagatggtagcatctgtatgagtactagctaagatataccttatccgattaaaatctcttactccctctatcaaaaaaatgtttgacgccgttgacttttttaaaaatgtttgaccgttcatcttattaaaaaaattaagtaattattaatttttttcctattatttgatttattgttaaatatacttttatgtatacatatagttttacacatttcacaaaagtttttaaagaagacaaacggtcaaacatgtttaaaaaagtcaatggtgtcgaacatttaaggaaggagatagtatattttagtacagatggagtatatatatgattattaattagccttcctgggcagtaccaatctttccaattggaagatagctactggacgcgaggagaaaatcggacgtagaagcgagcagcgaccggcagttggacgagtcgttggctccagcaacgaccgggatatctgatgcgactagtgcccctggacttcgtcgatcaatggcaaattattgcgataaaattgttttctgccgatcgagtataagccaatcaattcctccatatatgttttatacatagcgcttggggagtggctggtattaatctggcatctatacttataaagtccacgaaagcgtgagcacaaagagatggctgcctctgaatataaattgatcggtagttaacaggcaccggcctacgtacaccaggaagggcaagccggctggcgcaaagatgagctcgagctttctggcagtttgtgccacttcttttgtgctggtgtgctcggcagctacgccacgagtattggcttcagtctatggagttggtggagggctcttgattgtcccttctaatgactccctcgctcactgcccctctagctgcggggaagtcgatggcatctcctaccccttcgggattgggggaggctgctttcgggacggcttcgagcttacctgcaacaccgccaccaaaactcccaagctccttgttgccaatagtacaacccagataacagcaatggaatatgacatggctttggctcctatgtacttcaattttacgacaaggcaaggtatggacacctacaacatttcatgggtgtcgccagctaagggtattaaaatttcagatgagaacactttctatgttgtctgttgtaattttgatgccaccttgttcgagtttggtacgggagatttcgttggttcttgtatgagtagatgtgacattgaga

SEQ ID NO: 22369 - DNA, 242 bp, Oryza sativa
agcacgtgataaaaatgtgtcccgtatcaaacaaaaaccaattcctatggaagaaaaaagagagagagaaaactcccacgttgaaaaagacctcaagttattatcactgtttctctcactctctcgtgatactgcagtagcctttttccattttgttcctcgctggagtagtaaattttcatttcctttaaattttgttggtttgccccccacacctcctccccactcccccacttttcagt

SEQ ID NO: 22370 - DNA, 1501 bp, Oryza sativa
ccatcacgagtcgttcgcacgcaccagccggaaaaaagatcgaagcatcgatatgtcagcaaatcgatcggactctaatccagacctcgtgcgtatcagaatcgggtccgtgttagtgtccgacttctcccctaatacctgcgcgtgttcacatcctccctcacgagtcgttcgcacgcaccagccggaaaaaagatcgaagcatcgatatgtcagcaaatcgatcggactctaatccagacctcgtgcgcatcagaatcgggtccgtgttagtgtccgacttctcccctaatacctgcgcgtgttcacatcctccctcacgagtcgttcgcacgcaccagccggaaaaaagatcgaagcatcgatatgtcagcaaatcgatcggactctaatccagactgatacaaatcacataggttgactcacggccacacaaataataaaatcagcatgggagatatatctatatctataactaatataaatattcatatttttccggtcgtcacatccttaacccacgtttttcgtccgtcaccgtcgccttcagctttgttcacaaaaactagggttctatttggagagataagctcgaaccgagctcgattccgcgttaatttctccgggataaggtccgattcttggggaaaacggaagaggaggataagggaaatatttcccctcaaccaattttggaaaaaatagaaaggggcgcccggatttggagtggaaagcggcgccgggtcgggttctgtctccggccagaggttgaagacaacactgtagcgacagggatgagatgtggactttggggaaaaaaagcctagcccgagaaaaaaagaaggaaggacgtgaaacaaacttttagcggtgcagctactaggccgaacaggaagaagtaggatgctaaagtggacttcacggattaggcccaagaaagagaggggatttttaattacttctccagataaattaaccaataaaatgatctttaaattgttaaaattatttcaaatgctcaaataatatcaagaaaactcttgaacatacttggataacaacattaaaaccagatcatttaatgattaatttattatttaaataatactgaaacgttctttgtattattaaaattagtagttgagctttgaaaaatccgagaaaaattccagagagcagaattaaccacgcatagaattaaatccatccatgctttatatttaggaaattttattatacatttacaacttattaatttatttatatataacattaattcaccaacaaatacatagcattaagtgtagccaagagcgaaaaaatgaggttggattcatcatgtcatctttccattcactacttaaaaaatatttttctggatgaccacccgaatagattgcagacaggccataagtgtttgtgcctacaaaaatttatcccattttcccatacggcttcttaagaaacttgtatgcaagaatcattttttccaaacggacca

SEQ ID NO: 22371 - DNA, 1501 bp, Oryza sativa
ttttttctgaatcctgttattttcttccaggggcctctggggataagaatggccaagaaggccattgatcaagggatgcaggcagcagacatgccgtccgcgttggccgtcgaaggggagtgctacgagcagctgctgcacacggaggatcgccttgagggcctagccgcattcgccgagaggaggaaacctgtatactcaggaaagtagtttatctgtgtatacagtatactgccatttggtgtcgtggtgatcatcttcgcttgcccgttcccggtgactttagtcgagagtaaataaagaagtttgtgtcgatgaattctcctgcacttgcctaggtaggttcgagacaagaagcccaactcttgtaattctcgtggcttgttgggctcagcggaccaaccttcctgggctggcctgtaggcccacccgaggcttcctgggcctcacccttgccggcagggcgctgccagccgaatttttttcatttttaaattttttcttttaatatttacagaaataatccatcggcgcaaaaaattacaaaaatagaccctgccgccctctactaaggcggcaagctgacgtggcaaatgggggagggacgggtggtgacggcagacgggagagacgggagagggaggtttttttttttgcacgaaaacccttgccgccctatgttatggcggcaaggggctcccatgcaaaaaaaaaagccaacccgggcctaatactttttggctggtacctagatgcaaaaagtaccagccaaatgctctttagggctgcgaaaattgcatttagccttgggcggcaaggggctaaatgcaattttcgcagatggcagcagatggcgccgtcgagccgacatctgccacgtcaacttggagggcggcagggtttatttttgtaatttttttgcgtcgatagattatttctttaaatattaaaagaaaaaaattaaaaaatgaaaaaaattcgctgccagcctgccacatcttagtcaccggctcagcctcaagctggctcgagcccgtcaatgagccgagccgagctgctgttttacctcgtttctccaaccgagctgagccgcccttctagcgagccttttacgctcggctcgtttccacactcacagtcccacacgactcctccggtcctcccatcctgacccaaccgctgctgctccagcatgcgcatcctccggggaatcctcgccgtctccggccacctcgccggccgccgcgcgccggcgaacaacgcccacctggcactcttctcccgcgccctccaaatcctcgcccagcaggagcccgtccgcctccagaagctctcggcgcccgactccggtccgtcccttgctcgcttctcctgtcattttttttttttttgccttcctcttttggggtttgtggtttattacagctgcgatgattggactcagggatcgtggagatgaggctggagcggccggaggccaggaacgccatcgggagggaga

SEQ ID NO: 22372 - DNA, 1401 bp, Oryza sativa
ctttgttttttactcaaagagaagtacaatctcttgtcactgaaaattattgactgcttcccttctttgttttttaccaagacaaggtagtaaaactagaaacggtcaaagctttgcccggcaagtagcctcgtcttccactatcaacgtctttcagaaacatcaacaggagaaaaatgttgaatgctcgtgcagttccaagcttaagcacttggtgactgttcatgtgtgatgtgtcgtgtcttacgtgtaccgttggatgcatctccagctgcagccaacaaactcacccgcatccgcatgagcagcgcgcatcgccgtgttcttcacttcttcccatccgtccacttccacaatgcggcgcctcctcgccgcctccggccgctgcgctccggcgacccgcacccaccatgggctcttcgcgcgcgccatccagatcttggcgccgccggatcccgtcagtctccacaagctctcggcacccgactgcggttcgtgaatcttcaccctttttttttttagggttgctgtaaattcgccctcttctcctccaaaatctatcgccgtaattccggtcacaactcacaaaacatcgaaacagggagagggggtattttgcaaaacctatagggggtattctgcagaaatttggatcgctgccattaatatcgatcggaaggaggggctgttccgcaaaatatgttaccatcggagcactcgatgggtcgggtcgccggcggtcggcacgggacccctctcctctccggccgccgccaggcacggcctcctcccgcgcggcagctccctctcgtgctctcaggtcagcgccgccatctcctgacgcggcgtgggtgccgatcccccgctcgctttgtatctcctcggttcccgccgggcggaatcggcgactcggcgtggcgtcggcgaggccctggaacagtggagcggtacaagtaggtaggtcaggggcttgggagacactgtactttgctgcaaagccatccacttcttgatcccttccagcagtagccagtagccactcaattcacaatatgtctttagtagtactgcagaggtcccttcaattatctctgatggggtgtgtgatgctacccagtgatagcaacaatgtcgatgtgcaaaagacagggtctattaaggactgttaaagattgtcctctcatgtcttgtctactactaatcttctgatgattctgttaacccggggatcagcatggcttttagcctttgcctaaattttctgaagaatccttttttttttctgaaagagttgctctaaaaattctcccttgttgcggttcctaaatttgtgggtggaaacagaaatcgtagagctgaggctggagcgtccggaggtcaagaacgccatcaactgggaag

SEQ ID NO: 22373 - DNA, 1501 bp, Oryza sativa
tttcttcccctgcgccctcccaccgggagtccacacccctctcctcctcgcccgcaacctcccccttcgtgccggcctccgaccgagaaagcgcggcgtctccccagccacgcgctcgtctccggcgaccgccgcgccctctcctgcaggtacgtgcccctgcttcccccacgttcccctcccgtgcgccgtgcgccggggctctctcgggcttccgggccgagacggcggcggcggcggcggcggcggcgcgaattgtggcgcgcccgccctaccgtcctctcggtctccgcccgcttcgggacacccctgcggtgccgctgccaactagggagtagtttcacacgcttagttcgatccctaggggtttttggttttgatgcgttcaaacctagcgattcgattcctgtcggttttatttgcaattgggagaaactatccactttaattcagtctctgcggcccgcggggggtaggtgtgtgtggtggtagggattagttgccctgcagtaagttctgtatgtttgggtactttgagcactacagatctctagtgatcagcgtgaatctctaaataatggcctttatggctttgtcattaacgtgagatgcacatatgtcgtgcatatcttattgtgctgtttgtcagggatgttgcatttagctgtattttgcaaataatttgcagttgcagacttgcagtgaactactagtttctaaaacgtgaaacattcctcttctcttttctagttttgcagctttccactgtgtatatctggtttctactttttgtaaaataaaatggagaacactcagaatgagaacagcaaggaagccaagcaagatgacgagacccgccaaaacaagcaagatgatgaggtaattctggtgtgcctttagtaacaatctgaaacaggcaattttgcttaatctcattttagcacgatactttttcattgacaaaatcaatggatgttggctgcaattcaataagggagcaggttgatgtccataatttgtcattattataatggttgggttttttgcttcccatttttcaccatgatagccagagatactttgattacatgggggcataacacagcatggttctgacgcattgaaccacattatacttgtttactgtgaatctgaatctcgcaacttaacaactgaagttaccagcagaaattatgaatctgcaacacatatttgacttagctttacaaacaaaactgttctggttatattagtactcaacacacaagaaaactcccttacaaccaattcagttctagtttctttaacttgaggtatttgcgtaaaaagtgtactcttgattgcctgtgaaatggactcgtttgctgtttctagaactgtggcagatctagttgaagattgataatttgtaaactaccctgtacaattggtcgtctgcactttctagtgacgtgacttcagaaattctgctcactgatcctaaattttggctgtatgcagg

SEQ ID NO: 22374 - DNA, 567 bp, Oryza sativa
tgaaacggaggaagtacgttgtgaaatggaggaagtaaaacatattaggtgtacttatcagagcatttcattcatttatttcataaaagctggtcaattacgcggcacggcattttctagtcatatagtataccactaggattagaagtactgcactgtagtacttactacgagttgtagtaggtattcgactcctactgtcctacattgaactgagccactgacaacatcaagattaggcagcgtatttttcaggggctgattgatgaaaactaacggatgattttctttatcatggatttgaattaaacagtagtattttatattataagtcttaactgatatagtttaaaacaggttatctaaataacgtaataagaaagttttttaaaagaaaatgtctttttttttgcggggaaaagaaaatgtctttttagaagcgtgaaatacataatctgtgctgataacgggccttgacctgttacggagagccaccgaggcgacaaaaacaatcttctacagtaccgtagaccgtatgcttctgcatcataactactcctacacaga

SEQ ID NO: 22375 - DNA, 705 bp, Oryza sativa
gctacttgaagagttcagttttgcactcaacttaggccggagaaagtgtcaaaacaaacgtgtaacatattctaaggtcaaagtgaaagctggaaagagaaaccgggaagagataggacttgtgatcatcaaatcaattcatgtcacaacctcaaagacgttttcgagcaagggaaatggagcctgcaaccatttattcggcaacaagataaagcactttcaagtctcgtgtcaaacttaagtctttcacgacgtgaaagagtggctaccaactcatgtccaaaagcattttcggatggacgcgatgtaactcgccgaaattagcagacaaagagattcaagctcatgcaccttgcaaccactcaagaattaagataagatcacgtagcagagaacatcaacagagcaagcactcaccactcaccagacaccaagaacagctgcaataacctgtccaactctaaggctcaacaactccaggaatggctatcagaaggccagaactaacaagaagcagctagcttttgtactagtgtgtgtgatgcctgccgttcttttctattggcctgctgcttcctagtgcccctagagctgagctctcctttttatccttgcacttttcagcctatctgttcttggcaagcacgcagttggatggctcaacctgtgaatgatgcaagtgtgtactagtaggcatgtagcacg

SEQ ID NO: 22376 - DNA, 559 bp, Oryza sativa
ttgatttcctttgcagtatatatccatgtgttctatgtttgattatatatatttgtggtgtttgtcatcaattaccaaaaagggggagattgaagcatctaggcccccgttgttaattttggtaattaatgacaagcgataattatggactaaccattgctattgagatatattttaagttaggtccacgtcatgtgtgcgcatggatgactatcgatggattaaaatttgatggcgcgaagcgaagaaaagaaaacggtaaaactagtgttttaattttaaaattgatcgaggtgaaggacgatcaaatttgcaagtttatttgttagtttcgccgtactataaaggggggtaatgacctagcaaagagatgattaaattgccacattaggtcattgcattttcacttgtgctcacattttcatcacacacacataatcacctttgctttcactgggctcggcctgaccaggggcggtcagaccggccacatagtggcggtctgaccggcgtgccctggccggtctgaccggcctcacaacggcggtctgactggcca

SEQ ID NO: 22377 - DNA, 1413 bp, Oryza sativa
cttcatgtccagtagttggccactatttgtccaaggacccaggatagaccaaaagtggctgcctaactgttgggcttttatggccaggcgtatttaatcggttgaatcggtttgtcatgaatatcctagcggaccatgggaaatctccaggtttaataatgattttgaatgttgatgctcagctcatcagtttgtgagttgtgacattgatcccgagtttgatggttaacctgctgaaagcgtgttcttgcttaggctcaatctggaggcacttgacacacggccatggaccgaccttcgcctaaccatgcgcacatctcgcgtaaggcaagtgcgcactgagctcgtctttgtttagtcatggaaaccgcatgccttaatttgttaggagctggggtaatttttttccctgactagcgcgggatggcggtgcgttgcaatgcgaatggaaaagagaaccccatcacacatttaaagcctcaaaagttttagaaaaaattaaggtcacatttatcatcattttgtacctcacttcaatattttttttaagggatataaagtctaccaaacctgtcgatagcaccactatataggtacatgaatgtacatctaaggctgtaacactggtggagaaaccatctttacttccggttgggaaccccgtttagtcccgatttttcaaccgggagtaatgattcgggactaaagatacatctttaatcctggttagtaccaccaaccgggactaaagagaggggatctttagtccaaccgggactaaagagacaatagcgacagtaccagatggtccctttttctatttctttttttctttttattttctcccgaatcaagtaggcaaatccccaaatcaaagtaacatcccaaattcacatcaccaaatccacatcacaaatcataaagttacttatacacacaaatcaaatacatcacaatatcctaagaaattgctcaaatacatcacagatccaaacaatgaatcagaatttttaacttctcagtcaaatacatctaagtgaatcatcacattttttttttaaaaaaaagaatgccgccgctagccacgaccgccgggcgcggcccagccgcccgccgccgcgcgcggcgccgtcgccaggccgccgggcgcggccccgccggccttcgccccgcctgtagaatcgagatgtcgactagaggggggtgaataggcgatttaaaactaaatgacacctaatcaaaactaacttaagttgctaggcttggtgagggtcaactctaactaagcaactaagttatgttttgcaaacctagggtgatagtggctcaattatatctttagggaagtaagtcacactcctatgtcaatgtttagcaatcctagggtgatatgatctcaagtatgtctctaaa

SEQ ID NO: 22378 - DNA, 1501 bp, Oryza sativa
gccagggtcaaaggtgccgattccataaccggcacctttgagacgcacaggagccaaaaaaaaccagctcgatgcatcggctctggatcgagcagctccccatcccatatacaagaaatcatgattcatcatcacaaaaattcatcaacatcaattcatcaatatcaatatcaatatcaacatctcacttctcaccatcacataaattcaacatcagcattaattcatcaacatcaccatcgattcatcaaccacagcatccccacacaaatcacagaaattgaagactcaccatcaaattgccgccgacgccgcctctaggaggccggatccagcagcccctgacatctaggcagccggatccagcgtggtgcggcgaggaggctgcgaggaggatggaggggcacagcagccgctaccgcttccgtcgggctgccgctgccgctactgttgccgaggtgtgccgcctcctatccggtcggatctggtggaggggaggccgcggccccctccgcggggccgccgccgctaccgccactccgtcggacgagagagagacgatagggagcgagcgagcgagagagagagacggagagcgagagagatcgagaggataatgtaatgccccgattctcgttcgggattaaaaatcatttaataatgcattttctagaaattaaataaaagctaaagcaattttatcaagtgaaataatgagggaatttaaaattttcctttaaaaatcattggccgagaatattttgtaatattctttgtgccctaaaatactctctgaaatttcccgcgaattttcggagctcgagaaataattttaatagcacaaagatcattgaatcaattaaaataaaaagaaaacaaagaaaatcccccttcctctctttgggccattttcggcccaagtcttccttctctcccgcggcccgcgcgccccctttctctccctctcgggccggcctcctccctcggcccgctcagctctctccctccctcaagtctgttccgcctccccagccggcctctccctccctctctctctccgacaggtgggacccgtggaccccacctgtcatccccaacctccggccagctccaaccgtcggccacgccacccactccctccgccgatcccgcacctcccctcgtcccaaccggcgtggactcgagaccccttccacctcgcgaccacatcccgccccactccccctctctccccgagggaatcgacgccacgccgagccgccacacccgccacgatgccgccccactccgtcgccggttgccgcctctcccgggctcgatcccgccttccctcatccgtttcccccattttccccaagccgctgcgccctctctcgctctccccgcgccgagcccacgcgctgccgctctccggcgaactccagccgcgccgcgccgccgctcccgtccaccccgcactgcgccgtcgcctccccgttaccgcagtcgccgtgcgcacccc

SEQ ID NO: 22379 - DNA, 1320 bp, Oryza sativa
gatttggtctttttttgaggatatggtattttagtgtttattatggtgttttttaattgctttttgctttttattatatctatcggattttaatccaaagattaaaaatctgtgtgatacgataataaaaatctttcgaaagatgtataggtactccctaatttttttcccgttcggttagccctcagtgggtaaaaatccatgcaatccctacccgattttgctatccatctctcgcgatttttttatggcatttgacacttttttggcctccatgcaaccacttgcaatgcagcggcaattttgcaggtcgaacgttgcatgcagtgcagctcgccggccggctggcacatcgaccagtgttaccaagctaccccgcgcgcgcgcgatgatggagaagcacggtgtcaaggtggcctctgattggcgagctggccgccattagtacggccaacgctgttcggtgagcgacaccgcccctctcgtcatcgtcgtcgtgaaatatagagttacagtcctatataactaaaattacatttgtaaatttagttgatatgacatgtaaatgcactgtaattttgataaaaataatatttaagtaaatatatatttgtattttctttaaaatataaaattacagtcctatataactaaaattacatttgtaaattcagttgatatgacatgtaagtggacagtaattttgataaaaataatgtgtaagtaaatatatatttttattttctttaaaatataaaattacagtcctatataactaaaattacatttgtaaatttagttgatatgacatgtaagtgcgctgtaattttgataaaaataatgtgtaattaaatatgtatttgttatattctttgggaccacctatacatttgtcgacaaattttctcctaaaaatttgacatatataattatagtacaatcgtagtgtaattacactataacttgcatgtaactacagtgtaacttgtatgtaagttttacgtaattttgaatcgatagatctattacaagatttgttcttgtgaggaagaaaaaaatcacagcatacacatatatgaaaggatttgttcccaaggcctcaattttaccgaaataacatgttacggagagatttttgaaagttacatataagttatattatagttacagtgtaattgcatgtaagttacttacgattgtactgtaattacatctgtcaaatttttggaagaaaatttatcaacaaatatatagcaaaattgtattcttttgtagtccgttggatgtaaatctaagggtagaaaaaatctaggtgatttt

SEQ ID NO: 22380 - DNA, 1501 bp, Oryza sativa
tttgctttctttattttcaatagtttgtttctaaaacggttactgatctttctccctctttcaaaattgtagatggcagtgaacgccagcttcagttcccacggttttggtgagggtcaccacgtcgcttagcttcgtgacctctcccgtttccttggcttctcgtgtcccgagtacacggggtactccgtggaccgtgttccccctcactgtgagctctctgtgtacctttacccccgtggaggtatacacggagctggccttcgcccacaccacttcaccgtggccaggcccactctccagatcgcgtaccaggacctctcctggactgcgcttcgtcacctggcccacgactacagccaccgtctcggaggctccgccttccggcagcttccacgccttccctctggccactcagacgccaggtacccttgtccgtacagcgagtctcagccagtgctgactcgcatggttgagctttcggaggctcaggccactcagcacgacctactccttgaggcttaccgctcccttgcccgccgatacgccgccttggaggcccgtctggccgaggagggtgtcacctcagttgacactatctcttgggactcaggacgcctctgccacgccagccacctgtcctcccacagctcccgcggctctgcctgcactcccagtggcccgcgctcccccagctcgcgtgcgccgtactcaccagtgtactccccctacccacacccagttagcccttcctacaccccggacacaccccagttgcttcctcccgccgtggcccacgctttatccgcaccgcgcggaagcgtgttgttggttcttccaccgtgttccgtttccgccacccagctcccccaccgccagcggcccgtgctgctgccggccctcgacaggttccgccggtcccttcgcgccagccgatcgacgtttcttcgactgaggagccgactacaggaggcagccaggccgacgaggagtagaggaggcagtcttcagcagccgtccgtgtgataggcccttttgttccgccgccaactcttttggagtcgtggcgaggtagtgcgtgcgtgtgtttgtggtgggtgttgtttggtagtctggttctcctaggtggtgtgcgcacagtcaagctcggcgtagctctgtgacttgtccacacccgttatatcaggtgtttttatgatttgaaaaatccagtttatgcctagtgtgtgctatctgagttgctatttgctttgctccttgccctcctaagtgcttatctgactcttaccccgcccttttctgggagtttagatggctagccgcccccgccgtgcagctcgtgcaccagcccgctttggttttgaagatggtagagttgaagcagaagcaaatcatgaatcagctaatgagcagtctcaccacagcaaccgttcgcaccgtactgtttcccgcaacgcagaggttgagcaaccccgccgcagcaaccgctcgcatcgcacag

SEQ ID NO: 22381 - DNA, 1501 bp, Oryza sativa
acccaaaatcatacatctgagatagttagactggccgaattttttttccacgcaatttatgtaggattataagtagtttattcaaaagtagaattgtatgtgctgtacttcacaacttgttttctataaaataaacaaaaagtgtatttcttgtactgttgtagtattgcctatacatacatgtctggtcaatctaccctatcataatttggaccctgtacctgccatcaatcagcttagatattttaattttccatacgattaacgtaatgatttctagctcttgaaagcaaacatgtcgttttcttctgaccttttgaccttgttctaataatatgcgtggcatattgattaattgaggagatgatgcaatttaactgacaattccatctcacgaaaaggccagccatgggctgtcatttgagatagatgggcatctaacctgtcattatccgttaagcagtgggattactgatcgtttccattacagggacgcgcacgaggcagcctgagaaaagagaaggaagctaatgaaaacgaaagcggccaagaccaagaaaacgagtcgacggtgatgccgcgttaggtcgctcatcaacagttgtctctctttccctccatttctggtccagccataaacaccattaataccgtttttttatcctctttccaaaggaaaatttgctcaatacttgactgaagttaacatgacattgttcatcactcgttttcagaaaagaaaacaaaaaaaaaagagaggggacattattcatcactgtagtggtagtgtgcctataggcacgtcactgctctccaggaacaaaacgacacaaccattgtctcctaattcagcgtctattgggacccaatgggagcacaagtaaaaacagccattggggctgagtgatgagccatcagagagtaattaatcgcactttgaaattattagttagtttctgtcacatgatgaggtgtggcaccaagatattttttgcttgagtgatcatatggactatagaatggccaaagcttcacaaatatctgtccgtgttatcgtcagttcgtcacaagaagcaaaagaactactaggtcgatcaccaagcctgacgtggaattgcagccatgacttggaaggtttccaaattccaagttgtgtgctgtgtcctggtcaaaacaaactacagtagcacttggcttgtgtctcatatagtcatctcctagtccttaaactctgcataacaacaaagcttttgccacaaaaattcttgttatctccatgaatttctttcaatctaaacccaatccacacggcagacttcagtgttaatcagagttggtcctcagtctcacctaaacctatgatgctaagtccatctttccaagtgaaatgtagtggtatgatttgtcgatagaaaaattatgctactcctggatctcacaatatcactgcaggtaggagcacaagagaaggtacagatcgcaaggacaaccatacagctac

SEQ ID NO: 22382 - DNA, 1501 bp, Oryza sativa
agtgtagatcatatagataagtgtagatcgcagaactgattgcaatataaattcagagttgatccagatttattacaccacttccataatttgtgggttgtccttcgttcagatcggaattgacttgtatgaataatttatattcccagtcatctaccagaaacgtttcgcacgtgcaccggtcgttccaatcatcatctcgctagcttgtcggggaggaaaatgtcacgtacttgtcagctgtacgtagtcaccgccgaagaacatgttggtagaaatgatttcgacttgcgaggtcatcttaccgtgaacacccgggcatgcatatacctggtctaacacggccggccgtagtcattccctcgaagtcttagttcaaaagttaatgcagagcttttaaatgcttagaaataaatttgacagctctaaaagagtttgagacatacacgaataaacaaactcacacctaaattagactcaggttgtgtttagttcagcgcgaagtttggattttggtttaaattgaaaatgatgtgactgaaaagttgtgtgtgtatgacaggttgatgtgatggaaaatgactgaagtttggatccaaactttggatctaaacacagcctcatttcatctctcaaccacatatatatttcttccatctgtggttatcacctttaatttctacacgtacgtatcttcactccacagtccaccccattacttgtcattttttgtttttgcataacaagattatcgaataattatttcaataagaatatggtgggcgaattggccagtttgtagaaacatcagagtactgctaactgcagtgtagatcgaccgacttgacatgttacttcctttcaaggattcattagaaaagaacctacaaaaatctactattgaatcttctacagtctctagtttggcaacgccgcaggccattattttcgtcatctagtagcatgtgtattgctttgttactgtgtgttgtgattaatagcatccggacagtaccattctttccagctggtagatagtcagatagccatggacgtgtggaaataatcagatgtgtataggatcagtgagcagcgaccggcagttgggcgagtcgttggctccagcaacgacagggatatctgatgggactagtgcccctggaattcgttcatatacgaggacaatatacaggcttggcagattgcaacaaaactgtttgctgctgatcgaaatactgatcaatcaatgtctccatatgttatatagcgcttggggaatcgctcttaatcttgcgtttacttaagtctctgcaggcgcacgatcagtataaattaagagacgacagacgttgcctctgaatacaaaatcgatctcacgcgtagttagcatacatatctgcacccacaaagctaggcaagctagccgatcggcgcaaagatgagctcgagcttattagtggcagcttgcgccgtctcttttgtgctgctgtgctcggctgct

SEQ ID NO: 22383 - DNA, 1501 bp, Oryza sativa
tccctcccataggtgtgaacttgcacttagcacctactccatactatatacatgagtgacatgtgccttatatatacatgcatataggaaatatatatacttttaaaactcgtacaacgtataaacacctgtatttgttggtgcatgaatcacacctctcaaaggacacatgacaaaatgctatttatttcgatttgtttgttaccacgttacaaagaaccacatttattagaacacgaaaatgttttcataaacttttttttttacaattttgatatactgcttgcttataattaactaaatttcaataaggaaaatcaaatttaagaattgaatggtatatgactatatatgtgacgtctatgtacagtttgttgatttagtcgaataaaagtagcccatcaatcgtccctttccatgtgatatggtagatgtgccgaaatgctaagttttattccgatttatttgttgctagcctcatagaattgaataacatttattagaatacaaaaatgttgtcataaaaaaatttctttacatttttgatataccacatatgcttataataaactaattttcaataagaaaaataatcacgttttaaaaatagaatggtgcacgtgacttctatggacacttgttagttttctagtcgatatacaggtagctcatccatcgtccctttccgcgtgatatggtagatgtgccgaaatgccaagttttgttccgatttacttgttgctaccccgatagaattgaatcacatttattagaatacaaaaatatgttgaaacaaacctttcatgtgtgtacacatgatcatatcaatgctgactcaactcaggttagatacatgggagcgtatcctatacacacaggccctcgtggagcgtatcctatgcacacaggccctcgtgtgtacacaccgtgtacaccaactaaaaattatcaaaaaaaattttaggaaaattcatacatgtactttcaatagtatatatctacgtgcaaagtcgcatcttcaaattcattctacatagagaataacaaaaaatataaaattctgataaaattacaaccttaaaactgtcagattttttgtttttttgttacggctaaaatataataaatttgacgttaatattttaactctaggtgtaatacaattgaaagtatgtgtatgattttttctagattttttggtgacattttttagttagtgtgtacgtgtgtacacgtgagggcctgtgtgcataggatatgttgcctagatacatgacctgtccctccagtctccctgcagccaagcaaaacagaaaaaaaaaagaacacgaatccatccgttggatgcccatccgacgctcagatccatcggcatcttcgcagtgggccccacatgtcatagagcgtgggtagggacgccacaagaggttgaggttgaggatggcggctacaagcctgcaaaggctttttccttcttccccaaccaccattaatggcttcc

SEQ ID NO: 22384 - DNA, 1501 bp, Oryza sativa
gtttagcatgtcctgttttctttctgaatgtgactcccgtgtttgcttcctctatatcatttatattcttctttttacttactttctcatctcttactgttcaagttatttgaatccctccggttgcgtggtaaagttggtttgtcttaaattgatcaggcagttattttgaatgtacagatctaagatcgtttgattcccctacttagtggtgattccagttacggagttaccattatcagcaacaatattttaaaagttctgatctattgttctgctctaattatgccaggaggatatcatccatcggatggatgtgttgaacccgcaggtgcgtcacccctctactttctccttttgtacctgtatattcgatattaaaatgatagtggtttaaataataaatatttgtgaaaaggcatgtagcctagtggttgcagtgacctgagtagcacctcaaggtcctgagttcaattttccatatgagcgaatttcagattgggttatttgatggctaagtttcctatttgataggttaagtacctaatttaaaaagacagtcttgagttcaaatatccatagtagcaaatttcagattgggttatttgagggccgaaattctcagattgggttatttgagcgaattcaaaaaggctgtatatatccggttggatgtagaggctgggaaaaatacccttcttaaaaaaaataaatattttacattattccactcatggtttgttttctcctttctgcagacctgccggaccttgttggaaaagctgatgtttgataaacacctttatgctcgggtgtttgatgaacgtgccccttcggcacctacccttttgcagagtattttgaagcaagatcgctgtaaagaaccatccaagtgtaacaagcgttactttgctaacccaatgagtacatttctgctatagacagatgcgctaggctctctagtgttagttgatttgtgcatatcgtcactctcaaacgatttatattacagactagttgtacactttgtgattcgttattacaggactgtttatgctgttggtaatcagatttactacaagcccatcaacatagctacggctgtgtttagtttccttcaaacttctaacttttccgtaacataaaatgtttggacacatgcatggagcattaaatgtggaagaaaaaaaaccaattgcacagtttgtatgtaaattgcgagatgaatttttgagcctaattaaacatttgctaataacgaattaattaggcttaatagattcgtctcgcagtttacaggcagaatctgtaatttgttttattattagtctacgtttaatactttaaatacgtgttcgtatacgagagaactaaacaggcatatgataccctacagaggtatctatttttggtcgaatggagggagtagattccagtacagcgagaggtgtggaattgactaaagtcagggttgctccagtctacacgcacgacccggttc

SEQ ID NO: 22385 - DNA, 500 bp, Oryza sativa
aggtagtagagcccaaaaagcaccacacctaactcacaaaaagacgcctccttttcgcgggaatcgaatcgacaaaggctcaagaacgagaggccagcacggcacagaagccacaagaagcgatcagaacagctgaaatcgaatcacgaaccaggacacctgctctcctctccggctcctcaaaactaaatcaactacctactactcctcccaatcctctctctgttcttcttcaaggagatacgagatagagagatagaaatagatacagataggagatgagagggaggggagcaagagatttgtactatggaagaagttgggatgaatggatcaaaggattggtgggagaggagattaaaggggatatgtatctgtgactctcgtgcttgcctgccttagctgagggactcaactctgttgaccttttgagcatgagagcgacgcacagcatgcaaccatcagctgctgcctttcgatttctttctccttcttctaga

SEQ ID NO: 22386 - DNA, 1342 bp, Oryza sativa
agttcagatacatcagggtcctcgcgcagccgccgcccggtcccctccacactcgcggcggcgcggcggcctggcgcctctccggcctggcgcagcggcctaacgcgggcgaggggaggcgaagcggccgcccggtcccctccccagtcgcagcggcgcggtggtgggcgcctctccggcctggcgcggcggcggctcccagctagctcgcggcggtggcctgacgcgggcaaggggaggcgaagcgacgaggcagccgcccggtcccctccccactcgctgcggcgcggtggcctggcgcctcttcggcctggcgtggggaaacggcgatgcgagcacgcgagattggggcgagattgaaggagacgtcgtctggcaggaagggtaggcgcgtggggtgaaaacggagtcctgcaggtaggccagtgcagcggaccgttggattagttttcaacgccccagatcgatccaatatcacaccgtgccatgctatagcaatgtcaccgaatctgaatcctcttattttccacatgctgcttcttgagccgaaacgaggggtgccatagtaagaacgtgatcaggtgtaacggcccactgattgcttgctttcaaatgtctagtggagcaattagctacacatacatatcgaaaagagtacttcggctgctacgcggatgccaacgattcccaagtgccccaaaccaagcgagaagacttcggctgctatcgcgtagcccaacctgcaaatcggcccgtgcggcaccttccccagtcgcggactcgcgctgcgaccgatcccacccggggccggttcatccacccaactcccccaagtcccaagtcccaaactcccaacccactcgtgccgtgcacgagccgctcgcgttcgctagtcgccaccactagccgccttagcccggctaccggctatcgcgctacaatccgatccaccggtacgcgcagccgtgcaggctgcagccgcagcgccccgctcagcgcacggcccgcccgatccgtcaaaccccagtggaaaccacacgacgcacgcaccactgcacggccgctcacccacgtcaacgtttaacctggctcgcgtcgcgcgcacggtgcactgcaccccccctgcctttggccacgcaacacggggaacaaataccaacgcgaagttggcgagggttttttccgccgaaaaactgaaccgccgcagccgcactcctctcccgcgctcatccgttcgtctgtcgtctgttccggttgctttggcgggcagctagggtttaggcgcggggccctcccgaatccccgatgtacggcgtcggcgtcggcggcggcggcggcggga

SEQ ID NO: 22387 - DNA, 1501 bp, Oryza sativa
  unsure (1)..(1501): unsure at all n locations
ctggttccttcctaggctcttgtgaactttgcattcaggcgattcaaaacttggtacgaatgatcattgaggtttacaccttttaggctagtcaaggatggtttttactactgggttagtaccctgtcaggaagaattgcaatctgcaatcttacatatgaattccttagatgaacaactgtcactgaattttgcaccatgcttattggaagttcttttcgggccattatcctatccataacatttcgagcattccaaatttatgtgcatgatgtatcatatttcaaggcagacaacaacatggatatgtgattttatttatttatttatttatttatttatttttttgcattctatgcatgaatgataagtgatactactaatcacagtgaaaggcggataatgaatcttgacaattttcacattgttcctgcagggaatcaggtgagttgtcagctgaggcaatttgttgtcacctgagcagactggctctttaactgatcaagcattgtagatccaagaaagtaactaaagtaatatcttcaaataattcatcaactgtcagggaactcattgccggttgtatgtatgattcaaattatcttgtcagatcttgtacttgatggcgttgtgtgttagtacttcccttatcaaatgaatcgcttgtttagcgagcagtgatctcatggtgtacttctatccaatgtactgaactgttatagtgttattatgggattttctctctcttttttttaagaggtgaactgctgtaatttcgcccactgattttgtgaaagatgtgtcctctcggcttgctctccaatgatccatagtagaaaattcattgaaactctgtaattttgtaatctggaataattctcatgctcgaaattaggctttgataaagagctttttatttttatttctagagtaaatttcagaaaactataactttagtaacaaaactactccgtatcagtttgctacaacattagtgacatgcttcaattagctgcaacaatagcgtgggaaattatnacaaaactgtaacttttaccttatatgctgctatagtacatataggtgacaatataacgtaaaagttacagctttgtgataatttccgacgctattgttgcagcaaactgatagttttgtcactaaagttacagctttataaaatttactcttatttttctatgtttgcacgtaatgagatgacatgttaatgatggaccaatcattagccgaccatcactagtagggacgtaaatgcaatatccaaactttccaaggaggcatctgcaaaatcgccaccaaccaaaccagctccatccatagacttgttgactgctccctcgcgatcccatctccgccgccgccgccgccgccgccgagcgagatgaggaagacgaagccgtcgaagcagtcgcgcgcgcaggcgcagcagaacggcggcgccggacactccaagctcgccaggtacttcgacccggaggcc

SEQ ID NO: 22388 - DNA, 1501 bp, Oryza sativa
catccacataatggaattcagacgcacttgacaaaaactcagtagctgaaataggaacaaggagattgcgagttaaaagaggtgggcttgatcctgaaacatcatctgatatctttgctgattctgaggccaaacaggcaagttctgtcacgagctggttgacaacaactccacccttactgaaccccaggatgacagtcttcggaggacagtattttaacagtgatgtagtaggactttgattgcctgatgaacccttcattgtggccttcgtaaccatagattgtatctggtaaccacaaattgtgcatggaagaaatgcaattcagtacaaagcaattcagcacaataatttgacacgataaatggatgaaatcatgaaatgaagactcaaaatagtgagatattgcaataaacaattgacatctcagtaggtaaacaactatcaagacagaaattgcattggagtaaaaagaaaactaacatataatgcattcgttttctcctattttaggaagtatttattttataagcaaagttcttgaagtttagcgcaccatggcagtatatctatatatccaatatgctaagcattacgttagcaaaaaaaaaaaatacagtagtagctgctcatgtagtcaaaaggtaaatcaagcaagaaagacaaaaatcaccatcccagaaacccaatcaagtcatccttagaaagtcatatttactttaccaaatgtgaactaataatctgagaagctgattcatatagcaggctgaaaccttacgttgacaaaaaaaaatgttagcgcgaaattcctgtgttggtaaccaaaaattaacaaaatatcaagaattcagttattgtagcatcgtatactaactataactgaaaccagtgatgaataatgtgcctcatgaattcacgattgcatcagtaattcaatggtactcctgtatatgtaagtatctaaacatactactacggaaatattaagatacaagtacaaagtattcgaataaacgcttgattgtaatgattctaattgcataaaagaatagagaaattacagaattttaccaaacctcacgaatgcaatgtcctaaaatgatggtaacgccagccgccgccgggaagccagtgggatcataccgctcggggtcgcccacggcgtccacggacggaacgagatctcggtaaactgcaaacgaaccagcgaagcaggcggcatccaccacccacgcgttggcctccccggtgagcttcccggcgaggagccgagccaggtaggcggcgtccgacagccgctcgatcgccgggtcgccgctgccccggacgcggtcgcccgtgaagagaatcgcgttggcgcatgggacctggcagaatcaggcctcggattagagagagagagagagggccagcgaggaaggagacgacggtgcaggggattggggcttacggcgagggttttggccggagtaaggacgagcgaggcggcgacgcggaagg

SEQ ID NO: 22389 - DNA, 1501 bp, Oryza sativa
cttcagtgaggccgtcgcctggtggtccgcgagcagtccaataacgtcagtcagagggagagcctacaccgcatgaaatcattttccgacccgggaagcaaaaatagtgaggttaccgagtacactcacgttgattgcggcttcacgctcgatcgcctccttatcataaagaggcatggggacgtcgcttgccgttgtcaggccgctgatcattaattggccgacgcggcgctccacggtggcgtcactcaagcctgcagatcaagaacagaattcgataaattagggagaacatgcacagaaggggatcaaattaaacacaagaaaaataccccgaggagaaacccgggtcgcgtcctccggccaagagtagtcaaaggctgggtgggcgagagcctggagcagctggatccgcctactaatgaagtcggtagcgacttcataccccgacaaacctcgcgctcagaggtcatcaatggcatcgatgaacgactgaagagcaggggtcaaggcgggttttgcggtccaagatgggattttgtctggttgttcctcaggaacgacaaagatcggatctgaatcctctatctgaagatagaaccaccttgcccgccatctgctacgagaagaagggcactggaaggggatatatcgcgacttcaggccatctcgaagtcggaaacccacacatccagataccctagtagattccatccaacgcaactcgtagtagaagcgaaagaggtcgagaaacggctctaccccaatgtaggcctcacaaagatgtgaaaagatgctgaggaaggcaatggaattggggttcaaatggagcagagaaaggccgtagaaattcaagaccaagagaagaaactcagaaggcggaggaagaaagccacagagaatatagtcctcgatcgcaactatacggcccaggacaggttcaggttcagtacctcctggttccctctccatggctccgcggccggggagggcgccatcctcctgtagcttcttaagcgacgcgctggtggaggtagacatgccgagatccatcgccgccggagatcgccggagaaggggctgagatgaacaatctagggctttgcaggagcggaggagacaaggaacgcctggaggctggagagcttttttcacaacgggcggacttcaaaatggatcctcaaaatcctcttaaacagacgcatttccgacggtgcgaatttcaaggaaaggagagagagattaccgccgaaaatttctaggtccgttacgcgcggcagtttttcagacttcagtttaaattcactcatgaccgttgggcttcacatagtgttgtcgattgcgtcctatctctacggttcgcacaccgagaacgacaacagcctcaacaccagaagtcgcgattggttacacgagtccatttaagcagaagtcgggggctactgtcagggttatgggtaaggtataccctttacccttcaatacatgtcgcgtatcggta

SEQ ID NO: 22390 - DNA, 1501 bp, Oryza sativa
cggctcaaagcaccagagagaaaaactaaccacaggatggtggcacgctcgtggtcgtgggcgcctgggcgacgaacgtgcaagctggagtatgagagagcgagccatgaaggatgggcaggccgcactcacgggcacacggcgagctgcaagcctgcaatgcctgcaaggctgcaaatcagagtccacggagctacagcgtgtcgttagagcaagtttaatagtatagcttactgctagctctaattcattatatccaatctaataggcaattcatacaatagttgcttactatattattaatatattgttccatctatcatacacacattgtgttttggagtccgcgctgtagctggttacaaatctgtagtccgttgctcttctctctcatattttatctcgttaaaatatgtttacagctggctaatagattgctattgtatctgctcttatgcatgatcgccattgttcccagataaacagaggcattacccccacggctcgggatctctactacacatttcagcatagcaaagcgccaaagcccattggccccaccggccaccgcgcataagccctcgcaacaacagccaacttgaagcagtggagctcaaaattcgttccgattctaggggggatcgagcagcgagcggactcccctcgcttaccgccgcgcttggccgccgccgagggacggtggatcgcggtgtcgggggactcggcgtgaggggaagcgggaggcgtggtccacctcgttaggccggtgcctactcccagcgacggcaccgccaggacgacgcgccgccgtgatctcggcggctccggacctccggttgtcttctcgaaccgatattggtacgcttccttctcaaacatcaatctccatgcctcgttgatgttttaatctgctactattattgagtattacctccgtttcaggttataagactttctagcattgttcatattaatataaatattaataaatctaggcacatatatatatatatgtttatattccctagcacagtgcctgtgcgttgccacgggtgaagtcaattttgattttacatatatatactctgtacatgcacgttagtagataaggaatcgaaagcgatgacatatcaaccgaaagtgactccactaaatcgaaccttctattgttgtgcaacgaattgacactcactacactcatacctaattgtttgttgttttaaatctactcgatttatgattataagaaagatattgataccaccttaaaataaaattgtttttttactgactcctatatttatggctacaataaattatttatttttttaggtcatgtaatattgtccatatcatgtatgcccgccgtcctcctcgtcatcgtcgtcgttgctgtcctcgtcctcgtccttgtcgtggggggtagtgggctaggggtggctgggtccaccagctcccttcaccatcgacgcgagggagggggagttgaatccgctgcccc

SEQ ID NO: 22391 - DNA, 229 bp, Oryza sativa
taatggcttcctacaggctgtttagggtcaccaatcacatgccttgtctcctagcactggtagtgcgtgcgtataagttctagtttgagctcttcttggatttgtttcatgcgtaaagctcaattcttctccttctccagactaggagtaggaaaggaagcttccaatggaaacgcacatataactttatctgacttttcctttgttgctagtatttgttcgttccaag

SEQ ID NO: 22392 - DNA, 1501 bp, Oryza sativa
ttaaatatatttttataataaatttatcttgggtcgaaaatattactatttttttctataaacttagctaaacttaaagcagtttaactttgatgaaagttaaaatatcttataacctgaattataatatctcaagcagcgatcaatgattcgatggcaattgcgtggcaaagaaactgagaaatcacacaaagttgtggtcactcacgcttggtgctagtgctagctgcggaatggggcagcagaaatgcgacgagctagctggatagcggcgcctgccaagagctagcgcgtggtggtccatgccaagtgatcgatacagcgagccacgcgcgccgaaactcggaaaaaggcggagagatatcacgagcttcgtttcgcgcggcaatccaccatgccacctcgcctcgcacaagcgatctcgctaagagaagtacaataacacaacgtactgtaaactagctataaacagataaaagaagagagagaaaagcagcgggctacatatctgtagccagctgcagcacgatctctaagacgtaatgtgtgtatgataaataggactagatattaatagtataggaatcaattattatatgaattagctagtattatattagcaatagatgatttatagctactagttggctatttgctctaataatcctcggcgagaaaatgacgtggtttttatataattgtttcgagcccaatcacacaacgatggagacctgggagcaataagagggagaaagactgccacttgatagacggaaacaaaaatccatgtaatgcaatttgctagtaccatcgcctcatcagagcaacttatccgtaacgagggatcatcatttttttaaaaaggacaagttgctaagcacgaccgatcgattctgattgggttaagattccgtttctgtccatatcagtgaatcatctaaaaacaactttgaaatactcttttgaaaatgtaatcccaataaattcatccagtacaactcctgccgttacggtttggtcaacagttcaaaaccgcacaccggatcctgctcctgcgccgttcgatctcatctcgacggataccagcagctttggcggtggggaccccacggctcagtagcagcacaccgcgtccgactgatcccgagccgtccgatcccatctcgacggctaccaaagaaggtgacggaggtgggccccacgggtcagtgtcacagcacccggtttctctgacacccgcacggaagtggggcccagccaaagcccccacaataaatttcgcacagcgcacaggcctctcccatcacccagcaaatttttttctcgcccaccatttcgaacgaaaaaaaatcaatcaccaaccgggaggccgaagcagccaacccaatggcgcagcacaccgccgcggcggcgggcggggacgaggaggtggcggaggctgaggcggcggcggcggcggcggcggggagcacgctccggcaccgccacgcgggcaagggcg

SEQ ID NO: 22393 - DNA, 1501 bp, Oryza sativa
tgacaaaagttaagaatttctttcgaccatttaaaatgttagggactaaactgatcctacagataaactttagtgactaaagtagctattctcccaaaactttctatatagaagttgctataaaaaaacaaataaatccattttcaatttttttaataattaaaacttcactaatcatatgctaataacttatctcgttttacgtgcgcacttaatcttaatccgataagcagattcgaacggggtcgaaaacacaaatataccgatatttcgattaagttctttttttataagaaaaatcgaactgaactattaagttttggtaatatttgtttggattttattagtttttatcggtttatcaatagttttcgtgaaataccgctcttgagcggttttgatccgatactcggagtcgtaaactctggtgtcatgtacggtggcggcgggctgaccgggtggttgttggtatgtgcacacggttgccccgggcgttcaccgttcgcggctgggggtggtgtcaccgtgtcagcaaggtgagattttggggtagagggccactacgtgacagctttgggccgggaaatccgaagttatatccacattgcaacgagaggccgtccagattgtatcccgttttgcaggtgaaaggtcgtagctatcacgtatgagggcgagagaccgtccaagtggtgtaccgtttccagatgaacacggtcgtaactggtatcacgtatgggagagctagagaggtgtacattagctccgacagtggcttcaggccttcaatttggtcagttccagccaaaagcaaatacattgccgctaccatgtggtgtgaaatagattatctgattttggtgtaatatttgagggtacatgtaaataaattaattactataaagtgcaaaaaatgtttttagaaagtattctaagcaacttgtacacgcaaaattttgtaaaatcaaaccgtttaggagtttgaaaagtgtatatgtgattatctataatctgtaaggggaaaagaactgggcctctgtccagggcattggagatgtgagagaaatagagaacaaatgcaatgaaaatagcagcactttgctgtagctgtagcagtactgaactttatcacaaatcaaacggccgtacaaataattctaaacggatatgctgcgtgtaattccaaatgcatgttgtgcagtgttgccatctgccatactcacattttggagtcagtccgtaatttggagtcaaatgtagcctcacattttgtagaccctgtccaaatgcctactatgcattacagtggagatgttctatctagaaagtcagataaaatggccctccatgacatgtgaaattcacttaaactctttttctttcaaagcaccaaacttggttttatccataacgagcagctgggcatcctattcaccatagaatggttgagcctaaatcaaagtctcctattttgaaacaggaatatgaattgccattatat

SEQ ID NO: 22394 - DNA, 322 bp, Oryza sativa
tccaatgcattgttcttgcaaagggaatatagccttttttagctcacgaacatgtgagcacacagccacacaacacggaggatgcagatgtttagggaggagaaaaaggctacagattctttcgtaatccaccctgtcctttgttcttttcctgccattcggaatttagtggtgacccaatgacaaagacctttccagtgtttccaattccaaggctgcaagtattaccgtgaatctttctgtcagcaccataaaaatattacaccccttttttgggtcctgtagtttatcctttaacctaaagatcttgattttctacagg

SEQ ID NO: 22395 - DNA, 213 bp, Oryza sativa
agatttaaattttggtgggtaaaaaccccaaccaaattacttcgatttgctttcgatgctccccatatcaccggtggtgctttccagttagtttggattttgataatagaaaattttaacctcattgaggcttgactttgaagcattgaaaagcgtggaactattcatagacatatttttgttctttgttctttgttcctactatagtctagc

SEQ ID NO: 22396 - DNA, 1173 bp, Oryza sativa
agatttaaattttggtgggtaaaaaccccaaccaaattacttcgatttgctttcgatgctccccatatcaccggtggtgctttccagttagtttggattttgataatagaaaattttaacctcattgaggcttgactttgaagcattgaaaagcgtggaactattcatagacatatttttgttctttgttctttgttcctactatagtctagcataatttgaacaacgcaagaagtactccagtaaacaatttctttgttttggaatcctcaaggagccaattgggtagaacatctttatcggaaccaatagtggtacgcgtttgaatccctgggacctgattaagctccaatattcatacgacgtgcgcggcagagtgcagagtccaaactcaaacgccgaatcctgtatcaattacaaggataccctttcccatcgtgcaggcgacctgagtttttttttctttttcttttacacatgagccctaccttaagccggcacgccggagagttgacgtcgtcaaacaggttttaatcgcactcccgccaaagtggccaaactggctacctccgattgattcggtccgtgaagccgcaagccggaatcgtgaaaggattttttttaaattactttttgtactttttaatttttttattttaaaaaataaacacttctgaaacttatttacaaaatctagacattttgtctatatagagaacagtgtgaccaaataacactgtcacaccgttcaaatcttgaaaataagtcttggaaatatttagttttaaaattaaaaaattaaaaagttcaaaaagataaaaaaagatctatgaaagccggcggcgaaatgctactccactttttcccatcgtgctggtgctcactgctcagcgagagcttgacaggaaatatttctgaattcccatcatggaatgaaccatattggttgtgtgaaagtaggaactactacttgcatatttcggccggttttaggtcccaactttttcttcaaaattctaacttttctatcacatcaaaactttcctacatacataaactttcaacttttttctttgaactttcaaatttaggctatgtttagttcagcgcaaagtttggattttagttgaaattggagatgatgtgactggaaagttgtgtgtgtatgacaga

SEQ ID NO: 22397 - DNA, 336 bp, Oryza sativa
gggtattttcttgacatacaagtttagaatctaacccgagtcctcataaagatattctatctatatttggtaccgtatatccagctagaatataaccgccatgtagatatggggtaaccataatctccacacatattaacgattgacttagagatggacccaaagtctcaggtcacttgggccatagacccaggccgaagattaaaagtccactataatgatcaaattcatcatgtaattttaaacatgacctaaaatacaataagctagtcttggcttttgggttaaggttgaacgacaaataacttgcaacctcaaatgctaaaacgggagcaa

SEQ ID NO: 22398 - DNA, 413 bp, Oryza sativa
aattcttaaagaattataaaaccgcactaaaaaggattttaacagcattgggtcgcatcattgtgaacacaaattgccaaagcaaaaagtgcctaagtccctaaggatcacaacgggccacgctggaaataagactgggctgaagtactgtacaggcccaggcccattagtactcccgataccctaataataccgaagtgaaaaacgtctcttcgtcttccccgctgagactctcgccattttccccatttcttgctacagtgcaaaactgcgccgggcaaactagggttcatcaatccgctccaatccgccctcaaaaacttcacgaaatttctccccgcattcaccgctccgattccccatctttttccagccatatctcgaactaaatcagaccatccatttcacattca

SEQ ID NO: 22399 - DNA, 458 bp, Oryza sativa
ttaggtggttaatgcaggcttaaagggaaggctgttattttgcaaacagttttgttttcaagttttcaacaatctaagtgtgtgctttccacaaccagagcgagacaagtctcagcttggtcgggaggtgagaagaacaaatttatttatcaagatttgcacaactcccagagttggcttcaaatctggttttttttcccaaaccaaaccaattttccaaacttcccgataatagtggtccccaaacgaccaatcacttccagggacacccggtcccgctgtcccccggacagctaaatgcttcccaagcattaggtttcccaaaccttaacaccttttcataaaacagggtaaaacaaaaactacgctaaggaatcacctcacatccgcccgtgaccgtgggcacggctgttcgaacagtttgttaacctctgcagagggggtacactttacccaca

SEQ ID NO: 22400 - DNA, 1501 bp, Oryza sativa
tcagttttcaaatgtcccagattacagaaccgatcaaagatttgaaccccttccgtagctctttggaacacccttaataactttactccaccattctggaaaaaaaatgtgttgtaaaaggctaaggtgcagctgaaactaagcccaacttcataaaaattaaactttatacttctcgaaagaaaacaaaagacacacaagaatttgtttaatggtctcatcaacttgatcacagccggatgcggtaggccccgtttgacaagacgatctaaagtccaatagcaactgttaaccgctacccacatagaaaatttttaatgtagaacacttctacattgcactgcattgcaaattcaacagtatagttggtcatatggctcgaggcaaacttgatggattaaaggaaataaacgtcataagccaacttactcgtataggatcctgtcttcgtaagctttcatttatacactgctgaatataaatggtcaaataggctgcccagcctggcacgaccaagacacgaccgggcctagaccaagatcaatcgagtcggcacgacctgagctacacgtcgggctgggccgggcctactcatggcccgaaggcatgagtgctcatcgtgcttccctataaaatacttttattttgcctcccttatttctttgggctgagtcttatatggctgaataagtctattttatatccctctttcgactgaagtaagtctatgttggatccctcaactatttttttcaccataccagtagcccaggcacgacctagctatcgggccgggctgggccagcatgggcccgaccccagtcgagccatgtcgtacctaggccgggccaaattcatgtgccttgggccgggccgtccggcctcgggctatatggctaactatactgctgaaacccctcgttccaagatcaatccgtcaaccaaatcttattgaaacaagtagtccaaaattacttgactagagaagccatccctttggttgtatttagttccacaccaaaattggaagtttgactaaaattggaagtttgaagaaaaaagttggaagtttatatgtgtagaaaagttttaatgtgatgcaaaagttagaagtttaaagaaaaagttgagaactaaacaagctccaaagcttgcaatacagtgcattgctttcctcgctcttattaggattaactcaaaaaatatgggggctaactctgcaagggttctaccttgtagccggtccagaaacatagtacgtatttttcctatcaccaattgttgactctattgctatattagagagagcaaaagcactgtgagggacttggataggcaaaccagccgaaggcctagaatgacaatcagttcagccatcaaatgcccaaagcccaacccagccataaacccatatataactactgaatgcacggataatttttactatgaaaccctgaaccgtaaatatcgtgtagccatgcatctatcgttgaggacacaa

SEQ ID NO: 22401 - DNA, 1501 bp, Oryza sativa
cggtgctcgcggcgacccgcgccgcggccgacatgcgcgtcaagctcagacgccaggtgcagtactccgtccccctcgacgaccgctcctcggatgccaacacggttatcaagtacacctccgcgagctcgccgccgacccactcctcacctgctacggtgcagtcctgcttcggcttcagcaggagctacaaccttgtcgtctttgagctctcacacaactcacttgatggccccataccggacgcccgcacacacgccgtcgctgctatagcacctgccgccacccctccggcccccgctcgccgccgccacgaccgatttggcccccgttccccgcgtacatccgtaggggaatagaaaggaggatagaaagggagggaagggagataaagggaggaggaagaagggaaggagagaggatgacatgtgggcttcacatataagtgggtcctacaatattttttttggatgaaaaatgggtcccacatattttttttaattctactgccacataagtgccacatcaacgccacgtggaacgaagcccaagtcaacaccgccacgtacgcatcacgtcagcgaaaccgtccttcaaaaccatcgagggaatcaattgcaccggttttaatagtcgggggttgagatatccggtattgtggtttagggatagggatggcagttttgcccatgggttcgggtatccgcggatacccgacccaatgggcacgggcatgggtgtaaaattttacccgtgggcttgtccgcccaagacccgtagacatcgtgggcaacagccgggcttcattttttacctgtgggtaacccatgcctgacccgatacatttgtattagctaatttcgatttatctcttaattattatacccccttctcttggttcatttgtgatactaactaataataagttgcgatgtaattcaaattattattgataattgataatttggtaaattgttgattttatttttctttgttaaattatatatctttcgagttattattcatgtgagatccattgggtacccgacgggcatacccgtgcccgtcgggcatgggtacgggcatagagttttacccactaaccctagtgggtaggatttgggcgggcgacgacgggcatggggtcaggcatggttttgctctacccgtgaccaacccgacccgttgccatccctatttagggatacaaatcagattcggtcactagttaaaggagtcaaactgaacttattccttcgttagaaacgcagccggcccagccgagcccggagcccgtgcaccccggaaccgtgcaggctgcctacgcgaaagcggaacagcgccaccgcgacagacaggcaggcagcaactacccgaccgatcgcctcctcttcctcctccttcccacctcccgcccacgcctccagatctccgcgagcttcgaccgccaccgcgaccgccgccgcagcaagcagcgtcatcccccgcgcgacgccaggca

SEQ ID NO: 22402 - DNA, 365 bp, Oryza sativa
tgtaaataaaaaaaagaagtctctgaatcaaaggagttatggtattgtgaaaaaggagcatatacatgtgttgtccagacatggcgactggaattgcctgagcttggattcttgttggcgcttggaagcccatcttatctaaatcaaagagacgaccaaagtgtttgattaccaagctataataaaaagaatatatatatcttcatttccgttcataaaccctatgctagcatgctgtgaaacttgtcacggaagttggacgagataacaaaataaaatcagtcagaggcgtcggagaatagtaaaattttgacatcaactcggtaatggtctgctctaaattcgatccaagaaccaaccagcca

SEQ ID NO: 22403 - DNA, 475 bp, Oryza sativa
tacaagctgagttgctgctgggaagaacaggaagacccatcatgtggctgttctgtttctgtggtggtgtattgattgtcaaagggaagctcaatcaccatttgttttttttttttttgccacctgaaaactgaatgacagatatatcctgtcccacagcaaatgaattcagtttgttgtctgtaaaagggaaagtgaagcaagttttgcatgagacagattctgaattcttcttcatgatcacggatactcaaaattatgttcagcctactcatttggtagaattcagaacatttgcatccccaaaccatagaaggttgtttataagagggaaccgcaaccagttagcgcattatttcctcaccctttttttctttggaaattcagcttataattgattcggtgtgaacttctatgaaaacaagcaaaactatggtctccagtaacaaattgaattgtgttgcataaattacac

SEQ ID NO: 22404 - DNA, 1501 bp, Oryza sativa
atgtttcaccggtagtcaactgaaatatttaaccgtctgaagcttgatgttattgaaacattttctatatcatgtgtaaaatattaagttgtactaactgtttaaacattataaaatacttagtgaaacactaaaagaaaaccaactgcaacgcttataaattaaacaggtgaagcatcgtaaaatactagtagttgaaactttataaaacgtggtgcaatatttaaaaatcactaagaagataaatattgttttcaatggaatataaccatgtgtggtcttgttgtaaagatttaatcataacgaatttaacggtgtactcggatcataaatgagataaatattttacaagaaaaaacattttaaagtttaaaatattttgttcttgggctgcgtgcctgagcgtaaatctacctcatccgcatggagagagcctcttcaatccaacggacgcatgcaaatttgcccagataagatggtgtagctagtgcccgatattttcctcccggatcgggtgcccaacgcggagttctctccttatattttatcaaaaacttgagcttgctaagtgtttacatggcataatctttacaaaaactttctttaccaacatgtcttaaaaaaaagaacttttaaatcaactttctaatatttaaatctcttatttatgtgaaatgttatagactttatttataatcattatccatcaaaactttagagaacacaaccttaaactcgattatccattattcatcaaagtttaaaatcgaaaaaaaaagtgagtcttcaaatgcagctaaaaaactgcagcaatatcactccctccaaatcagcacatgcatgcacaatcggagcacaacttttatctgtactattataaaattgaagatgtttttctggtattttgttacgtaattcgtatatgagtctgaattttaagttcgttcgcttttgaaaatatatatccgtatttgagtcgatttttaagttcgtttgcttttagaaatgcaaaggagtcgtatagaaatcccttaaaaaaactcgcatgctaactttagacgatcagattcctaactgcagctcattattttctaagaaaatatatatccaaacgaattcccacagtgaattttactttaaataaaccgtataacagtaataaaattaaaatagcatttatctgttgtaacgcatggacatttcttctagtcgggaaaaaaataaaatcggagcagaattcaaatcgtaaagtctgagcagcacaacaatcgtgtgctgtgctgacgacagccatgggccacactctcccattctggcccaactatcccgctccggcctaataataatggggcttcacgcagcccacgatctcgttacggcccaaggccggtggggagaaggggcataatggtcttttgcttcacggtccccggccctaagcctctcacggttcgggttctccctcacacactgaacaccatggcggcggcggcggcggctc

SEQ ID NO: 22405 - DNA, 1501 bp, Oryza sativa
ataactaattcattgtaactcagtttaatgtggttcaagttgcaaaagttgtataaaataaagatctacatattaaaattgtccataaattgaattaaatttatttaattctttttaaatgggctttaattatatttaatcttgtaaaattcataataaattcatttgaagtcagaatgaggccgttcaagtctcataattcatctaaaatcatgatctacatgtttgtttactttttatgtattgtttatttggtttttattagtctttttcttcgttttacgtgttagcttgtcgtttccgtcgttgcgaaggttcgcgagtgcgccggaagtattcaagaagattaattgaagaccgattattgcaaggcaagtcacacagatcctaaacacaatcctttgagcatgttgatcctatatttaaattctctatttatttcaactgtgcatttattttcgaatgtcactgggtggtgtgaatctattcctttgttatggcctgtttgcattgattactttattccttgataccttgggttattataacttgactagttgagctatatatattggttcagctagatattagatatgattgcttagccatgcttagaaacattagcacacaattgggataactaatgtttcactatcacttatggttatatttaatggtagctcacgatggtcaatcgtgattggttaattaattacttgccaactaaaacttgataatggtgggttgtgagcacatggttttgagagtcgtgctcatgacaattaaggaccggttcgcgagctactattgtgaaacattaatcgtgccaaccacaagccagcgtgggcaacggctttaccttttgtatagcatggttcattgcggagcaccagactgagaagtggcggagataagcccacgggggtcgctggggagtccatgccttgttttataagggggtgattatgatccaggaatggtgcgctgcggtggattgtgttatgcaaggggtactgtcacagcccctttccgaggtaccgtggtggtactgaggcacatggtgacatgatgtggggctgtgtcttgtgggtacagtggtacacctctggccagagtaaaactattcgaatagccgtgcccgcggttatgggcgagttgagtaatgtttttcgtgattagtctcacacctctcataattagttattgatgttttactggtaataatttgcttagctcctggtttggagttagatctgtacagccgggtatggttgttcaggatggttgggcctgtgcagcatgggtgtgctgttcagtgttgattaaaatttctgattaactactccactgttttatttctcttaaatgttttgctaaatgctgcttttgcaaatgagcctatattatgccatcctttggtatccttgtgcacttgcatatttgctgtgtggcttgctgagtatgtcatatgctcaccttgcaataatcaatcaacctcagt

SEQ ID NO: 22406 - DNA, 1501 bp, Oryza sativa
cccgccctcggtcgccgccggtcttcatcccgcttcagtcgccgccggtctccatcccgtcctcggccgccgactgtgtccatcccgccctcggtcgccgccggtctccatcccgcttcagccgccgccgctctccttcccgctctccatcccgccctcagtcaccgctgcttgccatctctccttctcgcttcggattcaccgattgcgggagatggcaaggtcgaggacaatagcctggacatcaagaagcaggtctgattcttgatctccttttttcccactctgaaaagatttgtgacttatctagtggatggatttgttgctagttgatgtatggagtggttgtatggattaaggaattatgttgagaattaaggttgatagggaatgcagcaagagaaatagtaggcagctgatgatatatattgtgctctctatagaaatgttcagccgatttagtgatccttagtatataattttgcaaactttcagtttacaagaatgctcagaggacaaagtcaattgacaatgctgaagatgaatacttgtagaataccatgagtgcttaaaatgtcacgtttgagtaatcaaatgtatctttcctggaatattcacaatattttctttacagttagtatatatctttcccatgtattctgcaaggatttcatttatttgatattttttatggctcactttatcaggacaaagctgtgaatcgaaggaaaattgcagagtttaagtcgttagggcttgaggcagttgagaagaagaattatctttctgcagcaggatttacagtgaggtataatagagcacaataatttccactgtgtttctcttttccaaattatattgtagtggtttgtgtagctttctacatgaggcagtcaagcttctcaatgatttcactacccgtacatttttcatgaatgcaaacataccctgcaattttgcaaactttcactttataagaatgctgaggacaaagttaattctctgcaaaaatttagcttcacttcttcagtagatcataccctgttattgatattttttttaggtaatctttctccatggctttttgtttagcaaaatttgttaaaacttgagaaatgtagctgtccataacaaggtatataaggctcccacagtttatcattacactattgtcacaccccgaagttttcctcccaagtcaaaattgtaatttataattgaccctaagaaaatgctggtgaaatcaggagaaaaccctaagaaagtaatgcaaataataatcggatctgacatgtggaatttttcttgaattctacatgtcgaaattcattaacaggatttttagtggaattttcagagctctagaaataattttaaccaattaaaaatcactaaagtgcaattgttaattccagggaaaatcctttttccttttctttttctttttcctctcttttccctcctttttgtcaagtgggccgtcggcccacttctcccttcc

SEQ ID NO: 22407 - DNA, 1501 bp, Oryza sativa
ggggatattcttgatgcaatataaaaaaaggcgaatattagggatggcttgatgatctaaggctcccgtacatgttttttgcgagaaagtagctagcgagcccagctagaaacaatccttcttcttaagataatgagctaggaacatccttttatttgtccatctgtagttaactacaatgccttggcatcaagaatctccaatcaagaacacgttcacactataatgtgtctagcagcagctagcatcattatcctaaaaaaatttagctacatacataaacatttaaaagagtaaagtgtattgctggcacttaaatttgttcgtcttatctaggtccttgatattgttaaagtgtattattttgttctcaaattaccatgacatctttgagatcctatatggcactcacgtgtcaaattaccacgacacctttgagatcctatatggcactcacgtgtcatgtcacacgggtgttaactcattttctttatatttttctctttccttttcttctcttcttcgttcctactcgtgtgggaaaaaaatgagaaaaagaaaaagaaaatttaggaccggaatatccgtgtggcatgtcactttagtgtccatgtggcataccttgtaggatcccgaagaggtcttggctagttaggaccggaataacacacttaacaagctgggggatttaaaaatacattttaagagtttggagatctgggatgtcattgataaacaagtttagagatcgacaatgcacgttcgtcttgtttaaacaagacaattctatttttaagataatagaagcttaattgagctcatccaattacatcaaagtgatataactgtattgagaacactctcggactttgcataactaagttatgcataaccaaaatacacacaatgtggttttaaagtgaaagcaaatacaaaacacggggagaattaagggccatcaatcttaaaactaataaatcgctacccacgtttctgggtaaaaaaaaaattccatgctccaatctctaacatgccgcagtagtaaaatcaatctcggtttaccatatgctagcgacagagaaagcatggttagtgtagctgtctacccattttacacttagcttcactcaattggacagtctactggtgacatcgatgaacttacatccaacaacatactccatccgtccttaaaaaacaaatctagaattagatgtgacatatcgtagtactatgaacctatatatatctaggtttatagtactatgatgtatcctaaccggtactaggttgatcttttataggacggagggagtatatactatttcgcagagcacacactgggaaaaaaaaaactaaaacattaaattttggaccgaaagactaaagcatttacggcccaaataagcagacgtgtgtatccggcccacttaaaggttggttggtctcttcttcttcctcctccatcccctttgccctcctgctgcgccgccccaactcc

SEQ ID NO: 22408 - DNA, 1501 bp, Oryza sativa
cgagttgagtaatgtttttcgtgattagtctcacacctctcataattagttattgatgttttactggtaataatttgcttagctcctggtttggagttagatctgtacagccgggtatggttgttcaggatggttgggcctgtgcagcatgggtgtgctgttcagtgttgattaaaatttctgattaactactccactgttttatttctcttaaatgttttgctaaatgctgcttttgcaaatgagcctatattatgccatcctttggtatccttgtgcacttgcatatttgctgtgtggcttgctgagtatgtcatatgctcaccttgcaataatcaatcaacctcagtcgaagaaaaaggatccagaaggagaaaacgtttggcttataccccagttgagctgcctgtgggagtggagccggagcttcgctagattttattttccgctgcagttttcttcttagtgaggactaagtgcctcataagtaagtatttatcgttttagttaatttgatgaatctgtatattaaattgtcagtttatgtacctcggctgattcctggaccaggattttatgcacaaataagttcggaaattactagtgaatttccgggcgtgacaaacactcgccacccaggcgaactctgcctctgctgccgaccgcctggtccgccttcgcctctacagtcacttgcccgagcgcgtgcagggggggaggagagagagacccgagagggagagtcatgacaggtgggcctaggatttttttgtttgattagattggcacgttggcatcacgtgtacaagctcaagtcaaaaccgctcaaaacagtgtcgagggaggtaattcatccagtattaaaagtttaggatgtgtaatgtctggttttcgggttcaagagggtaattcgaacaaccgcgccatagttcaggggggtacttcgtacttttcctttcattaaatcccacttattattgtataagctacatggaaccatatgtattttatcatgtgacacataaacctaggtattatgaccctaaagtttcacaaaacaacaccgttaaccattttaacatagtctgctatctcttccctttccatgcctttgattcatcccggattgtgttgatgtgcacatgaacaaaagtgcacattcctatccgctcttcattcaggcccggtccgcccatctgctgctaggtctaagaatggaatttaagacgtgattctagaactcaaaagtgtagtagataatatagttttgtgatgcgttaggaccttaatacccaggattatgtgacacttaccaaaattcatgtggttcatgaaacttagaccataggtgaggttcaataaactttactctctctctctctctctctcttttaatctcagctgactcatacgctgtcggattcatggacagtgcactacatacagggagtcatagaaggtatagtagagatactggtggatttgctccatcttatctgta

SEQ ID NO: 22409 - DNA, 671 bp, Oryza sativa
ttgtaatggtttttttctgaataggcaaatttgcaatggcatggatccaattaaccccaggttcaataggggaagagaacccatgtagtttgagccatagaaggattatcttgatacagtttggatgaagggcagacatcacttattcactttcaaactactgtaagggatggaactgtttggtaattgggttgtgtttaatgataaagcaaagacacagagagaaacttgatctgaaatgctctgcatcatgtactagtaaaatttaagccctatctgtttgctcttagcctctgggaagccacagctctcagaaatggactatcaacaatgcatcaatttaaacactgcatgactagggtttcaagtttcacttttcaatgtatgaaatttcagccaagcattatttcaaaatgagtagaaaaactagctcatcagacaatcaccagcatagtagaacactcagagcagccagaaatgtagtatcaaatcaaatcaattgcttaaagatggacatcagcaaactattccaagagcaacatacagtacaacagcaaagtgtgctatacataaatgtacatatttttcattccaacactgcagtacttccaatgtgtggtgattacccagtgcttaataggctacatattatacactagattagtatcatg

SEQ ID NO: 22410 - DNA, 1501 bp, Oryza sativa
agtagtgcggacaaaccttggatagggcaatggctcatccatggtaacggcaaagcttccttccacgtagccaggccgaatataatatcgaggcatgaaaatgggaagcgactcatttgtgcttcatgcgacccactaacagactgggggtctgtttggggagcatctagcagttatagcttctcacagaatctttaggaccccaaacagtccagattttacccagattctaggaatctgtagttgtagaatccggaaaatgaactagaacccagaagctagaaaacccggcttctctagattctcagaagttggctaccaaccagcggattctcaaagtcttaagctccctcaaacatggcctagaaacgttgtggcaagtatcccgattcgcgccatttcgcactaaatcgacgaatttgatacatgttgtgtgattatattattggattttgatgcacgtaatataatcggacatgcaacatcacattgggggacaatgtctattcgcacaaggaatccccctacgcatatagacttggactcgaaaaaagtcctccgccccctcaccgaagggggaagggaggttcggagtactgtttacaattccgataccacttttcatgccggacgctagtggcacatcgattttcgtgaagtccgatcgaaaaccgatagattctgaacaatatttgtaggcaaaaaaatgaattcgaatgccctattttggtcggtctgaaaatcaatgggctttaccgaaatttcgaagaggaaacaaggcgttgttcagctccctttgttgcagatttgtgggctatagcatcaatccaacacatcagtttttttttttggtgcctatcgctagcgagatgcaattgatagtgtagtggtaaaaggtgtgcggtttcaatcttaaggtcccgtattcaatccccatcctatcagataggatgactcctgaactattaaaaccaatgcaatttgactctcttagctgttgacctggtcttcatcccacgtggtgcttgtgtggtattagaattaaaaaaatatatatgtgggacttatttatcattcacacaaaaatatataaggaaattttgctacaaggcactgctattgtgtggttttagccctaggacaccgcaaaaactaacttttggaggaaaacaatccataattgtggtattttgccagtggacaccgtgcctggttttagccctaggacaccgcaaaaactaacttttggaggaaaacaatccataattgtggtattttgccagtggacaccgtgccgactaaaataataacttccaattgaagaggagagagaaatcgtgtgaaatgtcaaaaatgccaaataatatattatgggacccactgtcatcctctctctatctccaacccttcttccttcctctctctcttccttatctctctctctcttcttttggcaaaatttgctacaggacactcaaagattatggtctttgctgtgaga

SEQ ID NO: 22411 - DNA, 1501 bp, Oryza sativa
gtgggccgacggcccacttgacaaaaaggagggaaaagagaggaaaaagaaaaagaaaaggaaaaaggattttccctggaattaacaattgcactttagtgatttttaattggttaaaattatttctagagctctgaaaattccactaaaaatcctgttaatgaatttcgacatgtagaattcaagaaaaattccacatgtcagatccgattattatttgcattactttcttagggttttctcctgatttcaccagcattttcttagggtcaattataaattacaattttgacttgggaggaaaacttcggggtgtgacaatagtgtaatgataaactgtgggagccttatataccttgttatggacagctacatttctcaagttttaacaaattttgctaaacaaaaagccatggagaaagattacctaaaaaaaatatcaataacagggtatgatctactgaagaagtgaagctaaatttttgcagagaattaactttgtcctcagcattcttataaagtgaaagtttgcaaaattgcagggtatgtttgcattcatgaaaaatgtacgggtagtgaaatcattgagaagcttgactgcctcatgtagaaagctacacaaaccactacaatataatttggaaaagagaaacacagtggaaattattgtgctctattatacctcactgtaaatcctgctgcagaaagataattcttcttctcaactgcctcaagccctaacgacttaaactctgcaattttccttcgattcacagctttgtcctgataaagtgagccataaaaaatatcaaataaatgaaatccttgcagaatacatgggaaagatatatactaactgtaaagaaaatattgtgaatattccaggaaagatacatttgattactcaaacgtgacattttaagcactcatggtattctacaagtattcatcttcagcattgtcaattgactttgtcctctgagcattcttgtaaactgaaagtttgcaaaattatatactaaggatcactaaatcggctgaacatttctatagagagcacaatatatatcatcagctgcctactatttctcttgctgcattccctatcaaccttaattctcaacataattccttaatccatacaaccactccatacatcaactagcaacaaatccatccactagataagtcacaaatcttttcagagtgggaaaaaaggagatcaagaatcagacctgcttcttgatgtccaggctattgtcctcgaccttgccatctcccgcaatcggtgaatccgaagcgagaaggagagatggcaagcagcggtgactgagggcgggatggagagcgggaaggagagcggcggcggctgaagcgggatggagaccggcggcgaccgagggcgggatggacacagtcggcggccgaggacgggatggagaccggcggcgactgaagcgggatgaagaccggcggcgaccgagggcgggatggggggcgg

SEQ ID NO: 22412 - DNA, 1501 bp, Oryza sativa
taaaaatgtctctaaagtgcctctaaaagtgtctctacactataaaactccttgttttagagataattcaaaaagtgtctctacaaaagtgcctctacatgtttttttttgttctagtgatggtactcatgtcaagccattgtccaccttactaattatatccctggcctctgcaaacatatatactccctccatttaaaaatgtaaggcacattttgttatgttagaacaagaattgactaataattttgcgtcacaaaaatcatactagtcaaagccttattctaacaaaacacaatacagcttatattatattttgaaatggagggattaccctatatatgtgggtcactatccactatgtatgcttccgccatcgtcttaacttaaagtctatgtgaactccctccctttttactcgccaccctaaacgaatgttgattttgtaacccactatccataacaataaaaccatgctaccaggcatgttgtcctaggcgcggctctaactaacgtgcatttgtatagtaagctccaaaccattgctctgaccaaccttttttttttcactaactatgaacccgggttgaaactaaaagtcacttgtccgagagcgaaaaaaatgcaccgtcgcatccaccatatatatatgagtttgatctatcactagtgcgtcgttgctatctctagtttagatgcttctgtcatcaccttacttatggtttatctaaacttccttcttttccacttccaccctaaacgaaattgagctttctcattgatcttgtggtccaccacgcatagtaaaattgtatgtatagtacatagtaagctacaaaaacttggtgtagagtaagtgcttttttcccttcactagacggcatttggcttcgaaagccacaagagtatagattaacattatgagaagtgcctctttagagcttaaaatgcctcaagaaaatgtctttacataacacgcagcttttaaagtaccaaaagaatgcatctacaagataaaattaagtaaaaatatactaaaagtgtctctaaagtgtccatagagtaaaagttttctaggcaacttttagagtgccactaaaagtgtctccactctataaaactcctgattttagaggcaactcgaaaagtgtctctataccaaaagtgcatgtatatagggtttttgttgcagtggtggtactcatgtcaagccattctccaccttactaattatatccctcacctctacaaacatatatacttcctccatttaaaaatgcaaggcgtattttgtttttttaaacaagagtttgactaacaattgctatatatatcatttatgtgacacaaaagtacgatcataagaaagtactttcgaatacgaatctcataacatcaattttgcgtcacaaaagccatattgtaaaagagtgattaatagtcaaaaccttattatagtagagtaatacaccttatattatattttgaaatggtgggagta

SEQ ID NO: 22413 - DNA, 170 bp, Oryza sativa
cctcccggcgtgcctccgccggagcaggacggccaacaccatgctcccctacttcgcgccgatcgccgaccgcctcggcgcgctgcagccgtacctggcccccatcgccgaccgtctcggggtgggcgcgcaggcgggcgtcggcgcaggggcgtacggcagggcggacg

SEQ ID NO: 22414 - DNA, 546 bp, Oryza sativa
accaaaataattttggcacgtgatatataaccttgggtattatgattctatagttttacaaaatcacacctttaaccattttgatttacttttatataaaaatttttaaaaaacggatgtaacatttatatgatgggataaaatccttataatttgagatatgattgtaaaactcaaaaatggtattgcgaaacttaagaaccataatacctgaggttatataacacatgccaaaatacttgtagttttgtgtaacttagactataatattatcggcggagttttatgaaatttagtgaaatgaaaggatggtaaaatggaacgcagggaggtccggcccacagggacatgcggcccagtaatagaagaagtcgattaggagcagcgggaaagcgataaggaaagcgacagccatagccactcgctgcgcctcctcctcatcgcctcgccgtcgccggagaagacaaccatgaccaccatcgccgcgcggatgccgtttgcgggcccacgcctcaggcctccctgcaacctcaccgcctcgaggcc

SEQ ID NO: 22415 - DNA, 435 bp, Oryza sativa
ccgctccccccccccccccgcgctagtcccagtgcgctgccgctcctctcccgccggccgccgacgcccgcgcaccaccgctcctctccctccctcccgtcggccggcttgcgctgcctcctctcccgccggccgccccgacgagctcgcctcctccctcgcggcgatggacaacgcacggccgacggcgcgcgaggcgcctggggcggcggcggccatctctctcttgcgcacgctcgcctagcagtccgccgcccttctccccgatgggcgccggcgggagaagagggatcgaagccacgtgcctctccccgtccctcggccgccgcggccctcctcccgtcgtcctccccctccaccgcgccctcccgttccccccccccggcgccgccgcctctacttcctcgccgccgcggccggggacggccgcgccga

SEQ ID NO: 22416 - DNA, 1200 bp, Oryza sativa
tataccattcaccatagatgccaaaaggacagacaagttgccctcctgtatctagaaagaaggaatctagcaaagtagtagcaattttttgtcacttctatgtgctgaaatgaaccttttgatatcacttcttatgggtgaaggatagatgattgcgttgctcatttttaaatatatgaatctcaccatatttttgtaggaactttacaatagtcagatcatttctgctacgaatatcgaactatgagaagttaaacttaggggttgtccagatcgatgtcatttcaaactatacccttttatggtaaaattgttaaagatgtacatacatttagttttctttttttaccaaactttggtaaatacataagcaatcatgccaaaacattaatattgaactatgagaatatataagggctgttcaggtttattttggcttcaatttgaaccgccactttacacggcattgtgtgcatagtatatcagatgctggattgctgggccgctgttgttctttgccaattttaagcttaccaaaaatttggattgccgaaaaaaaattgtcactcatttggtttgctaccacaaatttggcaatgccattttttatttcaacactagcctagcaggtcttaaaaaaaaattggtagtaatccaaacaaacatcttgccaaaattttggcaattgctaacctgccaaaagaatcaactaggcccgagtcatactgcaataagcgctactactactatactcccttttagttattcctaaatgatctacatatttgtgttcattcattaggtctattcgttatttgtacattagagtaaatggacattgatacatgcatccatgcacacaaacatttgtaacatatatgcaatatcttgatttgctattggctaggaaatagtggggatggtgcatgcattaagtttgttgctagagtaaatatagtatgagagttattagcttttcttgttattagtgtacctatgaaatatacagataaatttggaatggatggagtagttttttcttccgtctccacacgcttcacttaactactcatcaataattctgggacagcgataattgcagaattgcagtacgtactagactagttcgtgcagtgcaggtacacaattaagtcacttaactccggtacttgcttcccgatccaacttaacaccagtaca

SEQ ID NO: 22417 - DNA, 1501 bp, Oryza sativa
ccccattttttccctccctctctccctcggattcgttcggaatctttccccctaaacctcgccggcgcatcaatggcggccggatcttccgcgcccgtttccccctcatccggccgccctctctcactcccaaccctatataaacactccccgtgcctccctccaccgtttccgccactcgccgctctctctctccgccggaatcgagctcgcgccgtcgctctctctctccgccgtcaccgccgagctccagtccgccgccgtcgtcgccccggaccttctcccgcttcggcgccgcctcctttggtttcgccgcaaccttgccgacctcgtccacccctccgtttcgcccgccgaccgccggaacgccgccgtccccgtctacccgagccgcgccgccgccttcctccgctccggtcgccgttcccgtcgtcgccgtcgacccggggtgagctgtggaccgccgattcgtttcccccttccctcccctctctcgggcgccgctccgccgcgccggtggtcgccggcggcgaccatcggggcgcgggtgcgccgcctcccgtcggctgtgccggcgtggccgccttcgggcgcgccccgcggctgccatgtggggcccggccgtcagccgcccgcgccctcgggtgcggctgacgcgtgggacccacggcgccggccggtgtgagccgggtgcacccggtccaccgtggaccgtgaggctgccgcgtgggccccactcccgtggacccggtccgcgcgcccctcccctcggctgacgcaataaatccaaattttaaattaaaatttaaatgaagaaattcgcaaatattcatttaaagagcatataaccttcaaatggccataacttggccatttgaactcggaattggaccgttcaagtctctaatttttccttaagaagtcaagaacccatttttgtgctttgtttctgcttgttatatggagtttattagagtaaaagccttttcttttccgttggtcgtgtagacgctgcagcttcggaagatccgctcttcgtggaggttgaagccgacgtttgggaaagcgagcaaggcaagtcacatcatctttgaacatattgaatcccagtttataaaattatgttgatttaaattattgcattatcgctttatttaaattcccgcgttatcactgttttatttagccatgcctatttacctttgttatgaccttattattgttattgttattatttccttgttcaccctagattaaacaaaaccccaactagtggacactctactcatggtacctctagtatgatgttaggtggatgcttcgctatttaattaggtaacattaggcggttttacaactctagactttgggatattcatatcacctggacactttggaattgttggagtattgtggaattggattcacaccgccccctctattcaaaatccccaaaatggttttaggctgggctcggggtgcatggttttgatagtagcac

SEQ ID NO: 22418 - DNA, 1501 bp, Oryza sativa
ggcaagttaaagcattgaaccaaacagcctctaaaaattggacgtagggagtacaaattatactacaatgcagtagtacatactcctactagctactccattgagtagtagtagtactaacaagtttttttttttgcggggaagtagtactaacaagttgaagagattttgtggtagtgtgatacagatcgatcgtggctggctactcaagcaagcaaggagacaggcgtgtttcatggcaatcgttacagcacggagcccccggtgctcgacgacaagatctacgcattagagacgccggagaggacgggcggcccgtgcgtcggcccatgggttggaagctagtatagctctggtggtggagtttggaggctgcgttgcctccgttttgcaccgggacaggtctccttcacgtgcactgccgcttttgcgccatgatggggtctcgtcccccctggcccgccgtgagtgagacgcaggggctacccggtaaaaaaggggaaaaaattgtaaccttcacaccaacccgactctttttctatttaacacacactcacctcaccaacctgattctgacacaaagtaaaggctatgttcgtcggtgaagaagatgtcgatcgaatctgtagtaggagcactagtagatgggagtagatcgtagtagagcaatacgccaatattaatacggaagttatactgcagcctgtacgcttgtacggctgtacccatcaccagtgcatcagaaaatgggagttgttggggattttcagaagctgtggatgtctgtattctggtatgctagctccgaaaaggaaaagtaatgatagcacatgtatcctttgtgtcggcgaaaggaacgggattgatttttgaggccactggggtggtgtggtgagcaattagaatcgctcatagttaaaccatggagtaagagcacccgcaatagtaaaataagatattctctataaaatatgtacatctcagcaatagactagattaatagtaaaccacctcaataatatgtctacatgggatctatagctctctaattcattgtctcatttttctctatagactatctccaggttagtaaatagctttgctttctcttttcatttaatctcttctaaatataaaaatatgctgacatggatcttttctaaagagcctatagatatccattgcggctgccctgagtgtgtatgactagacgccactaagccacaggctatcagaaacaacgaaccgtcgtgggttagttacaattgggagcagagagtgaattatttgtttactgataatgacaaatctccaaccttgcaaggaccagcattggggaaggagccaatggcaccactgaaaggaatcaccattcgtggttgtcagtatgtatagcacaaacgcacatgcaatgagaggtgtgggagcatcgtaatctctacagtaactttagtttcatggcgtctggatgaggaacattccagttcacatggagtgtttc

SEQ ID NO: 22419 - DNA, 1501 bp, Oryza sativa
aggagtcgtgagaccaagcaacagcaagcgggaaaggccatggaaggcggcggcgaggcgctcttcctggacggcgtcggggaggtcacggtggccgtcggcgacgacggcctctccttccagccccttcaccaggtttacgcacagccgcacccgccgctgcccttctgcccgtctgcgctcaccccgaatctagtctttagatcctacagacttaactggggttttgacaggagtcttggttgaattgtaggatggagtcaggaaattcgtagcttccggtcttcgggttcttgaatcgaagaaacggaaggtagatagagaggcgtagacgatgaataatgcgctggtgtctgaaatagtgaatctacaaccttgtactgtacctattagaattctgaacataggctagttggttcactatttataccaacaattttcaggagattcatgaaaatcagtggttaatgaaaagctcaggagaggatcgctatcttggccaacatggcgatattgaagtttctgtttggaacataagtagcttgtgttgatgacggtgtatagatgtgtgattgcgtctgtgaccagcataagcatgcttttttaaaagggataatattcttactcaaactagaaacaggaacactagtagtgtgtttgtgaagctatcatttcacaaaacacagcttgaaccttggttgaaatattcaataaagagctccagactcccccagctcgtgtggaaagacatagttggtgaatatgacatttttgacatgcatttagttcctatcagcaaggatagtgcaattttactattccgtcagacttacattatccatctgcaaatcatacaagtactcatagaagctatcagtttgcttttgacatgcacctgtgtgttttctgctcattgtgcttctgtacattgcaggaagtgagttcttcatgttggtcatctatcataatgcaacctaagttagagagcaagcttaagttttcagatgtctatgctgtagagcttcttgaggtgggtcctgtatgtgaaccttggaatgcaagagctaccgttcaaggcaagataaatactgaggtataacatcccttctagttactttgcagacttaattttctgtaatatgtgtcaaagcgttcgtgccatattaaataatgcattatataagctcttccagatgacaccttttacaaataattgacaaaaaactgttgctcatgcagatgaaccgatttgtcatacacacggtcacaagaccaagaaaaagaccatctccatgggtaccttgtgaatatatttttggtcataaagaccagcaaacctgcaaaacttgggtggagcatataaagacgtgcataaataaggaacaggataggcccaagagcctcatggtaaatatgatgtgcttttctgctccttgacatagcattttgacaaacatgtcagtgctgctcaacgttggtcttatattcttgcatcaactaa

SEQ ID NO: 22420 - DNA, 307 bp, Oryza sativa
cccctatctcccttgttccatttttgaataatgatcttccctttttgaaatcctctgaaataatccttcgtgccgccaaatataaatccatcccaagaataccaaaattcccgcttttgaagcccttccttgacccctcccttggatccaccttgaaccctcgtgtacaaatacacaaattaaattcaaattcaatctccacatcaaacttctctccaaatcaaaccttccagtaaaagtctattttgcctccctccaactcgctcgggccgaaaccatcctcggcccatcctcttctttcgccagc

SEQ ID NO: 22421 - DNA, 517 bp, Oryza sativa
cgaaaccccttaataggatggcattatttgagtaccaaaaaaaaaaactatttgtgaaagctaaggtgtcgttgtcccctttagctctagttttgcgaaaaatcttttcgtgtccaaaagtagaagctagtcgagtgttttgacctttatcctagagtaaacctgtcttcacgcccagttgaagaaaggtgagctcaagcctctaggagtcttagttaagccctcgttggtaggcagaccctagtaccgtcacccgctcggtaggagttgtggtgaactagtgcgtgcgtgagttttgtttggtagtccgtgttcaggtgttagaccagttgggataccgactggaatacaccacctatgtcttctgtgatttcgaaaaccgttttgatgtagtgtttttgttttccttcttttcttatcccatttctggttcagtcagatctcagtcactctgaagccaatggcacattgttctatccgtcagatccgtgcccctaaccgccctggttctaaagaa

SEQ ID NO: 22422 - DNA, 209 bp, Oryza sativa
tcctgcagccccgacataatgtacctctaactaatacaggatatcgtaattgtgttcttttgtaggtgcaatgttagtttcttctgctgaaaatatgatgacaaaactgtatagatgcatatgttatttcctagctgcaagatcatgattagatgatgtcatgattgtgttcttttgtgggtgcgtgatataccttcttatgccataga

SEQ ID NO: 22423 - DNA, 380 bp, Oryza sativa
cctcagttgcagcacggactctaagacgcaatgtggatatgatgggtgagaccatatattaatagtatagtaagtaactattttatgaattaggtattaggtttggttatagatgaattggaggtagtagtgaactgtactattaaactttctcttatgtattgggctgtgtgggtcaagtacgcctcgctttgcgtcgtcgagactcgacaagacgagaagcgtctacagaaagctgggcctcgacccggcccagaaaggaaggaaggggaaaccaacccaaatctcgcttgcgcggtcagggaccgggccggttccttcccgttggaattctccccgtcccgcggcgcaccgcaccggcaccggcaccggcggcgaga

SEQ ID NO: 22424 - DNA, 827 bp, Oryza sativa
gatgagtgattatgtacgggagggaggtggaatggatttgtatttttaaggattggtctatcggatgtaaataattgttttaccgattaaagttacaatggtcatattttttttcttatattttatatatgttttttattttgaaaagatataatgtaatggtccaaaataataggtctaagattttaaatcatgtggtagcgtaggattttttagaagcatgtgtaaaatagaggatagagaaaagtggttatctgaattattaacacatagattattaacaaaacaaattacataatccgcatataaactgtgagacaaatttattaagcgtaaataatccgtcattagcaaatggttactgtagcacggcattgttagatcatggcgcaattagttttaaaagtttcgtctcgcaagtacaggaaaaacacagatgattgttaaattttgttaatctatgtagatgaaataattatgcatttgtgaaaaaaaactgcacttaaccaaacaaattttgcatcactttgctttgactaaaatactaattagtagtaggcaactaatactctgtaactctagctaattttttttgctcttcttttctattccgctatacgagtatacgtatggatagcaaggagagagtgacagaagaggggaaaatggaaaggatgaggtctgaggggaagggcggacgaggagggcggatggcgcgggccggaggtgcgagcggagagctttgggcaggggggacggcggcgcaggcggcagggatggcttgggttggcggcgtaggcggcggggacggcgacagacggcgggga

SEQ ID NO: 22425 - DNA, 340 bp, Oryza sativa
tttggttaaatgattgaatttgttaggaatttaggattagtttttgggtgctgcttgcttggaagtttcagccatgctttcctttataatttgatactagttcaccagttggtggtttagctcatcttttgtttggtttttgctggtcagatggtggcgttgtttgaaagggatatgttctagatggtttgtttatgcagctactactaagttaagttaaggactaagctgagcaacgtgtacgaattgcacagctcgtgacatggtttctttatgggagttttgcgatcttttcatgatcaaggtacgacaatatgctccgttggcttggactgtagca

SEQ ID NO: 22426 - DNA, 1501 bp, Oryza sativa
ttgacgtacgtgttgttccaatcttttttgtgatacatacatgaacgcatgcataggtcaggtcagtcatgagaataatccctctttttaattttcttccaaaagcaagcaagcatgcatgcacatcactgtactccaagctaaccgtgcggcatacatacagagagagataagcttcatataaatatcgtactacctccatattttaatgtatgacgtcgttaattttttgtctaatatttgaccattcgtcttgttcaaaaaatttatgtaactatcatttattttattgtgacttgattcgtcatcaaatgttctttaagttgaacataaatatttttatatttgcacaaaatttctgaataaaacgaatggtcaaacgttgatcgaaaagttaacggcatcatacattaaaatacggatgaagtacgtattaattgatgagctaggtaggttagctgtatgtacccctgaatctgaagaaatattaatgtagcgtgtatgagtacgtgtgaaacggacagcccaaaagttcgtcgcaaaatcaaaccaaaggtccaactacaacgacaactacaacaactcctggtcagagctgattgcttcatacatgcatgcatgctcccttgcaagttgttactacctccgctctaattaacattttaccctaaaatacatacggtcaaatatgatgacattaaattattagcatataaatttaagggttaacatgcaaaaaatgatattcacagatttttcatgatgaatatttttcatataatttttaattactacaaatatatcttttttaataatagaattcattcctgcttttgcttttaaagaaactatatccaattattgtaatcgttatatactacaacttacaaatatataggtagaaattaagaacactactaataataaaaacatgtgtatttattgtctcaatatattgaaattaaataaaaagaacaggggcagtatgagctggctagagctagccgacaaactgatactttttgcaatgcaagagagcagtaaatatagtaggccggtacaatgcatacatctccatcaatcgatcgctctctctcgaccctgaaaatctaaaattgctgtgaatttttcaagccatctcgtgcatatattaatgaatcgatagatcgatgagtgtcttacttaacacgccgctagccaattaacgtgagccaccaaaaatgaaattgttctaaccaatcagacccaaattaaatactagtatttatattaattacatatatttttatttatatcagcagatgatgattagaataattagtccattgtcatacatgagcaaaggacacgtatactccctccgtttcacagtgtttaaatttattaacatcaatataaatataggaaatgattgagtgactttcatcgtgaaacgtatgaagtatgtatgtatatatatatatatatatatatatatatatatatatatatatatatagga

SEQ ID NO: 22427 - DNA, 1501 bp, Oryza sativa
agaggagcccctggatgatgaaggctttggtgtctagctcgtgcctgccgtcaagcgcctgtggtcgtcgccctagtcttacgctgtttctcgtttgtctttgtgtgtgctgggccttcgtcgcccatgtaataaattatctatttacgcttccgcttgttaaactctgaattgtatcaactcttggtgtaccttgcctcctgggacaaggaataatacacgcacgaaaggaacgcccgttgggttaattccggtcgtgacaagttggtatcagagcccccttgaccctaggatgagccgtagatcccaagccttagcaatattatcaaaaataaaaatcctttgctatttgtgaaaactctctagtctctctctgtcctgctgcttcatttatcgccaaaatctgacttttaaatgttgcttttctttttgtttttgtttgtagatggccggcagcgtcagtcgtcgtggtctggacatgactggtttcgtcttggagctgcggggtatgtgcgttgtcctggggtatccgcatggactggactaccagggcaggccgctcccggagcaggagggtgacgatgcagagcccacgctgcttgggaggttactgcagtgatcctcactggctcacccgagcggacttcgttggcagtcaccgcgggtggagattctttctccgccgcttgccagagcgccgctctcctcgccatcagcactcttcaccagcgctacccggacgagctgcagcactcgccctaccgctaccaccctcgtcgcggaggagcccgcgactacgccaccttccgggatgctagctcggaggatgacgctaccatcatgcacctggcgcgcatggtggaggcgtacgacgcggctcgtatcgacttccatcagatggtgcgccgtgggatggtcgagaacaacctgaagatcctagagctgcgtcaggagaatctgcagctgaagaaggacctagacgcagtggaggcacagctgcatcagctcaagatcgcccagggagaggtctgtcaccccaagcgtcgccgcgtctgccgcagccagaagatcaccgcccgaaagagcacctccaggcccgagcttgttcgtcagtccctggcgtggacttgcttcgtggagacccctcgtgccgagcccgcgcccgtggttcctcaggagggggaagcctccggcgtcggtagcacggaggatgcgctgttgctcaccttccgtcctggcccgtcgcagcggtagacgagcagttagtaggcttgcgcgtgtgttctttctcgtttgtcttcttgttgggatcttgtggggcatggttatgccggtgtgtggcataactgtgtcggagcctgtctttattttatttgcttaagcaacttgaactttaatgaaccaatttaatagcagtaataaattcaagagttatggtagtcgtggatggttagctttaattgtcagctctctctgtttgctggttctatgtggggttttc

SEQ ID NO: 22428 - DNA, 1501 bp, Oryza sativa
gggagctcgaccggcacgtcggggtcggcggcggtagggaacgcctcgggcgactcgtaaaagtggtagtatatcgacagcacggagcacggctggatccacagcatggcgcacgggatgcccatcccggcggcgacgtcgagcgcccacggcacgaagatgttgttcacgacgaacgtcaccggccggccggcgtcggcctggccgtcgatgaactcggcgagcgccgatggccccacggccgtgacgtgcgacagcacgtcgttgggcgccagctgctggcaccgctcgtcgccgtcgtcgtcgtcgtcgcgcaggtactcgaagcgcaggcggccgagcccgacgtcggcgcacgcgccgtcctccggcacgtcgcggaggcggccgccgccggcggcgaggcggacggtggtgaaggtgacgaggaggcccgtggcggcgaggcggcggccgaggcggaggagcgggttgacgtggccctgcatagggaaggacacgaggaggacgtgaggctccatggacctgagcgccttgttgcctccggctcgtgtcgtgtgttttcctctgaaacctacaagggttgtagcgtttgttgtgttggaaacaccgcaggtttacttgctagttcagctgcttctttgcgttcggtcgatatatatatatagggaaagaggcatctctgtgtgaatagcggcgcactgtgcccacacttgcaacagtgtttgaaataccggcgtcgtcgaattattggatttgtttaatcgcttgccaatttatcatataaaaaattaagccataatttaaaattttaggagttgccaagatagttaattaattaaagggcttgtttaggagagtttctgacactgcagcttctccggttagaaactcctccaaacaatatttttctcctagattttaagaatatgtaattgtagagtttaaaaaatgaatcaaaaactagaagctgggaaaccatttttttaagattctcatcagttatttttcagaatcttaagttatctcaaatacggccaaatactattaaaaacctgtcgaaacaaatatagtaatttttaagtttgaatttgtacatattcttcaaattcatatgcttccgcccggccggccggtccctgctccggacggttaataggccggtggttgtcttgcatgcatgcaacacgttagttgtaacactgcctcagtgccactgttcttgccgaattttccacgtgagtgtactggatcggagcattgtttttcaataaacaacagttttcctttgcgagaatcatgcgcatttaatctatcatattgtttgtaggctactctctctccattttaaaataaaatgtaaaatatttaaggtttatctccacgttgaacgttttcaagtttgaataaatttatagaaaaaaccgcaacacaattttcaacataaattaaacaaagtttgtcttaaataaaacgttttttagtttgattaaatttataa

SEQ ID NO: 22429 - DNA, 1501 bp, Oryza sativa
ttatttatgtcgtggaggagaggtgatgtcatcgcggcgccattctttctctgtggaagttgtgcatgcgtttactgacagcctgactgataatagttgttcaaattaatcaggattgttggatcttgaaccatcacggataaaatttatgaagaatgagaaggttttttgaaaaaaaaaaatatatatgtaatgtaacatcccggcctagggcttaataagattaatagaatacttatatcaacaagttgcaacttcttttcgggaagccaatctccaaagaactctagggttaagcgtgcttggcctggagcaatttgggatgggtggccgaccgagaaattctttccgggtgcacacgagtgaggacaaagtgttgcagaaaagacatgtgttggtctgtgagggcagtttatgacctatgaaagtctcctatcctacgacttatagaatatacgagtatggtatacctttacgtacacaggttgtttccgtatgcgttgtaggaatctgttacgaattatagaaaatatctctacgggccgggtgatttacaaagtcctacacggaggggatacagcttctattgtgttgtacgggatccgatgtctccaagtcttacttggagatcaagatgatccacggtataaaagggacccccgtggagggggtgcaaggcatcgaatctcatcgccaacacacctaccatagtttacgaagccgaagtatgcggagccaagtcgccgggagatctcgtcgaatatatcgactacgatctcgtcggtatcatcgaattcgtctacttccattgtattatgtggttttccataatcaatcccatgtaaactagattagggctattacccgataaggggcctgaaccagtataatccttgtcttttgtttgcttgatgtcgtattatgtagatcctcattccaactaccccaatacccaactcatccggtctacgagtatcactcgtcgacagtggcgagccaggtagggggccttggtgcccaaggttatgctagtatgacttcaagccatgccgacaacaatgtcaacactggtgtcaatcaagaagcttctatctcgacatcgctggtgtggactcaagtcggatctattgtctttctagtctacaccgttatgccaatctcaactggcccaaaattactatcgggaacgagaacggtgcggttacgacttcgagaaatgacatcttgccgacaattccttccacacaagtggagaacggaatatcgacgaccccaacacctagaaaaaatcctcaagcggccgaattctgtgccccgcatagaaactaagagccgacaaggatatccatcaagaagccgagatcttcgtgtcctatccataaggcatccaagcatactctagaggactacccagtgatactacacgtgaaggctgagttctacgcttgtagagaacatagaattcagcgcacttcaccaaccaatatcacctattgtccaa

SEQ ID NO: 22430 - DNA, 1501 bp, Oryza sativa
gtccgtttcacacgtactcatacacgctacattaatatttcttcagattcaggggtacatacagctaacctacctagctcatcaattaatacgtacttcatccgtattttaatgtatgatgccgttaacttttcgatcaacgtttgaccattcgttttattcagaaattttgtgcaaatataaaaatatttatgttcaacttaaagaacatttgatgacgaatcaagtcacaataaaataaatgatagttacataaattttttgaacaagacgaatggtcaaatattagacaaaaaattaacgacgtcatacattaaaatatggaggtagtacgatatttatatgaagcttatctctctctgtatgtatgccgcacggttagcttggagtacagtgatgtgcatgcatgcttgcttgcttttggaagaaaattaaaaagagggattattctcatgactgacctgacctatgcatgcgttcatgtatgtatcacaaaaaagattggaacaacacgtacgtcaatacatatatgtgccaatcctatccacctcatcatgctcgtgattcaaccactgcctggctgcatctgcgcaagcaaacacacgaaacatctcgtaaaatttgattatcacacacacacatatatatatatgtcattggtacgtatatggtatattgtttagaaacacaatataagcacttgtgctcgtaattaacacgcacacactagtaagtatcatctatcactgaaagaataatcacccataaatatgagcatctgcatcaagtttagtacttcaatccggatggatatatttcaccacaagaattcaagaaacatactcccacagttagagaaatcaaatctaatacgggatgtaacatatcatagtactaaaatatgtcacatctcgtattaggtttgtttttcataggacggagggagtaactagttgagctttaccctatatctagagaaagaaataaacagtgagagagaaaaaaaaagacacatgaatctctgtagatcatctagttggtcgccgctcgccatgtgattggcattcaggaaggcgcttgtgggttccattccggcccatctagtatagccagcttgttaatatcctccctgggccggcccaagtaacccacccactggcatggtctgctccggcccaactaacccacgactgcttggctatttccgtcattttcacgctgaaaacccccctcctcccctccaccacaatcgtcccgccaaactcgaacgcaaccgcctcccaatccccatctccgccgcacgatccgcctcgagattcgcggaatttcccttccctccctcttctctcgtacgccacccactgattgcgccacgtcatctatattactacacctctcactctcactctcagtccataactgaccaagaatctatcgctacccatcgatccaggaggaaggaggccagtgagaagcttccagaaggttcgatcgggagcgc

SEQ ID NO: 22431 - DNA, 1501 bp, Oryza sativa
tcgactccacattcccggactatgacctcgacgtcacacacatcttcggcggttcttgtcacgaccggaattaacccaacgggcgttcctttcgtgcgtgtattattccttgtcccaggaggcaaggtacaccaagagttgatacaattcagagtttaacaagcggaagcgtaaatagataatttattacatgggcgacgaaggcccagcacacacaaagacaaacgagaaacagcggaagactagggcgacgaccacaggcacttgacggcaggcacgagctagacaccaaagccttcatcatccaggggctcctcttctgtgttgggaaaaaattgagcaagactgagtacaaccaccgtactcaacaagacacacccacaagtgcataataaatgcaagggagtacaagggagttataatataaagggttagggttgcagtaaacagcatttaaagatgcttagttgctcaaagctattttgtaaacacgattctagaactatgcaatattatttatcaaggccgtgaacccacacaaacctgccttaacccaaggcctacgatgattcagaccgaaccggcaacccgaccctgggtcccagctcgtcctaagccaacccaggccaaccattccacattttagttgttaagcaggttttaagaattaaaacactaacttgggtacattgctcggcttgcccataaccgagggcgcggctattcgaatagattatactctgatcagaggtgtacatctttacctacaagacacatcttcctcacgtgcaaccacgtgccacataccaccacggtatacagacggaagacgtgacatagtttccaacctatcctagccatagacaagagtaccgacccaattccacctacggccggaacccccgggacaggcaggcaggactgagcccctagcagcaggacaccggccctgtgccacgacatctcgactaccgggccgcagctcgtgtagccttcatttgccctggagatgtccatcgacccccgacttcgtccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccattttggggattttgaatagagggggcggtgtgaatccaattccacaatactccaacaattccaaagtgtccaggtgatatgaatatcccaaagtctagagttgtaaaaccgcctaatgttacctaattaaatagcgaagcatccacctaacatcatactagaggtaccatgagtagagtgtccactagttggggttttgtttaatctagggtgaacaaggaaataataacaataacaataataaggtcataacaaaggtaaataggcatggctaaataaaacagtgataacgcggg

SEQ ID NO: 22432 - DNA, 526 bp, Oryza sativa
cctgaggctcagacatatattaggagctatagctgagcgagctagcgcgcgatttcgtctctgagtgagatatacgcaagtatttcacacacgcgaccccacatatatcgcatggggtctattcacaaatgtgtagtctatttcgcatacgccctattaattttaatcacgcgcacattttgcacatcgcgtatatgtgtatgtctctgcggtgtatagcacgcgtagtgcggcgtggcaataggattgccatgttaattgcgaccacaaattagagggtgtagtcaaagagggctgagagggcccactcaaacgcgcggctcttgtgtttttttcaccttcaccttgtgctcctttcacagagatagagcgtgctagagtgtgaagatatcccacagagtgatctagagtgtttcatgggggccattttgatttgctcagctcaactcatatactactcctctctagctgagctgagggggtctcagtcgccctcatatatgcgccacttttttatataatatcc

SEQ ID NO: 22433 - DNA, 1381 bp, Oryza sativa
cagcgagcgctcacggaggccgacattggagaccatccaagaggagaactacatgtcgacaaactaaaattatcaagaaatagccagcagctcacctttttttaattttctcttttatgtgcgatattgtttctattatcttttctgagatctgaattggaaaagatatgtaatgaaacagagaaagatgttcagtcaatttttgtaaagaaatcaagaacacgtagatcaggattgtctttttttaaaaaaatgattgggtgcaagcacaagcgagttatccattttactgcttatttgcatgcatcccaaattggaacactgtataaaagcttttgagaaaaatgaatggactgtgaatataattgagcatcacaataaaagatttattttttatttttatcttttgctcttcaatcttgatttgattttttagtggtacgatagatagagtttgtaccatttctgtctattttaaatatttttaatgatgatttactaaaatctgatcccaacatttgaaaagagtgcaatattgcactttaaagtgtggcaatagttctcatgtgcaagaaaaagaaaaaaaacacacaataatgtttcttacagaagtactgttcgtctatctctgttatgtaaatttataaaccaaacatcagttttgattagagttcttttttaagaaaatatatattcatgattattgaaacgaaactaagttttatataaaaaaaactatattgtactaaattaattagagtcttagaccactttattttagttattattaagtttatttcaaaaataaataattcacggtagtagttcgctcaataatatataatcgaatagggccgagaagatggcatattgtactgtcgggaaagagaaaatgaaacctaccgatcgttgctcgttgcttacaagtttagtacgaactacgaaaaggacattcgaaaaacggtgtgaatacttcaaataacagcctagtaggaaactgtgttgttttttcagcttaggaagaaaagcatcgatgtgtcgatttcgcagactttctttccaacgtaaaaacaacttctttgtcctatatatattttttattttttattgtaattattgaactgctgccgcgttttcgtttaccctatacctagaccaggtgattataaaattcagacaattcgatcagcagtacggagtaacataaaagccatttgctgtctaatttgatatatgaatgagcatttctttgtagaaaaaaaatgtagtgcgcctgaaaacagggcaaggaggtgaagattgatcgatgaaagcaaaggaggggtgatcaaacaggtacctgaagcaacgcagacagatggttttctctcggcggacagaa

SEQ ID NO: 22434 - DNA, 1501 bp, Oryza sativa
gatgtagggttattacctgacaattcaggggcccgaacctgtataaaaatctctgtctccatctcttttacctcagtctcgtatataccctagtaccaacgatccccatactatgcaaataccggaatcgcgacatcaaacgtcgacatctcttaagtattgagtttaaaaatgtaaaaaatatatgaatagacttgtcttgaaaaatactttcataaaagtatacatatatcacttttcaataaatatttttatgaaaataagaagttaaagttgtattttggagaccatgtcgctgtcctaattaaacgacttataaaacatggtagttgatacgtactcatcaactatagagaaatgcgacatgcatttgtgtagactaattatttggataataagattgtcgaaagtaaatcaggaaattaatgtcactgatgtaacactgatgtaacttgagttggcctagatacagattaattattaatgtatcggatgttttttttaatatgtaggagatggttttatgttttttttataaatttaatcaaactaaaaaacgttttatttaagacaaactttgtttaatttatgttgaaaattgtgttgcggttttttctataaatttattcaaacttgaaaacgttcaacgtggagataaaccttaaatattttacattttattttaaaatggagagagagtagcctacaaacaatatgatagattaaatgcgcatgattctcgcaaaggaaaactgttgtttattgaaaaacaatgctccgatccagtacactcacgtggaaaattcggcaagaacagtggcactgaggcagtgttacaactaacgtgttgcatgcatgcaagacaaccaccggcctattaaccgtccggagcagggaccggccggccgggcggaagcatatgaatttgaagaatatgtacaaattcaaacttaaaaattactatatttgtttcgacaggtttttaatagtatttggccgtatttgagataacttaagattctgaaaaataactgatgagaatcttaaaaaaatggtttcccagcttctagtttttgattcattttttaaactctacaattacatattcttaaaatctaggagaaaaatattgtttggaggagtttctaaccggagaagctgcagtgtcagaaactctcctaaacaagccctttaattaattaactatcttggcaactcctaaaattttaaattatggcttaattttttatatgataaattggcaagcgattaaacaaatccaataattcgacgacgccggtatttcaaacactgttgcaagtgtgggcacagtgcgccgctattcacacagagatgcctctttccctatatatatatatcgaccgaacgcaaagaagcagctgaactagcaagtaaacctgcggtgtttccaacacaacaaacgctacaacccttgtaggtttcagaggaaaacacacgacacgagccggaggcaacaagg

SEQ ID NO: 22435 - DNA, 1501 bp, Oryza sativa
gtgtttattgttgaataaggaaaaatttcctttctaacaatggtgttgattttctgtatgtttacctttcagtgtgatttgctggatttgaacaggtcgaactgttattcaatgtagatccgcttcttctaaggtcaagtttccttttcctgttcagtcttgataagcgtgcgagttccgttgagtttacttcagcagtgaagtttgagctgtgaaaattggatgtcaaaacagggagataactactttttttgactgattctgatgtattgtacctattcggaaattaattgttattaaatacatacgcttgaactgttaaacttggatctgaaaatcagttcataattgttgcggttgaaataaattgttattaaatacaggaccttcataggtaattgtattcttcgcctataattttacctttgcaggggatttcctgtgtctgcgcttgactcattgttgctcatttgaaacccagtccttttttcatcaagttttcttttcctggtaaatgttggcatatccttgttaaatatgacgcatttcctttttagtaattgtgatgataacttgagtgtttacctttgaagagcatttgtttcatccgcactggagtaatttttggtcgatggagatccgctccttctcaggtctagttttcttttccttttcgatcttgctaaccgcgataattcctttgaattggctcgagcagtcaagtttgaactgttaaaattggatatgaaaatcagttcataattgtcgcagtttgcaggagtcaatcacaaacgattaaggtatttagggtgattcttacctgtcctgtgttggactgccatcatccgtagggtgatttccactctgcatcgtgttttcctatatttttgttgtgcaagtatcaactgcgaatcaaatgtcaaaaaatataaagtatcaactgcatatgtgagtgtttgtcaatataaatctataagttgcactatgatggaagatgatggagagaactgatagggacctgactggtgtctccggaagaaaggaagagtagattatttattgcagcattgttgtaagattaatttatataggaatatagagtccgtggagtttccatgaacctatgtgtcgtggattagtactccatccatattattactatacttgaacaattgtcttccattctttttaatggtatcgtttccattctatgtataagatgtaattccttaatactgtgtacggtcaactctattttgcaatacttttagtacggttatataaaaaacaatgtggctttttttggcagttttaaaattgaaattattggtacggatgataagctgaatagatggtatattttttttattgtacttgaaaatagattgcatatatatattgtcaaatttctaattagatattttttgcctgatttttacagaagttaattaaattattgtaaaatccatttaaatattacacatttggaaagttcctttga

SEQ ID NO: 22436 - DNA, 308 bp, Oryza sativa
cttcgtgttggtgtcctcggatagcccggccgagctcactatcaccggtggcagcgtcgtccagtgctaggccggcgatgacgtcatcgtgacgtcataaatcctttatttaattcgtaataattttctgtattagatgaaaatcgattaaacttcggaaattcataactaaatcatcgtaactcggattcgagtggttcaagttgctaaattcatctaaaatcgagatctacatgttaaaaatatccacatatactgtttatgcttatttttgtactgttttgttgattttgtttatttgctttagt

SEQ ID NO: 22437 - DNA, 1426 bp, Oryza sativa
cctcgccggcgcatcaatggcggccggatcttccgctcccgttcccccctcatcggccgccctctctcactcccaaccctatataaacactccccgtgcctccctccaccgtttccgccactcgccgctctctctctccgccggaatcgagctcgcgccgtcgctctctctctccgccgtcaccgccgagctccagtccgccgccgtcgtcgccccggaccttctcccgcttcggcgccgcctcctttggtttcgccgcaaccttgccgacctcgtccacccctccgtttcgcccgccgaccgccggaacgccgccgtccccgtctacccgagccgcgccgccgccttcctccgctccggtcgccgttcccgtcgtcgccgtcgacccggggtgagctgtggaccgccgattcgtttcccccttccctcccctctctcgggcgccgctccgccgcgccggtggtcgccggcggcgaccatcggggcgcgggtgcgccgcctcccgtcggctgtgccggcgtggccgccttcgggcgcgccccgcggctgccatgtggggcccggccgtcagccgcccgcgccctcgggtgcggctgacgcgtgggacccacggcgccggccggtgtgagccgggtgcacccggtccaccgtggaccgtgaggctgccgcgtgggccctactcccgtggacccggtccgcgcgcccctcccctcggctgacgcaataaatccaaattttaaattaaaatttaaatgaagaaattcgcaaatattcatttaaagagcatataaccttcaaatggccataacttggccatttgaactcggaattggaccgttcaagtctctaatttttccttaagaagtcaagaacccatttttgtgctttgtttctgcttgttatatggagtttattagagtaaaagccttttcttttccgttggtcatgtagacgctgcagcttcggaagatctgctcttcgtggaggttgaactcggaatatgttcacatcatctttgaacatattgaatcccggtttataaaattatgttgatttaaattattgcattatcgctttatttaaattcccgcgttatcactgttttatttagccatgcctatttacctttgttatgaccttattattgttattgttattatttccttgttcaccctagattaaacaaaaccccaactagtggacactctactcatggtacctctagtatgatgttaggtagatgcttcgctatttaattaggtaacattaggcggttttacaactctagactttgggatattcatatcacctggacactttggaattgttggagtattgtggaattggattcacaccgccccctctattcaaaatccccaaaatggttttaggctgggctcggggtgcatggttttgatagtagcac

SEQ ID NO: 22438 - DNA, 1501 bp, Oryza sativa
tgtccattaatgtcaatatgctattgtgcaggtaaggggaaaaggttgtggaaagaagagtacaaatatgggaacttgcacaaaaagtgcaattgaaaatacaattcaagatgatgaagtatttgatatatttgttaaataaatcatgtattttaacataaaacttttttaattaactaactaagaacacaaaatttaggtgcatgacggaaaaattgcttcaggaactgctaaaagaccatcaaggaaatttataatttcagatagtgaggtactgcatgagacaatttatcaagttattaattaatatatttttttttgtaacaactaatttttttcccataggatgagcacagcagtaatacaaaggtgactggggacagcaccagctgtaatagtagtaaggaagatataaacaaaggtcgatgcaattataatattgagaacattaaagttcacatgaatgagcagtccagtcgatgcagatcaacaaggattagaagaccacccacccgatactcatattaggtacaacatattacttatgggaaaatgttggttgctttagatttggtttgattagtaaattataataatatggtctttcgtctgcaggtaatttatcgtcaagaaggcccaaaagaaccaattaaaaggagggttcagccaatactttttattgaagaatagtattatatatgttcctattaatttttatgttcattagatattgtcagatgtaacgtacaacttgcacttgccaaaggaatccttggattactttgtttatttctaagatagagagttaataacattcaatataaatgcatgcatgtaccttcagtacatgtatatgagtcgatccctgcttgcttcctctaccgttgatatcctaaaagcatataaaacaagatcagttgatttatatttcttaattaatacaaatccccaagcaagaaacttaatgattaaaaaaacttgattatgtaaaatggaaatcaatcaagaaagatgagctctcggggctaccttcgctctcagccatgcttgatgttgctgcacctgctatccgcactgccccaacacctgccatccccactgccccatttcctacaaataccacctcccataccagagccaactaaccgatggctaacactactcctgatctagacatcctgcggtggatctaccaaggcactgacttggatgccctatggtggatctagccaaccagtctttcagccgtcgctaccacaaggcattccctctcaaatcggctccgatggatgagtagtggaggagaaggtagtgatgagtgagctagatagattggagaagaatatatgttcagattctccgccgcctggccttcgccctcatgtggccattcgggacaggaagacaaacgcgaccgcagcgcagatatgtggccaggaagggcttgggaggagataacgatgtgcctgcaattttacactttggtcctgcagtggatttt

SEQ ID NO: 22439 - DNA, 1501 bp, Oryza sativa
tgtgccacttcatcaaccatgagtgctgtcatgtgaaaggagatttcttcgacccagagggtgccctagccacaagtgacgaattcaaggatcttcgggagtggaacagtgctatgccataatgtattaactacatggcgtatttaaagtgacaatgtaaaaaaatattgtaatatatatattttggcaacacttttgagatatgtaatatatgtacatttatcattaccaaatgcttgataatcttctaatatatgtacataataatctacctgcaagaatttatattaaataatttaaaagtaatttacgggcaaattattattaaatttcaatattttctacctatcttcgcaggcggaagttttttttttcaggtggccgattcctattttcgcaggcggaccggactagccaacgtccgcctgcgaaaattatctttgctggcggacggccaccccgcctgcgaagatcggtgatcttcacagtcgttggcttacaggcggactgccgccccgcctgtgaagacccttttcggccgcttgtgataatgctgttcctagtaatgatatgccatggggtgatggggggtccaacttataaatagtccctgcctgcgtcgtatttttacccttttcgatgttccagtaattttccatgacataactaatcgccatatatatcattcccttcaaaacatataaccaacaaagtaattaaaagcagcaatgaacattgtcgaataacactgcttgacatcttggggttattttccaagtaaggtttctgagcagtccaatttgaagttttaggaatttctacagttatgccctgtggacagaaaatgttcaaatatgtaaggattggacacacaagcacttccaagttttttctttctaaactaagaatgcataacactacaccagaatatttaaccttgtataaccaatttattagtacctaacactagcgtggcatgtgcaattatattcctctggcagcatctacggatctagcaaaaactagctagttttatatcccaaggtttctgcagcaaatataaagataaccgtgggtatccatgattttttatttcactctcgatcgatcgatttgcacgactgattttgagaaaatttcttatatattcctaaatttttatccaatcccttctatactcctaagttttgctcatttgcttatatacttttgaattttagtttagatctattccatatggttttcgttagttgaccgctagtttagcattaaattaaagtgctataaaaaatccattatgctttttagtatgatgaaatatataagttggagtgtagaaatttatttgttcttacttatcaaaaaatttatatggagtatttttatttttagatatgatataaaaagtttgttcttacttatcaaaaaatttatatggagtatttttatagcggcaaaatttgctacaggacacccaaaatttatgtaattggctagaaga

SEQ ID NO: 22440 - DNA, 244 bp, Oryza sativa
atatgaagtgttcagctatgaaatttactaattctagcaagccatagttatgcatgtcaacaagttgggttggcgatgttttaccctccatataggtctttgacccttcatctagcaagctgaaaaacgacccaactctaacaactaatttcaactcattgtgatttgtcctacaaatcatagcaacaaaaatatacatttagctaattgttgcatgttacctgtcgatgatatgggcccgggg

SEQ ID NO: 22441 - DNA, 1501 bp, Oryza sativa
accctccttgcacattttcttcagctgcaaaagcattcatcataggatattagtgaaccatagatggaaccttaatactaaagaaacaactacattttaagaagaattccacagttacagtgcaactacgctatggaggtgcagggtgatggttttgcatatcgaatttcttaagatgaaaacatgtcaacatgttggattgatactaagatagaaatcctgatttgcatagcgccttttatccattttgtggggtaattcaagggcatccctatatcaatttattcaaaatattcaggaaattgtggtgcactaattttggatttgtactggattcactttcagataggtgcaaagatgtgtgtgctgcatgtataaaatactcatcaattgaaaacatgggttcaggtcttaaaaccatgttgaacagactccatgaaaattttatagataaggaagtccatggaaatactgaccatatgctcaagcttgtgctttgaaacatcccctggaaaggaaacagaatgaatttatgttacactgtgtacatgtatatagaaacaggacacggtcacattttattgtatatatggaaatactcccattttattgtcatgtattcatcatgctagtgctatatttttgcagtatatactatatagtgccaggcaggtaccatgccgatacataagaaaagccttgctccatcaagtgagccttggataaaatagaattattaaattgtttgttatcgacaaactgaatttgatttgtcaatatcaagtgagccaagctccatcaacccaaaaaagaaaaaaaaaaaaggaatatgcctttcagccgacagtgaagtgaatgaatggatacagattgtactctggtggtgaggataaatcgacaagccatgacttgttggccatagatgtgttgccttcattcgattatataatcctttgacccaaagattggaagccactttcaatttcccaatctccactccaccagagtactccactttgggatgcgtgcaatttaatttattttggtggtgtgaggctcaggcagccctagccccaaaggtgaaaaaaaaagaaagaaactttgtatagtgaagtataatgcaactgtgcaagatagggcggagttggggaagaaaggagaggaggtgaaagggtagaaagactgacgatatctcacctctgtggaggcagtcgaatgtgtcctcggcggcgaccttgcacgccccgacctgcaaaacaaaacaagaaatgcatttaggaggattaggagtttgtgattaagaggagagagggggaatgggatagattaagatggttacttacggcgccgatcttgaggaagccgtcgacggtgcggttgaggaaggggttccccatgtcgatggcgacgtcgatcctgggcgagcttatcgaccccgagaacccaccgcgaggcattctcctcctccaatccaatccaacgtatgtactacctcgacttc

SEQ ID NO: 22442 - DNA, 372 bp, Oryza sativa
acactttactatcggttggtataacaaccggactaaagattgaaaagaaagatcatggtagagaaagagctgtgcgcgtgcgtcctttatttttcttcccccttctcttccttatcttctccccttcccctctcctcccctcctcggcttctatcgaggcgggcgggtggggcgggcccgatggcaatgggtggcagcgtcgacagagcctcccccaccttctattcccctctcctcggcttctactagcagtgggtgggcagggtgggcccgatggcggcgggcaacatcggcggcgggaggcatccgaggggtggtggcgctctgcccctccttccccttccctccttggcagcgggcagtaggcggtga

SEQ ID NO: 22443 - DNA, 1501 bp, Oryza sativa
tttcactactctcatctgatgagacatgactaggctgtaactgaagctgaatctaaagaggaagattagtgtgggattgcagacaaaactgctactacttccttcctgcactgcaagaagaagaaatctgtatccagtctgtgttgaaccccattaaagcacacacagcagcttcgattcagacagcaaaagaaacattctgatagatagcatcaaattgatactagtatttcgtttgtgtcaaaaaaactctcgatatgtcgtaatcaaagctcgaaaatcccatttgtttgatacagcagcaacagcaagaaaggaacccctactccgatccagccactgaaacagtactaatgaatccggattcgcgcattcatcctatctgatgtgatgaaaagaagctagagtataagaatctaatctgggagaaggttgaggtcagtcgtcgaaggcggatgaggggtcggcgaggtgggcgaagcgggcggcggaggcggaggagaggaggaggaacttgcggacgcaggacctgacgcagtcctcctccttcttgccgagggttcgccggtagaaggtggtgacgcagtcggagaagcaccggtgcgacacccagttgtacagccgtatcctgcgtgcacaaaaatccatccatcgctactccactctctctgcgaggaggaagggaaggaaagtaagagattaaacgtacgcgtctcgggtctggagcttgtcggcgacggcctccatgcgcgccttgtcctcctcctcctccccgccgccggcggccatggcggcggcggcgtccatgctcttcttcagtagcagcacaagaagaagaagaagaaggagaaggagaaggagaagcgtagcccaagccctaaggccctttagtatagttgaagtggtgagatgggccgtggtgggccttcggtaattgagcccatgggctcaaccccgaaaatgccagtgggctaggtgaggtaaaccgtgcacgtgacgctttcagtttcttttcttttctttccttattatatcatcaaaaaaagaaaagaaaaagagaaaaaaaggtatggaagatactgtatagtatacgctagcagcataagctccgtccgtataattatttcttgtacgcatatgatgtacagtatgtattttacgagctgtatactaccattgcgttggatttatgctggagctatttgcctatgtagtggagtattctagaaggatgcttgtgcgccgtccattgcctgcagaaacggacggcgcgggtgggtgggccccacagggcggtgactgacgcgtgggccaccacattgggatttggctttgctttgctttcgtgccttgtcagccgctgcccccggccccttcttctccttcttcttcttcttcttcttcttctccctcaccatcaccaacaagagagaggaggagtggattcatcgatcgagaagtcgaggtagtacatacgttggattggattggaggaggagaa

SEQ ID NO: 22444 - DNA, 1501 bp, Oryza sativa
tcatccccctcctgagggcgttgtcgtgctatctcaccccttaagggtgattgccaggcgaaagcccagtcttagctcctttgagtcccgacggacggcggcggcggtttttccgtcgcctttcttcttgaagacgtcattttggcatcccctagggggcgatctcctctgtgtccctttattggtctagtggcggtcagtcatgcttagtgacagccggtccgatgctagccttcttctgggctggtgtgttggcgatatcggtgtgtgggtggtggtatatttttttcctttttcctggttacgaccttacagggttgtaatcttataatttttttctgctctatcaatataacttcgcacagtttcgtacgggtcgttaaaaagaaagatgatgcatatgcagtctcgatgtggttgtagctgtgataaagaagcttgctgtgcagagttttggtactcgagctcttgcttggtggagatactctctgagccatgtgcaggatgtgattagacaatggatttggtactagtttgctagttgcatggaagagctgagacctgtatatatggtgggcgcatgcagcggcgcgcgtggtattggagttagtctttacttatcggagatactagtctttacttatcggagatagtctttactttatttctttatcgggttgttttcgtttttgttaagattttatattttgtgtcggatcggttgattgacgcgtatgcaattagtataggcaaaatagaaagcaattagcccacgattaattaagttttaactattacaaacttgacaaattgatatatttaattcttttaaaacaacttctatataaaaagtcttcgcacataacacaccgtttaataatttaaaaaacgtgctaacgaaagtcgagataaaatctaaatcttaattaatcagaaaagaatatggccacatagtaagttaattaatttatttttttttgttttagcgactgaaataatatttctaacaaattttttagatggagggggaatatataacagcaggtacaatagcagactataagccagctataaacatattttgagaagataaatgatgagagagaaaagtagtgggttacagccagctgtgcaacatgtgctctaagataaatatatgtatgacacgtgggactaggtattaattgtgtactatatgttataggtaactattggataaattggctattaaattaaatatagataatttagagttagtagttagctatagtattaaacttgctctaaagcgtcttaatcaaaacgatttaattatagatggtttcttgtagcatcgaggtcctagctagttgtaaaaaagatatacagtagcccgtcatcatcaaagaatgcctatataagaccgagctttggtagccagagatctcaaagctatagctacatcatttcctcttagagtagttgccgtccactccaatactgcctgatgggatcctcgggg

SEQ ID NO: 22445 - DNA, 1501 bp, Oryza sativa
cgatacttatatgttggagtattttgcaatcaacaattaatattatttcattttttgcattcctgtccaaactttcatgtatagttcctactacacttctaaggtaccaaattctgaaataaagctcattgtacttttatgatatgttcactgatcaaaactactattgcaagtctgatatgttcaactgtacttctgatgtaccaacacattagctttgtttattgattgaaatttatttttgttctattagtaccgctgtccaagtgtgcagatcaattcgtaatcgatcagcaggcctgggtgttgcttcaaggtataagtggacttgattgaaccatatctatttgtttgatccttatttgcatataaacagttgataggtactccctactatggtatgttgcggggtatattttaattaatttccttttgagatttattattttataagatggggattgttcaactgcaactgatttcgtagtctattgttcagacatttcatttaagcccatccatatagtttgtgaaatataacagttgggccattaagagtgtgtaaagaactcgctgagtcattctatcaaatgtagagcaagatcgatgacatgcgctcccagtattacctgacatactattatctggcttctttggtaaattcatctgaatcacatactagaatgttaaaacgacactgtatatagtgcatcattgtttgaatgagttatcatcaaaagcatcatgctgctagttataatcaatgtagaaaggcctgaatttattcttgtgatttatgctgcatttcacatgtgattagcatattagacaattatacacttttgtcctgaatggttaagtttgccatttgcaaaacgaagtatgcatttcagttagccagggtattattccagattaccattgggtttgttttttggctttgcggtgaataagtatagtgcatagttgtgtaattgtacctgctgatgcattagattagtacggacatttcacattcaaactggtatcaaaggagtttttagaaatcatggtttacatacatctggaatctttcccctcagtaatgaataatgaagtcactaagatataatgtacactgattggattatactgtacacaatgtggagttcaattttctttctattgcgcattttagccatacttctattgtattttagtatgtggattgggatgggtggttttagtctttaatatgcgcctttagtttgaacccaggcttggagaaatcctggttccgccactcatataagcaaatgtatatattgtgtgacacaaatttttttcagtttgaaacttattttactcaacctccatcctctctctctctctctctctctctctcacaagagaattgtcatcaaatgtattgattcttatgcatgctatctgaaaattaatgttatgttctcaggttctgaccattaaccagtggtacacattctcatgttttggaaagagc

SEQ ID NO: 22446 - DNA, 464 bp, Oryza sativa
tgaggtgtgtgtgacttgccttgctggccttagaactcttcaaaatcttctcctgcaaaatcggactctccgggaacgtcggaatctaaacataaaagagcaaaatcaccaaaacagtacataaacaatcataaacagcacatgtggatatttttaacatgtagatcccaattttagaaaaatttagagacttgaaccaactaaatccgagctaagatgaattagttatgaagttttaaatattaaaccggattaaatcatttatatagattttaattggattatgacgcaataacgaattatttttgaaaagaaaaaaggatttatagtgtcagtgggctcgggttcacggtggacaggttgcacggaagcggcctatggaacgaacggctaagatctaatctaaacaaaacggacggccgagatcgatcggatctaccacgggtctacggctgatgtggagc

SEQ ID NO: 22447 - DNA, 1501 bp, Oryza sativa
ttgctcttcgttagatggaggataaaagtgacatttcccattctgatttgggcaaatgggcggcaatggaatcttttggggctgtcattggcggtaggtttaggcgccgaacgaaaaatcctccatccatgagtaattaacattatccataaatcgaaaacattcaaattatactaatctatctggattaacaatttgactttaaaaatatactccctccgttcaatattatataacttgaaaatttggattaagggggtgtttagttccagggtgtaaagtttttaaagtatacggacacacatttaaagtattaaacgtaaactaataacaaaactaattatagattatgcccgtaaactacgacacaaatttattaagcctaatccattagcaaatgtttactgcagcaccacatagtcaaatcatggcgcaattaggctcaaaatattggtctcacaatttacacgcaaactgtgtaattggttattttgtctacatttagcactcaatgcatgtatgtaaacattcgatgtgacatttttggaaaaaaaaatgtgggaactaaacaccccctaatattatttttttaaagcaactttcctataaaaactttttggaaaacacagacaatttagcagtttaagaagcattcaccgattaatcggaatacggttgtcagacggaatacggttttccacaacactgctttaagcatgactgaatttatttttagaaactagcacctataatatattataggcgtctttttttaattaattggcacctatgacaaattaaaggtgttggtttttttttaaaaaaaaagaaaaccaacacctatagtattggtgtcagctcttctatgtcgcgttttccatctactccctatccacgtcgcgaaatttgccgacgctttccctttcccgtgcgtgggagccgccgccgctgcactcgatggatatgatcagtgatagggaagggtgctactaaccgggactcgtctctgctgtggacgtctaccacaggggcgcggtcgtcgtctcccatgtcatcgagacctccatgtcatcctcgtggttgctcacctcgccattcaccatcgacaccgtggaatgcaagaacctggttccagcctcggtggcgttgccagtggatctaaagccaagctggaggatgatcggcgacggaggatttgagccaggcaggtgataaaatcgtctcagtttaccattcatggatactccctccgtcccataaaaaaatcaacttctggctatgaacctggacacatgttgcgtccagatttatagtcagaagttggttttttatgggacggagggagtatataggtccaattgaaaattgaattttaaaaattttatgttcactttaaactgggtgaaccggtcagtgtttgtaggaaaaatgttggaccggccggttttaatagaatggaccgggtggtttggaccgacttacccctcattcttatcggtag

SEQ ID NO: 22448 - DNA, 999 bp, Oryza sativa
tatatatatgcatgcaagccttacgaatattgtctcatgtatatggaactaatccttgttgcaattaataatctttcctagtgatctaaattttgctttttgagatttggaatgttttgctttgagagatttggaatattgcctctcacacacaaatatgtaactaatctatgttcgttcacgacaagtacatgttttgcttttagatagatttcaaatcttgccttgtgtacacgtacatatatttatggaaataatgtgcgggccctacgaggtgctgaattcctctcgttacgccacgtggcaagttgagagtgttttgagggagacacgtggcagcttaagagcgtttgtagggagtttaatggacttttagtatataatagatagattttacggcgtttgtagacaatgaaaggtaaattccaacacttcaagatcaaacatataccaagtaaaagagaagtattgatgcgtttgttttctagataatggaatataatatctcggtctttgctcaaaaagagctacagccaattattacaaagttccactccagaagagagtgtagttcaagacaagttgaacacactaaacaggaaaagagaggacccaaactaagaaaagcaaaacaaaatgtggagctagaatgcctcgtcaaagcctaagactgaagttcgaagccaatacatagacccttagacaatccttgcacgaagaggtttctccaaagcggtgcccccaaggaggatgagatgtggatcgccgccaccgctcgttcggaacgaagcaaggttttcacccggaaaatatggttaggaaaggagaggggtaatctaaaacgacgcctccaaggaggggaacgacgccaaacggcgtcgccgtcgttagccggccaaacggctcgacaaggctttcgcccgcgattccctgtccaaaaccacaccaccaatccacacaagaaggatctttgtcggtcaacaacattgtcccttcaga

SEQ ID NO: 22449 - DNA, 1501 bp, Oryza sativa
ggtggcgaacacgacgtgcgtgatgctcgacgccggcttcccccagttaccgatggcgttgcacgccgcctctgcgccgagccgaggtatgccctcctcagcaacctgctgccgtacgttgagcgaggtggacatgtacgccgtcaccgacgggttggccctcagccactcgtcggagatgtacatgtgccgcttctccgtcgttgtcttcttgcctacattgcaatgcaatcacattattactatataattacttgggcaccatgaaaatctagcttatctctctcatatatatgtgtgtgtgtgtgtgtttgatgattttatggcagttaagtttatggatcgatcgtgacagatacagaatggtagtttcgcatgcacttacagatgtttgcaaacttggcttttagatcgaccaagtgattgctattggtaatctcaaagtaataatcagggaatgacttctgctcatacacatgcaccggcacagccgtgccgattcccaagattgttggcttgttgctctcccgccggcacgaggattgttgctcaattcatgtgtcaactccggtgcccccgaggatcccatcaggcagtattggagtggacggcaactactctaagaggaaatgatgtagctatagctttgagatctctggctaccaaagctcggtcttatataggcattctttgatgatgacgggctactgtatatcttttttacaactagctaggacctcgatgctacaagaaaccatctataattaaatcgttttgattaagacgctttagagcaagtttaatactatagctaactactaactctaaattatctatatttaatttaatagccaatttatccaatagttacctataacatatagtacacaattaatacctagtcccacgtgtcatacatatatttatcttagagcacatgttgcacagctggctgtaacccactacttttctctctcatcatttatcttctcaaaatatgtttatagctggcttatagtctgctattgtacctgctgttatatattccccctccatctaaaaaatttgttagaaatattatttcagtcgctaaaacaaaaaaaaataaattaattaacttactatgtggccatattcttttctgattaattaagatttagattttatctcgactttcgttagcacgttttttaaattattaaacggtgtgttatgtgcgaagactttttatatagaagttgttttaaaagaattaaatatatcaatttgtcaagtttgtaatagttaaaacttaattaatcgtgggctaattgctttctattttgcctatactaattgcatacgcgtcaatcaaccgatccgacacaaaatataaaatcttaacaaaaacgaaaacaacccgataaagaaataaagtaaagactatctccgataagtaaagactagtatctccgataagtaaagactaactccaataccacgcgcgccgctgcatgcgccc

SEQ ID NO: 22450 - DNA, 1501 bp, Oryza sativa
gcgagattagttttcggaaagggttaaattgtcaaattaaatgcacgtatcagtacctcatgtaagagaacattactacattttaagccactacaattcttatcaggatttgcttaggaaatataaattgtaatgagagccacaaataaatagaagcaagatttactgtgcaagttacaatggatttgatgtggaaaaggtgatccatacgatttggcatacctctagtgaagtaacgatctttaacaccagttgaaaaccctcctttagtaatggttatttcaatcggtttagtactgactaaaaatgttttcagtgacttggacttttagaactagtaatatactaaagcatctttagtatcggtttttaatctaaccgagatatttgtgattttgggtaccacgacgaaagatcagttctccagtagcgtagacaaaagaaagatgtggggagctaatggaaattggttttcaaaatttcatgcatgtcactagatattgtatagtcttatcattcgtcgttactatgttgtcattttaccaaagctaactgtaggatcgaacaacaataactaagtcaaccagaggcggggtgaatggttgtaatatccaaaaaccaaaacttttagcagaattaaaagttaccctcgaatcgatgaaacgtggtatgatcggagaagttgcgcctggaagccgccggtctgacagccgaaatctgctgtcgtcgcctgtagttgccgccggtctgatcggtgcgacgccgtcagtctgaccgccggtgtcccaccggttgaaccgccgaacctgagcaaacacaaatcgaaaaactctcaaagtagacgataactttattacttctctatgtgtgttacaaagtgcaacaaaagcactcctcacaaaaatctcgactaaactcgaaaccctaactattctctcgactcagtgctctataaagcgataccgggaggccacaccctccctctctatttatacatgagataggcatcctaaagctacgaaccaaactcatacacgaagtccaaatctctctaggaaaccttcccgtacaagaaaccaactttacaaactccaattgtaccaaatttggacttcttacaaattcaactctgcatcccatacgtacacaatatctccatcatatgccatatggaatcttttccaaccacgcacatcaatctttagcctaagtgtcccgcatgatatctgaccgtttggacgtcaccttatctccaagttgactcccgatctatcaccggcaatactctcccgcgacgtcaagattacctacacatgaattaaccaagaaactatattccaaggacaagctatctccaacttgactcattgttagcaaaaaaaaagaacagtattacatacgcatagtatccatctagaagtcataaacacaaattacctacggatatccaacgaaacaacccgaaaccaaaaccgacaaaaagtgaaccggtcagaccgcg

SEQ ID NO: 22451 - DNA, 1501 bp, Oryza sativa
agctacagatgttgatggtggaagaaattgattgacccaggctacatgtgtgcaagaccgaaaatcaaagaagtggtctatatatggcttctaagatatattgctatgactgtcaaaatgtaatgagtgatgaaacatggatagattgaaggttaagcaattagtagtagtatatctatgcgtaaaaagaaagggagatccacaaacagaggtgggggaataccttgttggtggatccatgtcttgctgggcacatgacatggcctgcaatctgcaaggcaagggcaaagcaggcgtcacatatacgctacccctccgactccgagcacctccgccggcggccaccgctccgaatcgacgacctgaccacgaccaagcagaagcaggcagtcagtcagtcaaacctccattaccacatccaacaaatcgagggaaagaaagagacgatcgatcggtgctcacaagtagagagctacaaaagagaatttgcaaaacaaatttgacacagatgataagtggcaatgtgaaaagaggggaggagattgaacttgaatccggaggaggaagaagaagaagaagacaaagaggaaacttgcagcaattggggggaaaaacaaccgagagtccaggctggccatcccgactacatccaatacaacaactatataataataataataatttaaataaacacggaaagaaggaaattttaaaaaagaagagacacaacaacacaaggggcgcgtcgggatggtccaagtcagcggctggcacgcattggggaatcaattgacggctacgaaccacgcaccatcgcaaaaaatgacacaggacgaacatttcacatcaaaaaccgataatttttcattccaaatcatcgactttggatccccggaaaatccaattgcaacccccagtcagtttcatcgggggatcaaaaatctcaaatttcccagtgaagcaagaaaaggaaacagcttgcgagagatgttggatctatacatcagccaaagtggcaaggcagggaaggggtcagtctgtattcgctcagatctccgccgccgcccgcgtttgttgcacaataccgaccactacaattgaatctggcaagcaattgggaagaagaagaagaagaagataggagaggtggagaagagaagaatggaggaggagaaaatggaggtggctgtggacttggcgtggtggagaaagcaagaaagaaagaaagaaaaatttacgactagtaaagctgtttcccgactctagtgtattccattgttgttgaatttgtactagtagttgaatgttggtgttctttctctcctactactagtaagtagagtattatcctctgatgatgatgagtctccctccactccaactcggcaaatcgtctccggtctacgctcctcgtggagcccacgcacaaactatcttctcttctctttttctttttcacacacaagtactatttttattcaatttctttctttaattaatt

SEQ ID NO: 22452 - DNA, 1501 bp, Oryza sativa
gcccaccatatatacaggtctcagctcttccatgcaactagcaaactagtaccaaatccattgtctaatcacatcctgcacatggctcagagagtatctccaccaagcaagagctcgagtaccaaaactctgcacagcaagcttctttatcacagctacaaccacatcgagactgcatatgcatcatctttctttttaacgacccgtacgaaactgtgcgaagttatattgatagagcagaaaaaaattataagattacaaccctgtaaggtcgtaaccaggaaaaaggaaaaaaatataccaccacccacacaccgatatcgccaacacaccagcccagaagaaggctagcatcggaccggctgtcactaagcatgactgaccgccactagaccaataaagggacacagaggagatcgccccctaggggatgccaaaatgacgtcttcaagaagaaaggcgacggaaaaaccgccgccgccgtccgtcgggactcaaaggagctaagactgggctttcgcctggcaatcacccttaaggggtgagatagcacgacaacgccctcaggagggggatgacatcgttgtcggtccggccaaggccggactaggttttcactcgccgctcaccacctgcgaatccacgtctgacacaccgatgctccaccaccacacaagctctgccgacatgtgggacccctacactggcgtcccccgccggctagccttcgggcaccgaagaccgcaccacacctaccgccagctcctcctcacacctaggtagccttctccactgtcagccgcgcctctcgtgctaagccggcctcctccaccggacgcgcctatcgcgccaatctggccttcctccatcggccgcgcctctcacgccaagccggcctcgatctccgccgcccgcgcctctcgcgccgagccgggctccgctgccatcggctgcgcctctctgtgccaagccggtctccgacctctccactaaacgatgccacgctggctgttgacggtcgttatcgatcaattttgatcgttaatattaccaaaatagaggagaactagtgatgcttgcaatgcatatacatgtaagaataataatattccactagtattaggtttactaaccttttgcagagaataacaatgaagtcagacgaattggacgatgtcgatgatcagacgataaatcaactcagacgataaatcaatcggacgatgtcgacgatcagacttatgtatgaatgggccaagaactcagaattgacacgatgaattgggccaaaattcacaagtctacgaagtgaagcaacggaggaggccactagcaaaaacttgggctggttggtccggcccctggttcggccgaaccagtgggtttgacctaacctcccgtggcgctgatggatgcagggttttgatggacagctgggattgatcaccaatgacggttgcaggatattaccgaccattccaaccatcataaccgtcattac

SEQ ID NO: 22453 - DNA, 1501 bp, Oryza sativa
tgatccagatatatcttcaaaattttttatgactaaatttacggctaaaagaccaaattttcactataattcaactttgagaaaaaaatgttattttggattatattttcagacttttgcgtgccattcaagcaattataagaaatatgaaataataataatataatagaatccatcattctgcataacttcataataattaaattatacctacagtcataaaggtaaaataagcataattatgagtaatgttcccaaaatatattagttagaaagcaagagttatgctaaagaaattagcaactataacatctaaatcataggttccctaaatcaaattagtaatacttttgcttatgtattttgattattatacatttaaagacccatatttggggctatattttctggcttttgtgtgccattcaagcaactataaaattatgaaaaataatgatatatatttcgtcatcgtatataagttcacaataattcaattagaccagtaatgacaaaagtactgagtattgttccaaaaaattacaactcccattttgatattataataaatccaaaataacattagttaatctatagtgttcctcctatataggaaaagacgagtaaaaaagatagatcttaatcaatcaataaaacttttatactatttttagtaaataaagtaagaatacctgaaaacactacaaatgtaaaaaaaaatagaattctatgtgtgtgtactttgtccccttcgactttctcttattctcttctctctcactcaactccgtcttataatttctaactaattaacaacatgatataaaaagatcaataattacaaagcaaaataattatgattcttatgttatatataatttctattttatttgaatttttattttatttctaattaaataaataattcaagatccacattactcatactttactgtataaaaaaaaaaccatttgagcatacacacctatcctttgcatggtaaccaaatagaaaaaatatagagtattataaataaaaaatgacaataagtattatatcacctcaaatcattgtacatcctctgtaggtgtcacgtgttacgtcttaattaaaaataaaatcttagaaacggttagaaaagacatccgaccatcgttttgacttaataagtggatccattatttttaccaatagatataactttagataaaatcttaagctgccatgtgctacatcttaaaatttagaaaaaaaaggatattagaaattttgacaaaaaaatcatcggttttcactttaatcatttagcaaaaaaacaccccatccatttcgccatccccccacatgtgcacaacaacactacccgtcccctctcgtctcagcttgaactctccactctctcctctacctatccctttttttttaccgaaaaataatcaataatattaaaacatgcatattttttaagctgcattgaactatttggagaaaatcaaataa

SEQ ID NO: 22454 - DNA, 247 bp, Oryza sativa
tccccttccccacccatcccctgccctctcctccccctcctcccttcccacgcagcaggcggccggctgggccgcgcacgggcccagtggcgagcggcggcaggcggcagccgctgccggcatctttttttttttttcaatttgtgattcactaagatgtataattttatgatttgttgcatgacctgtcacgaccggaattaacccaacgggcgtttcttacgtgcgtgtattattccttgtccca

SEQ ID NO: 22455 - DNA, 153 bp, Oryza sativa
ctttccaaacaacacctaatcggataccgtttgacctctcaaactgacacttgactaactactgcataatctgtaactgcagtaactcgagttgacaaaccaccactcaaatccggcgctctactcaaccaatcctcatacaaactaaccaga

SEQ ID NO: 22456 - DNA, 382 bp, Oryza sativa
ctattcgaatagccgtgcccgcgggttatgggcgagttgagcaatgtttttcgtgattagtcccacacctctcacaataattatggatgttatacctgataataatttgcttagctcctggtttggagattagatctgtacagccgggtatggttgttcaggatggttgggcctgtgcagcatgggtgtgctgttcagtgttgattaaaattcctgattaattactccactgttttacttctcttaaatgttttgctaaatgctgcttttgcaaatgagccaatattatgccatcctttggtatccttgtgcacttgcatatttgctgtgtggcttgctgagtatgtcatatgctcaccttgcaataatcaatcaacctcag

SEQ ID NO: 22457 - DNA, 1501 bp, Oryza sativa
agatagagaggtacttaaaaaaaagaaaatagcaatgcagacaatatgggcttgtgggttttgagaccctcttagggttttcattatcggtagcaaaaagtattggagggtagtggtaaacaagataattggaattatcggaattctaccgtggatagataatttttttttgcaaaatttgttaagaaaatcacacagactctatccaaccaatttggcataaaaaataacaaaaatatatatactccacacacccaatacatgattcaaaaaattacattttttttaccgatacacaatacaaactctaaatcacgattgttgttatatacttttgtatctaacttttgttgcgaaacacaatacaaacataaataagtgtgtaaaagataaattaattagcaagtgggcttttatgcgagattgtgtattatattcttataaggaaactgaatatgtaatccacgtacggtgatcttcctttcgaagttgcggtggtttcgcttgctccggtacttctcaatgcgctcctgccgctcctccgcactgtaccttcccaccgccgccgtcgccctcggaagctcctccttcgtcggtgagtggtcgctggacggcggcggttgacgagacgagactggtaagacggcaccatccatcctgacactattgaatggacgagatgaggaagacgaggaggtgctactgccactgccactgctactgccattgctaccccagctgtgatacatattttctaggttcaagctaccggcctccttgtaaatgtataccctacatatgactcttgaggatctctccatagctgccattatatacgatattggatttcatgtatggacgttcgtgtagctagagcctccacttgaattgtacatggagcatgcaaggaggaattgctgtttgctgatcttgctcctgcagggagtcaactcttggctctacaatgatttgacacgacttactagcttagtgattgtgttgtgccatcgtggatcaattgccaatcatgatatatgccaccaaatcttgagattcttctcgtgcatgctatgtctttcatgtcccatgacatccccctctctctctgttttctttttcttgttgagatcgtctcatgacatggtggtggatctcagactctcagagccacatacatatggcattattgttatttgttaaccatgcgtatgtcatgcagaaatcaaatgtgtttggcacatttcttaaataaggccctgcttagttcccatacaaaaattttacgccctctcacatcgaatgtttgaacacccacaagaagtattaaatataggctacaaaaataactaattacatagattgtgactaatttgcgagattaatattttaagcctaattgctccatgatttgacaatgtggtgttacagtaatatgctaatgacagattaattaggcttaataaattcatctcgcggtttactggctgattctgtaattagt

SEQ ID NO: 22458 - DNA, 1501 bp, Oryza sativa
gctcccaacaggtatatccatgttgtttcgagcatctattggacagaggttagaattttgttctagccgtagatccaaggtgctgcttttagttggaaattggttgttggcaaaataacttgaagtgacctagctagaccaaccgcattattccattctcctgttatgataattcagcgttttctgataaatccttaccgtagcccacttaagaatgcggtatatcatgaactcaccgaccttcaagtgggcttagccaaccaacaggatgaaatcaaagggcaccaagcattaacattgtagaaaatgcttggattgcttgctctaacagttgttacagttttcttttggaagcaacctgcatagattttaagatgccccaggcatgcctatttgtaaactagcactgtcagacagtgaaaataggtgggactattaggatagtggtgtagttctcttagattttcttttccttctagtaagtcaactataaaaacagttcgaccactatagcacgatcggaatgcaataattgctaacagagtaacagttgaagtatgcaaagaatttacagaaatgaggaacatataaactagtcatgcgcggttgtacaagaattggaaacgaagagacaaaagttggctatctgtctaatttacagcaagaagtctattatggcaggtcacagttttatgtagggtgaagtttgattaagattgggacacatgttagtgtagaataaagtgtgtttgatttttaggccccctttgaataacaggaatgaaaaaacggaagaataggaaaaacataggattctcataggaatacaagtgtaaaacagaggattacaaaacacaggaaaaatataggaatgaccgtttgattgagctgtaggaaaaacacaggaatttgaggagagataaagactcaaacgattcttaacatgaggttctacctcatgctaaatttcctccaaaacttgcatgggaagaggcattccatagaaatttttgtgatgaacaattgacatataagagtattggttttgatatttggagattattggtgaagtggttttggagataattggatttgcaggtgatgaacagagactgctgtattataggaaccggttagacctggcaagtgctgctggtcaaaccgaaggtgtgcgagcggtcagacaggctagcccgcggtctgaccggttcactttttgtcggttttggtttcgggttgtttcgttggatatccgtaggtaatttgtgtttatgacttctagatggatactatgcgtatgtaatactgttctttttttttgctaacaatgagtcaagttggagatagcttgtccttggaatatagtttcttggttaattcatgtgtaggtaatcttgacgtcgcgggagagtattgccggtgatagatcgggagtcaacttggagataaggtgacgtccaaacggtcagatatcatgcgggacacttaggctaaagattga

SEQ ID NO: 22459 - DNA, 1501 bp, Oryza sativa
tcgaaaaacagggtcccaaaagtaccaacagcacctcccgcaagtaaggccctatttaggttctaaacaaaaaaaattttcatcatgtcacatcaaatgtttagacacatgtacggagtataaaatatagataaaaaactaattaaacatattgcatgtaaattacgagacaaatcttttaaggctaattgagccataatttaacaatgtggtactacagtaaacatttgctaatgacggattaattaggtttaataatttcgtctcgcagttttcagatggaatctgtaatttgttttattattagtctacgtttaatacttcaaatgtgtgtccgtatatctgatgtgacacgccgaaaattttcatccgcgaattaaacaggtcctgagaactaacaggaactgctccaagtcgatatcattcttaaggactcacattcttaaacattctaactttttttttctaaatggtaagtaactactgaataccaacaatgcgttatattttagggtagtgatagtagaaataaagtatcactcttcctgttttatattataagcagctttgatttttaaagttaaacttatatgattttgatcaaatttatagagaaaatatagcaactctcttataatacgaagttagtttcattaaacctaatattgaatatatttttacatcgtgtttgttttttgaaaatgttggtatgtttttatataaatttagtcaaacttaaaaaatcaacttaagaaaagttaaaacgatttactccctccgtcccaaaatataagcatttatagcatacaagtcaaacatttttaactttgaccattaatagcaaacaaatgaaaaaatcaataatgcaaaattaatgttgctatatttatcattaaacaaactatcataatatgcaactctttttttatttaaaacatcttactttagtaggtattattggtcaaaataacatatcggagacagtgtcagggtctaaaaatatctttattttaggacggagggagtagtttattactcctacctatatctctcaggctgtgatccaaacttcagtccttttacatcacatcaaactgtcatacatacacaacttttcagtcacatcatctctaattttaactaaaatctaaactttacgctgaactaaacacagcctcaatgtgtaatgtttagttaatttgaactaaccaatgttaaataaaaaaacagagaaagtactaaactaacatagatgtcaacgtcgaggccgacgtggtcgtggatacccgagctatagctcccaatctcccatgcaccacccggcccacgggccaatccaaaatttccaccacgccgcgttggtgcacaacgcggtagccggtagggggcgctgcttccgccccggttgagcgccaccgagagagagccaggcacacgaaagtttcgtctccaacacgacaacccccacatttttcctcttccctccacttcgcccaatccc

SEQ ID NO: 22460 - DNA, 1501 bp, Oryza sativa
gtgcgaaagaccgctgttccatcgacgtcttgttgcccaatgagctctctcgctcggcgcccagattccaaggcgcgttcccgtcgatcttcagcctcctttgcaatccgttcgcggtcttgttgttcacgctgtagtcgttctcgctcctgtcactgtcgctcttcctccagtcggcgacgttcagcttcttgccgtgcgcgatcttggtccgcttctcgggcttgacgctgttcctccgtttcgttgtcagccatgaatacgccaaagaagaggggtgtgtagttatcctcatagctgtcgtcgaagttgtcgaggtcgccgtggttgtagtggtagcctaaatcgtcgtagtcgaggatctcggttggtcgagaactgacgccgggggagctgaggtagccatccaaatcttccgtcgagactgtcccaagaggttggagtataacgccaacctctctggatctagattggattggggccgaagccggagctcgcctagatcttcaagtgggagatgtcttggcgatgaagacagcggccaaatcatcaggaagtttcatcaggattgagggataggacccgtcgtcttgatccggccgcggaagagtagattggatctcgtccgagtggtttggagccgactcgggagagatgatcttagagtaggcctcggccgagttcagaataccgaatggcacggggacctggtttctccccgactggtttgagtccgagtcatggagagagatcttgccgaagtcgttggtgatgaagttgaggctgccgaaccggaacgcctgcccgggagggaaggcgaagtcgtcgatgccagaaacagaacccatcgcacttagtcggcaaaaacttgacgctacccctacctggcgcgccaactgtcgaaacaagatttcggcaataataaaagggggtggctatcaagctaggaaagtggatgggtttggagacaaggaattttatacaggttcaggccttctcgttcaagaagtaatacactactcctgtccggggatgattccgccgagtatgttattgattgtataaactggaaaaaagaatcgccccccaagaggcacacggaccctccttatataggggaaggagtccgctttacaaaatacagtccatatcctaacggaatatggaattatagataaaatacaatcgtaaccgactaagatcccgggtatttccttgacatacaagtttagaacctaacccgagtcttcatagagatattccatctatatttggtactgtatatccgactaaattacaaccgtcatgtagatatggggtatccataatctccacacttatcaagaagataataataataataataataataataataataataataataataataataataataataataataataataataataataataataataataataataataataataataataataataataataataataataataataataataataata

SEQ ID NO: 22461 - DNA, 1501 bp, Oryza sativa
cttgtatatgatgtgtgcacatgagcacatcacacttaccttatcgtcgaaacaagatttcggcaataataaaagggggtggctatcaagctaggaaagtggacgggtttggagacaaggaattttatacaggttcaggccttctcattcaagaagtaataccctactcctgtccggggatgattccgccgagtatattattgattgtataaactggaaaaaagaatcgccccccagaggcacacggaccctccttatataggggaaggagtccgctttacaaaatacagtccatatcctaacggaatatggaattatagataaaatacaatcgtaaccgactaagatcccgggtatttccttgacatacaagtttagaacctaacccgagtcttcatagagatattccatctatatttggtaccgtatatccgactaaattacaaccgtcatgtagatatggggtatccataatctccacagtagcccccgagaccttcgcagttgacaaaatagccttctcgaaacaaaaaacagtagtccgagtgcttcaattcaacttgctccagcttgccgagtactaaaaatcaaaaactgtgaagggcgaaaataaaacatggtgcatcgagtagatgcacctaattaggtgtagcccccgactatgtgattagttgaaaaactaaacatatagtcaagaaccgagtggttttatagcgaagcacgtatggtacttagtaagatacccagccgactgcttctcaacttgagtatatcaaggacaaaaaatacaagaagggccgagtgataaacactcaaaaggtccaaaaatagacatgtttgataggaatccgagtaaaaaatctcataaaataacccaccaaacaggatagaaaatcatggtaattaatgagtccaatagcctaggctgtgacccttaccataaccaaaataagcatataacatgctaaaagaatgactattaataaaccagtcatctcaaatcaacccagacagcctttgcagcctaataaagctttcaaaaacggtataacacctttctgtcgggcaccttttgtttgcatcgtgttaattcttaaagaattatcaaaccacactaaaaaggattttaacagcattgagccacatcattgtgaacacaaattgccaaagcaaaaagtgcctaagtccctaaggatcacaacgggccacgctggaaataagactgggctaaagtactgtacaggcccaggcccattagtactcccgataccctaataacaccgaagtgaaaaacgtctcttcgtcttccctgctgagactctcgccattttccccatttcttgctacagtgcaaaactgcgccgggcaaactagggttcaccaatccgctccaatccaccctcaaaaacttcacgaaatttatccctgcatccaccgctccgattccccatcttttcccagccgtatctcgaactaaatcagaccatccagttcacattca

SEQ ID NO: 22462 - DNA, 210 bp, Oryza sativa
tagtcccggttggtaacaccaaccgggagtaaagatcccgggggcctgacaaggtctgacaggtctagaactgggactaaagatcatctttagtcccggtttttagtggaatcgggactattgtggatttcggccgaccgaccaaagatggtttctccaccagtgctttattcaaattattgttcctggtgactaaggctatacacaaca

SEQ ID NO: 22463 - DNA, 1501 bp, Oryza sativa
ctctcttctcttgtttggtgtgttcaacttgtcttgaactacactctcttctggagtggatctttgtaataataggctgtagttctttttaagcaaaggccggaatattatattccattatctaaaaaaaaatatagcactaggcttatgggtggtgatactcacatatcagtgatcacattcctttaacttcacgccaaaggatctcaatcctacgatcagaactttgataatcttatgttgacaagtggagacacaatttactaaaaggcactccctccgtttcaggttataagacgttttgactttggtcaaaatcaaactactctaagtttgactaactctatagaaaaaatagtacacaaccccagcatagtttcattaaatctataattgagtaaattttcataatatactagtcttgggttaaaaatattactacttttttctacaaaattagtcaatcttaaagtaatttgactttggccaaactcaaagcgtcttataacctgaaacggagagagtattaaagaatgtggcatttgttgaagacacagtaaaaaaccgtggtactgttacacaactctttaaatttgtttttactctactatatattatattggtttctattaaagtaatatatttggtttttaggagagacaaaactaaaaaagaaatggcctctacaccactcttatgtagtcttcccctattttaaatagaaaattggtcactacttagacaatcagagacataactcatgtaattttttttttctggttgcattgcatagagtcattcaaataataacaattaataacatgaattcaccttctttaatttctaaatcagtttaaaatcacctataagtataaccagtagctagcaaaatctggctttgtctacaggagagaaaacagacaagaagggaccaaaacaccaaccataggctgtaggctgtgttgaagaatgttcagtgtttttgaaagggactccttttcaagcctttgaaagggactaccattatgaatttcaaaaaaaaaaaagtatgaacctcatatttttctatggcccatcgggccaggtcaaccgccgcactgtccgcctcctcattgtggtgggccccactgccacgtatgcacagttcttcctagtttcaaccttcaatgcacgtgcggaagactctgggtgttgtagccactgaatcacatccttgcaaatccctagctagccttccttcctggaagctagtgttgggctcatagttatttcaagtttttttttaacaagttcaaagtgactttattgttggaaaatttgatgacataactagccgaggtgatatcaatagtacttctattattattattattattattattattattattattattattattattattattattattattattattattattattattattattattattattattattattattattattattattattattattattattattattat

SEQ ID NO: 22464 - DNA, 1501 bp, Oryza sativa
tacactatcgtcactgcctcttctccttctccagctgcaagctcccacagggcgtgacgccatctccacccctcttcggctgtcggtgaccacaagctccccgtcatcgagctgcttcagtggagttggtcacctttcccttcaatctctacacccaccgtccctccccatgccatggccatcaccatcaagctcactggatctagccatgggttaggatgcaagtgaatagtcccgctacccgaaaaaacccgcttgatagctagttcatttcccacatagtagtataaattttagaagaaaaataaactaaaagtgagataagcgggtaaaaaacccgcttgcccgtcccgcttgcatccttagccatttttagaataattgggctaggcccaatttatcctattaaatctcaaagacccataataagtgttaaggataataataccacctcaggatttaagcgaggaatatctcaacctaaatagggagttattggaggccccctgttgactggttgaggtgggggttggaaagccacacgcgcgcgcgctgggccgggccgggcgggcgtgcgtcacgtcatgtcgctactcttttgcaaccacgaacccacgttaccacgactgcctccgcaacggcgcgtccacgatcccacgttcccacgaatgccgattgcctctctcctgatagataaggaggccgcgagtctgatcagaacgattcgcttgcttctttcccgttcgcttgcttctttcccgggtgttagttcctcctcctccgcgcctgtgctgctctcgcctcctcgcttctgatcgcttgcgcgcacgagagatcggaaggagcagggcctccggaaccacaccttcgcctgagatctgcaccgggtaggcgggtgatcaggtttttggggagtgcttcccgcacgactgctcgtcctcgcccaccatgtctgcgcctggagccggcgccgctgctgctgctggaggagatggcggaggtggtgcgccaccaggagctggagctggaggtggtgcgccaggagctggagcctgtgccgcgaacaacaacaccaacggagtcaattctgcctcgcaatccagtggagggccattctcggggtatatccttctcctgttcctgttcccgttgttagcgctttactgctatgttcctgttcctgatattcatgatgtctctagcatgctactgcgttactgctatgttcttgttcctgatattcataatgcgcatgatgccattagtatgctactggttatgttacatgttgtcactagatcaccctacactgtttatgccatgattattgtcttaacattttggattaaaatatgccgatttatgaccatatttctaacaatccaaaaacctgataggttattttcggtagttggctttgctgctgcactgaaaccacatgcttttgatggttctaactataagagatggaaagcacgtgtactattgtggttgacagcga

SEQ ID NO: 22465 - DNA, 1501 bp, Oryza sativa
gttttaaatgaaaattgacgggtagatgtttttcttttttcatatttttctgtaaattattaaagcgtcacgtggtggattaggagcgtttgtagggtaccacatggtggtttaggagcgtttgtaggaagtttaatagacttttagtatataatagatatatagattttgccttaatgccatgtaagcggtacttaagataaaaccaccatgaaaaccgctcggggttttgacagtggagagaattatctttgtatctggttttgtggtcgatacaggttatagactttctcccttggtcaaacaaaatatagactctttccttattgaaaaggaatgctttgtattacccacattatcacttgcattttctccaattatatcataataaccatttaacttaaacaaaaccatatcatttcatagccatttattttaacttatatccatactttagaatcacccatagatacaactccagtaaccaggagcacattatatacaaatactatcggtatccccaaggtatacctaggtttactgcacaacaactctagttggcaagctaaaaatgctaaaacaagtatctctcccttctgcatagtataaaatgcatgctcaggttattgctcggaagtatttggttcaaggtgtgccccaacctacttttacatccacattgtaacattgttactcaatgggaagtcttgggcccatcgatgccacaggtgtaattagctatcctgtgaaaaggtgtattggatcatgcttgaagaatgatgactataagaacttattgtaactaggtcaatccgaaacactttattaggacaattatagaatactggatctgccactatattttctattaatttagaatttgatacaaaattagttaacggtaattatgcatacaacttgcattgtttctttgatgttccatttgggatgcaaccatcaacttcctctgttgttacttagaattccaactataaattcttgcgaaaatgctagtgattgtatgacatgccttcaatatggccaatgctttcttgtaaaaaaatgtatatggccaatgctccaaatttagtatgaccttactatggaaggtaatgtaaactaaacttaggttaatttcatcctcaaccacacattcaagatcttgcacatgcacaaaaggaacaccacgcaaagatgacttctcattatattgaaaaactatcctttttattcagtaactaatgatcttcgattgttctattaaaaaaatattggtccttggccatttcctaatctgagttgcataaaactacatatgttcccatggtcttccattgagagaaaatggcagatgatggtttcaaatatcatgaggttagttcgtttccagttgccatttttttcttgtgatacatcttgtgtgttacaattgatatcgatcttgtattatgctgaataagagaattttgaaaaacaccatcaccattttattttgttttta

SEQ ID NO: 22466 - DNA, 1501 bp, Oryza sativa
ttttactctactatatattatattggtttctattaaagtaatatatttggtttttaggagagacaaaactaaaaaagaaatggcctctacaccactcttatgtagtcttcccctattttaaatagaaaattggtcactacttagacaatcagagacataactcatgtaattttttttttctggttgcattgcatagagtcattcaaataataacaattaataacatgaattcaccttctttaatttctaaatcagtttaaaatcacctataagtataaccagtagctagcaaaatctggctttgtctacaggagagaaaacagacaagaagggaccaaaacaccaaccataggctgtaggctgtgttgaagaatgttcagtgtttttgaaagggactccttttcaagcctttgaaagggactaccattatgaatttcaaaaaaaaaaaagtatgaacctcatatttttctatggcccatcgggccaggtcaaccgccgcactgtccgcctcctcattgtggtgggccccactgccacgtatgcacagttcttcctagtttcaaccttcaatgcacgtgcggaagactctgggtgttgtagccactgaatcacatccttgcaaatccctagctagccttccttcctggaagctagtgttgggctcatagttatttcaagtttttttttaacaagttcaaagtgactttattgttggaaaatttgatgacataactagccgaggtgatatcaatagtacttctattattattattattattattattattattattattattattattattattattattattattattattattattattattattattattattattattattattattattattattattattattattattattattattattattattattattattattattattattattattattattattattattattattattattattattattattattattattattattattattatcttcttgataagtgtggagattatggataccccatatctacatgacggttgtaatttagtcggatatacagtaccaaatatagatggaatatctctatgaagactcgggttaggttctaaacttgtatgtcaaggaaatacccgggatcttagtcggttacgattgtattttatctataattccatattccgttaggatatggactgtattttgtaaagcggactccttcccctatataaggagggtccgtgtgcctcttggggggcgattcttttttccagtttatacaatcaataacatactcggcggaatcatccccggacaggagtagtgtattacttcttgaacgagaaggcctgaacctgtataaaattccttgtctccaaacccatccactttcctagcttgatagccacccccttttattattgccgaaatcttgtttcgacagttggcgcgccaggtaggggtagcgtcaagtttttgccgactaagtgcga

SEQ ID NO: 22467 - DNA, 1155 bp, Oryza sativa
tgcaattggacattcatatcaaaacaaccacgcaccattctagtatttctactacccctgtcccctgtttctgttgctacttgctagccagccatggagacacaaagctaatctagtactgtactgtaccctctactccatccgtccaaaaaagaaaaaactaatttaatattgaatgatacacattttctcttcgttaaactaaaaaatgtcttatccaataccaggttggattttttatgtgacagagggggtaagtaactaggtgtattgcgttttccgatgcatatgtatatgagcactccctttgttgaaaaaaaaactcaacctaagaggtgatgtgacccctcttagtataatgaatttgaatagaagattgtcttgatttgttttactaggagggttcacatttccatctaggttatgggtctgtttagttcccacgcaaaaacttttgactctatcacatcgaatgtttggacacatgcatagagtattaaatatagacaaaaaaaaaactaattacacagattgtgtgtaaattgcgaaacattgctccatgatttgataatgtggtggtacaataaatatttgctaataacggattaattaggcttaataaattcgtcttgcggtttacatgtggaatctgtaatttgttttgttattaggctacatttaatactttatatgtgtgttggtatgtccaatgtgaaatgcagaaacttttcacccttggaactaaacagggcctaagttatttttgagaggaagagagcacgtaggaaatcaaaatggcaatgcaaaggcaggtacgtgatgatacacacataatcgaatcgaatcgatagatggatagatagtgatgaacagtagcaagtaatagtgcatatcattcgtatagatgagtgagagagatgatcgaagaagcagtaggcagtgacaatcatccttccccctggcgcccagacacaccatcatatcattcgttccattgctcttgcagtctggctgttgctgctgtacacactagattagcatcgaggactaggagtagctgctgccactgccatgacatctctcctatatgtaggcaccgcaggagtatatacaggcagagaggcagcagccatgaccatgaacactacaaggaag

SEQ ID NO: 22468 - DNA, 1501 bp, Oryza sativa
aattccgtggaaaatctaccggctcaaaaaatctcaaatgcactgtaatatgaccttgctacatagtaataacttgttggttgttgcaaataaattcttggtcgctccaaaacagcttactgtcttcctaaactcaccatagtttaattcttatggtactgtcatgaataaacatgatttcagatgtcaaagagaaaaaaaattgaggcctggtacaaactatagaatggtttttagcaaaatctggagaattgtaaaccatatgtgttgcagtggaaatggactttcatggtaccgaagcatgcatatataaataagttactttgtaacatcatatcaatattttctagttgaaattatggatctgaataagtttagcatttattaactaggaaccattccatcttctggcccactttatcccattatcttaaccatgcgaatgttgaaatagagatatatacactactcgtgcaacttgactagcagaggccactttgacaatttttggatatgtttatattttatctagattaaagcttttacagtttgctcttttcccgttttccccaaagttttcatagtaaaatttaaaaaaatctctaattaataactatttggtctccaatgttcttcttccctttggatattcttggtcaacaaaagcaaccatgttagtgttgtgtgacacacaaaaggaactgtgagggtggcatacataaataataggtctgaggagtggtgaatcgtgtggtacatgatatagatactcgatacatgatagcgtgaaatttctttggtaaagtttttaccagcgccagcggcatattttttgggttgtcctcaaagtttttcgttataacctttataaatcaattgtactagatcttagatgtccattcacttcagatattttttttcaataaaatcgaacatattttctttagtgaaccggcacttagaggtgccaataaaatcaaatgtattagtgctccacgacataaagaatatcgttgttacggaagtgtcatacacataaagagtggcggattgcggatacatgataaagacatacgattccataatggtctagaacttttttatgtgatagatgtggttagggatttccaagtcgaccatcatcaccatacgtgataagtagaaaagataagtttacgaatcattagatcgagagaatatttatctcattctcaatgcgcacgcttctcgaattattaacaatccgttgtttgtaaacaaaaataaatagaaattgcttttaaaaaatatattaatctattttcaaatttaaaataattaatactcaaataatcctacgctaatgactcactcttatatatcttctcaatctcactcttctcctctaacactcccccgagtaaaaccgtacaatcaaggtcagtaaaaaccacaaagaaaatcccatgattgacttatatacacgcacgcacgaacacatgatgtgcgtaataccctatag

SEQ ID NO: 22469 - DNA, 1501 bp, Oryza sativa
atagaagtaactctatatagcattaaaagtaattacattatgagtgagttccaataagaaactacgtggagtaaattcaaaagtgtagagaagattttcatgtaaatacatttatgaaagtaaatttaataaagcctgaaagtaatttacataaatcataaaagtaacttagcataaaataaaagtaagttgttacgatattaaaagtaaatttgtcataggaataaaaaatataaatctatttagaaattaaatttaatcagcaaaaattatggaattgagtaaaaacaatcaactcaaagcattacgaaattatgagaagtaatttaatcaaatctaaaagtagtttttatataagataaaagtaacttacctatataataaaagtaatttacaatataaatgttttttcatcataatattatcatgtaagatcttgttataaagatttaattgcaacggacacaatggtgtaatcggattatatatcggataagtaatttaagagaaaattttataagaagaaaaaaaatatgcacaacctaatagcaaaaactacttgcatgcatgtctgtaacgctactagtacttctcacgtaattgtccgcgtcgctcgttaagtctaaatcgagatgcctctcgaaatagattttgcgtaaattattccctcctccgttctaaaatattttaatacagaagtagtatttagcgtgttaggtaagctgcttaaaaaaattatgtagttataatttattttggtatgagttgttttatcacttaaggtatttaaaatttttgaataagacgaatgatcaaacataaacatgtgttcaaaagtcaatggtgtcatcgattaaaaaccagagagagtagatttcaggacagagggagtattaaattagacacgtgtttgttatcattttttttgaaacagttgacggtaagatttctaccggatatattagaagaaaagagtttttacctaaagggggagagagttcacaaggcaacacctccaaggaggaaacagcacccgcatacatcgatgtcaccgatcctgtaagaccagacaaggatttcacccaagactgtcgccgatcctgtaagaccaggcaagaatttcacctaagactaccttaaaacgtgtagaaccttcaagaaacaagagcaaaagtgttgagtgttatcgttgcccaactcatcggctgacccgatgcagcagctccgactccgccttaacacgaaagctcaagcaccgtagagaaaagcacaccgctccaaactcggcactaagacagatccacacagtcacagggctcttatgcctcgccagtgctttgttatcattttgtaccatgtcttttgggcctacggtgtacattactacatgtggagcgattagcagcagccatttcgtagttagaatagaagaacacactcttgaggctatcagcaaccagctccactgctagctccaggccggtcatggcggcggctggtc

SEQ ID NO: 22470 - DNA, 333 bp, Oryza sativa
acctaaccacatttattgcggtttggttgagcgtgtcacgccgcatgtaacgcagtgcagtgcactcgtttatccggtctgtgaccagtcacagaccggtcagatcgcgggttaggtggcgacaggcgatctgacacacgcctcgccccatcccgtcaggacgagggcttctaggcactcgtccccagctggagctagcgtgttacctcccagagatggcacgttagtcctggtcagatatatgccaggcttcatcctaaccattacaggcaagatgttgtgtgaagaagggcgagcatgtagattgctaagctgacacgtggtggacaagaa

SEQ ID NO: 22471 - DNA, 1501 bp, Oryza sativa
gcgatattttatcgatatcgagtgtgtgtgtgtgatgattttgtcaatcttaatatgtagcgaccaatcttaaaaagtgtttatataggtaagtgcacatgtgtatgtttgcagaggtgggtgtgcactcatatatattaccatctactcctccctctcataaaaaataaacctagtacgatatataacacatcctagtatactacgaatctggatagaatgaatgtttagattatttgtagtactaggatcgatatgtcacatttcgtgctaggtttttgtttgttatgtacggatgtccataatgtgtttaattaaaaaaaccttcagtgtagaatcgtgcagaatatacctaatacactcaagactacaagagtgagctagtttagtgtttttgttgttcgatttttcttgtgtgatttgcgctgggttgtatacttgtaattgtatacactggtagagaaatcgtttttactcccggtttgtaatcctctgtagtcccagttttccaatcgggactacgaatttgggactaaataagatcgctatctttagtcccggttcaaatacccaggactaaaaattgatataataccaaccgggactaaagagggcagcggcagtcccgattagtttctttttttttctttcattgtttttattgctacttactacttaatccctaactgattttctcccaaatcgagtgggatgcatatccccaaatcaaacgccaaatcaaagtaacatcccaaacaccacaaatcaaatacatcacagattatacatctcagatccatgcaatgaatcacggattctcaaaaaaagaaattatacatcacaatccatacaatgaatcacaaattcttcaaaaaaaagggacaaatatccccgccgccgccctcccatccgcctgccaccgccatcccatctgcgccggccgccgccgcacgggcctccgcgccgcctcgcaggccgctgcccagccggcccaccctcctcatgcgctcgcttagccgtgaactgtgaaggaagaaagagataaggctgtgaaccgtgtgaaggaaggaaagagataagttagagagaaaattaagatagaggagtttgtgtggacgggagaagaggataagtactagagattatatagtgtgttttgatctttagtcccggttagtaacaccaactgagactaaagttataatacaaactggaactaacgatccgaactttaatcccggttagagttaccaatcgggactaaagatcccgaagggccctgacagcccctgacagcatgtgaaccgggactaaagatcacatagtccgttctgcttataaaccgggactaaaaatcatctttagtcccggtttttattgcaatcaggaatattgtagtttttgtcgaccggacaaagatgatttctccagtacagtgatatatatggctgggttgacactctcggctcgaagtcgatcaataatttgtatattcatgtat

SEQ ID NO: 22472 - DNA, 1501 bp, Oryza sativa
atgaatgattgcaaggtgagtatatgacatactcagcaagccacgcagcaaatatgcaagtgcacaggataacaaaggatggcataatagggttccatttgcaaaagcagcatttagcaaacatttgagaatttaataaaactgttaagtaataattaaacaatattaatccaacactatacaacgtaccctgttgtataggcccaaccattctgaacaaccaccccggctgcacagttctatctccaaaccaggaatataccattccaaaccaggagctaatcaaattattaccaattatagcatcatttactatggtgagaagtgtgagactaatcacgaaagacattgttagacccgcccataaccgcgggcacggctattcgaatagttttactctgatcagaggtgtaccactgtacccacaagacacagccccacatcatgtcaccatgtgcctcaataccaccacggtacctcggaaaggagctgtgacaatacccctcgcacaacacaatccattacagcgcacctttcctggatcttaatcacccccttataaacaaggcatggactccccagcgaccctcgtgggcttatctccgccacttctcagtctggtgccccgcaatgaaccatgctatacaaaagataaagccgttgcccacgctggcttgtggttggcacggttaatgtttcacaaccgaaactcgtgaaccggtccttaattgtcatgagcacgactctcaaaaccatgtgctcacaacccaccattatcaggttttagttggcacattaattaattaaccaatcacgattgaccatcgtgaactatcattaagccatctttaaataatagtgagtcataagttatcccaatagtgtgctaatgtttctaagcagggctaagcaattatatctaatacatctagttgaaccaatataaacaaagctcaactagtcaaattataataacccaaggtatcaaggaataaagtaatcaagaacaaaagggctataacaaacaataggttaattccacccaatgacattcgaaaataaatgcaatatttgaataaaaacaatagctttaaataggatcaacatgctcaaagggttgtttgggatctgtgtgacttgccttgctggccttggaactcttcaaactcttctccggcgaaaacggactcttcggaaacgacggaatctaagcagaaaagagcaaaatcaccaaaacagcacataaacaagcatgaacagtacatgtggatatttttaacatgtagatctcaattttagaaaaatttagagacttgaaccaactaaatcggagctaagatgaattagttatgaatttttgaagattaaatcggattaaaacacttaaattgattttaattgaattatgacgcaataatgaattatttttgaaaaggaaaagggatttattacgtcagcgggctagggtttcgcggtggaccgggcgcacggcggcggttca

SEQ ID NO: 22473 - DNA, 899 bp, Oryza sativa
aagtgtgatttatatcttatgcatttacataaaatttttgaataagacgaatggtcaatcatgtgagaaaaagtcaacagcgtcatctattaaaaaatggaggtagtatttgtttttgcagcgcttaatgagtgcactatctatgaaattaacatttctcctttttgcatcgtattgtctactgaaagcataacaagatatttcattggaaagaaagggttatgtacaattgatgatcctattctgttgtattaaaaagtgagtagtgaaccttggtgccactcatctcaggtttaatggtttagcattatttggttcatattcataaattgtctgtcgacgaaccaagtagtggattcagcgcaaacaaaataatgaacctagcagaataatgccacattaaatggagcaccacaagaaaatttgttggaaagaaacggttcgttattatttctcatgttgccgaggcagatttttgtaggcagagggaagacaagacacatgaacttgatgaccttactcaaagcatgagtgaacctgggcgccacttatatcaagtctactgattcagcattgtttagtttgtaagttctgttagaataaccaaatgcttgattatgtggaaacaaagtactccactgtacctagcagtgtcaacttccaagtgtcgatggaattatctgtcgagatccaacttccatgttgaagtaacaaaattaacatatccacttgaacctgtactaatttgtaaacatgcataggccttaaaattatagtcatgctgctatgtgtttgttcctgttccccctgaatggtttgagcattaggacattaggtgtgtctactggacaagcaaagcagcaattttcctctttttttttttggtcatctacttcaga

SEQ ID NO: 22474 - DNA, 1501 bp, Oryza sativa
ctactgatcatcatcatgcattctgctatttcactacacagaattagaccagtatatgaataacatcacaccttatccaataatcagtccacttgcaggcagcactatcctctagtcgatcagaagccactatccaatgcaaaactcatctactctactagtgcctgcacatttcatccaatcttctcacaaaaagtgttttttaaaaacacaaaaatctaacctagtctaaatatctgtctcccattttaaattgtggaggaatgtcactgcacatttgatctaatccgctcataatatagtgttttcttaaaacacgaacacacaaaatttctagaggtagttccctgtgtattcccttggaattccagccaattcttattatccccaaatttctattctatcccatgtaacctatttcgtagttgaccgtttaatacctatcgaacggttcattttgccttcatgtaggagtatgaaagaagcacactaaatttgtggagtatatcgcttaaaaaaaactgtggagtatattgttcgaagtgtaaaaaagtttattgttcaaagtggagaagtttttttacgtgactattatatttatatgtttactgtgtgaggtattatatatgtaaatattttttagatcatgattaaaaaaaatgcaatttaaatttaaatttattattataacaaatattttatgtagcatattttatctaaagaaatgctatgcaagactaaatattatgtttaccgtcttaaaaaaatgccacgaatacgttctatggatatgtaatcttattaaaatttctatgtaaaatgattcctcacgcaacaatctcatgaatgaataaatactgtagttacacaacaaattattgtgtttcccacgatagatttcaaaaaattatacactcctttcatgattactaagggtaaaactgatatattacacctattgaactttcaactgacggtcaattgcaataaagagtatgaaagggattaaaatcaaaattcttaattagggaacaaaactaagacacattgaaagaatcatctaaaatttcaggggcatacacataattttgttaaaaaggtaacctagggtaaaaatactactaccttcgaactacttgtcagcacatttttctttttacaacttgaaactatctgtaccatatttattatgagaggaaatatataacaatgtcaaaatactcgcatatatgatatatccccaagtagaagtaggctgggccgagccgagaaggcccatgtaatattggctaatggttattgggcctcatttgggcccactagaaagcccacatacagagaccctcatcgtcgtcgatcgtctagtaaagcggggagagcggcggaggagaggcgcgccaaatccccctcccatttcccgccttccccaatttctcccaaaccctagctagcctttccccaacctagactccttgacgcggcgaggaggaggaggcggcga

SEQ ID NO: 22475 - DNA, 1501 bp, Oryza sativa
ggcgtccatcaatagttgtagcggtataaaccagctatagaggcaagggcactagtcagcagcagacgagacgaccggcgatgaagaagataaggccaatcaacactggcagaatcatgcagccttggacgtgaagaaactagtcagcagcagacgtagacagcttgcgttgaagatgatgacacctattagcagtgattgcgacgtagccagccgtgaagaagatagcatcagttggcatcataacaggccagccgtgtaggcggaaatactagtcggcggcggacgaggctaccggtcggtgaagaggtagacgcccaacaacggcggcataataggctagccatgcaggcggaaataccagttagcggaggacgaggcggccggtcggtgaagacgtagacgcctagcaacggcggcataataggccagccgtgcaggcggaaacaccagtcgtcggcggacgaggcggtcggttggtgaagacgtagacacccaacaacggcggcataataggccagccgtgcaggcggagacaccagtcagtggcggcgaaggcaagccggtcggtgaagacgtagacgctcaacaacggcggcataataggccagccgtgcaggcggagacaccgatcgacggcggcgaaggcaagccggtcggtgaagacgtagacgcccaacaaacggcggcataataggccagccgtgcaggcggagacaccagtcggcggcggcgaaggctcagtcggtgaagacgtagacgcctaacaacggtggtgtgaccaaccaaccgtataggcgaaaacaccagtcgacggcggatgaggtggccggtcggtgaagaaaacgacgcccaacaacggcggtgtgatcacccaaccgtataggcgaggacaccagtcggcggcgacaacggcaagccggtggtgatgttctaactgatccatttctgtaacataggagataagcttaaagccatgaatccctttgatgcatatctggatctggatcctgcagaacaaacatatatgatgagtagtatctgatgtaaatacagtacttgagaaagattcaagtattttcaaatatttataaatatatatttctcctcttgtcaattttaatttccccgagcggataactccttacgtttaaacactctgcccgactagtcatagtccccaagcaccgggagtcggtctaggcacttcccaagcatgcatacgagtgacatgagttcgtcattaatggaacaaagtttcacggatcagagtttactactcgggtacttttgcaattgttaagagcagaaaataaattatcttatctctatgcttttgaatttttttgagtaatacttagcacctttactcggtccatccaacgagcccccgggtgctaggaatcggcccgaaggcaaccatccatcgacaaaccaaacggaaagcataggaagatagaactccataactcgataggcacttttgtactcagattatatc

SEQ ID NO: 22476 - DNA, 1501 bp, Oryza sativa
agaggaagtcggaggaattccggagttgtcggtaatccttttcttatttctttcactctgttaagtactctgctttaatcgaaatatcattgggagtaattaatatttattctgtgagagttacctcttggttagttcctaatcaacttatggggtcactgatcactataatccaataaaatatagtggttgctttagtgtttagctaacattaaagtagttattaaacttcgtagacgtggtatctgggtagttaattttcggtatttgcttcatatcccacagtatgtttgaggtaggtgtagaggtggtgatagccctcaaaacactaaagtcatccctatctgggtactttgaagagccatatctgggagcagcggactggccagcgcccgaagtaccgcgttaggattaaactgagctttctatagacactgtctctcactagtaaatcctctctacccttagcctaccttagctttgtgtccttggatgaacctagtgaagagatgacacacaagttcctgtggaaatctataccttggaatactcccaggtgaagtgctacatcggtatcttccgtgcgcttgcggattttatctgtgacattaagaaataccaacagcaataaagcttggaggcccaaggaatggctgtctatcgtgatggcccgtcatgcaggtctctctatgcttcctccttgtgttggacatctccatgtagtacccgtgcaactccttgcaagcagggcccatcttcgctaacatgtcgtctccaaccagtggcatgcctaatgtgaagtcggtcggagccgtgggacgagctgatggtgccttgccaagatttggcttattgggaactagaagcgaggcttctacctttcctcttcctctccccctcccaacagctttcttttttgtttcatgctgtggtggagaagattgggccttcttgctctttttggcaggagggggaaagtacgccatgctgtcgacttccaaaccctcatccccaaaatctgtatcatattacaattggagatcttcatctccttcttcaatggcaggaggggcagatataagagttgtagtgggtctagtacttggtgttggcctaggacttatattttatctgaatgttatgcttgggccattggataaaggtcccatgtgcaactcctagggtcaaaacctcgtcatttggtggatgcatcagagtggagcctacccattcgggcttgactaagtccacttgtactttagcatgcctggccatcaactacgcccgatgaactcgggttttcggtgtaggcttgaacgcaagacccttggcggtaggaagtgtaaatgcttgtgtcaccctaacgactagggtgcactctatgggaccctgtgatagattcatacatgttcttagaatatgtcataacatattgatgagctaagacaacatatgctttatttgttggttttaccattgtgtggtccactgcggtagggac

SEQ ID NO: 22477 - DNA, 733 bp, Oryza sativa
atagggcgaattcgagctcggtacccacctatccgcatggccaatctagaagagccactgcacatatacccactcaggaccctggaccatccttgttagtcgtcagatttgcctatgtcgtcgaatgtgttttcctgacacatcccatttctgaggccaaaacgttttttttttaagagagagagagtagaaagcaagaccactactgaattgtaatgtgttattttctgtagcgaccatgtccaaagaggagcagcgtgggctacagggaagtgggagtaggcgtatatatatatatatatatatgtatgtatgctggcatgtcccctctctgttttaaaatattaacatttttagcatggtgacaagttaaacaattttaactttaaccattaatagcaacaaaattaaaaaaaccaatcatgtaaaattgacgttcctaaatttatcattaaacaaactatcataatatgcaactctttttatttaaaacatcttacttttatagatattgttggttaaagtagcatctcggtgaccgtgtcaggatctaaaaaaatgcttatattttgagacggaaagagtatatacatgggcaatataatgatgttatgaggtgatggttgacaaaattcaaaaccaaatcattagcaaaccgtctgctaagagacaatcatgagtttatccacgcgagagatcggaggctctgactgacagtaatcactcagagcga

SEQ ID NO: 22478 - DNA, 855 bp, Oryza sativa
tgcatatttgctgcgtggcttgctgagtatgtcatatactcaccttgcaatcattcatcagaggaagagttctacagtgaagctgatggtgtggaggattaggtgtagccctggtcaagctgcttgtggagtggagccgtctgcaccgtttatcttattttccgctgcttagatctttattgattgagaggaactatctacctctgtaatgacattttattcgcttattaattagagtaataattgtactctattatcaatttgttattgtgtgcctcggctgattcctggacgagggctcacacacatgtaagcgtttggaattttggatagaaattccatgcgtgacaagttggtatcagagcctccttgaccctaggttatgccaaatggttacccatagaagccctctaaaaatattggaaaagtagaactgttctcttccccttctcttttaattaaaccaaactaatggcacatgcacttcataatcccttttaatggttttcattcaaaaatttattccagtgttattagtactgtacatctattactgtactaatggctcatttaccagcaaaagttttacaatattgttttatttaatcttgctacaataaaataaatttagcaagttgattttataactttcttttatttcttttggaacctgttattcaaaagtataaaatttgtaaccttgtttccaactgttttcaatttatgttgcaagcttggtttacttgatctacttacctttttactttgattttctaactttattcaaattaatccaaaaacttgtgctattaattggataaatgtcttaactccctcctttcacttgtctttaga

SEQ ID NO: 22479 - DNA, 1501 bp, Oryza sativa
tttttttacggagcgagctgtgtatatacgagcggtgccgtgcaccgttgagcagtcaccatcagtgccaatgccggacatgtttatttgcatctgtacacaacgcacaggccggaacgatagatcgagaaatatataaattaagattattttcataggtacgaattgacggtacagatcttgctcaactgcatccgcatggattattcatatatatactctcccttttccaaaataagttaacctcctatactatgtgtttgaacttattttaagactaagaaagtacaccgttttatcgtctctgcgaagtattatatatactaaataaaaaataattagaaacatatatacctatactttaaagttaatcatgatatatattcaattggtaaagaaaattagcacttgtggttaattacccctgtacatctggtcaattaatgtaataaatgtaatagtctaaatgcacgtcaattatctagttaattttattagtatagaggaatattttagaagaggtggataagaaaagaaggcacgataaggtatcgagacaagctacatgtgtcgtgcatgcaagagaagcctaacggtactgtgtttgtgcttgttcaaacaagatggtgctgagacccctgtcacgaacgtcggtggggatcggctcggccgccacgatggtaggggtcagcaccaaccgcttgactgctatggtattgtgctcattttatttttggataaaatttttttttgcacggtctagtttcaaaataaatttttaaaaaaggctaatttgtcaaaaaaaaaagagaaaaaggtatttttaggtagggtgaacttagctgcatgcctgcatatataaattagtatatggagttgcaaacatggacgatcgagacgatggagctagcccagcatctggcaaaaagtgccataaactagtatatggagtatgtgttacagtgtgatcaagatgggcccacattggcacggtggggccctatggaactaggatgtttgtatctttcccttagctagtcagatctgatatgatcctcgtttattgttaatattgtcgagcctacatgttcgctgtcatatatacatgtctctgtctcgatctctctttttatatatttgtatatatatgtatacatgaatatacaaattattgatcgacttcgagccgagagtgtcaacccagccatatatatcactgtactggagaaatcatctttgtccggtcgacaaaaactacaatattcctgattgcaataaaaaccgggactaaagatgatttttagtcccggtttataagcagaacggactatgtgatctttagtcccggttcacatgctgtcaggggctgtcagggcccttcgggatctttagtcccgattggtaactctaaccgggattaaagttcggatcgttagttccagtttgtattataactttagtctcagttggtgttactaaccgggactaaagatcaaaacac

SEQ ID NO: 22480 - DNA, 837 bp, Oryza sativa
gtcatgttgagtacatgaaagatgttgtgaaagccaatgaagtgctttcttgccccaaatgtcgtaaaagcaaaggtgtcatggtagattgtgaaaattgtgctaatttggaaaaagaaatttcttatttgaaaaattctttgcaaagattttctgatggtaaaaagaacctcaacatgattttagatcaatttaaggtttgcacacataaccgtggtttagattttaatccttatgctcatcatactagacatcctcctgttgtgttaggtgttggtgctagaagtggtgaaattttggttaaacctgaagataagaacattgtgtttaaatctgctggcatcatctctaccttgagtgcatcatcttcaaaatccaatgttgtgcatgtaaaaccttcatttgttgcttgtgttgctaagccatctgagtctaccaatgtttctaatgatcgtgaaaagtatacttgcttgttttgtgggaaagatggggcatattgttggtttttgtttcagattggctcataaacagaaaaaagagagagagattgcttttgcaaaatcaaagtggcaaaaatctggttgtccctcaaggaagccggtcagaccgctgtgggtcccatggtcagaccggcgaccggtcagaccaactactgagcggtggtcagaccgggcaccggtcagaccggcggtatagcagcggtcagaccagcagtaccacctcggtcagaccggactcggagaaaattttctgaaaattctcaacctatttttgcacgtggatatatgcctattggatcttctggtcatgtgtctcaatattggattcctaaatttt

SEQ ID NO: 22481 - DNA, 1501 bp, Oryza sativa
cagtgaagctgatggtgtggaggattaggtgtagccctggtcaagcagcttgtggagtggagccgtctgcgccgtttatcttattttccgctgcttagatctttattgattgagaggaactatctacctctgtaatgacattttattcgcttattaattagagtaataattgtactctattatcaatttgttattgtgtgcctcggctgattcctggacgagggctcacacacatgtaagcgttttgaattttggatagaaattccgggcgtgacaagttaggaaataaaatggtcagggttaatcatagattatttttggaaattcctcgagcgtaatagtatttcggtcgaaattccgagttaattataaaaatatgtttcttgaacagattagattaaaattggtagtaatttagatataattagtagctaaacaattagatgaattcttatagattattatagattatttttggtaatctctataagtcatcggttcacggtagaaattcggatttaattactaggaatcttagccgtgtatcatatttaatcgtttagtcatagactaaattaagttgtataatatttctaggatttcgttcgatatttagctcgtaatagaaatttctaacctattatatggatacaatgctcggggagagtaaattaaaaacttatgacaacgaaataattatacccgcaaaatagtttaaatcaaaattgggtttgccgtagttcgcagatagtaaagttaataaaaaggaatcgactttcgcattcgactttcatttggatttatttggatttttatttgaattctaaccgaattcaaatcaatttttgcacgtaactatagagcccgagggagttgcggatccaagcgaaggccaagacccgcaagactttgagcaaggcaagtcatcactattccttgaacatgttgatcctaattgcgaaattgttttgtttacaaacaaagttgcatgcaatgatgaacatcctacttgtgattatgccatgccttgattattgtttacccttaaatctttgtaaccatgtttacgtatgagtccctagtcaactatgacaattgcttagaaatgctattctagaatcatgcatactcatatttatcaaatgctatatgcttgggtaattacctttgggaaggtaattgagatgcggcatgtggagacatgagcgccacattgccatgatgttgatgacatgatttgtgaaaggagaaataaaattaaacaattgttttcgactggggcggacggagaatttgggttgtatctggaaaaggctagtaccgtccccagtcaattaaggaccgagccatgaagttaagcatgaaacgacccccgtacaaccgtacttctcgaatgggtatagacctagcggattagatagccgagcggaggcagtatccctgcatagatggttcacccctgagtgaggcaggtgcgctacgatgggacagccgttgaggt

SEQ ID NO: 22482 - DNA, 1501 bp, Oryza sativa
catgtgttgggacgaggctcatgtgttgggcagtcgcggagtgcgggtaaaatgtacatccactgtagtgtgagtaaaccaaatctattcgaacagccgtgctcgcggttattgagcaccgggacatgtattacacttggctagactctaaattctttaacttgtgtgggatgggatattacatgatgatttttatgctgatggagccacttcctgagaggcgggaatgtggatgtcctcagaaaaccataacgactcaatggcgggaagctatccttgggatcacaatggatggtggacagaaccgtcattgttaaatatgaacactggtaataaaacttgatcagtctatgctaggtcttaggcttgtgaaaataattacaaaacttgcttgcgcaaaagaaccatagccatcctttgaattcctctgtcatgtgcatcattgctgtggtggcttgctgagtacggttggtactcacccttgcaaatataaaattaatcagaagcgggagatgaagcctcggaggatccctatacctactaccaggagggagatgaagacgatggcactcagtaggtcttagtacggtcgttgcctgtggcaatggcatgccgctgcctgaattccgctgccttatctatttctgcttttggatgtattccggaccgctcggtccgatgatttaagactatgcctgcgggcttatgatgtaataattcgaattagacactcgtgtatgtgcacttggtattccagctatgaattcgtgcgtaccagatctgatccagggaaatggtactgtttacacgattgactcctgttataaaaacgggggtccacagcatggctaagcatcctaagcactttagctaaaaccatataatgttctagctaatccaattattaaccaagtgacaaagtataggtaagcaataacaaaggcaataggttccacccaatgacattcaaaaataaatgcaatagttgaatagaaacaatagctttaaacaggatcaacatgctcaaagggtcttttgggatctgtgtgacttgccttgctggccttggaactcttcaaagtcttctcctgcaaattcggactctccgggaatgtcggaatctaagcaaaaaagagcaaaatcaccaaaaaagcacataaacaatcatgaacagtacatgtggatatttttaacatgtagatctcaattttataaaaatttagagacttgaaccaactaaatctgagctaagatgacttagttatgaatttttaaagattaaaccggattaaatcatttatatagattttaattgaattatgacgcaataaagaattatttttgaaaaggaaaagatatttattgcatcagcggtcttgggtttacagtggaccgggtgcacggggatggtctacggaacgaacggccgtgatctaatcttatccaaaacaaacggccgagatcgaatcggtctaccgcgggtctacggctgacgcggtgc

SEQ ID NO: 22483 - DNA, 1501 bp, Oryza sativa
cctccccacgcttgagatcagaggccccgacaatcaagaccacaaatttgataaattcctataagattttatatggcgtacatttgatttatgtattttttttcttatttctacgattttcattgacgcgtttcataggagccctaaattaacctccgagggttgatcgcaattcgcaacgggtggtaattgctaaacccagggatgtaattcccaagtgcatagcacgctagaagtacgcattggccttgatcggccgcgattgctaccatacggcttcagtagttgaaagccgctgcaagtgcaagcagacattttgatgagaatcggagaagctagataactatggagatggtccgttgagccttactactgttgcccaaagaggcaaatatctatgcatgagccatgacaacgctggcgagctgtactagcggcctacactgtcgaaggtgtttttcctgacgcccccatttcctatgccaaaacttggatacttgagagagagtgtgtgtgcacgaacttcaagtatgtatggttaattgtacgtacagatgttgcttgacattgagttgttctcagtcttagtgagatgatgtgatgtccaaagaggaggagatatatatgcattaaggactactccagtacatagatagaagtgagtaggtggatacttacagtggtggagccagaaatttaaatctgtgaggtcaattactagtggtttgtatttaagtggggtcatttctctaaattcttttggatttatacatgaaaattaagatttataagatgtttttcaaaaagctgtggggtcagccgaccccacagaaatggcctaaatccgccattggatacttatacatactgatatgagaacacatgagcaaacaaatgagattatgagttggtggttgacaatattcatcaaaagcatagacggggaatttgtcatgataattgggaaaatatatactgcaaaccatatatgtagtgaaaattactgttgaatcgaaaaatgaacgtctaagattcgtccacatcaccactcactaaaatttttactcgtgagtaaatctactagtaaaattcctcgtgatgacatggactgatattttccctgataatcagagcgacgctcgtaggcgctccataggcctcgtcatcttcacagtcacacaccgaacgcgacaagcagaccgaaagcccaaaatcgcctctcgcgacgcggcccaataactcgtagcccatttagccgggcgcgtgcacccgattcgaccaccgccaagcccgaatgattccaccacacgccaccgattcgattccgaccgttgcgtccgcctcaggtgcgcgcccgcttttccaccccgaccgttgccagccagccaccctcgattccgcccaaaattcccccttcaaatccaccccccacaaacacgccaaaaccgcaaccaaatcccctcacccccacgacgcacgcgaaaccacctcgacgaatcca

SEQ ID NO: 22484 - DNA, 371 bp, Oryza sativa
tacaccagttcattagctaactaggggtgagactaatcacggtgaatctggttgaccgcccgtaaccgcgggcacggctattcgaatagttttactctgatcagaggtgtacaactgtacccacaagacacagccccacgacatgttaccgtgcactgacatgccaccacgacataccggaaagaggccgtgacaggacccttcacataaccccctctagccaagcacaccacacctcaggtttcacccccatccccagcgggcaacgggcagtcccctctcgtgcctaggtgaatccggaagcgacagaggccgtcgcagggcccgtcccgctccatcatgcccacccttgcctgtatgcgtcaactaga

SEQ ID NO: 22485 - DNA, 1501 bp, Oryza sativa
cggcgaccgtgcatcgattgagagacgacagagtcgtcgtcatcggggaagaagaacacgaggcgacatgccgccgccgcggggaggccacccaggctctagaagtggccgccaccacggcctacatctcgccacgccgcgttccacaaccacgcgtccacggtttcttggtcgcaacaatggcgtcgcctcaccggaccaaatcaaatcaatcgatcgaacgccgccctggactctcggaacgcgcgcgcggtggcaggaggacgagacgccatctgctacttgtggaggaggaggggtgcctgcggctgcggcgcgagtgggcggcgaggcgagggtcgggagtgaccggcaaaactagtctgccggcctacccagtccagagagaagagtgggggagagagaaaaaaaaaaaaggggggtggggggggggaggaggaaaggagaggaagaagggagaggctgccttgccgacgtggcatcctgacatgtgggaccaacgtgggtcctatgctgactcagccgccagataaaatcggtgtcaaaagacttagttcgtacggttttataagttgagggatgtgttgtatccggttttgcggtgtacttttttcatttgcaaaagataatcatccaatcttggggtaaatttaaactgtagtacctttcctgcacccttatcgaaattttcaggtcaattccaacgcaattctagaatgaactgctgcatattcctagatggaaaaagactagtactagtagagttttttttttttttttgaaaggaagtactagtagagtttgacactagtccaaacaaaggcatttatctactgaaacctgaaaaagtgtactccctccgtccaaaaaaaaaggtcaaaccctgagtttccgtgttcaactttgacggtccgtcttatatgaaatttttttataattcgtattttcattgttgttagatgataaaacatgattaatattttatgcgtgacttgtctttttaatttttttcataattttttaaataaaacggacggtcaaacgttgggtacggaaatcagggtttgtcttttttttttggatggagggagtagtctagtctgtgattgggacccaagcaagcatacagagagcaataaaagtataaaacacaatacaagaagtaaaaagaacaaaaaaaattccaatcaaactaaatttcatcttgagatttcgcaactcgcgctgatacttttgagaacatctagaaccttccacacacagttcattcccaattatttccccctatatcgtatttgagccactatattggcaaaattaacaccaatcataatttcataataatccatttcacaagcaacactttattaccccctaaaatcgctcccatccagtgagagagagagagagagaaaaaagagagagataaagtgataaaccccatcttgtgttaatcattcatttccaattttaaagaaaaagcccctgaaaaaggctcacg

SEQ ID NO: 22486 - DNA, 1501 bp, Oryza sativa
tgctacgtaccggaatctgccagacaaacatagactaatatctctgcagccaattccatcagaaattcagagttagcagcaggcagcaacaggacgcgttttgtccgatcggatgccactagagagtagagagagagaccaacaccactagcaaattgcaacagagaagcattaacaattaagcaagcaagcaatagtcaaaggcttgtttagataggtcgatcgctagtggtagtggtagtggcccattcagtgaagcaggtaggaagcaacccatatacgtacgtattgcattgctacctagctctgaattaccattcagctctagctaattagtgtactagtagatgatacttagttcattccacacgtcgtatagacgcggtctcgccatgccatggaggcgtcaacacgctggtcaatcgagaggagaagagaaacggattaaattaattaaggagatcaaactattgcagttcagactggatcgatgtatataattaattagatagttcctttaattggagctgtaaagctactggttcttgtcaaattgatgcaagattaattatagtacatatatagtttcccagctcgtcgcagacgctgactgaaaatgtcagtcgtctaacgtactgtatatgtatatagctaataagctagcggaccacgtaattaattaattaggtgataattactttgcatcattgcatcagtcgttcagcagattatattttgctgaacacaatttgttccgtgattaaaacaacaacagcgcacatacgatacataaaatttatcatatgtagtaattatctaattaatatcaataaagctttttatataaaaaagcagacatttatagtatacgctctccttctaattaacttgctggagtagtatatatcaagcttgctaggagagacatatatacgtatccacatgaggaacacgagcgatctatgaatgttaacaaaagaacagaaaagctagctaagaaaggtgcgtgcacttacattttcttactgtaataaacaatcaaaaatgaatactaaagtttactcactgcattgcaaatatgcagcttgcatatttgtaagaaatctaagtgttacaacatacgtgcattaattaattattaatttacttttgacaattactaattagccattacaatccagcaaaactaagtcggcaggcagcagataaattaaaccacgcgcgcgcggtatacacttgtgaacacgtacgtaggcgggaaagaagaaggaaaacgcaacaaaattaatggagcatccaactaagttgatttcgcctaaactaaagctgcatctactattactagctgctaattaacaacgcactaactataataaacatgctaagtggactagctagctaagctaagctactacagtactcctctcccacttgaccacctcagcttcctcctcctttctcatactaagaaagaattcagagtcaaatttctcagccacct

SEQ ID NO: 22487 - DNA, 247 bp, Oryza sativa
tgagttgatatcagattctagtaataatgttggttaatgccaccgctccggtgttggttaattaaaatatattaaatggtgggttgtgggtgcatggttttgatggtcgcgcccatggcaattaaggaccggttcatgggatgccctagaagaacttatcgtacttaccacaagccattgtgggcaacggctgggcttgtagtgtagctttcctctagttgacgcatacaggcaagggtgggcatga

SEQ ID NO: 22488 - DNA, 1501 bp, Oryza sativa
tatgactaaacgattaaatatgatacacggctaagattcctagtaattaaatccgaatttctaccgtgaaccgatgacttatagagattaccaaaaataatctataataatctataagaattcatctaattgtttagctactaattatatctaaattactaccaattttaatctaatctgttcaagaaacatatttttataattaactcggaatttcgaccgaaatactattacgctcgaggaatttccaaaaataatctatgattaaccctgaccattttatttcctaacttgtcacgcccggaatttctatccaaaattcaaaacgcttacatgtgtgtgagccctcgtccaggaatcagccgaggcacacaataacaaattgataatagagtacaattattactctaattaataagcgaataaaatgtcattacagaggtagatagttcctctcaatcaataaagatctaagcagcggaaaataagataaacggtgcagacggctccactccacaagcagcttgaccagggctacacctaatcctccacaccatcagcttcactgtagaactcttcctctgatgaatgattgcaaggtgagtatatgacatactcagcaagccacgcagcaaatatgcaagtgcacaggataacaaaggatggcataatagggttccatttgcaaaagcagcatttagcaaacatttgagaatttaataaaactgttaagtaataattaaacaatattaatccaacactatacaacgtaccctgttgtataggcccaaccattctgaacaaccgccccggctgcacagttctatctccaaaccaggaatataccattccaaaccaggagctaatcaaattattaccaattatagcatcatttactatggtgagaagtgtgagactaatcacgaaagacattgttagacccgcccataaccgcgggcacggctattcgaatagttttactctgatcagaggtgtaccactgtacccacaagacacagccccacatcatgtcaccatgtgcctcaataccaccacggtacctcggaaaggagctgtgacaatacccctcgcacaacacaatccattacagcgcacctttcctggatcttaatcacccccttataaacaaggcatggactccccagcgaccctcgtgggcttatctccgccacttctcagtctggtgccccgcaatgaaccatgctatacaaaagataaagccgttgcccacgctggcttgtggttggcacggttaatgtttcacaaccgaaactcgtgaaccggtccttaattgtcatgagcacgactctcaaaaccatgtgctcacaacccaccattatcaggttttagttggcacattaattaattaaccaatcacgattgaccatcgtgaactatcattaagccatctttaaataatagtgagtcataagttatcccaatagtgtgctaatgtttctaagcagggctaagcaattat

SEQ ID NO: 22489 - DNA, 1501 bp, Oryza sativa
gaacctacagggtcgcatgcttaatgggccggaataaggggattggatagagatccaatatgagcttaattcggatagggatccgaataggagtcctacgggccttggaggcccgagtgatggatcctatatattcgtgaggggtgtgaccggcggatacattgcatcacgtgagaaaccctagccatcacttccctccccgagaaaaaccctagccacgcgcgggtgctagcacatctgcgcgtggcgttccgtccctgtatgtgtggataccggtagaggcgccgctggtttgcggtgctgatcggcgtgggagtacggcgaggagaacgcacgaggaggagaaggtcgagccggtgcgatcgactacttcctctacatcgacgcgcgctacttcgcgagagttccttcaacttctcagtgtcttcttccgctgcgcagcacgtcgagtggtaacgatctatgatctaacacttcatggttcctggtttacgcgatagaaaattttgatctatgctatcatagcctacgcgtatcccaacagtggtatcagagccgccttgtatagtttatgatctagatcattgcatataattgatatgcggatgtagtagatgagatctattatgttgtatatgtgttcttaggtgatcggaacatgagatgaactggtagccgcatgggttgataagatcaatcggtatgtgtgttggtgacttcactggaatgtctagtactcaccaaggccgagtgcaattgtgttcatcggatagtccgatgtccactggaactgcacgccaatgagaaaaacgagccagtgagattgactcggttttggcataatttgattacgctgttaaggttttcacatggcgaatcgtagatgagatctatgtaccccgtgaccttttcagggcgctgccctgaaacccgtgggaccgccgtgtgcgttgccccttagatttcgcttggggtttttatatctatcttactttattgttgtttgtatatttgatatgacatggtaggatagattccctcagaaaaattaagtgtagtttatgctcttccaataattgcacctattacggttgtgatcataagtgatgggtttgccatagcaaagtgtcactttttatcatgataaaataggatagatgtcggacatctatatgcggagattattagtttacttgacaaggttatcaaaacagttttggaccttggggcataggttgggttggacatggagatgtcacccaacaacacaagagtcacatatgatgtgattagtaaggtgttgcttacctattttgatagttgtatagctgtgatgccaaagctcactagacactaataaaatgaggatcttgactcactatgttactagagggaattttgtttcacaatacatagtgggagtatcttttgttaaattgtttaatgaaaggttaaatgtaaacatggtgctgactttgcatacatatatttctattgtaga

SEQ ID NO: 22490 - DNA, 406 bp, Oryza sativa
atttgtacaaggatgggtcttggaacagattgcgaggatgatggaggtggctgatccaagtccaacaggattctatgactgtagatattgatcagtaggaacagggtttcagaatagatgctagatatgcagaattcgccgacaagaacagtgccccctttgtgtgagaggctgacatgtagggcccatgctgcagaggctgctatcactattagtcttgtacttttgttttctgatctaatatatacactccagatgggatgtgaactgtcatacaagatacctgattgttacttgtgtacttgtgtctgtgatgaactgctggctatatgcatactacacctgtttcaaaatataagtgatattggctatacaattcatagataatatctcttagattttgaga

SEQ ID NO: 22491 - DNA, 585 bp, Oryza sativa
aaaaatctatttggggtttattcgacggtcagtcgggaatttgtcaggtgatatgcactaagtcgtgtctaggttgatgggggcaatttcatgcgtatcattatagctatgcatttattttatgcattaatttattgattagccagttgcatcagtatcctcatttgagttcatgaaaaatgttctatgcataaaaatcatcatgctcgagtatttatttgagtcatttgttgctttgtttaatttggatttgagcatgaattggttcctatcccttgtctactttagatgtcagtcctattcctcgatcgcaagcgccgctccgagcttcagagtcgccgcccttagctttattgccttcttagtctgtttgcttgctagttttctgtttaggtttgttgcttgtgggttagtcggcggtcgatatcatgtgtcagtggtatgactgcctcaattaggagttgcgtgcctctttttcagtgttttaatcaagattaagataattgcacttaaattcataagcaagattagtttctgagcccctgttttcttccttttctcatatttctacctatccccttcaga

SEQ ID NO: 22492 - DNA, 1501 bp, Oryza sativa
tggtgtaaagatttgtcatcagtggacaaaatgttgttataagttgtagaattgcacataaacaaatcatggatcattttcagaatttcttgtgctgactcctaatttgactcttccagcaccctagaggggatcaactggattactatcaagctggtgtccaggtgattcaattcaatgtatctgaatcacctgatgagtgacagggggtgaaactgtaaaaaattccataagaaatccttttcaggtcacctctatgaacagttgtgcgaaaaagatgtgtacaaccattctggatgctgaatgtgacttcccggaaaattatatcaccatcttgaagctaaaatggcactaagagccataccacatgaacagaaaacatccagccatacgaaatatttatgtgtgatatttaatgtgttaggataaccatggaagcggacaaccagaatttgtggcttctctgaccaaggaaactagagttgtgtttagatgtaaagttaataaaatggtttgagctagcagtgatagactagaaacagtccaaaacagaaccaacagaattggtgacacaatggtaaaaagacaaatttgtattgagcaaaggcaccatcgaatatactccctccgtttcaaaatgtttgacaccgttgattttctaacacatgtttgaccgttcgtcttattcaaaaaaatttgtgaaatatgtaaaactatatgtgtacatgaaagtatatttaacaatgaatcaaatgatatgaaaagaataaataattacttaaattttttgaataagacgaatggtcaaacacatactaaaaaatcaacagtgtcaaacattttgaaacgaatggagtagtacacagcaggataaaaaagttgtttgattctgtttgcatctattctgaagacaaacaggtatgtgtgttcatttatctatgatgtgccgcatatgacaaataatcagctggaataaaacatgaatatataacaggaaatatcagaaaccaccccgcaatttacactaaaaagaaccactgcaaaaggagagaaatatgattcagcagtagcagcatagttcagaatgtcacacctcagctatatttgaaatcagcaatgctgatttttcttaaaatacaattgtcttaatacaaagaaattgacagaaacatcatttctggggactacctagtaggctagtacctgctggaggacagcagagggaagcaggactgtgcaaaacacaccaattaggaagatggcagcggaaaaccataccataccagaagcttaagtacctcttggtggatgaatatatcatgtaatagcagcgacacataggtagttagaagtagatgcggcagtatcattttcctctccttccagcccagaaagctgagatgtgtttccactagagcattttctgccaaaatcatcaaatgagaaagaaaatcgcaccacacaaccatgtggataaaatagtacgatcaccatgtaattt

SEQ ID NO: 22493 - DNA, 434 bp, Oryza sativa
tgctgcgtatgatggtgtgtgtgcccaattaaggcatcattcgtttaatcccaatgagagagggaatggaggagatttattcacaactattatggtgtagaattattccccttcaatctccttcaatcatcttcaatgccctccaaaccgaacaaggcctaaacgcagcattcccacactaaaaagggcgcacatgtacaagcttatttttacttttatgagtaaattttataaaatcccagttttaattagggtatccgtattgtaatccctgtgaattgccattttttttcatgtaaccctatgtttgggggtaaaacgtttaaagaaactccatatttatgtaaaatgcatgtatttcatcattatatatgggaaaaagtacgaattaacccccgaactatcgcggtcatctgaattacccccctaaacca

SEQ ID NO: 22494 - DNA, 1501 bp, Oryza sativa
cagtgaagctgatggtgtggaggattaggtgtagccctggtcaagctgcttgtggagtggagccgtctgcaccgtttatcttattttccgctgcttagatctttattgattgagaggaactatctacctctgtaatgacattttattcgcttattaattagagtaataattgtactctattatcaatttgttattgtgtgcctcggctgattcctggacgagggctcacacacatgtaagcgttttgaattttggatagaaattccgggcgtgacaagttaggaaataaaatggtcagggttaatcatagattatttttggaaattcctcgagcgtaatagtatttcggtcgaaattccgagttaattataaaaatatgtttcttgaacagattagattaaaattggtagtaatttagatataattagtagctaaacaattagatgaattcttatagattattatagattatttttggtaatctctataagtcatcggttcacggtagaaattcggatttaattactaggaatcttagccgtgtatcatatttaatcgtttagtcatagactaaattaagttgtataatatttctaggatttcgttcgatatttagctcgtaatagaaatttctaacctattatatggatacaatgctcggggagagtaaattaaaaacttatgacaacgaaataattatacccgcaaaatagtttaaatcaaaattgggtttgccgtagttcgcagatagtaaagttaataaaaaggaatcgactttcgcattcgactttcatttggatttatttggatttttatttgaattctaaccgaattcaaatcaatttttgcacgtaactatagagcccgagggagttgcggatccaagcgaaggccaagacccgcaagactttgagcaaggcaagtcatcactattccttgaacatgttgatcctaattgcgaaattgttttgtttacaaacaaagttgcatgcaatgatgaacatcctacttgtgattatgccatgccttgattattgtttacccttaaatctttgtaaccatgtttacgtatgagtccctagtcaactatgacaattgcttagaaatgctattctagaatcatgcatactcatatttatcaaatgctatatgcttgggtaattacctttgggaaggtaattgagatgcggcatgtggagacatgagcgccacattgccatgatgttgatgacatgatttgtgaaaggagaaataaaattaaacaattgttttcgactggggcggacggagaatttgggttgtatctggaaaaggctagtaccgtccccagtcaattaaggaccgagccatgaagttaagcatgaaacgacccccgtacaaccgtacttctcgaatgggtatagacctagcggattagatagccgagcggaggcagtatccctgcatagatggttcacccctgagtgaggcaggtgcgctacgatgggacagccgttgaggt

SEQ ID NO: 22495 - DNA, 433 bp, Oryza sativa
cttttaatgcatgattaattctacgtgctatcaattctagtcacattcttatatgacgtacactgataggcaacttttgggagaggaaatctccaacttcacagttagagatctgcagcttctccagaaccaagttgagatgagcctacattccataagaaataaaaaggtataatattgataatacccttttctcgactaataaataaataatcttttcctaattaaatggcgatatatctattgtctctttactaggatcaacttttggcagaggagattctaaaactcaatgaaaaggttgtacttgcatcttcttcttcttgatgaaatagctcatgatttaattggtatcagttcttacatctatacactgttcatgattgaggtaaaattacacgaatatatatcgctctatacttttaattgtagg

SEQ ID NO: 22496 - DNA, 1501 bp, Oryza sativa
actacatccgcatatcaattatatgcaatgatctagatcataaactatacaaggcggctctgataccactgttgggatacgcgtaggctatgatagcatagatcaaaattttctatcgcgtaaaccaggaaccatgaagtgttagatcatagatcgttaccactcgacgtgctgcgcagcggaagaagacactgagaagttgaaggaactctcgcgaagtagcgcgcgtcgatgtagaggaagtagtcgatcgcaccggctcgaccttctcctcctcgtgcgttctcctcgccgtactcccacgccgatcagcaccgcaaaccagcggcgcctctaccggtatccacacatacagggacggaacgccacgcgcagatgtgctagcacccgcgcgtggctagggtttttctcggggagggaagtgatggctagggtttctcacgtgatgcaatgtatccgccggtcacacccctcacgaatatataggatccatcactcgggcctccaaggcccgtaggactcctattcggatccctatccgaattaagctcatattggatctctatccaatccccttattccggcccattaagcatgcgaccctgtaggttcatatatactcggctgtaacccgaaaactcctttttggtccacgcgtcaacagcagcccctagcataacgtattgacccaccgggcatacataaagatcatatcggctgaacctctagtgtatacttgtatgaacccctttgcctcacgattatcgattaagctcaaggccagatatgtgccatcctctaatagctcaatcattcactcgaacctgttgatggattatataacttgtgattgactcctcaatcacctttggcatggccatgcacttccataatcgacaacatcgaggggcccagagatatctctccataggaggggcaaatcccatattgattatttatattccactacatgtttcatagcatacctgaaaactacttttataactatctaattatggagtagcgtttagcagtccctaagtaagctactacacatgttgagaaccacgataatctcaggtctaaggattcaacaccaatactcaataagatcactgatgacacaacacatatggctcttgcagtgtctcatattgggtctatccaacaacatgtttaccaacatgtgtccacattattaatttggtatctttataccatgatccatgagacatgatcatcaattaatacatgtgctgatcatataaacatatttgttccacatatgatatttgatctgggatcctttagaaatagtaacaaacaacataaagagtctcgtgaaagaatcacatattcattaaccaataaggagttatctatttcaaggaacaatgtcggataaatatgtaaacatagtatgtgatacaattatctctatgattgcctctagggcatatcattaacagccaccgccagcttctcattccatgaagctagc

SEQ ID NO: 22497 - DNA, 1501 bp, Oryza sativa
acaacgcaaagagtctcatgaaagaatcacatattcattaaccaataatgagttatctatttcaaacaacaatattagataaatatataaacatagtatataatacaaccgtctttatgatttcctttagggcatatcaccaacaaggacatgaagtaacaaatgagtagaattttgcctttgccaagaagatgtatgcacgtattcattataaaatttataatggcagatcttgtatgaacacggctagaaggctagaaattggaaactaattaaggttgaggtggaggattatgttacttccattaagcacaagcatattaattgttttgctactagtcagtaccacacatatggctagaagctttatctaacgcaattttttttgttaggacgtgtgaaatcatatgacaacacatgggaaacaaaatagaataaggccctgtttgattcagattaggattattataatttagattattaggaataaagtgaaacaaacagatagcctattatgatggattattataatctataagccagattactttaatctagtaatctactctaaatgttctttttttagtttattgggttgctaacagctaacaaacagcttataatccagagaaacaaacagcttatagcttattctatatatgttggcttattataattcagcttacagtaatctaactcaacaatctacgttacaataatattaagccgaaacaaacaggtcctaattcagtgtagagtcatttttgtacgtgcacgaaactgcttttccaaatcttgtttcatcttcaggtccatggatcgtcacaggttgtgcatgtatgaaatcaatactgtaacaatatcaccacaggagagtaatacctatgttttgcgcagaaatttcatcgttgaacagtggtttcatcctatttaactgagaattcactacatctattgtgtcacacatttggtctgcagtctgcacctagtacatttatatgaaatagtgggtcaccttctgcgatctgccaattgctccgagtcaagatcttgccaatatacattaagagcctattcgcttttgatgtcatttttaaccatattatttttggtaaagttgctaaaaaaatgtctacgtttagcttgttgccaaaattggtaaatacataagaaatcctaccaaaattttgatactattatcatcttaccaaaattttgttactgctaaaatttggtactccctccatcccataatataagagattttgagtttttgcttgcaatatttgaccattcgtcttattaaaaaaaatttaaaattattatttattttatttgtgacttgctttattatctacagtattttaagcataacttttcgttttttatatttgcaaaaaaaattgaataagacgagtggtcaaaaactcaaaatctcttatattgtgggacggagggagtaagatttattttagatataatctaaatatgccctaaaaca

SEQ ID NO: 22498 - DNA, 1501 bp, Oryza sativa
catggtttgatcgcacagtattagtcatttggctgatgagagtataaacgagtgaatggcccatgtttaacaactttgttttgttagtaaatgggcgtgtggttaattactacctaatggctgatgtaacgaacttgtttcctttattggtagtagtagattctcactcttctgttgaccatagctattgatttggtttccactatcttgccaagagctcattcattgtttagagggtaggttcaatatttcccaaaatagaatgaaactaaatgtttgggaagtgaaacagtagtatgcgtgcctcaactcgcttgttttcaccaatttacccgtgtaccccacatgattgattaaatttagtaattcatacttcggttcaccataccgttattctgataatgcacttttgcagagttgagcatattagatgttcagcaaaatagctgtagcgtgtgtatgaggctggcggatgaatgtgatagccggactttatttggtcagtttgctcaatcgggataaccttggagttgcttcctagatcacagcacttcaatctgatagagaatttccatgtctcaaaaccatgagacatcctttacaagcaaatagttatttcatatgacagccatcgaatgcgctactgatgtttcaaaatcaagccggttgatgcctgtgcctctgtgggggttgggtttcaacaattgctttgaaaaaaaatgtgttatgcagcgatgataatttgattgtgtgaattaacagcacaagacctttttcatgttatttctagaacagaattttgactcttttgggaaatgcatatgcttgcaatttatccttctggacaaagcattcttaagtaccatatatttcatttgcttgctggatcatgaggtttgagttcactttgagatatttgatgagatgaaacccaatagaacatggcatgctgtatataaggaagagtcctacatatatcttacataattgaattattgctaatggcatcctttttatcttgtagaactccttctatagccattcctgtggattcagatgcctctcctaggaaaaatacgccagagactgtaacaagtcctcttgtgaatggtgaaaagagtattttccgggatcaggttagaggatacagtgcacttgggagtcctttgaggagagaagttgggaacaggcatgtaagcttcccttgaccaatgttcttttatccacttgttgccattgtattcaaagtataaagtggattttccatcaattacatgccctccatcccaacttacatataatgttttcgtttacatataaaaatattcttgttcggttcaacataatcatgtggtgtgacgattcagcaatgggaaaaaaaactgaaaataccatgtgaaaacattattcttgtctatttgaatgaaaatgttttggaagtatcgtggaatctaacacattatgttgtgttttctggatcatattttctccagatctataa

SEQ ID NO: 22499 - DNA, 1501 bp, Oryza sativa
taaacccgttgcaaccttcttagtctttccagcacggccgattggtacgacgagactgcacggagttggtccagttatactatccacagggaaggtagttgtctgcactgagcctacactgctgggtacattagttgtttgctgtgcggattgtgtgggttactggctatcagggaataaccttggaaaggctgtcgggttttcagctgccaacgagtagaagtgttccttcacttgcgcatagatcttgtccgatagttgttctttgtatttgtctctcttcttataacttggtgcgtcttgtggaaacccgaccttccaacttgtctttgaggacaaaccccttacacgtccagagtgttcagccgtccccaacgccgcagtaagctgatctcgctccctccgtgggacgaactgtcctgatctttctttctcgactatctgctgcaaattagtagtcacttcttctatgtctggagtctcgaatagtatgtctccctcatccgagacttgacctgtgctgcgcgcccaaacccagttcttgctacgttcaaccatggggtctaccagcaggggcttaccggccgcggcaaatctttgctcgatctcctgccattgatcgacgtgaccagcgtatccgctcgaccccaatctatggggatatttgttcttcttcgcgagctcggacatttttttcctcaaagccaatgcttcagctgttgtatgatccgcaacaaacgtgtcccagtcagcctgcgatatatgtccataatccgtaaacggtgggagattcttctgaacataatcccgatttagatcggacttccacgtttcgagcggcgtcggactaccatctgcacagaataggtaactctatacaccattaggttcatgtcacatcatagttagggaataatacatggctaacgattttcagcacttacggcctgttcgataggtatgtagtccggatcatcatcgcggggggcgacttgtgttatttccattggaaacgggtcacttggtgtgcgccacgtttcttcactagaagcgtctggctgcttattgctaccggaattttgaggagcgttaccttcttgaggcactattggtgcgttcgatggaaccttttcgttcgacatcttccaacttgacgtaaaaaaatttgacataagtcccaattttacgtaagtcccaatttaacgcaatttcacataagtctcaatttgacataagtcctaatttaacataagtcccaattatacataaatctcaatttaacataagtcccaattatacataaatctcaatttaacataggtcacaatttaacttattttcacataagtcccaataacttaatttcacataagtcccaatttaacataggtcccaatttagcatcagtcacaattaaacagaaatctccatttgacataggtcccaatttaacaaaagtcccaattatacataaatctcagtttaacaaaaatcacaatta

SEQ ID NO: 22500 - DNA, 398 bp, Oryza sativa
acatggtatgtggtgggtcctgccgagatttaatcaactactattaggtatgtggtatccataaccctgataaatacgatagcataattctctagataaaaaatactctagaaagttccaccctagagattgtgctgattaaaaaaaagcatattacctttcgtgaaaaatgttatttttctcttttgtgaaatttaagaaaattctatagcatttctaaacttatcgcctaaataaaaaacaaaaagggtttaaaaaatatttatagtagtatagtgactgaagttagacagtgcaactaaaaatcacactacaaaggcaggcaacatgtgacagaaattggacttgtgacctactaaacacggtactcgtgacatctgatcttgggtcagactagg

SEQ ID NO: 22501 - DNA, 1501 bp, Oryza sativa
gacgacaacgacgacgacgacgacgacagcgcccagtcctccgatcactacaagaagctcatggtgcagggcctcgtcatcctccacaagctagccgccgcggagcacaaccggcggatcatcatcaacagcacccagggacggcagctgctctccatggccatggcgcccgtcagcgccgacctgctccaccgcatcgaccacgaagcgtggaacgacatcgtcgcctgctcgctgcagctcatgtgccggctcgtcaccgcccccggcgagaccggcgacaagctgcgttcccaggtgctgaacgacaaggacgccatcggcaccatggagaggatcctcaactgcgacggatgcaacgagaagaggctctatattctcgccattaacatcctcacgcagcttcccatggcggcgaagaacaaggtggtggacgaggcttcgagcatgagcgtcgagagcagaaggaaattcaccaagctacttctactcatctataccgacgaagagaaggacgcctttatgagacaaatggcaggtgaagcattggcaatgctgtccgaacgaagcaagagcgacgccacaatcatcttgaaagcaagtgacagcactctcaaggacctcaccgcaatgctcttggatgtaaatagcaacagaggatacagaatatgtgcagctgaaatcctggagcatctgtacattcgatacaccaagcaagatggctatctcaacaatctgacggaagccatgaaagatgtgttgccaaaggtgatcaatatcgaataaatgaatatattatttagtttgtttcatgttgattaactaataagagcaatgtctgtaacaatatatatatatatatatatatatatatatatatatatatatatatatcttgctgttcgtttcaggtgctcggagaaatttttcttgtgtcatggacgcataaagaaaagcaaccaggaatgacagaacaaggaacagagggagttaatttctcggcacaaaaagctgacattgaaagtcaagatcccgttgcttgtcaacatgaaaaggttaaagaggaaaacgaaaaggttaaagaggaaaatgaaaaagttaaagagcaagatgaaaaggttaaagagcaaactgtggatatgaaactttatgcagctttactgtcacttagtgaggcaatatttcaaagattggtcaatgatgataaagatttggctgaactgactgataaaattgccccaggaggaggcactgcatttagcttcgccggaaagctcaaggagatggtagaaggaaacagtgaacaagcaacagccaattgcctgagaatgctgaagattactaccaggatgatcatatcattgataaatctcaatggagccaaagtcggagcagacctggagagcttgatgcattctctgttaaaagcttcagaaaagatgttggaactggagggcttcatgattttctctagcagcgatcgtaccgaaagcacgaatcc

SEQ ID NO: 22502 - DNA, 1501 bp, Oryza sativa
actgctagtcacagtctatgagatttgggtgatctctagatactcatgaaaggcctggagtatgacttataagctccaacccgagggaatactaatggttgcctagtatcagttatggaattgagtgaaacctaactgcacaagactgacaattcaaggcatagtccattgttcagttgtggtcaggtgtagctccttttctaggtgaaagttcaacttaacagtcttcaccgaaacactggtatataaaagctgctatggaatagagagcattctcatgagccttgaaatttggtggggattgttagatttaattgggtaattaatccatttaaatcaattaaatcaaataaattccaaggctcattatgctaggaattcatgtgaattcattcttctatgggatatcaatgggatgaagagttttgagaattaatccatttgattaaggaattggtaacttatatcaattagtcctaattgatggatggttgatggttgtgtagtggaggatggttcatggctagttgatgacaattagttgctctattcctcttcctattccattggtaacttacatcaattactcttaattgattgttggttgatggttgtgtagtggaggatggttcatggctagttgatgacaattagttgctccattcctcttcctattccatgactcttactcttcatcttccattcctcttataaaatgggaatggatttgatctcccgcgagaagaagaagacacacttttatccattttcaaaagctgttgctgctacggtaatcccatcccaacgaatgtgtgcacacgcgttgggagaataggcctccgaaaccacgcgttgctgcgacgtttgcacagacgggcgagcgatcaggtttttggggagcgcaaggcgcgactactcactgttcgtcaacatctacttcatcttcaccaacatgtcgaacactggagacaaggagaaggagactcccgtcaacaccaacggaggcaatactgcctcaaactccagcggaggaccattcttggggtataaccttattacattatttcaattagaagttttactgttaatgttcatcgcaatgtcaacattgtgtcattatgtgattgttgatgcttattcaacgttaagcatgctcatgttgattacattcaccactatcactggatcaaatcctattgtaaatatcatgattattatcttgttattttggattaaaatatgccgaattatgaccaaatttccaacattaataccatgatcaacggcgtatacattgtaaactagctcttgcggttgcttttatcagataataaaacctaatggattttgcacgttttgtctcgtatggatggaagcacaattccatggcaaccctgctacttcatccgtttcatcatgtaaattattctagcatttcttatatccatatctatttagattcattaacatcaatataaatatgagaaatactgaaatgact

SEQ ID NO: 22503 - DNA, 1501 bp, Oryza sativa
agccagctcctactccttatgatcccagcgtgctattaaggaaaaaccgaagaatagcaagggatcagctgagatactctcaaatcattggttcattgatgtacttggctagcgcaacgaggcctgacatctcatttgctgtaagcaagctgagccggtttgtctcaaatccgggagatgatcattggcaggctctggaaagagtaatgcgctatctaaagggtactatgagctatggaattcactataccgggtatccaaaagtactagaagggtatagtgactcaaactggatatctgatgctgatgagataaaagccacaagtggatatgtgttcacacttggaggtggcgctgtttcctggaagtcttgcaagcagaccatcttaacgaggtcaacaatggaagcagaacttacagcactagatactgcgatagttgaggccgagtggcttcgtgaactcctgatggatttgccggtggttgaaaaaccagtgccagctatcctaatgaactgcgataatcaaacagtgattattaaagtgaacagttcaaaggacaacatgaagtcatctagacacatcaagagaagactgaaatctgtcagaaagcagaaaaactccggagtgatagcattggactatgtccaaacggctagaaatctggcagatcagtttaccaaggggctaccacgtaatgtgatagacagtgcatcgagggaaatgggcttgatacccacctaaggttgcataatagtggaaacctgtccattatgatcggagatcccgtgaatttggatggtgaaacaaactattgtgtgactgaagagacccttgaaaagggctcattttcatgatgtgtttctcttctttcctgcatggtaggatggcttatgtcttaatgtgatccgagtggcttttccaagcagagatgttgacctgcagaacatcttagaaggaacacacctatatgagttcgactgctagtcacagtctatgagatttgggtgatctctagatactcatgaaaggcctggagtatgacttataagctccaacccgagggaatactaatggttgcctagtatcagttatggaattgagtgaaacctaactgcacaagactgacaattcaaggcatagtccattgttcagttgtggtcaggtgtagctccttttctaggtgaaagttcaacttaacagtcttcaccgaaacactggtatataaaagctgctatggaatagagagcattctcatgagccttgaaatttggtggggattgttagatttaattgggtaattaatccatttaaatcaattaaatcaaataaattccaaggctcattatgctaggaattcatgtgaattcattcttctatgggatatcaatgggatgaagagttttgagaattaatccatttgattaaggaattggtaacttatatcaattagtcctaattgatggatggttgatggttgtgtagtggaggatggttcatgg

SEQ ID NO: 22504 - DNA, 1501 bp, Oryza sativa
gaaaagttctttggaaagatttttttttatggtaaaaagaaacttaacgcgattttggattaataaaaaatgagcacttacaatcagggtgtaagttttgatactactgcctgttttacagatcaccaacttcctgttttgaaaataactaaaaaaaaggtaaaactttgacaaaacctgaaccaaagaaaacgatttttaaaactgctgggattttgctttctgtttcttcaatggttcaagaaacagtctttggttgtaaaaccatctattttcataaacttgtgagatttattcttgctctttttttttttttgaaaagatggacatttggttggtttttattttaatttacccataaacagaaaaaggaaagggaaattgcttttgtgaaatgacggtggctaaaatcggattttggttcgagtagtgaggtcagaccgacactgtctagtcggtcagaccaggtggcggttagaccacaggtgaaccagcggttagaccggttgctagtcccggtaagaccgcagatataacgatggttaaatcagcctcaggataattttgcgcgtaattcaaataagacttgtgtagcgatagagtaagttttcaggtaaatcttaattcgtgtcctttacataaaatatcgtgtattaccatcaatgtcctataagtgcttaaattatataaagatttaagtccaagtttatggagttttttgaaatgaggggagcacggttaagttattgagaaacaatattattgataacaaatcacgtgttactgatataaatcatgtcaccctctggaaaaaaaaaagccaactttgtggcggaactccggccggcctcggcgagtcggcggccacctcctcgccggccgtcgccgattgtttcctccgccattcccgcaccacatgccgctctatctctctctctctctctctctctctctctcccagcagcagcagcagcagctgagcaacttgcatctttcctccccaatttccgccatctctcctccttcaactagctcggcccggcggcggcggccatgtcccgccgcgtcctcagcgccccggacggcaccaaggtctcccgcttcaacctcatgaagctgcaaggtcgacaagaagcggctgctgctggcactgatagccaccacgcccaccacgcgttcgatgaattgcttcaccgacccaccaccagcagcatcgtcgacctgaatcgcgccctctccgacgccgcgcgtcacagcccagccgtcgccatctccctcttccgccgcatggtgatggtggcccgacccaaggtgcctcctaacttaatcacctacagcgtcgtcattgactgctgcagccgcgtcggccacttggacctcgctttcgccgccctcggccgtgtcattaggtctggatggacggcggaagcaatcaccttcagtcctctgctcaaggctctctgcgacaaaaagaggaccagcgaagcaatggacattgcgc

SEQ ID NO: 22505 - DNA, 1501 bp, Oryza sativa
aagatatataggatatgcatgctaccaatttgagacgttgagagaaaaaaaggacaatattaatgtcgtggagagatatactaggatatataacagttaaatgcattctaaatgatattaggaatggatcatccaatttctctatataaacacctaggagaggatcaccaaacatagggaactaaggataggctagctaccaccactcattagaaagctaattccctctaaatctgaatatggctcttcttggcaagactagttgcaaggctgccgtgttcttggcagctctagtggtcatggctactgctttttcatcctctcatgctgcccaaggacaaggtaacgataatacaattttcgttctgcaatcaacaaattaactataaatgatttactcgcagacaacaaataaatgatttaaataaatgattttgatcatgaatttattttgtctgcgatgagcatataattcgtttttggtctactatgctttaatttattttgatcatgaattatatattcttacggtttactatttgttctgcaatcaccgagtactattaattatgagcaattttaccatccaccatttgatatctcgagatatcacaaatttttattatctcaagatactttctaatataaaaattagtacctcgagataccattatgtggtaccttgaggtatcaaatgttgaatggtaaaattgctcattaattatatgttctgcgagtatatctttttaattactattgatatttatgcacgaatcaaacatattcatggcctaactactagctgcacattgcaattttttgtttaggcaatgtaggcgaagagaaaatggcgtgtaagccgctacaaggatgcaacacagaaatgtgcatgggctactgccaaatgctcagctaccaaggaggcacctgcatacacaacgatcctgatatgtgctgctgcccgtactaaggtctcgtgtccaatcacacggattaattgttagatttaattgggtaattaatccatttaaattaattaaatcaaataaattccaaggctcattatgctaggaattcatgtgaattcattcttctatgggatatcaatgggatgaagagttttgagaattaatccatttgattaaggaattggtaacttatatcaattagtcctaattgatggatggttgatggttgtgtagtggaggatggttcatggctagttgatgacaattagttgctatattcctcttcctattccattggtaacttacatcaattactcttaattgattgttggttgatggttgtgtagtggaggatggttcatggctagttgatgacaattagttgctccattcctcttcctattccatgactcttactcttcatcttccattcctcttataaaatgggaatggatttgatctcccgcgagaagaagaagacacacttttatccattttcaaaagctgttgctgctacggtaatcccatcccga

SEQ ID NO: 22506 - DNA, 163 bp, Oryza sativa
  unsure (1)..(163): unsure at all n locations
ccgtgttgtttacganctctgctanagcncaccaagcattccgacaaatatgatattcacaggcacccaaactttgattagcttccaagttagtggttcagttgggataacaccagagagcgatagagtggacactatagtcacagatacaatgttctgcagc

SEQ ID NO: 22507 - DNA, 342 bp, Oryza sativa
caaagaacataaaacatagcaaaatgtcaaagggctattgggagcttacatgggcaacgtagttaagtgttgatggtcgtgaagtaccgattttggccgtcaactatcatatgctagtattaaataatgtaattccacttgtcttgatgaatcagtgtacatgcagagattacacaataaagtgaaaaagaaatgagctggcatgcaaagaaacacacctccggcgaatcacgtgcgagtaaacggaacgataggcccacaagtcagtctaaactaacctaaagtggggccacaccatcctcaattgccataggggcccacctagcaccctttggttaaagg

SEQ ID NO: 22508 - DNA, 376 bp, Oryza sativa
atgggtgctcgcattcacggctaattatttatagggtgagtgcgcgcgcgttttatataaacacatgcatttatatcatgttaaaaaaataattttatagcgattttctttgtcgatatatatacagcaaaagccgcgaactacaacgatgtggaactaatttttgctaagaatccaaatctagttttaccgttggaggacctattttgcaaaggatcagaattcatggaaggcactcatttggataagcattgtctacgtaggtttcatcaattaccatcgtggtggatccactcaatcttctgagtaacgtaccttcgtatccaatgctagatgatgtagtaattggatttctaggtgttaattcagtttgtca

SEQ ID NO: 22509 - DNA, 1501 bp, Oryza sativa
cgaagaagagataaagctttacaaaagacggttcaacacttgtccactgtgcaagataaatctgaacaaattttagttgaattcaaacatttagaaaactcaaaatttgctcgaaattgcaaaaacagaaattgccaaaaaaaattaaaaactaaacagattttgctaaacttaaacaaccatttgcaattttttttgatttgtataattggtgacaagttttgaattttgtaaagtatgtttaaattcaacaaatatttgtttccattagagtcttgcacatggtcgcccaagggtaaaattatcctttgcaaaatttccaagatatattaaaatagtggttggaatgtcttttgccaaacaactattcaactcctttaaaaaagagtaacgatggtgtcagcaaatatgccaccccatctattccaatgtagatttggtgctaccccttaaacttcttgatattaaaaataactaaatataaatggatgatcacaaataataatattacatcgaggtgaatttctatgacaaaaagataggtaacacattaatgtattttctcttatccgtatccaagcacgtcattcaactagtaaaactagaacatcagcaaattttacctttctctttcttagtaacatgttaacttagaattcaactgccctggggatgttccctcgtgaaaaactctaaagaaaacaatagagtatagtggcatctattagttcatcaaaaatcaagtttagatttgatctatacattggaaacaaaataagacaaattcgagtgtgaatggtatgttactatatattcatacgctgaattttttttatctcaatgtgtgagaagttgagtttggacaaaactcagaatttttgtacaaactatcaagtaacatgtagccgacacatttcatccatgaaccacacagcatgtactgctcgtccacgcaactcgcccgtctcggttttgctgtatagcagcgccgcaacacagctgctgatggatggacgagctccgaaaccaacgagttctctctatgtcgttagccgagcacttccgtcggttctcatctccactttggtgcttcagccaatggacgtaagcgtatggaaaacggccgccgtacgctcctcgtgcttccggatgccacccatttctaccccgtatggtacgctcgcactgccatacacgcgcatacttctactaatggtttgacacttgagctaattacaactgccgcgaggcaaaaccggatggtcaatatatttgaggatgtggccgtgtgtgggaaataaaagaatgcgctcaattttatttcttttgcaagacagacagttagttattgctgtatacttgtatgtgctgggtaatatatcaaaccggacgaattaacgaatggatcctctcatcctcctcaaaattaaaagaaaacattttttttaggggggggggggtgggggatcatgtgtaggagatgaagtaaaaggctcgcaaa

SEQ ID NO: 22510 - DNA, 1501 bp, Oryza sativa
aacatatactactagttgatctattcgatctgcatatattactaaatttcttttacttgatgagggcagatgtagcacgcacaacgattttgattaattctaaatcacgggagttttagggagaaaaaaaaatctttggtagagatcgagattttacatatatactaccaatttcgatctctagctagtcgattatcactgctgaggattgcccataacctagtgtgctttaaggcatgacaaaggactgtatggaatgaaagctgttcatcacgaatgcaaaggtacagtagattaatgtggccaatttccacacattcacgtatgtgtatgttaacatttcacaatggtggaatcaatataattaatcctctctggagttctaacaatcctacaacgaacagtaatgttctttgaaccatatgtctgcaacattaaaaaatgaccatgcaaacatataatattgtaacatttttttcttcaattccgaagataaaggagaaagcttgctcctttagccatgattaatactgatacgatgacatgcatgttgcattaattaagtttgaagatcaaatttattatgtgatgtacttaattttggtgacctcttagctattttcattcataaaaatgggattggcatacaactacggcataaggcagcatttttttatctagatgatcttaagttaaaattcaagtaacattatatatatggcccaagattcactcaaaatataatgtctatagccccaaattaaggcagggttgcacatcacttgggatttcgtccttgctttgccaaaaggtttaagtaaaaaaaaactaaacattttgagtcagcaaggttcaaatactacaataaatcaatataaattagcatacctaaaaaggcaaaattggcagccaaacatgcattaatctgaaacaaagaattacaaaattcccaatgagcactataaaaaaaaccaaagctgaattagtttgattaaaataatttatttaccagcatgttgaagaaaactaaaatgcttcatttatgcgtatacttaagcattggtttaaactatatagcagaaattaatcaaaattgggggagaatatggcaagaatactgaacttcagaatagagtaacagcaacaaaaagtgaacaaatcacttacattgtttctgtttcgacaacaaaacatgcatctaaatctaatgaaaactcttttaaaaaagtacaaagcagtaattccatcaacagtgatgcatcaccattaatttacataaaataccatttgttgcggctaatggaatttttcgaggaggtcatgcacaacaaaaatttaagttcttaattaccacctccaattcaccctaaaatataagaaattgtagctatgtactggacaaatattttagaacggaggtagtatatcacatatggcttaattagcttagataaacaagaaattttgccaggaatgacaatttgagaaacctctggcccaa

SEQ ID NO: 22511 - DNA, 1501 bp, Oryza sativa
tagtttggcaataatgtcacctgccacaaacttgtccggcaactcacagttgttgttctcaagttccttagccagcatctgaatctcatgagcttgttcaactacagaacggtcatcgaccatcttgtaatcatagaactgctccataacatacagctcactgccggcgtcagaaattccgaacttggcctcaagtgcatcccacatgtccttcccagaaggcatgtgcatgtacacgtccactatgttgtcagcgagtacactgatcaatgctccacgaaacaggcaatccgaagcctcgaacttagcctcttcctcaggagaaagaggtggttcacttcgtttgccccgtgaaacatagaagcactgcatcgctgtcaaccacaatagtgcacgtgctttccatctcttatagtttgaaccatcaaaagcatgtggtttcagtgcagcagcaaagccaactaccgaaaatgacctataaggtttttggaatgttggaaatttggtcataattcggcatattttaatccaaaataacaagataataatcatgatatttacaataggatttgatccagtgatagtggtgaatgtaatcaacatgagcatgcttaatgttgaataagcatcaacaatcacataatgacacaatgttgacattgcgatgaacattaacagtaaaacttctaattgaaataatgtaataaggttataccccaagaatggtcctccgctggagtttgaggcagtattgcctccgttggtgttgacgggagtctccttctccttgtctccagtgttcgacatgttggtgaagatgaagtagatgttgacgaacagtgagtagtcgcgccttgcgctccccaaaaacctgatcgcccgcccgtctgtgcaaacgtcgcagcaacgcgtggtttcggaggcctactctcccaacgcgtgtgcacacattcgtcgggatgggattaccgtagcagcaacagcttttgaaaatggataaaagtgtgtcttcttcttctcgcgggagatcaaatccattcccattttataagaggaatggaagatgaagagtaagagtcatggaataggaagaggaatggagcaactaattgtcatcaactagccatgaaccatcctccactacacaaccatcaaccaacaatcaattaagagtaattgatgtaagttaccaatggaataggaagaggaatatagcaactaattgtcatcaactagccatgaaccatcctccactacacaaccatcaaccatccatcaattaggactaattgatataagttaccaattccttaatcaaatggattaattctcaaaactcttcatcccattgatatcccatagaagaatgaattcacatgaattcctagcataatgagccttggaatttatttgatttaattaatttaaatggattaattacccaattaaatctaacaattaatccgtgtgattggacacgagaccttagtacgggcagcag

SEQ ID NO: 22512 - DNA, 1102 bp, Oryza sativa
tcctagctactgtagtgatgctgtttttttatgacaggcaaacggctagtgacatcatcagacaatggaattaatttagtagtaccatataccctttttttttcaagcagcagactgcaaactaaccattcaatggcactcatagattacagactagcatagttacaggatacagtactaagtgcatagtaatctaccctagtgctcacacgtgcaaatggaaatcccctagtgctttaacttgaaaattgccataatgccctctgaattgtataacataattgggtataatttcatatatttatataactgatttaactactaactgccaattgttcaacaaatagaaagtactcaactagtatttgacaattgttcaacatataagagtggcaatatgtgaaatatatagaggattgaaaattgtgcaatgtttgaggcagggggactcatgaattgaggatttaaaattcatgaacaattgttcaagagcaagaccattttttctcttcatattttagacccaaaaatccaacaatatggaaatgggataaatgcctctggattctcatggaagaattgaagaagaatcatgcaatgcaatggtagtgtagaagaatcatgcaatgtaatggtagtgtgccgaacgccattgccaataagtggatacggtagctctgctacataaattgatttcctttctgtaggacaggggaataatagacttaagtacacatgccaagaattatcattgctgagaggagttgcaactgtactctgtacttagatctgagtagcatcatacgcaggtaaatgcatgcagaacttgcagatcgagggaacagtgctaccggatgaatcgcaggatcaaccaacattcaacaaagacagatagatagagattgaagcttactgttgtggctggcggatgagtgctcgacccatcggcactccaggggaatccacttgagcaccctcccgtccgacacgcccgtgtacgggccgtcgccgtcaaacgccacgcagccacgctctccggcccaaccgcggacctgctcctgggggaccctgcagccctgcgccgacgagtcgtgcggccgcg

SEQ ID NO: 22513 - DNA, 161 bp, Oryza sativa
gccgctgctccccacgctctcgctgcccccgcgatccgcggccggttccctcttctccgccgagtccagccccggcgcgctcactctcgccgcctcgctcttccccgacgcgccctccccggccttccagggctctttcacccagctcctcgtcggcgcca

SEQ ID NO: 22514 - DNA, 1501 bp, Oryza sativa
atagatagtacgatggaaaaaaatataaaaatgttaatttcatgagatttgttacggtccagcagatggtacatcaggtaccaaatgaaatccaaccgttcaattaccgtgggcatgattggaaacattgtcaggtcgacttaacattcaggccgccgtcgccctcgacgccggccccgccggccgccgcgcaccacagaggccggcggccagatccctgccagcccgtcgacgccagctaggttcccccatccgccatcgacgccggcctcgcgcacaccctcgaacggatcctgcagcccgctgccgcttcgcatcctgcagcccatcgccgccgccgtcggcttcgtgcactccgttgacccggatcccgcagcctaccaccgacccaaatcctgtagctcgtcgtcggcccaaatcctgtgggctgacgccgttgatgccgctgcaaaaaagctcagaacctgggatggagaacgggcaggcggctggctgagccgatctgatctgaactgaggctacgcgaaattacgaaaatgcccttcaggcggtggtactgcatggaatcgatcggtggtactgcccggtactgaatctgtctcagccatccgatcaagttaaatgaatggtgtagatttggtacctacccaggctgttggaccgtaaaaatactctaatttcatagataatgcactcatcaagcagaaacaaataataaactaaagttgcattaggagaaaaaaatcctttacattctttcaactaggcttgaaaatgatgacagaaactttggaccaaccaaataaattttctagaagtgacagccatttccaattctagtcttatataattttttctgctttctgtgtcaacccgtttccacagagatgatatcatttcaggcagtttccgaatattttcatttctacttattttcaacaggcaaaatccacatccctcttcttgagtctggagcatcgatgagctcatgcacctcagttgcatcatcctccaccttggatacctcaaaacatttatctagtgcatacgagacatacacagaatctttctcaagcccatactcatcagccgagcatgaagcgccgaagtataacggagctagaaaaaacgcacggcctcataggctctgcgccattgcaagctcaagaaatccatcctatgaacggtcatatcgtatatggcgaagtcgtggtcaagccgcagacagatcatgtacaattcgtcctcggattctaccaagaacacgaccgccgcgcctatcacccctaatcctccggggataggatcgacgatctcaatggtgctgaacaccggcgtgggggtaaactccagtactccgatgctctcgaagaagcagttgaagtagaacttgccccggcaagcggcgatctcgcatatcggcaccttctcgtggtccttgccatccatgggtggatccaatggctgggttccaatgtcgtcgtcgtgtctcgtccactct

SEQ ID NO: 22515 - DNA, 176 bp, Oryza sativa
ataagttgtaataatgtctgctgagtgtattgccttagtatctcttttagtttagtctctctatctacccctgctttccttgatgcacagatggcttatgcataaacatgatttatggctattttgaaataatgcttttctcctagtctcatcatgtggttgatacttgataaatg

SEQ ID NO: 22516 - DNA, 184 bp, Oryza sativa
attttatcacagcgagcaataacaacaatacgacaggagggcaaaggtaacctcaccttgtgaggtggaagcacgtcgcccttgttgggttggaactccaggagcgtcttccccatcagccccgtctactctacgcaccaagcaggtccaacaaggccagaacaagattagcaccacgcctcga

SEQ ID NO: 22517 - DNA, 188 bp, Oryza sativa
atcggaaaattcttcccgagtgcgtacgagtgaggacaaaatgtgcagaaaagacttgtgttggtttatgagggcagtctataacctataaaagctgggggtacaatactcatattgcaacttcttcgtctatgacctatgataaccatatgaggctaagcgtgcttggcttggaaattcttttcagg

SEQ ID NO: 22518 - DNA, 1501 bp, Oryza sativa
aagtgtttaatgtaggcttcaaggggaaggctgttgtttttacaattgattttatttaaactcctttttgaaacaactaagtgagtacttctcaaacgacacggatgggacagtgcgtctcgtccgatcggagtatgtgcgatgtatcagtcttttgaattgatcaaggttggcacccggccaacagctttcaaacggccacccgggcctggctgatcccatcagccgtagattttccaaacatcgaacccattccacaacagcaatttcacaaagcagtagtcaaacaaaactacgctaggaatcacctcacatccgcccatgaccgtgggcacggctgttcgaacagtttgttaacctctacagagggagtacactttacccacacgacattactaacccggatcatccagcccatgcagaacggccacgtctggtgacctaagggctttcatgacaaggcatttcgagagcagacacaggttcaccatatgccaacgagaggggtcccagaccaacaccagattaggtcccagaccatactgtgccaggaaacctgggggttctccccgacaccaccccattgaatccacatgtctcttggcatcatggctcccccgattagctagttactcagccaggggtgtcccattccacccatgtggtcgcacttgtcttatgttcggatgaaattccaaggaaacggtccttaagtgcaagagcaggaaactgtactcccggtacgttccctggtccgcgattttggaaaaattcatttagttcgcaagcaccgacccaggtgtcgggttttccaagtcttttgtaaaacccaagttttacccatcgttggatattttaaatttgagggaaggtgttccgatgcgcgtgcccgaaggcccatacatcgaagcacaacagttgacaaaggagggttaagtgttcaataattcacggagggtaattgcagcaatttaggtttgggggccggcgggctatctcgcaagccgcggccgaattacttgtgttaatcctattcatgcaatatttgcaaaaagaaatacttagatttaatttataggtgcaagctgatcaaaggtgacttgccttgctcgagatcttgagcttgatcctcgaaatcctcgcactgcgggtcttcaggctccgaaactacacgccgaacgggataactcaacaaacagcgaaaataaagccctattattgacctctaagcgtgccattagatagatctcaagatttgaggaattttggaagttgaacggagtcaaacggacatacggttgaggagatattgaatttctaagattattagatttttgatctaaagaaagaggatttatttaaatcctttttgagaaaagaaaagaaaagaaagagggaagggaattagacttccctcgggcggctagggcgcggcccgagagaaaggggcggctcgaccgagcttaatgggccggccggcccgagaaggcggcccaaggcg

SEQ ID NO: 22519 - DNA, 1501 bp, Oryza sativa
attttagcgtgaaataaacacagccataaatgtgcgagtacccatataagtctaggatttaaatccgggtggactgattccatcataagaaacctaactatatgagttttggtgattttatttttcacttgaatagtttgatgagttggttaagatattgcaagatgcaatattactgtttctaactaacatgccgttaataattttattaaatttaagaagaaagtgatgtgatgcaggacgatatgtgttagttagatactggagtatatatatactccagctgcaatttactggacgcgtctacagtgtaaatatatgttatacttttgcatctgacctacccttacttaacctaccggggcggtcattgattgagtatattgttgaaagaagattactgcatactctctctgtcattaaaaaaactaacctattaccacataagataattaatctggatatatgtttgtccagatttatagtcttagatgatgtcaaatcttcatctagatttttttttatagaggaagtatgtttgcatgtggctctaattaacaagtacttaatgattaaaatgtgcatgtgccgagtatatggagaatagtacgtatataccgaatgaatttatgttggaattgctgtggaccaagtgagcaacaattcgatcgatgatgatcgtcgagtgtactagtagtaggttagtggtggctgggtcgtcacgtcattgcattgcaaagtccaaatatcaccccacacacatatatagacggagacgaccgaccgaccagtggatttagtcgcaaatgcgtgctgtgaaggattctaaagttggatttactttccagtccaatttccaagctaccacggtatttatttatttattttctccggcaccaagtcgcagtaagagtatgatttaatgaattatatgtggagtatgtgtaaagtttgacctagctaattaacgggaatgaattccattatgatatatatatatatatatatatatatatatatatatatatatatatatatatatatatatatatatatatatatatatatataaagagagagagagcagtattactgtttgtcaaatctcataataaataaataaataaaataaaatgcctttggcaaagaagaaaaaaaaaaggggtaaattggaatataggaagtggccggaaatccgaaaagagagggaggggaaaggggggaatccacctcgaagattcctcgtctcgcttcgctcttgctcttgactccgctctacccgccgccgccgcccaaacgaccaaacgacctcctccttgttcggactttggagcaagcaaaagcaatcgcaattagcaacacatcaatcaaatcctttgttagatttgatgcgagcgtcctccaatccaagattaatttccatctattattagggtactcctacgaaacaacaagtagctagctattagtgagtgagtggagattgagaattggatgggga

SEQ ID NO: 22520 - DNA, 1501 bp, Oryza sativa
gtgcatgtccctagtcatgcatgtttccaatatcagctacctgtgtggatgaaattatctgccaatatcagctgattcaactgaactttcattgagtccttacatcttttctcgtccttttctctagcaaatcacataggattagttatctagccgggagagcaaacgaatggcaacccttggaccaagcttgattgctcccctgctgtggctccatgatctcagacttcgtcagagtatacagtaatgcactttcttcagaaattttcttgacagaataagctcaagtcacttaactcgatgttaaagccctgtagcgtatcatgtaaagctcatgattttgatctcttgagatgacatagggctccgttcgttaccagggattcccaacctccctcccgcgttttccacgcgcacgctttttaaactgttaaacggtatgttttttgtaaaaaaaaattctatacgaaagttgcttaaaaaaatcatattaatccatttttttaaaaaatagcaaatacttaattaatcaaccgctaatcgctgctccgttttccgtgctgtaggaaaccgttcccaacagtgagtatcgaacagagccatactgtatgttcatacatcgttgcctagttgatgactaaaaaaacataaatattaaggaatgacataatattaaataattaaaagaggtaaggcttcgaaccacaccttgtggagctcatcaactgagcttgtccagttgatgactgaagtgctgaaaattttcctggtctgaattaaaatacagtagtactgatatagtagtacatttcatatatgctgcagaccattgccttttacaaacaacaactgtgaattgtattattagagcattgagttctccggaaaaaaagagtaatgcaagataatggcaaaagtcacaaagaagagtgtagataattatagaagcatcattcgcagtttgaaaagaaaggaggaagaaccacttggttgattacgcgtgtatacataatctaccttttaaaagcaacgaacaaatgcttaattattttgagggaatcagattcttaattagaccaaaaaagcaaaaaaaaaaacaaaaaaaactgtttactgcttggagatcttgaagtgtccaccctgaacttttgactgcaaggttaatccattttgtccaccgtcatttcccaaccaaagttctctttcccctaaagaaaaacacacacaaaaaaaaaatttctctaagaaaaacacacgaaaatactattattttcaagtagtagaagtcaagcttccttgctttgctttgcatccgaccgttgggccagaggctccaagccaacggtcaccagaggaagaggtacactgtcacagtagcaaactccacaagcttccatctgccttcttccataggattcttcaacctctgctgcaccccgcagattaccagcttccatccatggctggtctcccctatttatacaccaactccttcccctgc

SEQ ID NO: 22521 - DNA, 1501 bp, Oryza sativa
tttaatgcaggctttaagggaagggctgttgtttttgcaattgattttatttgaactcctttctgaaaacaactaggtgagtgcttctcaaacgacacggatgagacagtgcgtctcgtccggtcggagtatgtgcaatgtatcaatctttagaaatgacacaagattggcacctggccaacagcttttcaaccggccacccgggccaacaactttcaaacggccacccgggcctagctgatcccatcagctgcagaatctttcaaacatcgaacccctttccacaacagcaatttcacaagcggtagtcaaagaaaactacactaggaatcacctcacatccgcccatgaccgtgggcatggctgttcgaacagtttgttaacctctgcagagggggtacactttacccacacgacattactaacccggatcacctagcccgtggggatcagccacgtcgggagacctccaagctttcatgacaaggcatttccaaagccgacacaggtttaccatatgccgacgagaggggtcccagaccaacaacaggttaggtcccagaccatactgtgccaggaagcccaggggtcctccccgacaccagcccggcgaatccacatgtctctcggcatcaaggctcccctggtaagctagttactccgccaggggtgtcccattccacccatgtggtcgtacttgtcttatgtttggatgaaattccaaggaaatggtccttaagtgcgagagcgggaaaccgtacacccggtacgttccccggtccgcggttttggaaattcatttagttcgcaagcaccgacccaggtgtcgggttttccaagtcttttgtaaacccaagttttacccaagaagtttttcagattttaagtttgaaggcgtccgtcgatactcgcgcaggatgcacggatatcgagacgcaactagatggttacaaggggacatgatataacaattaacaaagggaggatcaaatgcagcaaattatgtaagtccgccaatctgccttgcagacgggacaacagattaagtgcgatcctatcagtgcataatatttttcaagcaacataattaaatttcaaatataggctcaagatgttcaaaggtggcttgccttgctcgagatctggagcttgatcctcgaaatcctcgcactgcgggtcttcgggctccgaaactacacgcgaaacgggacaactcaacaaacggcgaaaataaagccctattaatgacctctaagcgtgccattagatagatctcgagatttgaggaattttggaagttgaacggagtcaaacggatttacggttgggaagatattgaatttctaagattattggatttttggtctaaaggaaaaggatttaattaaatcctttttggaaaagaaaaagaaaagaaaagaaaatagggagggattatagacttttcctcgggcggctagggcgcggcccaagggaaaaggagcggaccggacgagctaaa

SEQ ID NO: 22522 - DNA, 322 bp, Oryza sativa
aattcctgcagccccaaaattcttagctacaattagtgggggatgctgatcccttcttaatctcagtaccatcttttttacgacaaataattttctgtacttctaactatcagatttgaattgtgatttttaaggggattctacttcaataagcatgtcttaaatattctggaatgtgtttttgacttggtgttgccattcttcatattgatgtggaatcacgaatcaggaggcagacacggttgttttgcactggtggactagaaattgttttcctgtgtttatattagcgtcatgtcgtcctacccatatggctcgcaga

SEQ ID NO: 22523 - DNA, 200 bp, Oryza sativa
atcgcgttgccgaacggggccgaggagggttccgccgaaacccttgttccgcccaaccacggagctcacccaccggctacaaatttgcaggggagcctgacactattgcgaggggctgcgcccacagtgcgtttaccccttccatcctgtttttttccaccgggatcaattgaatcccttggggtggctctccgtccaga

SEQ ID NO: 22524 - DNA, 1501 bp, Oryza sativa
tcgcctccctcgacatcgacgccggggagctgggcgacgtcgaccacgcgcacttcttcctggtggagtcccagggggagctgtacatggtcagcctggtgtacgagctcggcggcgccgggatgacggactgcgagacgcgggtgcacaggctctccgagcacgagcagccgccgccgcggcggtggcgcagggcgcgcgacctcggcggcgggcgcgcgttcgtgatggctccgtggtatttcgcggcgtcgtgcgacgccggcgagtgcgggctggaggcggactgcgtgtacatgttctacccgggggaggacgcgtgcgtgaagatatcgagcgtgagagagcgcggcggggaggagttcgtcggacttccaccggcgaacagagcgtcgtggattctgcacgttgatccatagtttcagcttggaattattaggtggtgtttggataattttagtcactgtcgtatcagatgattgacactaattacaagtattaaacgtaaactaatgataaaactaattgcataaatgagagctaattcgcgagataaattttttaagcctaattaatccctaattagcatatgtttatataggctaatcatagaatgagttttgtcgcctacgtttaatatttctaattagtgttcaaacatccgatgtgacaataactaaaatcaaccaaacagtcgcttatacttcatttatgtttggatttggccagtttatttttcttctcctttttgatattgtagcatactagcaaacgtgcttgtgggatgcaacgggaacaagttcatggttgcaatcaattactttcttccggttgcacctgttctcgaattagttagtaggtgatgatggcaacatgatgaagagtctatttgggaaagcttgtatcagaatccgaagctccccaaacaatctaatttttagtttaaattctgataagttatagttgtagaattcaaaaaataaactaaaagccagactaaaaaatccaaccttttcatattttgacaactctatattttcagattgtagcaactctacttttccaggccttgtttgtttcaacttagaattattataatatggattattagcaataatttgaaacaaatatgtagattattatgatacattattataatctataagctagattagtataatatgataatcttctctaaatgtgccttttcagattattaggtggctaaagaccattaccttacccttaaaagttttatgcaaattacccaccactgccatcgaacccaattgatcgagcacatccgcttcctctgatcctctctccctagtgtgcgcgaatccggtgcctcccccggccgtgtgtgcatccgcttcctctctccctatcgtgcgcaaatccttcccaagtccccaccctgcgctgcgcaaatccttcccccgagcccccaccctgagcccgactccttccccaaggcgcgtcgttgtcgccgtctcatccg

SEQ ID NO: 22525 - DNA, 1501 bp, Oryza sativa
gcccttcgatccacccatcgatggaaaggaccacgatgatgtggcgatatgccagattgccgcttgccatggcaagttctacttcaacggtttcttcgacaccatcggagtgctggagttcaccccaacaccggtgttcagctcgattgagatcgtcgacccgaccccgggaggattaggggtgacgggcgcggcgcacgtctatcttgtagagtccgaggacgaactatacatggtgtgcttgcggattgactatgagtttaccatctacgatatgacagtccacaagatggatttcttgagccgtcaatggcgcagagccgacgagattggcggccgcgcattctttctagctccgttgtacttcggcgcttcatgttcggctgatgagtacgggcttgagaaggattctgtgtatgcctcgtatgcagtggataaatgttttgaggtatccaaggtggaagatgatgaaaccgaggtgcatgatctcattgatgctccagactcgaaaagagggatgtggattttgccggttgaaaaaaaagtagagatgataagagggagtaatagatgtgattgctacctccaaatttatttatggcattcaccaataaattaagatgcaagatactccctccattccaaattgatctgcatatagttttttttgaggttattcctaaatgatctacatatttgtgtttatttattaagtctattcgttatttgtccattggagtaaatggacattgatgcatgcatccatgcacacaagtatttataacccacatgcaatatcttaatttgctattggctaggaaatagtggggatggtgcatgcattgggtttgttgctagagtaaataaaatatgagagagttattagctttttttggtcttggtgtacctatgaaatatgtagatcaatttggaatggagagagtatacaataggtcacctctaatacacaaatatcaatgactttagtactctcacatccttcttgaagtttgtgtggggggtggttcatcatctctgtcctcacttctctcctccacctcatcacccaataggggcagcacataaaacattatagcacttgcactaatgattggaaaaaagtcagaagctatacactctagatggaaatgatgctcacagaaattataaaaatcaaaatttgtatatagctgatcgaaatggtgggaaacagcatcactaaaaaatgatacttggtcggtcggccgggaatttccgccgtcgtttttatttgtttttgcagcgtttggtgagtgcactatctgtaaagtgagtactattcttaatcagtacgtatcttgttttctagttaattgttcgtatttcgagtgcttgatgagagttaattagttaagtcatcatttcccttatgcccgggcgacacacgttttacgatggatgggtgtcaataaaaggaaatggattttttccctcgagggaacgtctcttcgttttatacata

SEQ ID NO: 22526 - DNA, 737 bp, Oryza sativa
tatttctttgtggtaatactgccatttcctggcggtctgtaaagcaaaccctggttgcaacgtcaaccaaccactcagaaataattgctctatatgaggccacacgagaatgtgtgtggcttaggcggatgatcggtcacatccagaagtcatgtggcctaaacattgataacacccccaccattatctatgaggataacgctgcttgtgttgcacaaatacatatgggctatgtgaaaagcaatttcacaaagcatattgttcccaaattcttttatccccacgagctccagaagagcggggaaataaatgtcctgcaaactaagtcatgtgaaaatctcgcagatttatttacgaagtctctgccagcctcaagtttccacagatgtgttcgtggcattggcatgagacgacttagtgaattgcaaggatcagggggagcaaagaatagcccatgattgtgatcctgaagaatcacaaacaagtcgtgaagacttgatcaactgttgtactctttttcccttggtgagtttttttccccattgggtttttctcacgcaaggtttttaacgaggcaacaggtgcaacacaatattcaaagtgccatgtactcttttctcctaccattttttcccactgggtttttgggaggagtttttgatgaggcatgcgcataattcaaactcgtctaagggggagtgttatgaaatctatcttattgtagacgaattaaatta

SEQ ID NO: 22527 - DNA, 1501 bp, Oryza sativa
ttcatatatatgctaatgaatctaattagcatctatattaatatggacaatgctagaaagtcttacattgtaaaacggaggaagtactaaccaagagcaagaacaatatagtgtatgatatcggcgttttggatagaatgcctacattatgagcgaggatatatttatataccattcaataaaatatttaatacactatttataccatttcgtacaatacatctgttctaaaatatagcaacttttggctatacatagagatatactcttgtttaaattaaatgtactgtggaagttgtaatattaaaagaccctcattgttatttaacaaaatagaatacaaagaaaacaaaattttggttttattaagggtagcgcagtaatcgtacaaaatacaaggacttgtgtgcaaaatatccttctctccggctctcccacaccaaatcctctcaccccccacctgcgccccgcgcctctcgccgccgccgccgccggcgacgacgaatttcttccacccgcatccccctcctcctagcaagctagccgacggcaacgcctcccggttccccctatgaactgacgtcgagacctcatcccggccgccaccagcgccaacgccgctcctcctcctccacgagccggtgcctggatatttctggatctgaggccggcccgtggctgcaggactgcgtgcaccattcttccgacccgacgttctgccgccgcgcgcctccatgccctccggatcaagctccccctgtattagggtggggttttttgcctgggttggcgagcgaggcaagatgctgtggtgggacacgctgctctgctctgctctggcgtacggcgtacctatacgagagaaccaagtgccgcctccgtcagccgtgaggtgctcatggagggcaagcccatccccaccgagctccgcaacaaagacctccaggaccaggaaagagcaggttagtgagctcctgtttctcaacgtttccgctccatctccatcgctgctgccttttctgcttcttctttttcatctatatggctgggtgtgtggtgaattttgcttcagccccaagtatccgcgtagacaatgagtattgacggtggcacgctccacgtgccaagattctcctggccatgtcttgcaatccgagcacggcttgcaatccaagcgtgcccctgatttagtttgtcgaggtgcggcggcctttgaccaggcaacaaattgttcttcacaagttgaattggacacatttggttgacaatgataatcagtaattactgtccattcgctaggaagtcaaacccataattcctgtctcgcaaagactaaactatggtagtcatatttagtatagttcaaaggcaaccttcacaattgaatctattctaaaaaagttcgaagcagtcactaatgaaaatcttgaactactttaattctaacatagttccagaaaagattggtgaagtatactttgaactattctagaaaaagtaa

SEQ ID NO: 22528 - DNA, 533 bp, Oryza sativa
cgcccacccttgcctagatgcgtcggctagaggaaagctacgctacaagcccagccgttgcccacgctggcttgtggtaagtacgttaagttcttccagggcatcccgcgaaccggtccttaactgccatgggtgcgaccagcaaaaccatgcacccacagcccaccatatgattcattttaattaaccaacaccagagcggtggtactaatccaacattaccattagaaccaacagtctaaacattaatatgattttccccattgtgaactagttgaactaagcatagctaagcaattcctagtccaaactctaatcatgtcataaccccaagctaacaaaggagcatggtatccaaaaagcatggctgtgacaataggtaaccaacccataggatcccctataaaacaatgcaatatttgaaagaaaacaatagagcatttgcaatataggatcaacatgttcaagtgacaagcatgacttgccttgctctgctgctggaggaacctcggcgactatctcaaagtacaccg

SEQ ID NO: 22529 - DNA, 347 bp, Oryza sativa
atttattgatgctttttttctagaaaatgaagaattactgataattgcagcttatagtagtgaattaaatattatatagtttaaaccttacagatatcttgtaaaaaaatatctgagcaatgtagatgaagaaaatttataagaaattgtactttttcaagagtggtgtgtcacccggtcgatattacaccttacaaaagcgtatcttatatgcccgcgcgaatgcgcgggctacctttctagttatattaataatgaaagagatgaaacatataaagacgttatagtatatttgtttctcttctttcctccatctttatcttttacattttctcgctatctctagt

SEQ ID NO: 22530 - DNA, 1501 bp, Oryza sativa
catatttgggtacagggaccgctcatattctgggatgcattcttcagcttttgttaactgtgatgatgtagccttgagctgcagtcaacaacggttcctttcgattctgtcatgccaatttccccatccctgcactgtctttcacaattaagtcatccctatttttgtacaatgcaatgaacagctgcaagcatagttgcaagagtgatattttggttattcactaatatggtcatattatggtttgaagtttggtcaatttaattaaagagcacctatgttaacaaagcttccaattgtttttatattgttatgatcatgacattaacctgtgtggttgtacttttaattaatatgcacggggagtatttgcacgagcaaatttttacatgaagtttgttcatttgacatttggcgtcactgaatacaaatttctgactatgtatgtactatgttttaagattaccttttttaggttaattgaaatgaaggggaaacattcaatcaataataactaattggcatttcatgagacttttgcttgcgcagctgtgtgcggtagtagcaccgcgcttttcccttctaatactatccgcacactctatttcttttgaatgaaaaagacaggtggggttagaggctacacatgtcaaccactttttttttaccaactctctattttttttaattaaagtgattatatagggctaaagggtccacatgccagtaatagaaatacatacaataattaaaagatgatatacataggaaatgatgataatgcagattaatgatatttttgaaatcccattgcaatgcacacgcaatatggtaatatatataggaaaaagtccaaatcccccctagactatgcccaagagtccatctagcgtcccaaactataaaaccgggtatttagcccccaaaccttataatccagtccatttaaccccctaagctgtttcacaaggcggttttgcacatgtggtgggctgactggaccgtatttgccacgtcgtcatgctgaccaggcaattgcaaagtacaggagggaaaggtgaagtgatcgcgaaataaaatgagggagggaacgcacatcgctccatatatcattcttgcctcatcgtactccctcatcccatctcctaggtttcttctctcgagtgttgcgtctatgacgaccatggctgcctgatcacgcactgacgggaagattaaggtgatcgcggagtacatcttggagtaggtgagatccctgactcgattgcagtctttgatgcaagaaagtttcctccgtttttatctagggttttgtggtgattgttttactcacagtggttgacagcctccacgagggaggtatggaggcaagatataattagctttggtttctttagttttgttttctttttgttccgacattgaggtttagggctttgatgttttctgttgcatagtgcagatcgatgtgtgtaggatgatcttttttaatcttgtcaaa

SEQ ID NO: 22531 - DNA, 356 bp, Oryza sativa
gtaaatggagggagtatatcccttaggctaaggaatcagcactatgagcaacttgtacatgacataatttgaaaatagaattaacaactgcactgaaattgccatgcaaaggtgtaaaaaacaaaagccagttttttcgaaaatactctccccgtccaataatatatgggattttggatggatacgatacatcttagttcaataaattttgacatatatgatatataatttgtccagatttattgtattagttagaatgtgtcacattcatctaaaattttttatattatggatggagagagtaaaacttcaccccacggtacactagagcgtgcgtagaacttgtagccacagca

SEQ ID NO: 22532 - DNA, 1501 bp, Oryza sativa
ccgccgtcgaactccatccggtgaatccaagccgttggctcgctccctctcgttctccctcatcattccggtgtacaccccgtcgcccctcgtcgtcgcacggtgtcccggagaaaccgccgctgcccgccgtccattcgcagccggcgccttcgtcttcctccagccggcccgcgtggcagccacgtaggcgccacgtcggtgccacctcggcacgaccggatcggctgaccccggtcagccgcttcctccggccccgctcgcgcgcgcggtccaccgcgagccatgaggctgcgcgtgggcctgccgcatccgcgtccaccacgaaccgcgcgcatgcaccgcgcctccctccccaaaccctagcacgccccacgtgcacctcgctcacggtgagccaagttgccgacaagcgggtcccactcgggaccacgcgggatggacccgacccaccggctctctctctctctctcctccccgcccgcgcgcgcgccttgggccgccttctcgggccggccggcccattaagctcggtcgagccgcccctttctctcgggccgcgccctagccgcccgagggaagtctaattcccttccctctttcttttcttttcttttctcaaaaaggatttaaataaatcctctttctttagatcaaaaatctaataatcttagaaattcaatatctcctcaaccgtatgtccgtttgactccgttcaacttccaaaattcctcaaatcttgagatctatctaatggcacgcttagaggtcaataatagggctttattttcgctgtttgttgagttatcccgttcggcgtgtagtttcggagcctgaagacccgcagtgcgaggatttcgaggatcaagctcaagatctcgagcaaggcaagtcacctttgatcagcttgcacctataaattaaatctaagtatttctttttgcaaatattgcatgaataggattaacacaagtaattcggccgcggcttgcgagatagcccgccggcccccaaacctaaattgctgcaattaccctccgtgaattattgaacacttaaccctcctttgtcaactgttgtgcttcgatgtatgggccttcgggcacgcgcatcggaacaccttccctcaaatttaaaatatccaacgatgggtaaaacttgggttttacaaaagacttggaaaacccgacacctgggtcggtgcttgcgaactaaatgaatttttccaaaatcgcggaccagggaacgtaccgggagtacagtttcctgctcttgcacttaaggaccgtttccttggaatttcatccgaacataagacaagtgcgaccacatgggtggaatgggacacccctggctgagtaactagctaatcgggggagccatgatgccaagagacatgtggattcaatggggtggtgtcggggagaacccccaggtttcctggcacagtatggtctgggacctaatctggtgttggtctgggacccctctcgttggcata

SEQ ID NO: 22533 - DNA, 766 bp, Oryza sativa
aaaagacgtgttgtcggagtcgtccgtcaagcctgagtggaagagctagccctagaaggaattggagcacgcaagtgacgtaataatataaatgattgttatatttgtaatgcaattaattaagattattagacctgtaattggacttatcatataagattgtgtagtgttctaatattatttgagttttaatataagattactttatttgtaattagacttagtatgtataattattgactacggaattggtgcgacaagtagcaattgactattgtagtcttaattagacttagcatatacgcacgaaacacttagcatacatgactattttagtcttagcatgtaatattatttgagttttaatataagattactttatttgtaattagacttagtatgtaattattgactacggaattggtgcgacaagtagcaattgactattgtagtcttaattagacttagcatatacgcacgaaacacttagcatatacatgactattttagtcttagcatgtaatattatttgagttttaatataagattattttatttataattagacttagtatataattatttactagctagggttgtataatatacgtcacctagacttagcttatatcacgatttgtaattagacttagcacgtaaggttgtgtagggttctaatgtacgacatttacacttagcatacatgacttagattgttaaaacataaatgtctcgtaacttagcagatgtttcttgtatcaacaga

SEQ ID NO: 22534 - DNA, 609 bp, Oryza sativa
cccccaaaatttccttttgtgtgaatgacgaatgggccccacatgtatgtttttaattgtaatgccaccctagcgccacgtcaatagcagactaggtcaacactgctacgtagacgccatgtcagaaaatccgttctccaaaaccactgagagagttaaattgcaccaattttaacagcttagaggtcaatatatctgattttgcggtttagtgtcatggattagatatgggtcacttttaagggagtcaaagtgtacttattccttgatatgctaagccatgtcatgtcctgttgatccggcatgagagccggcccaacgcgggatttttaattttgggaataagttcaccggaggtccctcaacttaacagcgagattttttgagttcccttaaccacaaaaccagaaatcttcacccctcaactttacaaaaccatctaatttgggtcccaagacagtatacatggctggttttgatgatgtggcatcctagtcagcaaaaataattaaaataaatatgtaggggcccacatgtcagtgagagaaaatgatgtgggccccacatctctttttttttctttttctcttctcttctcaacttctcagc

SEQ ID NO: 22535 - DNA, 539 bp, Oryza sativa
aatatgatttgtttgtgtcatttgtgagagggaggaggccacacatgagtctgccacaccaaatctggttggaaaggagccaaatgattggaaaagtatatttattgtcaatctaacccttccatccaaacatctctagggctagagttagttcagggttagttgagagctggaaactaactctaacctctaactctaacccttagatccaaacagggccaatattaccatgccagtcaaattggtgtgacatcgttgttttgtcacatcagttgtgctggtgtggctaaaatgttcaattcttcaaaataagatttgaaaggtttatttttaatattaaaatttttaaaaagttaaaaaaaatcgatggcataggagtatatgtaaaagcagctactcaagtctgatctgatgagagtttttaatactgtagtggatatgttgagtactccagatgagattaaggccgagtttagttctaaactttttcttcaaatttttaactttttcatcacattaaaactttcctacacatcagg

SEQ ID NO: 22536 - DNA, 414 bp, Oryza sativa
gggtgtaaactgaaaggcactaccacatatgagaatggcatgtgggacccagagccacacgccagtgacatgtcaaatggtaatgagaaacataacctctatatttggggtagatgggaggattatgaaactattattttgtattcaacgtgaagatgacaactagaatgatatgtacggtcctgatgttccactattatattttgggcatttatgaatgattgtttaactaaacaactgactaactgatggattgacatcattttcgtagttccatttttttttaaaaaaaataagtagttgtaaaaatatttccagaagacatactaattttcagttctattggttataggaaaaaaaacatgtgaatttcaagaagaaacatcgggtcatatgttgttgtgttgtcaacca

SEQ ID NO: 22537 - DNA, 1501 bp, Oryza sativa
tcccctgcatgcgcgataagtgggttgtggcgccactgggccactgtgggcagtcgcattaactcacatatcttctattgggttgcacataagtgagttagtgggtaagtggggtgggctagcccagtgggttagtggcaggccaccccacttttagccttactctgacgcatctctctcatcatcgagtaggtcatattgctagctgcgcagcgaacaatgcgttgatgtccaccctggccaccagctcatttgctcagccactacaaaaccatcaaatccaaacaactcttcaagaagcagagcagcaagaaagtgggtgacggtaaccaacattgtcgatggtgacgatctgcatgcgatattgcgacttgaagtagaagtagacgtactcgatgtagctgagggagaagttatcgagccactcgccagagacgatgccctctaggtactcattgatagcccatgtgcaggttccccagcaccagggctgccaccacgctctgcagcacgttgagtaatgatggtagtcaactccaaccaatgaagccgccacgacactgagatccgtgttgaggccgatgtgggtgctcaagaaaagggcagaggtatcaggggcggtgtagaggcatctacaccgccggagagcggagagcaaatgcgtcgatgggtgcgcaggggagtagatcgaagcgatggcagcgtggtggaggtgacggcggagcaggaagagcaagagcagctgagtggattgggtgacagtgtgtgggggattgattggaggaaataaggtgcgatgtttgcgttggaggaagttgcggcatgcgccatgcgtgactgaggaatgatccggcgtctgcgtgatttcattgttggatcgcatctcacatcagggatttttatatctggaccattggataggatgatctaatggttagggagggcctgcataacattctatgtgcgttttcgtgggtgcatctagcaaaagagtgaactgcttcttttcatattagtatcaatgatacttgctcttagaaatagttggatatatctattccaataaatgtgcatccttcctccatttcaaatttttaagacaatagatgagactactgtcggtctctatattaacaagtggatatacacggatctattaatgctgcatatcccatcatttcaatgtgcatatctgatatctctccaacgtcactagtagtaaggtctaataaataaatatacaggctagctataaaaacagagccttcccctatagacacaaaacgatactagaaattagaaaaggaaagcagccaagtcgatcatcacatcacctgatcgttcttgtgagctcgggtgacaacgttaattaattcgtaagaaactgcggcaccggcagtagcatcaatggcacggggaagcgccgccgcgccggggctgctgctggcgctttgctgcgcggctgccgccatcgccgtcgtccacggcgaggattgggccg

SEQ ID NO: 22538 - DNA, 195 bp, Oryza sativa
actaggatttgtctttttttttttgatggagggagtatgctggagtagatgctggtgctgctgctgttggtatttcgggatgaacgacgacgtacgcgcggtcgccggcccggccggccagcctccagccggcgtacgcacggcgtagcatgcaggtaggtagctgcagtgccatgcattgtgcgcgcgcggcca

SEQ ID NO: 22539 - DNA, 547 bp, Oryza sativa
tcccagagggcggtaggcgactatttccgtcaattttcaaaatggaaaattatttttgtaaaacttttaatacaaaaaattataaataaaaaaaattcatccaaacacatcctaacaactgaaaacgctttgggtgtgccccgatcatgcacgggccgcggcgcctgggccacatgccgcagcaatcgagcatatgggccgagccgtcattgcagccataaaagcatcgcccaaacttgcctcctgacgcgaaaaataaatcaaacgattagagcgagattaattaaatattaatttaaaaaataaaagatagattaatataatttttaaagtaatttttctatagaatttttttgctaaaaaacatactcgtttagaaatttagaaaacgtatacccagaaaacgaaaaaggtgagttggaatagaagtgaagaaaaaaaaacagtctgctcaccatctcttgacctctaccgtgtcacctagctgcttttgtgctgcccaaagctgagccgccgccgtaatccggccatggcaaattggcaaaaa

SEQ ID NO: 22540 - DNA, 1501 bp, Oryza sativa
tgggtggaggagatcggctcaggaacggatggatttggtgaaagaagagtcgggcttatcccgagttcacccgaataaaaacggccaaaattcgtgagatagataacgaatttgatgggggtttcttcgggattaggtggaggagatagagaggaatccgtttttgcaatcaattttggaagggaagcaacggatgcaccggatttgatggaggaggaggcgactgcacaggttggctcggctctgtctggagctggaagacgacactgtagcagtagggaggccaactagactttttgggctgggccggaagggagcaacaaaggacttccaatttaataaattaatcaatgagatgagctttgaattgttaaaaatacttccaatgctcaaataatttcaagaaaaatcctgaaaatacttggacactcaaagtatttaacaaaattaaaatcagatcattaaatgattaatttaatatttaaataattgctgaactgctctttgtatgattaaaattaagagttgagctccgaaaaatccgagaaaattccagagagtataattaaccatggagaatttaataaaaattaaatccatccattctttatatttaggaaattttatttcccacatttaacttcacttgtaaattaataaacatttaatataaattctaataataatttattaaataatttataaatcctgaaacgaaaatcaggatgtgacaatattgtccttcttttcatacttatagctgtatcagttgagtttgatcttatgagtcatgattagaatctcaatctctagcctgcttcttggtagccgattagggtagtatcagggtttcagccgatcttacctgattgaactacaatacttgttttatatgcttcgttgatatgttaaatctgccctttatgctaagatcttatagcatttaaatatattaggctttcgtttgatatattctgcttgctttaatatcttaatatagagtggtatcggagtattagccgatacatgctaaatctacctgattggctatgctatgaacctatatagtcccattattaatatatatttcgatctaagtgatttatactgtctcggcatggcgaccgatctatcccaatcacttgatttaagtatatatcgatataaggagtatatattgttaatatctacagccaatcgagtagatttggttccttcttgtttactcatgactgtcgatcgatacatatatgacatcggctcaaaaataaatgatatgtcatcggccaagggtcgatcggctgtcatttatgaatttaaccgcggtttctttgtctttgttcttgttgattgcaggatcaaatcaactggcacgcttgcatacccgaaggcgagttttggacctgcactggagttaagcagatctcccaggcctcgtgttttacgtcaacacgcttttggcatgcccggtgggactgattagaagtcagagttttcctca

SEQ ID NO: 22541 - DNA, 1501 bp, Oryza sativa
gcatcccgtatgacccgtcagaggtgacggtcatcagtgaccatttcgattgcccgtcacaggtatcccgtcagagatgtgaggatctggtgtagtggttcaacatgcaatatctctgaagatgcttagttgagtgtgtggtgggctctgcttcaatacgcaccatgttttttgcattttggatggatgtccttgtcagcctacacgatcaggagtcaaacaaaagcgctaagaacctaagacccttctttttcagactttaaaactgaagaccgagactaaacaactcgtatagtttaacggattatagtggattgtttatacatgagaacaatagttttatagtattcaaattcaattgtgacacaatttggatctatagtctgctatctgcaagagattacatttcacaatctagcttattcctaggtttttctgctaggcccgttttttttctagtgttctacatcttccttccacgacaccaccattttttctcatcctaaatagctagctgtaaattaaaccgtcgtcaaaacatgaaaaatgaaaaaaaaacctagccgattttgttgtgcaattagttgcacaaaactacttgatctacaactttttttaaaaaatggaattatatcagttgaagaaactaagttcaattttacaaattattaacgcaactgtgtagttcttatatataaaaaaaaataaacaccagtttaatatttatatatttgatcaattaatctacaccattacaatttattacagttaagtcagttctcttaagttatttactcattcctttggttttgtacttggttatacattcctgcacgaatgttcgtaacccatgacgtacgtttttggagaatagtcatgtgttatgcatgatcttcattctagcaaataaactatatattcatttgtgacgactggcctgcaggtttcttggacgaacctcatatagatagagtcaaagatatatctgggactatatggcattagagaagagagtaaatgttgcttgctaatgtcgatatttgccgtgctgtccaagtttaattattttaattgtttgtttttgtgtaatgtgtcaaactaatgggtccctctcgggagatcttttctccctgcaggtaccaagttcaattgggtgaattccacacaattgcaatccattttcttaggaaacatgttgatggaagacacacatgtctcgtgtggtagcttcctctgctctgctacgtactgattgattctttcgttgattttgacgtgagcatgaattttccttgcatgattcgagcagtctcattgcttagtctgcttaagtagctagattaattctgagaagcagctggtgagtatccagttaaccagaatttgggatagctattgaggcttgaatctatattaattagcagtgaatttctaaaacctatatggtcattttaagctagcacgtggttttgtcactaacttatactaccttcatttaaga

SEQ ID NO: 22542 - DNA, 266 bp, Oryza sativa
gatttatactgtctcggcatggtgaccgatgaccgatctatcccaatcacttgatttaagtatatattaatataagaactatatgtctttaatatctacagccgatcgaatagatttagttcctcactgtctatttataaccgccgatcgatttatatatgacatcggctcaaagataaatgatatgtcatcggcacctagccgatcggctatcatttatagatttaactacgaattctttgtctctatttcttgttgattacagg

SEQ ID NO: 22543 - DNA, 952 bp, Oryza sativa
tttgtatattgatgccctacccacttattccgctagttgactgtcaactgactaatttttttttccaaaataactatatatactgccccgttttcactgaataataattttcagttattaaagaaaatattagagtggccgaatctcatggtgtagagaagggatagagtgaaaatttagaagcacgttatagggaattttctcactgaattgaacaatgaccggttttcaactatgcacgaatatgatcaagcaagaaaataataataaaaccatcatatatatatacacacacttttgaggcaatgtctaaaaaaaattgatcacaaaaactatttgaacaaagcaggcattcttgtttgaagaaatatactagaggaaaaaatggaaattgtgagatacctacattatatttgaaattactaaaactatattatattgaaatatatgttgctcatatgggtgcacgggtcgacaaccagtagatacaattaggaatgtcaacggggaatgcccccgcatggaaatgtattctcatctacgttctcacaagtcaaaaaaaaaaatccctgtacctattaccggcaaatacaatgggggagaacgttgttcccatccttgccccggggaattaatcgccttagggttcttgtctatgcttaaaacaacatatacataattttctggtaaaatttgctacaagatacttaaaaaaacatttgttgggagcactgtaagaactcgattgaattttcttgggacactcaacaaaatgtggtagtttgctgatagacaccatacgcgttatttaatgatttcctgctatttttggagagagaattttcgtaaaatgatagatttgccccccgggaccaaacttctttcctaaacaagcaagccggtggatggcgctgcgaatagagagcgttgggggtggagcaacctgcggaga

SEQ ID NO: 22544 - DNA, 705 bp, Oryza sativa
aaaaatacctaaatatttcagaaaatttgtatttcatttaattaaatacctaaatatgttttaattcaattttatcttttttatctttacccgtagcgaagaacgggcattttgctatccattaaaacatcatgtggcatctaaaccgttacatggctctctaataaattagtgaaatctattatataataaagtccattaatctttttagaaatacttttaaaccgtcatggggcaacctacaaatgctcgtaaaccatcacatgacactctaataaattagagaaaatcctagaaattataagaaaaaaagcaaaatatctagccatctgttctaccttaaattgattttatggacctgttattttcaacctttagatcttgagatgatctcaaatatatgtctaaaaaaatctcctttatctcggcatgcgtacttcccctcctcccttaacatacgtgcatgtccatgtgcaaaagttgcgttttgggttagcagaatgaaagaaagggactgtggatgtgaattgttgatcttcgatcaaacggctgtggcactttcaagtgatttagctgaatgtcagcacaggaaaattgatattaactacactaagtggggatgaagtgtataggtttatattcaccgtgctctgctttccccacctcatccgtactcccgctctcgcatcttcccgcgccaccaga

SEQ ID NO: 22545 - DNA, 188 bp, Oryza sativa
gcaacttgctgtcctctcctgccggctggtccagctccatctctcttcttgctctgcctcccccttcaatttaattgattcctccatccagatttcgagatcgagatgaaggcagtgatgatgcaccaccatcacgcggcacgccctgcgcgctgtccaaggcctatctcttcctcctcctcctcagc

SEQ ID NO: 22546 - DNA, 358 bp, Oryza sativa
cggtggttgcacggaaaattttgtggaagctgtaaagttctaaaaaaatggattgaagtgaatttgtgacccctagctttcgctggtgtggttttgcattgtagctgagggtggggaaagtggcaaaggttttggcgggaaagacaaatcacctcgacttaatgtcgtaccccaagtcgtattgtccgaatcggctgtatcacctaacccagtctgactcggacttagctgatctcaatcgtatccgatccggactcccgccgattcttgctctgtttccgcgacaatcctcgtcttagattccgtttcgatctaatcttcttttccaatgctgatattaccaaatttggttgttaac

SEQ ID NO: 22547 - DNA, 1501 bp, Oryza sativa
tatattataagtcgttttgattttagtcaaagtcaagcagtttcaaatttaatcaaatttgtagagaaactagtaaaaatttcaatccaaaacaaatacatttatgaaaatatattcaattatatatttataatgaaactaatttgataatattactatatttttctataaacttgaaatggtttgactttgactaaagttaaaacgacttataatttgatacaaatgaagtaataaggattggattaagtcaagtatagccttctataacttgtgttaaagcttaaatgtgaggcacaaatatgtgactgttgtgtgtttcgttgctagttgctacaaacctgcaaacacacctcttatttgtttataaattcaaaaagacaatgtaagctaatgtgcatgcagttcaagattgacataatacctcctttgattggagtagatagctttgcaagccggtggttgcatattagctagggaaggaccaaattagagcgcaagaaactgcactccatcgttttggttactgggatgatccacaaaaatgtaagaccagtgtctttcgtgggatgacatatacggcacaaagagctaacaaagacaataacaatgatgaaggagctatgaatttgattgtatgtaaggatctagactaatagctaaaaaatgttctattttaggaggtagtataatatagcggttatccggctcatgcgagctagctagcctatgatattatatatgagtctaagctgagctatgtgatttatgggtccgagttttttttctcaatccatggttgtacgatgtttttgtgagcctcttaagttctacggcgtaattagctttggccaacaatttatttaccgtgttttatttatattatctatggtggtgtttgaatctcctgaaaataaagacgaagataaagattaagtgtttcatgcaaaaatgaattggtaataacgtgtgattaattgagttttaattattacaaacttaaaaaatagattaatacgatattttagagcaattttcatatagaaagtattcccataaaacgcaccgtttagccgtttgaaaaatatgtcactgagtatccaaaattttatctctgctagtagaggaaacgaacagggctcacattaaagaagaatgttgctaagcaaaatgcaagtactcagccaacaacccacttgctaaccaaaacctcgatatctatcacatgaactaaacatggcacttgcaggagcatcaacaacaacccacctgacacctacacttaaccctaacctgaaacgcaacgaactgcaagttagtaccactccacgtgaccgcgcgcccatctagcacgtcaaaaacgctcgcgacgcgcagtagaaaagccacccccacccggtcggagtcggaaaccgaccgagcccaacgcaccgcaccgcaccggccaaccagtccacggactcgcgagcccaaaccgctcagccgccgatggcgacgccgc

SEQ ID NO: 22548 - DNA, 1501 bp, Oryza sativa
acttattcaaaacctgatctttattaaacaaaacaaaaacaaatcttggcaaacattggggttaacaccaatgagtcacattatttatagcaagtgcttacatgattggaaaataaatgaccaagcaccaattacatttattcatgagaaaggagacatttaattagcatcatacttattctccttccccatctctacgaatgcacgcttgatctagcgcatgaaccgcgactaagagtatcaaaattattcctaagctcagcaagctctacccctagttctgcgttacggtccctaagctcaatgttctccttgcggagcttcttcacttgtgccgctagcttatggaccgagggttccggcgacttcacttcttcctcttgaaattggccaagcgcccttacaattggagggggcgtcaaatgacgcttcaccgtcataggtggagggcaacgggattccgctgcccctccttctccgatgccgtcaacggccggagcaagcctttaccatacctaccgccgggagttcgcactctccgaatgcaaaaccaatcctccttgggggtggatggagtggcggtgggtgtgatgtagttgtggagctcctcatcccctgccttggtgtagagggtgcccacataccgctcagcaggaggcggagtggccttgtcatcgtcttggaaaagacgtctcgctttaataggctgagttcacccgtcgttgttcgtcgtgcaggctaatacccccggattttggtcttggtgacatgacgaggggagagggatcgtgctgccgaacggggagccgaacggggccgagacgggttcgaccgaacccctggtttggccgaaccagtgagtttgccggccggctccatatttgctggggagctgggcaccgtagcaaggggtgaatgcccccttccattgtgtagttttccactgggatgacttgattcgccggtgtttctccttcaaggttgtaggtggagtttgaggaggagccaatgtatggcatcagggatttgccagccattggtgagttgagggtgtaaatcaaggaattgagctaggatggagagaagagttgcaaagatggaggagaggaggaagaagggtcttatggtgctgatccaaaagttctacctccgaatgcgcatctaaacaaactcaaacgagcgcggagaggaagctattcaaacttggggccgattgggtgctaccctggtgggagcaggagaatggaatatggactttgaaggagaatggaaccaggggttcggccgaaccctagtgggctcagctggctaccaaaattttcacacgctcaagcaaacttattctaagctcagaaatgacaattttacaggaaattaagcatgctttagatgagatcattatggttcataatcgattaattcaataatatccacttcttcatctaaagattcattaggctcatgaaaaatttttaaacgttaactgtttaccttaaatatg

SEQ ID NO: 22549 - DNA, 764 bp, Oryza sativa
ctgttgtttggagaagaaggggccggtaaaaatgaggtaatttcttgggacgacatttgagaaatctccaaacagaaatgatcagggaaaaaccttagcatgcagtccagtttcagattcctttagtctctggaaagcagcttctggaagccatctctgtagaattgcctcattatcctcctttgtgctggaagagttgactgtttgcgcatcatttgtatttgtcgaagtattttcttttgtggatgcaccctttccactcttttcatctgtcttcttcttgatctccttcagctgaccaaactgtttccccagacctttcactgtaggaacatccttggtctcctcatttttcttagtgtcggccttctcagaagtctgattctgtaggtgctgcacccagcaagctccaagctcccatcttattggtcttgtttctcttggagcttcacattcaagcttctgcagactatctgtcattatcttacggacaaaatttgtactatattcactctcttgaggagaactttgcaaccgctgaactcctccagatggttgaatacatggtttatgaagcagcatccttaagctgaaaagagataaacatgattgtcatagattttatccaaccaatacaatggtaaaaatagattaagaaaagagagaaagaatgaaatggaccaagacgaacagaggtaaagtaaatcacttaggactgatttgggtaaacccatggtttagaattatcaggttagcataagatt

SEQ ID NO: 22550 - DNA, 463 bp, Oryza sativa
ctcttactgaaggggggaaagatagagcaagaatgagtacaaccaccgttttttttaataaactttgataattgtttttgttgcttaataaatatttccggtgctctgaaaattcaagtaaaatttgagggctcattttagaccaaggagaatttaacaaaaattctccgggccacattcgaatttttcttgtacatattttagtgttaaccaatttcttttcgaattttaattaattctattattccttttagagaatgatttttatttcgggatgaatttatcaggacgtgacatgggcccttccggcctggccttcggcccatctcctctcctggttcttctctatccatttctcggagttttgtgttgattctatggtattttgatgaagttcaaaaaccatccttgtatggatacatattttctctcactttagtatgattttcctcccaactttaga

SEQ ID NO: 22551 - DNA, 1501 bp, Oryza sativa
tatttctatttggactctccttttctttttctccgattaatgtgggaatttctagcccccacggcggcaaagtggtgccttcatttaaggctgttttaataatataatagattatgcagaagtataagatataaatcatgtttaaagtattttgagggataaaataactcacaacaaaataaattataattacgtatttttgaataagacggatggtcaaacgtgtgacagaaaattaacgacgtcatctattaaaaaagcagaggtagtattaatttagactaaaataattcaccaaacacttcaccggttcaccctttgtcctattccgttctgcagagaaaacagtgcttgaggttcagagttagtagaagctgcaactctcagctttgctagctagctagaagcagctatatatcccttatcctcttatcgcctctcaccctctagcttccctctccactgcctccctcgctcgctatctcctgcctaagcgctaagctaagcgacctgcagttctgcaatgctaaggccaacgtagagctgccgcttaatcccgtctcgcttgattggtttctgacaagaacgagattatcgagaggtttcaattcattagcttagcttagctaattagcttgagggacgccagccatggcgcccaaggcagggaaggccaagccgcacaaggccaagggagacaagaagaagaaggaagagaaaggtgcagcttaactgatggctaactgaatcttcttcacttcccatctgaattttcatcgaattcatcagctcggatgattggtttaatttaattcgttttcaagacaaaagttattttcagatgcaaggattaattaattaagctagcttgcctctttcaatatttgaaagttcatattgtttcagtattaacatgtgagtggtttttgcgtggaaatattgatatgatgctgctgcagttctgcccaccgtgctggacgtcaccgttgagacgccggactacacgcagctgacgctcaaggtgagcgccggggcgcgtattatctccgtcttctcgcatggatattttcgcgtaattaattaattaatatggaccacccagtattctgaccagtgaccactgtaactgaatatgtactgttccttctattcgatggccttaattgtgcttgcatgttaaacgacaaaattaagtaaattcttctctagctttcacttgcaacactttcatcttgtttttttttaaaaaaaagaaaaaaaaactttgtttaaagcgaaagtgcctaccacttttctcttagaaacttctatatttatttttttcaattgcacagaaaacgtgtttttcttgtgctaattagcaatggcgagcgaccgagcataagcggcaacttaacaaagctggcaaagaatgaccccactcgttgaaatgtacatgatgagaatttttattttctatacgaacattacacaaaaaagttcatgggcaatttacacatcc

SEQ ID NO: 22552 - DNA, 282 bp, Oryza sativa
aggtgtgcgcattttgcactgcggtcccttgccgccctctgcaagggctgcaagggggcaaatgtaattttcaccctgccaaaaatgcatttttctttcttttttcatcttgtccgtctctcacgtcaccctgccgccctccttgcaatatttacttctgtaaaatatttacaccggtacaatatttctgtaaatattaaaaaataaaaatttaaaaatgaaaaaaaattcggcaaaggcagcggttagcatttagcaagaagtcaggtgggcctattttat

SEQ ID NO: 22553 - DNA, 232 bp, Oryza sativa
aatttcagctacttacatgaacaggcacatgatctggcggatttagaagttcctttcacagaggaagagataaagagagcggttttccagtcaagatcagatagtgccccgggcccagatggtttcacaggtggtttcttcaaaaaatgttgggaaatcattcaacaggatctagtccaggctgtcaacagggccttctcctccccgccagaccgtcttagactaataaact

SEQ ID NO: 22554 - DNA, 159 bp, Oryza sativa
ggggcccacgcggcagcctcacggtccacggtggaccgggcgcacccgggctcgcaccggccggcgccgtgggccccacgcatcagccgcacccgagggcgcgggcggctgacggccaggccccacgcggcagccgctcggtgcgcccgaaggcggcca

SEQ ID NO: 22555 - DNA, 210 bp, Oryza sativa
  unsure (1)..(210): unsure at all n locations
accgtgggggctaaccgattccacctaatgcttgagggcatgtgagcatggttcaatggggcaccaattgtccgatcttcttaagtcccctagaaaccaagcgctgccattcccaacttttggatttccgggnaacacccacttgccacattgaaaccggtcgtgcggagcccacagcataacggctgagtaagtgcatttcacaatagt

SEQ ID NO: 22556 - DNA, 335 bp, Oryza sativa
tacaggttagggcacattacctttcacacgatgatgttcttgctggtgttgtgaatctgataaagaagctcaaaattaagagaattatcattggttcaaggtaagatcccaaattctacattttgaatttccattccttctttcaaaagagatccatttctctattggcatatattactccatgcgcatgctaaaccagggtattatgcaggagcatgtcaaaggaagcgatgctgcgcaaatgctgtcaggtttgggtggttatcaatggaaaacacatgtgtactaggtatagtttgagatattctccaaaatctataatcaacacctgcagc

SEQ ID NO: 22557 - DNA, 1501 bp, Oryza sativa
cagtagtggctgaggactgccgttgaggaggcggctgctagggttgagccggcagcactctagatcttgtctagcgtgattcgatcccctcctcccctgcatgcgcgataagtgggttgtggcgccactgggccactgtgggcagtcgcattaactcacatatcttctattgggttgcacataagtgagttagtgggtaagtggggtgggctagcccagggggttagtggcaggcccaccccacttttagccttactctgacgcatctctctcatcatcgagtaggtcagattgctagctgcgcagcgaacaatgcgttgatgtccaccctggccaccagctcatttgcttagccactacaaaaccatcaaatccaaacaactcttcaagaagcagagcagcaagaaagtgggtgacggtaaccaacattgtcgatggtgacgatctgcatgcgatattgcgacttgaagtagaagtagacgtactcgatgtagctgagggagaagttatcgagccactcgccggagacgatgccctctaggtactcattgatagcccatgtgcaggttccccagcaccagggctgccaccacgctctgcagcacgttgagtaatgatggtagtcaactccaaccaatgaagccgccacgacactgagatccgtgttgaggccgatgtgggtgctcaagaaaagggcagaggtatcaggggcggtgtagaggcatctacaccgccggagagcggagagcaaatgcgtcgatgggtgcgcaggggagtagatcgaagcgatggcagcgtggtggaggtgacggcggagcaggaagagcaagagcagctgagtggattgggtgacagtgtgtgggggattgattggaggaaataaggtgcgatgtttgcgttggaggaagttgcggcatgcgccatgcgtgactgaggaatgatccggcgtctgcgtgatttcattgttggatcgcatctcacatcagggatttttatatctggaccattggataggatgatctaatggttagggagggcctgcataacattctatgtgcgttttcgtgggtgcatctagcaaaagagtgaactgcttcttttcatattagtatcaatgatacttgctcttagaaatagttggatatatctattccaataaatgtgcatccttcctccatttcaaatttttaagacaatagatgagactactgtcggtctctatattaacaagtggatatacacggatctattaatgctgcatatcccatcatttcaatgtgcatatctgatatctctccaacgtcactagtagtaaggtctaataaataaatatacaggctagctataaaaacagagccttcccctatagacacaaaacgatactagaaattagaaaaggaaagcagccaagtcgatcatcacatcacctgatcgttcttgtgagctcgggtgacaacgttaattaattcgtaagaaactgcggcaccggcagtagcatcaa

SEQ ID NO: 22558 - DNA, 473 bp, Oryza sativa
catcggtgacgggctccaaagaaggcccgattgagatggcctgaatgcccgtcaccgatgactcttatcggtgtcgggcttctatttttgctcgttagagattagtgtgcgctcgttagagatgacttttttttggcccgattgagatatactttgcacactatatatactccagcagtccgttgtctgtagttatcccactgttcactattttggtgggaggttgaagggggcgaatttatgtaatttttttgcaaacaaaaataggaaaatcataaaagtaagtaaaagggtactactaatttcctattaatttagtagtacttatgttatgagatgttaactaatattttgttcattgttcagcgatggatcgaagttagatgtacacgactggcttgaggcgtcagtacaaagagtatagagatggcgtattaagttttatgaaagccgcagtggaggataggataaga

SEQ ID NO: 22559 - DNA, 375 bp, Oryza sativa
attgtcactaccgcagaaaacgttaaaggtgccggttgttaaaccacctttatgtcagttttcccaaccggcgttttcccaaccggcaccatggaagcggcacagatgacagagccggcaccgatcgcatttttaaaaccggcacctttgataggttcatgagccaaaaaaaaattagctcgatgcaccggcttgaatcgagccgatacattgagccgatctcatctaacatagaaatcccaaatcaatcccaatccccaatcaaacaacatcacagaataacaaacatgaaaaacatcactaaaaatctttcactaacattgaatctttcacaaaaatcattcacaaacaacgtaaaaaatggatcgatgcggc

SEQ ID NO: 22560 - DNA, 1501 bp, Oryza sativa
ttttgaaaacttccaaatactttgagaatctcaatctctcctaaaattaaataaacctaaacagatgtacttaaaaaacaatgataggttttgtttttttaatttttacacatgtagattaaaattaacgttgtatatttttgtcaagtgatatttgacactgtaaaatatgatatgaaattatttgaaacattattatcgtattaactattacatgttagcgtcatttttcatgatatatttatcactataataagtttatattaagtttaattgtgcatatatgtgtagtattatttttaataaaatcgtagattaaaggctgttgacaacaaatcagtgccgacactgatgatttttccttattagtatatatttccgattttactatgtacctatgcatgttttcttgttcttttttggctttattttttttttatagtatatgatgtaggtatttaagttttgttttttttccgggagggagacgatcgtatgacgtaagcgcattatgttttttccgggatagagattagcatcatggtatttttaagagctctaatccattgtttaaaataacgggtccactaatttgagtgaaaactgaaggttggatgcttttctttttttattctgaatttctaggatttctgtaattttattaaagcgccacgtgacaatgtagaagcatttgcagtacgtttaatagacttttaagtatataatagatttctaggatttctctaatttatttgagagccacgtagcagagtaaaagagtttgtacaaagtttaatgtaattttagtatataatagatagatttagaagatggtttaaagaacattgattggatatttattatagatcttaatttaactaaatatatttatacatgtgaagtaatatattttatctttatattgtagaaaatcatattttaaaaacggttgatttttatggatgtatgttgtttgtgacttttttatgtacaagtgtatggtttttttttcttccagcgaaggttaagaaagcttgatcattttattttcaatcatgtacgtttgtatgttacggaaagaacatcagtaacgtttgtatcgtacaatctcatacatacggacagtagcagctagcgtttgtatgttataaacatgtggaagttattatttttttaataatagatctaatctaatggtgtaaaataacgggtccaccaatttaagtgaaaatcaacggtaagattagatagtgccatgtggcgacttaggagtgtttgtaggagtgccacgtggcggctttaaagcgtttgtatgaagtttaatggacttttagtacataataatagatgttaatgaatttggatagatatatatgtctagattcattaacataaatatgaatgtgggaaatactagaatgacttacattgtgaaatggaggaagtatatatattattggacagagggagtatattttagaacggattgcattcatacgca

SEQ ID NO: 22561 - DNA, 1501 bp, Oryza sativa
ggatgatgcgcatcgcgtccgtggtcgcttcggcggtgttcttgtactgcgagagatggaattaacaaattaagttactgatgatacatatgaaaattagcaacgacaagttatgggttaattatatggccttttgggttcaatagtatactccctttgtcccttgaaaaaccaacataggttgtgttcttacccccaagttttccaactcgtttccctcgttttctgcgcgcacgcttttcaaactattaaacggtgtgattttttaaaaaagtttctatataaaagttgcttataaaaatgatattggtccatttttttaaaaaattagctaatgctccctccatctacttttgatagtcatatttccaaatctgaaaattttatttttgataggcatatttcaatccaacaacctatcatcttaatgattttctcgaatttaatgcatgactctccatttttccacatatgattggctacatgggctttgagaaatgtaaatattaatgaatcgcttgtttacgatgaatgactagtagcatgtttaaatggatgataagtagaattacttatccttggtctgtgtgttaagatgaaatatgactatcaaaagtagatggagggagtacttaattagtcatgtgctaatggactgttccgttttccgtgcatactgttccaggttggaaacatgctccagcgaacacagccatagtggtgcaacaaagacatatatatatctctttatagattcgttatactcacgtcgttcaatactagattcgtttttccgaggacggatgcgagcataccttggtgctggtggggtcgtgctgcatcggggtagcgacgaggaagacgaactcgcagccggcgatggcgggctcgaaggtgtcggcgtcgtacatgtccgcctcgaacagcaccagccgctccgccgcgccggggaactctctcaacggcgccgtcttcttctcatctcctgtcaagatatattatcagttttatcaccatctccatgaattggaaacacgaagcagagagaaagagagggagagacattggcagagtattcgttgtactgcataccaagatttctcaaggttccatggacgacgcagcctcgttccaagagcttcttgacgaggtaggccgcgatgtagccgctggccccggtgacacacaccctgctcatctctctctctctctctctctctctctcttctgaaaccgatcgattcagtgagtgggacgaattgtgaatttgtgatctcagcagtagttgtcatcgcactgttcatatccatccattcctgccctgctgacctgtgtggctaactgagtgcacccaagactttcgttgtttgatttcctttcctgcacgcaagtgggtgtcatatgtggctctgaacgaaacgagtttcaggtccatatctcgcaggactgaccggcttgagctgaaaaatatatagctcccacgagatatatgcattaaaga

SEQ ID NO: 22562 - DNA, 936 bp, Oryza sativa
aaagaaactttacataaccaaacgtaccaaatttggactccttccaaattcgactccgcatcccatacgcacacaattcctccatcgtatgccatatggaatctccatcaaccacgtgcatcaactctagcctaagtatcccgcatgatctctgaccaccacggacgtcgtcttatccccaagccgactcccggtccatcaccgcaaatactctcccgagacatcgagtcacctacacatggaacaaacaaagaaaccatattccgaaaccaagctatctccaacttgactcattagcagcaaacaatagtattacatacgtatagtatccatctagaagtcataatcatggaataaactcggatatccaaataaacaacccgaaaccgaaaccgacacagtgtcggccggtcagaccgcgggctgcaccggtctgaccgcgcattacacgccggtctgaccggctaccagagcccagtctgaccggtccacataaaatcacagcagtatcctgtaaatttacctgtaaatccaatcatctccaaaaccacttcgtgaataaattccaaataacaaaaccaataatctccaatgcccaattgttcatcacagaataatagtaaaaaacacctttgattttacaataacccttatcgttctggataagcttaatgttaaactttgaaatctttcattataaataatttctaaaatatttatcttaaaaatacagagctcatatgtatagattaatctaaaaaaaatacttcaacaaaatcatatatttattgatatgtttatatatctttatgtctattataaaaattagagtaaattgcatattggaccaccttttattaccaagctttcactttgaactacccctttacctatgttttcagtttgggctagttaatatttcctttttgttgcagt

SEQ ID NO: 22563 - DNA, 1501 bp, Oryza sativa
tatgtgttttctagttccatattgtacttgctgagtatttttatactcactcttgtattttatttggttttaggtacgcattgagaccgacatgcacgagcgggaagtagcacccttatatacacattacttgcacactatcaaactatattgcttaggtccataatgacacttaaattatatcctggtttggtcttgtaataatcttttagatttctaatagtttcttccccatggattataaggatggatcgtattgtgggaatgatattgttattagtttaacttataattgcctgtcgtggatgtccgtatttatatgggagactctgccaaaatttctaatatttttgggagttagtggttttgagtgtattttagtgtggcactccaggtacgtggctacctggggcattacaattactccctccgattatgcaaaagttattgatattttggtctggaaagaagataggccatgtttggataatgggtttgggatatgatttcccacccctcaaagggtaaatttcaatcctagccatccattcttctcattccatttcatcctatccctccattcatttccatttcccagtcccacctctcctaacccattatacaaacaaacccgtaatgttatattcgttgcaaaacaaaaactaatgcgatggctccctctgatcgagttggcacagtggatagatgtcaatgtatccacaagcaaacagttgagacatctagggcccatcaatcgattgaagctgcagctatactatagctagctagcatgcatgcatgcatggccatggatcgatgatcatcatccatcaagcatgatatctcaaacacacctcgagccgtcttttccctccacatttattgtacttgcgtcccccaaacatggccactgtgctacacatggacaacggtctactctctctctctctctagattcctcattttcgcaaacattcccctctcttcctccctcctctgcgatcccaacctacccatatttagacaccacaagagaagaagaaagaaagaattgaagctgtgtctagctaggttagcttagcttaggttgtttgcggagatcaatcgatggcggacggcggcggcggcggcctgtgcgagctcttctccgacgaccaccgcgacatccgccacgtcgcggacgccgacctgttccgcatcctcgagacgtgggaggagtgcatcaatggcggcgccggcggcggaggcggtggggtttctttagctggtgtggctgatcagggagccgctgcggccagcaccggcgccggcggtggtgcaaggacgacgacgacgacgaccgccgcgaacggtcggcggcgggagggccgcgacgaggagaaaggcggcggcggtggcggtggtcctccggcacagaagaagcaaaaggggtcgtcgtcgtcgtcgtcgtctccgccggcgttggcggcggcggtgggggacggcgatggtgcggcgaaga

SEQ ID NO: 22564 - DNA, 1501 bp, Oryza sativa
cttggactggggataaactaagcttttcaccttggaccaggtatttttcccaaaatgtttcaatttaggcttcttcttcctctagctccccctctctttctcttctctctactaacggtaatcacatgagaatcccgacctccccacccctgcaactatgggcatcagaagtagaagtcatgcttgagcacgttgccggcactgtacacgcttgagctctatctgcattgctgccgatatcgtgatggggatgttggaccagcttagcacgagcaagggctggtgaagatggaggtaaagccggatagctcgtccaatgatcttgattttggcacatgtctcagcgcgcctgatctcggtctggtggaaaatttgcggaaataattcgaatggaaataggagaggaatcaagcgaaggtaacatcaagggggagacaacaaaagaataattttattggccccttgctctctgctgcctttatcatcaccaagagccactaccttgccttacttcgcttcctctaattgaccactgagtggtgagtagatgagtgtgcctcactcaccaagacctgctgctgctaagtgccattgccaacatgaagcctgccacagatggaggagtttggtgattggagtttgggagaggacagggtgaaggagatgaagagagagggtggtctagactgcaacaaaaaggaaatattaactagcccaaactgaaaacataggtaaaggggtagttcaaagtgaaagcttggtaataaaaggtggtccaatatgcaatttactctaatttttataatagacataaagatatataaacatatcaataaatatatgattttgttgaagtattttttttagattaatctatacatatgagctctgtatttttaagataaatattttagaaattatttataatgaaagatttcaaagtttaacattaagcttatccagaacgataagggttattgtaaaatcaaaggtgttttttactattattctgtgatgaacaattgggcattggagattattggttttgttatttggaatttattcacgaagtggttttggagatgattggatttacaggtaaatttacaggatactgctgtgattttatgtggaccggtcagactgggctctggtagccggtcagaccggcgtgtaatgcgcggtcagaccggtgcagcccgcggtctgaccggccgacactgtgtcggtttcggtttcgggttgtttatttggatatccgagtttattccatgattatgacttctagatggatactatacgtatgtaatactattgtttgctgctaatgagtcaagttggagatagcttggtttcggaatatggtttctttgtttgttccatgtgtaggtgactcgatgtctcgggagagtatttgcggtgatggaccgggagtcggcttggggataagacgacgtccgtggtggtcagagatcatgcgggatacttaggctagagttga

SEQ ID NO: 22565 - DNA, 1501 bp, Oryza sativa
attcagaggtttgtgcaaattaccagtagctctgaacgggatgtcgattggctgtggatgtcgtggcggttgatgatgccgccgatcaagaacagcgtgctccctagcagcagcggcgtttggacacatttctggaggatctggacatgcccgttggcgcgttcgtatacctggcagatgttttgtatggatccgagtaaccacagcgccggcccggcgatgagcatgttcaggccgtgcttctctaggctgtgcctgtaccctcttgccatctgtaatggaaaattgagttgtgctagttaagtgacacttgtgccatcattggtcttctgtgttctaagttactgaactcttgacaaaatatgatggtagcaagaatttctgaattgatctttattgttctggactttacactagtaaacttttcaatttaagataagtggaattaactgacactcaaaatcgtaccagcgatactgaattttggaacgtttatgctagctagctggctagttcctgacattttaacggaagtaaataggaattaatttgcatatccatctggtctcactagtcggtactcatttacttatcaaaaagaaaaacaaatcaacacgcggagaaatctttaaaaaaaaaatcctcttttacaaacaggtctataagattcacgacttagttcattttctccaaagttcgtgctgtgacaggagaaatatgtgcgctacttcctccgtttcacaatgtaagtcattctatcatttcttacattcatattgatattaatgaatctaaataaatatatatgtgtagattcattaacatcaatatgaatgtggaaaatgctagaataagttacattgtgaaacggagggagtacttatagttagtatactttgttactgccattttgtttttttaatatttttagtatagattatatttttgaaatgttttcactacaactttgccttatgaaattagaaatgttgtcaccactacgtaataaagcactagactgttatagctagttagcagcactcttaattaaaatcagagagactaattaatacagaccttatgggacaggagaaatttgtattgctgcttctagttagtacactctgtcactactattttgttttttaaatgttttcactacagatttatttttttgagatgttttcaccacaactttgccctttgaaaaccagaaaacgtttatcatcactactgaataaagcactatactattagcaacactcttaaaaataaaaagcagaggggaagtaaagtaattaatcgaaacctgaatctcgaagaagatgagcgcaatgagggtgagcacggtgccagcgaagtggacggcggggacggcgacctcgacgagagcgaactggctgtcgagcccggcggcgagtgcgaggctgtagtcgacgccggcggcgtgcgccaggaggtcgtgcgcgttcaccgcgaggaggaggaggagcccgagcgc

SEQ ID NO: 22566 - DNA, 277 bp, Oryza sativa
ttttttcttataaaaattaaagatgattccgtacaatcaaaattctgtccgttgtcagctgttactgtgttcgatttcaattcgtcttgtccatccgcgtgaagcgggacgagcaatggacaattagggatacatgatcgagacggacaccgtcccaaagcaggatagtagcaatatatttttgctcacattgcagcgggtcccacgtatttagattttaaaccagcaaaaattgaaccggcttttgctcgccgacattttcatcaaaatactatcc

SEQ ID NO: 22567 - DNA, 826 bp, Oryza sativa
aacccatgacggtagcaattgaagaattcttccttcttacgggagcatataaataaggatacttatctttaaaggccagaattacttaaccatttatcttcccaaaatcttgtttgttgcccattattcactatccaagaacccatattcaagaaagtattattagctttcataagacctaaccagaaatgggaaataatgcgcgtatgcagtaccgactagccgagactaacgacgactcctcgcaggttcacagtctccctctcctaatcgcgctagcccaaacaactcccacgcgcggtttgcaccatgtcgggcccgtgccacactgccctgcggcccctgcccaagctcttgtaccgatcgagtagctagccatagttgcaatcgagctttgaagaagtttgatgacaaaggatcaaaaatatttgaggtaagtttttgggtggtgacaagcccttgtctatattatacaaacctcatctcagttccaatagggatcagttatctattccattatctgaaaaaatagggatcaacaccaggagtttatcggtgtacaaaatcgtcagcaaacttatgtgtttatgtgtgtaagagaggtcactagttaatatatgttattatttggataagagggatcacctaagattacaaacttatgtgtatgatagagaattagagataaccggtatgcacttactcatcgttagttaatgatagtcgttcatatgcgtaaaagagaccatcaacttaacaaatttcacctacaacaaaacactccattatacatttatactcctatgtgtatacataatacaaactg

SEQ ID NO: 22568 - DNA, 1501 bp, Oryza sativa
gtcgcaattcgcaaacttggcacggagatgctagaggtgggtcctaatcaccccttcggttggtgacttgtacattgtcgaagaggacgctgggttgccactgagcactccctgcctcttccaacaaaatacatcagtcgtcgtctagatctggagctcaggatgtgcacaccaaggccatgcgggaatcgttgtccacacactacaaaggccgcgaccaccctcaccgccagtattgacgacgagcacgttgcttggctgacagctagggctaccaatgagaagattggggagatagaatattgaggaagagaagaggagagagaggggtgatgacacgtggatccattgcatttttttcaccggacacccattgacatgtggcctcacatatttgttccaaaaattttaaccaaatccccacatacttgttccaaaaaagtagctaaattaccactaacgtgtgggttccatcggtgttttttattctagcatcatgtaaacgctagtaggcgtcatgtaggacagagatcaagttaataagacatgtagtcttcacgtcagccaaaagtacccttaatataatcgagagactcgatttacattgattatgatgttgggatgtttcatattcaattttacggttaagggacgtaaatgaaattcaacccatggttgaaggaagtggactttttccagtgtaaaagtgcccctctctataaatttgactttgttctagagattataataggttaaatctttatctaaagttgccgttgaaggcatttagaatttgcaaaataaacgacgattgaattttgcaaattaaccttgtatcaattggtatccctaaatttccaataaacgacgattgaattttgcaaattaaccttgtatcaattggtatccctaaatttccaatcatgagatatatgggtacttctatagtgcaaattatgaaaaatggagtaatgcgattgaatatttgaattaacagttgaggtggttcatacacataaacactgtcagaatatagggcctattcaaattgatgacattttcaactataccattatttggtaaaattaataattatatggctacatttagtttgttaccaatattgacaatgtgtacagaattttgacgacattattaagaaaatcctaccaaaattttaacaatattgtcaatttaccaaaattttgatattgctaaattttggtaagatttattttggtaccaatttgaacatacacatagttggaggggttttctgcaaaatggacatcttcttctccccttctggccgcctgcctcgaacgtgatgtcactgctactgggccctacatcctccaaaaccctaaccaaataaattccccattcgaaaccctctcaaaacccctccctccccttcccgccgccgccgcctcctccgcctcctctccgccggccgacgccgccgccgccgccatggactccggcggcgcctccgacccct

SEQ ID NO: 22569 - DNA, 930 bp, Oryza sativa
ccttgcacttgttcctgaaatattattgacgtggctgatgaatgctgtgtgttattggagtctgatttgttgtggggcttcattaaaggattttcatgagtagagctgggagaatagccttggctgacgggatgatgagggtgaagtgtgcctcgtcgctgtgttgacagaatgagggagggagattttggaccttttggtattttatgctcgctttactcatatttagccaaagtccatatataggagaggcccacaaccaaaggtcctaaatttatgggaacatactaatgaaggaaataaagcaacaaaataaagaaatagctaattaggaaacatttctctaaaacttgtaggcgtattgtggtggctggcagtagagccagcaattttaccctgtggggtccattatcattgcttgatattttagtggggccatttatgcaaaattcagtggatttacatggaaaaattagtacccataagggtgttagtgaaaaagctgtggggtcagctgatcccacagtttgtacatggctccgccactggctggtgcacttgtagccctgtgttggtgggctgtaggtgcgcctccacatgatatatcccctctctgaaagcagcttgtcctcatactgaattggggaagcacttgatgaagttgttttgagatccttgacgtattggcagctagagagttcagccaatggacaaagggctcgagaggatcacgggcatgacggggctttgagcaatttgatgagggtatctggcaaacttgttgacactccagtgggagtgagggaattgcagccttctctccatggaagggtttcagtacccacgtgaaagatatgtctaggactctcttgtgtacttcaatataattgggccttgaacttcctatatactacctctgtcctaaaatat

SEQ ID NO: 22570 - DNA, 1501 bp, Oryza sativa
tggctggtgcacttgtagccctgtgttggtgggctgtaggtgcgcctccacatgatatatcccctctctgaaagcagcttgtcctcatactgaattggggaagcacttgatgaagttgttttgagatccttgacgtattggcagctagagagttcagccaatggacaaagggctcgagaggatcacgggcatgacggggctttgagcaatttgatgagggtatctggcaaacttgttgacactccagtgggagtgagggaattgcagccttctctccatggaagggtttcagtacccacgtgaaagatatgtctaggactctcttgtgtacttcaatataattgggccttgaacttcctatatactacctctgtcctaaaatatacttcctccgtttcacaatgtaagtcattctagcatttcccacattcatattgatgttaatgaatctagatagatatatgtctagatctattaacataaatatgaatgtggaaaatgctagaatgacttacattgtagaacggatgatgtagtagattttgcccatgcaactacatgggcaaaatcccttatagtttggaattgaggcagtagtactttcttgctttattaatctttagctaagtctgtatataggagaggcccacaagcagaggaaatatatgaataaaatcaggaaatttttaatcaggacatttcctatacttggggccttacttataccatagaaagttgactatatttgaaaattgttccaaattattttttccagtcagaaatatagatcaaaagttcctgaaaaaactaggttaaactagactggaattaacctatgaagctttaaagaactttcttgaactacttgaacgaaaaccctcaatatgaaaccatagattaaagctagaactgagcaaacacaaggaacatcgagaaaaaaaaaaaacgtgttgcattaggcgactaattctcaatgttttttttctatacatatttgggggaaaaaatacttcaaatccaactcaagattctccaaatgtagtttaatttggatgttgtctagttgtactaaacaaaatcaggtgtggactttttttttaatgcataagtgggacttagcaaaaccaggttatggactaaccttggcataattgtggctgtagccacctctgaacaagctttgatcctatccgctttagctggtcattatatatgatttagaaggttaactgacatgcacttgagctttttctgttttatgactctgtacatgtttgtcatattatgatttgtcctttattaagttaccctgttgaagaacatttaagttcgggatggctctttttggacaggtttacagctgttttgaaatgatatttatctaaagttttaactatttagtcatcaggtccatttggtgctattgatatctccctttatctctggcaatctatctaaactgattacttgccgcttatctacttctttttaactttgtagg

SEQ ID NO: 22571 - DNA, 1501 bp, Oryza sativa
tcatcgaattcatcagctcggatgattggtttaatttaattcgttttcaagacaaaagttattttcagatgcaaggattaattaattaagctagcttgcctctttcaatatttgaaagttcatattgtttcagtattaacatgtgagtggtttttgcgtggaaatattgatatgatgctgctgcagttctgcccaccgtgctggacgtcaccgttgagacgccggactacacgcagctgacgctcaaggtgagcgccggggcgcgtattatctccgtcttctcgcatggatattttcgcgtaattaattaattaatatggaccacccagtattctgaccagtgaccactgtaactgaatatgtactgttccttctattcgatggccttaattgtgcttgcatgttaaacgacaaaattaagtaaattcttctctagctttcacttgcaacactttcatcttgttttttttaaaaaaaaagaaaaaaaaactttgtttaaagcgaaagtgcctaccacttttctcttagaaacttctatatttatttttttcaattgcacagaaaacgtgtttttcttgtgctaattagcaatggcgagcgaccgagcataagcggcaacttaacaaagctggcaaagaatgaccccactcgttgaaatgtacatgatgagaatttttattttctatacgaacattacacaaaaaagttcatgggcaatttacacatcctaattatttttgagcaagttagcaatggttgtgttagcttaagtacatagtaccattttgtgcaatggcatgtagcctactgattatagtaacctcagtagcgtcccaattcccaaggttttgagttcaaatctcctagtgaattttagattagggctgtgtttagttccacgctaaaattgaaaatttgaagaaaaaagttagaagtttatgtgtgtaggaaagttttgatgtgatggaaaagttgaaagtttgaagaaaaagttgaaaactaaacaagactgggttatttttggggttaaagttccgagtttaaatctcaaatttcatattgggttgtttgtgtggctaaattatcaatttaaatatggtacttataattcgcagtggtaggtgccaactcgctgcctagctcattttgtgtttgtggtgctttgttcagggcatatcaacggacaagatcctcgacgtccggaagctcctggccgtccacgtggacacatgccacctcaccaactactccctgtcccacgaggtcggtcagaggatcccaacggctcacatccgcctcgagattcgtgcccactgacagcctgtactttctccctctctgccaccaatgcaggttcgtggggcccagctcaaggacacggtggaggtcgcctccctgaagccgtgccacgtcagcatcgtcgagggtaagtctgaacgagcaaatcccgtatttctcgaggaccaaaacgcaaaaaaataaaaaactcaccgtctcgtct

SEQ ID NO: 22572 - DNA, 1501 bp, Oryza sativa
taagctttgtgtgcttaataggttgatgtggcatacttgtttgtaggttttaggagtgctaataaatactatgcttgcatgttaagatttaggtgtttagtgggcattagctttatagaaataagagagaaaagaaaccgtaattaaacggatcggatcagatcgaggtggccagacggacccggcccaataacagcccgtttgacctctcctcccatctgggcatttttggggcccactagtgagcagttcgtcccgttccgacgagcgggacccacccacccatccccgccgccgtccccacccaccgccgccgtcgatggagggttccccggaggcggcggatcggctggatccgggcgccgtttcgggctcgatccggccggtgacgagcttgccgaggaggatgaagacgagagattagggggatcgagatggatgccgagatccgatctaggctggcgctgcgcctgcgagatctgatcgcgagctaaccctatgggtacgaacgctgaatcatactatctgctagagtactaaaatttctggatattatatatatgatgcataagtagcaaggactaatagcaggtttaacaagtatctggggattagcttttgttaatcatcgtcagtggaaaagggggtttaatttagagcagtaagattagggattacattatcccgggagtattacttttgaagcgcagcccttttttctttgttttatcctgtccagagtgtttttgtttccatttacatcttgattttagatgttgttagtgtctttgattgaactatcattattaggatcatgaactggaagatttgctgccacagttttcagaacacatttcctaaagtatagtacagttatcagagtagaaattgtccaaatgagaatgttagtagcacatattatgtcagtatcacaatcatatagaagtacctgacaaacgaaacaggaattttcgatcagtgcttgtaccatatcctatccatttccaatttttgatacgcacactgacttatctttgtaggttagctgttggattatatcctttgttctgattgagtagacccaatctaatcgcctcttggtctcaaaaaaaaaaaatctaatcgcctcttgcagagagcctccttcctcatccattgagccgcctctgatgaccctagaattgtttgtggaacagccaacagataaattaggagtaaaaatgtgcacattcaactctcatttgatcacaagtctgacggagtattaatctcacacaagctgggatttattattcagattagaacatatttgcactcagactgacaacttagaagccaaacctttctctaacaaaaagacacctaaaactccttaactgattagcacaagcctaacatattgatcaatcccaaccacaattagggagcagtcaaacctaaaaaaaaagcaagcacaacctttctaatcaaaaaacattatacaactggatcacactaatag

SEQ ID NO: 22573 - DNA, 1501 bp, Oryza sativa
aaaaacaataaagaaaaaaatagaataaagtagcaaccggatctagcctctttagtcccggttggtgttagtatctttagtcccggttggtaacaccaaccgggaaaaaaaatggatttttactcccggttttttcacccggaactaaagatagcgatctttagtctcggattcatagtcccggttggaaaaccgggactatagggggttacgaaccgggagtaaaaactccttctctaccagtgggttacagtgatcatccattaaccatggattaacatacctcaatagattcgtctcgcaaaatagcctaggggttatggaatggattttgtcagtaatgtacgtttaatacttctaaatagtaagattccgtagagatatttaatagcacagaggattcaaacaaggccaaagtgaagaatgtgtttggttaatactattctgttgtgtacagttaggttgttcttcatggagtactccatatgtatatgtttgtcgtacaacaaatcctcataattttttttatcagtgagccatctctgcacaagagcgtgcacacagctagatgtacgatgatttgagtcaacgatccacccacatattgtttatccttccggctaacagcatttgattgcaactataccactaacttcccctcaaaaaaaaaaaaatcccctaaaaaaaactagtataccactaacaatttggtacatcagacacacacatcgatcagcgaacctgacggagaacacaagagtagaaaaatgcgtgccatgcttgattaaccaatggtaaggtcactcttttccccccgacattttttatcttttaaaaattcgatgaatcttttaagcctcggaagagcatttgatttgattcctgatatatatacgtcattgcgtgcgcaatttgggtttgacaagggaaccaccggccattccagactgaccaaaccaagatcgtacgtgttgtaaagtttcaaacaaaaaggatcatcacgtcgtaatgttattattatggagtagttgagagcttaatcaagctaatgtttagtctaagatactcctagtaataataactagacgataacccgtgctttgctgcgggatacatattagaatattagagaaatgatgaaatgatttggattgaaatattatgaaaataatttgagaatgatgatttagcatgtgtatgtttaattttagaataaaataaaataaagtgtagatataattactgtaggcttgcatgttaagctttgtgtgcttaataggttgatgtggcatacttgtttgtaggttttaggagtgctaataaatactatgcttgcatgttaagatttaggtgtttagtgggcattagctttatagaaataagagagaaaagaaaccgtaattaaacggatcggatcagatcgaggtggccagacggacccggcccaataacagcccgtttgacctctcctcccatctgggcatttttggggcccactagt

SEQ ID NO: 22574 - DNA, 1501 bp, Oryza sativa
gagaaaagtggtaggcactttcgctttaaacaaagtttttttttctttttttttaaaaaaaacaagatgaaagtgttgcaagtgaaagctagagaagaatttacttaattttgtcgtttaacatgcaagcacaattaaggccatcgaatagaaggaacagtacatattcagttacagtggtcactggtcagaatactgggtggtccatattaattaattaattacgcgaaaatatccatgcgagaagacggagataatacgcgccccggcgctcaccttgagcgtcagctgcgtgtagtccggcgtctcaacggtgacgtccagcacggtgggcagaactgcagcagcatcatatcaatatttccacgcaaaaaccactcacatgttaatactgaaacaatatgaactttcaaatattgaaagaggcaagctagcttaattaattaatccttgcatctgaaaataacttttgtcttgaaaacgaattaaattaaaccaatcatccgagctgatgaattcgatgaaaattcagatgggaagtgaagaagattcagttagccatcagttaagctgcacctttctcttccttcttcttcttgtctcccttggccttgtgcggcttggccttccctgccttgggcgccatggctggcgtccctcaagctaattagctaagctaagctaatgaattgaaacctctcgataatctcgttcttgtcagaaaccaatcaagcgagacgggattaagcggcagctctacgttggccttagcattgcagaactgcaggtcgcttagcttagcgcttaggcaggagatagcgagcgagggaggcagtggagagggaagctagagggtgagaggcgataagaggataagggatatatagctgcttctagctagctagcaaagctgagagttgcagcttctactaactctgaacctcaagcactgttttctctgcagaacggaataggacaaagggtgaaccggtgaagtgtttggtgaattattttagtctaaattaatactacctctgcttttttaatagatgacgtcgttaattttctgccacacgtttgaccatccgtcttattcaaaaatacgtaattataatttattttgttgtgagttattttatccctcaaaatactttaaacatgatttatatcttatacttctgcataatctattatattattaaaacagccttaaatgaaggcaccactttgccgccgtgggggctagaaattcccacattaatcggagaaaaagaaaaggagagtccaaatagaaatacaatttaaaaatagctgaattcggaattaaaaataagtaatattgaaagaaaactccatataggaacccaatatgagattaatcgaaattcagaataaaaataaaataaaatctgaaaatagaaaaaaattaagagtctaagtaggaatacaatttaaaaataattgaaattcgaaatttaaaataaggaatattgagagaaga

SEQ ID NO: 22575 - DNA, 1501 bp, Oryza sativa
tgtatcacgtaactatagatttaacattaaatttatcacaaaactacaaatttaaggtggaatatcataaaactacaaatttatagtaacaaagttatcacaaaactaccgattgccaatttaatcataaaacttgaacatttataactcaaatataacattagtgctaagaatttaaacttcaaaatctatagttttgtgataaatatattactaaatccatagttttgcgatacttagccttaaaccggtagttttgtgataagtttatgttaatctgtagtttgtgatacattaccttaaatatgtagtttcgtgataatttagctcaaatatatgtagttatgtgaaatttactcttagaaaaagagagaaagatttacactatccgatcagggtgagtctaaattataataacgatatagattttctcaatatagttacataaaaaataattatatttaaatttgctttcaaaaattgttgctctaggaaaacggcgtggagaaatcagctagtgaacttaaatagtactccctccgttttttaatagatgacgccgttaactttttctcacatgtttgaccattcgtcttattcaaaaattttatgaaaatgtataagatataaatcacacttaaagtactatgagtgataaaacaactcataacaaaataaattataattacataaattttttgaataagaccaatggtcaaacatgtgagaaaaaatcaacggcgtcatctattaaaaaacggagggagtattagtacgtatgtacaatgtataacaactcagtcatcttacacctgactgaatttaaattctacaatctacatggcagaagtccatattttgcccatgtatatacgttcaaaacataataccagctggagtgcatgtagagatcttttaatttggtccatgccatgctgataaagcatgtttcttctacctttgctcacgatcccaatggctttaattatgtaccacgatgagaaagcattagatgcaatgaaacgcaagaaaaaagaagatgataaaaaagcagcaaatgaagggcccctgcctctacgccaaatctggtggtagatcaaccgcatgactgtcatgttaattaagcaagaaattccctttgcatttcatctcggtagaacacctgcctagctttcaaataaaaggaaggagattaccttactaacagcatgggagaaattttgatttttatttttaccattctgacacacctgagttgaaaattgcgaaatggagcagccattatatatgagcatgcaagatctgaataaaagcttcactgctttcactggagaccaaaactggctctctttcacaagacattctccattttctttcttctcttcactcacactcacactcacaagagagtaagtgagctagcgagtcacaggtttgctccaaagctgagccaccccatcccatcctctggactcatctgcttggctctcctcacaccacc

SEQ ID NO: 22576 - DNA, 466 bp, Oryza sativa
tctacacagcgattatatttagactggatataggataccgaatatagatagaatatctttatttgtatctcgggtttgtttcttaacttgtacgtcaaggaaataccctgaggcttagtcggttacgattgtattttatctgtactctcgtattctgataaggatatgagttatcccttgtaatacggactccttcccctatataaggaggggtccgagtcgttcctgggacatcaactttcttggagattatacatccaataatacactcggcggattcatccccggacaggagtagggtattacttcttgaataagaaggcctgaacctgtataaatcctttgtctccaaacccatccacttttccagcttgatagccacccccttttagtattgccgaaatcttgtttcgacagttggcgcgccaggtaggggttgtgtcaagcttttcgccgatcagtgcaa

SEQ ID NO: 22577 - DNA, 248 bp, Oryza sativa
gcggcggaaggcggcggcgacggggatgtcgtcgcgggcgaaggacgtggtcgaggcgggagtggctccttaaccagtcgacgccggcggggcggaggagccactcggcggcggagggcgccttcccgcgcctcccacccccaccaccgccaccgccgccgccgccgccgccggaaaagtaccccctcgcgcgcaggtggaacaaatcccccggcggcgaggcccacccattggcgcccctctccagg

SEQ ID NO: 22578 - DNA, 382 bp, Oryza sativa
gcgggtgagggccgagggttttgcgaggttttttggggaatggaagatggagaatgaaggagtggagaggaagtgtcttgaagtagggaaacggaggcggtgctgcgagggggatgggctgggcttggctgggttctcgtgggccttgacttcgctgcaaccgaaagaaggaaaaagtccacaaggactccctcgaatataggatgaatctgattcgtatcccttacccataataccagatatcttgaccctcttagctattaaaactgatgcaatatgaatcctttggtggttttgaaggtggttttcgttgatgtagcatctaagtatcgcattgacttagtcttcgtcatctacgtggcattaaaaaaataaaacataa

SEQ ID NO: 22579 - DNA, 924 bp, Oryza sativa
aaaaaaaaaattgtattcccaagaaaagtcagatgtgttggggaacctccaaaaagtttggatggtgctaagagttgctcaggtaaccgctcaggaggaaataaggtgattatttcccagactcatcaagcagatcgagacctgctctcgaaaaaagagatactcatcactgcaactgaatatcccaacggagagatttcactggacagaaacataagtgaaaacaaaggatttttaaggtctaaaactgtaaagccagtaactcatcaaggaaaacgatgaatccagaggaaatttgcatcggctcagactacttttaaaatctgcaaggtgggtaaataacccaccgttcagacgagcgaaccatgttcttcctcatcgccggcgtccatcctcagatcaccaaaccaaaccaaaccaaacagctaaaaaaacgaaagagaacagcaaaacaaacacgaagaagcacatcgcagaccaaaccaaacgaacgccgcagatcgatctgtggtgttcgtgaaggctgacgagagtcgagaatgtggatgatagcggcggccgcaggtggaatgtggatggaaaccctagctggggtgttgcaaacttatagagcgacccttccggaaaagcccctagatgtagggtttattactgtacatgccatcctacataggcctccggcccagcccaacctcgccactctcggcccagttcgcttgcattttgcagtggaaaagttcagtttaggtccttaagtatcgagtttcagtcacatccctcaactatgaagcacattcaacctctagaacctacgttcctcggtagtttttgatgacggctgatgtggcgtgttgatccagttgtgtcctacgtggcgcctatcttgtacttacaattaggggaaaaaaatgaaaccccatgtca

SEQ ID NO: 22580 - DNA, 807 bp, Oryza sativa
catactaggatttttatcattttttgtaaaatcgctcgatttccaaggagcaatttttttttttacaaacggtaccacgagtctacgtagtgaattaaggactagcctagatgctttgcgccgtgaaattttttaccataataacgtggaataagtaataacacgatgctagtacaatttggagagagatggtgctgttggtgtttaggatgaaaatggtcggaaaaaccctctaccatttttatttctatatttctttttttccgaaaacggaatcgaaacggtataaaaaaacgataacgatatcagtatattggaaatggaaacgtcgaaacagaacctagcgatgttggttggaagaaaattcatattggaaacaacaaagtgaggcataatcacatatttaattatacatgaagataactttataactttattcttacatcattacactccacataataccattatatgatgattaatgatatgataatatgttcgacgaataatataaacaaagttcaataatactttaacatcgataagttgaagagaccaaagttcaacaaagcccacatgccacgccctagggttaaccgtgttttcccctagccacttcccttttctaatgggctacaagtccgccaggcttccaacattcatgagcttccgatgggttggactagctgagccgttggagaactttcagaattttctcagaattttgacggaaattaccggataaatacgattaccaataaaaacggttgaaaaaacctccatcccacttccgctatcatttccaga

SEQ ID NO: 22581 - DNA, 653 bp, Oryza sativa
catgaggaaagaataaggaatcatatacatgctactacttcacaaggaattctttgttagggaaggacagttttgacaaaattgatcaaattacaattgtacttcttcttttactgccaggcaagtaccaattccaattgtgcctgtaatgtctaaaaaaaaatgcaaaccttgctatcatgattaagaaggagaacagaaggcatttcagggtaaaggagccagtactacctttgttaacaaagaagatagatgcatgaatgaatgattaattaagctgcagaccacacatgggctacctcaatactgggggcacaaagatccccatcacccatatccacatgctttgcactgccctgcacagtaattaaacagttacaagctagatgcaacagctgttttacttagtagcactaagcacgaagcaaacacttccattaccaggtaccactagctctttctcagtagtaatctactgcataattgagtgctgacactctcaattctcagaaaaaagaatctctgggaccccaaaaatgtgggtccctgactccctgttacaagcttgcaagcaaaaacagaattatttatgtcggaatagggagattgttatcatagcacagtggactgaagcagcactttggcatgagaaa

SEQ ID NO: 22582 - DNA, 257 bp, Oryza sativa
agtcgccacccttagctttatcgtcttcttagtctgtttgcgtgctagtttttgtgtttaggtttgttgcttgtgggttagtcggcggtcgatatcatgtgtgagtggtatgacagcctttattaggagttgtgtgcctctttttcagtgttttaatcaagattaagataatggcacttaatcttataagaaagattagtttccgagccgtctgttttcttcctttctcttatttctacctatcctcctccagatgg

SEQ ID NO: 22583 - DNA, 228 bp, Oryza sativa
ctctttggtttcttcttttcattagttttgatccacttcttgttgtaggagatttgccgctgtgaatatggaataccaaatcaccaccatcacccaatcaatcaatctgaccccaaattgcaaattcgctctagttttactctgcatgcatcatcagttcatcacaaattcaccatttcttttctcctctcctcaaactgcgacacgctacgctgctacaggccacga

SEQ ID NO: 22584 - DNA, 415 bp, Oryza sativa
tccctttctcttttaattgaaccaaactaatggcacatgcacttcataatctcttttaatggttctcattcaaaaatttattccagtgttattagtaccgtacatctattactgtactaatggctcattttatcagcaaaagttttacaatattgttttatttaatcttgctgcaataaaataaatttagcatgttgattttataagtttctttcatttcttttgaaaccagttattcaaaagtacaaaatttgtaacctggtttccaactgtttcaacttatctcgcaaagcttggtttactttatttacttacctttttactttgaatttctaatctttattcaaattaatccaaaaacttgtgctattaattggataaatgtcttaactccctcctttcacttgtctttaga

SEQ ID NO: 22585 - DNA, 1501 bp, Oryza sativa
acgctgacgagtttcaccaggatgaaactctttccttctctctcatccccatttcatgcaaataatcattttttattcagtcttacccctattaaatgtgcatgacacaccagtgaaacccccattgtgactggccttattgatgttgattccaaactcctcgtagatgatggttttggaaccggcattaatatagcgaaactaatgatggtacctatagagggtgcacccttttttgtggactgttcttacccctatgctaattaacaactagtttcttgggagtaaatcacatgctagctagctggtgtgtacctaagtgtacttatgatgtgcttgcaagtgaaggcttccaacctccactccctcgttaccagcgcgcatgcttcttgaagtactaaacatgcatttctttgcaaaataatttctataagaaagttgcaacaaaaaaaatcgtattaagccattttttaagttttttataatacttaattaatcatgtgctaatacaaacccgtttttcgtacacgggagagaggttcccaatctctcctccttaacataacctttaaatgtacaaatgactttaatgtttacatatgttgtagctgattcaactcttaaaaccggggctagctaagcattcacacctatctgattgtgttgtgtgtgcgaattaaaggggtatcaatcatgagcaattttgagggattatggaaggcggaaatggtgatgacttggtacgtacatactgagaatgggacgcaccaggaatctgtattcaagaacaagaggaaaattaagtccatttgtgcgttgtaagccggccagtggacaagacccatgctaactgaagaacccgaattgctccaaacttaagactgatttcctgtttaacatagccaattgtaccgcgaggccatgaacatttgatcacaaccttttctgtagcagtgggagaaacaaccaagaaaaatatgcacagctacaaaatcttttttttgctcggaaggcgtacatccaattgatcccaagcctgtgatgttgcgtgattgttatagaatacgcatgcatgatgcatccgtgaaaatacatcagaaatgaaaatcatatagtatagggtcttgacgatgcacaagggcaggacgggtccaccgctcgccttgtgcatgtgtaacgaagcaaatttttagacttctagcattaaattctctgtatggtgttttgatttagggttaattggatccatgccactgcaactttgccaaattgaaaaaatgccactactattcgtcatatcggttacatgccactcgaaatttctaaaattagaaccatgccactccagttagttcttccgtcctcctctctcacgccgtcttgttcccgtccttatccccctcgctccttcccgtcctcccgctcccaggtggccggggatagcaccaccaccttcgtcgtcctcgccggcgcaagggttggcggcggcggtgcacgaaga

SEQ ID NO: 22586 - DNA, 1501 bp, Oryza sativa
tttatttttctttctcaatactaaattttattgaccatgtgcctgctgatagaggccgaagacgtaaaccatttccattatttaaaaaagaagaagctggtagcaaacacagtttggttcccaatttgttaattaaaaaaatgatttggttctcacaatctagttgtcatagaatttttcttcacaccgccacctattgaaatttccacacatccacggaaagatgggcattgtcgtggacaataccatgacgacgtcaagcttatatatacaagcgggatgcatacacggaacttgttagtttgctaatggagatcggcaacaatgccatcggtagcagcctatttccatagcaccggtccttcatcatttgaccacaatgtcgtggaagggattataacaacccacatggatgatgttacgtcgggctatagcctagtgcacgatgccaagagcataagttgtgttccatggctaaactcgaactgtggaacaactgatcaacctcaggcccaactactcaagtcgagtctgatcgatcgtcgcctccatgaacatgtggagtgcaaataagccgttgcttgactccactagttaatagctttgtgagtatatatgacattactcatttgctcaacatataaagtgagacaactttctagtctacatgatggaattcttgtgcatgtatttgacttttgtaagaggaagagcaacccatgttccgtctcgaaaccaaagagatatatacgaactactaacagacatggcaagttcgaggtggtgccataagtgatgaagataaagattaagtatgggcacgcaaaagagaaagccattaggacatgattaattgagtcttaattattttaaacttgaaaaatggatttgtctaatattttagaacaacttctatatagaatgtttttttttgcacgaaatacaccgtttagtagtttgaaagtgtactaacggaaaccaagataaaatctatatcttaatcagaaacaaatgaggcattgaggtgcactaggaacgatatgtaccgagaattttagtgcgtaagggatacaagacattaatgagtgtttgatgtttccaatggcatcaaagttcggatcgacagtgtgctttactagtctactgattacggagtagtggtttctcatggtgtggtttactatcagagaaacactcttaggccagtcacaatggctagtgtcattgcacggctacccaaaatattataccatcttctctcaaatgaaatcttttatgaaacaatccccacagtggaggggtttcactttgacgtttccaagactaagcaaagcatttaattgatacaagttgctgggatcatttgtacccaaaatccggcgcggcgcgggagaatgcggaggtcgcacggcggaggcggacgcaagagatccggtgaatgaaacgaatcggcctcaacgggggtttcactctgttaccgaggacttggaaacgacgctga

SEQ ID NO: 22587 - DNA, 1501 bp, Oryza sativa
gacgcttctggggatgatgaggtcctttggcttgctgcctttcagtgaaaccttgaagtgtttcgccaaaagctatactgactgtcattgcctttgatccgaaaaagacacatctgaaactcttagtccaaacaaatgtctctttggttaatcacttgattttcttttccatcctcaggttggtgattagctcgaggttagaatgtagttcctctggcacgagaccctaggtctcctttgtcagtaaacaattatacacatgatcacatatccgcatcttccaaaagaatcctcttagagcttgtttttattacaaatttctcccatattacatgaatacgaggcactgctttaaacaaaaagggaaggtgcttaacatcggtacattgtatctactatgggttagaattaacatgaggcctcacaggtatggcgtttgctccagtgaccacaaggcgagtgacttgtcttcttcttgcataatggccggagtgatggcgcaggttacgcttcggctgtggacaatctctagagaaatgacctggttctttgcagttgtaacaaatcaacgtcttctttactgagctgtccatctggggacgatcattttgacttggagttggaattggtggttgggaatccttgctaacattggcatcagtggtaccattattgctatcaccattggagtccttcccagagtcaaaattgctaaggttgtcattctgggttccaacattgatactatcgttgacatcttggtgaatgctactgacattgcacgctttgttcgagtggtcactaatggggcaagaaccatggttgttggtggtatcatcatcattagtattgctagtgttgttgtctgcattgcgttcatcttcttggggcaggaactcttgatgcacaacagaagatccggtgatctgaagtggctcagtgcgctgtctttggttaccacctggaattactgggatgttgacaatccttctcttgcagttcgtcatccgattatgctcactttcgagttgcatggctttgtccacaagtttctcaaaatcttcataatcctctaggagtagttgcactgcgagctcatcttttaacccctggagaaacttctcttgtttgtcttcatccgtttccacgtcttctggtgcatagtgagccaaacgatagaactcgtgcaggtactctgtgacggtcaaatctccttgcttcaggtagcgaaactctcgttttcttagtgtgatcattcctgcgggaacatgtgatctcttgaatacagatgaaaactcgttccaggtgatggcatgtccttctggccgtgatgtttcgtagctatcccaccactctgaagccggtccaaccagctgatgagttgcgaagccaacccgctcctggtcggtgcactgaatcaaccctagcttcttctcgattgtgcgcaaccaatcactggcttccataggatcgacggcaatggcaaaggttggaggccccg

SEQ ID NO: 22588 - DNA, 1501 bp, Oryza sativa
cggtagtcgagatgtcatatggcagagggttggtgccctgctgctaggggctcagttctgcctgcctgtcccgggtatcccggccgtaggcaggattgggtcggtactcttgtttatggctaggatgggttggaaactatgtcacgtcttccgtctgtataccgtggtggtatgtggcgcgtggtaacacgtgaggaagatgtgtcttgtgggtaaagatgtacacctctgatcagagtaaatctattcgaatagccgagccctcggatatgggcaagccgagcaatgtacccaagtcagtgttataattcttaaaatttgctcaacaactaaaatgtggaatggttggcctgggttggcttgggacgagctggaacccaggtcgggttgccagttcggtccgaatcatcgtaggccttgggttaaggcaggttcgtgagggttcacggccttgtttaataatattgtgtagctctaggatcgtctttataaaataactttgggcaactaagtgacttttaaatgctgtttactgcaaaacctaacccctattattatccccttgtactctccttgcattaatcatgcatctgccggtgtggcttgctgggtactgtggttgtactcattcttgctcaatctttcccctcttcagtaagagaagctttggagaagatgtcttaggtggagtcctagcttataccccagttgagcgcctgtgaagatggagccgtaggcccgctagtccgctgctgtttatttttgattgtcaggccttaagtgcctttgtaataatgtaaatattatcgatataataaagatgtgtcttttatatcatgtttgtgtggtgtaccccggcttttcctgggacggggattaatacactagcgttcgggaaaaggcaattttcccggtcgcgacaagctggtatcagagccatctcgactgtaggataagccaagtggataaaacctaaggacatattttataaataaaactatttgcgaaagttcctcttttcttcttcccctaatgctatttgcaaaaggtttacccttttcttccttcttcaaatttcaactagtactagatggtcagctttgcgaagaagaagatgtcgtcagttgtttgccgaagctccggaaggctgcaggatccgctagcgaagcgaaggaagcagtgaagccagctgtgaagcaggagtgaagatcttggagaacccgtcgcagaacctaagccaccctctagtgtttcgtttgtcgtatgtttccttgcttgtgtgtgtagcgcgtggtttgcatcggtgggtggtgatgtaaccatgctaggttgtttgcttaatcaacttgcagaataagcaaaacaaacaacacatcaacaaaaagagttagttcctttaaggtcctgtccctagctctggtctattctttccttgtatgcttcctctctcaacccctaccttgtgacagatggataacactggtaacaaaggctatgggaa

SEQ ID NO: 22589 - DNA, 228 bp, Oryza sativa
tggatttgttcggatttgttgaataaatctagctgttttgtttgttttagttttccctgctttcggttctttctactttgcttagtcaaacacaatttggctttgttttcggatcatgtgcagtaaggcttgacacgcgctgagttcgcgcggagctggtgtcgtgctcgtcgtgtcctggattgtgggatggcaagacgtggcaacggatacgtgcgcacatttagg

SEQ ID NO: 22590 - DNA, 815 bp, Oryza sativa
tgagccccactgtgctcacctaacccatacacgcggagcaaaaacccacgaggggtcggggcgcctcggccctcggggccgaggggggtgcggctcgaccccctcggggggactaagaggagggcgaacgcatcaccctcgggcccgacgtccctcgggggtacaaggccacgtgtgcgattgtgtctgcctcaaacctctagtcatgatactcctgatcccatgtcaccgacagtagcctccggcgttatgccagggcgatcgccctctttaagggaaacggtcgggcgtgacgccactcctaagtcctggtgacaggtgggaccggtctccacaattgggcagaaacccaacggtcacaaaccacgcacatcggcaatggtaactcggctgtcaacaatgagcggtctcttcaagactgccacattacttgagtagcacacgaatctggacatggcgattcgtttcgtctgaagatatggtaacgtcgcttcggtcggcgagcgtaattaacgcgcgcacgatatgatctatctcgactgccacaaccgcatacccacctcatgcgccgcaagcgggcgaatgggattagtggaagcgtgggcgcgagaaacgagggggcgaaatagtgggcgcgagaagcgaggagccgggcacagcgttggcaagagtataaaggcacagaggaagggatctgtttccttcctttcgccattattccccttgtcttcgccgcttgcaccctaactccttctttcctgtgccctaccttcgccacacgcgctcgctcttaatcttctcttcctccggcgcca

SEQ ID NO: 22591 - DNA, 1501 bp, Oryza sativa
ggaattccaggaggatgaaggcttcggtgtctagctcgtgcctgccatcaagcgcctgtggtcgtcgccctagtcttccgctatttctcgtttgtctctgtgtgtgctgggccttcgttgcccatgtaataagttatctaattacgcttccgcttgttaaactctgaattgtatcaacttttggtgtaccttgcctcctgggacaaggattaatgcacgcacgtaaggaatgcccgttgggttatttccggtcgtgacaagttggtatcagagcccctttgaccctaggacgagccgtagatcccaagccttagcaatattttcaaaaataaaatcccttcttatttgtgaaaatcctctagtctctctctgtcttgctgcttcatttatcgccaaaatctgacctttaaaatgttgcttttctttttgtttttgtttgtagatggccggcagcgtcacccgtcgtggtttggacatgactggtttcgtcttggagctgcggggtatgtgcgtggccctagggtatccacacggagtggactaccaggccaggccgcttccggagcaggagggtgatgatgcagagccccacgctgcttgggaggtcactgcagtgatcctcgctggctctcccgagcggtcttcgctgacagtcaccgcgggtggagactccttccccgccgcttgccagagcgccgctctcctcgccatcagcactcttcaccagcgctacccggacgagttgcagcactcgccctaccgctaccaccctcgtcgcggaggagcccgcgaccacgccaccttccgggatgctagctcggaggatgacgctaccatcgtgcacctggcgcgcatggtggaggcgtacgacgcggcttgtatcgacttccatcagatggtgcgccgtgggatggtcgagaacaacctgaagatcctggagctgcgtcaagagaacctgcagctcaagaaggacctagacgcagtggaggcgcagctgcatcagctcaagatcgcccagggagagatctgccgccccaagcgtcgccgcgtctgccgcagcctgaagatcaccgcccgcaagagcacctccaggcccgagcttgttcgtcagtccctggcgtggacttgcttcgtcgagacccctcttgccgagcccgcgcccgtggttccccaggagggggaagcctccggcgttggtagcacggaggatgcgcagttgctcaccttccgtcctggcccgtcgcagcagtagacgagcagttagtaggcttgcgcgtgtgttctttctcgtttgtcttgttgttgggttgtgtggggcacggttatgccggtgtgtggtgtaactgtgtcggagcctgtctttattttattcgcctaagcaacttgaactttaatgaacccatttaatagcagtaataaattcaagaattatggtagtcgtgggtggttagctttaattgtcagctctctctgtttgctggttctgtgtggggttttcaga

SEQ ID NO: 22592 - DNA, 490 bp, Oryza sativa
gatcaacatgctcaaagggttgtttgggatctgtgtgacttgccttgctggccttggaactcttcaaactcttctccggcgaaaacggactctccggaaaagacggaatctaaacagaaaagagcaaaaacaccaaaacagcacataaacaagcatgaacagtacatgtggatatttttaacatgtagatctcaattttagaaaaaattagagacttgaaccaactaaatcggagctaagatgaattagatatgaatttttgaagatttaatcggattaaaacacttatattgattttaattgaattatgacgcaataatgaattatttttgaaaaggaaaaggggatttattgcgtcagcaggctagggtttgcggtggaccgggcgcacggcggcggttcacacgaacggacggccgagatcgacttgatccaaaacggacggccgagatcgatcggtccacgaccggtctacgacgaacggccccga

SEQ ID NO: 22593 - DNA, 1501 bp, Oryza sativa
ctctccctcggattcgtttggaatccctcccgaaatcttcgccggcgcaccaatggagcccgagatcgccgcgccgatttccttcctctccggccgctctctccccctcccaacactatttaagcactccccgtgcctccctcctccgtttccgccgttcgccgctcgctctccccgtcggaatcgagctcgcgccgtcgtcctctctctccgccgtcgccgccgagcttcggttcgccgccgtcgtcgccccggacctcctcctgcttcggcatcgcctccttcggcttcgccgcgtcctcgtcgacctcgtccaccccttcgtttcgcccgccgaccaccggaacgccgccgtcctcgtcgacctgagccgcgccgccgcctctctccgcttcggtcgccgttcccgtcgtcgccgtcgacccggggtgagccgaggaccgccatttcgcttcccccttccctcccctctctcgggcgccgctccgtcgcgccggaggtcgccgccggcgaccatcggggcgcgggcgcgccgcctcccgtcggccgtgccggcgaggccgccttcgggcgcgccccgcggctgccatgtggggcccggccgtcagccgcctgcgccctcgggtgcggctgacgcgtgggacccacggcgccggccggcgcaagccgcttgcacccggtccaccgtggaccgtgaggctgccgcgtgggccccactcccgtggacccggtccgcgcgcccctcccctcggctgacgcaataaatccgattttaaattaaaatttaaatgaagaaattcgcaaatatccatttaaagagcatataaacttcaaatggccatatcttggccatttgaactcggaattggaccgttcaagtctctaatttttccttaagaagtcaagaacccatttttgtgctttgtttctgcttgttatatggagtttagtagagtaaaagccttttcttttccgttggtcgtgtagacgctgcagcttcggaagatccgctcttcgtggaagttgaagccggcgtttgggaaagcgagcaaggcaagtcacatcatctttgaacatattgaatcccagtttgtaaaattatgttgatttaaattattgcattatcgctttatttaaattcccgcgttatcactgttttatttagccatgcctatttacctttgttatgaccttattattgttatcgttattatttctttgttcaccctagattaaacaaaaccccaactagtggacactctactcatggtgccactagtacaattataggtagatgcttcgcttttaattaggtaacattaggcggttttacaactctagactttgggaatattcatatcacctggacactgtggaattgttggagtattgtggaattggattcacactgccccctctattcaaaatccccaaaaatggtttaggctgggctcggggtgcatggttttgatagtagcacctcggccatataaggaccggt

SEQ ID NO: 22594 - DNA, 655 bp, Oryza sativa
atccgcttttgcaaagtccagtggagtaatcactcggaagaagaatcaacttgggaacgagaagatgaattgaagtcagctcatccgcatctgttcgccagttcttctgaatctcgaggacgagattctgttcaaggggggtaggtttgtcacaccctgagaattcaaaatatgtaaattattgtttaaatggaatttttagaatttatttttaaaagcctagaaaagaagatctaattttaattaataaattccaatataaaatggggccagataaaatttcattaaatactttgcttaattctataattcctagatttttctgggatttatttgagctaaggaagtatttttaataaatggaattgcatttaagaaataatctaaattgaaaaaggttttaaaaagtcttcttttggctttgggccgaaagtcggcccaaaaccttctctctctctctccccggcccaagtcggcccagtccgcagccgagccgcccgcgcgcgccctcgctgccgctgacaggtgggtcccgcttgtcagtcgtcgtcttcctcgcgcagccgccgcccgaaaccctagcgccgcgccgccgccgttcctttccaaatccggccgcccctttccttctccggccgaattgatagaggggaaa

SEQ ID NO: 22595 - DNA, 606 bp, Oryza sativa
atgtctggatttataataaattatatcaaattttgaaataataatttttcgatattatgtcaaattgtcatatttgtaaaagttaaattgctagatgcagctacaaaataggggcaaatacataactaataaataaattaggggaaattgagagtatgaatgtcttttcgccaaaaatttaatattgttaacatgtctatttaaaataggggcaaaacttagttttgtttgaaaaaacaggagtgaaccgatataaaaataggggtaagaacgagatttccccttatagtaaacatgtaacatattacactcatctatgtatggcgtgaatatattatacaaatagcaccggtctataccactgtttatgttttttttataaaactaataactgattttagattgtatcaatgacgtgggtttagacagtgatcgatatggttttgtagagtattttccatacccaaccttaggctggcctgaattcgagagcgagccttgcctactaacacggaaaaccaaacaaagaattagtacataattaattttaattaagtattagttaaataaaaactttaaaataaattaatattgtttttttaaagc

SEQ ID NO: 22596 - DNA, 1501 bp, Oryza sativa
ctaggatgcgttaaacatgttgcagttgcattagttaccatctattggttggattttactagcattaattattgtagtgatagtttatgaaactttcgattgtttcatcgaatgtagtgctatgcaaaagatgtctgtcgtatgtttcttagtacactgaattagccattctggtatttagggggtgatcgaatccattatgtaatcaaatctcgtagtagttgtactggtgcattgtgtttcgtcgtgctaataagaccattcccagttattactgcaatattttgccatctgaaattgaatgttcatgtgtttttgccaattgctatcgtattccttatttactatccttccttttgtattaatttttccatgatgtcatcaatctgctaggctgagtttatttatggcattgtttactacgcctagtgtgcacttttgatgttggccagcaaaatcacagttttatttgcttatgcatggttacttctttactcgtagctatgtcgcacttacgagcttctgttttctatttcctgagtgacagtctccttgtctatttagctctggttgcacttttgatggatatggttatgctatttgtttggtccatagagtttctgagtggttatcctatataatattggtgaaaggtttattatgcagatgatctagatgacacattaatccagtatatgctgaattcgacaaatgtgtaataagtgcttcaattgtataatagtacaaactgtttggtcagtgtgtctgacatattagaactttcagtaatgtgccttgtggttttcaacttttgctggcattataatgtaacaaaggagcctgttgcgcattgcaacatggttttgttgcattcttcatcttgcattcatacaaatgccattcttgtacagtattttggacatgcaaatggttttattcactatcctaatattttatacaggataatgcaagtagaatacaaacagatagattgttcgctttgttgatggagtgaatatttaagtgataagtgatttatagtattcgtttgaactttggtatcatatatatgcatcagatatgtagtatattgtatattttacttgcatttgaattatttcttacataagtacatttctatggtgtctgtatgagtgaagaatctgatgttgacgtatgatgcaggaggcagcatcagttttgctgcaatctgacaaagtggagggtctaaaagttgaagcttcttttatgtctgaacaagacttgctttacttgggatcagttggattacttggagaatattctcggacgagaaaaaggcacaagctcccgcttggaaggccctgctgcatgcatccgaagccttgtcaatttatgcaaacttctggctgctcttggagtgcactggtttctgctgatccacttcaaggatcaagactattgtcacttctggctcttggtgcttctgatattatctcggtgaaagaaaattaatccaaga

SEQ ID NO: 22597 - DNA, 671 bp, Oryza sativa
gtcgtcgaagtcgtcgaagtcgttgtatcgagaactaaattcgtcgtactccacaatgtcagtaggacgtgagtcgacggtgggagagctgttgtagtcatccagctgatccgtcgaaaccgtgccgagtggttggaggatgacgccgacttccctgaagctaggcgaaatcggtgttgaagccgacttccgcctaggcctacgggatgaagacgctgtcgtggtggagacggccgctaaatcgtcggggagcttcatcaggactggtgggtaagccccatcatcttgatctggtatcgttggagaagatgcgatctcggccgagtggtttgaagccgactcggttgagatggtcttgaagtagctttcagccgcgttcgggaatccaaacgggaccgaaatccggttctctcccgactggtctgattccgagtcgaggagagaaatcttgccgaagttgttggtgacgaagtcgaggctgccgaaccgaaacgtctgcccgggtgggaagacgaggccgtcgatgccggagatggaacccattgcactgatcggcgaaaagcttgacgctacccctacctggcgcgccaactgtcgaaactagatttcggcaataataaaagggggtggctatcaagctaggaaagtgtatgggtttggagacaaaggat

SEQ ID NO: 22598 - DNA, 1501 bp, Oryza sativa
tgtctcaatgttgtataaaaccccaccttaattaaaatcttgataaatgtcagcatattttaaacaaaattttgaaaataggaaagaattaaactatcaaccttagtaaagaacttcaccattaaaaattttatatattaattttgtgctcaaaatgcttaaggtggcattttgtaaaactttcaaaccataatatttggggttaagtggctcatgtaataatacctatgatttcttttttgcaattttgaccataaaacctaggtatgcttaaatttactcttttttataaaaaaattaaccatttagatgactgaaatgatttttttaatcttagtgtttgctaaataaataaaaaaacttataatggaatggatatgctacctctatcccaaaatatatactccctcattccctaaatgtttaacaccgttaactttgttaaatatgtttgaccattcgtcttattcaaaaacttttgtgaaatatgtaaaaccatatgtatacataaaaatatatttaataatgaatcaaatgatagaaaaaagaattaataattacttaaactttttgaataagacgaacagtcaaacatgtttaaaaaaagtcaacggcgtgaaacatttagagatggagggagtagtaatttttacaaagaatatagacatattcagattcataagtaaaaaagcttatattctgctctctccagttcaagttaaaagtcgttttgattttttttcaaaattaacctgttccaagtttgactaatcttgtagaaaaaaatagcaaccttttcaacttaaaataaatatattatgaaaatatattcaattatagtttttaatgaaactaatttggtgttataaaaatggagtagaaccaaggagtatatataacgtaaatggtaaatataactgctgcaaaagctgcagctacttcctctcgcgagccgcacatgcaggctactactactagtagtacgcgagaaattgggatgcatatgcgacggcgaggcatagcttccagctaccttcctgcggcctccccggaacattctcctgtctctcatccatccacagtctttctgtcgactgcaggagaaaacttgcagcaacttcttcacttcctctgtaacaattcctaggaaatgaccagggccctctatctccatggcctatatatactgctaccaacaacccgtttctctagaggatccccatattatatagttagtgtgcaattatggctaagcttaattagctagctagccatatagtttgattaattgttcagttcggcagacaggtactttcagttgcgttcatttttatctcatcttaattattgtgtgtataaatattcgtctagttaattagcaatcgagcttattttcagtcattagttacatattactgctcgtgtaactatttctgaaaatattgttcttgcacgtacgccctgcaagcagatgatcgattttacttcttggttctgaaga

SEQ ID NO: 22599 - DNA, 667 bp, Oryza sativa
gaacggaaatattggcgtgagcaccttgttgaaatgtcggaagcactggtaaactgagatatttttcaggagtttcctgcagctccatgcaaggcagcaggaagaacatgagggtgaacacccaaaacctggcattccaggttctgttgttctgcatgcggcagttccacaaagaatgttcaggtactgccggcttatcccagcagatatgccatcagattaccactggtttattctgatgcctcaacagaaagctcgctgaacctggtatagcctacctgtatgtaccacatatatccttgctaggagtacttggaaatattggcacaagtacaacggtactcggtagtacctatccttacaaaaagtggtacattttgatcagagagtgacgctcagtatcagtattgagatcataaaacatgttgatcagtgtgggactttcagtatcagtattgagattagtacacgtcgaacacagcgtgacgctcggtatcagcagagagataactaagcttgacaaatgacaacatgtaattgtcacaggagcttaagacgtttcatacttgagcaacaaagcgatcaaaacaccagcacatcctgcatccagccgctaagtacacaggcaagataatatcaagcacgtaacagatgcagccagtaataa

SEQ ID NO: 22600 - DNA, 1501 bp, Oryza sativa
  unsure (1)..(1501): unsure at all n locations
tcctctttttaaaaattattttatcatctgtcgaactgcgggcaccctgtcgaactgcggttgttcgataggtaccctgtcgaaccacggatattcgatagagtgccaaacttgcgatttcgtctaaccgacctatatttttgcgattttcctttaaaatcgtattatttccaaaaaaaatcctatacaagcacgttgggtgcatgcactgcacgcagatgagtgaatgcatcgcgttgatcgagccatggatgtcacggtgcatcgacctgggatattaattaatccatccgttctgcttcatcttataattaagtcgctttaactaccttttgagttaaagttctataattttaactaagattatagaaagtttagcagccatctanancacaaaatattttcattaatcaagaattgaatatatttttataatatctttgtgttaaaaatactactatattttttttatgaacttaatcaaatttatactacctctgccttacaaatactctatttttcagtttttagatgtaatgtatgactattcgtcttatttaagaattttctatgattagtatttttattgttattagataaaaaaaagatatgaatagtatttcatatgtgattaactttttcataaaatttttaaataaaacgaacaattaacgttggacatataataaatttaaaatgcagtctttatgaaacggagggaataagtttaactgataaaaaaatcaaaacgagttgtaatacgaaacggatggactggtcctagtgcggtgtcttggatggcgaagctagcgaacgaaccttccatcgatcgatgagagatcgagcagccggagaaattaatagttcccgtgtgcccggccggaatctgattccttttgctaaagtgtgcgcatggcgtatgcccaatactttggaaatttctttattcacagcattcaagcttctttatagttgttttgctatgtgaactttcaaagatgttgtcaactttaggttgtacgcatcatattatgccaagcagtcggtatatcacttggatcatattattcggggattcacaccgcatatgctatatattgatatcaagtcacttggttgattacaattatcaaaaccactcggttggttagattatttattccttgactatatgtttggatggttcaattaaccacatagtcgggggctacacctattaggtgcatctattcgatgcacctgactttatttttcagccctccacagtcttcagatttggtaaaagtactcgggagaccatggcgaagatgattgaagcactcggctttggagtaatctagttcgagagaagattatattttcgactgtgaaggtctcaggggctactgtggagattatgggtaccccatatccacacggcatggttatccgactagtaataggggataacatatatgtatggaatatgtaacagatcgtgacttgggtattacgtttccct

SEQ ID NO: 22601 - DNA, 1501 bp, Oryza sativa
ctttattcacagcattcaagcttctttatagttgttttgctatgtgaactttcaaagatgttgtcaactttaggttgtacgcatcatattatgccaagcagtcggtatatcacttggatcatattattcggggattcacaccgcatatgctatatattgatatcaagtcacttggttgattacaattatcaaaaccactcggttggttagattatttattccttgactatatgtttggatggttcaattaaccacatagtcgggggctacacctattaggtgcatctattcgatgcacctgactttatttttcagccctccacagtcttcagatttggtaaaagtactcgggagaccatggcgaagatgattgaagcactcggctttggagtaatctagttcgagagaagattatattttcgactgtgaaggtctcaggggctactgtggagattatgggtaccccatatccacacggcatggttatccgactagtaataggggataacatatatgtatggaatatgtaacagatcgtgacttgggtattacgtttccctatatattatggaacggcctaaagttctggtttgataagattgtaaagtagatttaggaaaccgataccgtattggttaaggtttctatcttgtaatcctgccccccatcctatataaggtgggcaggaagccctctagggggcatgagacacaacctgatcgtcagatcaatacacactcggcggattcaaatccccaaacaggagtagggtattacctctcattgagagggcctgaacctgtctaaatcctttgtctctgcatccatccacttttaggtctcgtgcgctaccccgttttattattgccgaattcatgtttcgacacgatgagagatcgagcagccggagaaattaatagttcccgtgtgcccggccggaatctgattccttttgctaaagtggatacctagcttcggcggcgacgtacgtctccaatggaatcgtacatgtggagattatggatatcccatatctacacggcgatgatatttggactgaatataggataccgaatatagatagaatatcttatgtgtatcctgggtttgtttcctgacttgtatatcaaggaaacaacttaagacttagtcggtcacgactgtatttaatctgtatctgtgtattccgttagggatatagattatcttttgtaacccggactccttcctatatataaggggggtccgggcgcctctaggggcagttgttggattttctccaaatcatacaatcaataacacactcggcggattcatccccggacaggagtagggtattacttcttttataagaaggcctgaacctgtataaatcctttgtctccaaacccatacactttcctagcttgatagccacccccttttattattgccgaaatctagtttcgacagttggcgcgccaggtaggggtagcgtcaagcttttcgccgatcagtgcaa

SEQ ID NO: 22602 - DNA, 1402 bp, Oryza sativa
tagttggttcaagtctctaattttttctaaaattgagatctacatgttaaaaatatccacatgtactgttcatgcttgtttatgtgctgttttggtgtttttgctcttttctgtttagattccgtcgtttccggagagtccgttttcgccggagaagagtttgaagagttccaaggccagcaaggcaagtcacacagatcccaaacaaccctttgagcatgttgatcctatttaaagctattgtttctattcaaatattgcatttattttcgaatgtcattgggtggaattaacctattgtttgttatagcccttttgttcttgattactttattccttgataccttgggttattataacttgactagttgagctttatatattggttcaactagatattagatataattgcttagccctgcttagaaacattagctcactattgggataacttatgactcactgttatttaatgatggtttaatgatagttcacgatggtcaatcgtgactggttaattaattaatgtgccaactaaaacctggtaatggtgggttgtgagcacatggttttgatggttgtgctcatgacaattaaggaccggttcacgagtttcggttgtgaaacattaaccgtgccaaccacaagccagcatgggcaacggctttatcttttgtgtagcatggttcattgcggggcaccagactgagaagtggcggagataagcccacgggggtcgctggggagtccatgccttgtttataagggggtgattatgatctaggaaggtgcgctgcagtggattgtgttatgcaaggggtattgtcacaactcctttccgaggtaccgtggtggtattgaggcacatggtgacatgatgtggggttgtgtcttgtgggtacagtggtacacctctgatcagagtaaaactattcgaatagccgtgcccgcggttatgggcgggtctaacaatgtctttcgtgattagtctcacccttctcaccacaatagaagatgctataactggtaataatttgattagctcctggtttggaatggtatattcctggtttggagatagaactgtgcagccgggatggttgttcagaatggttgggcctatgcaacagggtatgttgtatagcgttggattaatattgtttaattacttaactgttttattaaattctcaaatgtttgctaaatgctgcttttgcaaatgaaaccctactatgccatcctttgttatcctgttgtcacgcccagaaattcacgaaccagaatttctaagctgaatgtgcattaaacccctgtccaggaccagccagggtacacaaacgacaattgttgacatacagatccacgtcttacaaaaatataaaagattacaaatgcagcggaa

SEQ ID NO: 22603 - DNA, 163 bp, Oryza sativa
gtctcgatcgccgccgccgcatccttgctgctgctccttctccctgtccgccgggcccacccgttaccttttaaaccgttcgccctggcccccccggtggcgcgcgccacctgttcgacgtaatgtctcacagtgtcaaaatgaaccagcagtgcttgacaga

SEQ ID NO: 22604 - DNA, 347 bp, Oryza sativa
atgtccgtttggagtgtgggatatttttttttctgggcccatctgtccgtgttcagcccgtatattgcaatggaataagttcatttcaggtacctcaagttgtcgccgagtctgaacttcgcaatactagataaaacatgtctcctcagcttccaaaaccaatacaaataaggtctcaacatagtttgaacgacggttttggctgacatagcacttacgtggcgctgacagggcacttcaagttagataaaaagtgggacccacgtgttagtgagtaacccacatgttgggacacggtgtggagctgacggtgcactggctagtagtgagcacgcagaaaggcacaa

SEQ ID NO: 22605 - DNA, 624 bp, Oryza sativa
aaggaattctttctgccgtaacactcatggttcaggcacggtgaacgctgatcctgaagaatctactatgttgtgcgcatactgcagaatggaaaatttctgccttgcttcccccgaatgaatcattatcctgttggtccagttctaaccatatggactgcagagtacagaatgcattgtttcacataaagagaaagaccaaacctattcaattttgtgtttgatacttgatagatcctttgcagatagtttcgataggcttgtgctttgccatttgttgtttgcagcattaaaaccatcaatcaaaattagctacactgtccgctaactttacattggtgtctacatcggattgttagtgttaggttttgtggcattaattgacagcctgaatgggctagaaggacatatttgcctgagttgtgaataacaccagcaatttactggctgataatttgcagttacagtaacaagcacaacgtatttcattttcctattaaaaacaggatattctactctaaatgattctttttcttgaaccacgtttttctgattagtactatataatttggctcaaactattttttgctaatcaataatttaccctgtgattcgaaacacagg

SEQ ID NO: 22606 - DNA, 253 bp, Oryza sativa
ttactccatggcattcagcatattgctcgttaattacacagctaattaccttgcttcgttcaatctaatggagcccaacacgcatgatcaaccagcgcaaagcaaggttttatatgccaaatctacttgtgtttgtgattaatggtcaaggttttatgtgcatgcttcacccgctgttaggtttgcctaggctcaagaaaatttttagatccgttactgattagatgaatcaaacaagtgtgctgcttgtttg

SEQ ID NO: 22607 - DNA, 1251 bp, Oryza sativa
tacccttcaactacagcacttatgctgtagagcttgaggtaacttatcgttctgttctcaaacaaatttaatgattttctttttcaaaaccatgcaacttctatgcattatgagaagtccaaatctagtgtcataatggttgctctcaattcgcagaagggtgcaatcgatataaataagagattgctgggagtgcctgtcagctcatctcccctgcaaaagtcaatcgccgagttcaaaagggcagctctacaaatggattctgaaatgaaggtgtcttttcttatgtttgttgcatgctgttgcctgatccatagtttcaactttaagctctccgctcaaaaggaaaaaactttaagcttcctgtttccctttcctattaggccttacagacaaggaaagtttggaacccctggagaaacaatcccctgaaggtcagagatctcaatgagcggttgatgatgacggagcgagcattcaccgatcgagaaggactatctgggaggccatggtacaaacacctggtaagttttttgtgccaatattgttggttgatgaactgctgtagttttttccttttctttatttttttttaaaaaactgctgagtgctttacttatggggaacaaaacaacgcagatttatgcaccatcactgcatgatgattacggagcgcaggtgtatccaggtgttgatgatgccattcagatggcagagaggacgaatacgtccgaatcctggcgatctgtgcagcatgagatttacaggattgctagggtcatcaaccaggcctcgctagtcctaagtggagggttaacataaacaactgttggggaagcggtggaaatggaactatgctttctactcgggggactggtaatcgttgactgcgataaatgaaatgttcatgtcacttatttggaacaaaaaaaaggaagaaaaatagaggaatttgtgggttttaaatccaaagagcgaagggtgaagagcaaagctttggaaagtaaactgtatcaaaataggactcgagggaataaagggtacatgtacctttgatagctacagagtggaaagtaaactgtatcaaataggaacagtaaacaaagataaaacaaaatttcgacattttagtttgtgttatgtgctttcaccttttgttagctacacttcaatgggtgcaaaatgtcaaaacagtccacgtaaacatgttactttttacgtccaaataccattcagtcatggagccaacat

SEQ ID NO: 22608 - DNA, 488 bp, Oryza sativa
ccagttaatcatgttgccagtgtgaagctataactgaatcgagtgactaatgatcatcagctgactagctagctgggtgtgaatgtgtgtatggtagtgtatggcatccactgagatacactgatcatacaccaattatttggttccagaaaagcaagaaaaaaaaaagaaagaaagcataaagcaaaccaaacccaacacaagtaacatcacacaccgccctctaaaacgtcaagaaaggcgataaccactagcactacaacacactactggtcctcatttcacaccaaacgcgtccaaactcttgtgtgctatctacgtgctgcattgttgtggtctttagctctggaccattcagtgagctactggtggatcaagccatgcaaaaagcactagagcaagccctataagtaccaatggccatctcctcactctcatcacacagctgcactacttgcactgaagtagctagagcttgcaagtaaaga

SEQ ID NO: 22609 - DNA, 1501 bp, Oryza sativa
  unsure (1)..(1501): unsure at all n locations
atgtggtatcctagtcagaaaaaaataaaaaatatatgtgaggcccacatgttagccgcccttttcttttcttcccaagtggcagcggcaggcagcacatggagggccgcaaagacatcgtcgacttcctccttgccatccagcttgtggggcccaccaagctgctcgagtccacgaccttcatctggttggactcacaggctgacaccaacaacggcggcggactttatcggtgcagcggcggcggctagcggccagcgacaatggcagcgggggtgacaccagcggcgagggtgagtaggacagccgagagcggcagcgcggggaggaggaggaagaggcggggggcaccatgtctttggcaagaggtcctcctccatcttcgatgtcccctccctcccccctcattcccaccactgccgccaccatcaccatccgcccaagaggtcctcacctcccttcaccgctgcaacgggtgaaggcggaggctcacctcccttcgtcaagcgtggcagaggcgctcccttcaccgccgccaggaggctcacctcccttcaatgcgatggcgggtggaggcggaggaggaggcatatgaggtgtgcagaggtggaggctgctcttcagatctcgggagtggcggcggcagctgaggagccccccgccggccgcttctcgcctcccctatctcgcgccggccatccctatccccatccccatccctatccaaaaagaaaagaaaaggaagaaaagtgcggctcacaagtaggacctacataattttttattttttattttgcttactagaatgtcatgtcagcgaaaccagatatccatactgttgtagcatccagattgcacggttttagtacagtttaggggttaagatttctggtattggggataagggatgtcaaaccaactcggtgtaaagttgagggacaacaggtgaacttattcttgcgcattttcggctatcacatgtgggccgtgtgtagctttgggctccgtatttagacgggagtttcactcgacgatgctccctggggcgcgagaatgctaaagcgnnnnnnnnnnnnnnnnnnnnnnnnnnnnnnnnatcccacaagctttttcgttttcggcacggaatttttattgttggattttgtgcaatggaaataagttcactttcagctcctcatttttgccactgagtctgaaatttgtccctcactgcatgtaacgcttcgcttttcgtgaggcgttaaaaactaattcggcaaaattctaatttcaaaaattttgttctttgagtgatagtctaagttgtgccaagatctcaattcaaatccatccttgatccctctcgtcaccatcaaaaattgcctcctcgaaattccccttccgactcaagtctccaaatcaaactccgaaattctatccctctctttgaatcatcgccaaatacttccccagatccaaagtatccaaaaccccatcttgaatcctccttcgactcctt

SEQ ID NO: 22610 - DNA, 1501 bp, Oryza sativa
caccacttgctggctgggcgctccctgctgggagtaccagcctctttctttttgtcgctcgcaggcctcccctttcgggtggcccgcggagcgccctcgacggcgaggacgtgaccctcgtcgccggaatggaccgaccttttcttcctcctcctgtcacgccaccctgtctgagcggcggatccgggggcggccgaagctgccacaccggaaccggaggggttccaggtccaggcctcctccttacgagccactcggtccgcgagctgaaaaagttctgcggtagtctggggctctttggaggcaatcttttcgaacatgcggttgtgccgcacaccccccctgaacgcgtagatcaccgcgtgtgcagggatgcaaggtatagtattgcggacttggcagaaacgctgaatgtacgagcgaagggattcatcatcccctcgctgtactgcgtgcaagtccgcttcttcacctgggcgtggataggtgccttgaaagttcatggtgaactgctggcacagatcctcccaggagtggaccgacgcgggtggcaggttcattagccaaccccgcgcctgtcccttcagggccatgggaaagaaattcgccatgaccctgtcgtctcccccagcggcctcgatcccggtcgtatagacctggagaaactcggtggggttgacgctcccatcatacttctcggtgatggtgggccggaaccttgggggccaacggacattccgaagactcgccacaaaggctctacagccaacaccaccaaccgggggcacggagggctggtcctcacgtccatgtcgaggtgacaccctggacgaagaggcaccctccgttgcgcggggagcacgccgatcactacgtcggcgctcgatgtcgaggcgggcatccggctcttcatgctgatcctcccgagtcggaggcgccgacgagggagtggtagccgaatggcgtgcagcagccgccgctcgccgcgccctccgccttgatgacacagagccggtggtggcggcgccggaggtcctggtggtggcggaccgtccaccagcacccaggcgctgctgtgccgtcatgaccaagttggccacgtcgtccagccatcgctgggccggagactccgggtcagggacgatgggcgggtgacgtaggagcgcgccaacagcccgaagtgcgccttgaggcgtgctgccgtcgccgtagacgaggaggcgacgctccccatctcgccgttcttctgcaccacccgcgactggcgatgctgcggatttttcgaccctctcgagcgcctccccctgcttaggattttgttgtggaggaggtgggggcgtacgagctcgacggcgtgggtttggctccccgtcgtcgccgctcacactcggagagaggtcgtgcgcctttgcttgctcggccattaggctgaacaagggaaacttggcgcacacggaagagtatgagagctcagaaaacacacgctgagccccctacctgg

SEQ ID NO: 22611 - DNA, 1008 bp, Oryza sativa
cccatatccccggcaatatatatatgtatatatatatgtatatatatatgtatatatatatatgtatatatatatatatgtatatatatatgtatatatatatatatgtatatatatatatgtatatatatatatatatatatatatatatatatgtatatatatatatatgtatatatatatatatatatgtatatatatgttacttcgcatttatcctaatacatttttttgtatcttgcagaaaagacgtgttgtcggagtcgtccgtcaagcctgagtggaagagctagccctagaaggaattggagcaggcaagtgacgtaataatataaatgattgttatatttgtaatgcaattaattaagattattagacctgtaattagacttatcatataagattgtgtagtgttctaatattatttgagttttaatataagattattttattgcaaattagacttagtatgacattattgactacggaattggtgcgactcctagcaattgactattgtagtcttaattagacttagcatatacgcacgaaacacttagcatacattactattttagtcttagcatgtaatattatttgagttttaatataatattactttatttgtaattagacttggtatgtaattattgactacggaattggtgcgacaagtagcaattgactattgtagtcttaattagacttagcatatacgcacgaaacacttagcatatacatgactattttagtcttagcatgtaatattatttgagttttaatataagattattttatttgtaattagacttagtatataattatttactagctagggttgtataatatacgtcacctagacttagcttatatcacgatttgtaattagacttagcacgtaaggttgtgtagggttctaatgtacgacatttacacttagcatacatgacttagattgttaaaacataaatgtctcgtgacttagcagatgtttcttgtatcaacaga

SEQ ID NO: 22612 - DNA, 1501 bp, Oryza sativa
tgcacgtagtgatggctaaaaatttagtgctacaccaacctctattgcaggttaattacttagcatcaagtgagtgctatgtcgtttagtacttatctacttgtggttttgattaacaactacactgattaaaagcttttaaaaaaccccactgactatattgttaaacggatatattaagagccaatttgtgcatgttgtgatgcactgtggatttttgaagaggaaggcagattatttactaattaatgaaaaaattcgccacagttaaaaatagtgtataccaggcaaccatagcaaatataatatttttttatgtatactctaattattacgtaatagtagtattataattaataaagcctaattaaaacaacttaaaaatatgtatgctattgctacccagcggatgatgcactaggtagtgctatacgaattgagatcctctgcagttaatgcatcgtgcctttgttactaatatgtgggtccagggatcatcggacctacatgtcagtgacaatagcacggtatgtacagttgactgtagaggatcctgatccagtgctgcacatgagaatgccaatggcaaagcaaagcatatcaaaggatatttttggcatagctgagttacatggcgttgctgatggcactatgatgaacacggcttatttctaaccaaatagaagaagcgtgtgcataactgattctttattttatcactgttgtctaggtaggtgcataggtagaaatacaacttttttaataaggtagctattactccctccatctctgaatatttgacgctgttaactttttttaaacatgtttgactgttcatcttattcaaaaaatttaagtaattattaattcttttcctatcatatgattcattgttaaatatacttttatgtatacatatagttttacatattccacaaaattttttgaataagacgaacggtcaaacatgtttaaaaaagtcaacgacgtcaattatttaggaacggagggagtatatgtttgtagttgacatgcaactgaaatctccagtttggctttgctggttgggtttttggttaccaaaattctggcaataaaatttgttgacaacgcaagaacaaaatagaccaggttaattggttagtgaggtcggtgatacaggttggcagctccccttccggttgctagcttcttcttttctcgtttggcccaacgaagaggccacactttttcagttaactctctctcacctttcagtctaggaaccggaagcgaatgaacttgctgcatcagcgttcatcctagcgtaggaagcacacatatattgtgcctgaccatcagatcgagctatggcttgtgtcatgatgcgtcctattcctatatatgagaccaacgttcgtttgatcctctcctcttagcaaactaaggtgaatgaaagttaaatgtgtttctgcatgcccagcaatctgatacgatcgatgtcacatatatatatatttat

SEQ ID NO: 22613 - DNA, 539 bp, Oryza sativa
gcagggggactaggaatggactttgtccgagggagaggaaagagagttgggccgagcaagggaggggaggaggtcggcccgagaggaaggagggagagagggtcgcccacgggctgagggagaggaggactttggtccgaaaatggcccaaagagaaggagagaattatttttagcttttcatttttaattaactctgcacttggtttttgttgcatttaaattatttcttgtgctctgaatattcaaataaaaattgagggaccaatttagagcatggagaatttaagaaaaatactccaagccacattaaaatttttcttatacgcattttaatgtttaccaatttaacttcgaattttaattaattttattattccttttagagaatgatttttaatttaggatggatttatcagagcgtgacagcttccatgttcattcctcagagttgggaggacagacaggtttgctcctgcaagttgttgctgggtctccctttcctgttgcgttttcattttcttttcttaactgaaaaga

SEQ ID NO: 22614 - DNA, 1093 bp, Oryza sativa
tcttggtagcttaggttcaattataggattcttcaggatcttcactccttggtgcttagagggggaacttcggaggcaggttccttcttcacaactattatgtgttgaatccaagcaagggagggggagatgaacactttgtaaatagcatagggaagaaggaaaatggaaatttgacaaatagttttcgtttggcaaataagtccttagggtttgttcgtttggcttatcctacagtcgagatggctctgataccaacttgtcacgcccggaaaatacctttcccaaacgctaatgtattaatccccgtcgcaggaaatgcaggggtacaccacaacaaacttgatacaaaagacacatctttattaattatcacgataatatttacattattacaaaggcacattaggcccgacaacaaaagaaaaacagcagcagactagcgggcctacggctccatcttcacaggcacttaactggggtataagccaggactccacctaagacatattcttcaaatagtttcgctgactgaagggggaaagattgagcaagaatgagtacaaccatcgtactcagcaagccatgccgggaaatgaattatagtgcaaaggggaacaaagagttggcataatagggttcatttttgcgtaaagccagagttgcaatattttaatgtttttaaagcatagtttaaactcggtccaatattatcacgattgcgaaaccacgcaaaccggccttaaaccccaggttaaccacctgtccaaagtgccatgaattccaaccatcactcagaagaaaaacactaacttgggtacattgctaggcttgcccataaccgagggcgcggctattcgaatagttttactccgatcagaggtgtacatttttacccacaagacacacttgacttcatgtcagccatgcatcgcgatacctcaaaggtacccgaaaagtcaagatcgtgacaagactatccacctagctcaacccaaaacagaaggacccgctaaggtttcgccgcccgccggtcctcgataaggtaaaggttgccggatcccccgggacgagacaggccccctcttgcgcc

SEQ ID NO: 22615 - DNA, 278 bp, Oryza sativa
gtcggtttcggtttcggggttgtttgtttggatatccgtgattatttcatgattatggcttctagatggatactatacgtatgtaatactgttgtttgctactaatgtgtcaagttggaattagcttggtctcggaatatggtttctttgtttatttcatgtgtaggtgactcgatgcctcgggagagtatttgcggtgatggaccgggagtcggcttggggataagacaacgtctgtggtggtcagagatcatgcgggatacttaggctagagttga

SEQ ID NO: 22616 - DNA, 1501 bp, Oryza sativa
attcgatcctacatatggtactgaattaattaagtcaccattctgggtactacccagcagagtttcccgtacctttggaataggggttgccttcaccctaacaataagcacggttaccgcgctaaccatggcaaacagtaagacaccgtataaaacttatcaaaaattcaaattatttttcaaaatttatttgaatttaatggagttatctcagttttaccttttatcgtacccggcaataaatgtgataaccacgataaccctgcagttatcgccggttttgtaaaccctgcctacccagccgcaacacataaatacgcgcgcgatatatatgtcgcccatgagccatgcccacgcacacataatctcgtgtgggatgattggagaggcagatcaaagagcgtaggatcacttcagtttgctaaattcgatcatgcacatcggaataggacgcatcatgaatccaagccgaagcatcccctttgtatccttcacaagcagcgatcgagaaccacggtaagatgaacgccaacgcaggtggcatatgtatgctggctcatgcttccctgtcagtgcaaacgtgcgaggcgtacgtgctcccttcagttcagcagaatgcagggaaactgcagagcgatggggagagcccagcagcagaaacagcagctagcgtgcctgagcaacctctcctccggacacaataacggcgtgaacgtggactacatcccctgtctactctctctgttttttaaaaaaaatcaatctgaactaatacttgtcccgactctagattctagattcatttttagaattgagtttctttttagactgagagtagcccgcaaggctgtatagtagcaaaagagctgtagcaaccacatctcaacccaaaactagcatgagtggagcgagcttagttccaaaactctatgtaaatccattaaaaattgtatacaaaattttaaaatatactctctccgtcctaaaatataagcatttttagactaatactgtggagattatgggtatcctatatctacacggcgatggtatttgaactgggtacaggatacttaatgtagatagaatatcttatctgtatctcgggtttgtttcttaacttgtgtatcaaggaaacaccctgagaattagtcggttacgactgtattttacctgtatcttcatattccgttaggaatatagattatcttttgtaacccggactccttcccatatataaggggggtccgggcgcctctaggggcatatgttgatttttcccgaatcatacaatcaataatacactcggcggattcatccccggacaggagtagggtattacttctttcataagaaggcctgaacctgtataaatcctttgtctccaaacccatacacttttctagcttgatagccaccccctttattattgccgaaatctagtttcgacagttggcgcgccaggtaggggtagcgtcaagcttttcgccgatcagtgcaa

SEQ ID NO: 22617 - DNA, 1501 bp, Oryza sativa
ttaaattttttgctatcagtagttaaaatttaaaaaaattgacttggtatttgtcgaaactagatttcggcaataataaagggggtggctatcaagctagaaaagtgtatgggtttggagacaaaggatttatacaggttcaggccttcttatgaaagaagtaataccctactcctgtccggggatgaatccgccgagtgtattattgattgtatgattcgggaaaaatcaacatatgcccctagaggcgcccggaccccccttatatatgggaaggagtccgggttacaaaagataatctatattcctaacggaatatgaagatacaggtaaaatacagtcgtaaccgactaattctcagggtgtttccttgatacacaagttaagaaacaaacccgagatacagataagatattctatctacattaagtatcctgtacccagttcaaataccatcgccgtgtagatataggatacccataatctccacagtagcccccgagtcctttgcagtcgaccatcatagccttctcaaagatgataatccaagtacttcaaactcttcaagccaaaatctgccgagtggactgtaaagggcgaaaagataaagaatatggtgcatcgaatagatgcacctaattaggtgtagcccccaactatgtgattagttaacaaactaaacatatagttgaaagacaaaataataacacaattgtgcattatatgacaaaagcatacgcggcgcctaaataggcatgctagccgactgctttttagccacaataaaagaaatccgagtggtttacactctaaaaggttcacgaatgaacacactcgacaggcatccgaatataaaaactctaaagattacccatcaagtattataaagattatggtaataaataagtcgaatagcctaggccatgactatttaccatgaaaacaggcatataacatgccaaggaaatgactataataaaaacaagtcatccctagttaacccaaacagcttttgtagcctaaaagagcttgcaaaaacagcataacgcctttctgtcgggcacctttttaatttgcattgcaataattccaaagaattatatgaccgcataaaaaggatttgatcagcattgggcaacactgttgtgcgcataatattgccaaagcaaaatatgcctaagtccctaaggaacacaatgggccacgctgttaaaagtattgggctgaagtactgttcaggcctaggcccattagcacttccgatacccttaacaataaaacccgaaatccaagcgacgcctcgtcttccccgccggaacgctcgccattttccccattccttgctacagtgcaaagctgcgccggcgaactagggttcacaactccggccaaatccacctccgaaaagtgcatcaaaatccttcccgtgatccactgcctcaatccctcacctctcccaagccatccctcaaatcaaatcagcacatttgagtgaaattga

SEQ ID NO: 22618 - DNA, 540 bp, Oryza sativa
agtctttcattgaatttcaactctccttaatatccatagaaaatctgtttcaggagattagtttgtttcatttctctaatcttgaactcttataataattttataacaatctttcaatttttttttccagatttatagttgccatcttcatatgctcgtttgagtaggataaatcttctgtcaatgcgatctcatctaaatatatacagattttttcataaacatttctatagagtggtttgattccatcacattactactccctttgtccttaaatgtaaggggtcttgactataaatctgaacatgcactagcagtattaactgtaattttgtattgtgctacaatgttctccactcggtgataacttaatccaatcactgatcagtatagcataagtagctgggttttggttaggagtactactatgaatcaggctgaagcaaattggatggacggtacaaaaaccggatgcgaagacaccaaggtggactactgtgcttgagcctgtgacctgatcattcgtctctcactttgaga

SEQ ID NO: 22619 - DNA, 1501 bp, Oryza sativa
tcacggttaggatcatacttgccgtcgaactcgaatgccgtgcgagatctttccttgattggcgctagtcggcatttgatgaaatgccgagtgatctgttctccctgtaagccttgttctttaagatttaacatacgatccaacaactccaaggcttgtactgcttcatctccgattggaagagagttccaagtatcttggtacactggaggaagacaagagtacccgggaagagcaggctcgggattctggacatagaaccagtttgcatgccatcctttgttcgaagtcttgaagggcatcgagaaatatttttgactcagagttccccttagttggaatcctgcccccccgactacacacggtttgttcttgtttggttggggcttgaggaagaagatccggcggaatagggcaaagtgaggtttgatccccaaaaaggcttcacaagcatggacaaaattggcgatatgcactatggaattcgggtttaggtgatgcaagctgattccatagaaattcaagatcccgcggaaaaattttgaggtcggaagagcaaagccgccgtagaagaaatgcgagaagaccacaatctcatgagtatccggagacgggaaggcctcaccgtgcgctggtcgccacccgatgatctccttggcagggagaacgccgtgcgccaccatctccttaagattctcctccgttacatcggatgacgcccattggccttcgaagctttctctctcttccgccatcaatttcactcaaatgtgctgatttgatttgagggatggcttgggagaggtgagggattgaggcagtggatcacgggaaggattttgatgcacttttcggaggtggatttggccggagttgtgaaccctagttcgccggcgcagctttgcactgtagcaaggaatggggaaaatggcgagcgttccggcggggaagacgaggcgtcgcttggatttcgggttttattgttaagggtatcggaagtgctaatgggcctaggcctgaacagtacttcagcccaatacttttaacagcgtggcccattgtgttccttagggacttaggcatattttgctttggcaatattatgcgcacaacagtgttgcccaatgctgatcaaatcctttttatgcggtcatataattctttggaattattgcaatgcaaattaaaaaggtgcccgacagaaaggcgttatgctgtttttgcaagctcttttaggctacaaaagctgtttgggttaactagggatgacttgtttttattatagtcatttccttggcatgttatatgcctgttttcatggtaaatagtcatggcctaggctattcgacttatttattaccataatctttataatacttgatgggtaatctttagagtttttatattcggatgcctgtcgagtgtgttcattcgtgaaccttttagagtgtaaaccactcggatttcttttattgtggctaaaaagcagtcggctagcatg

SEQ ID NO: 22620 - DNA, 246 bp, Oryza sativa
tcgcttatcatgggtgcaaattgctaggactcataaccttcctgacgagcaactattttctagtggatggatatgtgtgccgccaactgttctatgagaagccaattctcgttatcgaagccatggtcggctagaaatgctctaccttagcggcaaaggcaattgtttccaatgaaggtgactagctgctgagaggaaattgcagatgaaacaacaaaggacaaggggatactcgcaaaggagaca

SEQ ID NO: 22621 - DNA, 762 bp, Oryza sativa
gttttgaatggagacacagcttacaggtttcttagtaagtggctcggtgagtgagccactttctctggagcgattcgatggtcagtggtagagtagagtctgggaggacttcgtcctgttgcttctcctttcgtttgaatccatcttgttagaagtttttgttggccttagaccagacagaatattgggcaaaaaacaatttgtttgtgcctgtgaacttgccattgttctactgtaagagcaaatgttttttttttatctgaaggattaaagaaccaaggaatctataatgtccacaattgttttcattttttgccattttggtgcatggtgaggtaagttaatgcttcccttttctgttctttttttttccttcaatcattggtatggtgctgcattttcatacttaggatgacagtgtcaatctttaattttttaccatttgatcttttgcctatgttaggactgattattctggctacttggctagaagatattgctgtattttacacttaatgttcatagtaattaccaggacgatgcatgttattgcacttgaaatggcactagtgagcaatttatcctgcagcttttggccattggcatcttaaaatgttattattgcctgattattctttgaatcttctgttgatgcaatcttgttcattaactgcaggtttcttcaccgagggaaaggcagaaaatgttaacttaaaaagaactgaaaggtccaccctcttccgtttcttgggatagttaagg

SEQ ID NO: 22622 - DNA, 330 bp, Oryza sativa
ggatgtcaccttgcttgtccaagggtcagtttcttgttctttgcctacaagttagtagtataatataagcattgcaaggcaacatgtaaatacatggacaaaatcaattatttagctcaaaaatcaagcatacaacaaagagagacaatttaatatcctctaagcaccttcattagaacagatcttgcttccccaagggtcgctttgctgctcttcccctgaacatgataggaaaccataagctctgtagtatatccaccattgaacagaacaagaaatttacttggcatcagaattaccagatgaagcattctcccactttcccccagt

SEQ ID NO: 22623 - DNA, 209 bp, Oryza sativa
gaaggtcgcgtcctaaaacctcatctatttaagcacacagagggaatgaacccttgtgatctttgtcaacgccatttatatatttattttccagatggattgcaaactgtattgactattgagcaagcaacaacttagccacctcgttgacaaagggtagttaaggagtactccctccgttacaaaatataaggcacaaccactcttaa

SEQ ID NO: 22624 - DNA, 581 bp, Oryza sativa
taagctaagggaaagagccataattaatgtgcaaggatacaatgagaaattctgttaccaaaataaccatctttcagaacaaagaagcatacccaccacccaaggcatcgtcatcgtcctgtcgtccatacgagttttagaaggggaaaaaaagagagaaagagttttagccgagcaggtagattgcaaaagcaactgcttgacctgaaccacctgatagacaggaagaacaaatccttcttgtacagtcctactgcgagtgtgcagcccggtccatccagattaattgggtctgctccaccacagatccaactttagattataagtatagacaattcaaaagactagtctgaagggtgagaactgtccctatcttttaagtcatgctcacatatcatcaattaccgatgtaagaataaacccaaccattatacttctactcctgttcggacggagacaagacagagaacctttcctaacaagcgcgaaccatctcaaaattcattcattgcagtacaggataatttgcacattagcaagctttgctcccatccatggtttcctttgcaatcagatcagta

SEQ ID NO: 22625 - DNA, 1501 bp, Oryza sativa
gtcatattttatactgtaagcattatgtttctatattttatgatggagaaatagtatattcggaaacactacatataaattgttacattttgaacggagggagcattgctcaataacacagtgacttttgtctgacatttgctgtacttatgcaggagtcgccgccgatggcgttctcaaggcttgctgcggcaccggcggcgcctacaactggaacgccagtgccatctgcgccatgcccggagtggtcgcctgtcaggatccatctgccgccgtctcctgggacggtgtccactacacggaggccatcaacagctacatcgcccaggggtggctccatggcccttacgctgatcccccaattttggctgctatcccccactgatttgctgaaaggattgatcaaaaccatggaagaataataatccaggcagattgtgtggcaagtctgtataccgtgtgcaatcgatcgatctgtggtttgacaattgacattcagattatgctcaagaaataaataagtgtaatacagtgtgtgcacaccacagtttgtaaaagagaagaaaatcattttctaattaaccatcctggttctgagtgctatcctgatcctctgttggaaccttaactgattgtgagaggatgtatttccatgctaaactgtctcactgttactagtagattttaactctttcgtgtgatttgtcaacttggaattccaagaagctatctgtagttctgtacaacctgataattaacaagaaagttgtttcaataaattgttgtcatctatatagaaccatcaagcagtaatcttcacgtgttactatcattaaggatcaactcgtagtacggtttttttctttctaaagagccgtctatcaaattgcgaaaccagataaaacgtgtaagctttgatatccacggcgccccccgtgggcggccatggtggatttcggactaaatattgacttagactgcaagttgtaatcgttatcacatttcttatgtcctgcaatcataaccttaacctttctcaacctttatgctctttatcaatacagatctacattttcaaacctttgactgcaagctctaccgaacaagcaactgcttatctcactttttggcacatatttaaagttttaaacaatctactattttacacttcatctgatcataaatatttcacataatggactttgaaatgaaatttaccattcatattattcaaatttagtgtaaatttttttaaaaaatataagtcatgttttaaatacctttgataataaaacaagttaaatacctttgataataaaacaagtcataataaaataaatagtaattaaaattctttaaaaaaagacatatagtcagaagtcatttccaaagtcacctgcaacaaaaacttatgaccggagggagtagtattgaattgtacctccatataacccaagcagttagctagcactcagctctgctcttcacatttctagtaggt

SEQ ID NO: 22626 - DNA, 503 bp, Oryza sativa
taattgttaattaagtaattaatcactgatcaaatggagcgacagtgtcgatgatcgcttgagcggtctagctctttcataccgcggccgctttcattgcatgcgcgagaccgcgcggtcttttactgtgtgataccgcccgcgacgtcattcccacgtcattttcgtgcaacggttatacgagaccgacggtatatttctgtaaaaaaaatttgcatcccaaatattcctgaaaaaaattgaatgaatagtatattttcaaatttaattcaaataccatctaccacgggagtagaacatacatagcgaggatttgtgagctagtctctgacgaatgggcccgctcgtaaaagaagcacaacttcgacttccagttcggctcagacacggatagttcgccggccttcgtcgattccgatcccaacttcaacttatataataattctataagctgagctagacatcagacgacctcgattgattagctaggttaggtctaacca

SEQ ID NO: 22627 - DNA, 1023 bp, Oryza sativa
aagaagaagcccacattaaggacatgttgttgctgctactgcgatcaacagctagtcagcggtgtcaccacggtcacagccaccgtttcacttctatatctcttctctcgtctatcgtccctcctcccgcgccacaccgtcgcctcgtatccccgctcaactggccactccactgccagcaccggtgctgaatgggccaggatgagagagagagagagaggaaagccccgtcgtcatcctgccaccgccttcaccactccctgttgttgtcccgacaccctgctgctgtcagccgccttcttgcaccgttgagccaagaagaagaaaggggagagagagaggggatgacaagtgggttctacttatttatttatttatttatttatttatttatttatttatttatttatttatttatttatttatttatttatttatttatttatttatttaatgactaggttggcacatgcatgtcacgtcagtgaaactgccttcaaaattgacggtggagtcgttttagacggttgtaatagttgggggacttgtcatatctaattttgtggttgagggatacgaattagattcagctactagttaagggagttacagtgggcttattcctttccgtatgtggcttatcctgactcgcattactgtgggttcgggaaacggcgtatgagaccaataaatgtatactctattatccttgtccttcttaggtaggcacgtatatgcctacaaaagtatctagtgccccacaagtaacgggttgagcgcactagcacgaaaaacattattacataataaagaaatggaaacttatagttatggagcaattatggttttggcgtccgttttgatagctttggatcaattatggtatattgttatatgccatgaactagggtaaatttcaatttgagacacattttattacttacgtttcactttgaatcactttttaactaatatttttcatttactttgagccatgtaatcttacctttgtttcactttaga

SEQ ID NO: 22628 - DNA, 594 bp, Oryza sativa
agggtccaataagagcagactatagattttggtgataattaattacattaattataagagcaggtataatagcatactataaaccatgtataaacacatattgaggagataaataaggagagataaaagcagcggactacatatttaaagccagctgcagcagactacaaaacataatgtgtatgtgactagagataatttagagctagtagttggctatactattaaactcactctaaaacttactctaagccttagcgatgtgtttactgtgctatggcatataataatataatataccataattgatccaaaattatcaaaacggatgctaaaaccataacaggggattatcaacgttacaggaacaaagcaggggtctgcggataacaaagtaattgcattgttattgtcctatgtatatcctacagcagtaacataagttacataacccttgtgaagcgcacgcaaccatggagaaacggtgtttgagagcttcatcattatgcccagaggcgcatccatcaaactaacacaaaatatcacatcgtcaaaacaaaaggagcataaaaacacctgggaatcgtagagatg

SEQ ID NO: 22629 - DNA, 716 bp, Oryza sativa
tattaccaaccgggactaaagatcccggtgatctttagccccggttggtggtaccaaccgggactaaagatcttaactttatgccccggtggtgattcccacccggacttatggtccccgggatcctttgcccacgatggtgctaccaaccgggactaaagtcccacccctatatatatgtcttcttcctcctccagctgcccgagcaagcttcaaaattacttcaaaaaagaggggaggtcatgccaaaatttctattgaatttattttggtgattacatacaaatcggaggtgcctaaaaggtttgcaacttcatcctccaatgttttttttttgtcatactacatttgcacctatgttttgcacactttttttgtctccaaaatttagttgtaagttgatgagagagaaaatgtgtgtggggaagaaagaatatatagaaatttagttcatttgctaaacaaggttttataaaatagttgagaaggaaaactctagtgaaagttaatcttaaataatagaaaacaaactaaaatgaaaattaaaagaagtaaaacacattaaaattagtttaaaactttacaaatagtttttaagaattatttggtgtaatattttatgatttttgtatgaataaagatatcttataattattgtatgactgtcattattgtaagaataattatttgtgtgcggtttttttgactcatgtaga

SEQ ID NO: 22630 - DNA, 941 bp, Oryza sativa
ctagtcttttaaacaactaataatagaaatacaaactttttactcataatttatttaatggcttcattcatttttccatgacttatcaaccatacctcaatagatcataggaaaatgaccaaaatggtttaatgaggttctgtttgacatgctctaactccatgagcgtggtagaattaaaccaagctgactgttgaacacatcgtggcagaccactatttctttttttccttaacgagcaaaaaaatcagaccgaaatacgttgcatataaggtgggtcttctaattcttttggctagataacagataaaatctgatcttttcttcaatagaagctaccacaccacttattacgtaattcttggctcgaaaccaagtatagcggtgtctaacaaaggataaaaagatgacacattcaaaaacacaaacatcaatgaagagatacaacttattcaaagagcacgatcctattgataatatcttcatccaaagttgataaaaatttacatgacagttgtctccaactttcgaatacattgtaagtacgcagccttcaaatttgcttgatggtaatcactaattaacttccgaatgcagtgtaaatagtctccatgacaacatggattcactacttatacaacctagttttgtttggctacgataggagtaccaaccatgacaataatgctcgccaaattaaattcctaatgcatctcattcttaggacatcttaatcatcatgtatcgaaccgccaatatatatgctcaactgttgtcaacccctgcattcacccatcaaacaattaaaggagatacatgatcaaggttcagatctttgtagcattggttatttgtgggcatacactaaacaaggtgtagccatgttggtatacatggagcatttcagtgagacactagtcagttgaactggatgcaaatga

SEQ ID NO: 22631 - DNA, 720 bp, Oryza sativa
tgctcaccactggcgacggcagcccgagcgagtccctctcgtcgacggcaaagtcgtcttcctcaccgtcatcctcgtcgcggcgcctccagaggccgtcccttcgcatgcagccgcggggccgccgtgcctccctgcgcgagcgcccgccgcgcctccctgcccgcgcccgactccgccgtgtgctggcccgcgccaccgctcctccctgccgcgtgctggccgcgcgtcgccgccgccgcttgtcgcgtgcgccgccgccgccacttgcaaccgggacagtaaaagggattggggattttgctcattgaaccaagggtagaatggtcattcacaaatgataataatattatctttcttcatttaattaggaaattatgggcccaccaaacttctgtcaaaatcagaggtagacggctgcttcatttttaaaaagcaggggcaaaatcataaaccctaaaaagtaggggtaaaatcacaattgaattgtaaagcaagggtagaaacataattgcccctttacttttccaaacagtttggacgttggttttatcctacgtgacaagttgacctaaagttgattagcaaataaataaatataatagtggacccagatgtcagtaagtgaccgctatatttttcttctgccctcccttctctctcatctcttccccatctctctacacttctcccctctctcttggcgaccttcaagggcga

SEQ ID NO: 22632 - DNA, 909 bp, Oryza sativa
gccaaaactctgaattgactgtgttttgggcgccttttctcaagtacgcgataaaatattttggtaacgaacttaaatgatggctgaaatccaatagtattgctatcgtttaggatttagctaaggtttatttgggcattaatccacgcaagcccttaacagttatatgcacatttccattattggttgtgccgtgcttttatcgagctcgtcttcactcggtcaaaggtttaccttaacctcgctacgggcaatatacctttaacaaattaaatgatagctttaccttttaatcgatagctttactttttaaaacgagagctttaccttttatttgattccctccttttagtcgggtactaacatctactttttatgaggcaacttgcagggcataaataaagttcttgattttactgataaactcttaagggtagcacaatttgtgtgttctaaaacaggttaccgctgttatatcgctcgatagaagacactacgaccctgtttaaaagtaaggtagaatcataaagcgactacctcacacctgcgaaatagacgcatctgagcgggggttgttttcttaaacgaaatgcgctacaaacagaggccaaggatataatatatttttattattaaaaaacaattatatgcacatatagtagactcagtaatgtttgccttctcattttgcggccaaacatagaaggtattattattaccagaacatcagctaggggtcaactggacatttttattaacatcagctacttggtcaaggcaaggcctggtcccttgggccttgtggctcatttgtattaacagaattcaagtctttgctcgaaatgatttgaacggacgcaacatggtccaagattataaagtataaacatacttatagatccatagtta

SEQ ID NO: 22633 - DNA, 808 bp, Oryza sativa
catgcaactgttcggttatcaagtctaaatctctatcacgagcaaaaatgcaaatatctgtcactttttacctccttttttctaatcatcagacattagtgttcgttttgctctagaaattatcattgaatggcaaaacatgtccaggggtatatttgtccattcaccacaaatttaacaccgttaccattagttaacagagtaggggcacgtggctgcttcgtttttaaaaagcaggggcaaaatcacaaaccctaaaaagtaggagtaaaatcacaattgaatcgtaaagcaagagtagaaacacaattactccaaaaataaaacgaacctttttatagttaagagttactccctccttctcaaattgtttatcatataacaaaaaccaaaatttctcaacttgatcatcatataaccgcatggacacggattttatcagagtacaattaatgcagcacaggagaatttttgcatgtcaagagtgcaattgtgcattatgttttaatagatgcatgcattgtgggagaatgtgtgcataatattgtgcatgacgtcttgatccatgcagtttaaattatccttggtcttggtatataaatattatatgatgattaatttgagatggagggagtatttggttttgtggttgagtgcacaaaatgagactggggtcgtagttgagggaagacaaaagaacatctcctagggaaattgtgtttcttgtgaaaattttgggcccaaggcctcattttgcaggaaggggtggaaccgtaaaatcatctcatttcttctgctggttccctac

SEQ ID NO: 22634 - DNA, 1501 bp, Oryza sativa
agccaccggagatcataggttcgattctttgcagtacaattttattttcgtcaaccaaaatagcacgaatcttacagttgatctaatggatcagaaatcgacatatttctaaagaaaaatgcgtcgacagttttttagcctttccgtattttttccacacgtacacttcccaatctactaaacgttacgtattttgtaatatatatatatatatatatatatatatatatatatatatatatatatatatatatatatatatatatatatatatatatatatgtatatgtatatgtatatgtatactagcaaaaatacccgtgtgttacaacgggtgaacacaattttaattcttgtaatgggaaaaagggaaaatgcatttgtcctcaacagtacatatttttttatcctttgtgggatgatggtaaactgcacatcaccatagcggttgagggctaacttgtcacacgccttgtcctgacaccatctaagagtgacaccgttaatttaaatatttgttattgagaaaaaaaattttgttgatatttttctgattatttaaaatttttgttgttgagaaaaaatagttgaatatcggccatttgatgatggtagcatatttgaactagagaatttttaaaataaataattaaaaaggatagtagagcatcgcatcaagccgctagcctgcgtcgcaccagctccaatggagcgtcggagtggatgcaatggagacgctcgcgtgcattgccgaggtctcgacggttcgtggagagtgtcattgattacaccgacacaaccgcatcgcaaggtagggcacagggaaggagggggtggctagcaggaccgcccaccgtcgacatcatcgcaccctgacctcctctgcagcaccagcggtgctctgactgctatcaccgccatagcaaagcaagatgatgcaaagagagaaggaagaagacaaagaagtatataaatttagacaggtaaatgggtttttaagtgaaaccttcaaaaatgttctcatcgattcatcacttccaataagtatataagttaaatctactattagttaggctgtgttatttccccatgttctctactcccctttctcgttttccacgtgcacacattttaaactgctaaacggtgcgtttttttgcaaaaaaaaatatatgaaagttgatttaaaaatcaaattaatctattttttattttttaataatatttaattattcacattctaatagactgttccgtcatgcatgacacatggttcccaagtggaatcggcgaacacaccgttctacaaatagtactacttttcatctcaaattgagtgagaaaaaaaaacagacaaggcagagagtaccgagaggaaaaaagaaagagaaagaaaaccagagcaccacggcaccaccagataagtcccaaaagcactttctccttcactttccccaccacctctcccccaatgtcctgtactcatgtactcctgtttccc

SEQ ID NO: 22635 - DNA, 1501 bp, Oryza sativa
ggtgataaaagattttaccactggacccacatatcataaacacatgaggccccacatatcatagatagtgagtagcaaataattaattgctacatcttaaaaaggtaaaaggttaaatatcccaggaggctaggggatccatttttaaaataagttttattgaggtatatttgaaaaatatgtttcaaatgataaaaattgaaaaacacataaatctggagtactggagtatttcccccgtcccctctgcgtcattgaaaatctcccgtcccgttccgctccagcgcctgcgccgatctccatctcgcgactcgcgagcagagcagggttggtaggggcgcccatctccatccggcgagcagagcagagcggaggaggtgcgccatcgtcccgctgcatcctggtgagcatccacatcctctttctgatccatcgctctccccaaccggaagtacttttgtctcgaatttgcttgtgttaaccttaatacaagtaacagtctgtttgttcaacccaaatgttggatcagcccccgacacgcatcctctctcaaccctctctgcccataccattttctctttgccttcaccttgtcttctcccctggatctggcagtttttctcttaattcgccttaaccttctctagatcgaccctgactagcagcagcagtttgtttccaagaaattaaaaaaaatattttgctggttgcagttttgagcctggatcttgccaaacaagtggttgatcttactgctttcggtggccgtgtctcctccacaggaaggaaggcaccggggatctagaggaggccatgggagaattctccaaggtaagtggattatcatttgttaatatgtagttgcttggtaaccggtttttgcaaaatgtactgggtgttaattactagcggtggagatctggtcatcatgaatgagtgaaactattattactgcggcaatgccaaacatgccagagtatggttgtaatgttttgtgtgaagatcaaccttaatattgaatggcaatgttaaatctctcttgtatggagctaaggagcttgagtacatgttagaatgctcgttaatcctgtattacatatttacatgtcgaaactaaaatgtggtaatcgaagctttttgttaagaaacactattatatgagaaatggaacccagtaggattgctattagatatgatatattcaatccatttgcttgggtgttcaagtggcccttatcgatccagtttattgttttttttaaaaaaaaaatacatatcatttatttttatttttgtactctttactgaatcagcattcttatttgattcattctatcaatgtttaactttgtttttccatgcaatgatgcttttgttgatgaacatgaaatgcagcattaagtaactttttctgtcctttgcacaagctcatgtaatgattcatgattgtccattttcgttacacaggaatcttgcccttctgtgaagaacattttgcttc

SEQ ID NO: 22636 - DNA, 1501 bp, Oryza sativa
atatgtaatacaggattaacgagcattctaacatgtactcaagctccttagctccatacaagagagatttaacattgccattcaatattaaggttgatcttcacacaaaacattacaaccatactctggcatgtttggcattgccgcagtaataatagtttcactcattcatgatgaccagatctccaccgctagtaattaacacccagtacattttgcaaaaaccggttaccaagcaactacatattaacaaatgataatccacttaccttggagaattctcccatggcctcctctagatccccggtgccttccttcctgtggaggagacacggccaccgaaagcagtaagatcaaccacttgtttggcaagatccaggctcaaaactgcaaccagcaaaatattttttttaatttcttggaaacaaactgctgctgctagtcagggtcgatctagagaaggttaaggcgaattaagagaaaaactgccagatccaggggagaagacaaggtgaaggcaaagagaaaatggtatgggcagagagggttgagagaggatgcgtgtcgggggctgatccaacatttgggttgaacaaacagactgttacttgtattaaggttaacacaagcaaattcgagacaaaagtacttccggttggggagagcgatggatcagaaagaggatgtggatgctcaccaggatgcagcgggacgatggcgcacctcctccgctctgctctgctcgccggatggagatgggcgcccctaccaaccctgctctgctcgcgagtcgcgagatggagatcggcgcaggcgctggagcggaacgggacgggagattttcaatgacgcagaggggacgggggaaatactccagtactccagatttatgtgtttttcaatttttatcatttgaaacatatttttcaaatatacctcaataaaacttattttaaaaatggatcccctagcctcctgggatatttaaccttttacctttttaagatgtagcaattaattatttgctactcactatctatgatatgtggggcctcatgtgtttatgatatgtgggtccagtggtaaaatcttttatcaccactcataagattagcaaataattaattattccttgggtagatcttattttgcacatcttcgtgataaaacttatttcaaaaatggatcccatggcatcccctagcctcccatgaaagccaagatcttgtttggcacggcttcggatctcatatccacgatagatttgaagtttatatattaaattacaatggtttaaaattttaaacttcatctgaaatgtgcgcaaaataatttatctaaatattatcaacataattgtagatcttttgtggagctagaaatacccagctctaagaaatcttggatccagaattgtcccaaagagagcctaagccacgccaatatcattagcgctgatgacctatttgtaaaaaaaaaatacttatttgtgataaaaaat

SEQ ID NO: 22637 - DNA, 1501 bp, Oryza sativa
gttgcgactaccttctcgacaaggctgaaccctgggcggaggacaacacagtccatctccctgttctcgacgggttgctaggtctagtcacaggtgtgatagaggccatgagttccatggtctcaccgtcgatatagtagacatgacaaagccaagattccaagcacaagtcggtgatgagacaggcacatggattgatggtgatttggtaggagaggttccgcgaggcaacacggcacgtggtgggggcgatggttagggtttgattgggtagggggcacgagcgaagctgttggcgggttgaggggccgatggcagggagaagccgatggtagggtgcggtggagggagagccaatgtaggggagatctcgacgacaggttgggaagggagagcagctggtagcactctgctgttttgtgggagcagaagaggaacacaaggatttacgcatgtcttttcacggtggtaagacatggggcactcaagagagatggggtggatcatgggatgaatctcagttgctggatctaagatcctgagaaggatgtcagtgtttgaagggagaatcaccatcattattacggtctttttagagcaaggtcgataagagagccaactgatagctgcactggcttgctacgtcatctatagtaagcactatagcaagtctattcaatagaggttctgtatcacaaatattatttttactattttcatgggatccactatcttctctcattctttctctttcttcctcccacctcttctctttcgttcttccttgtcttctttgccttcggtgggtgctagttcaaaagacggtgatgtcgccgacggttgcgtcacggtgtatgatgacgggggcggcaggacatgatggacaagtgcaacgatggtagtgtatggaggtgacaagagcagttgaagcggacgagaacaaggatgacggcgacgcggcaaacaagggcgatggcctgtggaacacaatggtgatgactaggggcggcccctcgtccttgagccaagagtgcagctcgtccggttatctctatcatagatatcatttattattatacctacttttataataataaagattgtttttattttagaacctgaaataagtggcaatatttgggtgactaccaaacgggatttctgcacgtgactgtgatgtttttttttcccgaaactgttgatcattgccagaatgtcaccgcgcgagataggtgtgagtgtgaccgtgtgcgggtctgacgagagtgaacgaatgatttcttccaccacctaacccccaccgtctctccccctcccccccaatctcacaaaccctagcccccatgtcatcgccgccgccgccgccgccgacggaaatggcggagggcgaggtcgagagccgcgactgggcggagatgccgtcggacgcgctcgcggcggtgttcgggaagctggacgtgaccgacctcctggtcggggccggggtggtgtgccgcgcgtg

SEQ ID NO: 22638 - DNA, 1501 bp, Oryza sativa
tgaggtgttcagatattgcagctgatttcaccaatgcattatgtttctatcatacattaagctttctgaaaagggggaaacattttccctttcaaccaatcatgtacaataactttgcctgggcactagtgcagcaattgtaaaaacgtataccttggaatttcgaagagtgagcttatttagaactggacattgtttgagaatacaaggtagaggccaccaatcagggcaacacacccctcattgggtatcaaagttttcaacctgcttaacaaagggcaccatcttaaaccacttctgaaaattcgctagctaaagtgcaggcgagaagatcaactatttttttatgtgaatacaacaatttgaatgtcaagatagtagcaatgcattaaaaaagagagattgttaaaatgtcaaaatgatgaatatagttaagggaacagaaataaggcgcagcaaataacataaaggagataagatgttaacgtaggcttaccatttcaggtccagctaccaacttcaaactcttagcttttgataatcctcccaggagcacacattggcactatcattgccagtctcacctagcataccatgacaaccatgacagttttcatcctcacaataaccagagtaagtattactacaacgatcatcacaattctggtgaggtgtaacaattgctgcaactaatgatggcatgctttccagaaaaggtgtcctgccctagaaaccttcaagatggagtccaacgaggcttggtgcataaatgtgagtgtggtgatactcactgaactggcagaagtagaagcaaagatattctattgattggaacacgatcttctttacagaatcaaagcagcaatgatcagagaaagatagccatttcaatgcagggcagctcgagaagttaaggaaacactcctttaattctagactagataaatctagcttcctcaagtgccgtgagacaagaggcatgccatctgtaaaatcaaaggtgtttttgattattattctgggatgaacaattggcatcggagattattggttttgttatttggaatttattcacgaagtggttttggagatgattggatttacaggtgaatcgcaggtttgttagtttatgtgaccggtcagatcgggcagtgtgtgccggtcagaccggcggtgatcgtgccgtcggaccggccagcccgtggtctgaccggccgacactatatcggttttggtttcgggttgtttgtttggatatctgagtttatttcatgattatggcttctagatggatactatacgtgtgtaatattgttgtttgctactaatgagtcaagttggagatagcttggtcttggaatatggtttctttgtttttttcatgtgtaggtgacttgatgcctcgggagagtatttgcggtgatggaccgggagtcggcttggggataagacgacgtccgtggtggtcagagatcatgcgggatacttatgctagagttga

SEQ ID NO: 22639 - DNA, 632 bp, Oryza sativa
aacaccttaggaaaccctctagtacaagaaagaaactctacataaccaatcgtaccaaatttggactccttccaaattcgactccatatcccatacgcacacaatacctccatcatatgccatatggaatctccatcaaccacatgcatcaactctagcataagtatcccgcatgatctctgaccaccacggacgtcgtcttatccccaagccgactcccggtccatcaccgcaaatactctcccgaggcatcaagtcacctacacatgaaaaaaacaaagaaaccatattccaagaccaagctatctccaacttgactcattagtagcaaacaacaatattacacacgtatagtatccatctagaagccataatcatgaaataaactcagatatccaaacaaacaacccgaaaccaaaaccgatatagtgtcggccggtcagaccacgggctggccggtccgacggcacgatcaccgccggtctgaccggcacacactgcccgatctgaccggtcacataaactaacaaacctgcgattcacctgtaaatccaatcatctccaaaaccacttcgtgaataaattccaaataacaaaaccaataatctccgatgccaattgttcatcccaga

SEQ ID NO: 22640 - DNA, 1501 bp, Oryza sativa
tctgtttcaatgcttgattcctttgttgtgacgttaatcattttaacattctttgagaacgtctgatctctgcgtagcttagttactgaatgatgcaccctgtaagttttctagctcacttctgacagctgattaataacttaagacttccatgttcattctgatttttcttcttttctcaaagattgtttccaatgtttttatgaactagaaatgtgaagctggttcgtatttgcagtgctaaaatgaaacataaatcagcagttcaggttgttctggacaacgatggatttgttttgaacagtttgttaggtataaactgtggatgtcatggtccttctgaattcggatgctttatactgacattttctgtgtgaaaaatttggagctttcaactcatagtgtgagtcataagtgtcaggttagaaatgtctaatttgagacatgaatgaccattgagtgatgaaacattgagattgtctaacatcgacgacgtgctaccgtgcccaggaagaagttgatttctcttattaaagttggtatctcttattaacttgtgtaaacctgaaccttgttggaccggacgcctctcttgtcaggctacctaaaaccgtctgaatatgtccatgttatgcttctcattgttcccatcggtctttaaactattcttagatagtttcagtatatgtcatccatttctggagacaaaaattttcgttcatctgttgcatgacagcataagccattatttgcatctcaaattcctgtttataccatcagaagcagtgacagggtgtactgatataccatggaaatgtagatggaagtatggaacattccttcttgttcgaaaaaaaaaagatggaacattccttattcgaaaaaaaaaaagaagatggaacattcctgttctgaatctttcaaatcagtgaactgtacaagtgttgagaaatgtggggcagcagtacattgtagagctgtataatgttgtaaaagaataaaacagaaacccgtattgcgccgccgccatagtgtctggcaagcccaacatcgcgttctggcgcccatgcatgaactactggacgctgatgctgaagtgggacgcgccgaaaatacctcatccatttgttttgatttgaaaaaaaatatgccgttcatagaaggcatcatctgtatctcaaatcccaatttctaaaatttctaaggcttcgttcgttcctgggcaatctggggaattgagagagaaaatcatctcgttttccgcgcgcacgcttcccaaactactgaacagtgcgtttttttaaaaaaaatttctatagaaaagttgctttaaaaaatcatattaatccatttttgaagtttaaaatagttaatactcaattaatcatgtgctaatggctcacctcgttttgcgtatcttcccaatctccccaatcccttctcctcaaacacaccctaaatatccattatacacggataccaccataagcgggaagaaatt

SEQ ID NO: 22641 - DNA, 1501 bp, Oryza sativa
ggtggatgctccagcttaccaagggtttccttttcaaggaatgataaagcaacaaattgatggtgttgataagatgttgctatactgtcatcaaatcagcattgtatattgcagtgtttctgaaaatatagtgtatgatgtgacagggactcctgtcatgccaagcaaatggatccatgttgtagcagttgggaggacatggctattatctgcttttgccctgataaatttcctagatgctgggactgtgcaattggcagtgaagcttgtgcatgtcaagattgctgagatgacaagaataagatcttgggatccaggtattgtcaatttagttactataatagcttgccaaatttctacagaagtgaagaagggagggagtgatactcttgatctcagctcagtttgcaagtacaagaatgctcatgatagtatccaagtgggcacagtatctagcatttctctatcattgaccatatttgttgtccttccatatagaaagcttgggactagtatcaagatccctaactataattctggacaaatggaggtgcaatgcatccaccagagtgcaagttttgtcacttctattggcatggagtcgtctcttgtggttgcattttatggatcagctggtgcttacggattagctcttgatgatcacttgcagctaccctgggatcctggaggcactgatcttgagcttcaattgcatcagcttggggacaagctgattttcaaggcggggagaatgttatgtaattgggtcggattggtatgcatattgagctcagggctggctaggcccaatccgctgcgctaagccgaccactccagccactacaaaaggagcagagccaaaacagtacagaatagaacagataaaacttgacttcttccttctaatgctctctcttcttcaacctctgtacctctcttctcttctccaatctctatctatgtcttcttcttcaacctacagctgattcccagtcttgattccatttcctctatttgtatccccaaatactcatgtatcaagtgttggaggaagaattgtttgcttgtgcataaattcactaaatcacatggagtgggttcgtaacacagcaacgcatcttagagctgtgtaaattttgtgaaagatcagaacagaagaattttttttactttgaatatagaaagcactatagtataaacaaagataatcttctacaataaactgaaattaatgcagaacaagcagataccgtaacagagtaatgcttggagatcagtgtagaacaatggaaatgcagaacaataggaaaacttggcaagcaagaagaaaatgattagcattcgcgtggcttcagacgaggagcctataaaatcacagcaattcccttcccaacgaatcttcccacttgccctcttcttcttcttcccaccattcccaatcccatccaaaagtttccagaaactcatcctcctcctcctcctccccctcccatggccgacg

SEQ ID NO: 22642 - DNA, 1501 bp, Oryza sativa
tttaactttgaccttgcaaattcacaatgtgttgtaagtgactcgatgtctggtttcaaatgagtggctgttgctgcatgatgaagcactgagttgcctgaatttgacgacgtgctgccatcaacaggaagaagttgatatcctgtaatattgcagattagaattctactggcacgttaacttgtgtgacccttgattgagttgcaactgaagactgctacaggttgactgattgatcaattgttgatgactggcttttagttgcttgtctgaactgctgtatattttcagtgttttgttcagaatgacataggacttatgaaagttgcctcttgcctgccatccctaaacttaagcaactgaagaaagttaatggttcagtacttcaatcacaaggctacggagttacattaattttagctggcattctctggataatactgtggcaagtttttacttacaataggagtatgtgagttcattaatctcagctgaaattgaaataagtacagtatgcattgcccaggaacgaatatcatattcttcaatttttgcactgaagtgggaaatgaaaccagtttagttacttgaatcagcagaatggaaatgaaaattgtgacagtgatgtctgcctatagaaattaactacgtattagattgaaggggcattccctgttctgaatcttccaaatcagtaggaatgtggggcagcaacccatcttacagctgtgtaaattttgtgaaagaacagaacaagtaggaatgtggggcagcatgtcatgtaactgggtcggattggtatgcatattgagctcagggctggctaggcccaatctgctgcgataagccgaccactccagccactacaaaaggagcagagccaacaaatggggaagaaaacagaatagaacagaacagataaaacttgacttcttccttctaatgctctctcttcttcaacctctgtacctctcttctcttctccaatctctagctatgtcttcttctccaacctactgctgattctcagtcttgattccatttcctccatttgtatccccaaatacttatgtatcaccctgcaaaaaaaaaaatacttatgtatcaagtattggaggaagaattgtttgcttgtgcaaaaattcactaaatcacatggagtgggttcgtaacaataaggtatcagagccaacaatccgtgggattccataccagaaggcaaggtggatgacacacagtggcagcagtgacgtccagaggctagatccaagcattggaggtggtttcactggaggcgcctgccaggtgttcggagaaatgccgagctggctgggagctggtgctggcgctgttcttcgtgtccaagtgagccaagtcctttacccgatgactagcgaggtactacatcaagtctacaacggctatggagcagtggcggtgcaagtgctcgccacgagttgttggggcattgaggcgctagtctggttccggtcaagctatg

SEQ ID NO: 22643 - DNA, 1501 bp, Oryza sativa
tccgacgttgtgcttagaattgtcatcactgacgtcagcaatatattcaagagtttcgatatatccaagcttatggagcatgttgtgtagttacacacgtgctacgtactacatgcatgcatgtatccgatattagtatatctgaacatttttttctatttatggccacagagaaaaaccacatcataaaacatatcgttcagaacaatcgcatcgagaatacatgtatgtacacttgtagacaaattgtcttaattttgaaaataatacattttctcgatcggtgcatagtttcgtgctttcgatatagaaatggagatggctcaaaaaataataactaattgtgaagacgacttgttcgttcaaaaaataaaattgtgagatgacccgcgttgaatttctatgatattcatccattttaaatttctctgactatttatatttcataggaaaatgtgtacacacagtagctaggtatagaccataataattaatattacacatgatttgaattctctgggtccatccggaaacggaaagctttcttttccaacaaggattcgtgctggtaattaactcatcgttcgtaaggaatgcaacactgtcattcctatgggcgcaatgttcccgaccggaataacacagtaattcttgacagttgaaatacgagaaattcgataatatctacatgcatctctcaatcaactaagtgtacgttgatgtacgctacctgtatatatgaagaccacttctatagttaatatagcatcagataaacattttttacttaacacataaaataaacatttatatatgcagtccataatccatttacacaggtattttttccaagctgccctataaaagtgcccgtatataaatcaaggatttgtgcgggcggattccacaaccgctgactcccttaaggaactggccataaaaataaattttcagtttaattttgtaggcgcaaaaagaatcctaaaaaatattttatattttagtagacatgtagtggaaatgttcatttgacgaggtaaataatctgaaaagaaactaatccttagctggtgagaaaatcttagtggaaatgttcatgagattatctggcatagcttcaactactgtgctgtgaggaaacaaaagtatagacactactgtgaattcgtgatcacaattcacaataaggttagggtccttccactttccaattcccagttgccaacttgttggcaaattacacagacagagcgaagcacggaaagatgcaacttgccctctaactacacaacgtctgtctccacctatatataaacccttccatctctcccccacacatgcatagcagtgctagagagagaaacaaattaaccaagaaatcctcttaagaaggatactgacagtgcacgccagctagctaatcactccaccagtttcggggaaaaaatatcaaggatttcgagatcctagctcgctagcaggtgatcgatcgatcgatcaa

SEQ ID NO: 22644 - DNA, 1501 bp, Oryza sativa
tagctttcatgaaagcatcgatctcagggtctggcttaatgcctgcattgcgttcccttctagagatttccgtgagcatgtcgtatcttgacccaatacctaagcaccacctagagaaatctaatgtctctcttacggtcatctctgcattatggagatcatattgactaacataggcacttgtccgctctggatagaactcggaaaatttatgtccacaataggtgatattaccaaatacctagattgtgatagaatgaataagcaggtagcagtaatgcatcataagcaatataaaatagtaatattccatgagatgactggatttgaatagaaccttgaggtttttatcaagtttcccagtgagcgctcgcataagtgtgctttttcctgatgatggaggtccaagaaggagagtcatcctgaaaataatactagtcagattaaccacttttttctacttatcatattatggcattaaaatttcttacaactaggtgattccccgcgctttgctgcggaaattactaagcaattctcaagaaaatatctactttcttgtatatacatatatttctattagtatatgtatgtaaaattgattgaatgatggttggaaatagtaaatatgatatgatatcttgattgtattattgtccaattgagtacctgattaaatatatagcatttagatggggtggtgattcatggcgttgtttaattggtgaggaagtggaggggacttttatctaatggctaatactagaaagacttgtcgatccaacggttgaaactattttgatgatgtggctaaatgtggtgcctgtttgtggtctcacttatatagaaagcatagataagaagattggtttctatctgaaatgtttcgcaatctcctctatacccctgaattttgcctcatcccctacatgcccttgagcttttatgttgatctcttctatccttattccgttagttgaccatgagttgactgttaaatttttctaaaatgaccatattgcccattttccattgctacagttacatgctatctactctacttcataattcacaatatgaaaaattgtaactcatgataaaatcaaatgggacataattatttatttaaaagaaaatttaaacttttgaacaaatttattttttttggacaaaatccatataagagttttagctagaaattgtgaaccaaaattatttatttgttgggttcaaattttgatgaacacaatgtacgaatatcatgaaatttaatttataatttatttaaaaaattttgatttatttttaaaattgttgtcaaataattatattccctttgtttatttacaaatagattttttttcatataagaattgtgtttttatcattaaactagcacataagtataaaaaaaggggaatataatcaatttcaaaaatatttaatgggtaaactaccggcaactaacggaatgggcatagaaaaaaatcaaataaaaact

SEQ ID NO: 22645 - DNA, 612 bp, Oryza sativa
caactgacggcagtggcatgagaaggtgcgcaaatttagacttatggcatataaggaaagaaccaatttttagtggtatataagagatccgaccaatttttagtggcatataagggattattgcgtatatcaacgtactcctatataatgtactgtatataacaaatggtacgacgatggacagctggtcagctagcagccaagcattggctgcgggggaaattattagcagctgctaatcactcacgtatagttcgtacttcatttcttctgtagatgaagatagagataaggagtaagttttttaaacaaaacgagatggtattaatgaatgattgattgagttttaattattataaacttgaaaattagattaaaatgatattttagagcaactttcatatagaaagttttccataaaacacaccgtttagcagtttgaaaaacgtgccacaaaaatcttaatcttcatccaacttttattggagaaaaaaacggagccatagagcgggtgcccgtgggatgctggcatctaggcgtatatatacacatatagcttagcgtatgcttgagttaagttgctgcatgccaactgagtaatcaaccgatcga

SEQ ID NO: 22646 - DNA, 1501 bp, Oryza sativa
ctcaaataaatcccagaaaaatctaggaactatagaatcaagagaagtatttaataaaattttatctagtccacttttatattggaatttattacttaaaattagatcttttcttctaggcttttaaaatcatttcttataattctatttaaacaacaatttataaatttgggatttttagggcgtgacatagggggagtgttcgtctgggtcgattaaggactaaactatgtgtcaccaactaagatgtatcatgcaaccacatgtgttatttattggggtaaccttagcttactaagttgcttattgactaggcttgtattttggtaggctgaagtaatatgagttatgatgtgtgttgatgatgattctattgtgttgagtttaactcaaaggagttaccccatgtgtcaggatacggcatgggcgtctaagtttgtccaatacggcacgcagaaccattgggttgccactatggcgttaggtttaaggtgtgagccgctacctaacaacgctaggtcatatgccttagtgtgaattttcactcaccattgttgatgcaaggctagactttgaggaatgtaacaactacatctcaagtgttaaatcaggtacctttcggtatcgcgtggcatgcttgcatgattactattttgtgtcatatggatacattatacaaactctgcagattctaaactaattgattaactgttctcatggtcatgagcgatttggtgaaatgatacaagtatagtgttggtgatttttgaaatgatatgtgaaattggtatggtgtaaattcagtgctgattttgcccggtgttagctgagaatgaaatggttacttgctaccatggagtgcacaagtatgatattattatgatgcttatgttactattattgtttacttgttgctttacaaatttagttgcaatatataattattactattgcgaataaaaaattgcttatgctaaaatttagtctacaaagataacctcctttgatctcagcttgcaatagacatatacttcacatggtttgggtagtacttgccaatacatatgtattgacccacctcttattgtttttttttagacattgatgttggaagtgaaatgcttagggacgagtactttgcaccgtgtaggaggtttcgaggatggttctttctaggttgattccctatcggtttctgggttggtttggtagatgggtataccaaaatgatattttgctattcttattatgctacgtttaaactctttcttttggctggtcgaccctatttatattgtatgacttatgcactcgctatgttatgtgaaccatgttatctatttgtatgcatattatgtatggatgtgatgatcaggttgtggactcatgtactatctactaatcatgggacttagacggtttatgcttcgggtattcagaaattccattcctagatgccgacagccatggccatggccaaggccaatttgccctttgccag

SEQ ID NO: 22647 - DNA, 1501 bp, Oryza sativa
gagaaagttgaagtaacgtgaggaagtgcaattaatcgatcattgttgttccttgagtgaaggtgtgtgacaataacaagagattttggttaactacatcatcatgaagtcaacatgagccaacagaaacaagatccatgccaacgggcacgctcattttctagttctaacttaaattgagatttttttagggacggcgagagtacagaacagagaagccctggcgtcgcagcaggtaggttggcacttgccagtccaggcctgcacaccattcaaagcatttataattcaaagcatttataatgccattacaatttgacaaaaaatagacatatgccactacttaccacttcaaagcatttataaaaaaaaaagaccaaattgaagaagttgtaatgcattgaagtagatgtttaataaataactaaaaaatttgagaaaacaatttctgtgaattatatatgtaatttgctgaagctttgaaaaatcatagagaattcattttcaccctgatttgagtgaaccaaattaccattgatcctcataatattctccttcgtgtggttaagtaaaaattttttgacaaatatagggcagatctacagctaaatctgaattttcaaatagtgaatagtaacctttgcaatttcagcatttttaaactttgaaagctttataactaaggcgtatgaaatcagattctaatgattttttcacctaaatttatctaaaatcatcctatatctactgtactagtaccatgcatgtttgagcatttttaatatttggtgttcattcgagtttcatttaaatttgaataaacgacaaagttacagccgtggaggagtgtgagcacgaacctgatacttgtgatgagttcactgagtaaggcaagtcctattcaattcctcctccgatcatgttgtatgtctatattttcgtaatgcaatattgtctataacttgtatgcgatgttgaaaaaattgggtaccgatagaacaactcctacttgttacattatccaccttgaattattgttcatattcctgttgatatacctaggatgccttgtagtagtgtccaagtaccaattttagtatattcgagatactaatatagctattgcttagccatgcctagaaattttgatggatatcaatgacacaatattcactctttcaaattagtcatttgataatattggacaggggtattgcctctattatttgtgaaaataaaaactaaaaatgatggttttagaattgggtggcaagtgatgtgcataaggtgatagttgcacattgatagggtgtcacgcccggaatttctatgcaaaactccaaacgcttacatgcgtgtaaaccctcgtccaggaatcagccgaggcacacaataacaaattgataatagagtacaattattattccaattaataggtgaatataaagtcattacagaggtagatagttcctctcaaacaataaagatctaagcagcggaa

SEQ ID NO: 22648 - DNA, 1501 bp, Oryza sativa
ttagtagatagtacatgagtccacaacctgatcatcacatccatacataatatgcatacaaatagataacatggttcacataacatagcgagtgcataagtcatacaatataaatagggtcgaccagccaaaagaaagagtttaaacgtagcataataagaatagcaaaatatcattttggtatacccatctaccaaaccaacccagaaaccgatagggaatcaacctagaaagaaccatcctcgaaacctcctacacggtgcaaagtactcgtccctaagcatttcacttccaacatcaatgtctaaaaaaaaacaataagaggtgggtcaatacatatgtattggcaagtactacccaaaccatgtgaagtatatgtctattgcaagctgagatcaaaggaggttatctttgtagactaaattttagcataagcaattttttattcgcaatagtaataattatatattgcaactaaatttgtaaagcaacaagtaaacaataatagtaacataagcatcataataatatcatacttgtgcactccatggtagcaagtaaccatttcattctcagctaacaccgggcaaaatcagcactgaatttacaccataccaatttcacatatcatttcaaaaatcaccaacactatacttgtatcatttcaccaaatcgctcatgaccatgagaacagttaatcaattagtttagaatctgcagagtttgtataatgtatccatatgacacaaaatagtaatcatgcaagcatgccacgcgataccgaaaggtacctgatttaacacttgagatgtagttgttacattcctcaaagtctagccttgcatcaacaatggtgagtgaaaattcacactaaggcatatgacctagcgttgttaggtagcggctcacaccttaaacctaacgccatagtggcaacccaatggttctgcgtgccgtattggacaaacttagacgcccatgccgtatcctgacacatggggtaactcctttgagttaaactcaacacaatagaatcatcatcaacacacatcataactcatattacttcagcctaccaaaatacaagcctagtcaataagcaacttagtaagctaaggttaccccaataaataacacatgtggttgcatgatacatcttagttggtgacacatagtttagtccttaatcgacccagacgaacactccccctatgtcacgccctaaaaatcccaaatttataaattgttgtttaaatagaattataagaaatgattttaaaagcctagaagaaaagatctaattttaagtaataaattccaatataaaagtggactagataaaattttattaaatacttctcttgattctatagttcctagatttttctgggatttatttgagccaagaaagtatttttaataaatggaattgcatttcatgaataatttaaaaggaaaaaggtttaaaaatccttcttttggatttgggccgaaagctagc

SEQ ID NO: 22649 - DNA, 788 bp, Oryza sativa
gggagaggtggggccagcaccgagaatggtggccggcggccatggaaggtggtcgggaaaggcacagccgttccgggtgatggaggcacagccgttccaattaattttggaattatctgtttgaatcgagcggattttggggaggactcaggcaggttttcacggaagtgaggagaggaggccggcaggaggaaggagacgagtctgacaggcgggacccacgtgaggcgcgcggtcagcgcacgtgcgtcgcgcgtgtgtgggtggtgcggctggcgctgggccgcgcgagggaagcggctcaggcgggaggggcaggatggctcgggccgaggcagcccgggggagggagagaaggaggtgggacggcccagggagaaggagggaaaagagaggaacaagtacatcaaaggtccctcaacttgttatcgagttacaaaattgtcccctaaccataaaactagacacaaagcatcccccaacttacaaaaccagtgcaaactaggttcctcggtggttttgatgcctgttttatctgacgtggcggctgggtcagcttgagacccacgtgggccccacatgtcaggtgccacatctgcaggttctcttccccctcctctccctcctctctctcactcttctcttctcttctggcaagccggccgacggctgaggaggaggccgccagggcgaggcgggagaggtggaggccatggtggcggctgcgatgctggagaaggcgagggcagcgacggcttatcttaccttagcttagcttccatcgatca

SEQ ID NO: 22650 - DNA, 936 bp, Oryza sativa
acatgcgggacgggaggggaggaagggagggaccggcaccaaccgtggttggctgctccgtgtggcccgtggttacggctgctttctgtttggccgtttcgacgaacactgcgagtgcgagcctaattaactgcggtcggattcagccttaagatccgtgctatctggcgtcgatccgacggtgttgattgatttcatctagtagcggacatatctatctaggagtgcagaaagaaaatttcccggtccgactagctttcgtgaggtgcaacacatcaaggcttctgttgttgtacagtcgtgttccttcatgaaggaaacaggtacaagctgatggccacggaagcgtcgtatttcgttgtgtccaacatagaaacctcctatcacatctcgcttttagcaactactatcaataataaaccttggtccagactctaaacaacaagtccctgtcaaactttcgttgtatttacatgaaaatccttcatcaagattcatttcgttgatgcctgcataccaacatcaataataaagtatattaagaattggtgtcctcccagttctatagattgtttttttaacaagtttgtcatcatcatataaagctccaatagttgcgtaggatttctaatgtattttatacctttatattcatttcaaaattcgtgcattacctaacttctcctgttttttaatctctaagagcaactccaataaactatcacatagctagctcttcaactgacttggagagccaagcttgttgctctaacactctctctatttacacactctatttcgaatctataataccgggacacacatatcaacctctacttcctcattcttcttcctcctctttctccccttcttcttctcccgtggccatccttgagctcttccctcggcgacagcgatggcagaaccatgcgctca

SEQ ID NO: 22651 - DNA, 1501 bp, Oryza sativa
aggagaggccgtcgtcgccgacggccaccgtgacctccccgacgccgtccaggaagagcgcctcgccgccgccttccatggcctttcccgcttgctgttgcttggtctcacgactcctccccggtcacccgcggtgggggaagaggaggggcaaatgcgaattcttcctctgtttttttttcctttttcagttgggtctgtgcgcgcttgggtccgtggtggctgctttcgcgtgttcgctggctggacgtttttgaccaacggcgccttttcttgtcagtccttgtgcttgtacagttcaataactttgccaacaaattatccgtagcaaacgactattcttactgtttttacttctcttaaagtttataaaatatggagaggtcaaaaaaaaaatatagtggtttgaaattacaagagagtgccatctcacaatcacttataactttagagcaagaataatagtttcgtcgacaaccgagtacataacatctaactcatctgcacaaggagctttatagcaaagatcatatgcaatagcaggttgttaaattagcaaactgctaaaacttttgcgtagatttagcatggctagtcgcacatgtcccacaaaaccacgtgagtttccgtcagcatgggctgcaagtgggttacgatctcttttttccggtgctaccacctagcgataaatcaactgctcgtatttctctctcttcttctctcaatcttctacctagaattgaggtaatgtggatcaatttatcacccgctgactcatctttattgtatctgctattaaacttctcgaatgaaattggataaaattctggatactcgtggcacgtttttaaaccgctaaacggtgcgtttcgtgaaaaaaaaattcctatataaaagtggttctaaaacgtcaaattaatttgtttttcaagtttgtaataattaaaacttaattaataaattaatttgcttttcaaagtttgtaataattaaaacttaattaatcatacattaataccaccttattttacgtaaaacacttaatctttatcttcaggagaaaataacaccacccgatggcatgcctttacattttcagcagcacttaaaacaaaatataccatcgatgcaaccattatatatttaaaaataaatctatttgattttatatggtttgaggagaaatagttgattcggtaagcctattgcataattgcacaaacgacgacgagcagcagcagcagcagcaccaccaccaccgcttcgtccgccccgtgccccaacggccgacgctgctgcacggcacggcccccggccgaatctgccgtgcgcgggttggcacagtggcacacgcccaaattccatccctcccgtccctagccggttcctctccttcctccccccctcgcaaaaattcaaaaaaaagcttgcgctcctcccgtcctccggcgccgatctgctcgaaggaggccacccccaacctccccgaccaaaccaatgg

SEQ ID NO: 22652 - DNA, 574 bp, Oryza sativa
gcgtttgcagcatcaaagattccttcactctctgcttatctgcaggccaaaaatgttgctaggtatacggtctctctttcactgatgagaggacccacctgtcattcactgtctatcataaatataaagaggttttgagctatatttcaattgattgcttgatttgttgggatccaattgtcccttgtttagctacacatggtatattcaaaaactcggtgaattatagtctagtcacacttattagtgtatatataagtcatcgattgtcaagtgaggctcatttgcaagtggcatcgaatctgtttgagctcaccacactactacagaaaagttgattggtgctaggtggcaaccagccataggtaccggatttcgtaaccaacacccagcaagtggcacctttgacgaggactcaaatgtgccggttcttggttccaagaatgaaaaaaaaaagacttgattcaagccgatgcatcgagcagttcaccttcatctctcagattccatcacccctaagatcaatctaacatccaagaacacattcatagaattaacatttcaacaacacaaa

SEQ ID NO: 22653 - DNA, 182 bp, Oryza sativa
cgccacccacggcgtggcgcttgagaccacggcgcctcttcccggcaccatgccggatgacctcgccgccctcttcgcctctgcgcgcctcgcgcatggcgtccacacgccggagccgaccgtccccgacttctcgcgcccacccgccactcctctagacgacgccgccttggcagcactcc

SEQ ID NO: 22654 - DNA, 874 bp, Oryza sativa
atgagagtggatatggctcaacgcgataatcatgttgatacacgaagagtattacatataggcgctaaccttccatagaacactcgaccgatttatggaagcatgatcgggaggttttaggaaagatggctaattagagatacatgccatatacagtctaacagcggcagaggcgcaggcaagcgacaacagagcaggtgcgggcaagcggcgacataggcgcaggccgcaggcaagctgcaacaacggagcaaagtgtgaacccggactgggtacctgtctatctttgctatttttctttactgatgtataataattaacattgcaaataatttattttattttacactgatattagggcaccaagagcagcatgattcttggttcttagtttttttaatgcatgaatcggactttttttttcgcccttctttactggttttttgttttcttatcgcctttttacgacttttttttctttgtgtcaaatcggactttcttttttcttgtttttatgttttttcgcagagatagtgatgcataagagatacaaatagatatttcatgatctcttcatgatcagagattctatctttttttctgttttttaatttttttctctattttcatattattttcgaactcttctcctcttacgagtgtatcaaaattttattcttccagatcagaggttttcaaatctacttgttttctgatatcctcatagtcaaagattctatttgtattttcagattttttttcccgatctcttcacttcttttaaattcagaggttctcatttttagttcatttcgtatttgctccacagaatcttcgtctacctgcagtcccgtcgctctctcaccagcagcca

SEQ ID NO: 22655 - DNA, 717 bp, Oryza sativa
tagcatagtaacgacgccgcaaggcccacgcacacgcagacgcactaagccccggtagttttttctttttttcgccttttttcggttttcgctttttttttcttgaatcgctcccttattttcttcgcgtggtcgcgcggttttttttcgtgctatattttataaattgaatctttcaccttcaatttcagttgaaagttttaaatttgagttgaaagtttttaaaatttaagttgaatgctttgaattttgagatgaaagttttcaaatcttgatttgatttttttaaaaaaattgagttgaaagtttcaaattttcaattgaaaattttcaaatccgagttgaaagttttcaaatcttgacttaaaagttttcaagttcgagttaaaatttttcaaatcttgacttgaaagttttcaagtccgagttaaaagttttcaaatcttgatttgaaagttttcaaatctaggctgaaaaattttaaaaatttttgagttgaaagtttttaagtccgagttgaaagttttcaaatcttgacttgaaagttttcaagtccgagttaaaagttttcaaatctaagttgaaaaattttaaaaattcttgagttgaaagttttaaatctttacgtgtgcggtagtcaaatgtgaaaaaaaaacgtgacagggccgtgtagtccacggcaaaaaaaaaaaaaagaaacgtcatagcgccaaaaaa

SEQ ID NO: 22656 - DNA, 1501 bp, Oryza sativa
gactgctgccgactggtttcttcgcctccacggttgtgcaacttcatcacttttgattggtatcactatcttcactaccaccaatatttttgccacctctggtgggcaatattatctctatattggtcatcttgtctctatgccaactgcgtcggctaccatcaatggacaattatgactacgacagaaagacaagctatatgctcaggggcttactagctcaaacacaagtatcataccttcaatttggacttgttccggatacatgcaacatgaattcatgatcatgggtctattttctatgctcaaagactggactatttattatttctcgtaagggttatcaaccgaatacttgcgctagtcgggattcaattattatatctattttggagtatcccataagggataatcactcagatcataagctattcatatgagctacacttggtctatatcacccggaagatatattactcgggagcatgttacatgcgtcatcctttaaagggtgtcgaaggcatattttttggcctagggctaatatgttctgcaacccatatttttaggtgtggcctatcacgttcttttagggacttaggcactttttgcttagggcaaagtgtgcgtgatcaagtgcccaataccttaaaatccttttgtaccgtagttactcaactttttagtagttggtacaatgcatcttaaaaggtgtcaaacagtaaagctttatatagctgccccgctgacttttttatataggttaaggtactgtttgggtttttaagcaattgattggatataatatcgttgctttttgccatgtaagtgtgcatttttattgaccaatattaaggcttaggctgattatatatcttggtcattttccaggcggatggtaaatcctttatgagtttatttacttggattttacaccacatatgccgtatatttcttggtgtggtgaagccatgtgtcttttagggacttaagcacatctgttaaagcagtgtgcgcatggcgtatgcccaatactttggaaatttctttattcacaacatacaagcttctttatagcattttgctatgtgaattttcaaagatgttgtcaactttaggttgcacgcatcatattctacaaagcagtcggtatatcacttggatcatattattcagcatttcacaccgcatatgctatatattggtatcaagtcacttggttgactatatttatcaaaaaccactcagttggttggattatttattccctgactatatgcttggtttattcaattaaccccatagtcgggagctacacctattaggtgcatctagtcgatgcacctaagtttacattcagttatttttcagccctccacagtcttcagatttggtaaaagtactcgggagaccatggcaaagatgattgaagcactcggctttggagtaatctggttcgagagaagattatcttttcgactgtgaaggtctcaggggctag

SEQ ID NO: 22657 - DNA, 1501 bp, Oryza sativa
gctcatgttgtgcctggtccttgcattctttctgttacgttggggcgacgagtaattaaccagagatggatttacttgagcgccacccacctatgtctgaaaactttttttttagacttttttattttttttaattttattaacagaccattccaaaacgtatttgtaaatctgaaccttttggccgcctggcgtggccaaatgccaaataactctatcacgtcatgtgcagctagcgggcattgctacgccagcctcttacaaggattattattatataaaggaaaaattacgaattactccctgaactattggggtcaaccgatttgcccccctaaactcgaaaaccggacatttgacaccccaaactcttaaaacccgacaaattaccatcctaacacggatcgcagcggtttactacctacgtggcacacacatggcgatacagccagcaaaaacaaataaagaaaccagtggggcccacttgtcagtgtttttttttctctccttctttgcctctctctccgtgagcagaggagagaacacatggctgtggcgagccaaggacgcgctctgcctccgcctccaccgccgaccgcccgaactcgccgcctccaccaccagtcgcccgagcttgctttgcgttcgccggcggacatggttggacggccacaatgccgacgaccaggacgacggaccgttcgccgcctccaccgcgtcaacgagagaagcagagaagggaaggggaaaaattgcagagctcgagcgtgaggccgtccatcctcgccaacccttcctcgacgacccttccgtctgccccatgcaccgccacagtagcctcatccatggcggcgggggcaagaagtgcggcggcaagcggcggctcggcttggctcggctagctcgctcgggcgtcgccatcacacgccacccaccagacgagggtggcatcggcatggccggacgctggcacgctgctcgcggcgatgacgcgatctacccgtggcaatgtcacggaagaattctgagagaaattgaatcgacgaacggtgtacatgcatgtacaggttgtacagatgtgtgctgcttgccggtgtgacggggtagttttacaggagcagcaacgaagcggggaacaccaggagcaggagaagaatcaggtggcatcttaagcggcggcgagcagcggcgggcgcgatggccggggaggggaaatcgatggcacggctgtgtggctccggttgacagcgatgtggagattatgggtacctcatacccacacggcgtggttatccgactgatataggggataacttatatctatgaaatatgtaacggatcatgacttgggtattacgtttcttatgaaacggcctaaagtcctggtttgataagattgtaaagtagatttaggaaaccgataccatattgtttaaggtttctatcttgtaatcctgccccccatcctatataagttgggcaggaggccctctagggggca

SEQ ID NO: 22658 - DNA, 514 bp, Oryza sativa
acgtgtctcatgtgttgggacgaggctcatgtgttgggcagtcacggagtgcgggtaaagtgtacatccactgcagtgtgagtaaaccaaatctattcgaatagccgtgctcgcgttattgagcaccgggacatgtattacacttggctagactctaaattcttaacttgtgggggatgggatattgcatgatgaattttatgctgatggagccacattctgagaggagggaaggtggacatcctcagaaaaccatgacgattcaatggcgggaagctatccttgggatcacaatggatggtggacagaaccgtcgttgtttaaagtgaacactggtgctaaaatttgatcagtctatgctaggttttaggcttgtgaaaagaattgtaaaattagctttatgcaaaagaacctgaagccattccttgaaataccctctatcatatgcattgttgttgtggtggcttgctgagtacggttggtactcacccttgataattatatatcttttagg

SEQ ID NO: 22659 - DNA, 1241 bp, Oryza sativa
ccacgtggcgcctggggtagcctcctccctctagttcggctagggagtggccaccgccctacctcgggcccgacccctctcgggggagggccacgtggcattggggggcagcctcctccctctaaacatgatacccccgggcccatatcaccgacagtagcccccggcgttagtcctaaccaaaacctttcccaggtagtcagggttgacgccaatctgctagtcagttgacatgtgggcccgatctcctttcctatcattctgggagttgggcggtgggagtttaatcacgttcatacgtcgccttaacttcccactttcctcccggtttccgaggcgctgtgggatcgggaatttagcccgcaccttaggccgtgaacttattacctatatatactcagcaaacgttcttatattctctcgggcccatgaccttacgccgcgtacctcgtttgcccttgccttttgttaacctctattcatgttctactttcgcgtgagtgtgaggactgaactttccatagccagcaatcttcacccgcgatcaagccaagctgggcgccgtagccagccggcggggccagagccaattgctacggaagagccagcacaggggccccgggcgtcgaggcgtccagagctcaacgcaaggctaggatagagctaggaatcgtagccccctcgcttttagcaaagaatcgtttgaatggatgaaccgaatacaaactttttgttaccaaggggggcaaacgagcgcgcgacacgtgggtacgcgggaccgcgaggaagagatgggagagagataaatataagcaataataattctatgcaaacgattatcttcgcgcgagtgcgaggactaaatttccatagccaacaatctttacccacgatcaagccaagctgggcgatgtagccagccggcggggccaaagccagccgctacggaagagccagcacagggggccccgggcgtcgacggcgcccagagctcgacgcagggctaggatagagcaaggaatcgtagcccccacacttatagcaaagaatcgcttgtatgaatgaagcaaacacaaaccttgcttgcatgtcacgacctttcaaacctttagctcgaagagggcctcccaccatgggttcctaacaattttgggaagcctgcgaccacttagcaaatgaggtgaggttcccacgaggctgtgtccccacactacacattctgtttgctctttcctttcagt

SEQ ID NO: 22660 - DNA, 405 bp, Oryza sativa
ataattaaaagaacacactgttccactgatggaaagcatatcattacttaaccaataaacaatggtttgagccacaatgagtactagccacagaaagtaactacgtggttgattaaaagacaaccttttggcaatttaaattgactaaggtttctcctttgagtggcaaaattgacgattaaaccatcattctaagtatcaaaagccaaaataaatatcacaaaatgctcacgacaatttattcagaaagccatgaccaacaagtggaacaatttgaaagatcttagctcattttagaattaaaaagaaaagaaaagaagggaccctaggaaagctgaattcataggaaagcatgaactaacattaaaaatatgtaatctgtcaaagttacccatgctgtcacca

SEQ ID NO: 22661 - DNA, 1501 bp, Oryza sativa
gttttgtgtagtcttccatgctcctgcttcaaattccctagggagatttttggacgttaatagattcattaacatctatatgaactgtgggcaatgctagaaagtcttataatataaatgtagattcattaacatctacatgaatgtgggcaatgctagaaagtcctataatatgaatatgaaacggaggaagtgcatttaatagcactatgttggtgcatacctagagaaaaattatcagaactttggagacgagcttgcattatttaatatggatgaagggggtgatccgatgctagtactaactgattgaaagtcaaaattgttttcattattatgatttatgacacgatatgtaaattcacgcctatccgatgctaggatcatttgatttttttttctagtcaaacttttttaagtttgatcaaatgtatagaaaatatactattattttcaacacaaaacaaacataatatcaaattatatttaatgttagatctaataaaactatttttatattttagttgttaaatttttatataaactaggaaagtcaaacaactttactgtatgaaatggagggagtaaatgacactgtgcttccccctcaaatgcacgcttagagcacccgcaatggtaaagtaatgtgctatctataaaacatgtacatctcagcaatagactagattaatagtaaatcacttcaatggtatgtctcaatgggtatctatagctctctaattcattgcctcgtttttctctatagactatctctaggttagtagataactttgctctctctcttcatttaatctcttccaagtagaaaaatatgctgacatggatctcttgtagatagcatatagataaccattgagggtgcccttaggtatgacgcggcactatggaggcctaagagttacggtgaggctcaaaggttgcggctggaggttgaagaccgttgacgagtaggcctattggcaatgaaaaaggatactaacatacgggggataatacgggggcttatcgccggttatggtagctgtcgaaattgctacatctgcgacaattcaaaacaactgtagttgacagccattgacaattgtcacgactatagcggctgcgacgacaagtttagccgaacacgtctataaacacatgataacgatggcccagtaacacatgatactcgctccgtcccaaaatatagcaacttttgcttagatgggacgtattctagtactacgaatctagacaaagcaaaagttgctatattttggaatggagggaggaggttccatggatagtattgacattttttttttcaaattgataatgttaccaattcaattaatcctattacaatacaaatgagcaaggtgaaacaggagacaaaagagaccctgtttagatgggactaaaacttttaagtccctatcacatcagatgtttggacactaattataaatatcaaacgcaaactattaataatcttggacta

SEQ ID NO: 22662 - DNA, 1501 bp, Oryza sativa
  unsure (1)..(1501): unsure at all n locations
gttgtgctgcttactgttgttgtgactgccaccgttgtagtcgttgtcgaagttactcgggtgatagggatggtgctgacagacgatcagggtggaaggcccacctagctgtcccgtcatgaaacgaggcttctgattgttcccctgaggaaagctgatctgagctgtctttcttttttttncggngggnttnccttaaaattttnttnntttntgttgcgttgctcttcctggcggatagccttgtccacaagcttctcaaagtcctcatagactccggagattagctggttggtcaattcatcgtctagcccaaacaaaaacttctcctgcttctcagcatcggtgcgcacgtcgtcaggagcgtagcgcgcaaggcggttgaactcgtgcaggtactctgtaactgacatggttccttgctagagcgcacggaactctctcttctgttgtgccataatcccttcaggaatctgtgccttcctgaagctttgacaaaactctgcccaagtaacctccgttgcatctagacgggtcgccacgtagttatcccaccaggcagaagcgggaccttgcaactggtgtgtagcaaaagcaactttctcttggtcgttgcattgcagtaggttcagcttcttctcaatagcacggagccagtcattggcctccattgggttggtggtgcttgagaaagtgggtggctggatacgaagaaagtctaacagtttggacacgtgtgatggtggaggaccaaactgctggttctgttgcgcctgctgcaacatctgatggtaatgttgctgcatctgttgcatcatcattgtcatcatttgagtgactgttgggttttcgggcggtggagatggtctgctgccagatgcactactgacatgagctccatcggtctgctcttcgctgcccctggcgtcgctggagtcacggggatcattccttgtcttcaccatctggaggggataggtagaaataagagaaaggaagaaaacagatggctcggaaactaatctttcttatgaaattaagtgccattatcttaatcttgattaaaacactgaaaaagaggcacacaactcctaataaaggctgtcataccactcacacatgatatcgaccgccgactaacccacaagcaacaaacctaaacaccaaaaactagcacgcaaacagactaagaagacgataaagctaagggcggcgactctgaagcttggagcggcgcttgcgatcggagaataggtctgacatctaaagagtacagagggataggaaccaacacatgctcaaaaccaaattaaataaagcaacgaatgactcaagtaacttgccgagcatgatgatttttatgcatagaacatttttcatgaacccggataaagacactaatgcgactgactaaaccatagcttaatgcataaactagttgcatggaaaatgatgcgcataaaattgccccatcgaacatagacacgacctaatgcatatc

SEQ ID NO: 22663 - DNA, 1501 bp, Oryza sativa
cggcctctttccggtatgtcgtggtggcatgtcggcgcacgggaacgtgtcgtggggctgtgtcttgtgggtacagttgtacacctctgatcagagtaaaactattcgaatagccgtgcccgcggttatgggcggtcgaccagattcaccgtgattagtttcacccctagtttagcttaatgaactggctagttcaggtggtggtttgggcctgttgcaacgtggtgtaacgttggacagtgattggttaatatggattaattactacaactgttttactgctttcaactactgctttgaaatgccggctttatgcaaaagaacctttagcctcccttggatatatcttgcatcatacctcctcttccggtgtgacttgctgagtaccgtgggtagtactcagtcttgctctcttttcccccacaccagagttgaagtccttctcagttgaagatgtctcgaagaggttggtttcgtcgctgccgtcaaggattgcctgtggaatggagtcgcccgctgcaggagtcaagtcttcaggcttagctcgcttttctctttttccgctgcatttgtaatcttttatatttttgtaagacgtggatctgtatgtcaacaattgtcgtttgtgtaccctggctggtcctggacaggggtttaatgcacattcagcttagaaattctggttcgtgaatttctgggcgtgacaagttggtatcagagccgaccttgaccgtaggacaagccaaatggaaaaacctaagagccctctgaatccttttcattgcatatattctttgcaattggatttgtttcgggaaaaatttggggttttgcctctttggtttgtgggaaaaatcttggtcgttcattcggatcggatccttaaaattagctcggtctagggttttagaaaaattttatttggagttatatttgacagtcagttggggatttatcgggtgatatgcattaggtcgtgtctatgttcgatggggcaattttatgcgcatcattttccatgcaactagtttatgcattaagctatggtttagtcagtcgcattagtgtctttatccgggttcatgaaaaatgttctatgcataaaaatcatcatgctcggcaagttacttgagtcattcgttgctttatttaatttggttttgagcatgtgttggttcctatccctctgtactctttagatgtcagacctattctccgatcgcaagcgccgctccaagcttcagagtcgccgcccttagctttatcgtcttcttagtctgtttgcgtgctagtttttggtgtttaggtttgttgcttgtgggttagtcggcggtcgatatcatgtgtgagtggtatgacagcctttattaggagttgtgtgcctctttttcagtgttttaatcaagattaagataatggcacttaatttcataagaaagattagtttccgagccatctgttttcttcctttctcttatttctacctatcccctccagatgg

SEQ ID NO: 22664 - DNA, 1469 bp, Oryza sativa
tatgtggcatgcaaccctgagctttttgtccacccaggccaatgaaatttgtagattcgattataaattgatgttcagcactccatatttgtgaagtgatcccatggatagtggtgacaccaacggtttctcatcgttgctcaactcttgttacttctaagtgattttagtggttcctcatcgtagcatgttaggggtttgtctcactactaagtgattttatttttattttcttaggtatatcgttgatatagaagatgggatgtaaaatatgtttctttataaaaaaacacacaagaagttgcaatccctttacaacttgatggcagtaagtgagaaagaacagcaagagttaagccattgctcccatgaataaagaataagacgagttgctatttttttatgttgtacatatgtgttaaagatggtaataggtaagagcggcatgtattatttttgtgtcccttgtgaatacaaaaataagacgagttgtttgttattattttagttatcactacatgtttaaggtggtagtaggaaagagcggcatgggttggacagttcccgtgaataaagaaagcatgattgtttattgttttagtagtggtccctgcatgttaaaaggaagggccaaaccactaatgaaaaaagtagacttgagcatatatgtggtgatgatattattatttttggctccaattagaccttcttctacttgtactctaacagcatccgttccctatataaaggggaaggatgatacattatgcgaatagccaacttgctcacccaacttctcctagctgctcaaatactcatatgcatgttgcctctgtgaccgcttctcgtcttcaagcccatggattcatcaagacaactaccatcttgccatcctacagtgcctccccttgcttctccctaagctaagggaatatcacagcctgacttttcgttttaggacttataaattgtttttataatttatattaaatgttcattaatttacaagtaaagttaaatatgggaaataaaatttcctaaatataaagcatggctggatttaatttgtattaaattcttcatgattaattatactctctggaattttgtcggatttttttcagagctcaattactaattttaataatacaaagaacatttcagtaattatttaaataatgaacaaatcattaaaggatctggttttaatgttgttaaatactttgagtgtccaattattttcaggatttttcttgaaattatttgagcactagaaatatttttaacaattcagagatcatttcagtgattaatttaactagaaaagtaaattaaatccccttttccttttccggctgaaactggaaaagtctatctgtcatcctcagcccatccgtcctcttcgccctctgctctatttatggcgacggtgccgacagggctccacctctcctcctcctccaaccagc

SEQ ID NO: 22665 - DNA, 427 bp, Oryza sativa
aggccaaagtaataataccatggtttttccttacatttggtccaaaatagttaaatgtcaccaccagtcagtccaataatcacaggtccagcaaacagccgcagcaaccttaatcctagctgctaccttgtgagctttaacatactgggatcttgttgcaacttgcaagcttgcagcagccactcaggaccagggtttgacttaccatctgtaaccgcgcggttaccgcggttaccggccttaccgcggggtatggtaatagaaaaccacggtaacctccttaaatttaaataaattttaaaaataatttgaatttttaatatattttgcatggtttcgtacggtttttcacagttaccgcggtaactgtgcttaccgccagggcacggtaaccccggccgcggcggtttgtgaaaccctgctcagg

SEQ ID NO: 22666 - DNA, 1501 bp, Oryza sativa
cttgtaggactacgctaatgtatgaatcaccggttaatctccatataacatcgataactcttactcccataaagtggacagacccgttcaaacgaatgaattggaaaatcacatccactagcatgcaagtggattggtagttttctacatactatgaaggtgtaagaatttatatatcatgaagatatactaatcaatggtatttggcaatcttattaattcccctaatgccaaaatatagaccggtttatgtcactctaagtggtttaagctaattgttgaagattagtgaaacaatcaaattggtaatgattgataaatccactaagagaaagttgcataatatttaatttcttgtattgagctaattattttatacataccgcatatgtgtatcgttgcaacttattttcccatagtcctccgtaaggataaaactttgtttgtactgcacatttgaataagtggttatacatattgctcctatacgttgatttatttctcatgttcatagtagaacttatgaaataagtaaacgaaagattaaacattgtggtaattttattttcattattttacacattaataaaaatgtggttatgacattggaacatggaagtttcaacggatctcttcttgagggggagcatatatgctaaacattgattatcatacttaagacttggaagtcttatttttgatttaccaagaattaatcaaattaatcattgttttgataatttaccttgaaggttactaccgctatattgttgtgttaatccaagttgattaatataataaagcatatagatcattagctatttatgaagaatagtcgatcttaaagattatgcgatcaagaatatttctcacgcaaggtttttaatgaggcaacaagtgcaatatattctcctatccttttctcccactaggtttttggatggagtttttaatgagacatgtgtatagcgcggtattcgtccaagggggagtgttatgaaactattatctcctgccagagataaatatgggctcataccaaatatatggatacgtatcctaataggtgtcacgcccggaatttctatccaaaattccaaacgcttacatgtgtgtgaaccctcgtccaggaatcagccgaggcacacaataacaaattgataatagagtacaattattactctaattaataagcgaataaaatgtcattacagaggtagatagttcctctcaatcaataaagatctaagcagcggaaaaaaataagataaacggcgcagacggctccactccacaggcagcttgaccagggctacacctaatccttcacaccatcagcatcactgtagaactcttcctctgatgaatgattgcaaggtgagtatatgacatactcagcaagccacgcagcaaatatgcaagtgcacaggataacaaaggatggcatagtagggtttcatttgcataaacagcatttaataaacatttcagaatttaataa

SEQ ID NO: 22667 - DNA, 1501 bp, Oryza sativa
tgtcattacagaggtagatagttcctctcaatcaataaagatctaagcagcggaaaaaaataagataaacggcgcagacggctccactccacaggcagcttgaccagggctacacctaatccttcacaccatcagcatcactgtagaactcttcctctgatgaatgattgcaaggtgagtatatgacatactcagcaagccacgcagcaaatatgcaagtgcacaggataacaaaggatggcatagtagggtttcatttgcataaacagcatttaataaacatttcagaatttaataaatgtcacgcccggaaattcactagtaatttccgaactaatttgtgcataaaatcctcgtccaggaatcagccgaggtacacaaactgacaatttaatatacaaatccatcttaataataacgttacatacttacaaagaaaagaaaacagcagcggaattaacggtctagcgatggcttcagctccactcccacaggcagctcaactggggtataagccaaacgtcttcccttctggatcctttatcttcaactgaggtttgatgattattgcaagaatgagcatatgacatactcaacaagccacacagcaaatatgcaagtgcacaaggattccaaaggatggcataatataggctcatttgcaaaagcagcatttagcaaagatttaagataagtaaaacagtagagtaattaatcatcaattttaatcaacactgaacagcacacccatgctgctcaggcccaaccaaacctgaacaaccaaccccggtcgtacagatcaaacctccaaactaggaattatccattccatactaggagtcaaattaattatcacattattaacattgatgagtagtgtgaaactaatcacgaaaaacattgctcaacccgcccataaccacgggcacggctattcgaatagttttactctggccagaggtgtaccactgtacctacaagacacgatttcgcacatgttgccatgccccgaaataccaccacggcattgcaaagggggaaatcgtgacaataccctttgcacaacacaactcaaaacagtgcaccgttcctggatcataatcacccccttataaacaaggcatggactccccagcgacccccgtggacttcttgccacttctcagtctggcgcactataatgaatcacgctatacaaaagataaagccgttgcccatcctggcttgtggttggcacggtaaatgtttcacaacagtagctcgcgagccggtccttaattgccatgagcacaactatcaaaaccatatgctcacaacccaccttaaccagattttaattatcaattaattaacatcacacgattaatcatcatgagctaccattaaatataaccataattaataagaataatataatataatttatatttaatcccctttaattagctaatgtttctaagcatagctaagcaaacttacatatagcatttagctgaaccaa

SEQ ID NO: 22668 - DNA, 487 bp, Oryza sativa
cataatcagttatctagctatcctctcttcagtcacacataaacatgttctttcccagtactgcaaatatgcgcgagcaaaataataccataatagtatcaatagccatgaccatcctcctgctggttgcgttcttctgtcggatcaagaagcaggctgccatggcagccaagaacaagaggaagaagcaacccaagctgccaccggggccagctaccatgccggtgttgggtaacatgcaccagatgctgatgaacaagccggtgttcaggtggatccaccgccttctcgacgagatggacatcgagatccggtcagagacccttatatttcttgtcttccttccctttcccgtccatcagatcggtaccgccccatcttcctccttccgctcctcatcgggctgccattggggagaagcgcggatgtcagggggagtgggagcagatcagtggcaccaacgacgagctggttcatgccagcgtgc

SEQ ID NO: 22669 - DNA, 1501 bp, Oryza sativa
aaaaagcacgcatgcacttctcatgcaggtggatggaagaacgtacgtgcgttgggcagactcgtacggtctaattgttcttaagttcttttttttaaagataaatgtaacggtatatgatggtaaaagatattgggtccatcaaattaaataaaaccaatgttctcttttttccttagattttctaggaattaactagagcaccacgtgtcatcttaggagagttttagtatatttgatggacttttagtatataataatagatagatagatttatctctctaggcttgtgaaatttactctgtaatatatattgtcatttttaatgtttgttcttttttggttgtcaagcaaagaaaaatgatttatattcaaagttaggaaagtgtttttcttatatatatagatttgatgggttcatcggtttaaacaatccaaatacttaaatctaatagttggtgtacatgtcggaagttatacttttttctatgacaaagcctctcgaccccaaaatataaacttctagcaagtggggacaactctcttgttaaatttgttccaacgtcgtcggtgcgagtgtggccaccggcgtcgtggttctggtcgtgtccgatccatgcttgcaaccttctctgccatggagaatgccagaaaccccaaatcggctagccaccaccgactccaagttggcagtggtgctcttcgtctagagtcacaaaaatggaacgagaaggatgctcctcaaactcttctcccggcaggtaaagacagagaagggcggcgaggaatcggtcaactcagtagtatagccccgaatgagagatggttttgacctcagtgcggggtagaggtgagattgaagttgccgagtgctcgctttatttagctttcgcagcgcccctgtaagttccaaaaaagctgcctcaacatagtcagcaagatgcttaggcggtggggcttataattttagtaaaaacggtggcgacaccgatcagctgtatgacccactatagtgcaaatctggcacacatggttctcagtagacttatcagtatcagtgaagtcataagtattggtacgcccccctgtctaacttagcagctgacacaacattgttccaagatgcaagaaattattttctttacacttcagtattcaagcgtaaatatattttgacgtttcttacccttcttctaccttgatctctagtaaagcttcgtccttaataatgtactcactctggttccataattcttgacgttttcgataatgatacggtcaacaaaatatatcttttactttgtttttattataatatataatgcatgtttacttttcttatattactttgaaggacaaatctatatatgctattctagttcctttaaagaaaatacttttaaagttattaataatcaaagttacaattgtttgacctcaatcttatccaaaacgtcaagaaatataaaacccgatggagtattatacaacccctacagcc

SEQ ID NO: 22670 - DNA, 230 bp, Oryza sativa
aggatacctagataactgattatgtggccaatttatagatggaattttataagtgatttgttcccgtccagcagaggtaggcgtaccaaatcctagccgtcaattgggacatatcagacggtgattgagatttctcggtaccgtgcagtaccattttagcccatatggtggtaccatcttttgaagagaggtgaaagggtagtatagacttttcatatgtaagggcgaga

SEQ ID NO: 22671 - DNA, 1501 bp, Oryza sativa
gcaaggacgattgtgctttgcatggggaccaagcgtggctaatctctcatgtctcatctctcattgcgtttggagtttttctctacttaattatcttatccttgcaatgatgatgtagatggtgcaacatgaaatattccttctctctgctgcttatctgcaggccaaaaatgctgctagattgagaggggtccatctgtcatatatataaagaggttttgagctatatatttcaattgattgctagattgagattcacctgtcgcttgccagctacacatattcaaaactcactgaattatcttctagccacactaattagtgtatctaagtcatagatatgataaatggaatcagtttgccagtggcaccgagcctgtttgagctcaccagcacccggttgccaaagcagagggagagaaaccccaaacataatattggtacgatggtactaccaccatcccattttaagcacagccatgagttttcatattcaactttaattgttcgtcttcagttaactgcccagcatgtaccgagctcatcgctcgattcacacagtacagccaccacggagctcgtggtcgcgggaggggagatgcaagaggatatcgtcgccggggcggggaatatggcagaggtcaagcggcgttcagtagtcaagaggcggcgatggggagaggggagaggccgcatctttccttccccaaagatacaatgcaaaacaaggggataacgggcccttctagcactcaacatattgtcggatcagctccacaaagctcatcaatcatcaataattgcatgaataatcgacaaatctacctaataatggcattactccagtaggatgttgatgaccccaaccctttgtcgcttcaccccgtggttccatggtaaccatgctttcaggcgtagtaccaatggtcccactcacacaaaacttgtttgtccatgtaggaaaatgggttgtgaaaccattttaaaatccaacacgcagcgctggcatgcttgcgaaaacttgctatgcaaagggacaccctttgaattcgcatacaaggcgtgattccaaggattggaagaagaaagaaagtactaccctaaatctcagtgtctccactttactataagattatacaaccccgttggactactctctaatagggctgcgggggttgtatgatactcactccggtttcatatttcttgacattttggacaaacttttgtatctttgattgataataactttaaacgtattttgttttaaggaactagaacaacatatatagatttgtccttcaaagcactataagaaaagtaaacatgcattatatattataatatttttttgaaaagattatttattatagagtaaattgcacctacagtacaacaacttgacgggtgtgtgcgatatagtgaaagaacttgagaattgaacgttcgagtgcaacaacttgacaagtgggtgcgttctagtacaagaacttgacaattt

SEQ ID NO: 22672 - DNA, 666 bp, Oryza sativa
taacttccaagtggaattccgtttacatggaatggattgcctgaatggtgcttctgatttcggcatccagcacctctccgcccttaccaaagtcaagatcggtatttggggcaacatttgctctgatggtatttatgatccagaacaagatatgaacaatagcatcaccaggtctgttgttagcctaatcaaagctgccatcgagaagcttcccaatcatccaactagcagattccatttagagtatgatcatggaagttgtttattggtaagttcttgaccagacctggagacattgattgttaattcatcgtcttagtttcaaatcctattattgttattattactatttgtttcttggatgctgcaaaagtgcaatatcttatcgtttaattggacaattaattcgctcctggcttgtcgctctctttcttgagctgtggctctgtgcctgtttccttccaacatttgcaggacgtacctcacctgatgcttttaataagtaaaaaatgtgagattggatcatacaaagcaatcagtagctgccaagaagggattactggaagcgaagttccgctatctgttttctcaataataatcatcctcacatttcattttctttttgtgccatgtgtaacagggtgagacaagtcaagagtttgaggg

SEQ ID NO: 22673 - DNA, 176 bp, Oryza sativa
ctaatgccataatgattaaaaaaaggactacttttaaaaccttactgggactactattttttatatgatacaattttggacatacataaaagtaattttatctaactcccaacacaacatcaagccacaaaaggacatgaatatggactgcaattcgaattgaagattgtgctagt

SEQ ID NO: 22674 - DNA, 1501 bp, Oryza sativa
atcatttttataatatttaacataaacttatcaatatgttccacattaaagcgcgggtcatttgtttcatgataaatactgataaactctaatatttcatttgttttctttttatccctagcttgattgtagcaaaaatatatatatattgaaaattacttagtaattcctgcagcaaagcgcggggaatcacctagtaattattacgattaccactatggctttatggagtgccaacgtggtggaaaatatttgtgggacctacaaatcagtctatccctctccttcatctcctccttcggcatgcagccaaccttccctcaccgccatcacccatgtcccgcatccagtcccatatgccgtccacaccaccatcgcctgaatatttgctcaagatggaccctgttcatctccaccgccggcgctactcgagaggcctccctcctgagctcactcctccaggctagcctcgcctcgtcactcgcagggtctacgactccacttccacgtgcagacttgtacacttagtctgcctataacctcttctctgtcgccccttcattcgaaaaccgttgtagttgggttcgttggcgttgtgggcttcccccatttcttcactctcctctctaatagggcctaggtcagcccccttcactacgctgctcccaacggcgtcgtctccactggcagctgtctccaagtcgcttgagcacgattgcacgaagttgagtcgggtggcgccatcctccctggacagtgtgactgttgacggtctttaaatcataatatttgaccgtcaatacttgtatataatgaattaacatatggcatccaacttagtggtagggattattactaatcaattccactagtgttagtgaaatatgttatgcagttattttgaggagaaaacacatccatcatgcgacaaaatggacctccgcatatttaggatgcgtttacccggattggagggcccataagtcgataaaaaccacttagaattgggccaaaatatagtgcaagttattggggacccattaagcaacctaccggccaaatgagaggctgggaggacactttttgggttcggccgaacccaccagttcggccgaacccgttctgcggccgttcatcgccagattacacgtgtacgctcctgatcacttcccaatggcagttccggggcattttggacatttcacataggctgtaaccgtcatacctgcctatataaaaggaggagctcactctcatttccaacacacaactttgaactgaattacaagatactctattgtatcttttatacattagaataaggtagagagtgaggggaagctttggaggagtgcccggaagtttggcgctcatccaacttctacctcgacgagtgtagcttcctaggagcaattctggaggagtaccggagctgtcagtacactctgctctgggttcggagaacttcttctgtaaagtaagtattcgtgttcctttctta

SEQ ID NO: 22675 - DNA, 158 bp, Oryza sativa
aaccttactaaattttggcaatgccaaaattttggcaggatttcttttgtatttatcaaatttggcaacaaactaaacgtagacattttttggcaactttgtcaaaaaatggtatgggtgaaaatggcatcaatctgaacagcccctaagtggttatt

SEQ ID NO: 22676 - DNA, 1501 bp, Oryza sativa
cagaacggaggggctatatgttaagcaaccatattaaggtatagaaccgtggtcaaaacaacttttatgtacttcatgtttgatgtaaccgcagttgtttaaacccattgaatgctatgaaacataaattttaccttagcatcatcacaagctctcccaggacatcaccagagcattgctctaaatcatcaattacgacgactataggctgatcatagttctcagctgcagagtaccaagatgcaagtgcaaatatatccgctacctattcgagtgacaaaaccagaacagacaacaagtaaggctatgcactccagtctcaaactctcaagtaaagtacagctaaaaaagacttgagagcaggccatgtcactcacatctggaacatctgaaagtagctgcctcaacaagctcctgaagcaacaaccaactccatttttttccgataattcagtcgccgacagcttggccaggtgacatccattggactcaagatactctgcaagatcccggaatgtcgtgatgtcgtcaacgaactccgcattctctgcaaaattaagaagcccaaaccatcaaaccgagcaattcttcgccacacctaccaaccagctgaacaaattgatggcggattctcactggtgagaacaaaagccgtcggtatcttcctgcagatcacatcggtgaggagagggtatggctgccgcacctcggctgcggaaggtctcgcaatggagcggactgcggagaaggattcctgcacccatcgcagcacctggtcgaacagcttgaggctgatcccccgaagaacctcctgcccacacgagcaatcgaaaattggatcaatcccaagatgagaaatcgcactcgtcagattctgcaattgctgaggaattaagcgagtgagtagtaaacgaatcgatggaatatgggggaattgagtttgcacattgatggtggactggatcttggaccaaacgcggtggaaggcgtcgaggcggagccgctcgtacagctcgtcgtcgtcgtcgtcctcagcggcgtcgtcgtcgcgggatctcttcccgggtttggggttgggagatgccagcccggaaacgtcgatccggcggcgcgcccggccggacgacggcagcgagggagccgacgaggaggacgacgaggcagcggcgccgcccttgtggaggacatagaacggctgcaaggagaacggaagttaatcccagagcagcagcggcgcccgccggccggcgagaggggcagcaaccgcctgagagagagagagagagagatggaaacgcacctcgatgttggtggcggcggtgagcggagcctcaccgggcggcgcagccattgtcgcgctaaccacggcggcggcgcgggtggttcggggtggcgatctccgacggcggggaatgaggcggcggctgcggctgcggctgcggcggcgggattagggcagtagcgcggaagagggggcttcttttggcgggaaaggctcgcg

SEQ ID NO: 22677 - DNA, 1501 bp, Oryza sativa
ggagaacaagcaaaatctccacaatttcttgccctcgatctccacggaaaaccgccctaattattcaaggatagaaaatatagaatattaaatcatcaaactaaaccagatttgactccatgcacataaaacatgcttcacttggtgcatctgttcatattcaagcccatactcgtttgtttgttgtgttagggagagaagttaagtggtgtgtgggaaggaacgtatatcaggcacattaggagtagtatcaggccactagcaagtttcacgatgagttccccacccccaccccgcccgccctcactgggggccactgcgatcccagcacccaccccaccgccggcctccaattcggtaccggcgtcccccaatcccctttgcaggttccccctttccgttcacatcgccgtttccgtgtcagtctcggctccctttcaggtgaaggttcagaggaggacatatttattccgcccccagatgctcctggcggatctgctcgagccagcgttgaagggagcaggtggcgccacctccgcgctctcatccggctccgcgacctcggctggatcctcgcaccctctggtgctccttcgtcgagccgtggctacagcagttactccgccagctgcctcctctgtgcaggtaaggggagttactctcagaagcctcctgcgctgatggtacaggcgacgacttccgcctcgcgcattcccaacgaaatcccagcatatccttcgcagcaggcatggcagattgtgaagccgaagcattgatggaggaagaaaccttctctaccagcattcaattcaaatcccagcgtatctgagaaagctttcaacgctcgagtcttcactcctcaccacctaccaggcaacaagcaggtttaccatgagcctcctcagccaattcaaagcaggatctccttcctggaactctttaaaaggaaggcaactggaagatgtttttgctgcctcgccaaggaccaccgcattgcggactgtagagacccacccaggtgcatcctctgctttgcctctggccaccgtgctcgccgctgcccaggggcttcagttcagaagaaacaggttcaccagaagcagcccctgtctcctcgcctagcgccggcccctccacttgccagctgcctggtgttcctcccctccctacaatggcgcgtccaggggacctagccaaccggctggacagcattcagcgctgcataccgtggtcgactgcggtccgtgaggaggagggcttactgtccaggtctgcggctgtggtccggatcacaggtaacatgcctgtgacaaatgcagggtagatcaataggttgattgtgaccaagttctagctcccgcgggacgagcttacggtggtggttttccctaaaggtgtctacctcctcacctgcaccttgagcactctcagtgacagcgtggtggcggcgagtccgttctctattgaggacatcaacttctcggtcaagccgtgcgagttc

SEQ ID NO: 22678 - DNA, 1501 bp, Oryza sativa
ggctacggcgccatggccgacagcaacgacacacagctgggcggcacggagtttgacaccgaacgaatcgccgaaatggtaaaagttcaaattcgaggataacaccgtccttaagtacaacgaagtctttcctgacgacgacgaggtggtggcggcgccgatgatgatcgacagcggtgcgatggtgcagagggatgtgatggagacgacccattcgacaattagggccctcgttcgaaaaccgctggaatttcaagtttccctggctataaattctttgtcttcaaattttactcgattttgtaagttaatgttcatatttactatttgctccatgtttttagtttcgtatagacctttggtaattttactatttcactaagaacatgtacaataaagggcggtaggaggtccacataggattttttgttgagctggaaaaatgagaggaaaagagagaatgggcaggcgactaattaaccacctggctacacgcgcgacccgaggtgtgggcccgtaatgctaccatcgctaccagttctcgttcctctgcgcgtctttctgcgtcaccatcgtcgccatcttccgtggccgccatcgtcccaccaccctcatccacggccgtggcggccaccgtcctcatcctcgtccgccatcaccatcttccgcggtcgttctcgtccttggttgctaccgacgttgcccgcggccatcccaccaccctcgcctgcagtcgccatcctcgtccttcgcgtccacaaccattgcttgcattcgtcccgccgtcctcatcctccgcacggcagggtacattcatcccacatccacacccgtgtccgccacggtcgttgtcctcatccactacgaccgccgttgtcgtccgcggccgtccggccatcctcgcctgtggtcgacgtccttgtccctcacatccgtcctgccatcctcgctcgtatccgttgccgttgctcgcttccatcccactgtcctcgtcctccgcggcggaggcccacgtccgtcccaccgtccacacccgtgttcgtcgtcctcgtccaccgcagccgtcgtcgtcgcccttgcccttgtccacagcggccgccaccttcgtctgcatccaccgtagtgacatacacgccatcacctgtgtccgccgcagccgccgccctcgccattgtccgtgtccgcccatgtccgttgcctgcatccgcgcaaggttgggaaaaagaaagagaagaggagaagatgtgggcccataaaaacaatagaatatttatgttacattaagcataggatatctctattgtataccttagttataacgctaactacaagtgacgtgttcacctattatattgcagccaacaacgggctttcttatcagtcaatacattgttcttaggatactcctggcctctgcaccacaacagtacaagttatgtgttgctctagagagggtatagattattaacaaaattccatcaaaaaagaagcgaccttgaaa

SEQ ID NO: 22679 - DNA, 1501 bp, Oryza sativa
aggtagccgaggagaattttgcccaaggagatttgtctctttgtttctagagcttcagctagaaattgccagttggttgtggggccgcaacttgatccacagaacagaaatttttctagccacattaacaaaaaggccacatgttcctgaggggtgaccgagccctgacccatatatgccgctacatagcctgaccaacctcctatgcttttggtcttgaagtcatattggttctttgtgttcaagctcatagggttggctgatgaggtgacatccagacccgtgatcatgctgatatctatgagagttggggtcatcggcccttgattgaacaaaaaggcattaatggtgtttgaccagaagtaggaagcagctgccatcaggggttcatctttggccgagtttgctatagtaaggtcaagtgcttggccgattccaatttcatcccagtaaaccctcttactagctgatacacgtttgaaccatgtagtccagctcttttctggtggaactttctctagagacggccaggacttgaaagtattcttccagtgacctagatctgggttggttaatctgaaggggatcctattaatttcaccaataatgaactcggtggggtcaggattgccgattgggccgagaaagtagtggttttcatgcgtcagactgggaattgcgacttggtgggaaatatgctacaaatccgaggcaaccaagagaaggaaagcaatatgaggtaggagaaaatcgatctgctgctaaggaaggggatttagccgatgagaacttacctcagtgtattcggctgatagcgcaccagatgggctggcagaagacgacattggtgcgggcggagatctcgttgaggaggaagtcgcctagaaatcgcctttgcaccgggggaatcaccggagaagagagagaagaggtttcgcttgagcggtgaaaacggaagtcacggcgtgagatttctcgggggtaacggttagtatttaaagtgctggaataacagtcaaaagcggcggagtgcgaaacttgctcggagccggtacatggcaaatccagaacattatcaaatatcccggacttggggggcatgtgttaacgaccaaatttggtaacatttgtgtcaggaaagaagatttgatcaaagcgaagtcggaggcggagatcgagttcggaaacagagcaggaatcggctggagtccagatcggctacgattaggatcggctgggtttgagtcgggctaagtaagctgatacagccgattccgacaatatgacttgtacacgacatcgggttcaagttaatgtacctcaagatgattgccacgcacggatagagtcctgggaaggcaattgtatctattaattaggatatcttatgtaaattccttatagataaatacgggcaaaagtctgccgcaaagacttatggtatcttagagtttgttagagataatagtcgtgtccggtatgggcatatcttgtaattctc

SEQ ID NO: 22680 - DNA, 1501 bp, Oryza sativa
gggcatcctgagcgttggttccagggataactttcagagacttggtcagatcagcaacatgcttgatagccgatttgagtcttgctttctgttcttcaatagactttgggagatcggctagttttttgtgttccatgtccagctcagcgttgcattcttcaagttgtgctaagagttcaatcttgcgagcctcgagccgatcaatattagacttgattgggccttcagatagttgatctttccagtttgaattggtgttgctcaaagtaaacggctggggtaagaatatcggctaactcatctgggattagagcctgaatctcatgtagccgagccctgattgagccacaatcaaccaccaagctatccagtgatgatgcttctagccgatccaagatactttccagagttttctttacatcatcagataaaggggctaaggctttgcttgtggtatcttcttctccttcatcaaggtagtctccaatgtcgaaagagaaaagatcggctaagacctgcagcaatgatttagaagcagttagaggttaaacaggcatagccgatctgaatgcttgttgagacaaagaaaaacttactgggatagcaggagcagctggttgttcttcctcctcgatgtgatgactccccacagctgaaggggtctggtcacttgacgattgttgtgcaggaggagaaggaggaggggaaggctaaaaggaaacaagtgttagtcagaatcagctggaaattaaccaatgaaagttaaaactatcttaccggtggagctggcttagatgttgttgcagccgatttcttcttcaccgtagtgttctttttctgcaattacaagacctgggagtgatcggctataagacaaaatagttatctgatgatgttctttcagtatcgcttacttcggctgtggcctgatcaacttcatcttcaaatatctcttcatccagagcttgttcaatggatggatctagggtaggcagatcatcggctggcttggttttctttgtcttcttcttcttagttggggctgtgatgcttacagccgatgatctggttttcctctttttgccggtatcggctggttccctgatgagcccttgaagaagagctgaggtcttgggggcatcatatccaataaccggaggagatagcccacctccgttaggaattaaacctggggcatattggatatccttaccactgttgctttgacggggaggagaggattctgttgtctacaaatcaaaaggaggattagttgagattaatcggccaaacagctatttaaatcaagtggagttaaagacttacttgagggacaacatctgggaagaggtctgtcatatacattgaagctgcttggtggaataaatgcagcttccattcaccccaccatctgtcaaagtttttacttctgaacattgccagttctatgttgtcaatactgcccagagggggtcctttgtaacgccccgattttcgttcg

SEQ ID NO: 22681 - DNA, 1501 bp, Oryza sativa
acactgatacattagctagtcacacacacagcacaagtcactttggcttcttgtcatcaccaatggcacagccggccaccagggtagagaaagcatcgatcacttctgcggacaggggctgcttgaatagcttcacgtattttgtcatcgcttgatctgttttcttgccatctggggagatcaagccagctttcttcatcaggtcttcctgggcacgatcaccaggcttggccggagcgaggcgagaagcaaccttctttgccagccgtgcgctcctttggagcctggcgcgcttgcacctggcgagctggggtcggcagcggcggaggctggacctcctggaaaacatgctcaaggaaagccgttagcttatcgtgcaaatcaggcggttggacctgttccggcggctgggcctgcggctgttccagggactgctctggcggcggagcgatgttgccaaggccaacctcctccaacattgggtcgaccgacagggggatcgccatcattggagcatcgaagccggcgatggagttagctagctggtcaacttgtagcacagtcgcaaaaggagtagtcagtggaaaaggcacaatctgcgattcctgtgggcgaaactccgtcagcccctctgacggcgggggagggggggaggctgtctggggtaccagcgggcgaggggctggcggaggggactgcctgttgcgaggggacctggtgcgctcccttctaaccggagacgtcgccgcccgctgatagccaccataggaaccacccctgtggtctggtggcctggaggaggagcgcctggttggagccgtcgtgcgagcagggggaacatcccaacccgaaggccggcgatgctcatgcgccggcggagagcgggagcatgagtgagagcggttgcgtcctggtcccagcctcgccgccacatgttcgcgaggggcgcgctgtccatccttgactcctaagctccaaatgatatcgtgccgctttggcacctcttcagtcactgaggccgaagagatcatgccactgccctggctactagggctgtagccccagactggctccatcggaggaggactggagtcaagcacttggtcaaggtggatcagcacctgataagtgagaagcttcgacgagacagtccgtctgcgttccagccctgactcccccaggtcctcaagccagaaggagtcaggagagttctgcagaagcggctcctccagctggaagtgaaccgccttcgggatggcatcaggatcctcggaccaaatccaagcacacaggcaggcggtcttggtctccgtctttggctcctcaagatcctggaccaggcaaccctcatcgaggatgcctgcaattgtatccacagaccaagtatggctgggaatgccctcaaagcagacacgcacgctaaagcgccagtctaccaactctgcctgaactcgcacggcttgaccgagaagttgatgtcctcaatagagaacggactcgc

SEQ ID NO: 22682 - DNA, 1501 bp, Oryza sativa
ctcaaatatttcagatgaagcaacatttctataccagtaagatgatggttttgtaactttctacaatcttttaaatctagcacacgtagaactttgaaatccaacaatgatggagttttcacaaagtaaccaaatatagtaagtgatcggacatttttcagactcaggtttgttgccatgatgacgttttcctttctgttattctggaaatatactctacgaggttcgtcaattgggatgggtttgaactctgttgtatctaataaagtggtgaagttcttttcagctgccttgcctgttatgaaattaaaaatgatgtcatgaacccgacatgccactggtttaccatattggacatcaactggttggatcaagcttctattgatgagttcatggaaataatgctcaccggttttatatgcacttccctcttcttcatgaatgaggccttcagcaatccatctgtttatcaaccgctgtttgttgatcttgtgatcttctggaaatagacttaagtacaataaacaagttcttacatggtaaggaagatcatagtaactgaaagacaatattcttctcatatttccagcattaggatcctttgcaagtgcaaaaccgattgctgctagcaccctcacccattcatcttttgcatactgatcagccaacaaactagaaatagttataactgccaatggtaggccaccacatttttttataattccattagaaacttcttccagatgaggatagtataggttttctgaaccaaaagctcttttaaaaaacaaccttttagagtcgacaaagctgagaggttccatatgataaacatagcctccatgataagagcactttgatgcaacagcagtgttacgtgttgtcgtgattattctgctgtcacagttgttgctcagcaatgcaagtttaatagtttcccatgcttctgtagcccatacatcatctattacaactaagtacctgcaggattttagatttgaatcagtgcttaaaggttatgatttcattaggcattttgctatggtgaaggtgaaagaacaggaagagggaagtggttgtctctttgctgaaattttgactatttggatcttttcagaaatttatttcaagaatggaccatacaaaaaaattcaaccaaaaatggaccctgacctcagcaagaatgtgtatgagatcaattaaattcattccaaattacggggggagaacaccttcgacaataagttgagctatgaacctcgatacacaatatggccccattgggacaacgccacaacagcatcgtctggaagctcaccctgagcagggaatacacagcacagtttacagactccaattcctaggggcagcgagaacaattttcaatgagacaatttgaaaatgttgggcgccaccgaaatgcaaattctttacatggctggttctgtggaacagagtctggacagcagacatactatagaggagaggttggctaaacaag

SEQ ID NO: 22683 - DNA, 1501 bp, Oryza sativa
acaaaaaaaaatatttttaggtctttgtttgcatttaaaattaaaaagttgttcattctcatccatgaaggttcgtaattacaagccattatggatgagtcatctgagacgggtggtaacttaccacccgacaaagatgagtcatccatgtctggctggagaacctatctgtgaagggtttgatttggggcccgacagaggtatatatgtcatccgtgttggaccatggcccgacacagatgatagcttcacatcacttaccaataatcactgaccatgcacattttcgacatagatgagggtattgccccgttatggatgaccggtttcgtagcagtgaatatatctctttgggcactgttagctgtgttccttcatttgatgcaccaatcagttgtatacctccgtggatttagtgacggatcgatgacgtactgtgtctggctgctttctccagcatgtttcagttattgcatttgttttctaaagaatgaattggtgtttcatgcgcttgcatgcatgcacctttaagttgcattgtacgtgcttgatactatgttaatttgtctgtgtcctaatgacgcaccatacatctgtgtgtgagatttagtttgtcaattgatgtatacatatgtgctttgtgttcctacccaccagggcctagaactccacagtgtgagagactgagagcattttgttgcaaaagaatattggagataaactatgtactatgtgctggggggggggaattgacggatggcgactgagtgcttagggtttcaagagagggcgactccagtgggagagtcctcgtcggtcctcccccgccggcgatcgccggagaagggtctgcctagaggatacacccacgcggatatcctcacggtagctgcccgtggtccagttagttctggcgcaaaaatttcgggtgaatttgcacacgaattccggcccgagagacctagcaatggcggtgggagcccgatggctacagtgcagcccagagtcgcgagaggcccagcgagttccacgatgatgaattgcggaaaaaaagtgggtgagattaatttggaggatattttccccaaatttcgccccactgagccgcaaaagtggatctggatcaagcgaggtgaggttcgccctcttctagggttcccggcgagagacgacgagatccggcgttttggcgacggagctcgtcggatttggaaggtgcccgagaagaggtgtgatcaccgcaccttcgcccaggttgtgatggagcgtcgtcctcccaatcgcctggattggcaagccaacaagcgacgagcgacagagcaaggcggcggcgattggggtgcacgaggcggaggtgactggggggcgtgcggagctcgcgaggaggaggaactgcatcggcaactccttgctcaaaaccctagggcgaatcaaggtgctcaatggaaacctcaagggctccctggtaccgatggagagaggggggcaagagctcctaaga

SEQ ID NO: 22684 - DNA, 293 bp, Oryza sativa
gtttggaataccaaaaagtttgctaggactgaagaatctgtgaaagctattgtggggctagttggggagtttgaagctattgatggggctagcttaagaagggatggtcctataagagagttgcttgcagggatcctagagaacttcacttctccatccacctgtatatcagcaaagttggttatatggtgagatgggaacctgaaggatatcttccttatgaaaacagacagaatcctccagatgaggggatgacagagatgataaagatgatgaggggttaggagaggaca

SEQ ID NO: 22685 - DNA, 316 bp, Oryza sativa
gaccgcaggtatttcatacaaaaggttaaatggctttggcttcccaaaaaaaattccaccattccatgtacctggtatgtacaattgattacatgcaaaatttgcccatcaaaacatatattttgaagctagattttgcaaaaaatagttagaccaaaccttgtcaaaatattaaaaaaactccactttccaccaacgaaatataacaaaaatggagccaaatgaagcaggatagagagttcttcacctttcgtatagagttcaagtaaaaatttcgggttgaaaacctccccccctaattggtgcttgctttagg

SEQ ID NO: 22686 - DNA, 413 bp, Oryza sativa
ccttaataaatatcggctgcgttctccgcatctcatacatccatgacgaccgatccatctaattatataaaggcaaaaaagttacagataaaaaaatagaccgcaggtatttcatacaaaagtttaaatgcatttgtctcccaaaaaaaaatacaacaatacatgtaactagtatgtacaattgattacatgcaaaatttgcccatcaaaacatatattttgaagctagattttgcaaaaaatagttagaccaaaccttgtcaaaatattaaaaaaactccactttccaccaacgaaatataacaaaaatggagccaaatgaagcaggatagagagttcttcacctttcgtatagagttcaagtaaaaatttcgggttgaaaacctccccccctaattggtgcttgctttagg

SEQ ID NO: 22687 - DNA, 271 bp, Oryza sativa
caaacgccgatcatcatcattgcaagcataaggtaagtggagaaaaactccaaacgcaatgagagatgagacatgagagattagccacgcttggtccccatgcaaagcacaatcgtccttgccctaatcatgcatgttactagtagcctcttatcaatcaaaacaaacacccatcagaaaaaaaaaagggtgtcaagatcagttaaacaaagcggcagctagcagcagcagaaacaagaagaagaacaaacgtctcgatccaggacaggaa

SEQ ID NO: 22688 - DNA, 1501 bp, Oryza sativa
caccgtgggccgcccccttggctcgctgacgtgtggggcccgcctgtcggcgccggccctttgctgacgtcagcacttgtcatttcctttgagaaattaattattaattgcgcaataattcggtttaattctagaaattcatttaaatggctcaaaatttctaaaatccatatctaattcattcgaactccgaattgagccattcaacttgcaaaattcatctaaaattgagctctacatgtttgtttagtttttatgtcctgtttccttggtttttattagagttttttctcgttttgcatgccagcgtgtagtttccgtcgtttcggaagtccgcggtcgcgaggaaaagagttcggaagatcaaagtgaagaagcaaggcaagtcacacattccccttgagcatgttgatcccaatttacaaatgttttactgtttgcaaacaaatatgcatgttttgctaattacatggggtcagggttttacctatctgctcgcttgtgccatgtttacttgatatctgttctttgtcaaccttgggtaatgaatcgactagctcatgttacttatgtgacctagctagaactatatgcttagccatgcttaattaccactagctcagttgatgggataactgcagtattagacctttttagtatcagagtgagctgcgtgctcgagacacctggccatgcttcatggtcgtaattatccaactaaaatgcgactgaatggtgggctgtgggtgcatggttttgctggtcgcacccatggcagttaaggaccggttcgcgggatgccctggaagaacttatcgtacttaccacaagccagcgtgggcaacggctgggcttgtagtgtagcttttctctagccgacgtacccaggcgagggtgggcgtgatggagttgggtcggccggggtgtccggttgatcggcttccggattcaccgcggcacgaaaggggggctgcccgttgcctgctggggacgggggcgaaccctaaggtgtggtgcgatcggttagagggggttatgcgaagggtcctgtcacggcctctttccggtatgtcgtggtggcatgtcggcgcacgggaacgtgtcgtggggctgtgtcttgtgggtacagttgtacacctctgatcagagtaaaactattcgaatagccgtgcccgcggttatgggcggtcgaccagattcaccgtgattagtctcacacttaataaatcgacctaatacactgtagtttaggtgggttggttgggcctgttcaacgtggtgtagcgttgatcagtggagatttaatgttactttaattactcaacagttttactgttttgctcaataaaatgttttacaaccgcctttatgcaaatagccacaaaccgtccttgtgttccccttgcacgtctgcatcgttggtgtggcttgctgagtacggtggttgtactcagtcttgctattattcccccttttcagaagtgtagtgcttctgagctga

SEQ ID NO: 22689 - DNA, 377 bp, Oryza sativa
acagttgtacacctctgatcagagtaaaactattcgaatagccgtgcccgcggttatgggcggtcgatcagattcaccgtgattagtctcacacttaataaatcgacctaatacactgtagtttaggtgggttggttgggcctgttcaacgtggtgtagcgttgatcagtggagatttaatgttactttaattactcaacagttttactgttttgctcaataaaatgttttacaaccgcctttatgcaaatagccacaaaccgtccttgtgttccccttgcacgtctgcatcgttggtgtggcttgctgagtacggtggttgtactcagtcttgctattattcccccttttcagaagtgtagtgcttctgagctgaa

SEQ ID NO: 22690 - DNA, 1501 bp, Oryza sativa
caaaatttaaaaggctatacttatattaagagtaaaaactacatatatttatccaaattatcataaagctatatatttaacatggtgtatcataaaactacagatttaacactaaatttatcacaaaactatgaatttaaagtggaatatcataaaactacatatttaataaaaaattatcacagaataacaaaacttgacatttataacccaaacataaaattagtgctaaggatttaaaccctaaaatcttaattttgcgataattttattgttaaatatacgacgaatatgatgatttgaactgatgataaatcattcatacgattgaaaaataattttctccattaaattagggtacagtcacttgcaacttgttcattatagttgattgattgaattaaggcctggttcagttcccaaattttttttcccaaaaacatcatatcgaatctttggatacatgcaaagagtattaaataaactaattgcacagtttgtatggaaatcgcgagatgaatcttttgagcataattagtccatgatttgcctatatgtgttaatgacggcttagttaggctcaaaagattcgtctcgcggtttccaggcgagttataaaattaatttttttattcgtgtccaaaaacctcttctaatatccggtcaaacatccgatgcgagttccaaaatttttcttttcgcgaacttaaacagggtctaagtcccacgcttgagttatgtctaacattgcgggagatgtgtctgacatcccgttagttgaagtatccttttgcagtttactttgattactggagtagtacattctaccttttgaggggtatatgggtcttctggtcaccaccttaatttttgttaaagtgacaatgatcccttatattaggtccctcggtcaaaaaaaaaaaaaacacaacatagaaggtagtaatgtgatatcttctaattgaacaaatctggacaactaggagggtcctcctaggttgcttttttacatggagtgagtatatatttagactagaaaaaaatacccgtgcgttgcaacggataaatgctattttaatcttattattattatatgttttaaaatctactatgagaactcgtttggatcatttatttagaaaatcatgagccgtaattaggagtccgatcattttaaattagcatgcgagttttttaaagagattttttatatgattcctcctatatttctaaaagcgaacgaatttaaaaaccgactcaaatacggatttatattttcaaaaggaacaaacttaaaaactgactcatacacggatgatgtaccaagtactagcaaaaatatcttcaatatttataatagtagagattggtgtaatatgccgagagagtaggttaaaccgttcaaggacaaaacgaaaattatgttgcaacgagaaataaaaattccaattcatgcctaatttttcagttctcaattaatgcataccaatcccgccataga

SEQ ID NO: 22691 - DNA, 1501 bp, Oryza sativa
  unsure (1)..(1501): unsure at all n locations
tttttcaaaaatagattaatatgattttttaagcaactttcgtatagaaactttttttaaaaaacacaccgtttagtagtttaaaaagcgtgcgcgcgaaaaacgagatggggaagttgggaacaggggtcacttcttttttaattgaatattttttagtaggaaaaagtacgaagtaccccacgaactattgtggtcgaccgaattacccggttgttgacagaaaacacgaggcctgggagatctgcttaactccagtgcaggtccaaagctcgcattcgaatgtatgagtgtgccagttgatttgatcctgtaatcaacaagaaatagaagcaaagaaaccgcagttaaatctataaatgatagccgatcggctaggtaccgatgacacatcatttatctttgagccgatgtcatatgaatcaatcggcgattataaataaatagtaaggaactaaatctattcgatcggctgtagatattaacgatatatagttcttatattaatatatacttaaatcaagtgattgggataggtcggtcatcgtgccgagacagtataaatcacttagatcgaaatatatattaataacaggattatatatgtctatagcataaccgatcagatagatctagcgtgtatcggctaatactccgatactactctacatcaagatattaaaataggtataatgtattaaacagaagcttaatatatttagattgcgacgatatcttgacacagagggcggatttaacatgtcagtgaaacatatagagcgaatatggttaaatcagataagattggctgaaactccgatactactctaatcggtaaccagagtacaggctagagattgatattctaagcatgacttantagatcaaactcaactgatgcaacataaagtacgaaaagaagacaatatctagacatcaagccggtggaagttcatagagtggtagatatcttatataatctaggtcaacgtcgctatttaaccaatcgggtgccttcctgttacaagatgttagccgattgtaggttagatgacgatattgtcgaagattatgtaagatatatgataacttgacgaattacatagccaagattagagtatcataaagatggaagcactaatcccgagaacataattcatcataacaagttttacctcttgttgaagatcgaaaccgatgcagctcaacccgaaagcaagaactcgtcaaaataaaactaaagcaaaaaggtggcgatgcgccgagattgtattgaacgtgtatgttgttaattacatagggctcggggtctatttatacccgagaattacaagatatgcccataccggacacgactattatctctaacaaactctaagataccataagtctttgcggcagacttttgcccgtatttatctataaggaatttacataagatatcctaattaatagatacaattgccttcccaggactctatccgtgcgtggcaatcatctt

SEQ ID NO: 22692 - DNA, 1501 bp, Oryza sativa
taggagggcgatggaatgattaggggaaagggaggaggcgcgaggcggtggaaaaaaaagcggccggaggccggcaacatggggagtagctcacctcgacgggaagtagaggactccagcggtgaatggcgagggcgaaggggcggcaccagacgaagaagccgatggaggcgacggcgcatattaaggtggtctgggacggcagcaggaggcggccggaggcggcaaatgcaacgtcggcctcaggttggcggtgggggtggtttttcggtggtggaggggataaacggatcggtggccgggcttgcccgcgcggcagcgaagccggctgcggtggtggcagggcgcgggtgcggctcaggtggcgacgacatgcggctggaggcggtttagggtggtggtgactcgggtgcatggtggaaggggagtttcggcggaggtttgtgcaaatggagcggtggccggtgtgcggcgaggcatggcgaagccggcggtgtaagcggcgcagcgcggcggtggctacggcgacggcggcatccagccagagctcgccggaaagcggcggagcgcgggctcgcgcggggagcacgggagaggaaacgaggagctcggggaggagagggaaatggaagaggagagcacgagggtgctttttataggctcggggaggagaaatcgtggccggacgtgacggatttgaagcggcaacggccggcgacgtgggcgacatcgtgggcgaagtggggattgatttggcgccaaaaattggggaaaagtgggggattttgtggaggaggtggagggaaaccgattttatgcggtttgggcgcgagggcgtgagcgggaggagccggaatcggcggcgacgtgggcggcaatggcagcaatggcagcaatggtggtttcggctttggaggccgaaggtagaggaaggacctgacaggtggggtcgtcgggcccacctgtcggggagggagagagggaggagagccagggggttatttagactttgcgcgaggggaaattgatcgggccgagaagggaggggtcggcctgagagggagaagggaaggagaggggcgagtgggccaaggagggggaaaagatcttgggccaaaagcggcccaaagacaaagaggggaaattttatttgttttctttttattttaattgattaaatgaaatttgtgctattaaaattatttcttaagctccgaaaattcacgggaaatttcagagagtattttagggcacaaagaatattgcaaaatattcccggccaatgatttttaagggaaaattttaattctcccattaattcactcgaataaattgctttaacttttaatataatgatttttaagaaatgcattattaaatgatttttaaacccgaacgaaaatcggggcgttacaaaggaccccctctgggcagtattgacaacatagaactggcaatgttcagaagtaaaaactttgacagatggtggggtgaatggaag

SEQ ID NO: 22693 - DNA, 1501 bp, Oryza sativa
tctcctgccaattgactgattactagcaaagaatcccccatgatttcaatgtatcggcttcaacttccttgagtaattgcaaccccttgagcaccgcttcatactcagcttgattattggtcgcatatggtttaatagtataagcaaactcgaaacatgccgccctaggggaaattataactaagctgatgccacaaccatgagtacataccgatccgtcaaagaataaagtccatggcactatctcaaccgagccgattgaatcatcacgatgctctacaataaaatcggctatagcttgtcccttaatcgctttcggtgattcataccgaagatcaaactcagtcaaggaaaatatccacttcccaactcttctctttaatattggagccaatagcatgtacctgactacgtcggctttgcatataacagtacactcattagataatagataatgcctcaaccttgtacacgaaaaatacagacacaagcataacttctccacaggagaatactgagtctcagcatccaagagccgtcgactgagataaaatacaactcgttccttcccttccaattcttgaatcaaaaccgagccgattgacttctcaccagccgataaatataacctaaacggtattcctttctgtggaggaatcaaaacaggaggagagctgagatactccttaatattatccaaagccttttgctgctctgccccccaagtaaactgctgattggcttttaacctcaataagggtgtaaaaggttccaaccttccagacaaattagaaataaaccttctaacaaaatttatcttgccgatcatctcttgtagctctgtcttattttccgggggctgaatcttcttgatcgcattaacgctcctttgggttacctcgatccccctttcatgaacaagaaatcccaaaaactggccggccgacacaccaaaagcacattttgtcggattcatcttcaagccatatttcctggttctctcgaaaactttccttaaatcggctatgtggtcctccacttctttagatttgacaaccacattgtcaatataaacttcaaccagccagccgattaaatcatgatatatataattcatggctctttgatatgttgctccagcactctttaaaccaaaagtcatgacgacccattcaaataagccgattgcactagggcatctaaaagccatcttatggatatcttcctcagccataaagatctgattatatcctgcgttcccatccacaaaactcaaaattttgttccctgatgcggcatcaaccagctgatcggccactggcattggatattcgtcctttggtgtagctttattcagatctcgaaaatcaatgcacaccctgaccttgccattctttttaataactggaactatgctagaaactcattcagcatatcggcagggacgaataaaaccggcatcatacaaccgtttgatctcagctttaacaggttcaagcat

SEQ ID NO: 22694 - DNA, 1501 bp, Oryza sativa
cgcgttccttatccttggtaacctttgcaagggctcgcaatcgcgactgaaccagatcctccctctcatcggccataaggttgtaatactcatcggctgttaaatcgttttgtaactccgtccgtcgagagccgattctaacttcccatggcaaaacagcctcatgtccataaacaagtttgtaagaaggaacttgaatcgatacatgacaagccatcttataagaccacaatacttcagccaaccgagtatgtcattgccaaggataatcataaattttccgcttaatcaatttgatcaaacttttattagacgcctcggcttgcccattagcttgtgcataataaggtgaagaattcaacaacttgatacccacactatcggcaaactgaacaaactcatcagacacaaagattgaaccctgatctgtagtaatagtttgaggaagaccaaatcggtagattatatgctcctgaacaaattgaatagcatccccagaatcaactttcttcaaaggaatcgcctcgacccacttggtgaaataatcagttgccaccaatataaatttatgtcctttactcgatggtggattgatcataccgatcatatcaattccccaacctctgaacggccatggcttaataataggattcatagccgacgccggtgctcgctgaattgctccaaacttctgacaatcctgacaccccttataatatctgaaacaatcctccagcattgtcggccaaaagtatcctgcacgccgaagcaaccacttcatcttgtgagccgattgatgagtaccacagatcccctcatgaacttcgctaattgcaaccttagcctgatcggcactcaagcacttaagtaatactccatcaatcgtccgataataaagctcgtcatccaacagtatatactttaatgccttatatcttaatttcctagaagccgactgagatggattactcaaatactaatgcacatcgtacctccaatcatcggctgatatcgctgcaatttcaactttaacatctttgatcattggcttataccccaacgccccttgagctaaatcattagcttcaagattttttttcttgagatacatgctttaaagtaaccagccgaaactctttcattagttccaagcacttctcattataaactatcaacgtatcgttcttgcattcatattctcctgccaattgactgattactagcaaagaatcccccatgatttcaatgtatcggcttcaacttccttgagtaattgcaaccccttgagcaccgcttcatactcagcttgattattggtcgcatatggtttaatagtataagcaaactcgaaacatgccgccctaggggaaattataactaagctgatgccacaaccatgagtacataccgatccgtcaaagaataaagtccatggcactatctcaaccgagccgattgaatcatcacgatgctctacaataaaatcggctatagcttgtcc

SEQ ID NO: 22695 - DNA, 1501 bp, Oryza sativa
tcgcacgcgcgggcagcgcgcgggtgaggctgagcgggggtgaaggagcgcgccgggggagggagagagagagagagaaagagagcccgggagagagagagagagagatgggccgagcggaattcggcccatcgaaccccgggggaggcaaactaaactttgcggagggaaatcgatttggaaggatttggattcggatttgaactcgacgatagatcggggattgagatcttgagatggcacgggcactagacaacaagcaaggaaacaaatttcgcaattagggtttttaagagataattttcccgctaggcgccacgacggaacgggcgctacacatccgcccatgaccgtgggcacggctgttcgaacagtttgttaacctctgcagagggggtacactttacccacacgacattactaacccggatcacccagcccgtggggatcagccacgtcgggagacctccaagctttcatgacaaggcatttccaaagccgacacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgtttggatgaaattccaaggaatcggtccttaagtgcgagagcgggaaaccgtacactcggtacgttccccggtccgcggttttggaaattcatttagttcgcaagcaccgacccaagtgtcgggttttccaagtcttttgtaaaactccagttttacccaagttgttactcagattttaagtttgaaggcgaccgtcgatactcgcacagagtgcgcgagtatcgaggcgcaactgggtggttacaaggggacatggtatagcaattaacaatggaaggatcaaatgcgacaaattaagtaagtccgccaatctgcttcgcagatgggacaacagattaagtgtgatcctatcaatgcataatattttgcaagcaacataattgaatttcaaatataggctcaagatgttcaaaggtggcttgccttgctcgagatctggagcttgatcctcaaaatcctcgcactgcgggtcttcgggctccgaaactacacgcgaaacggggcaactcaacaaacagcgaaaataaagccctattaacgacctctaagcgtgccattagatagatctcgagatttgatgaattttggaagttgaacggagtcaaacggatttacggttggaaagatattgaatttctaagattattggatttttggtctaaaggaaaaggatttaattaaatcccttttttttggaaaagaaaagaaaagaaaaggggagagggagggaatatagacttccctcgggcggctagggcgcggcccgagagaaagggcggctcggccgagcttaa

SEQ ID NO: 22696 - DNA, 235 bp, Oryza sativa
gcgcggggagtgcggtgacccggaggtgctgcgggtggtgggcggcacgggcgacttcgcgttcgccgcgggcggggatggcgtgctccgcgcgctgtgcgcgccgcggctgttcggtggcgcggccgcggcgaaggtgttgcggcttgagctgagcgttgcgcacgccaagggctagtgcgcgtgcatgggcgaatattttgctccttcttttttaccttgtgcaaaattgttg

SEQ ID NO: 22697 - DNA, 463 bp, Oryza sativa
gccacatcccacatgcaggcaaattgctctatcccggtagtttactgaatgaacagtggcgaatctggcattatgcacctttgcaatcgcaacagatttaagtaaatccattggctgtaccgcctgtcctttactattgcgttctaattatggttttgggggctgattagacgtttagtttttttcttatcttccaaatggcacggaatggcatcagattcaagaagagcaggacgactttggtttttttaaatccatttttgagaacaccatttggtaaagttcgaacagagggttcagaaaacaaacaatacttctgccgtggtttggtagtccttcacttcactgtctgctcgctattcaccattcccttctctactactcctggactgctttgttctctcgcagtccacagctcttccatccctcccactctcctcagcttagctagcggagtagagac

SEQ ID NO: 22698 - DNA, 262 bp, Oryza sativa
  unsure (1)..(262): unsure at all n locations
cttttgttcgcagccaatgcantngnccttccctttcttgcaaaatgggnacgggattgtgcttcnccgttgtaggaccgctgatcatcacttgactggcacggcgctccacgatttcgctgttcaaacctgtaggatcgagaacaagcactcgataagtcagnagnacatgcacnataaagaatgaattctaaatacaaganaaataccccgaggagaaacccgggtcgcgtcctttggccccgaataatcaaaggccata

SEQ ID NO: 22699 - DNA, 1501 bp, Oryza sativa
aggcttcaaggaaaggctgttgtttttgcaattgattttatttgaattattttctaaaagcaactaagtgagtgcttctcaaacgacacggatgagacagtgcgtcttgtccggtcggagtatgtgcaatgtatcagtctttagattttgaaacaaggttggcacccggccaatagctttttaaacggccaccctgggccaaccactttttaaacggccacccgggccaacaacttttcgaacggccacccgggcctagctgatcccatcagctacagatttttcaaacatcgaacccattttcacaacggcaatttcacaagcagtagtcaaacaaaactacgctaggaatcacctcacatccgcccgtgaccgtgggcacggctgttcgaacagtttaatgacctctgcagagggggtacgctttacccacacgacattactaacccgggtcacccagcccgtggggatcagccacgtcgggagacctccaagctttcatgacaaggcatttcgaaagccgatacaggtttaccatatgccgacgagaggggtcccagaccaacaacaggttaggtcccagaccatactgtgccaggaagcccaggggtcctacccgacaccaccccggcgaatccacatgtctctcggcatcaaggctcccctgataagctagttactcagccaggggtgtcccattccacccatgtggtcgtacttgtcttatgtttggatgaaattccaaggaatcggtccttaagtgcgagagcgggaaaccgtacactcggtacgttccccggtccgcggttttggaaattcatttagttcgcaagcaccgacccaagtgtcgggttttccaagtcttttgtaaaactccagttttacccaagttgttactcagattttaagtttgaaggcgaccgtcgatactcgcacagagtgcgcgagtatcgaggcgcaactgggtggttacaaggggacatggtatagcaattaacaatggaaggatcaaatgcgacaaattaagtaagtccgccaatctgcttcgcagatgggacaacagattaagtgtgatcctatcaatgcataatattttgcaagcaacataattgaatttcaaatataggctcaagatgttcaaaggtggcttgccttgctcgagatctggagcttgatcctcaaaatcctcgcactgcgggtcttcgggctccgaaactacacgcgaaacggggcaactcaacaaacagcgaaaataaagccctattaacgacctctaagcgtgccattagatagatctcgagatttgatgaattttggaagttgaacggagtcaaacggatttacggttgggaagatattgaatttctaagattattggatttttggtctaacggaaaaaaggattaaattaaatccctttttttttggaaaagagaaagaaaaggaaggagggaggaaatttagactttcctcgggcggctagggtgcggcccaagggatc

SEQ ID NO: 22700 - DNA, 793 bp, Oryza sativa
cgtgcgttaaatacgctcgccgaccgaagcgacgttaccatatctccaggcgaagcaaatcggctcgcccagatttgtgcgctgctcaggtgatgtggcagtcttaaagagaccgcccattattgacagccaagttaccattaccgatgcgcatggtttgagaccgttgggtttctgcccaaccatggagaccggtcccacctgtcaccaggctttaggagtggcgtcacgcccggccacttcccatgagaagggcgatcgccctggcataacgccgggggctactgtcggtgacatgggaccgggagtatcatgactagaggcttgaggcagacacaatcgcccacgtggcctggcaccctcgggggacgtcgggcccgagggtgatgtgtgcgcccacctcttggtctccccgagggggggggtcggaccactcctgctcgcccccgagggccggggcgccccgacccctcgcgtttctactccacgtgtatgagttaggtgagcacagcggggctcaccttaccgcatttattgcgcctcggctaagcgtgtcacgccacacgaagtgcagtgcagtgcactcgattatccggtctgtgaccagtcacagaccggtcaaatcgcgggttaggtggcgacaggcggtctgacgcacacttcgctccatcccgtcaagacgagagcttctaggcactcgtccccggctggagctagcgtgttacatcccagagatgacacgttaaccccgatcgatatatgccaggcttcatcccaaccattacaagcaaga

SEQ ID NO: 22701 - DNA, 1501 bp, Oryza sativa
gggtggccgttcgaaaagttgttggcccgggtggccgtttaaaaagtggttggcccagggtggccgtttaaaaagctattggccgggtgccaaccttgtttcaaaatctaaagactgatacattgcacatactccgaccggacaagacgcactgtctcatccgtgtcgtttgagaagcactcacttagttgcttttagaaaataattcaaataaaatcaattgcaaaaacaacagcctttccttgaagcctgcattaaacacttatttcccctggcttgctgagtactcccgtactcacccttgctctatataaatattcccccccccccctcagttgctgaagaagatgaagcggatcctgctgatgaggagttcttccaggagcaagccggctacgatgagttttagggtttcggcctagttcccaagtcgcgcctgtgttgattggtccaagtcctggcttccgctttccttttgtaatgcagttgtgagctcgggatctgtccgcagcccaacatgactgtacatctactctataataaagagacctctgttgctgtgatactctgtctccctgtgataccagcactgtttcctgggactggtatcgattaacaggttaatttggagcgtcacgggctagttccggtcgggactagttcggggcgtgacactttgcttccgcctccctctctctctctttcaggaccatgtcgttgccagtcgcgttcatgctattcttattttattcgttgccaacctccaccatctatggacaagacacatcatgggacacattcttccatcttcctcagcaccatttggtcgcccgagcaccggcgcccatctttcctcctcttttgtttctcacctttggttatgaaagacaatgaacattgcgtattgtgcactattccttcttggtccagtccaaccatgcttctagaccactcacataatattgagatcataaaaatagaacatgaaaaattctaattatgtcaatgaaacgggcactcatccaaaattaatggattaggttttcatctatgaggtaaaataagttttttttttcaatttctagctaatttcagtttttttctatttgctgtattagttttagcactatttgatccattaaaaatttattataatttataatttttctctgtattgaattatttatagctaaataaaaaaatggggatttagttatataattttcctaatattgaaatatcattccggccaaagttatttgcagtttcatgttgttattttattgattatattttcttcatcatttatgtctaattgtgatatatggtttaggattttaatttgtgtcaatgaatgctaatccattgcaacgcacgtgcattatgctagttataaaaaaattgcttgaaaaaaatcatattaatccatttcttaatttttaaataatgcttaattaattatactctaatgagctgctctgttttccgtcctaagggtctg

SEQ ID NO: 22702 - DNA, 200 bp, Oryza sativa
  unsure (1)..(200): unsure at all n locations
cggggaagctctcgagaggtcgcgaggtggtggttcaactcggaccttcagaagctgtgttcaagcgatggttggaagtctgcagagcagctccgaggtnccccggttggaatcccggaggagtcggggnggtgggtatatctcgtggttgaacggggcgtgcgtcaagcttgaaggcatcggcaagcgtatcatccagg

SEQ ID NO: 22703 - DNA, 1501 bp, Oryza sativa
aaggaacttgaatcgatacatgacaagccatcttataagaccacaatacttcagccaaccgagtatgtcattgccaaggataatcataaattttccgcttaatcaatttgatcaaacttttattagacgcctcggcttgcccattagcttgtgcataataaggtgaagaattcaacaacttgatacccacactatcggcaaactgaacaaactcatcagacacaaagattgaaccctgatctgtagtaatagtttgaggaagaccaaatcggtagattatatgctcctgaacaaattgaatagcatccccagaatcaactttcttcaaaggaatcgcctcgacccacttggtgaaataatcagttgccaccaatataaatttatgtcctttactcgatggtggattgatcataccgatcatatcaattccccaacctctgaacggccatggcttaataataggattcatagccgacgccggtgctcgctgaattgctccaaacttctgacaatcctgacaccccttataatatctgaaacaatcctccagcattgtcggccaaaagtatcctgcacgccgaagcaaccacttcatcttgtgagccgattgatgagtaccacagatcccctcatgaacttcgctaattgcaaccttagcctgatcggcactcaagcacttaagtaatactccatcaatcgtccgataataaagctcgtcatccaacagtatatactttaatgccttatatcttaatttcctagaagccgactgagatggattactcaaatactaatgcacatcgtacctccaatcatcggctgatatcgctgcaatttcaactttaacatctttgatcattggcttataccccaacgccccttgagctaaatcattagcttcaagattttttttcttgagatacatgctttaaagtaaccagccgaaactctttcattagttccaagcacttctcattataaactatcaacgtatcgttcttgcattcatattctcctgccaattgactgattactagcaaagaatcccccatgatttcaatgtatcggcttcaacttccttgagtaattgcaaccccttgagcaccgcttcatactcagcttgattattggtcgcatatggtttaatagtataagcaaactcgaaacatgccgccctaggggaaattataactaagctgatgccacaaccatgagtacataccgatccgtcaaagaataaagtccatggcactatctcaaccgagccgattgaatcatcacgatgctctacaataaaatcggctatagcttgtcccttaatcgctttcggtgattcataccgaagatcaaactcagtcaaggaaaatatccacttcccaactcttctctttaatattggagccaatagcatgtacctgactacgtcggctttgcatataacagtacactcattagataatagataatgcctcaaccttgtacacgaaaaatacagacacaa

SEQ ID NO: 22704 - DNA, 1501 bp, Oryza sativa
gccaaaagtatcctgcacgccgaagcaaccacttcatcttgtgagccgattgatgagtaccacagatcccctcatgaacttcgctaattgcaaccttagcctgatcggcactcaagcacttaagtaatactccatcaatcgtccgataataaagctcgtcatccaacagtatatactttaatgccttatatcttaatttcctagaagccgactgagatggattactcaaatactaatgcacatcgtacctccaatcatcggctgatatcgctgcaatttcaactttaacatctttgatcattggcttataccccaacgccccttgagctaaatcattagcttcaagattttttttcttgagatacatgctttaaagtaaccagccgaaactctttcattagttccaagcacttctcattataaactatcaacgtatcgttcttgcattcatattctcctgccaattgactgattactagcaaagaatcccccatgatttcaatgtatcggcttcaacttccttgagtaattgcaaccccttgagcaccgcttcatactcagcttgattattggtcgcatatggtttaatagtataagcaaactcgaaacatgccgccctaggggaaattataactaagctgatgccacaaccatgagtacataccgatccgtcaaagaataaagtccatggcactatctcaaccgagccgattgaatcatcacgatgctctacaataaaatcggctatagcttgtcccttaatcgctttcggtgattcataccgaagatcaaactcagtcaaggaaaatatccacttcccaactcttctctttaatattggagccaatagcatgtacctgactacgtcggctttgcatataacagtacactcattagataatagataatgcctcaaccttgtacacgaaaaatacagacacaagcataacttctccacaggagaatactgagtctcagcatccaagagccgtcgactgagataaaatacaactcgttccttcccttccaattcttgaatcaaaaccgagccgattgacttctcaccagccgataaatataacctaaacggtattcctttctgtggaggaatcaaaacaggaggagagctgagatactccttaatattatccaaagccttttgctgctctgccccccaagtaaactgctgattggcttttaacctcaataagggtgtaaaaggttccaaccttccagacaaattagaaataaaccttctaacaaaatttatcttgccgatcatctcttgtagctctgtcttattttccgggggctgaatcttcttgatcgcattaacgctcctttgggttacctcgatccccctttcatgaacaagaaatcccaaaaactggccggccgacacaccaaaagcacattttgtcggattcatcttcaagccatatttcctggttctctcgaaaactttccttaaatcggctatgtggtcctccacttctttaga

SEQ ID NO: 22705 - DNA, 1501 bp, Oryza sativa
tcggccaaaagtatcctgcacgccgaagcaaccacttcatcttgtgagccgattgatgagtaccacagatcccctcatgaacttcgctaattgcaaccttagcctgatcggcactcaagcacttaagtaatactccatcaatcgtccgataataaagctcgtcatccaacagtatatactttaatgccttatatcttaatttcctagaagccgactgagatggattactcaaatactaatgcacatcgtacctccaatcatcggctgatatcgctgcaatttcaactttaacatctttgatcattggcttataccccaacgccccttgagctaaatcattagcttcaagattttttttcttgagatacatgctttaaagtaaccagccgaaactctttcattagttccaagcacttctcattataaactatcaacgtatcgttcttgcattcatattctcctgccaattgactgattactagcaaagaatcccccatgatttcaatgtatcggcttcaacttccttgagtaattgcaaccccttgagcaccgcttcatactcagcttgattattggtcgcatatggtttaatagtataagcaaactcgaaacatgccgccctaggggaaattataactaagctgatgccacaaccatgagtacataccgatccgtcaaagaataaagtccatggcactatctcaaccgagccgattgaatcatcacgatgctctacaataaaatcggctatagcttgtcccttaatcgctttcggtgattcataccgaagatcaaactcagtcaaggaaaatatccacttcccaactcttctctttaatattggagccaatagcatgtacctgactacgtcggctttgcatataacagtacactcattagataatagataatgcctcaaccttgtacacgaaaaatacagacacaagcataacttctccacaggagaatactgagtctcagcatccaagagccgtcgactgagataaaatacaactcgttccttcccttccaattcttgaatcaaaaccgagccgattgacttctcaccagccgataaatataacctaaacggtattcctttctgtggaggaatcaaaacaggaggagagctgagatactccttaatattatccaaagccttttgctgctctgccccccaagtaaactgctgattggcttttaacctcaataagggtgtaaaaggttccaaccttccagacaaattagaaataaaccttctaacaaaatttatcttgccgatcatctcttgtagctctgtcttattttccgggggctgaatcttcttgatcgcattaacgctcctttgggttacctcgatccccctttcatgaacaagaaatcccaaaaactggccggccgacacaccaaaagcacattttgtcggattcatcttcaagccatatttcctggttctctcgaaaactttccttaaatcggctatgtggtcctccacttcttt

SEQ ID NO: 22706 - DNA, 1501 bp, Oryza sativa
gaggcggagatcgagttcagaaacagagcaggaatcggctggagtccagatcggctacgattaggatcggctgggtctgagtcgggctaagtaagccgatacagccggttccgacaatatgacttgtacacgacatcgggttcaagttaatgtacctcaagatgattgccacgcacggatagagtcctgggaaggcaattgtatctattaattaggatatcttatgtaaattccttatagataaatacgggcaaaagtctgctgcaaagacttatggtatcttagagtttgttagagataatagtcgtgtccggtatgggcatatcttgtaattctcgggtataaatagaccctgagccctatgtaattaacaacatacacgttcaatacaatctcggcgcatcgccacctttttgctttagttttattttgacgagttcttgctttcgggttgtgctgcatcggtttcgatcttcaacaagaggtaaaacttgttatgatgaattatgttctcgggattagtgcttccatctttatgatactctaatcttgtctatgtaattcgtcaagttatcatatatcttacataatattcgacaatattgtcatctaacctacaatcggctaacatctgttaacagaaggcagccgatttggttaaatagcgacgttgacctagattatataagatatctacctctatgaaacttccagcggcttgattgtctagatattgttcttcttttcatacttaatgctgcatcagttgagtttgatctattaagtcatgcttagaatatcaatctctagcctgtactttggttgccgattagggtagtatcggagtttcagccgatcttatctgatttaaccatattcgctctatatgtttcactgacatgttaaatccgccctctgtgtcaagatatcgttgcaatctaaatatattaagcttctgtttaatacattatacatgttttaatatcttgatgtagagtagtatcggagtattagccgatacacgctagatctatctgatcggttatgctatagacatatataatgctgttattaatatatatttcgatctaagtaatttatactgtctcggcatgatgaccgacctatcccaatcacttgatttaagtatatattaatataagaactatatatcgttaatatctacagccgatcgaatagatttagttccttactatttatttataatcgttgatcgattcatatgacatcagctcaaagataaatgatgtgtcattggcacctagccgatcggctatcatttatagatttaattgcggtttctttgcttctatttcttgttgattacaggatcaaatcaactggcacgctcatacattcgaaggcgagctttggacctgcactgaagttaagtagatctcccaggcctcgtgttttctgtcaacacgcttttggcacgcccagtgggacatgtaagaagttagacgtcagttcttcctca

SEQ ID NO: 22707 - DNA, 1501 bp, Oryza sativa
gacaagaccaacgagtggactaaagtttggggtacattattttttagacgtaaagactagtagtccagtttcgcggaagattcagctttgttatagttaagggagccacgcaagctgagtcaataatcaaaacacgtgagtttcgtcagccttgagttttagcttcatatatagtgagatttaggttatgttcgggggattttctgatagcggtaacaagtcataaaatttttaggccacataaacaatttattatatatatatatatatatatatatatatatatattaaaaattgtagtcatagaatcgaagaaaaatatataagaaccgaaaagttgggttctccatgttcttacgaggtggtagattggacacagtaacctcttctatgattggagccgtttattttttttctttcttaaaaattgatttttaataaggaaaatgaatcacatccctaaatttgtagtcatttttcctgtcctgaacttgtgggggaaaaaaattgaactggctggacaaattaatggagggaacgtaacagtgacttgagtcactcgttttctttctttctttttgtttgaaaccatatatacttgagtcactcgttttcatcagcacagaagaaaatagcgtgtgatgatgttgtagagttctggaaacacactgctagctattctctatcgatcgatcgatcgatagtgccatggaaaaagataagtgaaatgtagctttcacccaaaaggatatatgctctgccccttgtctccatctcaattatttccccccataattcagtggacatggctcattggatgcttctgcaatgcacagtggaaatgaggtattactctattagcagctattagcagcaagagtactataccatttgagtaattttttcattcttgaggaaggtaatcggaaggcatcacgctttctatataaaatttgatatgtaacaaaatttgtatcgtaaagttttagtacctcgagatattattttgaaaaccataaaatttctcatatcacttataaatactttggtaccggcaatgcttgccaatcgaaattgattgattggtgtcttgccgagagaggcttcaattcttagacgatcttgcttgcctagaatccatggaaggaacgaaacgctcacatcctgaacaacttactccattttcttttctatagaatctggttgcacggctggccctatattttagaggttctagacattcttcatgacatgatcttaagatttatactttcatatatacttttataaaccatgtatcgtctaaattagcacaaataaatattaataacatgatagacatctaaaataccctccactgttcaagaaggtcggcatgcgtcgagcaaggaatttctagtgcttggatcagacatggcccagctctgcccaagcccagcccggcccggcccattaccaaccctataccaaaaatggcaaaatcacccgcaaagatgctaag

SEQ ID NO: 22708 - DNA, 1501 bp, Oryza sativa
ttaatatttatttgtgctaatttagacgatacatggtttataaaagtatatatgaaagtataaatcttaagatcatgtcatgaagaatgtctagaacctctaaaatatagggccagccgtgcaaccagattctatagaaaagaaaatggagtaagttgttcaggatgtgagcgtttcgttccttccatggattctaggcaagcaagatcgtctaagaattgaagcctctctcggcaagacaccaatcaatcaatttcgattggcaagcattgccggtaccaaagtatttataagtgatatgagaaattttatggttttcaaaataatatctcgaggtactaaaactttacgatacaaattttgttacatatcaaattttatatagaaagcgtgatgccttccgattaccttcctcaagaatgaaaaaattactcaaatggtatagtactcttgctgctaatagctgctaatagagtaatacctcatttccactgtgcattgcagaagcatccaatgagccatgtccactgaattatggggggaaataattgagatggagacaaggggcagagcatatatccttttgggtgaaagctacatttcacttatctttttccatggcactatcgatcgatcgatcgatagagaatagctagcagtgtgtttccagaactctacaacatcatcacacgctattttcttctgtgctgatgaaaacgagtgactcaagtatatatggtttcaaacaaaaagaaagaaagaaaacgagtgactcaagtcactgttacgttccctccattaatttgtccagccagttcaatttttttcccccacaagttcaggacaggaaaaatgactacaaatttagggatgtgattcattttccttattaaaaatcaatttttaagaaagaaaaaaaataaacggctccaatcatagaagaggttactgtgtccaatctaccacctcgtaagaacatggagaacccaacttttcggttcttatatatttttcttcgattctatgactacaatttttaatatatatatatatatatatatatatatatatataataaattgtttatgtggcctaaaaattttatgacttgttaccgctatcagaaaatcccccgaacataacctaaatctcactatatatgaagctaaaactcaaggctgacgaaactcacgtgttttgattattgactcagcttgcgtggctcccttaactataacaaagctgaatcttccgcgaaactggactactagtctttacgtctaaaaaataatgtaccccaaactttagtccactcgttggtcttgtcactaattaataattaatctccgaaggatgagcatgaatcatatactatatgtatatcacattaacaaattcctaacccttgggcaccaagaaagatgataaaattaaggataagactttttggcctgcattagtcgtcatttcttaactgctcatgcaacgactttgcataatt

SEQ ID NO: 22709 - DNA, 832 bp, Oryza sativa
agtgtaagcaaaatgtcaaaatcccttatattaggggacggagggagtatcatgtataatgtagtaaaatggataaaatttgcatattattattttcttaaattgattaaccagtgaattcacattcttccattagtcttgctcatgtaaccatgcaagagctaaaaattgggtaaccattttgggggaattcctcaccatttttcacatacaatttataccgagagcagattagagaaaaatgtttttttcttgaaatccaggccttatcgacattatctaaagtattttgttcaaaactttcacactccaatttggacttcttatggaaatgagaaaataaaatcagtgacctataggtgctcgacatcagaacctagccttcaatggtcttcatgcctcccacaaagccacacctaaccttgtactcttgtagtaagatgcggtaactataaattgtacagaacttttcaggtggttctgatctatgataggggttactgctaagccaggtaattaacagatttttctggttttgctgctaggttaaccatagagtatattcaagtagcccaaaactagcaggcactagtggtacgtgttatctactttttctctccaaccagaaggctcaaaaacaatttaaattacctagcataaaattcgttgttgtttatgtccctgcatcatgaactaaactacctaacataaaattcattcttgtatatgttcctgcagttgtacattctgatgacaagtttagatggggtacactaataagaaagcacttattaaactctcaaggccctatttgcgaagcaagaataatagt

SEQ ID NO: 22710 - DNA, 583 bp, Oryza sativa
cactagggagaaccaccatgggagacacccatgatataagacgatcaacacgatcgacactcaccatgaagagacaatcaacacccaccagaagccacaacatacaagcctacatacgccaagacaagccgccggatatcgacatcagagatacgcctggatcgaccctatccggtacctttagaggccggccgtagggatctagcactgtctctgattccgtcgggcgcgagctcgaggaggaaggctaccctgttgtcgactatgagtcagaccttcagaccgccatgtcgacaacagttagataggctaccccacatattgtactggtgtgattatggtgaataaaaagcaacatcggctccggccaacaggatgtagggctattacctgatagctcaggggcccgaacctgtataaaaatccctgtctccatctctttttcctcagtctcgcgtatatcctagcaccgacgatcctcatactgtccaaataccgtagtcgagacatcaaacgtcgacagtggcacgccaggtagggggattttggtgcttcagtatttcgacgagatgggttcaagaga

SEQ ID NO: 22711 - DNA, 470 bp, Oryza sativa
  unsure (1)..(470): unsure at all n locations
aagaaacatattttctaatagaaataggcttaaaggtactggaattatggtatnttcaatgtttaatgcatttttaaatanctgatctttccttcttcatgaaagttttacattcggataaatttaaatgtaaaaaatttagtgtgtatccctctcatagatccgtatgtataagtcaagtgaggtaccaagtggcatataattaaggaattatcgagtactcactttgtccctaaataagtgttaatttagtcaaaaatttatccctaaaagaatttagctttagagtggtgtagtagaccactttacatcattttctttttatttgtagtcattaactaaaccaatagtgttccttcatcctccttgttttcttcccctcctcattttctcttcatattagtaataaatgtgtcagagttacggataagatataccctttacccttggatgtatgttgtataccgata

SEQ ID NO: 22712 - DNA, 1501 bp, Oryza sativa
agtttgctgtgctgccttcaactaagcaaggccacagaggcctagtttacttccaaacttttttttcaaaaaacttttctatcacatcaacactttcctatacacataaatttctaactttttcgtcacattattttaatttcaacaaaattttcaattttgacgtgaactaaacatacccagagtgatcagctgctgggcaaaaccgtaaatcgaaacgattctgaatttctggttcacgggtcggctggaatcatcgtggtgtcgtattaatatagtagtatttaactgcactgcactgtatcagtttagtgtgaactttacagagagctatactagactacgatacagagagaatgacagattggcccgatcgatttgttctccggcatgggcgaccctacacaaaatgcttcgttacagatagccaggtcgatgtgccgtctcctttgttgcttttcaccttttctttttactcaggctcacccagacacagacagtctcacatcacaagtcagtatgcatatgcctccaatctctgcagttcccagttggataggaggattcctagataatctcgcagagttcagtcgcacggctacagaatcggacattcagatcacagttgcaagcaacagatcacatgaacaagctccaactaatacagtttcagttcaaccagtccaatgcatacaggaacaaatcaagaaagttccagctcaccagccagtctttagtgtcttgctaccttcttcaagttccaacacgtacaaacagaaagggcaatccagatctccctgaagatgtgtgctttgtgatgaattttttataatcttttttgaagaataagctttgtgatgatttattaatacctgaaactcaattaggttctaaagcaagcattgcaagtagaggctctagagtagcatgacatgaagaggtagttacaccgtgtttagttccaaactttttttttcaaactttcaacttttctatcacttcaaaattttcctacacacataaactttcaacttttctgtcacatcgttctaatttcaatcaaactttcaattttgacgtgaactaaacacaaccttagtaccttgagcattcaaactccaaaaaggaagctgcttgagagagcaaagaagataccaaaccctcttctttccctatccccttccctcctatgatcctatcctatcctagcttccattccccctcaaccttgcacatcaccatcctccccttaatgccactcctcgcctcgctgctgccgccgcctcatcgcattctagagcattgctcatggcggaccaccaccaccagccgccgaccccaccacggcgccatcggcgtccccatgagctgtccatggcggcggaggaacgacaccatgggacgcagacggcgatggcgtcggatgacgatcgccaccatgatcgtggcggctggatcaggccggaggagaagcaccggagctccggcgtggcgtgggcgc

SEQ ID NO: 22713 - DNA, 612 bp, Oryza sativa
atttaagcagaagtcgggggctactgccagggttacggataaggtataccctttacccttggatgtatgttgtataccgatacggttagggatggcaattttacccatgggtccgggtatccgtggatacccgacccgatgggcacgggcgtgggtgtgactttttacccatgggcacgcccgcccgagacccgaagacgttatgggcaataggtgggtttcattttttacccgtgggtaacccatgcccaacccgatacatatgtattagctaattttgactcatttcttaattcttataccatttctctcagttcatttgtgatgctaactgatactaagttgtgatgtaattcaaattattgttgataaacgataatttggtaaattattgattttatttctctttgttaagttacatatcttttaagttattattcatgtgagatccattgggtacccgccggacatacccgcgcccgccgggcatgggtacgggcacgaagttttgcccgctaactctaatgggtagggtttgggtgggcaatgtcgggcatcgggtcgggcatggttttgctctacccgtgcccgacccattgtcatccctagata

SEQ ID NO: 22714 - DNA, 1501 bp, Oryza sativa
cgagagatcactacgatcaactggttgagaaccggtgagtaggtgtccctcgatcatttggagtcgtggtacgaggaccgctacgctgccggtcgaagaccagttgtagctgttcctcaaccatctgaagtcatggtgcgaggaccgctacgctgccgtagtcgtacctcgaccatctgaagttaaggtgcgagagattgctacgtattggtgcgagaaccagtgagcgagcagaattatctctcgaacactaatggaagttgcggtgcgagagattgctacgtactggtgcaagaaccagtgagcgagcagaattatctctcgaacaccaatggaagttgcggtgctagagttggtttattgcaatttgtatctcatgtggccagtatgactcacgtacccaacttatagcatatccggatgtccgttcgcaatcatgtcgagtgatcaagccaacgacgttcacgagagattatccgttaacaaccttttctcgagtagtccagccatggccggtgctatgagataggtcgtcggtctttattggtaggttgggtgcgataattccgcatttgtcgagaatgttctcgataatggagtgtactcgaccataacctactcgagtgctcaattgttcctgaaaaatattttctagaaggcaagacatatagcagagaatatcgagtatgtactcaaaaactgcgtggatcttctagtattatcaggatataacgagcagatgtaaatagcaagcattatgtaaaccgtaaacaagcatgatttatacagaagaaaatagagcgagcccccagcgttagaccgtagttggcctaacatcggaagcactcgcacaacagatattgtataaaaaatatgctctaggtaaacataataaattatagatctgacaatgatgtatgatctgaataggtatgataaattgcagataaaatattgcgtacctttgtagatacatgccggatgtatctatgaaattagtagaacaatttgaaaaaccaatctaccaattaccttattgcgtactcattcgacatcatatgatctgacatcttttggtacgccgcgtatcttgaggcttggatgatctcgatagaccgagttgtcgatgacgatgatggttccgatctggtcggaagatgtacttcagtcgggttagatcttctcacagccgaagtcgtcgagtagcttgttgttggagaatccatctcttgaacccatctcgtcgaaatactgaagcaccaaaatccccctacctggcgtgccactgtcgacgtttgatgtctcgactacggtatttggacagtatgaggatcgtcggtgctaggatatacgcgagactgaggaaaaagagatggagacagggatttttatacaggttcgggcccctgagctatcaggtaatagccctacatcctgttggccggagccgatgttgctttttattcaccataatcacaccagtacaatatgtggggtagcc

SEQ ID NO: 22715 - DNA, 1501 bp, Oryza sativa
gcagacaagtacaggtatctcacgtttacaaccataattactacagtatctctgagaggtgaattgcttatcactcgactagtatgcacgatcagtgttagcaaagacaggtggagtgtctgctgtcaaattacaagtaggctgtcaagaagctagcgtttcgtccttgagagaatcagacacacggccgaggatccctcgttgcggttggtctacggtttggcatctcatctacttcatttctcatctcacacgactgacacaattaattagtggcttcttgtcgattgtgttagagtaaacagcaaagtactccctccgtcccattttaaacgcagtcataaatttctatgtccaactttaatcgtctgttttatttttaaaaacaaacataaatcaggtataaaatattatttatgttttattatttagtaataataaaaatactaattataaaaaattttaaataagatgaatgatcaaagttgtagattgcgtttaaaataaaccggatgaagtacttcggtactgtgcttgctacaacatggcttcttttgtcactttgacgtgttgggaaaagatgcaacccgctttaatgattgtgttgacctttatgttaaggcctcaccaatcccggtaaacaatcgtctcctcactcattaccacaaactatgctccgattcattttcatatattaaaactacatatgagcaattctatgttttgatcattgtttctctaccacagtaccacttatatatgagtagtaccaagaaaatgttaaacatgaaagcaattttcatgataaagctagtgaaatatttgtcatatattaaagcttaattaatgttgttgcatactcatatatctgactgtatgcttgctcagctcaacacctactctatttaagtaccagtactgattagtttacatcaaactcttaattttctagtactacacaattaagcctaacggttgctactacactactgccactgttatgactagtgacccactaattcttcacaagtcacgtaacgcccggaattaaaaatgtcacgcaattcattgcacagctgcagccggcacctccgcatttgtgctctacatttgtgcttgcttcacatgaaaaggctacacatgaatttaatatctcacacctttcccttgcgtacaaaattcagtcaaactcagctactagcatggagcctcaccgacacccctctctctcatctcatttacacattttttaaaaagtaaaaaagtaattcaaagaaagagtatctgggaatattatgttactcgtgcgatgccacattcagataaatttggagtacaaatttactaaaaataacaaatccccaaattgtacttgcactaacaccaagatattacaaaaagtaaaaaaatcaagcctcacactccaaagaagactcctccctcgcatcacttgtcggcgtggtcgcttcttccctccccccagccaaatttcgtcaaattc

SEQ ID NO: 22716 - DNA, 215 bp, Oryza sativa
aagtgggtgcgggagatgaggcgcacgcgcgggcgtggctgacgtggcccggaggaggcggaggcgtggacgcggcggcggttgcgggcgcggcggcgccgactggaggaaggagacgggcccaacaggtggggcccacctgtcggcgtcccggggagagagggagggcggcttgggccggcccacaaggagaagggcgcgcgcggcggggtggt

SEQ ID NO: 22717 - DNA, 1501 bp, Oryza sativa
ctgatgtttctgcaattaattttatttgaactcttttctgaaacaactaagtgagtgcttctcaaacgacacggatgagacagtgcgtctcgtccggtcggagtatgtgcaatgtatcagtctttagaatttaaacaaggttggcacccggccaacagctttttcaacggccacccggctaacaacttttcaaacggccacccaggccaacaacttttcaaacggccacccgggcctagctgatcccatcagctgcagatttttcaaacaccgaaccccttttcacacagcaatttcacaagcagtagtcaaacaaaactacgctaggaatcacctcacatccgcccgtgaccgtgggcacggctgttcgaacagtttaatgacctctgaagagggggtacgctttacccacacgacattactaacccgggtcacccagcccgtggggatcagccacgtcgggagacctccaagctttcatgacaaggcatttcgaaagccgatacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgtttggatgaaattccaaggaatcggtccttaagtgcgagagcgggaaaccgtacacccggtatgttccccggtccgcggttttggaaattcatttagttcgcaagcaccgacccaggtgtcgggttttccaagtcttttgtaaaactccagttttacccaagttgttactcagattttaagtttgaaggcgaccgtcgatactggcacagggtgcacgaatatcgaggcacaactggatggttacaaggggacatggtatagcaattaacaatggaaggatcaaatgcaacaagttaggtaggtctgccaatctgccttgcagacggaacaacagattaagtgcaatcctatcaatgcataatattttgcaagcaatataattagatttcaaatataggctcaagatgttcaaaggtggcttgccttgctcgagatctggggcttgatcctcgaaatcctcgcactgcgggtcttcgggctccgaaactacacgcaaaacgggacaactcaacaaacggcgaaaataaagccctattaatgacctctaagcgtgccattagatagatctcgagatttgagaaattttggaatttgaacggagtcaaacggatttacggttggaaagatattgaatttctaagattattggatttttggtctaaaggaaaaggatttaattaaatcctttttttttgaaaagaaaagaaaagaaaaggggagagggagggaatatagacttccctcgggcggctagggcgcggcccgagagaaagggcggctcggccgagcttaa

SEQ ID NO: 22718 - DNA, 186 bp, Oryza sativa
acttataaccaagtaaggcagtattctgtttttttttctcgaataaccaagtaaggcagtatatctgtcaagcatgatattttgtttttcccaaattattgaagaaaattttgtcagaaagaaaaagagtgttgtgcacctatgtaaattagctgtctctgaaagaacaaaccctcatccttgtgt

SEQ ID NO: 22719 - DNA, 1016 bp, Oryza sativa
  unsure (1)..(1016): unsure at all n locations
agtgcnagtgagtatccgatgactatcacgcgaattcgagctcggtaccctatttatataaatttacaccatagttacacccccacttagttatataattaggatgtaattttaggacttgcatatgtaattttaggacttgcattgtagatgcactaaaatcacatatgtaatttatggacttataatgtaaatacatgtcgactattttttttataaaaaatatgacgccgtaaatatagttactccctgtaaaaaaaatcacgacaggacatgacatgccgcaactatcaaaaacaaagcaagctttgctagcaagcgtattgaattactgaactagttctacctcacaattgcaaacaatccttttttttttttacttttgctagatatatgcccgcacattgtaatggatcagacgcatattgatataactaggaaaatactcgtgcgttgcaacgggtgaaagttattttaatattttaatcctggtattggtacacagtttagttaagttgaaattcactgtaggaattcgcttggatatatattattctaaaaaatcatgagcggtaattaggagtttgcttgctagttttttaaaaatgatttcttatacgactccttctgtattttcaaaagcgaacgaactttaaaacccgactcaaatacaaatctaccaaagtactggtaaaaatattttaatttttataatagtagatattaggggtagactaaaagctcgcatgttaataggccaagctgatataattagagagatgatggttactttttcatgcatacacattgcacgagtggagaactctgcatttaagatggtagagatatacttcttttgccatgactgattttgattgcaatacttgtatgttcgttctttgaccattatatatatgcactctgctactggtttaagacccatttgaatagtaaggatgaaaaaacagaggaatagaaaaatcacataattctaaaaggaatacaattataaaata

SEQ ID NO: 22720 - DNA, 718 bp, Oryza sativa
aggcccgttgtatatttgatttattatctgtatgtgtttttgggagccatagcctagcggtcatggtgctcaagtagcacctctaggtcctaggttcgactccccatgggatcgaattttaggtttggttaaaaaaggtcactcgttgtcactggcccctttaaaacacatgtttagaattgacctatggagggcgggccctcgtgtacgggttaaggaccgacccatacggggcaagtccgtgtgtgaggggccagggttcgtagtctttctcggccgatttggttgaggcttcctattcttaatgaaaagccataggggtggtcattcccccgccaccgccagtcgaggtgttttttttctttttctttctggaagtcagatttaggatattttttaaaaggtaaaagtctgtttatagaagtcgactactatgctgtaatggttgttttcagtacctatttgccaaaaatagccatacgaagtggcaacagcctttaccatatctgcaatataatacgggttacatcccattgatcaatccccattcactggttacatgcatgagtactggctttagcagcatttctttgaatcatttttttattactcccaattaattaattcatcaaacttacatgtcagacgtgagtttgcaccaatgctgattttccaatgatgataaattctccttttttccttgtctgtaatttgcagg

SEQ ID NO: 22721 - DNA, 1501 bp, Oryza sativa
cacgatagtaagacacaatcggctttgtcatgtcagccttcaaaggggtacatgtcgtgtgcaccaacccttgaataaatcatgtatctcaatgtctcccatctcctattctcaactctggtatgctactattgaactgataggtatgtaaatgaatatatccacaactaacctacatgagtaggcaatattccaatatacatactcacccatagccatcaatcaacgaaagaaaacacaagaaggctcatggtagaactagtcactactgagtacatagtgatttgcaaattgaaaacattttcttcaggggtgggccaagtcaggatggggagtgccaggccctcctcgtcacccacggtggtttcggcacaatttctaactatactctatttagtttacaatcgtaaattgcactccacactcagtaaatgttgactaagtttcgttatacactgatttttggtactccactactttcactttgtagcagggtgaagcaaaatttgctgggatgacaaacaagtatagcaattgtattacaacatttttaatgacgatgtttcttagcaagaaggtacataattcttagatagataaaagaagtaatttacaactaaatgaaaactattaattatttgtaccatttctttcacctttcatttgagaccgtgtatgggtgtatggcactaagttcattaaaattacacgtgagataaggaatagtatatgttccatttacattgaccctgtagatttggtccataagatgtgtgtgtggacacgcacacggctacgagatcgatggccaacaatagtgcatatataggtcaatcctctagaccaaaataagcttaattacatggtatgaccaggagcgtagagcaaggcatcattcaccgtatatagcaaggccatctatagctacaccaagctttgtaaaattaattatatgctggaaatatatcttacctttttcttaatacaaaacgtggaaaagagaatgagattgtcatctgtgtattctctgtttgttttgagaaaggaatttgatagggcatcataaacgagaatgtaaaattagagcctaactaacgtgacatggtcttcaatttttacaaccacaaggaaaattaaatcatagattcactaaaaaagcccattctaggtattgattatggttgtgaaactaaataacggatagtaggtattagattggccacacaatttaaaatatttatgtgaatatgtactatacactttaatgtgcttaatctaacattgagataaacatattggcatatggtataataagcatatatatttaaagagagttaacaatgctttagaattttttaagtacttatctcttagcctacgaacttaattatatagagcatgctatatcggctattaccaccactattgtggctactatgttccaaacgctagctattttgaactgttgtattgttgtggtggcctcaggatcccattatca

SEQ ID NO: 22722 - DNA, 1020 bp, Oryza sativa
agctgatatccataaatgaatatgcccactgctaacctacatgactaggcatatattccaacatatacatactcacatctaaccatcaatcaacaaaagaaaatgcaagaagtcttgtggtactagtactgttggacagatagcgattaaacaaaagcaagctagtaatatttgtaggaggagataaatgatttgcaaattggaaatattatgtacgggggtgggccaagtcaagatgcggatggagggggggtgtcaggaatttctcgctgcactggcagcttcaccactgcatgagacgctctcctaacacatgcttatgataaatagactagaggtgtgatttaaaaatttatttagtgtgatctagatgtgtctatgacaatggaaaaggggagtgtgtctactgctctcttttcaatagagttgtctcctcacgctctcctagacgtgtctatgatagatggctagaatgtgatttagcgatttaattcgatccaagtgtgtctatgatagatagactatggatttgatttattggctaacgtagtgaattttacagccatataacatgtcacaactatatataatattaaatagcggggtaaccattttactatttgtagcaggatgctatggccaccacaacaatagaatggttgaaaacagctagcatctagaatgtagcagctgcaatagtagtggtagcggcaatgctaggaggcactattaaattaagttcataggaggctatgagataagcattgaaaaaatgtatataacatttttgcaacttcttttaaatatatgcctattatatcataagcgaacacatattgtttatctcaatttttgagtgtgtatcacataaatcaacatttttttgaagtccatgcctaatgtggtcataaccaacgagtctattaaagattgtcacatgttactagatcatgtcatcctggatcatggcgatgcttctatcaacacttgccatgtagagtttgtcaattacttcaacca

SEQ ID NO: 22723 - DNA, 1501 bp, Oryza sativa
tttccaaacaaaaaatcgtcaacaatttttaagcatttccataaataatctaaattaattgtttccatgaaagtcatcgggacctatccactatctgccataccaaatctatatataatccacaatttcctattgtccactatttagtgccttaactataaccaatatataaatggtttcagagcatgcgattttttgtatgtgaatgtctccaatttcacttatgtggttgtataacaagaagtccatatcatgttagctaggttccttaaacattagctatgttctctagttcatgttgtcatatcatatttctttcttaaaacaacacagagaatacacgaatagtggttttattcttttccacttttttataagaaaaaggtaagatatataccattgacaacataattaattttacaaatcttggtgtagctagatggtcttcgtcggagggattagctatggcacacatgggaaaccatgggattgtgacgacaaggggttttggttgtgcttggtatgcctggaagtgcttgggaggtaagaacacaaaagaagcatatatgtttagcctcccgaaggataataacccaactcctttctagatcactattggtgaaaaatctgtagaaagttgggagttcttgagcttgctagcctagttcttgccgattctagaagccaaccccctctaacgagctctagtcgggcttttataccctaccacctctctctctctctctctctaaatagtattgtacacaatcattagatcgtttcaactcttagggtgtgttcgcatgcccttgttctcaacctcatctccctcgttttccgcgtgcacgcttttctaactgctaaatagtgtgttttttgcaaaaagtttctacatgaaagttgcttaaaaaatctaattaatccatttttgaaaaaaaaagttaatacttaattaatcacgcactaatggactgctccgtttttcgtgcgaagggaatggttcccatccacaacatacaaacacagccttagagctccacgccagttttgctgtagaagcaaaacttcatatgggactccgtgttgggcagacctgtagggtcttgtagtttccaccacaatcatatgaaaataagaacttagatacgggctatctcaccacattaaatgaggtgagacaacttgagagaatctgtgcaaaatataaataattatatgggttagatatgtgctatcttgtacatggagatttctagtggtctttgtgcaaaacagaaggattggcatcaacttttgggactttttacaggggcaaccaactatggggcaaatctataagtgtcatacaactttggtgcattggagcaaaatttgcaggtataatcattgtttaaatgggcaaatagttaatatccttgtaggtacggaagaataatattctacatttccttacccttacatctgtcacatgcttgtctatgtgttcttcattgtatatact

SEQ ID NO: 22724 - DNA, 791 bp, Oryza sativa
ttattatattcttaagtatggcaaaagaaaagtattgaccttgtataattaagtgaaagtatgcttcggttacatgagtataattaagtgaaagtatgtgaaatgtataatatgtggccttaaatttgaaaattcatagagacaactggtgtattttaccatgaatagtacttctctcttttttttttcggggatatgaatcgtacttgtcaaagagaaaattcaagccacagtactattaatgagattgaagaacactattaataggaaacccattagaaagctagcataatatatcctgatagtaccggacaataccttgtgctaactcgtgatgcttcactgagaagtttggtactggtcgagtactacctttactcttttagcattaatatttaatatattcttaagtattgcaaaagaaaagtattgaacttgtataattaagtgaaagtatgcttcggttacatgagtataattaagtaaaagtatgtgaaatatacaatatatgaccttaaatttggaaattcatagagacaactggtgtattttaccatgaatggtacttctctttttttttcggggacatgaatcgtacttatcaaagagaaaattcaagccatagtattattaatgagattgaagaacactattaatagggaacccattagaaagctagcataatatatcctgatagtaccgaacaataccttgtgctaactagtgatgcttcactgagaagttggtagattcagaatttctatttcgtgaaattaatatattggttagca

SEQ ID NO: 22725 - DNA, 252 bp, Oryza sativa
  unsure (1)..(252): unsure at all n locations
aaggcttcntacatttggtcatcttttcagaacaactattttcggccctcagtgatatggttgagtgctggatatcaggatatgttattcctgcaaatggcatcgttcaaataacttatcttaaaaaagtttgacgtgtgatctttaagtgaactaacttttgtaacaatctaaacttccttacttggaacatggcttttcgtgttaagataaaaaaaattgtcctttgaaatatagatggaaatgttataa

SEQ ID NO: 22726 - DNA, 1501 bp, Oryza sativa
gtaggatcgagatactatgaaaattaagatattatgtggaatcggtatcgtttcggcttggtaggattgtagtatcgtaagatactaggatacgaatcgggatactgacaaccttgcgtatcgcccggctgaccaagcaaactctatgaatcatcactgtcttgtatttggtttgatgaacctcctatcctttcttttttctttctgggtataatctatgggatgatgcaattattgtgtgatattaataaagcttgcaaaaggaaaaaaaacttgtactcatatgagcatgttgtaaaatattttgtctgtatcgaacgcaagttggaaaaatcgatctctcctgccaatctgatatctgtatttgtacagttagtagcagcattatattattgactttatatggatgaataatatattcatatatagttcactgccttgcttaacgcaattgtgttatgaaaaatatgaatttttttctcctatcttcggttgaaacaatgaacaaatactctttaccaatagcaacaacaggaatattatttttttatgtaccgaagaaaaaaaccaagcacgtcataggtcgacgtgtatatgttcgtctttcatatctctgctctataaaatcgtgtatataggctcgattatactcctaatacatttgaaatcaagacaggcataactcatccccaattatatataactgtatacggaaatgccctgcgtcgggcgcccgatgggcaccgtgcctccggcgcctccgtgccgtccccaccacacacaccgttataacaaatcacccacataatacaaaaatgttctattaagggaatacctttcattttttttccaccaacaatattttagcaagtatactcgtgtgtgtttcactatgtataaatcaaatgttacattgaattgtaatatcctttcgctattttgctgaaacattgtttttatatatggtgaaacaacttcaaaaaccattgttctatacattatagcaaaatgttttatgaggtgatttggttgtgtttcaactttttaaacgattgaaacattttcgatccacctaatgaaacaattccgatctatttggtggaacatcagatttttgcaaaaaaataaaaataaaaaataatcggacgtgtaggtggccccaactatataagcacatttgcaatacaagaacgtgaaaaaagaacaaaagcaatcaacctcccaaaaggcccaaatagaggcctggcccatcaacccacgaaggcccagctatcttcttttcctttttttttttcctttccagttccacttcagaaaaaggggaaaaaaatcgcatccgatccgaatccggcgagccgaatcaaatcctcccctcgagcaccagcggagcggaggagcgaattcgccggagacgagacccctcgccgtcgtcgattccccaggcgagcccgtgcattcgttcctccgcggcgagcagaagcggtgcgcctgcctgcgatgg

SEQ ID NO: 22727 - DNA, 344 bp, Oryza sativa
atcgtgtttggcaatacaacaccttggaccaaaggatgcttgaaagatagactggataattaagactggatgccaaagtacgcttgctgctagccatttcggtagcttttgtggtttctacttaactatcgtgtttggcaatacaacaccttggaccaaaggatgcttgaaagatagactggataattaagaactatattggactgtacattcgcctatagacttagtcatgctgctggttgttctctgtcgctgctacaaggtgttcgtgctattgccttctgcttctgtgtgctatggtaattgtaactctgtggttattgcgcatgatgctctttgaattt

SEQ ID NO: 22728 - DNA, 1501 bp, Oryza sativa
ggagggagggacgaaaagagatggggcgccgggaaggagggcgctgtgtgggagggagggaggaagggattgacgaaaataggtgtgaaagccatatgcattttttagttaggtatagatttaaaaaacacatggtttagctgttcaggaaatgtgcacgcagcgaaaaaacaagggagtagaaattggaaaatgcaagatgtgcaggcaacactgctatcaaattggactgatgatagaaacaagtgactggtaagctgatgtggatcagggagaatcattactcactagtgatcagtactgctatgttgctttcaataaaagcaaagattctccttttaaaagagaaagtggtaattagcgggaactattcaaagctctcgaggggacatccccgttgtttgcatgtcacttaaatgattatgaaaaaccataaaagaagataataatatgtaatagatcactctacaaacgtgtaatattaaatttaacttctacatgttacaacgaaaataataaattttattgtgaatagctatagtttaacttttatgtttgtagagtgatatatcacatattaatacgtcttctttaatttttgttttcataactatttggattacccagacaatgaggagatgttccgcgagagtttaaaatgcactatcgtaggtagccaatcaatttaacatttcactcaaggagaggccaccatttccgaaatgtaccatctttaaatcaagcaatgggcactgtttggttatatttcctgtttgctctgtgttttcttccaccttccatttctgaatcctcttgagaacttgcatagtgcatcatctactttagaacaattttgttggttcggcactgggaaaaagagtctccatgctgctctagcgtttcgtctgcaggcaaaatttttactgtgcaaaccaggtttgtctatcttttcctcagagaagcagctgaagaggaacacaaaacttcttggttgcgcagcaggtagtgcagcacaagcagcagcctggcactgtgattcccaaggaattcatgcctgtgactgtgtgacatgcccatcggcacatggagatttcacgatcagggtagcgaaggaagcatcgaacagatgcttgattgctggcctgctgccgcatcggatgtccagacatgaaccatctcaaacgaagcgaagcagatgctgccgcagtcccaggctgtctttgatcgtaggagtcaaggtgcaaccaaagtttttttttttttttttagaataagagggcaagagtactgccccttttcattgactgcctcttttttttagaataaaggtgcaaccaaagttgccacaaggataaagcaggagggaatcaaaacaaaggcctttattgctttgccactgctactactacctctctgtgaatctgtgcagtttcattgtacgctgatctctctggtcgaccaccggcttagctgagagatcctactcgtgcccggtgtcgag

SEQ ID NO: 22729 - DNA, 819 bp, Oryza sativa
gggacccacttgatcctatgtttctgcgtaagcgcgcgcaaacgggctggtccccatcaaaagcgaacacatccacgtggtgtactcgttaataataagggcctgctcttcgagcaagttgtagtacttacggctcgtggggatcgatgtcgattaccccgatgaatcgatctgagataactgtcgctcctcgttccttggccgcatctctaagagagatctgtgattgctggaccttaggaggtgacgtcctcatggcgctgagaagaacctgcagctttgagaggtcgtgattctttgtcttgtgaataggacaatagacatcgcgggttagagaagtacgttgaattccacgctctttgcaggcgtcgagaaatacccagcaagcttgtaaggtgtgtttcctggttttgtggatatgacaccaggactttgtcgcctcggaagttgtccttgtcggctcgtgattctcgtcggaaggacaagatttggccgcattaggatccttctcaggctcggatgtcgtcgatgttccgttctccacttctgcgggaggatccttcgacatggagccgtccagggttgtaaccacggcgttctcgcttctggtcattgatggaccagttgagatcggcaccatggtgtaaaccaggaagacgatttcgccgacttgagtccacaccagcattgttgaagtagaaactccttggttgatgccggggttgacgctgttgtcgacgaagcttgatgacatagtagtagaaccttgagcaccaagttcccctacctggcacgcccctgtcgacggtggatacccgt

SEQ ID NO: 22730 - DNA, 282 bp, Oryza sativa
  unsure (1)..(282): unsure at all n locations
cgcgcgaggtgngtgcacactactactatagggcgaattcgagctcggtacccaacgatcacagcctacgaagtcggagcctacaggagccaagttccgggtgatctagtcggaccaactcgactatggtattgtcgatatcatcgagttctgctattccctttgtaatatgtggtttccatcatataatcccataccaactggattagagctattacctatcaaggggcctgaaccagtataatccttgtcttctatttgcttgatgtcgtattacataga

SEQ ID NO: 22731 - DNA, 268 bp, Oryza sativa
cagtaaagcagtatgtatgtcaaatatgataacttgttgctcacaattattgaagaatctttttttaaaaaaataaaagaacttctctgcacctatgtaaattagctctcttaccatgattctttaatctgtgacaaactactaaatgtcctttccttccagagaactaatattggggtcctattgaaaaaaaaattattagaatgatgccgtattaatatttctatcttgatcaatatttcctttagcatgaaaacctcattcttcc

SEQ ID NO: 22732 - DNA, 280 bp, Oryza sativa
  unsure (1)..(280): unsure at all n locations
agggcttggggggtctttcattctaacttggcttcgcttcccaaggttngaattcgggtacagaagtatagcctcgggttcaagagggccgatagttcaagctcttcccgcagtgnccctcggggctcttcataagggtcgggggcgcaccagcaccatctgacgagcgggaagaggnctgactccggtcgtcagggcctttaggccaccgttcggctcgggggcctctcctccatgctcgctcccgggccaagtcagcacagggtgagggtgcgcggaa

SEQ ID NO: 22733 - DNA, 660 bp, Oryza sativa
ccacttacacctctgcctcttgttgccaccaattacttatttcttgtgtaatatatttcgagcaaacataggtcaatttgcataaaagcaatacagtgcttgtctagttaccagacaatcacaatcggcgaaagtgtagctacacatgacactttctatgtgcccacatgtttattgtggtccagagtacaatgagatgcctaaatgcactccacatttacagctaaaagcttaactcggttatacttgatgaaatgaacaacatggccatcctaaagcagattcaccaaagcactggctggcctaatattcagttgtttagaactcaatctggaccactaaactcagtatgcctaaatgccaaggacgccacaagatccatattatctacagaagaagtcattccaacacatgtttcatacaagatccaaaatgatttcatggcactaacaattgcaatcctattccatcacatagctatagtgggtacatagaaaataacttctgcttgcctctttaagcagtgaaaccaaggggaaaatcccaagcagaagagcatagcaactgacaagaacttcataggtaaatgctgccatgtttgctaatacgggtaaggacacgtctaaaagaatcaatcaatactttctttctttgtccagg

SEQ ID NO: 22734 - DNA, 1501 bp, Oryza sativa
atttgacactatcaaaatttttagtagggcatcaatccaaacatgccctaaatatgttactacctccgtcccaaaataagtgcagccgtggatatccgtacccaacatttgaccgtccgttttatttgaaaaatttgcgaaaaatttaaaaatatttagtcacacataaagtactattcatgttttatcatctaatagcaataaaaatactaatcatataaaattttcaaataagacgaacggtcaaacgttgaacgtgaatagtgtaaaactgcacttatttttgggacggagggagtatcacgtaagcaaaaatctaatgtgacaaaagtgacaaaagagttaaaagagaagagatgtaaaaagataaaaacattatttctcatacaagaaaccatctctatagaataaaaatgatagataaaaagagagaacacaggaaccaataatgaaaacggtggataaaaggagacataagaaatgagagaacacaataacaagaataaaaactgtggataaaaaaaagagagaagagaggtgattagatgagaatttaatttaaagatgccattcactgggtatataatttttataaataatgtctatatgacatgtaaagtatagtataaaaactattttgatagttttagtttgagatgaccttattatccacattttcctagctgcttcgtgcaatcggtctcgtcgaacggctcacacggcttccacgtttctcttgtgttagtagccagtaggagtactttatactaccactgaaatagctgagctaatatacgcgtaaattacaggtcttagaaaaacgatctgggttggtcaacaacctttggtcgtaggccatgtttgcggcttgcgattaatggagaccgagaacttgagggcacgtaaaataagagagttaacataataattaattaagtttaaagtgtttctttgagcccgttcagataagtgccattttgtaccatatcattttttaaaaattaacaaacactggtaatgcctagaaaattttgataccaatgcgtttagcttgtcaccaaatatggtaatgcctaaaaaattttgataccaatacatttagcctatcctactaaaatttagagtaaagtccatcaccgatccctaaacttgtaccgctgtgtcatctcggtctctaaactcacaaaacgatcgttcaggtcctcaaacttgttcaactgtgtcatcccggtccctaaacttgcagatcacttgtttaggtcctccaatttgttaagttatgtcaccccggtccctaaacttggatttaaatatcattgggttaaatagaacggtctaaagactttatatttaaaaataatttataactttttcatgtgaactctaatgaagacaaactttatatcaaacttgtagccctcgatttacaactttgtagtcgattttttttattttaagtcattttttgtcccaaaatataattttaaaattaaaatttcaa

SEQ ID NO: 22735 - DNA, 1501 bp, Oryza sativa
taggttgtttggtacttgttgcatcttgtagctctggggattgagaacatcaaaggttttatggcaattacttactccacttagcaacaaaaaggcattaaggactaaaccaacacccgatgattcaagttgttgggctgaatgcgtcaaattgggaatgtttacaagattattatctttttgaaaaaaatggtagtgcatatactctttccatgaaaatatagaagactacctaaagttaacacttcacaagaatattatataaaatcaggtgttgcaaaatgaataggaaatggccagatttagagtactctttgattcaaaattgatatatctctggcaataggttacagctcaccttcgagccatctctagttatgtttttttttcagagagggttaaataaccgcctttgatgatcctggagtagcacaaccacatgtattgatgcgttagcataactatgatgtggtttctgaacagtttctgaaagccctgtgtctagtagtgattatgaattacttgaaaaaaaggggaaaaactaaaatacatacacatgctacaagaaaacatataatctgctgtttttttaagaatggcaagtgttctgtctaagttcactaagctctacaaaagaaccacccttcatagtccttaaggtggcagtcaccttggaccagacaatgtgtctggagggagatttgcaacagagtcattgcgagcctcagaaacgccctgtcctccttgcaggcttgcctgcacaatcgtcttcctttgccatgcatcccagtgctccgcgataccgtcttctagcattgtcaccaccgttgacattctggggcggcttggagcggactcctgggtgcagagcagcgcaatctgcaccagcaacctcatctcctctcgcactccctgttccccaccattgtagatttccagtaagtttgggtcaatcagcacctccagcctgtcctcttccagcagtttcttcacctgaataataaaaagaatatggccctcttttatcactgagttcatgcttatgctctacaggaatagcactgtatcattttttttaattcaattcaatatgaagtaagaattggtaaccagtttacagtgtatgttggtcgttccatgttaaagagatcaacagaatgtaaatatctgcataatttgcagtcaatattgttttttaacaaatgaaatcgtgcgaactactaatgattagggaggtagacatgtttgatctattgaagaaagttggagtttcataaggattgcttcagtaatacagtatgaattaagtggttcattgaagacattagcatgttgtccctagaaataagaatcgaaactaaagattatagtgcaaattataatgtcaaatgtaaagcatgggaggtagtcaatataactgacagaatataatagcttgagaaaagacatatcctgcaaaacaagggaagattcaacaaagcatgacttacccaatcatgca

SEQ ID NO: 22736 - DNA, 455 bp, Oryza sativa
aagggcggggagccggggactagcggctatggcgcaacaaaatgcatacgagtatttcttccttttttttttcttggaccaaaggcaattttttctgacgagttttgtttccaagaacgcattattttagaacaaaatatttcagaaaaacctcgtatttatatgaaatactcctatttcattgttacatatgattatttttcataaattcacattagtcgactcaaagcacacatttctctcgtctagcttaatttttttcttactttttagtgcactagaaactcaatataatcctaactcaataattgattaaatgtaaaaaaaatcatactataatcatcaactactgttgaaagcacggaattagggtctcaaattttttcagagctatagttttgatatctgttggatccattttttatcttagaaaaaacccaaaagtttgaaattgg

SEQ ID NO: 22737 - DNA, 266 bp, Oryza sativa
ataagtttatatattcaattcttcataatcttaatgataaattttaagttgacaaataataacaccataaaaaataaaataattgatataaacacatgatagcctaagctcgcgagctagctcggctcggctcatttcagccacgagctgaaaaggaggcttgggcttggctcgtttggctgacgagccgagccaagtccgagctgagctcacgagcccgagctttttttttttttccatccctaactgcgcgtctgccgcccagc

SEQ ID NO: 22738 - DNA, 1501 bp, Oryza sativa
gacctacaactttgtagtagaaaagtttttgaattaaaactgtttagggtcccaaaatattgttgcatgtttatagattttgaaattttaattttaaaattatattttgggacaaaaaatgacttaaaataaaaaaaatcgactacaaagttgtaaatcgagggctacaagtttgatataaagtttgtcttcattagagttcacatgaaaaagttataaattatttttaaatataaagtctttagaccgttctatttaacccaatgatatttaaatccaagtttagggaccggggtgacataacttaacaaattggaggacctaaacaagtgatctgcaagtttagggaccgggatgacacagttgaacaagtttgaggacctgaacgatcgttttgtgagtttagagaccgagatgacacagcggtacaagtttagggatcggtgatggactttactctaaattttagtaggataggctaaatgtattggtatcaaaattttttaggcattaccatatttggtgacaagctaaacgcattggtatcaaaattttctaggcattaccagtgtttgttaatttttaaaaaatgatatggtacaaaatggcacttatctgaacgggctcaaagaaacactttaaacttaattaattattatgttaactctcttattttacgtgccctcaagttctcggtctccattaatcgcaagccgcaaacatggcctacgaccaaaggttgttgaccaacccagatcgtttttctaagacctgtaatttacgcgtatattagctcagctatttcagtggtagtataaagtactcctactggctactaacacaagagaaacgtggaagccgtgtgagccgttcgacgagaccgattgcacgaagcagctaggaaaatgtggataataaggtcatctcaaactaaaactatcaaaatagtttttatactatactttacatgtcatatagacattatttataaaaattatatacccagtgaatggcatctttaaattaaattctcatctaatcacctctcttctctcttttttttatccacagtttttattcttgttattgtgttctctcatttcttatgtctccttttatccaccgttttcattattggttcctgtgttctctctttttatctatcatttttattctatagagatggtttcttgtatgagaaataatgtttttatctttttacatctcttctcttttaactcttttgtcacttttgtcacattagatttttgcttacgtgatactccctccgtcccaaaaataagtgcagttttacactattcacgttcaacgtttgaccgttcgtcttatttgaaaattttatatgattagtatttttattgctattagatgataaaacatgaatagtactttatgtgtgactaaatatttttaaatttttcgcaaatttttcaaataaaacggacggtcaaatgttgggtacggatatccacggctgcac

SEQ ID NO: 22739 - DNA, 1501 bp, Oryza sativa
caggccggcaatgctcacttatagcctggaacgccggctcatgccccggcactgcgttctgaagtatcttaaggacaatggattgatagaatccgacaagagctactatagcgcggtccaggtgaccgaggaggtctttgtggagaaatacataagtccatacgaggacactgcgccgcaccttgctgaagactatgctgctgtatccagcgtaaagatacccaccagattcagattgaaaggaccaaaaacaggccatgcaagtgcgcaaactgcctaattcttgccacgagtagtgagctggtaagtcctcttgcagtgttctttgcctgactggttgttgagtgcgctggttttgctgttgctagccaccaacagaactgaactgataattagattcttgaattaagatatgccatctggtagatatgtaaccatggcactgttatgaaccggttcatcgttttgtcacatgtgtgcaatcgttcattcgaatgggctcatccatctgtggttgtatgaatttgccaatgaagtcatctggtagatatgtggcaccgttatgaaccagttcatcgttttgtcacatgttttgcatattgttcattccaacagctcattcatctgtggttgtatgaatttaccaatgaagttagtcttgaacaactagctttgagcatatttaggagtatgtgtttacacattcccatctatgcatgtttcatttgctcttgtttttttcttcttctactagcaatctagcatatactatgagtccatgacacttcaaaaatttccattctgatgcaaacagtgtaggcaatcatagaatctctttgtgaaatcatgctcatattattcatatgaaatgtcttgattaattgatacaagaggcatatagatacatgctctgagtctctaccatgttctacttgatgtactgtgacatccacctgaagccatcgccgtagcccatccggcggacgacgctgcacatgaagacctcgaccggccgcactccggttcctgcaaggttgacattgcccttgccggtggtgaggccggtgagcccgaggtagtagcacagctcctgctcgggcaccgcgtacgggatgtctatcttgttcccgaggacgaggaacggcacgccagcgagcgcgtcgtcagacaggagggcgtccagctccatcttcgactcggcgaaccggcacctgtcggcagcgtccaccacgtaaactactgcatcaacctgtcaagcagacatgaagcttatgaagaagcagcaaaagtggctcacttcagactttgaagagggaagtagctacaaatgctggaaaaacaggtggtatttggctattgacaagatatgcaacagcatgtgacaattgacaaagtatgcatgagctggcgccaccactgtgattactgtgtactggctgattgggaagctgtgttcatactagcatgaattctcaggcaagcgcccaactcaatccctgtt

SEQ ID NO: 22740 - DNA, 1501 bp, Oryza sativa
ctttctttttcagttacagagataataagaggtatacacataattgtgaatgtgtctctttaaatacacgttcaaataaatgaagactattaatatatctcattgttaacgaccaaatttggtaatatcggcatcggaaaggaagattagatcgaagcggaatcagagataaggattatcgcggaaacagagtaaaaatcggctggagtccggatcagctacgattggatcggctaagttcgagtcagacttggtttggtgatgcagccgattccgacaatacgacttggtgtacgatattgggttgggtcgatatgcttcaagatgattgccacgcgtggatagagtcctgagaaggcaactgtatctattaattagtatattttatgtaatttccttagagatatgtttgggcaaaagtctgccgcaaagacttatggtatcttagagtttgttagagataagagtcatgtccgatatggacatagtttgtaattctcgggtataaatagaccccgaaccctatgtaatcaattaacacacacgtttaatacaatcttggtgcatcgccacccttttttgctttcgttttatttcgacaagttattgctttcgggttgagctgcatcggtttcgatcttcaacaagaggtaaaacttgttatggcggcttgcgttctcgggattagtgcttccatctctatgatactctaatcttgtttatgtaatccgtcgagttatcatatatcttatataatatatagcaatatcatcatctaacctacaatcagctaacatctactagtagaggtcagccgattaggttaaatatcgatgttggtttagattgtacatgatatctaccactctatgaaaattccaatggcttgattgtctagatattgtccttcttttcatacttatagctgcatcagttgtttgatcttatgagtcgtgattagaatctcaacctctagcttgcttcttggttgccgattagggtagtatcggggttttagccgatcttagctgatttaactatacttgttatatatgctttactgacatgttaaatctgccctttatattaagattttgtggcatttaagtgtattaagcttttgtttgatatattctgcttgctttaatatcttaatatagagtagtatcggagtattagcccatacatgctagatctatctgatcgactatgctatgaacatatatagtcccattattaatatatatttcgatctaagtgatttatattgtctcggcatggcgactgatctatcccaatcacttgatttaagtatatatcgatataaggagtatatattgttaatatctacagccgatcaaatagatttagttccctcttatttactcatggctgccgatcgatacatatatgacaccggctcaaagataaatgatatgtcatcggcacctagccaatcggctatcatttatagatttaaccgcggtttctttgcctttat

SEQ ID NO: 22741 - DNA, 1501 bp, Oryza sativa
gaaacaacatttcgcaaaagaatattgttaaaaacccaatcattcctcacgcgccaaatagcccaagctcctgcaacaaaacaacaccacaacactctcatatctgatcgcctcatattctgaaaaaggtttagaagatcgtttctagaagtagggatcgaattccacccaaaagcatctctgtagcagcaccaaagaaaacgtgccggagggcatataaacattaggtgatctgtatcctattccaagccacacagcttgcaaagagggctacctgaccaattcatttttttgagcttcttagctacttgaattcttccttgtaacatcaaccacatgaacactctcgtttttaggggggtaggggctttccagagttcctgaagcagaatgtctttgactcccccaaaaacaatttccttgtaaagagattttgttgtaaaatttccttgtaaagagattttgttgtaaatctcccggatggattcaatttccaaatcataatatctctctttgtcgtcagttggactgtaccaagtaagtcctacaaccttagccaatcaggtaattcgtcttgacctaaagatctcctgagattaatttcccactcccctccagacaacatttgtttcacggttttgtcagggtcactgcaaacactgtgaatgtaaggacattggattttcaaaggagactcccctaaccagatgtcgtcccaaaactgtacagaatccccacagccaattttgtatgcactaccaaacttcatccacctttttacttcatgaagtcctttccaaaattgtgatcccccatcagtagaagactgaaagaaacctcccccagctgagaagtattttttccttagcaattcacagcaggggctggtgttaccagattctaatttatagatccatttgcagagaagagtttcattcattactctggtgttattcaacatttgatcatccgttttttttaatatttttgttattagtatttttgttgttattagatgataaaacatgaataatactttacgcgtattctttttttacttttttcattaaaaaaattaaataagatggacggtcaaacgttggatttaaaaacccacaagtaaatttattttggggcggatggtgtaggctgatcaactcagatgaactgaatgaatactctgctgatggaaaatctggcacagattgaacgcaaccacagctgcacaggcaaagccctgaatcctgatttgtctgtctgcacctttattgggccgagcctgaatgggcttttaatctaacagcctactttggaccaggagaacgagaaggccggcccactgttcatttgccgagcaaagtatagagatttctctccgtttcgacgcctcaccacggagactgaaagctgaacccgatctgcatcagaattcagaagtcagaacaaactgactggctggctggctgttcattgaaagatggacattactctgataccatat

SEQ ID NO: 22742 - DNA, 230 bp, Oryza sativa
tcgttagcgatcaagtttcgaccgccaatattaccaaaatagaggagaactagttatacttgcaatgcatatttaagttagaataataatattccactagtattaggattactaaccttttgcagagaataaccataaagtggaggagaatcgacatcaaaccaaatgatcaatcaatcggacgatatcgagaatcagacttatgtatgaatgggccaagaacttagaaa

SEQ ID NO: 22743 - DNA, 163 bp, Oryza sativa
  unsure (1)..(163): unsure at all n locations
aaactgacgcgtggtgaacaaaaatgccggtttgtgactggtctaacacggtcacgtcatcgacagacaaccgtgctcccacgttgcatctgcttccgncgaagtgaaggcgagtnacggcnctggccctcactcaaggacaagctgtgattagctttccagc

SEQ ID NO: 22744 - DNA, 167 bp, Oryza sativa
ataaaaatccctgtctccatctctttttcctcagtctcgcgtatatcctagcaccgacgatcctcatactgtccaaataccgtagtcgagacatcaaacgtcgacagtggcacgccaggtagggggattttggtgcttcagtatttcgacgagatgggttcaagaga

SEQ ID NO: 22745 - DNA, 1501 bp, Oryza sativa; identical to SEQ ID NO: 22712

SEQ ID NO: 22746 - DNA, 167 bp, Oryza sativa
aaacaagacgccgaagccaaacgacgcaatcaagatcgttccactctccagcgccaaccccgacaagaccgtcaagatcagggcatcaccgaacgagaaataggaactcgcgctcatcaccttcctctgcgacaatgcagacgtgttcgcttggcagccatgcgaca

SEQ ID NO: 22747 - DNA, 1501 bp, Oryza sativa
ccgccgtcgtcgccgctgccgccgccggtgagccgccctccttccccctcgcgtccaccgccgccgctgcttgggtgggagagagccgagagagagagagaggaaaagagaggccggcagagagaaaaagagagaaagagagaaaagaaagaaaaagagaaagagcgaaaagaaagaaaaagaaagaaaaagagaagagagaatggagaaaaagaaaaggaaaaataaatagaaaattaggaagaaattaaggaggttaatagtttaagaaaatctaaaataattagaatttaattatagattaattatggtcatagaattgcaaaatttaatataaattatagattattcttggtaatttctaaaaaaaatcaattcgtggtagtagtttagatgtaattaacgactaaacaattagatgaattgttatagactattatagattagttttggataatctctataagtaatcgattcacggtagaagttcggatttaatcactaggaattttagacgtatattatatttaatcggttagtcatagggtaaattaaatcgtataatattataagataattttttgattccgtccgatatttagctcgcgatagaaaatttctaacctattatatggatataatgctcgggtagattaaattaaaaacttatgataacaaaatatttatacccgaaaaatagtttaggatgtataaatcgaaattagatttgccctagttcgcgaatagtaaagttaatataaaagaatcaactttcgcattcgacttccatttggatttatttggatctttatttgaattttaaccgaattcaaatcgtttcttcgcacgtaattttagagtccgagggagttgcggatccaagcgaggaccaagaaccgcaagactttgagcaaggcaagtcatcactattctttgaatatattgatcccaattgcgaaattattttgtttataaataaaattgcatgcaatgatgaacatcttacttgtgattatgccatgccttgattattgtttacccttaaaatccttgtaaccatgattacgtatgagtccctagtcaattatgacaattgcttagaaatgccattctagaatcatgcatactcatatttatcaaatgctatatgcttgggcaattacctttgggaaggtaattgagatgcggcatgtggagacatgagtgccacattgccatgacgttgatgatatgatttgtgagaggagaaataaaattaaacaattgttttcgactggggcggacggaggatttgggtggtatctgggaaaggctagtaccgtccccggtcaattaaggaccgagccatgaagttaagcatgaaacgacccccgtacaaccgtacttctcgaatgggtatagacctagcggattagatagccgagcggaggcagtatccctgcatagatggttcacccctgagtgaggcaggtgcgctacgatgggacaaccgttgaggtag

SEQ ID NO: 22748 - DNA, 386 bp, Oryza sativa
  unsure (1)..(386): unsure at all n locations
tcgggtttcgtaagaggtctgtatgtgaaattggatttttttttcatgtgggtcataactcatanccaaatagcatgcaaatctttttgcatgtgaacgctcttttggtccgcttgtataaaatagggagtgtgtccacaaaaatcggtttttagtagtgatacgtggacgacagtgatccacttaattggggagacgaacgaatgaaaacggtgggtggaagcagaatttattttctaaaaaagactggaaaatggcccgtgcattgcaacggggaagaaaaaaatatcaaatcatgtgtatgtatatgttcagctttgggaggacaggtgaggtggttggtgctctcagtggctttgctcctgccctgccgtcgtgcaaacagg

SEQ ID NO: 22749 - DNA, 1501 bp, Oryza sativa
cgtaaagatacccaccagattcagattgaaaggaccaaaaacaggccatgcaagtgcgcaaactgcctaattcttgccacgagtagtgagctggtaagtcctcttgcagtgttctttgcctgactggttgttgagtgcgctggttttgctgttgctagccaccaacagaactgaactgataattagattcttgaattaagatatgccatctggtagatatgtaaccatggcactgttatgaaccggttcatcgttttgtcacatgtgtgcaatcgttcattcgaatgggctcatccatctgtggttgtatgaatttgccaatgaagtcatctggtagatatgtggcaccgttatgaaccagttcatcgttttgtcacatgttttgcatattgttcattccaacagctcattcatctgtggttgtatgaatttaccaatgaagttagtcttgaacaactagctttgagcatatttaggagtatgtgtttacacattcccatctatgcatgtttcatttgctcttgtttttttcttcttctactagcaatctagcatatactatgagtccatgacacttcaaaaatttccattctgatgcaaacagtgtaggcaatcatagaatctctttgtgaaatcatgctcatattattcatatgaaatgtcttgattaattgatacaagaggcatatagatacatgctctgagtctctaccatgttctacttgatgtactgtgacatccacctgaagccatcgccgtagcccatccggcggacgacgctgcacatgaagacctcgaccggccgcactccggttcctgcaaggttgacattgcccttgccggtggtgaggccggtgagcccgaggtagtagcacagctcctgctcgggcaccgcgtacgggatgtctatcttgttcccgaggacgaggaacggcacgccagcgagcgcgtcgtcagacaggagggcgtccagctccatcttcgactcggcgaaccggcacctgtcggcagcgtccaccacgtaaactactgcatcaacctgtcaagcagacatgaagcttatgaagaagcagcaaaagtggctcacttcagactttgaagagggaagtagctacaaatgctggaaaaacaggtggtatttggctattgacaagatatgcaacagcatgtgacaattgacaaagtatgcatgagctggcgccaccactgtgattactgtgtactggctgattgggaagctgtgttcatactagcatgaattctcaggcaagcgcccaactcaatccctgttcattatgagtttcaaaggaaataaacttgttggtcagtcctgtaaatagtccattttctcctactctatcagtataaaaggcaaaccttttgcccgccttagaaaaaaaaagaagaaaaacttgttggtcagtcatgaatatacacatgctggctgtacgactaaagaaacatggtacagttcctcccgcaattgataccactatcagtt

SEQ ID NO: 22750 - DNA, 1501 bp, Oryza sativa
tgctgctgtatccagcgtaaagatacccaccagattcagattgaaaggaccaaaaacaggccatgcaagtgcgcaaactgcctaattcttgccacgagtagtgagctggtaagtcctcttgcagtgttctttgcctgactggttgttgagtgcgctggttttgctgttgctagccaccaacagaactgaactgataattagattcttgaattaagatatgccatctggtagatatgtaaccatggcactgttatgaaccggttcatcgttttgtcacatgtgtgcaatcgttcattcgaatgggctcatccatctgtggttgtatgaatttgccaatgaagtcatctggtagatatgtggcaccgttatgaaccagttcatcgttttgtcacatgttttgcatattgttcattccaacagctcattcatctgtggttgtatgaatttaccaatgaagttagtcttgaacaactagctttgagcatatttaggagtatgtgtttacacattcccatctatgcatgtttcatttgctcttgtttttttcttcttctactagcaatctagcatatactatgagtccatgacacttcaaaaatttccattctgatgcaaacagtgtaggcaatcatagaatctctttgtgaaatcatgctcatattattcatatgaaatgtcttgattaattgatacaagaggcatatagatacatgctctgagtctctaccatgttctacttgatgtactgtgacatccacctgaagccatcgccgtagcccatccggcggacgacgctgcacatgaagacctcgaccggccgcactccggttcctgcaaggttgacattgcccttgccggtggtgaggccggtgagcccgaggtagtagcacagctcctgctcgggcaccgcgtacgggatgtctatcttgttcccgaggacgaggaacggcacgccagcgagcgcgtcgtcagacaggagggcgtccagctccatcttcgactcggcgaaccggcacctgtcggcagcgtccaccacgtaaactactgcatcaacctgtcaagcagacatgaagcttatgaagaagcagcaaaagtggctcacttcagactttgaagagggaagtagctacaaatgctggaaaaacaggtggtatttggctattgacaagatatgcaacagcatgtgacaattgacaaagtatgcatgagctggcgccaccactgtgattactgtgtactggctgattgggaagctgtgttcatactagcatgaattctcaggcaagcgcccaactcaatccctgttcattatgagtttcaaaggaaataaacttgttggtcagtcctgtaaatagtccattttctcctactctatcagtataaaaggcaaaccttttgcccgccttagaaaaaaaaagaagaaaaacttgttggtcagtcatgaatatacacatgctggctgtacgactaaagaaacatggtacagttcctcccgcaattg

SEQ ID NO: 22751 - DNA, 1501 bp, Oryza sativa
attgaaaggaccaaaaacaggccatgcaagtgcgcaaactgcctaattcttgccacgagtagtgagctggtaagtcctcttgcagtgttctttgcctgactggttgttgagtgcgctggttttgctgttgctagccaccaacagaactgaactgataattagattcttgaattaagatatgccatctggtagatatgtaaccatggcactgttatgaaccggttcatcgttttgtcacatgtgtgcaatcgttcattcgaatgggctcatccatctgtggttgtatgaatttgccaatgaagtcatctggtagatatgtggcaccgttatgaaccagttcatcgttttgtcacatgttttgcatattgttcattccaacagctcattcatctgtggttgtatgaatttaccaatgaagttagtcttgaacaactagctttgagcatatttaggagtatgtgtttacacattcccatctatgcatgtttcatttgctcttgtttttttcttcttctactagcaatctagcatatactatgagtccatgacacttcaaaaatttccattctgatgcaaacagtgtaggcaatcatagaatctctttgtgaaatcatgctcatattattcatatgaaatgtcttgattaattgatacaagaggcatatagatacatgctctgagtctctaccatgttctacttgatgtactgtgacatccacctgaagccatcgccgtagcccatccggcggacgacgctgcacatgaagacctcgaccggccgcactccggttcctgcaaggttgacattgcccttgccggtggtgaggccggtgagcccgaggtagtagcacagctcctgctcgggcaccgcgtacgggatgtctatcttgttcccgaggacgaggaacggcacgccagcgagcgcgtcgtcagacaggagggcgtccagctccatcttcgactcggcgaaccggcacctgtcggcagcgtccaccacgtaaactactgcatcaacctgtcaagcagacatgaagcttatgaagaagcagcaaaagtggctcacttcagactttgaagagggaagtagctacaaatgctggaaaaacaggtggtatttggctattgacaagatatgcaacagcatgtgacaattgacaaagtatgcatgagctggcgccaccactgtgattactgtgtactggctgattgggaagctgtgttcatactagcatgaattctcaggcaagcgcccaactcaatccctgttcattatgagtttcaaaggaaataaacttgttggtcagtcctgtaaatagtccattttctcctactctatcagtataaaaggcaaaccttttgcccgccttagaaaaaaaaagaagaaaaacttgttggtcagtcatgaatatacacatgctggctgtacgactaaagaaacatggtacagttcctcccgcaattgataccactatcagttttttcttggttttgttgtaacaat

SEQ ID NO: 22752 - DNA, 167 bp, Oryza sativa
cgccgccgtgaaatcgcaagctacgactagtagagactagggtgcaaatactgcagtttcgatatggccttaaaagttgttgggccgcaattgtagcccgttgggcgaaggcctgcatttttggacgggcagcggctgatgttttttttttgtcaggcaagcaaaga

SEQ ID NO: 22753 - DNA, 597 bp, Oryza sativa
ctgagaagaagtttcttgacaagtttgtgcattcttgcaagtgtagcattgcagatcctgctaatgcttatgcttctagctttgttggggatgttctgtgaatttattgtctgagaggacaacaggaaaatgggctcattcttgtgctgggagggtactgacaggattgttgtgttggaaagatcaagggtttagacttatacttttgctatctccttcgtgctcattaaggtttgctatctccttcgtccattgttgcaaaatttcttataactttgctctaggttatcttgtgttggctagtatcactattcactgattgataaacaggaacactacagcctgtggtcaccctctaggttgatggaatgttgaataacatttccaggagttaacatgcttttgttttataatgcagcatgtgtagctctgttgtttgtattcaggatccgatgttttccttccctaaacgggtttatccatgtctatggcctgctgccagaatcccagtgcatatgcagaagaaagaagacaaaaattaaacactatggttatcatatgtggtgggtttagttagttccataacttgggtaaagt

SEQ ID NO: 22754 - DNA, 1501 bp, Oryza sativa
ttaaaattttagaagtcttaatattaaaagaagtggtagaaatgatccttgaatttatccaatatatgagttgcaagcatgaagtcgtgtcttccccccaagaacaatgtattcatatcttctagtgtgcttcaaagtcaataatctctattcataggtctgacattttcatccgagcaatagtgctgtttacaattggtgactgccgtcactattgtttctccaggaaatttcaactcaagtgcttataagttacttatcactgttttccgatagccttagcccttgagcgatatggttgttaccctggcactgcttgttcaagcttctaaaggcaaagggattgctgaatgtgaaacttagctactacagcattgcgttgcaggtgaaaagaagttaattgacaagttcatgcacccctacaagatccaggcctagtgagcagatatgcttgttctgggaaaaatacctgactgaagttctattctagcagatgaatgagaactagagaatgcgctcacgctccccattgctttgttggaagaacatagggtttgccatcccccttgtacattgctattaccctttttgccattttaccgtaggtgatccattgtagtaccacatgcactacaattgattccctataaaaatgcattaattgattagctgaaggaattttcttttaaaaagttgatgagcagcagagctacagtatggctcccatcttgctaggcatggattagatactgacatttccatgagaaacatgaatgatttgttgagcaagcatgctatttcccaggttttaactgtttgtttttcaaatgccttcatgacactatcttagtttgtctgagattcgtagtactataatgtgttgcatcacatactacattaggttttttttggatggattgagtaattatttatgcatggacttgacatctctttctctctctctttctctctaggattgaattgttacatttcgatatgagcttgctcaaagacaggtttggtaatttgaaactttatattattcatggttccagccgttcaatccttcatatcatccagaattccagggctggggttgcatctgtagcccttcatcaaccccacaaaattgccttgaaaatatgttgacatccaagatccaaccatccgtatcaggataggggatccttgaactgactgttgttcactacttcactccatatgatcaacccctcgaaattccaagaccaaaaccaatgggcctttaattaatcttacattggtcagcctcaactttagttatgtaggccaaaattataacagctaaagacaatttataggccaaagtagataccaggggttcaccttttcaattgagtgctggatcacgagccccaatagtataactttttcagtcaaatttcgatcaaattttactatttccaatttgaattctcaaaaagcattcagattttcattcagaatccactttcagaaacct

SEQ ID NO: 22755 - DNA, 1501 bp, Oryza sativa
caagttgagggacctttagtgtacttttcccttccttgtttgtgagctcaccgagctgagaaatcataaccctgtgatttcacgcggccgccgtcggcaacccttgcgccgccgccgccgacgacgacgacgccatgatccgcctccgggagcgcatcctatctctgctcctccagccagcatcccctcgcccaatcgccggaattttcccgccgccttgccccctccgccgcctcctctccaccaccgcgccagtttcccccaaacccttcgccgtcgacgagtacctcgtcgccacctgcggcctcacccgagcccaggcagccaaggcttcggagaagctctccaacctcaggtccccctccaatcccgacgccgtcctcgccttcctctccgacctcggcctctcgcgccccgacggcatcgccgccgccgtcgccgccgacccaaggctgctgtgcgccgacgtggggagcagcctcgccaggcgcgtcgacgagctcggcggcctgggcctctcccgctcccagatcgcgcgcctcctcccgctcgccggcaggtgcttccggagcagctccctcgccacaaggctcgccttctggcacccggtgttcggctcgttcgagaatatcctcaaggcgctcaagatgaacgccgccctcctcggctccgacctcgacaaggtggcgaagccgaacctggccttcctcgcgcaatgcgggataaacgcctccgatgtcactcgcacaaccttgtccctgtactcctgccggctcttcaccgtgaaccctaggttcctccaggacgctgtggcaagagtggaggagttaggcgtggcccgtggttggaggacgttccaccgcgtgctcagtacagtggctttcttaagcagggagactattgccagtaaaatgcagctgctggatgatcttgggttttcgcaggatgatttcctggtaatcgtaaggagggcgccacaagtgctgcgtttatccgatggaaggatacggcgatctgttgagttcttgataagggatgtcggtctggagcaaagctacatcgcacaaaggccaacgttgttggcgtatagccttgagcggcggttgttgcctcggcattgcttgctcaaggtcctcaaggcaaagggattgctgaactgtgacttgtcttactactgcatagccgcgatgagcgaggagaagtttgtgcaaaggtttgtggatccttttaaggacaaaattcaaggccttgctgatgcttatacctccagttgttctggggaagcaaatggagttcgttcattggtttgcctgtagactgaaattggatgatgttaaagtttatgctgggaaatttggctagattgttgcacaagaatgcaaaatattaaggtttgtgatcccttatcattttgtactacctttgttaaaacttgtgctgaaaaagtatgtaggttatagttgtatgctacatgttgtatcttgtagctctggagattcaa

SEQ ID NO: 22756 - DNA, 1501 bp, Oryza sativa
atttctatccacacctaatctttattttaaattatatttattttatcaatttgtttttagggtttattcctaattaactattctttactcacgattaatgaacttcgaaattaaatccaaataaaataggcgaataagatcggcatgatgcatttaatttaaaaagtttttgaaaatccgtatttttagagttttgattttgtcggtcgaattttcagggtgttacagtatctcttcttctcttctgttttcttgtgagccgaaagcaaccttgatgagggcttgtcccagaacttgcactgcttcgccgctgaaaccactgagtgaagtcggtgcttgagacagtgccagggttggcaaacccatcttggcatatgttccagcaaacataacatcagccgaacttcctccatcgatcaggatgcgccggacttcaaaaccggctatttctgctgaaacgaccaacgggtcctggtgcaggaatagaactccttcggcatgttctggtccaaaagatattggctgtgacaagtatcttggaacgctatcacctgctgagacaatgttgtgcacggcctgaagctacatcttcttttgccgtttcgacacttgtgaggggggatcagatcttgtgatgacctatgttgtcgaaatgacaactgcgtacgtcgaaagacgtggttactcaacagtggttggaaggaaacgaagtgtattaaatttctaaattcttttcttttcgatccccccattacatggccctaggggactatttatagccccattacaggatcctactactagggtttaggttgtacaggggaatttacatgattacccttacgaaagggacatttacaggggtacataatgttataggggctcataggcccctgatgggccgtcaggcgatcgccggccctatagcccctaggcttgatgggccggaaaggcttcttcggccctcgcgggagcgaacttgtcatggcgaagtcgtcttccttcggcggatagtcttcgccttgcacccttcgcctgagacgcctctggcccggcaaggcactcgtactactcttcgcctcacgtcgttcttgctccatagccttcgccacgggtttgggcagacttggtcgaagggcctcatgccatccgccaacaagcccctcatgggcacgggtgagattggagcttcggccgagaccatgcaaaccatgtggtctggtatgcggcgccccctttcgaccgatgctcctgccgaaacctacattattcctgcgaatgaagtttgttacttgtgcggctggtattattttgccgcgcttcgcctcgtgcgattggtggttatatattttattttcctgggccgaacggaacagtattgggccttcccatcgtaggctttttactgtgccgctcagacggtgggaatttaccgtttcgcctacccttgcgacacgtggcgctttattactggtgagtagacgaacggtcgcctgggtga

SEQ ID NO: 22757 - DNA, 1501 bp, Oryza sativa
actgtcttcttcgttccagccggggtaatcaccatcttcgagttcacggtggcgaaaaatatggcaccgaagagctcagcgctgggctcaaacccggaagtccggcatgcccagtcaaagatggagatccgaactagcggcgatgggctcaactgcggaagctccacctggaaaaggcgaaggatatccggcaacaacacgttgcacggaaaccgtagccccacctcaaaaaagacggcaaacaccaccgtccgattgtcgacaggcttcggcaccacggctttccccggggcgaaagcctgccccttaaccaacgccccagagctgaccaacttcgccagttcgacgtcgtccatgagagaaacccccaaaaaggcggtgctgtcatcatcaacccgaccgggatccggtccttttgccgaagctaggtttggcttgcgaggggccatggcgaacggcgtgtatgcggtggcgaaggaagagaatgggcgaaacacctaaggggtcaagaaatgctgtggaagagaggaacggaagaagagagcgcacgcggtaaaaatggcaagtgtaccggtgaaaaggaaagaggggtgggaatatatagctcacccaggcgaccgttcgtctactcaccagtaataaagcgccacgtgtcgcaagggtaggcgaaacggtaaattcccaccgtctgagcggcacagtaaaaagcctacgatgggaaggcccaatactgttccgttcggcccaggaaaataaaatatataaccaccaatcgcacgaggcgaagcgcggcaaaataataccagccgcacaagtaacaaacttcattcgcaggaataatgtaggtttcggcaggagcatcggtcgaaagggggcgccgcataccagaccacatggtttgcatggtctcggccgaagctccaatctcacccgtgcccatgaggggcttgttggcggatggcatgaggcccttcgaccaagtctgcccaaacccgtggcgaaggctatggagcaagaacgacgtgaggcgaagagtagtacgagtgccttgccgggccagaggcgtctcaggcgaagggtgcaaggcgaagactatccgccgaaggaagacgacttcgccatgacaagttcgctcccgcgagggccgaagaagcctttccggcccatcaagcctaggggctatagggccggcgatcgcctgacggcccatcaggggcctatgagcccctataacattatgtacccctgtaaatgtccctttcgtaagggtaatcatgtaaattcccctgtacaacctaaaccctagtagtaggatcctgtaatggggctataaatagtcccctagggccatgtaatggggggatcgaaaagaaaagaatttagaaatttaatacacttcgtttccttccaaccactgttgagtaaccacgtctttcgacgtacgcagttgtcatttcgacaacataggtcatcacaagatctgatcccccctcacaagtgt

SEQ ID NO: 22758 - DNA, 1501 bp, Oryza sativa
ggtcgaaaaatccttccggatttcgatcaaaccttcgatgtaacacacaatttttttttcgcgaactaaacaggccacgtgaatgtggaacaggtgcgtcaaccagcccgcttttaaatggggattctttctgtacagtacaacaaagaatctgttgaaacatgattatgaataaagctgttgtattttaacccagaaataatactgaattaaatttgaccaaagtaggtcaacagatccacagttttttaaaagctcctcgtttaagcatttgcatgaatctgcacaacagcacaaccatgagaagttactgaagaaataatacaaggagtactctacttcacaatactctgacaacaaccttcttgattgctttctttagagatagtttagaacacttatataaaagttctttttcatcgtagtttatttttcagcctttgcttttagatactacctccgtcccaaaataagtgcagccataaatatccgtgtttagcgtttcgactatccgtcttatttgaaaaatttatggaaaatatttaaaaaaatagtcacacgtaaagtactattcatattttatcatccagtaataataaaaatactaatcataatcttttttcaaataagacgaacagtcaaacgttggacatgaacagtgctaaaactacacttattttagaacggagggagtagtttagaacacgcaaataaaaattttacttacaaattattttttatacacaaatataccgtttggattatttcaccaaacatccaaacgatggggctgaatgaccgtaatgatctttggtctaaaatttatatcacaattggccgtttagagaagagaaaatgacctcaatgatctttggtttaaaaattatattgtgtcactggttccttctagcctcgtcaccttcccacacctaacactatcaatgtgttactcctaacactaggaatgaaatattaccgtattaaatattcaaaagcatgtattttatgagatggggttttgtgattcttcatatggaatcccatattcttgatgtcctcgtgtttgaatcgcttccttgaagtttctattctatcctagaacaatggaaagcagcaggaatatagacaaagcacgcaattctgactgaacaccacaatattagtagtagaggaaactgttccaaattctcgagagaggatattctctcgttgtttgcatgttatctaaataattatatattttttttaaaaaaaatcaacaagatagattaatatgtgatgaattactttacaaacaatgtatactcaaaattaacaactgcaaaagttacaacaaaaaataaatttgattgcgaatatatattaactagatatattttaatttgtttttaacttgcgtgattgtgaactgatctatcacatattaattaatctagttgattgtttataactatttggatgatatgtaatccataaggggatgtctcattcagagtttaga

SEQ ID NO: 22759 - DNA, 521 bp, Oryza sativa
ctaaacattaatatgattttccccattgtgaactagttgaactaagcatggctaagcaattcctagtccaaactctaatcatgttataaccccaagctaacaaaggagcatggtatcaaaatagtatggctgtaacaataggtaaccatcccatagtaatattgcaaaaccaatgcggtatttgaaagaaaacattaggacatttgcaatataggatcaatatgatcaagtgacaagcatgacttgccttgctctgctgctggaggaacctcggcgactatctcgaagtacaccggagcgtcagaggaatcggaatctagcgacatacaaagcaaacattgcaaacaggctataagactactgaaacagggaacaaaaccatttttaatggattctacacatttttcttgatttactgagacttgaatgggattaaacggagctcggatgaattagttatgaattttagaagattcactgtgtttattactataaaagaaaaaccttaaacaatttattgc

SEQ ID NO: 22760 - DNA, 1501 bp, Oryza sativa
acctgactgattattgaatatattgattgattcgaagcttaaatagcgtacacgggtgaacagtgtgggatcgtgtgctgcagctgcatgtcccgatggatgcatgcacgcatcgatcggcacatgaaatttcgtgcctattattagatcacccacaatgataaagtaagttgctctctataaaacatgtacatctcagcaatagactagattaatagtaaaccacctcaatggtatgtctatatgggtatctatagttctctaatacattgtcccgtttttctctatagactgtcttcaagttagtagatagttttgctctctctttatttaatctcttccaagtagtaaaatatgctgacatggatctcttgtagagagcctatagataaccattgtgggtgcctttatacttttatttttttccttatttttttcatagccgggaattaagcagcagggcacgtgccacgccacgccatgatgcatgcatgcatcgagcaaattaaacaaaaattaatatatgcatcaactcgatctcactctgccttgcaatgccctgccttgcagtgttagcaaccctaaactgatctttactctacgtttcttcttccattaatttcttctcccaaaagcaacgtgaatacatacatcttaattaattaattaattacaattaacaacaagaggagcggaaaagcagcttactgacaactaatcacatcaaattaacaagatcatcgcttaattacttttgccaattggtttgtattgaacgttgttttgatcatgagaaaattcattggcagggaaagcaagcggccattaattagggttctaagtttggggggtgacgtatactaattccattaattacccacccccaccacaagcactttaaatatgttatcttgctgccataaaataatcgccttccaaagtagggattatacgccagtcatgtgtagtaatttaatttacaccaaaccaaaaacacatcacatcaggacaaaacagaagaggagaatacttaatcgattttgctatatctcactcgaaagatttttttcttatctctcactcgattttctcactcaaatttacagtgcattttcttgtaagttacagtgtaatttataaaacttacactgtaacttttgtaagttacactgtaatttttgaatcttcacatgtaaattttaaattttgtatttgatttggtctttttcttgaggatatggtaatttaatgttcattatggtgtttcttaattgctttttgctttttattatatctatcgaattttaatacaaagattaaaaatctgtgtgatacgattataaaaatctttcgaaagatgtataggtactcccatacttaatttaaccgagagatatgcatgccatgcatgcatgggtgtaacactaccagccagaagctgctgttaaaaaaaaggttgaaataataaaaacagtaaaaagataaacattgaactagtagt

SEQ ID NO: 22761 - DNA, 342 bp, Oryza sativa
catcagcttcgtacatgatgaatgcgggcagcttcaccatcctcttcttacacaaggcgaccagcccagcggtaatcacttccagtagaagcgctagggaggatagtggtaggtcgttgcgccgcagccccaaggtcaatctgttctccgagctgagctcgtcgccgtgtacctcatggcaatatctggcgctccagacaagggttgactctatcggttgacgcttttgtatagggggtcaccgaaatcccgaaattttcggaaatttcgatatgatatttccgaaattttaagcaaaatttagttgaatttgaacaaatattacccaaattcatgaaaaaa

SEQ ID NO: 22762 - DNA, 384 bp, Oryza sativa
aatgcaagtatatacagagacgatctacctaggactttactgtaaagaatttaattgtattacaaagaatatttacaaaaatcaaatgtttgtcgcatatgcattgcaaatgttctgccatttcgagacgagctaactaggacttcactctaaacatccctttcggtgacaagatatcatctagtatgaattgtgctatctcctctctaatgatttcgaagttgatttccggaatacttgaaataaattcctgcatgttcggtgccaagttagtctacatacttgtaaatttgttgtcctatgtgtgtataaacaattgaaatacacacctcagggtcgagcaatgtcaccttttctgcgaagctcctcatgttatggcagaca

SEQ ID NO: 22763 - DNA, 1103 bp, Oryza sativa
tgttctcgtcgcacacggtggtatactggccaatgtatatgctagggcgcttgtggcctgtgttggtatttcttagcgatattactaggaataaaatttcaagcaatgacgtagaaatactcctgatatattatagttacagagttcatccgcaagcacactaatatacctttgtaacattttacccgagagtattccagcggtattgtatttatttaatcccgtcggaagatcatagtagagagaaccagactaataatttatatgttacttataataattatagtctaagtaggggttacgataaattaaatgatagagtgatatacaagtagagaaatactcattctcatactaaaatatctaagctaagtggaaagaaaatagaaggagaatcttttcctatacttctagtatacatagtatacgtacattctagttatctgattaactagtttaataccctctatccgatgccctcctggtacatcgagaagccatccctgactgtcgagttccttacgacagcctatcattaccatacaaccggggctaaatacggaggactaccatcctcagtaaattaacttaggactatatacacgcgcggaggaatatccgtactgaggtgtcactatcagtggcccacctctcatccgcagcatataaccccaaataatgatatcccgtaatctagacaccatgcctaaactaccagatactactctaatatcatcgtcatatcatagagtaattgcataagcaaacattgcccgtaccgatgcatctcccagataagctagcagtataatcagtataacatgaacataatgtaaagctggcattcatatactcggaaagtattcaataccataaatgtataaagaagagtattctaataaatgtacaaagcttacaaaagaggaaaatagagctactagagccatacctgaactcttccgaaggctaccggacttcgatttctactctatttctactccactagcttaagaacactaaactaaacttgacagaatatgagagagctttgcttgaggtgtgtgagtgaagtgagaagaggacctccttaaataggctgccaa

SEQ ID NO: 22764 - DNA, 1501 bp, Oryza sativa
tttgcaggtttggcccatacttgattctgacactcaaacttttcttccttcccgttaatatggaaacggatactccccgttcccacgtcaatgttggctcctacggtgctaaggaacggatgccccaagatgtcgcgtccaggtagtcacgggacatgggagtgagtccattatagatgttttacaagataagccagtcgtccatcccatgatgaggacaggcggccacatacttctgaagtcgttcccacgcctcaggaatggactcatcccccgtctgctggaaacacgatattctcccacgaagggcgctggttttgcccatcgggaataacttcgataggaatgccgtagaacatttatcccaggtgtagatcattgcacggttggcatagaaccacagcttcgctttcccaagaagggaaaacggaaacagccacagcctgacggcgtttggactgacacccttcatggtgtatgtgctgcaaatctccaggaactgttgtaagtgagcattggcatcctcattaggtttgtcgcagaacaggctagcctgcgccatcgtgatgaggctggacttcagatcgaaatccacttctcccaggttgatctgcggcccaatggccacgttgtcagctgagggagcaacaaattcatggagggtcttgtgactcttgtcagccatattctggaaggtcggtggcgctggtatggctggtttctttgtcgggagagttttctgcggagcgacgactcgcggcttgacgctccggaaaaaaagcttctggattttctttaaagttttccggcaagttgaaaccagtcatgcaataccgtgtttccacaacaatagtgaaaacaaccaaggttagcctgcaaaggatagtgattatgtagaggtaaatataaagtattagttctggtaatctctattataaatcttccccagcaacggcgccagaaatgattgttggtatttcttagcgacattactaggaatataattcccagcaatggcgcagaaatactcctggtatattatggttacagagttcatccgcaagcacacggatataccattgtagcatttcaccagatagtattgcaagggtatcgtatttatttaatcccgtgggaagatcatagtgagagaaccggactaataatttagatgttacttgtaataataatagtctaagcaggagttaagataaatcaaagggtagagtgacacacaagcggggaactactcattctcatactaaaatatctaagctaagtggaaagaaaatagaaagagaatcgattcttatacttctagtatgcatagtgtacacacattctagttatataattaagtaactaataccctctatccgatgccctcttgttacttcgagaagccacccctgactgccgagttccttacgacagcccgtcgtgaccatacaaccggggctaaatacggaggagtatcgtccccaagaatttaacttaggac

SEQ ID NO: 22765 - DNA, 1501 bp, Oryza sativa
ttggagcactgacccagcaagtcaacatctaatatgacaatagctaagatcaattaacgacatacggaaaataaagtaaggaaggatatagcaaaatacctcgacaaaataaagattcgacaaaagatagctaatttgtagacaatagatatatagataatttgccaaaaaaaatagacacacccataaaagataaattacatataggtactttaggagatctaggcaatgcactttcctttctttctttttatttttttaagagattctctgctcagtaccactgagttcgtcacagttcaacaatatgctactgactttatcgacatctataatatgtcatcgctttttccttgacctcaacgatttactatcgccgtccacagtctatcagctacacgccatttttactgttattttttttaatgaccgaaataccctttcagtcatcttacctagcacaaagttcctagcgcgccccaatttttcctcttcgagcaccaccttcccaacgccgccacctgtagactctagctagtctaaatgcaagtctacatggtctagacaatacatctactatcgacatattatttttgcacacaaatgaatacactaaacacacttacacatgtcccaagatgtagcccctctcgtagagtcgtgggtcggagggaggtgggagtaaggtccacggtagcaactagcaaaggagaagcattgcgatttcgtggctgcgagtggcttagagcagagaagaagagtatggaataggatgaaaaccctaaaacatattggttttggggagggcacaaagtttcatgtcctgccacacaaaaaaaatgcattggtccattgcctaggctatagtctaagcgacagttttacgttctacactcatctcgatgctgtctaattgtgtggtcgagacagtctagaactagaaccgtctttgactaactagatggtcaaacggtctaattctcggtttaggctctaaactcgatgataaccgatcgtctagcatctagactatggtctaggcgaacactgacggtaggatcgaaaaacagacgtttaacaatgacaaaatcctttgtatactcctgaaattttagctaattccttctatactcttgaattttgcttacttccttatatacccaaaatttgattttgatcccttccatgccaatcccgtcagttgaccgtctgatttctataaaaatatccattttaccctttggatgaacataaaaaaattatgaattacattattgaaaatgtaaaagtttgtcgcatgaaactattatagttatgagtttgctgtacgatacattatttatgataaaatttatttttagataatgaaataaaaaatatgtatttattttatttttttaaaaaaaatcataaaataatgaggagcattcatacaaagatatgactaccaatgctcacgatactatttttatgaatgctcccgataaaaaaaaatccatta

SEQ ID NO: 22766 - DNA, 231 bp, Oryza sativa
tgggttggtttagacgacgtgtgttagtctagttggatgcacgctcttgcattgacagttgagtattcatgttcataatgctggtgaaattggtgattcaacttcttgttgcgtcaaaaaggcatgttgaacttgtttgtactgcatattatccatcgaaccctttcttcttacatggttttagatcttcgtacttcttgatgctattcatgattcataacatatatcttt

SEQ ID NO: 22767 - DNA, 1501 bp, Oryza sativa
tcgctcaatagttgttctaagagaggaatgccgaaggttgaataactcctttgggttctctggttctctagcgcccttatattcttttaggtgatatcgggtacctcggtatgggggtaatacaccaggtctagctgcatatccggcatcagctaggaaatatttacctacatattttttgtgcatattaattagctaagaacagaattgaagtttcagatatggagctattaggatatgatgtgaataatcctaccttctggtattttaaggccattagtacgtgatagagcatcttgaagcacataagaatcatgggcagaaccttcccatccagcaagaacatataagaaccttaagtcaaaatcaactgctgctagcacattttgtgattgaaatttctttctacccctaaaccggtcttgcatatgcataggtacacatgctggaatatgtgtaccatccagggctcctatgcatccctacgaaaatagacaattttgtttagaacaaatataggtgaatatggccctagactcttagggtatacttaaacagggattatcaattttgatgtacctgaaagtaggggtgaaatctgccatgagagcttgttatcttttgatgtgtgtcaatggatttgatgcatacaaggtcacgggcaaggatacagagggcatctaaaacaagattgaaatacctactaacagtctcacccgatctcatgaattcaaatgcaattggtctatttgaccaattgtgacccacaacgtgaataaacatagcgacttgttcctctattgtgacatgaaaagtctcctctagcagggcacgtgatctaagctcagcacacaacttatggaagacaactttcctcatacgaagctcacttatgcaatgtgcttcggttccatggtataaacggtctagacgtcttaatctttcaacatctctatcaagcatgggagcatatgtaatggctcttttcctttttcttctattaatcctataccaatacatggttaggcacaccagaattccagcaatcaatcttctcctccatatataatggcagtagtccaagtaatactgtaaatacaattttctttgacccatctaaaacatattttcagaaaaagtatggaatcagtaagagaaaaaaactgatagttgatatctatctattaaggtcactgcaaatactgtaagcacactgttactggttatcagtatcagtaagagaaaaaaaactgatagttaatatactgtaagcacactttgaatatcttgaaagcaacaacatgatatggatatctatctattaagctcactgtttatcatatattagtcaagaatgaaatctatctattactgcatacatatgcataaaactaatagtgaagaactagtatatattagttcagatccggtccacattctagtgccacacgattattcaatcaccatcaattatacaaggatgcacatgtgccttagtgct

SEQ ID NO: 22768 - DNA, 1501 bp, Oryza sativa
tccccacagccgcctccacgctgccgacgccgcccttggagcagtagaaccgggacgacggccgccgccgcccgtcgccgaaaggcaggggaggcggcctccgcgccaccgcgctcccgccaggctctccgagccccacgacaagcgcgcctccggtctcatgcgtgcgcaggagctgcgggcgcaggaggccgcgcagccgcatcgcgcgatgcatcgctggaagccgcgtcgtcgtcgggcgaggcgaggaggaggagggatccgcgagcgcgctaggcctccctctggcgcatgcggcggtggcaacaggtggacggtggatgggcgccgcgagcgccggcggcgcgacggcggggagaggtgtcagggtggcggcggctgcgacgcctcgggaggaggagtacggcggcggctgcacggctcgccgatttgggtgggtgggttagcttcgcttcggattgggccgtgtcatctctgggctttggagttttctttagattcgaccagaactatcgagttggaccaaccctatctacagagttgtaagaacgggccgagtttaccgtattgggccagaaaatttcattcctatcgaggttaagggcctgagctggagctcagccaaaccgtttcagctccactaaaaatggagcggagctggatggagctctctcactagagaggtggagctgggtttattagctccataactccacttcagacccaactcctgaaaataaatttaggagtttgagctctaccaaacaggccctaactctttgggctgggccacgtcaagatctgagcaatttgctggctctgccactacaacttgtcactattagtcctgaattgaactgctgattcagtgttgtattagaagaaattcttctcctctcctcttaaggcctttataatgtggcaagctgtcatttagctcgatctcttcacgtcacagattcggtatgaatctttgccacgttcatggatgggctcaccaaattgaagcccgcgtgatcttcgttggtcacccgttcttggcgtgaggagagaagactacaaacgcgctgcgaaagacgtggctccgttttgtttttcctacatggactatagaccttgtggtcttcctgggtcttactccctccgtccaaaaaaaaatcaacataggcatggatcgaacgctcatgtccagattcattgtcctaggatccatgtctaggttggtcttttttaggacggagggagtaagccttagtggcgtcttgggccaagcctatgcatgacctacattgtaaaggctcttagggcatgtttggtttccggccaaacattgccacgcctaacttaaggctcgccacgggtattttggtaggtgtttggttgacaactaaagctaggctagccacagctcataagccctcccgccacacttttttcccccgaaagtttggcggacattttcaccgccacactgatttgtggcgcgccactgccgcaa

SEQ ID NO: 22769 - DNA, 347 bp, Oryza sativa
tgttgatcatcaggggcataagctctctctctcttactaggcctggacctccttttatacctcaaggggttaccacatgggcccaaaaacacaacttagtggagaaggattacaatctttgcattaaatgcctgtcttgtctcttgacttgggaagcaagcgcataccatcttgatgatgaggcctgccaaatcttgccgcctaacacggggggtgcccctgtcaaccaccatttaaggtgtgtagtcttctgggctcctggttgcactgggaaacgggaaccctaattgaccagagcgaatgaaccgactctggccgggatgggaggctaagacctctcatcatca

SEQ ID NO: 22770 - DNA, 1501 bp, Oryza sativa
cagcgccgccaccaccaatgctccccctcctcctcctaccagcaacgtgtcgagcacttgcgtcggcgccggcggctacgggctcgccttcgaagcgtcccacttcatcgcagcagacgagagcagcaggggcgccaggtccgatcgtgacaccggcaatggcgtcgccggagccggcaacgacggcctcaccagggacttcttgggtctccgagccttctcccacggcaacataatgagcatggccggcttcgatccctgcatgtcgacgacgtcggcgtcgtcggcggcgccgtacgaccaccaccaccacagcaacaagccatggcatagctagtaaccacctcggccgccatggatgaatagcgaatgaatcatgcaagcaaatccaaacaaattttgttcgtgggctactcatcgatcgttcgacaagaactgcctgatgatgatgatcatgtcaagattatttcatagctgggtaagtgagtcgaatttacccagctctctctcttttgatgttccaattgaggtttaataattcgatgttcttttgggagggtatgggctgttcaattcatatatatggaacttttcaaattatatactgttgtttatgctagctatatatcatagttaattcatcttcctactgtaataataaaatttttagccattctcagctcataaagctgtgtagagctactgccattagagctccatttgtaatcagttgttaccattaatcattcccttaaatttctagttcctgaagaatggatttgcatgcattttgagctgggggtgcacttaattaataacttatctggaaaataaatgtggtgtgatgaagtaaaattttcaaaatctgtgtttaattatgggctaatggttttcatatgttatgcacatgttgttgcccgtatatacttagttgtaactgcacaggtttccttcatttctgataaactgaattggagtacatgtaaatgctttctctgctaaaatgaatgaaattggaagtgaaatgttatgaaacatttttcagaagaaaacacggtactgcttcagaaagccgtagcagtaattcgagaactttaatcaatgcagcagtgtaaggctgtaagctgagaactactatgtcattatagttactgaaaccgcctttaaaataaagcgttgacaaggaaataaacactacccagtgtaatctcactctctcagccgtaacagtattgtgacattatcagtaaagttaatgccttgtttttttttaatattggagtactctttttattcatttcacattttggttatacaaataaaatagtttccaatgcctatttcaaatgtaagaacatcaatcaatagacataccttagggcttaggcatgttacttttgacaagaataaaccgtattattatccctgcctggaccattgcatattcttcttcacaccagtacttaattgtgtgtactctgcagttattagattaggcatt

SEQ ID NO: 22771 - DNA, 1501 bp, Oryza sativa
ctagctttccttccccacttttaagatcgccaaagctgattgtttgtgtgtgccctaattttgttgccctgcctgaagcaaacaaacattcatggactgctcacttatctccactaatttaacagttgtaattaagatacctaacccaaagctggaggagagatgtgcatatgctgaaagatacacatgcatgcacagtgaccgatcagaattcagaacaatgtggaaaaaaagagaagtggatgatctcagatcgacctttatgtctcatgtattggtgttatcacgccctgttccaacatttcgaagttagttaacactcactacctatatgctttgtttcagatgtagaaaaaagattcaattattcagtatgaatccttgcacaggaacaccattagctttaattaatcagggccctacacaattaatcagggcaatggtgatcataagcaaaattcagacttgtcaattgtgacccatgtcccacctgtccactacttgtctttgcactttagctcatgtatatctgggcactattcggaagaagaatttttacaatccttaaagaaagtattcacaggtaaaaattttagtaacttgagatatctaatacctagagatattaagttttatcaggtgctgcttcaggagctctccaaagaggaccctaaaatctaatctcccagctagctttggaggcagtaattaacatccattggaagagcatataatgggattagagcacagtaacagcaggtaagcaggcaggcaggcatgtacaggggatttcttgagtccagtgcatcacagtctgaagagagagagagagagagagagaggcaaaggaaaagacagaatgcccagcgatccttgtggggtgttgctgacacggagctagctagctagctagctagagagagaaagctactactaccctagtaagagaaagaaagaaatacatagtgatagagatagagagagaaagctatagttcagtgtgaattgtgggtgtcatccaatgggtggaggggttgcacttgcacacacacttgctcctcattcctctctcctctcctctcctctctctcatcaaccctagcttgatagttgattcaaccagccaatatattcgatctccccttctcttcttctctcgatcgatcgggtgatgagaagccaattgagaatttgagatcgttcgatcatcacctcgtttcttgctgagattatagccaagctccatgattccgtctatgccggtagtgacactgcaaggtgcacaccagtagatagctagtggcagcagcagcagcagcatcagtggagctagtcgtcgtcccggccggccttgccgtcagagatcgatcggtgtaagttacagggtgcaagtgcgatcgatcgccaccggcgcagcgagatctgattgatattgatccatcgccgatcgattgatcatacgttcagatatcataatcagcagcagctggtagaattcaag

SEQ ID NO: 22772 - DNA, 1501 bp, Oryza sativa
cggttcaccgactcagcctactcgaccacaagctccgacgctgcctcctccccatctaaaccgcagctatctcatctcatcttacaccaacagcctctctcctcatcgccatcaatggcactgctgatccggacgatttctcatccaaatggttactatgcaagagggtttcttgaagagaccgaggaattagtgcatactaatcaccaacccgtgcgttgcatgggctattattattaatattataatattttagattctaattatagaaaattcattagatattttttaattatatcggtttaaacttaaagatatataaatcagatgtcaattacaacatggatagtataaactgaagaatcaaaagtattttcagtagtctgttattaactacaatagcctattgttaaatagggcattgttatttaatttttaatcgtacctatggtcatgataatacgatccaagtaagtactgaccagatttataattaatgttttagctcataacgagtgctctattagtttggtacactactacgaaaaccatctttcgtggcggtcattttgggtttccgctggcagaaatcgcagccgtcacaaagcaaaggccagtgaaaatgtcgatcttcgctagcagttatttaccgccagccaaaatgcatcttcgctggcggccgagaaaggaacgcccgccagcaaagagatctcttcgctggcggtagccttaggacggccgctagcgaagccaccgaagacatgtccttgctggtggcggacataacgcagccgccagcaaagaagtatctccgcttgcggtagccttaggtcggccaccagcgaagataattctttctttgataggaaacatattttcaaacaccaagtcaaagaagatagtagttcccatcccgggcaggcatgaattgaaataatagtttccatcccggataatagtgaatacatcctagcatttgccggcaaagccaagtaagcgtgatcagcgcttacccacaggaacatgaataaagatccaaattgcactcccatgactacacatgttccttgaataattgaaaactagaatcaaagaaccaaattgaaatcatattgcgcatccatggcaagcatggaacttgaattatttacccagaaccagaatccggaatattgaaacaagaataatgtcgtaaacataggataaacatgaaaacctaaatggcgtgaacaacaatatgaatataagcggtcacatgtcacatagaaatatatcggaaataaatagatagagcaaacaatccatgaatcacacaattagttcatcatacacttgcctccaaagaaaggttggtatcatgcacaatctgaaggaccactacctaatcacaaacaaaacctcagcaaacacattcaaacatgcatataaaacaatgaaaaaggtgaacctactgtcccatcccatcaaaacgcaataacaaagaacgccgtttggactataa

SEQ ID NO: 22773 - DNA, 209 bp, Oryza sativa
tggaatctattagaagaaaagtgatggttaggatacatgaccaaaggtctataatggacaagtgggtaggatcagtttgcccaaacatacataagaagctgaatgcatacatcatagaatcaggggtttaccatgcaatcagtaatgggatggacaagtttgagctgaagcatcagtctcataggttcactctcataggttcactgctg

SEQ ID NO: 22774 - DNA, 1501 bp, Oryza sativa
actaataagagtataacccaacaagtccattagaggattcagataacaacacgaaaagcctacaaactttgcttgtttcccatttgctagtcattactcctttcgtcccaaaatattaatacatagtagaacatgaagtggcattacccaatatgtccttattcagattcctaatgtccttatccaaatttatagtactaggtaatatcacttcatgttctaggtaaccacgttttgggacgtggggagtggtcactagcatgccgtcaattggttggtaccttgtttcactctttggagcatcaaaaagtaggttggtaacaatgctgtcaatgcattattccagccttccaggactaaccacacaaacggtggcaagttgtcttagaaaataattttcttgcatacactctccaaaaaaaaacccacatatataagccttcgtggttatcaggaagctatgaataggtttgtgataacttgactcgaccgaaaaggaagaagaccgaacgggagaaaaccatggggttagcgagcgagagagagagagaaacgccggcgcctccggtgtttgagcaggttaaccaaggacggagacgtcgaggtagaggagcatccacgagccaacaaacaacgactcggactcggaacaacgagtggcaaatcggcaatgggtggtgggtgggtcggtggcactgcgattgcattccgtcgtctcctcgactgcaataattctggcccctccagccgccgggagctcggagtcagaaacggcgactccctcaaacaggaggcgtcgccgtcgtctttgccgatgtggtgtcgcctcgcgacctggaccctccctttccaatcccatgggccactcatgtccaaaccgctcgtacacggcccagaagtcaaccaagggtgtcgtttccttccaaccaagacaccttctcagaaatttcggctgctgctgctgctacaaccattttccttcgcaggaagttggttctagagctcatccagacgatgcaccatcgtacacagacccatcccctgctgcattttcagcacagtagatgatactgaataattaattttattcatagaccttggagggcatttgggagtttaccagcctgcattgctgcctctagctgctctttgctctttgccttcgactcatgagctcgatttcctcgaattcaatcatggaaccaaacagacgggaattgacagtccaaacagcatgcaaaacgtgattggaattgtggaaaagcgatggctcacagcagttccctcgctttggacgcatctcctgcagaatttcactgtcatgcaagagtatagatagaatatttattcaagtgtttcagcattcgtgtcaaagattttgcaaggagaccggtattttgtacaggccctggccgccaccgaaagagggccctaaaatttacaggcccataaaactgatgaaaacagcataaaaaattccaactcaagtggacaaatgttg

SEQ ID NO: 22775 - DNA, 1501 bp, Oryza sativa
tcgatatcaattgttacatccactgtacctggctacaccgaaggaacatattggaaaaagtagcccacgagaccaacctctcaagaaggctccatcaacaacttgccaaaaatttagaaaactcaattcaatttcacggatcaatcatattatattcatggactataagaatatgtatcggccgtacaatgttttggcgcagtagctgttttgctttttggatcaccagtacaaatcaagagcagtttatcaaattaagcaaagtgaagctgacgtggaacaatatttgacccatctatctatctatcaaatcccttgcttgtctccaaaggaaactaattagcaaagatgaaagaataaccaagctatgcgtagtttaaaagttcactttttttgagtgaaggacatgctaacccacgggtctataaactgttcatttgctgacatcttcttttgtttctttctacatgtcctgcatccatctatgcctgcagggaccaacttgcagctgcaggtagctggttcaaatcctcaggtgattttgttagctcatattttggtaaataattccatatgtacatagtagcacctgctccaccatttgagtggagtgtcatatataggtgaagtacttgaattactcactccgtcccaaaataagtgcagccgtgtagttcaccggctgcacttattttaggatggaaggagtatatattaagccttattgggaagatgatttcctcctaatccacaagttttttttttcacaagtttatatgttataccagaggatttaggtctctcttgcaacatacggattttgcaggattttcacgggcattgagctgataggtgtgaaaatactgtaaatttaccattcttgaaaatgcgcctcggtgaatttagcactgtcctattgttgttgacttatcatcacactagaacaaatgtactggttagtgggctcagtgggtcatagctagttaaaaccctcgtgtggttttctttagcctggagtggtaaagaattccataaatccgtagcagcaccagctccaccatttgaatcttatagtctagagaaagacttggggctttttttaggtctagatttattggtttagacttttaagttacttataagctaatggatttaaagtcctaagtttaatgatagagtcatatatctctctcacataagtcaaaaaaaagtttttccaacttagtttttgtcttaatagcgaaagtagcttatggctttaaaaaagccaaacgaaaaaattacttatttgtttagctttagccttagatttttcgattcataactgtcttataagcctaaacaaagaaggccttagagttttactgtatagcacaagttggtgggctagctggctcggcttcaagcctcatcacctcttaataaacattggtagttactcctctcatatatataggttttaagtacttgcataacaagtcttgcgaacactattttttgt

SEQ ID NO: 22776 - DNA, 1501 bp, Oryza sativa
gggagattttgccaagatattaaagaaattcctagtgaactctcttattcatgtaaaactgcatttggttgtgaggtttagctgagattttctgagttctgaaaattttcgaaccttttcggaactagtgaatcgagccatgcacagggagttccatcacgccaaaggaaggtcaccctggagacgtctctttcttctcctacaagctcctcccaaatgctgtgtttctccaatcactccatcgaatggcctccgatggccctgcaagagagagggcagggatcttgagcggagcagggctggctgtatcgacatgacccggagagaaatacgaggacgaagacttgggaaaggggtaaaaagtcatggggacttgttgtgtcaacaaatgtccccataccaatcttacccctgtgaaatcaacggtgggattgaagtggtacctcaaggtacctggtacctcgtatggcccgtttggttggagggagtttttaggagggattgggagtttagagggatgaggctattaagtgttttgtttggttgggagacatgaaaattttagtgggatggggatggggaattgaggaaggaactcccttcttttcaataccttggtaggggcaggtaattgggaggaaattcctcctttactttatgtaagcaaatctcagccatccgtttttattaatgataatctccaactaaactctctatcaatttccatcacctctatcaaacaagatattgggattaaaattaaattcccatcttaatctcatcatcaattctctcgtgtaaactcccaatcccttcccttgagttaccaaacaagccggtagtacctcctcaaggatggtaaaaactctcagagatatgtttagtgtgggagtttccggattctcctctcaccctgcccgtttggttggagggagtttttaggagagattggtagtttagagggatgaggctattaagtgttttgtttggttgggagacataggaattttggtgggatggggatggggaatcgaggaaggaactccctccttttcaatacctgggtaggggcaggtaattgggagggaattcatcctttattttttctaagcaaatctcagccatccgtttttattaatgacctaatctccaaataaactccctatcaatttccatcacctctaccaaacaagatattgggattaaaaatcaaattcccatcttaatctcatcatcaattccctcgtgtaaactcccaatcctcttccctcgagttaccaaacaagctgacagtgtatcttcttctccttattaatcaaacaatgcacagatctcctatgtgttcgaaaaaatatattcacatggttacgacattaatttggaaggcatggttaaatataaggaaaataactaggtttttccttttcatggataaccatgctaaattcaattggaaactttgattgctaagtctcctatttgaaagatgtttcctctgtgc

SEQ ID NO: 22777 - DNA, 1501 bp, Oryza sativa
tactttaaatgtgtttccgcatatccgatataaccactaaacctaaatttttccctaactaaacaattcctaattaaatttcctagctttgtcttcaattcctgaaccagttctacctgtccgagtgatacatgcgtccatgacaactttcataaaagactctaattactctaagaaagagactaatcaaagaaaacaaacacaggcagcagcaaagcttaggacacattgagaggaggcagccatagaagaaagactccatggccggccgaccaagctcttttctccagtcgcatccatgtggagttcacaatttttattgcaagactatgtgcgatccgtcttggcttcctcaaccgcccacatatttctttttctttcctgtcaatctctctctcagcaagcaaacaaagcacaaaactctgatcaactcactaatgacagcacgccaacaaactagtaattaaaaagtggtagcattggttagtttatggttgggttagagtcaaaatcagggtgctgatgccttgataacctctcacatggtccctgataagcttatagatcagaggcagataggctaccagcgagtggttttggatgatgacaggagcattattccctgggagatgcttataagcttattgtgcgtatatcatgtatgcatccacctgtgagatcctgattagatgtttggttgtgacctatgagaggttagggatgggtgatgagtattataaacttgcttttagatgagagaagtgtaaagtgtcattattgtaatggagggcatattaaggttcccctccctgttttgtcaaatccgaatcgatctcctcttatcatctcctccttgggatgcattattcttgttgtctttcttgttgatgactttgggtagctgataccacttgcatgtttcatgtgtagaatcatgtaatcaggaccttcattttccaatcagaaggtcaagatggtagcttcaatttccaatcaatacaaataaatgcttccttcatttctttaatgtatgatacccgttgacttttttttattaacgtttggttattcgtcttatttaaaacttttgtgtaaatataaaaatatttatatcatgcttacataacatttgatgataaatcaagtcacaataaaataaatgataattatacaattttttaaataagacgaatggtcaaacgtatctcaaaaagtcaacagtatcatatattaaaaaaaggagtgctaaggctatgcttccatggagtagaaaagagttcatatagcttcacataggaaaacagaatatgttatactcaaaatgtacacttgttacctttttttttttaaaaaaaatactttttccttttgaaggaatgcagaatgctacatcaaacaacatgttctctatgctaaaaacagtgtcagtgatgtaatactttccgtgatttattatataggaataccacaaaatcttctcgaacttctccttttcttcaga

SEQ ID NO: 22778 - DNA, 478 bp, Oryza sativa
cattcttcaatgttttttgtggttataatacttttggagctatgtttcacacattttttttttgtctctaaaacgttgttgtaagttgatgagagagaaaatttttgtggggaagatgaatatatagaaattttggtttgttacttaaaaagttttattctcatagtttaaaatataatgaaaattaatcttaaaaatagaaaataaaataaattgaaaattaaaagaagtacaacattaatattagtttagaacttcaaaaataatataatacaacattaatattagtttagaacttcaaaaataatataaaagaattgtttgttggattattttataattattaattgtatgagtaatgatatgtcattattgtatgactgtttaaagagtttttaattattttatcattattgtatgactgtcattattgtacgaaaatttatttatgtacgattttttttcatttcatgtaaga

SEQ ID NO: 22779 - DNA, 1501 bp, Oryza sativa
ccagacatcgttcaccctgaacttttaataccggacaaattacctctctcgacccaatccagagctgttttgttctacgtggcgtacgcgtggcagtccagtcagcattttatttataaaaaaatatgggacccacctgttatacccctatcacaaaagcataagtccctatgagagaaactaaaatttttgtgagagggactatagtccctccttcccaaacaccactttttttccttcttccttcctaaacaagcagtgatctgatgacattttcggcccagggccgtatatggtggatgattctactctacttttaattttatttgacgcgagtggtttctacagctgacgtgtatgtggtcaacgtaccgtttcaaattgagagagtttgtagcatggacatttttgctactgtgccacctctgtttcgtacgggctaataagtcactactattgaaactcagcttcgtcagttcacaaccgtgctaagctctatattgccacgtgctaagcaaatttaagtattttttttagaatcacacagtacaacgcaaacactcacaatcactcacaacgtacacgcactcgctcctatgaacgcacgcacgcaaaccttacccctatgagcatcttcgaagactgggccggcaaaatataatttaaagcgcatatatatatatatatatatatatgaaaattatatcctactaccgagagtaaatatacatgtattacaattcattatgtgctcgctagctacgacttcgacgccggtgttatatatgtcagaagaagaaggaccggcgttataaattgtcgatccgtcgtagtagaattcaccgtcgggatcaagaacttgttcgttgatgaatcgcatcaagttgttcttgagcagccacgataaatttcttgtgtgtgaggttgtccctcatgtgaataacctatgaatatatgaaattaataaacaagaaattgatatgtacgtaatgaaattttgaatggtttatatgtacattgtgctctcttgtggtatagatttgggttgataggatgtgtatacagtcgggtacaaaaatttgcatacggactttttaacaaacagatccgcatacaaaaacagacttttttttatgcctcttaacaggttcgcttgtgaaatgaattttcgcatacgggcctatattaattggatacatttcaaatctctttacatataggtcttctttgcatgtgataaaaaaggtgtgttcacgaaaaaacattttctttatagtggcatcctatatatttgtaaagggtgtgtttccactaattgttatagtattatttctgttttttctcattaaaccacatcatctcaagtgttcctaatgcttggattattgatctatggtacaaatctttattatgaagtcatatcatcttaatcttatatttggatgattcatctatatcattatttttcatctctaattgagccacatcaccttaggctata

SEQ ID NO: 22780 - DNA, 1501 bp, Oryza sativa
cggccctattacggtgtctcctaagtactttttttttttttttgcccttcgtttacctctagggctcctgtcctctcaccgctcggccgccgccggcgacggcgaagacaacatttccatcgccatctcgccataataatccatggcttttcctctggcccgttagccctagccacattacgttgtttggggattgggaattgggaatcgggagagattcagagatgggagatcacctggggcatgccagatcgatgtgacgccgccgagcgccggcggcgagcggagcggcagggggcgaggattggcgctgcgttctcccctccctgaattcttccgccccgtttctggatttctcggtcgcaatccaggtaaattttacttgatcaacagcatgctgcatttcgcttctgttcatcgtgcatcgagctaggtggtagagaaggggaagagacggggatcgccgggaacgcgaaacggccggaggtcgctggccggaccgagctcctccggccgccggcggcggcttgagccgttacgcagagaaatgttgggccgccgtgagctccctggtacctcgtcacaggagtcaaattcaggcccatcgatttttgagagggattcggcccaatcaagtagtggatgattgagccgtatttctggattacttaggtgatggtgatgaactgatgatcaggtaatttttgcattttgctcgctgatttcgatctttaccactaggaattttacattttgtcctctacatgcaccggaattttcatctctctcttgtttccggccacctatcggccgtcgctgcaagaacataagcattggcagacgaagaaagaaatcagagatgtgcctcatgaaaagtgagactagatgggaaaaatatgtactacaaacctttatatgtagtagtacaaacatgtaaactaccgtaaaaatcaagaaataggatttatccatatcacgatgagtaaaacttttacttatgattaaaaaaatattagaagtaaaatatttactcatggttacatggataaattttgagtaaattccctatatacccatgaaaactcacataatctctttcatatccctgaaatttatttgatcccttctatacccttaaaattttgatcctttccatgccctgccgttacatttttcttcttttcactgttacgtttggttgcaaatgtctgttatgcccttgatgattaatttaggattgaatataagcatgaaaaagattgaaatttttgtttgagtgcaaagtgtgtgcattttatgaaactaatgagactataaataattatatatcagaaaatattgacataaattttgaaaataaaaaaatgtaataaacaaaaaaatttatttgcaattttaataggataatggatttttttttatcgggagcattcataaaaatagtatcgtgagcattggtagtcatatctttgtatgaatgctcctcattattttatgattt

SEQ ID NO: 22781 - DNA, 1501 bp, Oryza sativa
tggggtgacatctccttgtcaagtaaaccaataatctccgcagatagatgtccgacatctatcctattttatcatgataaaaagtgacactttgctatggcaaacctatcacttatgatcacaaccgtaataggtgcaattattggaagagcataaattacacttaatttttctgagggaatctatcctaccatgtcatatcaaatatacaacagcaataaaataagatagatataaaaccctaagcgaaatctaaggggcaacgcacacggcggtcccgctagccgtgtacatagatctcatctacgattcgccatgtcaaaaccttaacggagtaatcgaattatgccgaaaccaagtcaatctcattggctcgtttttctcattggcgtgcggttcttgtggacatcggactatccgatgaacacaattgcgctcggccttggtgagtactagacattccagtgaagtcaccaacacacataccgattgatctcatcaacccaagcggctatcggttcatctcatgttccgatcatctaatgtcgcgaccgagaaaatttccttttcccgaacgctagtgtattaatccccgtcccaggaaaagccggggtacaccacacaaacatgatataaaagacacatctttattatatcgataatatttacattattacaaaggcacttaaggcctgacaatcaaaaataaacagcagcggacttgcgggcctacggctccaacttcacaggcgctcaactggggtataagccaagactccacctaagacatcttctccaaagcttctcttactgaaagggggagaaagattgagcaagaatgagtacaaccacagtactcagcaagccacaccggagatgcataattaatgcaagggagtacaaggggataataatataggggttaagttttacagaaaacagcatttaaaagtcacttagttgcccaaagccattttatagagacgatcctagagttacacagtattattaatcaaggccgtgaaccctcacgaacctgccttaacccaaggcctacgatgattcagaccgaactggcaacccgaccctgggtcctagctcgtcccaagccaacccaggccaaccattccacattttagttgttaagcaggttttaagaattaaaacactaacttgggtacattgctcggcttgcccataaccgagggcgcggctattcgaatagattatactctgatcagaggtgtacatctttacccacaagacacatctccctcacgtgcaaccacgtgccacataccaccacggtatacagacggaagacgtgacatagttttcaacccatcctagccatagacaagagtaccgacccaaccccacctacggccggaacctccgggacaggtaggcaggattgagcccctagcagcaggacaccagccctgtgccatgacatctcgactaccgggccgcagctcgtgtagccttcatttgtcctaga

SEQ ID NO: 22782 - DNA, 1501 bp, Oryza sativa
aacaccgggaaagaagctaagaaaacggatcggactcgcggcctccttatctatcaggagaaagaacgtggacgcgctgttgcggagggaatcgtgggaacgtgggttagtgcctgcaaaaggatagcgacgtgacgcacgcacgcacgccgccatctgtcacgcccagaaattcccgaatagaattccaagcagaatgtgcattaaaatccccgtccaggaccggccggggtacacaaacgacaatgttgacattcagatccacgtcttacaaacatcataaaagtcttacataaatgcagcggaaaaacgaaagacaacaggagctaagccttgactagaactgcagcgggaacaccactccacaggcatcctcgacggcacggacgaagcctactcctcggagaaacctccatctgacacatactcgaactctgggggggttgggaaaaatagagcaagactgagtactacccactgtactcagcaagtcataccggaataggggtatgatgcagggaattatcaaagaagagctagagtggttcatttgcataaagcgagcatttataaacagaagttaaaagatttaagcagttgtaataattaattaatattgatcatccgctgtccaacgctatcccacgttgcaacaggcccaaccatccacctaaaccatccaaattcaaaagattacactagggtgagactaatcacggtgaatctggttgaccgcccataaccgcgggcacggctattcgaatagttttactctgatcagaggtatacaactgtacccacaagacacagccccacaacacgtttccgtgcgccgacatgccaccacgacacatcggaaagaggccgtgacaggacccttcgcataaccccctctagccaagcacaccacacctcaggtttcacccccgttcccagcgggcaacgggcagtcccctctcgtgcctaggtgaatccggaagcgacagaggccgtcgcagggcccgccccgctccatcacgcccacccttgcctggatgcgtcgactagaggaaggctacactacaagcccagccgttgcccacgctagcttgtggtaagtacgataagttcttccagggcatcccgcgaaccggtccttaactgccatgggtgcgaccagcgaaaccatgcacccacagcccaccatgtgatttattttaattaaccagcaccaaagcggtggcactaatccaacactaccattagaaccaacagtctaaacattaataagattttccccattgtgcactagttgaactaagcatggctaagcaatccctagtccaatctctagtcatgttataaccccaagctgacaaaagggacatggtgcaacaatagcatggctatgacaataggtaaacaccccatagaaatattataaaacaatgcagtatttgaaggaaaacaatagagcatttgcaatataggatcaacatgttcaagtgacaagcatgacttg

SEQ ID NO: 22783 - DNA, 706 bp, Oryza sativa
tcgcaaatatccatttaaagagcatataaacttcaaatggccataacttggccatttgaacttggaattggaccgttcaagtctctaatttttccttaagaagtcaagaacccatttttgggctttatttctgcttgttatatggagtttattagagtaaaagccttttcttttccattggtcgtgtagacgctgcagcttcggaagatccgctcttcgtggaagttgaagccggcgtttgggaaagcgagcaaggcaagtcacatcatccttgaacatattgaatcccagtttataaaattattttgatttaaattattgcattgtcgctttatttaaattcccgcgttatcactgttttatttagccatgcctatttacctttgttatgaccttattattattgttattgttattattaccttgttcaccctagattaaacaaaaccccaactagtggatactctactcatggtaccactagtatgattttaggtagatgcttcgctgtttaattaggtatcattaggtggttttacaactctagactctgggatattctcatcacctggacactttggaattgttggattattgcggaattggattcacaccgccccctctattcaaaatccccaaaatggttttaggctgggctcggggtgcatggttttgatagtagcacctcggccatataaggaccggt

SEQ ID NO: 22784 - DNA, 183 bp, Oryza sativa
atgagtgatcgattcatatagggcgaattcgagctcggtaccctatatatatatatatatatatatatatatatatatatatatatatatatatatatatatatatatatatatatatgaaaattatatcctactaccgagagtaaatatacatgtattacaattcattatgtgctcgctagc

SEQ ID NO: 22785 - DNA, 1501 bp, Oryza sativa
tatttagtttgttcttaagataacttattgattttctcatttcttttagtttggggtctcatggtttatctgccctaatataagtttgggcctcatggtttgctgtttgtgcttatgctagaaactgacccaacctggttcagttgccaatgtgcatcagtgcatctcaggcggataggcacgagcagcggaggaggctacgcacaggcgtttactagcgtttcttttgccatcttcgatgcgtaagccgtcgcgtcaattaagtcttttttttatcaggagtcaaccaagactggacacgatcgagccgattatgcgtgcatggtcatggagggcgagggccgttcaaaattgaaaacgaccacgtcaaaggtcggctcttcgatagttcgatcatctacgtccactaggcccaattgatcggccagattgaacaaaaaaatgaagtcggctatgctagaattctagatgcatcgcacggcatcatttgcattaaatttcatcactgatcaagaacactgaacactcaatgttggaaatatagtcattaatcgacatattttaatccaaaaagttaaagcaatgatcatggcataagcagtatagggtgatcttaacataaccagtagcatactatgcgcatcatgaatgtcaggaacaggaatataccagtaacgcgataacatgctagaggcatcatgtagaacaggaacaaaaacatagcgcacatagtatagcgatagcgctaacaatgggaacaggaatagcgctaacaacagtagcaggaggagaagagtatactccgagaatagccctccgctggatggtgaggcagaattgcctccgttgttgttgtcgttcacggcacctcctggcgcaccagctccggatccagctcccgtcggcggcgtaccacctccgccagcagtggcggcggcaactccagacatggcgatgagcagtcgagcagtcgtgcgggaggcactccccaaaaatctgatcacccgcctacctggtgcagatttcaggcgaaggtgtggtttcggaggcactgctccttccattctctcgtgcgcgcaagagatcagaagcgaggaagcgagagcaattcaggcgcggagaagaagaaactaacaccgggaaagaagctaagaaaacggatcggactcgcggcctccttatctatcaggagaaagaacgtggacgcgctgttgcggagggaatcgtgggaacgtgggttagtgcctgcaaaaggatagcgacgtgacgcacgcacgcacgccgccatctgtcacgcccagaaattcccgaatagaattccaagcagaatgtgcattaaaatccccgtccaggaccggccggggtacacaaacgacaatgttgacattcagatccacgtcttacaaacatcataaaagtcttacataaatgcagcggaaaaacgaaagacaacaggagctaagccttgactagaactgcagcgggaacaccactccacagg

SEQ ID NO: 22786 - DNA, 1501 bp, Oryza sativa
gtgggtaaagatgtacacctctgatcagagtataatctattcgaatagccgcgccctcggttatgggcaagccgagcaatgtacccaagttagtgttttaattcttaaaacctgcttaacaactaaaatgtggaatggttggcctgggttggcttgggacgagctaggacccagggtcgggttgccagttcggtctgaatcatcgtaggccttgggttaaggcaggttcgtgagggttcacggccttgattaataatactgtgtaactctaggatcgtctctataaaatggctttgggcaactaagtgacttttaaatgctgttttctgtaaaacttaacccctatattattatccccttgtactcccttgcattaattatgcatctccggtgtggcttgctgagtactgtggttgtactcattcttgctcaatctttctccccctttcagtaagagaagctttggagaagatgtcttaggtggagtcttggcttataccccagttgagcgcctgtgaagttggagccgtaggcccgcaagtccgctgctgtttatttttgattgtcaggccttaagtgcctttgtaataatgtaaatattatcgatataataaagatgtgtcttttatatcatgtttgtgtggtgtaccccggcttttcctgggacggggattaatacactagcgttcgggaaaaggaaattttctcggtcgcgacattagatgatcggaacatgagatgaaccgatagccgcttgggttgatgagatcaatcggtatgtgtgttggtgacttcactggaatgtctagtactcaccaaggccgagcgcaattgtgttcatcggatagtccgatgtccacaagaaccgcacgccaatgagaaaaacgagccaatgagattgacttggtttcggcataattcgattactccgttaaggttttgacatggcgaatcgtagatgagatctatgtacacggctagcgggaccgccgtgtgcgttgccccttagatttcgcttagggttttatatctatcttattttattgctgttgtatatttgatatgacatggtaggatagattccctcagaaaaattaagtgtaatttatgctcttccaataattgcacctattacggttgtgatcataagtgataggtttgccatagcaaagtgtcactttttatcatgataaaataggatagatgtcggacatctatctgcggagattattggtttacttgacaaggagatgtcaccccaacagcacgagagtcacatatgatgtgattagcaaggtgttgcttacctattttgatagttatctagctgtgatgccaaagctcactagacactaataaaaatgaggatcttgactcactatgttattagagggaattttgtttcacaatacatagtgggagtatctttcgttaaactgtttaatgaaaggttaaatgtagacatggtgctgattttgcctacatatatttctattgtaga

SEQ ID NO: 22787 - DNA, 185 bp, Oryza sativa
aatcgaaaatttactcccccatgcatggaggccggtaaatatctcctcccggggttactgggactccaggaaatccacctagctgccttcattttacactcacaaaaaactggaggctcgtaatcaagaggcccctccctatatggcaccggcaggtgacgcctttctccctcaccacgtccagc

SEQ ID NO: 22788 - DNA, 1338 bp, Oryza sativa
aagccctcatgtccttgtctacagagaatatatgaatatatttctagcactggagtattatttatgactttcttcacttagaggatgtatgttatcttcctctgtttttcccatccatgacaaagtgctggtgatcgaaatcttggagtagaacacataccggaaaacatggaacttccattgttggccaatttaagccccttgtgtaagggggtgtttagatccagggtgggggtgtttaaatccaggggtgaaaagttttggcgtgtcacatcggatatatggacacacatttgaagtattaaatatagtctaataacaaaacaaattacagattctgcatgtaaactgcgagacaaacttattaagcataattaatccatccttagcaaatgtttactgtagcaccacattatcaaatcatagagcaattaggcttaaaagatttatcgcgtaaattagtcgtaatctgtgcaattagttattttttagcctatatttaatacttcatgcgggtgttcaaacgttcgatgtgatagggtaaaaaattttagggtaggatctaaacaaggcttaaatcgatgaggatcaggaaatttcggttctatcgtcctccatccgatacgaaattatttggccgaagttttggactctttttttaaaaaaattgcaaagtttaaccaaattttatatcggtatccccagtaccaataacgaaaatgatcgatagtttgaacccagcgaggatctgcttgctgtctagtgtgaacaaggtccttttatgaccatgaaatagacaatgtactccctccatcccaaaataagtgtagttttgcactgtttatgtctcacgtttgaccgttcgtcttatttgaattttttttacaattaatatttttattgttattagatgataaaatataaatagtattttatgtgtgactaacttattttaattttctcataaatttttcaaataagatggacgatcaaacattggatacggattctcatggctgcacttattttgggacggatgtagtactagatagagaattaccaccaaatcaatattggtttgaattcttaatcagtggcggatgtatagttggttgggggctccataacaacagctaacaatggtgacaaaaatcggctttatcagttcagggaccggttgtatctggtttttggattgacagaaatcggattcgggtaaagctaaggggcctcaaatgaacttattcctaacaatggtgaggatgtgtgattgcagaagtccgggtgtggcctagtaggctgggcttgtccgagtcagattacgtccgagaggagagg

SEQ ID NO: 22789 - DNA, 340 bp, Oryza sativa
  unsure (1)..(340): unsure at all n locations
agagcgtnattgatgatacaccttcatgcttgcctgcacgcacgactatctatagaggatccccttgaaaaaaaaaacataagattttctttgctgtcccaacttttttaatggatataggtgagacacaaactgtctggtggttgggtagatatctagccgccgggtacctcatggcaatatctggcgctccagaccagggttgactctatcgggtgacgcttttgtatagggggtcaccgaaatcccgaaattttcggaaatttcgatatgatatttccgaaattttaagcaaaatttagttgaatttgaacaaatattacccaaattcatgaaaaaa

SEQ ID NO: 22790 - DNA, 1501 bp, Oryza sativa
gcaaagtatgtactgtgatctttatgagcaatttgcctataaaaagttgtttttttatataaaaaaaatcctacacacatagtataactatagcttcacggattttcaaatggtgtcattcttgcaaacgcattgtatgattgtatttatgagaagactttcttaaatcatgtttataattttatacgatttgttcgcttgcacactcgaatgatgatcactaataactaagggtaagttttaaatagctacttgaagcgactacatcacaatttcttgatgaatacatttcccaaactgttaagtgatacatttcgtgcaaaagttttttacatataagttaataaatatatttttctaaatttattataattaatactcgactaattaccatatagaaataacttactctctatgtcctaaaatatagcaatcttatactggatgggacaagtgcaaagaatctagacatgagtatgtctagatttattgtactaggatgtgtcctatccagtaaaggttgctatattttgcgacggagggatatcttattttacatgctttcaaaaatctaagctaatcatctgttccgaaccaactaaattttttagccattcggcatgcacaaaagagcgagatgtaagaggcaatagatcatagttccactagaaacatcttaaaatttgagagatcgatcgaaaacgagtacacccatatgcacgggccgaacagccaacttaagcaaattaatgcgccgtgacggtggtggatattcgatcgctaccctctctaccaagttgcatttcattgcatcgcatatggcccatacattcatacatgcaaactatagctagctagatatatatactccatctcaaatataatctcgtgtccacgcgcgtgcgtgtgtactgttcagtaacgcgggagtacggctcttaattttagctaggcaggcaggcaggcacatggccgaccgatcgacatgggacccacccacactgcacactgtcattagagacttgttttagggaatttaagactttgagaaatactcccgcctccctaccaaaatataagagattataggtgattgtgacatatcctaagactataaatctggacagatatcttaggatggacaaatgtcagatccatagtcttggaatatatcacatacccataatcccttatatttagggatgaagggagtagctgttagttagtttctgatcaaaatccgaaaaaatagggtttttatcagcttgtatataactttttaaatgtgaaaaaaatgtattgtttaggggaatttctagttctaagataaagtatagttgtcagaagctcttccgaatagatcctagattgccggtcgatgggtcccaccgaccatccactcacaaactaaaccaaccgatcagaaattaaagccaacaacggtgaccggccggcacgcagctaagctagctagcgtgcgacgacggtggtaaaacagccg

SEQ ID NO: 22791 - DNA, 1501 bp, Oryza sativa
cggcattttctttgtttctttccatcatcgccttcccttgttcacctgtcttatatgcaacgaactcgtcctagtgatcccttagctttgggaatgtgtcgaagttcggtgtctgccccttcagtatatacttctggtacagatctcccttgaagctctgaaactgttctgccattttcttcagagtccaccttttcactttgtcctctgtacccgcaggaagggtgaatgtctcgagcattgtggtccacagcatctctttctccgaatctgggacaaagctctcatgatctccgcgtgcccttgttcttcgccagtacaccgtactgacaggcacgttatcccgcacaacccaaccgctgtgacgtacatagttcttggcggcttcggccggggcactaggacgtccatcttcttccacttccgttatgatgtgccgaccctcaagcttcttcgctgcacctcgttgcccgcgtgccctcttctgtccaacggagggttgactaccactagcctcctcctcctggttcccctccacatccctttccacgtgcccctgctggttcccctccgcatccctctccacgttcccttcctcgttcaagtactggtttggatcctcgttcccctcttcttcattccagtactggctgcttccctccgcgattgtatcgtacaatatctgttcctcatcgcggtcagccatctgttgatacaagaaacatctgctaagtcacgagacatttatgttttaacaatctaagtcatgtatgctaagtgtaaatgtcgtacattagaaccctacacaaccttacgtgctaagtctaattacaaatcgtgatataagctaagtctatgtgacgtatattatacaaccctagctagtaaataattatatactaaatctaattacaaataaaataatcttatattaaaactcaaataatattacatgctaagactaaaatagtcatgtatatgctaagtgtttcgtgcgtatatgctaagtctaattaagactacaatagtcaattgctacttgtcgcaccaattccgtagtcaataattacataccaagtctaattacaaataaagtaatattatattaaaactcaaataatattacatgctaagactaaaatagtaatgtatgctaagtgtttcgtgcgtatatgctaagtctaattaagactacaatagtcaattgctaggagtcgcaccaattccgtagtcaataatgtcatactaagtctaatttgcaataaaataatcttatattaaaactcaaataatattagaacactacacaatcttatatgataagtctaattacaggtctaataatcttaattaattgcattacaaatataacaatcatttatattattacgtcacttgcctgctccaattccttctagggctagctcttccactcaggcttgacggacgactccgacaacacgtcttttctgcaagatacaaaaaaatgtattaggataaa

SEQ ID NO: 22792 - DNA, 1501 bp, Oryza sativa
tttctgtcgatgtttcgccactgcgaaccatcggcggggtgtctcagcatcccgtcctgttgacgctcttcagcgtgccatcgcaacattctagcattccccttgttcctgaacaaacgccttagccgtggtattatagggaaataccacatcaccttagcaggaattctcttctttgttagctgcccgtcaacttctcctggatcgtcccgtctaatcttgtatcgtagtgctttgcaaacagggcatgcttctaggttctcatactcctcaccgcgatataggatacaatcgttcggacatgcgtgaatcttatgaacttccagtcctaacgggcagactatcttcttagcctcgtacgttgtctcgggcaatttgtttccccccggaagaatgttcttgacgagtttcaataaatcgccaaatgccttgtcactaaccccattttttgccttccattgcaacaactccagagtggtatccaactttttgtgcccctgctcgcaacctgggtacaacgaagttctgtggtcctccaacatcttgtccaatttatgggcctccttttcactttcgcagtcttccctggcgtcctgcaacatctgaccaagatcatccgcaacgtcgttaccatcagcagctatttcctcctcgcccgtttgatttccttcaaatccaacatactgagcaaagtccggaatattgtcgtcttccacttcatcttcttccatttcaacaccttgctctccgtgggatgtccaacaattatagcttggcatgaaccccgactcaaacaagtggaaatgaatagtcctggatgcagaatactccttctgattcttacacttattgcatggacaacaaataaaacctctttgcctgttagcttcggccactctcaaaaaatagtgcacgccgtcaataaactctttggaccgccggtcagcgtacatccattgccgatccatctacatgagtcaaaaaaaccgcacacaaataattattcttacaataatgacagtcatacaataattataagatatctttattcatacaaaaatcataaaatattacaccaaataattcttaaaaactatttgtaaagttttaaactaattttaatgtgttttacttcttttaatttttattttagtttgttttctattatttaatattaactttcactagagttttccttctcaactattttataaaaccttgtttaacaaatgaactaaatttctatatattctttcttccccacacacattttctctctcatcaacttacaactaaattttggagacaaaaaaagtgtgcaaaacataggtgcaaatgtagtatgacaaaaaaaacattggaggatgaattgcaaaccttttaggcacctccgatttgtatgtaatcaccaaaataaattcaatagaaattttggcatgacctcccctcttttttgaagaaattttgaagcttgctcgggcagctggaggaggaagaagac

SEQ ID NO: 22793 - DNA, 1501 bp, Oryza sativa
gcagcatacacagcttcctggaaacaacaatctttaaacggcgatcgaagtcaccaccggcaacggctgttttaccaccgtcgtcgcacgctagctagcttagctgcgtgccggccggtcaccgttgttggctttaatttctgatcggttggtttagtttgtgagtggatggtcggtgggacccatcgaccggcaatctaggatctattcggaagagcttctgacaactatactttatcttagaactagaaattcccctaaacaatacatttttttcacatttaaaaagttatatacaagctgataaaaaccctattttttcggattttgatcagaaactaactaacagctactcccttcatccctaaatataagggattatgggtatgtgatatattccaagactatggatctgacatttgtccatcctaagatatctgtccagatttatagtcttaggatatgtcacaatcacctataatctcttatattttggtagggaggcgggagtatttctcaaagtcttaaattccctaaaacaagtctctaatgacagtgtgcagtgtgggtgggtcccatgtcgatcggtcggccatgtgcctgcctgcctgcctagctaaaattaagagccgtactcccgcgttactgaacagtacacacgcacgcgcgtggacacgagattatatttgagatggagtatatatatctagctagctatagtttgcatgtatgaatgtatgggccatatgcgatgcaatgaaatgcaacttggtagagagggtagcgatcgaatatccaccaccgtcacggcgcattaatttgcttaagttggctgttcggcccgtgcatatgggtgtactcgttttcgatcgatctctcaaattttaagatgtttctagtggaactatgatctattgcctcttacatctcgctcttttgtgcatgccgaatggctaaaaaatttagttggttcggaacagatgattagcttagatttttgaaagcatgtaaaataagatatccctccgtcgcaaaatatagcaacctttactggataggacacatcctagtacaataaatctagacatactcatgtctagattctttgcacttgtcccatccagtataagattgctatattttaggacatagagagtaagttatttctatatggtaattagtcgagtattaattataataaatttagaaaaatatatttattaacttatatgtaaaaaacttttgcacgaaatgtatcacttaacagtttgggaaatgtattcatcaagaaattgtgatgtagtcgcttcaagtagctatttaaaacttacccttagttattagtgatcatcattcgagtgtgcaagcgaacaaatcgtataaaattataaacatgatttaagaaagtcttctcataaatacaatcatacaatgcgtttgcaagaatgacaccatttgaaaatccgtgaagctatagttatactatgtgtgtaggattttt

SEQ ID NO: 22794 - DNA, 1501 bp, Oryza sativa
  unsure (1)..(1501): unsure at all n locations
cggctagctctcacagtctcactcttggtccattcacctgtgactgtgaagggacatgtaccgactgggctggaaaaattaatctagtgatgatggataactgtattttctcctttaatacatgctgcaaatgttgctataacattgttccaaattggagagatttctgcaagaaaggtattggcatcacaattcacacaagatctatcatagctagtcgaactgtaatggtcttatgctagtatgagtagaggacgtactcatggaatgtgagtgtacgtatcttccatataatcgaagagttttttttcttttttacggttttgctatttcacttttgacagattttggacttctatctttcgttttttttatccgtatatgatattgcatcaagatttatatttctataaatctaacttgcagttacactcagttacagagcacttgcactcacttacgatgtatatcaaaattagattttacaacaatattttttctctagattgacgatttttgatatatttgtctttttttttgttttatttcattcacaaagatatgcatctattagttaaaaatcctgtaagatttgaagctctccatcgaaagatttgataaaatagtcccaaaaaaatagggggctcctagctaacgcgtgctcgctgctagcgagcactcctcccctattaactacctctattaacactattagttaatatacttaattacctctattagttaatatacttaacactaatgatagtaattagaaaagattcgggagatttttttactaacagattaaaaaaattttatgttagatttgaaaattttcgatttaaattttaaaatttaaagttaaattttgaaaactttcaactcagaaatgaaaactttcaactcaagattcgaaaactttcaagtccagatttgaaaattttgaaaactttcaatttaagatttgaaaactttcaactcaagattctaaaactttcaagtccagatttgaaaattttgaaaactttcaaatcaagatttgaaaactttcaactcgagattcgaaaactttcaagtccagatttgaaaattttgaaaactttcaaatcgagatttgaaaactttcaactcgagatttaaaaactttctagtccagatttgaaaattttcaactcaaaatttaaaactttaaactcaaaacatgctaaagattaaaaaaataatcagaaaaaaaggaaaatgcgaaaaaaaatgggtaaagaaaaacaaaaaaaaagagtgggaggcgtgcgcgcgccggcgctgggccttatgggccggaaacgcgcgccgattagcaatcgcgcaaaaaataggaccgaggaaataataaatcgatctcgtattcgtttgggcgttaggagcattgggccacggcccacatagcccaacagagaagctcactgggcctctaacttccctctccaacgtcctcgccctctctcgntaagacgctaacgac

SEQ ID NO: 22795 - DNA, 631 bp, Oryza sativa
ttccataatgtccaagtgatatgaatattcccaaagtctagagttgtaaaaccacctaatgttgcctaattaaccagcgaagcatctacctaaattcatactaggggaaccttgagtagagtgcacagtagttggggttttgtttattctagggtgaacaaggtaataataacaatagaaataataataaggtcataacaaaggtaaataggcatggctaaataaaacagtgataacgcgggaatttaaataaagcgataatgcattaatttaaatcaaaataattttataaactggaattcaatatgttcaaggatgatgtgacttgccttgctcgctttcccaaacgtcggcttcaacctccacgaagagcggatcttccgaagctgcagtgtctacacgaccaacggaaaagcaaaaggcttttactctaataaactccatataaaaagcaggaacaaagcacaaaaatggattcttgacttcttaaggaaaaattagagacttgaacggtccaattccgagttcaaatggccaagttatggccatttgaagtttatatgctctttaaatggatatttgcgaatttctttatttaaattttaatttaaaaagggtttattgcgtcagc

SEQ ID NO: 22796 - DNA, 315 bp, Oryza sativa
ccggcgcgaggaggtccaacggccggctggcgatgcggcggcggagacacgggagaaggggaaggcggcagtagggcgaggcggcgtcggcgggctcgcggtggcggagtgacgacagcggctgcgacgcggggcgaggaggtcggatggcccgccggcgatgcggcggtggcgcgcttgtagtagtcgtgcccggcgcccatgagcccgccccaccattccaggttccacgttgtgtgtaaagtgtgtgtgagagagagagaggaggaaaggagaggaagggagaggctggcttgctgacgtggcatcctgaca

SEQ ID NO: 22797 - DNA, 979 bp, Oryza sativa
catacacaagctcgcattcctttgttgtacattatattatgctcacttttcagcaaacacgcaagaaagttgcacaatttttattaaggaagaacattgaataggctgggaatgaacgacagagaagaaataacctagaaaaaacagaggaaaacagaaggctataatcttatgccatgaattgaaaatgctcgacaagatgatcacccattcattaaaaaaaaacttccactgaaatattctaacactattttcttttcgtcaacctggtgaatagatggaaggatatcgacggagggaatgtaaagcgtatctccgaggttttggtcgctcaagagtatcatattcaactagttcctcagacgtaacatacctatgggatattcatctataaaaaaccaagtgtcaatggatcctacggagctattcgtacatgtacttcaatattttcatcatatggtcctcttatgtgtgtgtgtgtgcaagtttgaatttccatatattgttccatacttccattaaagtctcatatgattttcctcgaatttgatgaactagccgccaaaccgtgcattgtatcacttttcatatattgttataatatcattaatgtattggttatctatatcacttttcattgttctaagtcagatcgtgataaagtactggtagtttcattcaagttatacgttgaaagcatgtcacgagggcctttgactgaacctgccgaaacaacactggcgaacaaggcagagccattttggtgaaacaagatggcgaagcaccaaggagaaggcaaagacaaagctctttgccatcgccaccaccgtgccgaagatatacggtgccaagaatgggccgaaccgtcaaggacggcccacttagcagcccaactaggggcccatgaccaatttgtttttaattaagagcgtctgcagcataaacataaaatcgattttacagcaaaagaactgaacca

SEQ ID NO: 22798 - DNA, 174 bp, Oryza sativa
ttcttgctacctttgagccattggctaattctattactaatctcactgctctctacattgtgcaggatacagagttcacaaattgaggtactattctcctttgtcctttccttcggacaacattttacacccattttacaaagtcatccttccatttatacacctgtttttagt

SEQ ID NO: 22799 - DNA, 327 bp, Oryza sativa
gtcaccgatgactcttatcggtgtcgggcttctatttgtaccagttagagattagtgtgcgcccgttagaaatgacatttttttggcccgattgagatatactttgcacactatatatactccagtagtccgttgtctgtagtttatcccactgttcactattttggtgggaggttgaagggggcgaatttttgtaatttttttgcaaacaaaaacaggaaaaatcataaaagtaagtaaaagggtactaatcatttcctattaatttagtagtacttatgttatgagatgttaactaatattttgttcattgtcaacgatgggatc

SEQ ID NO: 22800 - DNA, 588 bp, Oryza sativa
ttttccgtcggccgaaagcttccacacaaagctgtcccgggaatccggctgtagctgaattgcctcaagccgatcccacaagtgcagcgcctgcatcgaaagggcccccttgatgtcatggacggacggacccaaccatatgagaggaagctaagatgttaggggtctaatctgacggccggtgacagaaatggaatcctatattttacaatcaactgattttctttcttttacaatcaactgattttctttccaagaaaatatttatgatttaaacatgttatgtaaggagagttggagacagatagaatcatcgtgtttcacgctgggcaccaaagaacagttcgtctaatcaatcaaaagcaataaagctagcgcactaggattacacatgtggattcacagtgaaactttgcagcatgcatggtcccgtgtaaaagttgattgattattgtactatgctaatgggtggacactgtgattagggactgaattatgcagagtaaactccacgttagtaatccattaattccccctctccctttaaaacctgccccttgcattctgttgatgagcacctgcgcctca

SEQ ID NO: 22801 - DNA, 1501 bp, Oryza sativa
ctttaaaaaaatcagacatgttggtaatacgtaaataaataaccttacaaagttgcatgaacaaatttaacttcactaatgagttacaaaattaacaaataacactattcatttttttctttttctgctatgtttctcaatttttcacagatgaagttcagtttatccttaaaactttacatggttgttcaatttgtgagatttttttttccaaatcttttgaaaacttttatatctttgtttgaaatgtaaaaatgagaaacatagaagaaataatgatattttttaaaaaaaataaaaaataaaatctcatagatagctaaggtaatagtactttgacaaccatgcaaagttccatgaataaacttaactttatttttgagatataaaatttgagaaacatagtagaaaaagacaaaaataggaatattgttatttgttaatttatatatcattaatgaagttgattttgttcatgcaactttgtagggtcgttcatttacatattacctacatgtgtgattttttaaagaatttttaagaacttttataaaaaaaaaattcaagtttccacctaggatgtgatttccaccatatactttccccatcaggaataacactatatgtgcatcttcggtaagtgtaagagcatctcaaagagaatggccaaatggctctccaagctaaaatttggcaagtataaagaaaaatgccctccaacagcctctctattcggttggctaagccgtatggctagccaaatcacagcactcactggccaaacttggagagtcatttcggctggccatccatgggctccaccactcctaccatctctctctgcccaaatagcagaggaccatggcagtggtggtgttacagtaggcttccttgtcgttcgccgccgtcagctctcgccttgtgtgcgtgggatctgtcgcctgcctcacgcgtggggagccacagttgcttcgccgcccgcgcgtcgccgctgtcaccgcccgcgcgcgcgcgaagccgccgccgccgtcgccccccgcctctcgcacacgggggagccaccgcagccgtcgctgctcgcacgcgcggggagccgctacagccgttgctgctcacctcgtcgccgcccgcgcgaggggaagccgccgccgcctgcctggcgtgcggggggatccgtcgccgccgcagtcgatgggctgatgcgggagaagagaaagagaaagaggaggaagaagaaggcaatggaggttgacatgggtcccttttttattttggagatgtaaatagagagactattggagtgaatacctagtttgactgcccaaatcagttagagagttggctataagagtatttaaagagtctaatttagagatgctgttggagatgctctaacagagaagaagggaaaacggttcaagatcctaagaggtcaccgaaagatgtcctctaggatttgaggtcttacgaaatatcctcctgatctccaacagatcagaca

SEQ ID NO: 22802 - DNA, 184 bp, Oryza sativa
taggtaacattaggcggttttacaactctagactttgggatattcatatcacctggacactttggaattgttggagtattgtggaattagattcacaccgccccctctattcaaaatccccaaaatggttttaggctgtgctcggggtgcatggttttgatagtagcacctcggccatataagg

SEQ ID NO: 22803 - DNA, 199 bp, Oryza sativa
tttaaaaactaaatgacacctaaacaaaactaacctaagttgctaggctcggtgagggttaagtctaactaagtaactaagttatgttttgcaaacctagggtgatagtggctcaattaattctctaggaaagtaaatcacactcctatgtcaatgttttgcaatcctagggtgatatgatctcaagtatgtctctaga

SEQ ID NO: 22804 - DNA, 642 bp, Oryza sativa
ttatgggagaatgttttcgatctcaaatctttgattgggttccatataaaaggtgtagagcttgttctcctccttcatttgcagccatttttgtcagttttcatcggtgcaatacgaagaaacttgcacttttataaatggtatattgtagttacttttttatttttttcttattttttagcaaatacataatgattccattacatgtttataaaagtatttagtacctaaattgaaaagttgggtttgcctctattaaatttattttcattcggataaaaggacgatttttttcatttgtaagaaatggacaatattttattaatgcttaaaattgttgtgtggctgtttaaatagtccgtaaaactttaatttactatgtgattagttccctccaatttaaatacattcttttttaccatcgggcatggatgtattaatgacaagctttattgtaggtcatggatgtacagcaagaaaagagctcatccaacgttcttgaaggaagcagccaaatttgttgaggtcgcaaaggcacatgctgtgagggagaatttgaggagcgttttttgcccatgcaaagtgtgtaagaacgaaatttgctgcaagatccgaatgaagtattgtcgcacatcttatagc

SEQ ID NO: 22805 - DNA, 522 bp, Oryza sativa
tgggagtgagaaaggagagtgttttaatatttgttgattgctgttatttggtagtagtgttactactggatcatactactatccaccttactacctaccctcacaatagtagtatccaccttactacctaccctcacaatagtgaaccaggtaatatgactccttgctacctactttttagcatagtgtggatgccctaacaaatttccataacatttcgacttcttgaaatcacacggttagtttgtcaaaaaaataaaataaaatcacagagttactgcactaatttagtaccctttatttcgaacatcaaatgtgttcactaaggaaatacctgcaaaatttgttggagccttaaaaaaagtctatgaaaactatcaactatagataaataaaactttcctcttgatatcaaaatgttatccggagacgaaaaggttttatcaatgaattttgctctaaaaaaatcacagaagccttaaaagtttctctctctctctctctctctctctctctctctct

SEQ ID NO: 22806 - DNA, 1501 bp, Oryza sativa
cgatcggtgccgaggcgaagctgcggggtgtcgtggacgcactcgaggctgaaatcgtcggacagcgagcagtttggcccgatgccgaacgggtactcgatgtcgacgttgccgcacttcttcggacacagcggcgacggcggcggccgccgtgatgcggccgcgatcagaggctgcagggcgagcaaagctaggccaaggaagagcagcattggatgatgcttcgtcatccgtgcctggaggtggctgtcgtagcagatgctaatttttgagaggagaatgtataggcgtgttaaattcttgagaaacttgacatctatgctaagctagcttcatgcatgttatatagtacttgggcgaacccgatgacttgagtgttagaataattgggctaggcccaacttataatattaaatctcaaaggcccataataagtgttgaggataataataccacctcaggatttaagcgagaaatatctcaacctaaatagggagttattggaggctccctgttgaccagttgaggtaggggtcggaataccacacgcgcgcgccgggccgtgggcgagggcgagggcgagggcgtggatggcggcgggcgggcgtcactatccttttgcaggcactaacccacgttcccacgattccctccgcaacagcgcgtccacgttccacgttcccacgattccctccgcaacagcgcgtccatgttctttctcctgatagataaggaggccgcgagtccgatccattttcttagcttctttcccggtgttagtttcttcttctccgcgcctgagttgctctcgcttcctcgcttctgatctcttgcgcgcacgagagattggaaggagcagtgcctccgaaaccacaccttcgcctgagatctgcaccgggtaggcgggtgatcaggtttttggggagtgcctcccgcacgactgctcgactgctcatcgccatgtctggagttgccgccgccactgctggcggtggtggtacgccgccgacaggagctggatccggagctggtgcgccaggaggtgccgtgaacgacaacaacaacggaggcaattctgcctcaccatccagcggagggccattctcggggtatactcttctcctcctgctactgttgttagcgctattcctgttcccattgttagcgctatcgctatactatgtgcgctatgttcttgttcctgttctacataatgcctctagcatgttatcgtgttactggtatgttcctgttcctgacattcatgatgcgcatagtatgctactggttatgttaagatcaccctacactgcttatgccatgatcattgctttaactttttggattaaaatatgccgattaatgactatatttccaacaatccaaaaacctgataggtcattttcggtagttggctttgctgctgcactgaaaccacatgcttttgatggttcaaactataagagatggaaagcacgtgcactattgtggttgacagcga

SEQ ID NO: 22807 - DNA, 449 bp, Oryza sativa
tggttggtttgttgccttgcttagctgcaaatgtggaactctacattcccctgacttgtagtaaactgtaatttttcgcgagttgttgaaggcattttaattcgaactgacacttttacacttgcaagtgtaactgcaagctactaaaatggtagtagaatctaggggctgtaattcaagttacctttgagcccagcttatcttaaggttgtttctggtgcaatactctgatatttgctagaatgatagatgcagttaggaaaataatgcagcatattgttgtttagttctactgaataggtatgctatgtggtttctgtcacattcacacatcagtagttcacttggtggtgccttaagtgaagcgcttatgattcacgctgatgtgttgcagtttgtgttcaacatcaactgaatattgggtaggaattaatgtatgtgctccattt

SEQ ID NO: 22808 - DNA, 1501 bp, Oryza sativa
ggtaggtcgatgtgacctaatggccacgtgtgccccggcgtcacaccgatgatcggttgagacggctggagcaccatccccggggccttgatagcatcaaaggccgcgggggaaaggatgttgagagccgctcctccatctatgaggacacgtcccaacttcacgttgcagatggtgggggaaaccaccatcgcaacctgccctccccgggcaatgcacggtgggtggtcggtctggtcgaaagtgagagcaacctccgaccaccgcgcccgacgcatcgcctcatgggtaggggccatggccagaagctctcgcttcatagccttgaagctccgtcgagagacgtgagcacatgctcctccatcgacggtggcaatggtggccccaggttcttggaaacctaggtcatcatcaccatcatcgatgtcaacagcgggggccttctgcttggcctcacttcgccgtttgccggaaggaaccgccggggacttgccctcacggcgttcctgcctcctgtcctcctcccatttcctcgttcgctcggccaggtttttgaccgcacgacagttcgcgagattgtggagggaggtgttgtggacagagcaccatctgccggcgaggcgctccctgctgggtgtaccagcctcgttctttttgtcgctcgcaggcctcccctttcgagtggcccgcggagcgccctcgacggcgaggacatgaccctcgtcgccggaacggtccggcctcttcttcctcctcctgtcacgccgccctgtctgagcggcggatccgggggcggccgaagctggccactccggaaccggaggagtttcaggtccaggcctcctcccttacgaagccactcggtccgcgagctgaaaaagctctgcggtagtctggggctttttggaggcaatcttttcaagcatgcggttgtgccgcacaccccccctgaacgcatagatcaccgcgtgtgcagggatgcatggtatatgtcggtgatatgggaccgggagtatcatgaccagaggcttgaggcagacgcaatcgcccacgtggcctggcacttcggggacgtcgggcccgagggtgaggtgtccgccctcctcctgatttcccccgagggggggggtcgggttgcgcttgccccggccccgagggccgaggcaccccgaccccttaaggaagtctgcgccacatatatgggataagtgagcacagctgtgctcacctaacagcatttattgcagtctggtcaagcgtgtcacgctgcatgcaacgcagtacagcgcgttcctttatccggtctgtgaccagtcacagaccggtcagatcacgggttaggtggcgactggcggtctgacgcacgccttgccccatcccgtcaagacgaaagcctctaggcactcgtctcaagccggagctagcgtgttatctcttagagatggcacgttagccctggtcagatttataccaggcttcatcctaaccattacaggcaagg

SEQ ID NO: 22809 - DNA, 1501 bp, Oryza sativa
ccgacggcggtgacaccgactgcacggtgaagaaccaccggaacagctgaagagaggggcgcaccccgatgaacatctcgcacagatgcgcgaagatggccaatgtcatcaccgcattgggggtgaggtgcgccatctggaggtcatagaactccaggacatccatgaagaaatgagaaaatggcgggactagcccagccatcgcgaaggggaggaagaagatggaccgccccgggtagtctggtgccgggcgcccctcgcccagcatcactatctcccgaccggtggcggactccggcatgaagcggcgcggcagtccggcgtgcctctcattcacgatgcgggaaggcggtagtgcactgccgtcgagcagagcagagccccgtgccatggcggcggaggaagagatgattgagaacgagcgcgtgtggcgaaagtagggcgtagcagagaaagagttagagctcaggtggcgaaggcaagaggaacaatggcgaaaggaaggaagcaaatccttttctcgatgcttttatacccttgccatcgctgggcctgactcctcgtttctcgcgcccactacctcgctccctcgtatctcgctatctcgctccctcgtttcccgtgcccacgcttccactaatcccattcgcccgcttacggcgcattgagtggatatgcggttgtggcaatcgaaatggattgtatcgtgcgcgcgttaattacgctcgccgaccgaagcggcgttaccatatctccgggcgagacgaatctgctcacccagattcgcgcgctgctcaagtggtgtggcagtcttgaatagaccgcccattatggacaaccaaagttaccaataccaatgtgcatggattgagaccgttgggtattttgcccaactacggagaccggtcccacctgtcacagggtggcgtcacacctgaccgcttcccatgggaagggaaattgctctggcataacgccgggggctactgtcggtgatatgggaccgggagtatcatgactagaggcttaaggcagacacaatcgcccacgtggcctggcaccttcggggacgtcgggcccgagggtgaggtgtccgccctcctcctgatttcccccgagggggggggtcgggttgcgcttgccccggccccgagggccgaggcaccccgacccccttaaggaagtctgcgccacacatatgggataagtgagcacagctgtgctcacctaacagcatttattgcagtctggtcaagcgtgtcacgctgtatgcagcgcagtacggcgcgttcctttatccggtctgtgaccagtcacagaccggtcagatcacgggttaggtggcgactggcggtctgacgcacgccttgccccatcccgtcaagacgaaagcctctaggcaactcgtctcaagccggagctagcgtgttatctcttagagatggcacgttagccctggttagatttataccaggcttcatcctaaccattacaggcaagg

SEQ ID NO: 22810 - DNA, 1501 bp, Oryza sativa
tgagcatttgggaattgggatagttagagcttcgattgtttgtagcaaccaatgtggttgcttttcaactctagtcatttcagtgtttgtattctactaatgtaatttacttacagcctattgatggtcaatgttcagaaatttttgtgcttcactatcatgcttcgtcaattcttcaaatggatagtgttgtcttgtccaactgtatctcttttcatccttatattttctagctatcttcactgggaacaagagattgtctgttcatgaatcatgatgcctaatgactctgacttccttttggatgctctgttcctttctactacgaagtagtatcttcatatctagtattaaacctacttgctgtcttgtttcataaatggtccatataacctgctgtcttctgtggtttgattttgttgttactttgttagctccaacaatttaggcattttccagttgttttattcctggcattgagctactctggttgttgaccgcttgagctgcaacctcatagtgttgctggtgactgccgaaagatagtaacagtttgctcagtctttttctagtaggtgtagatgcatgtgctacatttgctgaaatagtgctatttcagtgtgtggtgtgtttagctgctttcctcattgtgattaccacatggcatcttcaaaacagccagcattcattcaggagatttagtgtgaaacagcttgtgctgagaattaattggaaagttggtacacggtgaaagaaagtcaccgtcttattttccatgtttgatgccatgtttgtctgaagaaaacaatttggtagagtatgtggtactccctccatttcaaattgatctatatactccctccattccaaattgatctacatatagtttttttcaaattatttctaaatgatctacatatttgtgttcattcattaagtctattcgttatttgtgcattggagtaaatggacattgatgcatgcatccatgcacacaagtatttagagcaaggtcaatagtgcagcccactactagctcctattcatctatagccaatgtaataaccgattcatacaatagttgcttactatactattaatacctggtcccacctgtcatacacacattacgtattgaagtccgtgttgtagctggctacagatcagtacccttctgctcttctctctctttattaatctctttaaaatatgtttatagctggcttatagcctgctattgtacctgctcttataacccatatgcaatatcttgatttgctattggctagtaaatagtggggatggtgcatgcatcgagttttttgctaaagtaaatataggctctgtttgattcagcttaggattattataatctggattattaggagtaagctgaaacaaataagtagattattatgctatattattataatctataagccagattactataatctaataatctcctctagaagagctttttccagattatttagtggct

SEQ ID NO: 22811 - DNA, 185 bp, Oryza sativa
taatttagtcttggtattttacagttttcatgtccctcggccttagtctgtttgcattaaccaggaattatggcatagtcatatttccttctaatcacttttttttgggttttcaaactttgagtgaatagtctagcacaggaatggaattttagtaccttgacttttttttaacacatttcagg

SEQ ID NO: 22812 - DNA, 1501 bp, Oryza sativa
cgcacagccatgcgagcacaacagcaagccgccggactggtcctccatggaggcagcactccctgcggcgatggcggcgttcgcggtggtgatgcctgctgcgagcgagcgggcacggcgcgaaccagacaataaggaactggttggtggctcgctaccagccatggtcgcagtgtggccgccgacgtcactgagggcacacgagtgccgatgggaagtggccggcttgccagtgacgagctcgcgggcgttggcttagatggatgaggaggtggcacccgtcgagcatggagcggcacatttttttaagagaagggtatttttatccagcctctacatccaatcggatatatacagtctttttaagttaggaacttagcctatcaaacaaggaacttagctctcaaataacccaattcgctcatatgaagatttgaactcaggactttgggtgctactcaggtcactgcaaccaataggctacatgccctttcacaaatagagcggcgcatgctgtagccgtcctgcaagcagtgcaaaagctcccaaagagtgtccacatgtcccaatgacaccgtgcgcagcgtcaccctccccaacctttccgcccattggccttcaacgttctaattccgctccgctcggatgcagcttgagagagagagagagagagggtcgggggggggggggacgaagaagtaaaatgaaaggggagggttgaagaggatgaaactgatacacgggttccatatgtggggggtcattttggtctatctgatgataaaaaacgtgattgcgatgatatgattacacttttaaaaaattcaagtgatacccagccgatatagcgaatattaatattattttctaatttggcacatttataatagcattaatcaaattaacccaatagatgatgtcatgtcagtggtagttaggacagaaatatacatatgtctgcacgtggcgtacaggaataaatgagaaagttcaatacatgactcaggtcctccactacactggtgtggatcgtgattcttatgattaaagaaatcgaaagaaatgagatcgagacgcatattgttacgacctacaatatattccaaagacgaaagtacaagaataatgatcttgctgatctcgtcattgtttgagaaatcgacgatacaaccagaaaaaaaatgccaaggcgtcaatgtcgcaagagcaatcatataccatatctgcatatcatatcactgtaatcagtctccacacctaaactattgttgttttcccattttgtgggttctggtagagttgttggataagtagaccagtataccaatcaggtcgcgcacctggtgctaatagcttagtttgcgatctctccatcggttctcgccatggcctccacggagcagcaagaacacgcagtggcgctgcttgaccccaaggtctcgctgttactcaatgccgatgccatgtctatttttactatgcaatttgcctgaaatttcat

SEQ ID NO: 22813 - DNA, 371 bp, Oryza sativa
caggaaaaaaactatttattcggagcaataataagagagtaattgggggtggcctaattagcaaaatcccatttgccaatcaattcccatcttccatcctacattttcgtcacgcggcacataacaaaacgtacttacatggatgctcgttcatgtatcgatcgtcagtactgtaggatgcttccaattgaaaccgagtcccttttcaacttttccaagaaacaaagctgtgtccatccacagcgcccaaacctgcaaagtacaaaaacactaactttctctttggcgtcatttcaaaagacccaaccaaccaaacaaaacaagccagtaccaagtccctctcatggctcaacagtgttgtgtttgttagt

SEQ ID NO: 22814 - DNA, 1501 bp, Oryza sativa
taaaccaacaacaatgtgcatacgtactgccctcaccgtctcggtcacacgcttttctaccgctttttacacctgattttggctttattttgttggcacggttagtgtaataataaaatctgaacttttaaaactagtggctaaaaaaatcccaaaaacaatgtaaaaaagggcccggccacaaaaaaggaggaaaaaacccaaagagatgaggtgctagctagtactcttacatcacgtataggagtagtatggttggcaatttgtgcagttttttttttctcaatttgctgcactgagcaaaagtcaagaacatgatgtcacgggtcactttgggactgaaatatttgcatgtcacatccaagagtagaggaaaatattcaatatcggatagatacacatttgaagtattaaacgtagtctaataacaaaacaaattatagattccgcacgtaaatcgcgagacgaatttattaaacctaattaatccgtcagtagcaaatatttactgtagcaccacattgtcgaatcataaagcaattaggcttaaaagattcgtctcgcaatttacacgcaatctgtgtaattagtttattttgtctatatttaatactctatgcatgtgtccaaacattcaatatgacagtgtgagaagtttttgcgtgggaactaaacaggggcctcagtacagcacaagctctccactatactgtagtagactagtactccctccggtttcattttaattgacgttttggacaatggcacggtctacaaaatatatttttgaccttattttcctattataatatacaaaataaataaatgcatgtttacttttattatagtgctttgaaagacaaatctatatatgttgtcctagtttctttaaactaaatatttttaaagttattgatggtcaaagttataaaagtttgacctcaactttgtccaaaacatcaattattatagaactagagggagtagtactacatccgtccttaaaaaaaaactatgattaataaatcaaaaggaataagggatattatataagcaacagctagtagaatgaacaaaaaatggtctacttgatcttaccgtcaattgtcattgttggagaaattgacgctacaacgactaacaaaatgccgaagcgtcaacgtcagaaaagcgcaatttgaatggtaccataccacaccagagtaatctaatatccacacctaaattagtagaacgaatctttccttttctctctttttgtggtttctgattgagtgatagagtagacccatatctcgactcggtggctgtgctatcatctagttcacgagctctcaatcgaccggattttcgccatggcctccagcgagcagcaagaacacgcagtggcgctgctccaacccaaggtctcgctcttcctgaacacctcagcaattcttatgtcgattttcactgtgcacttcagttttctgcatggctgaatggattgggacttgcttga

SEQ ID NO: 22815 - DNA, 1080 bp, Oryza sativa
ctttttcgtcgtcgctgtcgacctagggtgagccgaggaccgccgcctcttttcccccttcccttcccctctctcggccgccgctccgccgtgcctatggccgccgccggcgaccataggggcgcgggcgccgtctcccgccggccgcgccgagtggccgccgcgtggggcccggccgtcagccgcccacgtcctcgggtgcggctgacgcgtggggcccacgacgccggccggtgcgagcccgggtgcgcccggtccaccgtggaccgtgaggctgtctcgtgggccccactcccgtggacccagtccgcgcgccccctcccctcggctgacgcaataaagcttttttttaaattaaaatttaaatgaagaaattcgcaaatattcatttaaagagcatataaacttcaaatggccataacttggccatttgaactcggaattggaccgttcaagtctctaatttttccttaagaagtcaagaacccatttttgtgctttgtttctgcttgttatatggagtttattagagtaaaagccttttcttttccgttggtcgtgtagacgctgcagcttcggaagatccgctcttcgtggaggttgaagccgacgtttgggaaagcgagcaaggcaagtcacatcatctttgaacatattgaatcccagtttataaaattatgttgctttaaattattgcattatcgctttatttaaattcccgcgttatcactgttttatctagccatgcctatttacctttgttatgacctattattattgttattgttattatttccttgttcaccctagattaaacaaaaccccaactagtggacactctactcatagtaccactagtatgattttaggtagatgcttcgctgattaattaggtaacattaggcggttttacaactctagactttgggatattcatatcacctggacactttggaattgttggagtattgtggaattggattcacaccgccccctctattcaaaatccccaaaatggttttaggctgggctcggggtgcatggttttgatagtagcacctcggccatataaggaccggt

SEQ ID NO: 22816 - DNA, 321 bp, Oryza sativa
aagcaacagtattccatcccacgactgcccctgccaactgcgctagcactgttctcatcctgaaagcttcattgtaacgtaacatctgatgatcccaggcaagcaagttgcagaattagcaacttggaattgatactagtcaaatcagtactgtaaagataagtgcatcttacaaagtttcaccagatgcacatgcccagatatgaagtgtctgaactaatgccctcgtcactttttgtgcaactataatctattgcatcacaccatgtaatgagagaaatgaagatgaaaaacttacctgaagagttcttatgggaacca

SEQ ID NO: 22817 - DNA, 1501 bp, Oryza sativa
ccatatatcacaattagacataaatgatgaagaaaatataatcaataaaataacaacatgaaactgcaaataactttggccggaatgatatttcaatattaggaaaattatataactaaatccccatttttttatttagctataaataattcaatacagagaaaaattataaattataataaatttttaatggatcaaatagtgctaaaactaatacagcaaatagaaaaaaactgaaattagctagaaattgaaaaaaaaaacttattttacctcatagatgaaaacctaatccattaattttggatgagtgcccgtttcattgacataattagaatttttcatgttctatttttatgatctcaatattatgtgagtggtctagaagcatggttggactggaccaagaaggaatagtgcacaatacgcaatgttcattgtctttcataaccaaaggtgagaaacaaaagaggaggaaagatgggcgccggtgctcgggcgaccaaatggtgctgaggaagatggaagaatgtgtcccatgatgtgtcttgtccatagatggtggaggttggcaacgaataaaataagaatagcatgaacgcgactggcaacgacatggtcctgaaagagagagagagggaggcggaagcaaagtgtcacgccccgaactagtcccgaccggaactagcccgtgacgctccaaattaacctgttaatcgataccagtcccaggaaacagtgctggtatcacagggagacagagtatcacagcaacagaggtctctttattatagagtagatgtacagtcatgttgggctgcggacagatcccgagctcacaactgcattacaaaaggaaagcggaagccaggacttggaccaatcaacacaggcgcgacttgggaactaggccgaaaccctaaaactcattgtagccggcttgctcctggaagaactcctcatcagcaggacccgcttcatcttcttcagcaactaggggggggattatttatatagtgcaagggtgagtacgggagtactcagcaagccatgggaagtaagtgtttaatgcaggcttcaaggaaaggctgatgtttctgcaattaattttatttgaactcttttctgaaacaactaagtgagtgcttctcaaacgacacggatgagacagtgcgtctcgtccggtcggagtatgtgcaatgtatcagtctttagaatttaaacaaggttggcacccggccaacagctttttcaacggccacccggctaacaacttttcaaacggccacccaggccaacaacttttcaaacggccacccgggcctagctgatcccatcagctgcagatttttcaaacaccgaaccccttttcacacagcaatttcacaagcagtagtcaaacaaaactacgctaggaatcacctcacatccgcccgtgaccgtgggcacggctgttcgaacagtttaatgacctctgaagagggggtacgctttacccaca

SEQ ID NO: 22818 - DNA, 1501 bp, Oryza sativa
ttcaatttactgcaacatttgatccatacatattgaaacattataagtacactaggtgaaacatttttcggtggaacaaaaaataaaacgaattcccttaatagggggtttccaaaatatgtgggtttttttgttgcaatggaatatttcagttcactgcaacattagatctatacatagtgaaacattgtgagtacactaggtgaaatattttttgtggaacaaaaaataaaccgaattcccttaatagaggggttccaaaatatgtgggtttttttttgcaatagagttgtttgtgtgtggacacgtggtgagccaggggagtgtaggcatggtgaaacattacaagtacactaggtgaaacattttttggtggaaaaaaaaataaaacgaattcccttaatagggggtttccaaaatatgtgggcttttttgttgcaatggaatatttcagttcactgcaacattagatctatacacagtaaaacattgtgagtatactaggtgaaatatttttttgtgaaacaaaaataaaccgaattctcttaatagaggtgtttcaaaatatatgggttttttttaatagagttatttgtgtgtgtacatgtggtggggtggcctagggagtggaggcatacatgcgcacgcgggactgtttggttgttggggttggactcgaccatcggagactcactcgagactcgagagtggtagacacggagaatctcggcgggtgggcggtcggcgaggggctccgctcccgccgccggccttgctccggcaacgagcacacgcgcctccacacgatcgccgccgctgcgccggccacgatgtacgtgaggctactcttcttgtgtgcctgcacccccagagcgcaaatcgctttgaagcgtatgttccttaagctctctgcatctacactacagttacttccatttggttgcttgcaggtttctgttcatgcctactttgatcactgatacagcacaggctgttgcttatcagatctgttcttcctctgtgccacatcccacatgcaggcaaattgctctatcccggtagtttactgaatgaacagtggcgaatctggcattatgcacctttgcaatcgcaacagatttaagtaaatccattggctgtaccgcctgtacctttactattgcgttctaattatggttttgggggctgattagacgtttagtttttttcttatcttccaaatggcacggaatggcatcagattcaagaagagcaggacgactttggtttttttaaatccatttttgagaacaccatttggtaaagttcgaacagagggttcagaaaacaaacaatacttctgccgtggtttggtagtccttcacttcactgtctgctcgctattcaccattcccttctctactactcctggactgctttgttctctcgcagtccacagctcttccatccctcccactctcctcagcttagctagcggagtagagaccagacagatcaatgg

SEQ ID NO: 22819 - DNA, 1040 bp, Oryza sativa
gacttcgtccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccattttggggattttgaatagagggggcggtgtgaatccaattccacaatactccaacaattccaaagtgtccaggtgatatgaatatcccaaagtctagagttgtaaaaccgcctaatgttacctaattaatcagcgaagcatctacctaaaatcatactagtggtactatgagtagagtgtccactagttggggttttgtttaatctagggtgaacaaggaaataataacaataacaataataataggtcataacaaaggtaaataggcatggctagataaaacagtgataacgcgggaatttaaataaagcgataatgcaataatttaaagcaacataattttataaactgggattcaatatgttcaaagatgatgtgacttgccttgctcgctttcccaaacgtcggcttcaacctccacgaagagcggatcttccgaagctgcagcgtctacacgaccaacggaaaagaaaaggcttttactctaataaactccatataacaagcagaaacaaagcacaaaaatgggttcttgacttcttaaggaaaaattagagacttgaacggtccaattccgagttcaaatggccaagttatggccatttgaagtttatatgctctttaaatgaatatttgcgaatttcttcatttaaattttaatttaaaaaaaagctttattgcgtcagccgaggggagggggcgcgcggactgggtccacgggagtggggcccacgagacagcctcacggtccacggtggaccgggcgcacccgggctcgcaccggccggcgtcgtgggccccacgcgtcagccgcacccgaggacgtgggcggctgacggccgggccccacgcggcggcc

SEQ ID NO: 22820 - DNA, 1501 bp, Oryza sativa
ggagatgatatgaagtttatgtgggataagtaggtaagtaccaaaagagccgaaagggaagtggtcaagcatgtggtagctgaagatcaaagtttttataaaagatgaggtgttataagtgaagcctgaaatattgctgttgaaatggcaatggtacacatgcaatggcacctctggagagaacctgcacaagcggcaagtggcagatcatggtcatactgatgttgcaggcatgaatggcaacctggagatcacaacctgcatgaacataccatgaagagatagcagccaacgcagttgatggtttagtggatccagaaaggtgttgctttcttgatatttactctggcgtttggtgaatgtggcatgttgttctaagccaagaggaggtcacaagtggtaacaagaaaaactgaagttagaaaatgaatactgatgctgatcggagatttctgattattagtagaacctaatggatagtcaactgcgctcaaggagagcacatgttgtacagccatgttaattgctttgaaagtgggcaagttgcccatcaattatttggttatatggcagctttaatattgttcaatgaaaagatgaggcctatgccagatcatggtcgtttcaactgaacaaaccggggaatgcggcatgatgctcgttttcaattgcaacgtctgcacctctgttccgttgccatggtgttctgatgactttgatgaaaaaaataaactgcctgttttataaggaaaaaaaaggtacgtgtattcttgtgagtttaagttatctttaactatcattgtatacactctctgtagctgcagagaattatatatggcgtgtcattgtagaaaataaacctgcttgtttttataagaaatggaaaacagattaccccagtaaggatagtttaatttttattgagaaattttgaatgcttgtgctttcttcccggtctgaatattccaacacttgtttcttctttgttgtataactgttaccttgccattttgtctttcataacaccctctctttcttttttttcttccttttgaagcctctgcagtacttgcacagcaaacagatgtactgtaagcctgcaaaactacttttgctttgtccggcactggatgactggaacgaaaaccacgcatttctaacattcttgctgcaggcaaaaatagggaagcctctgaagattgcagccagcaagccatgcagggagaacatgttactgatttctgattccaaataaaaatgcggcaaggtagtgccgtagtgcctaagcatgttacactcaagccaatttgcccagccagactgacaccgatcggatctcaactctgcagtctgcacgacgtttccttagcccttctctattcgctgtgccagtgtgcttgcttgcttctctcttagccagagtaacattccagcctcttctcccctacacgtctgccactgcttgcttctcatctctaacccagcttgctagcggtgcagg

SEQ ID NO: 22821 - DNA, 1501 bp, Oryza sativa
agataccagtttccagtaaagaaacttgtgatcagaaagtgtggtgctagcgggaaggaattgacgctgctgctgtcccatttccccaaactctctgacttgacaatgtatagattggagaagatagcaatgcttggtgtggctgagcagcagataacggcaacatcggcatcttcaccatcactttctggtaataagttggagaatgcacgtttcggacaagagcaacaacagccaagaggagaggacgagaaagcagcggcatcttcaggactgctgctcttgcctacccagctacaggagttgttcatctcctgttgctcaaagctgatcctccaccacgattcacttggagaaaacatggaaggacgcctaagaggcatagaaggagggttacaaggcctgcgctccctcgtatcattgactattatcgattgccctgatttcttctcctcctactcatcatcttcctcatctttcccatttccttcctccctgaaatatctgtctattgaccgtgtaagtggcatggagactctgtcgctcctctctaacctcagctctctcaccaacttaggcatagaatgtggtgatttaagaggcgaggatttgtgttctctgctcgcccaaggccaactcacaaggctgcgagtcaacaagaaccccaaattcttcgtcgggatcaacccctcatcactgcagcaccttgtaacggatgacatcgcaggagtgcttgttgtgcccatctgcagactcctctccccctcactcaccaagctaaccattttttgcaataacgaggtgaaacgcttcaccaaggagcaaaacatggcccttgagcacctctcctcccttcaggagctcagttttagtttttgccggctgcagttcctcccctctgtgttacacaggcttgttagcctcaagagattagagatctcgtgcagtgagttcatcagttcgttgcccaagagtggtcttccaagttcactagaaatactagatgtctctggaggcagcgaggagctcaaaaggcagtgccgcaagctaagaggaaccattccaatcatcaaagacagcgactgggatttgattggtaatgaacattctcttgtttgagccatcccggttcactttctgtttggcgcaacgttaatactgtgtgattcatctacctgaaaaacctgattgttctgaaatcctgtgcagattctttcttggattagtatgtgccttattctagtcttggagaatcttctctgcatccatctccattgagttgataatcaacttgtgctgcttccatcacgtgtacaaaaactggtctgtcatttcatacgagttcatatctgatgctttagatgctcattttttggttatctgtctgatcgcactcttctctttttgcaatctttcagctgttctgaataggtattggcagtgagagaattgtgggatttaatcccctgcacacagaaagaacttcaccttgtcgccgcct

SEQ ID NO: 22822 - DNA, 1501 bp, Oryza sativa
agaattaagataataaaacaatagtttacaacatatatatttatgtatttgcatggcaaatgctaatttgtggagggatccacaggtgtcataacatgtattcaaaacagaataaacatacacacagaatttctggaaaatatctgaagaaacataacaagataagtatacgcaacataaatatttaacatttcctttgactttagaattcctttttatccaataaagccattttgaataaattagacagtatgtacagaactacattatatgcaaaaaaggaacaaaaaggaaccaaggagacagcaagattcaaatataagttttagcaaagtgaaacagcgaatttcatggcatactactgtggttcgaccgatttaagtatgcccacaatgctatcaacttttgcagctcttatgggaaaattctcaggctttgtgggatttccactccaaaaagagataataaaatgagcactagcagcatgggaccatggagaacaatggacaacacatgataacttaaacatatgttttagaataaggtgaaagtattaaatagacaagatgaaatggtttatgtcagtatggcacaaatggagcagtggaaccatgtaacacatagattagatacgaagcatacctgtagttgtgattaagagggtaccatctgcagatggaaagaattagtgtgagacaatgaatgatgaaccaagagttatgacaaactctaaaccaaatgaagatacatggcacagtgtcaggtacatggttgttgcccaagagaatgtcagggaaaaacatatatccatcttcccatcaagaccatctacaattctacatatgaacatatcaaatgtagtgataatatatcttaagcaaattctgatgacttggtgaactccatatctactccgtacctaacaggctataccgtacaaaccaacttcccagatgattcagcggtgttgttaacaacagaaccacacatctcatgcaatccgcagtctgaggatgctactgacaaccagcaaacagggaaattgagcgagagaaggtgatcgcataccccatttctccacgggggtctcacgcgccaatgcatctagctccaggaactcctccagcttgctcccaactccagtatctgaaactgcagtagttcacgaatgtaagcggaaggaaggggcaacagatcacaacggcgcaagcgcgcagctgcactaccagatatacgcaggggcgaggaaccagcgggttccggggagcgcttgacggagaccgtgagccggcacggcgactccgacatccggcagcgctgcaccgcccagtaaatcaactgaaaccgaacaaggaatccaaacaaagtgtatcatcaggggagaggactcggaatcgcacgcgaagatgagggcgagggcgaggcgtacggagtggaggagcttccggtagggcgaggaggaggtgggggacgccgtcgatggaggcggggaggacgccat

SEQ ID NO: 22823 - DNA, 1501 bp, Oryza sativa
tgaaacagagttgagttattgattacttgcggcaagacagctgttcttctctgatgatgggacccaatgtattctttgctttgttcaagtttatgtcttgagagcacaatagtttctgtccaaggaaaagagagaattccaggattgtgctttcgttgtgtctgtctagtaatgattccgttgcttcatttgttttatatatgtgatgtaaattgtcagtacacactgttacttttttgtattacctagtgtaaagtatataaaggaaaacactgtatgcaaaatccttactgtctagtgcatattcttgttctgcaacaacctggtctcacggcgtagtttatataaaacactctgattgcacaatgaatttctggcatctcgatttcagtaaactatactgttcaaaaccttcaagggatgcagcactacatcatatcatctggttctgatcaaatccaaataatctggacaaaatttaccagagtttcatgattttcatctaatgccaaattgccagagcagaagttcgagtagtcaaaattttccacataaaaacttcatcagagcttcatgactttcatctaaggactgcctgattccatgtcatacaaagaaaagtgaaaggcctctcccatgcttgaagcaccataatatgcctcccccatgcttcaagcaccataatatcacatcattgcaatgcctccccagtgggcactgcactaactaaagtccatgagctttagaaaggcatctcactgctataaattagtgcaaaacatcactttatggtgttaagcctcaatggtagtttagtttaggtaccaatcaaatagacaaaacttgttttttttttgacaagttagaagcctggaatgccttgtatctgcacaccgctgcattggtaaatccatgctcagatgactaaatgacaaccacaatgaactacctacgaatagtggaaatcacatgaaacaaatgatgcaacttctcactgtgaagggcttggcatagagccatctgcatgtttaacagatcatatcggagattaaggagttcactagtcctaacattaggaaaactgtgaaatttgacagagaaaactgaaccgtgtgaggtgtgcatctaaaattcagaactgaaagaagtgttctttttaacactgtaccacgatttcatcaacccgcaactaactcccttatacagggcaacaggcccatttttcatcagttccatgttgcaattacctctaattgtgaagaggcagttgtttttcaggcgcataactatgaaataaaaaaaacatatgttttctaaacaggtagaatctcctaattactgtgcttccaatgctaaaagcagatcagtcatgggttcagcgcagaataacatgccccacatgatacctatgatcaccaagttaaaaaagatgccgcttgacaccgcaaagataataatcagctaatcacaattgcaaatttccaattcatccttgctacga

SEQ ID NO: 22824 - DNA, 1501 bp, Oryza sativa
gatttgggtgttttttttcttttttttttttttttgaaatgaaagaagaagggccaccaccaccagggaagttgtgttctggataagaaggaaatgttcaactatctcactcacatgttcctccatggcaataactgtgaatgaaaatgatcaaaaaaaatattcaaaatgtttatgcaatcgttttttctctcttggaaacggaatcagagacccgaaaaataaaaatgataccgtacaactcgaacataaaaaaataaatcacaaacgaaactaccatagagtctgagaacaccttgcgttaatgagttataatcatgtgttacatcgtttcttttttgaaataatggataaaatccgatatctataagtattttaggttactcatatggttttataattagcctatgccaattactttcttcgtctcaaaagataaacagatttgaaatgaatatgacactctttagacagaaaactataaagtgttccattcacctaaaatattttatattttgggacgaaaagattatagggtagtctctttactaactgaaaaaagcagtgaattgccaggggagtactgtagatacgataagcagtggcgcacccaccctgtgtatggtgagatttttcttttcctcaatcgagaatcttacaaaatctggtcgagaaaaaaccagtcacgatatgtcgatatccaggtgacaaccttctcctgaaaaatgacatattgatacttacggcctcataatttgcaaacgaaaaataatttataaataaaacttttatatacgtgttgttagcgatctgaaagtaaagggtgaaaaataaacttcgatgaaaaacccataaaattaactctaaatttaagattaaaatttcaaacttaaactaataaaaattttctaaaaaaatagctaataaacataagtataagaaaaaaaataagaccattactccagccatatgattagtgctccgtattacttagaatcaagccgtacacaagattaatacataatccctctatcctaatataaaaatatctcagtatagatgtagacatatcgatataacgtattctataactatgaattacatagtgggagtacaagcaacgctgatgacttttctcccggtttcatattttcttttagaaaaaaaatgaaaaaaatgcatgacttcttcccggccttttagcgtgcgtggcgctcaacacattttctactaatatataacttgccacgcaagcgaaaactcagacgcatcaatcaacaaaataaataaataaataaacaaacggatcaaaagcagcagcagtagtcagtagacgccttccaagacaagctcaagcaaaagcaagagacaccaaccggcggcgaggaggcaggaatcgcggcggcggggtcgccggagatggggagggaacggggtggcggcgaggggatgacgatgctgcagcggtggtcgtcgtcggtgtggagcgtgagcgggagcg

SEQ ID NO: 22825 - DNA, 335 bp, Oryza sativa
gggccccattctcgaaccgccgccgccgccgcgccgatccccatctccgaatcgcatggggcgtcgtcggcgctagggtttcgcctccgctccgccgccgccgtgatgccttcgcgagagaagccgacgagcaatccgcggtaagccttgcattcccgtcccggcggtggcggcgccagttcgccttggtgtttgtgcggtggaggaggagggggagatagggcaggattcgttaggttagggtttcgtttctctccagccggatttccccccgcggaagcggccgcaaacgagagcggcgaccccgcgtagcacaccggagaaaccttaggttc

SEQ ID NO: 22826 - DNA, 314 bp, Oryza sativa
ccgactgtttaatgtcgtgggcaggcaatacatagtaaaatgtgtggaactaaaagtaagtgatgaactagaataaccacatttaaacgaaatcgaattatatcgtcttcatatccccccggccccgccgcagacacacactgcaaacagagtactccatccgtcacacaatataagtgatttagaaaggatgtgacatatcctagcactacgaatctagacaggaagcctctctagattcgtagtcctaggatatatcacatctctctagaatcccttatatttttggacggagggagtagaacataaggtag

SEQ ID NO: 22827 - DNA, 198 bp, Oryza sativa
taggtgaagttaccttttcttttgccaaatgagcaaacacaaattaaatcacttagttcattaagcacaaaacgttaattgattatatgaatcctgaaggattaatggatcgatgcatagtaaacataacaagtaataagcataccattgaatccacgcagcatgcaattgataaatggtccattctttctcttcagg

SEQ ID NO: 22828 - DNA, 1501 bp, Oryza sativa
taaactacatcaatttagacttggagtagtactatttttcactccaatcaccactcatttaaattccttccaatcttagggtgtgtttagttccacgctaaaattagaagtttaattgaaattaaaacgatgtaacggaaatgttggaagtttgtgtgtagaaaagttcgatgtgacgtttttgggttcaaaatttagaactaaaccgtgccttaccccaactatctccattctgaagcacccccgtttaatgagagttatctagattattttcattttatattaacttgttttttaaacattacaattttttaggacgaatagagtatatttatatttgaagccatccttctctgtcttcttttttaaaaaagaaaactcgcgagaagagtttgaggacaacatagatttaatttgtctttcattctctcctgcctcgagaaaaataaaaggaattggctgttgcgaatggagattaaataggctaaactgtgactggagggagacgataatggatatgcttctctgttttgtaaaacgtggactgatccttcctagaaaaattacaaatgtgtcgttctccgtgcacttgcttcatatgaacaacaccagtcagcagaccgtcaatgaaatgttttgttacaacttagtacaaaatgtgttcttcgtgcaaaaaaactcatggtagcaacttaattaggcttgttaatataaagctaaagaagagttctcggcacttgcacaaatccactaggcacccacttcacattacattgcagctagaaatgaacaaaaatattcttgtgcctcactaaagaaatggaaattgtcatttttaaattaattcataccaatctaagtgcattgtatctgaccgctctaaaaaaagcagagcaatttactatcatatagtactacatttaggcatttagcacgggcgttattaacacaaattgccaattaaaatgtcgtcggtttcacaacacactcctgatactgtaacagatagcatctgatgctggtgtccaagaaaccgccctaccattagctagtagctagtcctcttaattggctaccttccgatccctttcatcgccttcctcttcagtcaaatgacacattaaattatgtcggtaattcacctccgtacacaagcaaacgcctgctagcttaattgatccccataattaaccgcatgcggtataattttcttcttcaatttacacaagaaaccgaccttgttgatcgagttgttgttgtcacctataaagctagcataaacacactactcctcttcttgaccccttcttctcttctccatagctatcaaacacaccttgtaagcttctagcttcttcttcttcttctacatacacttcatcttctccatagcaaacaccttaaacttatagctgcttcttcttcttcttcttcttcttcttcttctacatagaatagaagcttctacataagatatagtccatgtatagctctagtagca

SEQ ID NO: 22829 - DNA, 424 bp, Oryza sativa
gcgagcgtgctaggcaaggagaatgtgatcattgtaaaaaaaatttgaagaaaagatcattgtacagaatgagataatcagaaacatcatgcaccaacgattggtaatagtagcaggctgaagatgtcgctggtatggtggcggagcagtaggcagccatgagagctgctgcatgccaatgccaacaagtgcatcattgatacaataaagtctggttgtttggggttttgttttgttgaatgggctgtagtttttttatgcatcgaggtgttttcaatatatagcttaggggaaatcatcatgattcgaatttcattgatttgttgcagaaaatttataaaacttgctgaactttgcagaggcctgataaagcattcatgacaacttggtgaaacattcatttgacatggttatacttatgata

SEQ ID NO: 22830 - DNA, 1501 bp, Oryza sativa
ccacgacttcacaggagatcgacgtcagagttagcgtgacaccacgatcaccgatttactccgattgctcctcctcgttgtcgctgtcaagatcgccatcgattggtgcgtcatccggcggcgacccggctgcggcggcggagacggagtccaacggcggcgagccctcgaagagctgccgccggagcacgtcgtggaggccgtcgaagagcctcttcttgacggaatccatggcccattcgaggcggttgaggagctcggtggagttgttgttgtacatgaagaggccattgtagaggtcgaagctgtcgctgcaggtgttgtcgacgaggcggagcagcgtctcgtaccccttggtgttgatcggagttgtttggagctccagcatggcgagtgttcgtccgacggtgtgggtgaggaactgcgtctcggcggcgtgcgcgtcgtgctcggcgcagctcatctccaccatgcggcagccctcgcgcgcgaagatgtcgaggaaggcctcggcgcgggcgcggcgcgccgggcagtcgccgacgcggaccttgtcgaacacgaaggggaggccgccccacccgtcgcccgcggactccgggccgaacatagggtgggtgcagatgatgtcgaactcctccgggagcgtgccgaggaggaggttcctggggaactccttgacggagagcacgtcggcgaagagggtgtcgcggcggaggcggtggacggggagcgagcggaggacggcctcggcggagaggatggaggtgacgaggagcaccacatccgggtggcactcgacgagatcgtgcgcgtcggtgaagtacgtcgcgccgagctcggccgccacggcggagtagtctgagcgcgagtgcgccaggacggtgtgcccctgccgcaccagcgtcctggtcaggaactgcccatagttcccaaaccccacgacggcgatcttgagacccctccgcctccgccgctcctcgtcctcctccatctcaccaacctcctcaacgccgcgaggcacatggtcgaacggttgccgtgcatcacctcccgtggcgcgggcggcacgaagccggattgaagccgccgccactcccacgcgccggagcacctggaggttggcgggagcggcgattcggcggcgggagggcgctagattcaatcggaggcgcacggaggaggaggaggaagagcacgacatcgccatctcggcgtcgaggtgagcggcgcgccaacgcggcggtgtctcgcgccgccagcctacaaatggggagagagtgaaccagtcaactcaactggtagtgttctagccttctaggtctcgcggaaatgaagcgggcctcttaaatgggccgacccataccgccgaatcggcccatcaaacgaagcccatgaaacccatctcctcggctgggaggagaatcagaatccgctttgcgagcagcgaggagggtggaatcgagttcgagcggcggcgaatcgggagcggcgagattgg

SEQ ID NO: 22831 - DNA, 1501 bp, Oryza sativa
  unsure (1)..(1501): unsure at all n locations
cccacgctcacacgggtccatggatttggaggtgcgtggtgagggggtggaccgtgcgcactgggctgcgtctcctcctccccattgcctcgccaagccggccaatacttgatttttttttgcaattttttccttttttttttggccccggtgatttaatttttgggatggttttgctttattgttgttggatttctgattcagtttctttcgtttccgtgcattagttctgggcttctacgaacgtacgagacaggagcgatgcggtctctcgatctcgcatgtacgatgcggtctctcgatctcgcatgtactgacgaaccaaaattttgggaggagatcgtacacggacaagtggaaaaaattgcacatacggacgaaaaatactaatactaattttggtgacgattggaaaaatactaatcttttaattagttaagataagtaaattgatgatgaaatttttatagtaaatattagttatattaaattttgttcagcctcaaagatcttattggctccgctactaggtgtgcttggtgtgagatccgcttgtggctgtgtgagtatggtccatatgcgtctgtcttttatgtaacagttacggaaatatgctagagttaaaaagaaattattttctctctctgaactcctcactaacttggattttaggttgtagtccctccaaacaccctcttcgactcgggttaagttgcactagctgcaaacaccaaataaagagcaatgcatccaatgaatgaagaccatgggtggcgcgttttccgagcttttaaatagtgtgaattttttaaatgtcctataagtttctaagcattttccgcaataaattttaaatttacaaggaaaaagtacgaattaccctcgaactatcgcagtcgaccgaattacccccctaaactagaaaaccagacattgctcactctgaacttttaatgccggacatattaccccctcgatccaatccagagcggttttgtcctatgtggcatacccgtggcaatgtagtcaggattttcttttttaaaaatagtgggacccacatgtcataccccatttcctctctctctcgggcacaaaataggcatggcggcgcagggacgggaggtggccggcggcgtgaggggacgggcgggggcagacaggtggaggcagtgccgattgcagtggcgacgagaaggaggaggggcccgcggtggcggtggcggtggcggtggcggcccgcggcgacacaggggctgagcacaacaagggaatgtcacacggcaacatggtggctcgaggaggaggaggaggaggaggtgatggcctctacacgcggtggcacgaggcccttggaggcttagaccacacgacaacagcgccacgtggcagaagctcgaagacgacgacgctctcgggcgagtgatggcgctagccggntcgtgccgacgcccgcccgcgcgcaaccaagccgncgtcggcttgttacccaccggcgccc

SEQ ID NO: 22832 - DNA, 1501 bp, Oryza sativa
gatcagctaggcccgggtggccgtttgaaaagttgttggcctgggtggccgtttgaaaagttgttagccgggtggccgttgaaaaagctgttggccgggtgccaaccttgtttaaattctaaagactgatacattgcacatactccgaccggacgagacgcactgtctcatccgtgtcgtttgagaagcactcacttagttgtttcagaaaagagttcaaataaaattaattgcagaaacatcagcctttccttgaagcctgcattaaacacttacttcccatggcttgctgagtactcccgtactcacccttgcactatataaataatcccccccctagttgctgaagaagatgaagcgggtcctgctgatgaggagttcttccaggagcaagccggctacaatgagttttagggtttcggcctagttcccaagtcgcgcctgtgttgattggtccaagtcctggcttccgctttccttttgtaatgcagttgtgagctcgggatctgtccgcagcccaacatgactgtacatctactctataataaagagacctctgttgctgtgatactctgtctccctgtgataccagcactgtttcctgggactggtatcgattaacaggttaatttggagcgtcacgggctagttccggtcgggactagttcggggcgtgacactttgcttccgcctccctctctctctctttcaggaccatgtcgttgccagtcgcgttcatgctattcttattttattcgttgccaacctccaccatctatggacaagacacatcatgggacacattcttccatcttcctcagcaccatttggtcgcccgagcaccggcgcccatctttcctcctcttttgtttctcacctttggttatgaaagacaatgaacattgcgtattgtgcactattccttcttggtccagtccaaccatgcttctagaccactcacataatattgagatcataaaaatagaacatgaaaaattctaattatgtcaatgaaacgggcactcatccaaaattaatggattaggttttcatctatgaggtaaaataagttttttttttcaatttctagctaatttcagtttttttctatttgctgtattagttttagcactatttgatccattaaaaatttattataatttataatttttctctgtattgaattatttatagctaaataaaaaaatggggatttagttatataattttcctaatattgaaatatcattccggccaaagttatttgcagtttcatgttgttattttattgattatattttcttcatcatttatgtctaattgtgatatatggtttaggattttaatttgtgtcaatgaatgctaatccattgcaacgcacgtgcattatgctagttataaaaaaattgcttgaaaaaaatcatattaatccatttcttaatttttaaataatgcttaattaattatactctaatgagctgctctgttttccgtcctaagg

SEQ ID NO: 22833 - DNA, 1501 bp, Oryza sativa
ggttcgcgcagcgctggggtggccgtgcgcccgtgcgcccgtgcgcgcgtgcgtgcgcgagcccggcatccgccgtgtgtcccccgtgcgcgaccccgctgccgctgctgctgcagctgcagcgcctgcgcgcggctggcacgtgttgtcctcgcgaggctggctggctgctgcgcgtttttgccttatccgctgcgctgctgcgtgcgctgacgcattcgccgttcgtccgtccgtccgtccggcccaccgacgagacgagaggattcgtcgcatcctggcggcagcttgcagggagggaagggatctctcgatatctcatcattcagacgagccaagttcgatggatcgatctggggctcttcaaaattggatggctagctaccaccgccgtgatgattcaaagcattgttttgttgcatcatttacgcgctcgtttaatttggcagatgggcgacattcatgcatgggcattcatagcacgggcgccgtaactcgccgattagactgacatcgccaattttttttttaatctccacctcgctccaagcatcacgtgcctaaataagtgttacagtacagggctagtgctattgcgtgaagtgaaatttccattctgtgttttgaacaggcaaaaatatagcgtggattattgaaacttccgttttggcgatcgatatgatacactggtacacacaggggatagtcttctgataggctggtgggccggggtggcagaaggcgacgcgaaaggacgtacggtgcactgctgtgaatgctgttctcgcaaatggcaaccagctgtatgcatgcatggcaatgacgataaaaacatggactatcatttgcttctcatctgcaccctgctgcgcagtgcactcatggagtgacggtctgtacggtgatagagtggctgcagtactgttaagaattaagatttttacggcaacacatggacagtgaccgtgtaacacttttcaatgttgatgtaggagtatgattctcagtatgagaggtgtaaagagattttttatgagactggactccatatttgatttacctccatttcctactgacaagagtttcaacctcagaggtgaaaaaattccagcacccccgcctgtcacctctccggccatgtgccatctgacggcccacgtaacaatcagaccggactggagaatccctggccattcattcatgggctgaccataaccaacaaaatgggccaggccgtatccaagactggtcggccacataaaatctccagatttcacaaagcccaaatctctactgggactcgcgaacttggcccagctgcatcccaaagcctttctactgggcctccacgcgtatcaaatctagcgacttctaggcgaaaccgacttttgccaccacttcctctccctgggcgaatcgcctccctccaactcgtatcccgccatggccgccgccgccgccgccgccgccgccggcgactcgccccgccgcggaacaccgg

SEQ ID NO: 22834 - DNA, 281 bp, Oryza sativa
ctgcagcccacgaaggaagagaaggcaatacccgaaccgccaaacttttaatggaggaacaccccttgttgaactcgttaagttcggtgaacaggctcggggtgccggcgggcaagataagattacttactccctccacaaagggaaaaaggttcgcccgggtctcgaagtcaccagggcgaagtggggcgccgcgagggaatactctgaggcagatgcttcggggccgcacacttccccttcgccttgaccagcggcgaaatagctggctcgcgcacagg

SEQ ID NO: 22835 - DNA, 1501 bp, Oryza sativa
tatatatatatatatgtaatgctagaaaatattataatatgaaatagggggagtacgcggcagacggggaggagaaaaaaaaatcggtcactaatcagaagtataagacgaggagatcctgctacttcttccccatcaccaccaccaccaccatcgctttcttcctcctcgccttctgcttctgcatccatccatccatccattactcgccgaagacttcgcgcggggagagaggaggcaagcttggtcgcgggaacgcgggaagaaaggtccgagcttggaaggagaagaagaagtagccaagaacgcgagagcttggaaggcgagctgcggtggtgtagctagccaatgccggcggggaactggtagggagggggatggggggagggggcacgctcgtcgacggattccgccgcctcttccaccgccgcacggcgtccggctccaaccagtcgtccaacgccggcgaggaggccgcctcctccgacctcgaggtcgccgacgacccggatctcgtcgccctccgctccatccgcatccgcgtgcccaagcgcaagatgcctctccccgtcgagagccacaagaaggtgaggaggtgcctagtgtgaagtgtgctttgctttgcttcgttttcttttcagtttgggggtgaaatgaaagtttcaggctttctcgtgatccttgattcgtggccacgaggggttcttagactagatcagatcttcgtggcacctgaattacttgcatactgtacaatatcattatttctttttttctatgatctgtgcaaagtgcaatacagctcaagtgcaggtaaagcttgcgtgttctatccaatctttcttctttcgatggttgcttgtagagcgatagttgcttgtaaactgccatccgattcgtcatcctggctgttgacctgtgttattccagtgatctatgaaacgatcgatctcgtaaaacttaagtttctttctttctttctctgtttgcttagttctgaaattacttgctcctgcatgctccatttcttagaggagtgcaattgcagcactactatgcaaaaagcttgtgccctcttttggagctgttctcaacaattggtcccatcatccttgtcatactgatccttaggagctcatatccaagttgtccacttgtggttttggatgatctcatcagaatcggctactaattagtactccaggtttgacttggtctggcctatgtatatctctggtacggactgtttctattgggaacaagtcgcgtcttgcacatggtatggagcaggtgttcctttcatttgcgaataaacctacatgtctatgtactgaaaatgtcaatttttgttaggttggtcatgatattcccagggacaagatcatggttttgtttatagggctattctactactgaagaagttttataaccagccactctgtatttttagttagcttaatattttcttgcaaaattgtgatcttgtagaacacagtggaaa

SEQ ID NO: 22836 - DNA, 1501 bp, Oryza sativa
cttttgcttgagcttgtcttggaaggcgtctactgactactgctgctgcttttgatccgtttgtttatttatttatttattttgttgattgatgcgtctgagttttcgcttgcgtggcaagttatatattagtagaaaatgtgttgagcgccacgcacgctaaaaggccgggaagaagtcatgcatttttttcattttttttctaaaagaaaatatgaaaccgggagaaaagtcatcagcgttgcttgtactcccactatgtaattcatagttatagaatacgttatatcgatatgtctacatctatactgagatatttttatattaggatagagggattatgtattaatcttgtgtacggcttgattctaagtaatacggagcactaatcatatggctggagtaatggtcttattttttttcttatacttatgtttattagctatttttttagaaaatttttattagtttaagtttgaaattttaatcttaaatttagagttaattttatgggtttttcatcgaagtttatttttcaccctttactttcagatcgctaacaacacgtatataaaagttttatttataaattatttttcgtttgcaaattatgaggccgtaagtatcaatatgtcatttttcaggagaaggttgtcacctggatatcgacatatcgtgactggttttttctcgaccagattttgtaagattctcgattgaggaaaagaaaaatctcaccatacacagggtgggtgcgccactgcttatcgtatctacagtactcccctggcaattcactgcttttttcagttagtaaagagactaccctataatcttttcgtcccaaaatataaaatattttaggtgaatggaacactttatagttttctgtctaaagagtgtcatattcatttcaaatctgtttatcttttgagacgaagaaagtaattggcataggctaattataaaaccatatgagtaacctaaaatacttatagatatcggattttatccattatttcaaaaaagaaacgatgtaacacatgattataactcattaacgcaaggtgttctcagactctatggtagtttcgtttgtgatttatttttttatgttcgagttgtacggtatcatttttatttttcgggtctctgattccgtttccaagagagaaaaaacgattgcataaacattttgaatattttttttgatcattttcattcacagttattgccatggaggaacatgtgagtgagatagttgaacatttccttcttatccagaacacaacttccctggtggtggtggcccttcttctttcatttcaaaaaaaaaaaaaaaagaaaaaaaacacccaaatcaacacagatcgtaacttggtggcgggcgggtgagaggacagcaggttaaattttacattaattttttttatacattaagatagtattaaattttacactgaaacatgtgatacctttccaaacatggtaaaattaccct

SEQ ID NO: 22837 - DNA, 1501 bp, Oryza sativa
tacgtcaatgccacgtaggacgtagacctagtcaaaccagctatgtaggcgccacgtcagctaaaacaaccttcaaaaacgtcgagggacctcatttacaccggttttaatagttcagggaccagttgtatgtagtttttgggtttgaggacgaaaatcggattcggcgtaaaattaagggacctctgatgaacttattccaaaccaaaagatcgtatccgtgttagactattgggttgggcttttatttccttaccgcaaagcccatagctgtctgtcttgttcaagtccaagagtaagattgccatagcccatggactcacaatttcacagaccaaagggttagagcccaaacaccgaatgcaatcccccggagaacttgattgtttttgctctttcaagttgaaatagaatcggaagatccggcggctttgattagttgcttgcttgttgtctgagacggagagaacacctctctgggcacggcatgtttctgcaggctgcagctggagttttagtagttttcttttcttttttattacagtaagttaaaagtgcatcgtttccttgacctgtactatactctctccatccaaaaaaaaaaaagacaaaccctaggtttccgtgtccaacgtttgaccgtccgtcttatttaaaaaaattataaaaataattaaaaagataagtcacgcataaagtattgatcatgttttatcatctaacaataataaaaatactaattataaaaaaaatcatataagacggacagtcaaacgttggacgtggaaacccagggattgtctttttttttttttggttagacggagggagtaggtctgtagcgtggttgcactagtctcccgctaccttagcttgtgctggtataaatcagttaaaattgttaggtcgctcgtgcggaggaaaggtgaaagtgaaacaagtgggtatgtaaatgtatgtacgcatccatgcattcaattcgacaagctaacaaaaccttaaatagtcaccgaactcccgtgcttggggagcgttaaaacgtttcaattggcattgatcaggtggctttacaacgtagggcccgaccgtcgcgtgtactgtaactgatgtgaagccgaaaacgcaagagtatcccatgcacggttggtctgaaaatcgcagtactccgtattggtatgtaactacatcgtacagtacaggcgagtactctgactcaatggcaaaatgggtacagtgaagcagttagcagtgtagttagaaaactagtagaaatgtgaagcgaacagttttgtttgcaatcccatgttctcaacccttctccctcgtttttcgcgtgcacgtttttcaaactaataaatggtgcgtttttagtaaaaagtttctatacgaaagttgtttaaaaaaattatatcgatttattttttaaaaaaaatagcaaaaatttaattaatcacgcgctaatggaccgctccgttttccgtacggagagtttagttcccaa

SEQ ID NO: 22838 - DNA, 359 bp, Oryza sativa
aacgagaaccatgatttgtgtcactcgaggaagactcccgatagcaatcaaccctacaacagttgccctgtcattaaagtaggtgaattcacgagtaagagagatgaccacaggtagaagtacttctatggggacaaggatggaaacttttgtgacatgaccaagaagtcaagaagtaaaaccggaacagtggaatctaaagctcggttcaaccttgggctttgtatcagatgctactagaataaaagcacttgcactagtatcgttcaacgcactttcctagcaatcgatccatcgagaaagaacacatcaaggctgaaggtgtaaaggaatacgttgaatgctaaatgatgacaaca

SEQ ID NO: 22839 - DNA, 1501 bp, Oryza sativa
ccaaccatgaaacacagttggcaacaaatggagtagctagctagcatacctcgatctcagtttgattcgattgaacatcatggatgaaccaccatgattccagtgaaactgctgccttcaaacaagagttataaatatgacattttctgaatctctgaataccagcaaaccaattggtgagactctgaaaaaatggttcatcacaggatagctctgatcatcagggctccaaatccaaatatccaatcatccaacgagtgatttgcaattccctaatccttacctaccactctgcaggtacattacgtgtgtaattgtgtcaatgcaggagccgcagttaagtcagtgtcaataggttgatccggaccccagataaaaaaaaaaaacggaaatgcagcagaagcagcaacgcagcaaaagttctccacaacaagcaaagaaacagccgttcagacttcagagacgtggcacaacatcaatatgccatgaacccatccttccatagtggagcatatataataaaacctgggcctgacgcagagctgtcaccaccaccacaaagcagagaaaaatttgggactgacgaaaacgactcatgatctaaataatggttaggtggtcatcagtgttggtgtgttaacctgacctcttccttctatcacatgctcacaggtcgattaagcactaacaatttctttttatattgcaggcctctgcccctttggtcagtaaaacataagagctgaagaaactggaattcagatgtgcttcgctaatcaggcgaattcaacaacgaaaatgaagtccttggaaattcattgggaactcgcatgagacaattctgaattgttttttttcctgtcatcagactgaaaggcacaaatatttttgttaagaaacaattggagctaccaggagtttatccatagaatgtctgaagcagtgcagggccccagtagaacagtaaaccccgagtggcaagtactcaccaacacagatccactgattgatttgcaaaatcttcatgcgacttacagatgtcaccatgggaggctcaattcaaagcatgctaatgtaaaacatgtggttttccatgacaaataattagagcacacagatttggaatccctttgctaagtgcctctaataccgctgtcaagaaagctgcataccaaccggatgaacagcacggttgaagagaagatggccacacctaacctcgtcgcaaagaaacaaggtcgctctcacaactaacactctctgccatacttgggacgacaaggactcccaaagttcaaaagccaaggtgatttgggtttgactcttactctacttcaagatcctgagttactaacacacaagccaagttaatttgctcctgaaaaactttcttgtatcacaaatcacaatgccaagcttattcctcaatgttctttttttttttgtatgatgacgagttaatcttcatgacaatgccaaagtttatttcttcatcctcata

SEQ ID NO: 22840 - DNA, 616 bp, Oryza sativa
cccgattggtgcgccggcgaagatttcgggagggattccaaacgaatccgagggaagagagagggaaaagaggggggaaagagggagggaatcacggggagtgatttccccctctttattgcgcgcggggacggcgggatgcggcggaatccgcggcggcggcggcgctagggcacgggcgaggcggcgggcgcggcgcgaggtaggggatgacgggtgggccccacccgtcagcgagggtggcgggcgggcccgcccgtcagcggcgcgggcgcggggaggaggccgatgggccgcgggggagaggagagagagggagggagttgggccgagccggcccaagagaggaaggggggaaaaggacttttagggatttttctttttataaaacccttttaactttgtttatttcttcttaattattatttgtgctctgaaaattccactaaaatttatttacgcattttaggcttttaggaaatatacaaaaatcctccaagccttatttgacttttagctttgcacattttaattgttggaggctttcacatggattttacttattctttgcataatttcgaggatgtattttagagtcgatttgggacgcggcaac

SEQ ID NO: 22841 - DNA, 250 bp, Oryza sativa
actccttctttggcaaccccatctcaagtggatttcagccaacctagcagcagcactcttccttctcatgtcattgtgccatcagacacatacttagtaaacccattttctatggctgaacatgttggtgttgatgaggaaggcatatacttagatgaggaggaggctgttgttggtcatgctgatgaaactagaggtgaaggggctgtcaatgaagtatccgaggatgaatcttgggctacatctgagg

SEQ ID NO: 22842 - DNA, 1501 bp, Oryza sativa
gctggaatatcacatccaccaagaaatcctgaaatataagaaaccagtataatcagccaatatactagccataaattaaactcagaaatatgatgaaagtttgtcaatgcacagctgcatgctatccatattctacatgatctacctccatattcatcaaagatgtcctcggctacaatctgctgattaggatcatctgggttgtatccaccacgtggagggctcatgcctggcttttgcctaagttcccacttcaaaggctggcaaagaattccttgtgttaaaacattttgaagtttaaccgaagtacagtgagaaaaggtggcaatggcaaaaatgtgcatcttaattgttgacacgctcaaataaagaaatatatatctttaaaactgctgattcaatattcagtactctatccatagtattccacttgatgacaatttcaagagctatcttcagatattaattacccaagcttcaggaaaaaaaagcaactgtagataagttgctatcagcaatcaaattatatgcagttattaaaagggagacaagcaatacaaatggttgacagagatctactacttgcaagtcttgttacaggaagcttatttgaatgtaaattgcaacagggaaaacattttgacaaaaaaaacctaacctcacttgaatcagtctgtgccattatagctgtaagaggatcatcccttttcagtcggctctcctcgttaggcatgatcacatccttcagtgggcattctcggtcaccactctgatgaccatagtttccacaccttaaacatctaacgttacgaacttcaactccaaatggtttaaccctcgcaggagcacctgtctccaacctgagagtacaacaaaaacatattaaatcataaaatgctacttaagagttatctcaaggcagcacaatgatgctctaagcctactcccatctaagtcacaaaagttcccagatcgatggatcgaggaacgtgggacgtcatctttaaaaaagatggaacaagaggggtatacctcttctaaaactatggaacgatagatggaacatgttcctagtttttccggaacgataatccggaacggtgtacccaatttaaggaacatgttcggtgttcctagtttgactccctggattgtgctcttcttttttcatacaaagtcgatagcgcgatggcagatggctcgaagcgacggcaagatcagcgcgatggcttggcactgcgctgccgcggacagcgatggaggagaaaagcgggtgcgacacgcagcgcgcctcaatttctccatcctccccttcacgatggcggcagcagtgcagcgcacgctcatatatgcacctaggcgcgatggcagcgagctgcaaagagcaaaagcagcggtcgtcccatggagcgatgaattctgttcggaaattttggattgcctttcccatattttgctcatcgtagctcgttcctccctcatatcatcctgctaagttcct

SEQ ID NO: 22843 - DNA, 1501 bp, Oryza sativa
aatagccttttgtatgcacatcttccgttttgtttgtacttttatattattggattccaatagtagtgtgtggtgccactgtaccaatcggtgattgtaggctgtgtttagaatgcataagtcgtttgtttcattacattgaattactgacttgtgctctgattctgaacagcacgcgcatatcagttgggttacagctgtgctgatgagaaggaacttgaatatgccttgaggttttgctgataattgggattgcctaatcatactggcaacatgaaaccaagtttttggtttgcaagggaaattatggtcagaaggcttggtgctatgttttttttttttttacctagtttaggtttctggtatgttcctatgtgtacaactcacgcacaaatatgagacggctaaaattctgatctgttttgatcagttgaggaagctgtatattgttgtaatcttcctaaattacaaggtgcatgctagtaataaaagaaaccttctgtaatgctcactgtatttgtttttgcgctgtatttgtatcgttatgttctaattgatgtccagcttgcaaagcatcaagtttttagtgtttcagtaatgaacccatgtgtatgtttctgtgctctgttttgtgcgtgtaatgagcgtgcgcctttgtgttctgttttgtgagatcatcatattacctgattgctggtcgacaccagtattacaagaatcaccaccccgatctgtgtggttcatcaaccatgtaagaaaatgctaatggctgtaattaattcttgcggtgaaactagatagatgtcgaagatgccttggttgaattgaggaatttttttcggttttagatttttttaaaaaaatatttacagaaataatctatcggccaaaaaaattacaaaaatagaccctgccgcccacctctggggcggcaagctgacgtggcaaacgggggaggaacgggcggtgacggagggagggttttttgcaggaaaacccttccgccctctggtggggcggcaaggggcccgaatacaaaaaagccagtcggggccggctattttgcaggcggccccttgccgccctctggccgggcggcaggcctcgctgcctataaaagggctgctgcccagcccccagccctcattcttctctcctcaattccagtgaaaaaaaagaagagaggggaggagaagagaagaaggggcgaagccctgccggattcagacgccaatttcaggtaatattcatagatcctatatgtgattattgagttaaatagtgtgtattctttaaaaatttgtttgaataaatgcattatatttttagggttttagttgtactaatctagaagtgcgtattgtagatatcggtaactacgtagatctgctagtttggaatcaatacattaccgttgcattggcttatacaagaagatattacgttgtagatgtttattgcatgaaagagtaatatgatctagttatttcgttgacagata

SEQ ID NO: 22844 - DNA, 470 bp, Oryza sativa
aatggctgtttgattggaccacaggaaaaacgcaggaatcagatgagagagatagactcagaggaaatgttccaagaagttagacctcttgctaactttcctccaaaatgtgcataggattactcattccatatgaattttaaaggattggatagaattcaatcctttgtttcaaatgccttcctagaattttttttccataggattgaaatcctctaaaatttctacatttttcctacaagtcagaggggcctaatcattttcaatgcagtactgtccgacatgtacaaatgttgaaaagtttggagtctgtagagatggtttaattcctgcagctcctacgtaggggccggacccccattggacaattcgtacttgacagtaacttttcttcaccagtacagacaaacccatagatgaaatcttccttacaaactttcaagcaaccgtctggttaaaaactaacataa

SEQ ID NO: 22845 - DNA, 1501 bp, Oryza sativa
aacatcataattgctattactaaatgatccaaggtcttacatagtagctgtataccacactctctttaattaattaatcatttgatgattgcaagatggtcctgaacctagtggaagatgagattacatgcaatccattccagatatgctgctacatttccagatttcacttgcctaacagagtcacaggttaaaattcgcactacaaataaaacagagatacagtagctgagttggactcattgcaaattccagcttcagtacattcatccaaattaattgcacaatttcagcaccaacataattggcacacctgagttcagacaactaccctggcctaacctgcatatgattagatattagaggatcatcatctagcctaattagcatttgggaattgggattactacttttgatgcatcaatggcattctaaagcgactttctgataactgagggaccagtccctctcctgcggacagctgctatacgtgcaagactagtcctcctcttggattggatcacgccttagatagtcctggacatcattaagtttggtcaagtatgagaaaactcggttgcttcttttctgaaagaagataattcagttgcttgtcactacttgggtttcagttactatctagatctatcatgtatgcacttcatcctagttggaaggtgatggagatgcaagctataaatcacactatctgtttaactataagcttggagaacacatgtgatggcacatggcctgaaacaacccaaattatgtcaatcatctcgcagagatgaaaggcatggccttgaaagttgaaacccatccgaatttaaaggaggctttaatagccactgacgagcaacaagaatgcatttgctgaactttcaactcggcctatgaacatcgagctggatccaactcgatcgtagcttgctgagagcttaaatgtgtactctgttctgaactctggacactgtctgtgtccagctaaaccgtggtgcggcgctcaagaggctacgaactcggcaaaaggctttgctttcgggtagtagggtttaatgtttgggtgttagtgcctttgtgcttttttgtgcaactgatccagctttgatgttgcctgaaatcctgcattgttttctgctctgccgctagtaaccccaatcaccactcgaaatatcaaggaacccaatcattatccattgtgcttgtgcatgaacaatcctgtccgatcgctcaactcaaaagttcacagctggaaaattttatcattgtcctacccttttcatgctttcgtccgtgctcatatgtaccgcgagtgcaacaaacaaaatagtttagcgcagctgaattcctggaaatttccatacgaaagtttctagaaaaaaaaaaacgtaagtcaggagcacagctgcgctaaatagcaaatctgcaattgtaacaaccatccctccaaaaccgcgtagcgtagcccaaccgataagcaggcccacttacacacatc

SEQ ID NO: 22846 - DNA, 320 bp, Oryza sativa
cgtacatgaaacacgagaaattcgctcttaatttccggattactacaatatatacgggatcctaatctcactggtgtaaattaagaaagccttttaattatttggagcgacatatatcaaatccctcgtttacgcatacatgcatggatacatgctatatttcctaagttaattccttgattgcatgcatgtgcatcactctgtatcattatatattcaaacgcgcgctgattggctcgatcattagctccattattcctagctagctagtacatacatttctccttcagctatagctacagtgtcagccggccgagata

SEQ ID NO: 22847 - DNA, 1501 bp, Oryza sativa
tcactaaggcttgggatctacggctcgtcctagggtcaagggggctctgataccaacttgtcacgaccggaaataacccaacgggcgttccttacgtgcgtgtattattccttgtcccaggaggcaaggtacaccaaaagttgatacaactcagagtttaacaagcggaagcgtaaatagttaattattacatgggcaacgaaggcccagcacacacgaagacaacgaaaaacagcggaagactatggcgacgaccacaggcgcttgacggcaggcacgagctagacaccaaagccttcatcttcgaggggctcctcttctgggtttgggaaaaaattgagcaagactgagtacaaccaccgtactcaacaagacacacccacaagtgcagcataaatgtaaaggagtacaacggagttatagtataggggttaggagttgcagtaaatagcattaaaagacacttagttgctcaaagctattttgtgaacacgatcctagagctatacaatattattaatcaaggccgtgaacccacacgagcctgccttaacccaaggcctatgatgattcagaccgaactggcaacccgaccctgggtcccagctcgtcccaagccaacccaggccaaccattccacattttagttgttaagcaggttttaagaattaaaacactaacttgggtacattgctcggcttgcccataaccgagggcgcggctattcgaatagattatactctgatcagaggtgtacatctttacccacaagacacatcttcctcacgtgtaaccacgtgccatataccaccacggtatacgaacggaagacgtgacatagtttccaacccatcctagccatagacaagagtaccgacccaaccccacctacggccggaacccttgggacaggtaggcaggactgagcccctagcagcaggacacccgccctgtgccatgacatctcgactaccgggccgcagctcgagtagccttcatttgtcctagagatgtccatcgaacccccgacttcgtccacctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccattttgaggattttgaatagagggggaggtgtgaatccaattccgcaacaatccaacaattccatagtatccaagtgatatgaatattaccacagtctagagttataaaaccacctaatgttgcctaattaatcagcgaagcatctacctaaaatcatactagtgataccacaggtagagtgtccactagttggggttttgtttattctagggtgaacaaagaaataataacaataacaataataaggtcataacaaaggtaaataggcacggctaaataaaacagtgataacgc

SEQ ID NO: 22848 - DNA, 797 bp, Oryza sativa
atctggattccaattggaatgggcccttttgctttgcccccaaatgattgactgcctcaagagaattttactcctgtagtgaccactactgcaattgtttttagcccattggagattcaaatgctcctatataagcacccattttctctgacctgcaatgttagtagtgttcctgaaatggataatcgaaatggacatgcacaattcaagttgatcgaattggataccaacaaaataacaacaaatgaagttttgttcaaagttagttgctattcatgcggcggatgaagcattggatcaaggtgtagagacaggattttatcagaaacagtagaaatgagattgggctatgaccattcacaatgtggtaaaaccaagatgtttccagtttccaacgatatcttcttcacctaccctggtcataagaaagaccatacaacactccaagcaagcaaggaaaagtaaaatactggaatttgttttgtagttgtcttttatgccacttataccatatcaggatccagccttgacacaatttgtaactttattccttgagttatggacactacatccaccaaagcttaaagcttatcttaatgcaatttacgtcatcatttcgtgtatcatttctctcgatgattcctttttctcttttgttcatttctgacagggggacatggggagtttttccttttcactgtatagaagtgataattctgcctaattgcctgatcaatttttagaactcggtgacacttgtgctattaaactgaagcctttttttttgacaattttta

SEQ ID NO: 22849 - DNA, 417 bp, Oryza sativa
cccaaagtctttccctcatccctcctttttccccttctctctcgggcctcctctcccctcggcccagctccctccccctcccttcctttctcaggccgcccctccctcctctccttcccggcccactcccttcctctcccctcccacctgggccgtgtcccggcccagccgagcctccccaggccgcgccgcacgcgcccgtaacgcgcgcgcccacgcgcgctgaccacgcgccccgcgtgggtcccaccgcccggtcgtcgtcctcctcccgcccagcttctctctctctctcccgtgaaccctagtttcttcctccctcaaatccacgcgaatcaatgccattctttccaaattgattggggggaattaatccccattccttcctttttgatttcccccgttttcccccttgaa

SEQ ID NO: 22850 - DNA, 1501 bp, Oryza sativa
agaggagcccctcgaagatgaaggctttggtgtctagctcgtgcctgccgtcaagcgcctgtggtcgtcgccatagtcttccgctgtttttcgttgtcttcgtgtgtgctgggccttcgttgcccatgtaataattaactatttacgcttccgcttgttaaactctgagttgtatcaacttttggtgtaccttgcctcctgggacaaggaataatacacgcacgtaaggaacgcccgttgggttatttccggtcgtgacaagttggtatcagagcccccttgaccctaggacgagccgtagatcccaagccttagtgatattttcgaaataaaaatcctttcttacttgtgaaaatcctctagtctttctctgtcctgctgcttcatttatcgccaaaatctaatcttgaaaatgttgcttttctattttgtttttgtttgtagatggccggcagcatcaaccgtcgtggtctggacttgactggcttcgttttggagctgcggggcatgtgcgttgtcttggggtatccacatggagtggactaccagggcaagccgctcccggagcaggagggtgacgatgcagagccccacgctgcttgggaggtcactgcagtgatcctctctggctcacccgagaggacttcgttggcagtcaccgcgggtggagattccttctccgccgcttgccagaatgccgcactcctcgccatcggcactcttcagcagcgctacccggacgagttgcagcactcgccctaccgctaccaccctcgccgcggaggagcccgcgactacgccaccttcggggatgctagctcggaggatgacgctaccatcatgcacctggcgcgcatggtggaggcgtacgacgcggcccgtatcgacttccaccagatggtgcgccgtgggatggtcgagaacaacatgaagatcctggagctgcgtcaggagaatctgcagctgaaaaaggatctggacgcgctggaggcgcagctctgtcagctcaggatcgcccagggagaggtctgccgtcccaagcgccgccgcgtctgccgtagccagaagatcaccgcccgcaagagtacctccaggcccgagcttattcgtcagtccctagcgtggacctgcttcgtggagacccctcgtgccgagcccgtgctcgtggttcctcaggagggggaagcctccggcgttggcagcacggaggatgcgctgctgctcaccttccgccctggcccgtcgcagaagtagacgagcagttagtaggcttgcgcgtgtgttctttctcgtttgtcttcctgttggagtcgttcggggcatggttatgccggtgtgtggtataactatgtcggagcctgtctttattttatttgtttaagcaacttgaaccttaatgaaccaatttaatagcagtattaaattcaagaattatggtagtcgtgggtggttagttttaattgtcagctctctctgtttgctggttccgtgtggggttttc

SEQ ID NO: 22851 - DNA, 1501 bp, Oryza sativa
aagggaaaaatcttggtcgctcgtttaagtggggtttttcaaaacgagtcagtctagggttttagtaaaattattgggatttattcgtcagtcagttggggtttgatgggtgaaatgcattaggtcctagctctataacatgggttgcaaggtgtttatgcttcgtttgttattattaatatgtatctaatttctcattactttgtcgttatatgagtctgtcttatttattcgctctcatgcaaaatgatctatgcataaaatttcgcttctattcgattctcttatttgagtcttttattgctttatttaaatttggatttgagcatgcattgatcctactcctttgtcttctctagatggccggtcacccacccaaccaccgcggagaaggcatgatcgatttcgtggcagagttggcacgtatgacactggtggtgggctacctcaacgcgccggagtacacgacgattccgccgctcagtggcgagcttcctcaccgtgtccgcttggaggtccatggctacgtggggacttgcctcgctaacatggcggtcgaggcatctggaggcacagcagatcacgcctgtcaggaggcggcctacttgatgatggccagactacgggagcgccacgactacatcttccacgacacggcgtaccgctaccacccccgtcgagcccatggtgatggcgtcagctccttccgtccgacagctggcgagaacgacaccacctttggtcacatgtgtgctgtgatgaggggattggacaggatgcactcggacctgcacaaggcgaccaaggccttgaacgatgggaagctcatgaggatcgtcgccctgaaggacgagatagcgcgcctgaagaaggagaacgctcagctaaagggtcttccagcgccaggaggagtccggatccgcaccatgccccgcaagacgacgactgcacctgtgcgcatccagcttgcgcccaggaacccacctccagcagcagctcccgcagcaccttcagttccgcccgcagttcctgcagctccagttccagctcccgcgttcactctctccttcgctccagcatcagccgccagaggttcagccagtggtaccggaggttggttgtctgctactcccagtggcagcggcgagactgatctgtcaggctccaggagtcgctcagagggaccgggtgacgagcaggaggacgccttcgactccaccgaccgcaggagccgttccgagcattaggctcgttttcccattagtttatcgatggtctagcttctggttgttagtttgtgtgtttaggttgcttgtttggggtcagttgacggtcgatatcatgtgcctatgatatggctgtcttaataaggatgtttgcttgttcttttaagtgtttttaattcagatcagaacaattgcagttttaattcctttgtaataaagcttagttcttgagcatctgtttttcttcttttcccccatctgctcttccctccaga

SEQ ID NO: 22852 - DNA, 839 bp, Oryza sativa
tacaaaaggcaaaatcgtcaggtacagatcaaaagatcaggaggacggattttctcgttttggcggtgaaaatcaagtttactgctcttccttttgactctcaagtctcaacacgatctcttttgagagcacgcttaagaaagcaacactggggtgggtctctgccgttaattcaacggacggtgtatagaggctgtctggggaggttcctgcagctgcagcttcttctataattagaagctccgtcaaacagtctagcttttagtctaaattctgagaagctgtagttatagaataaaaaaattaactagaagtcagttttttcagattttcagaatttggctaccaaccagctgcttattagaatgttaaccgtccaaacaggccaaagtgttcttcacccgtgcggtgcacccgtgcaacaaaccacctccagaggctgcagaacttgtgggggtacgtgtgtcactgtgtcagttggtaataactttgtactttcgcaagctgcaagcatatctgaatatgttggatggtgtacggtgagactattaattgtacttgttagtggtgattcgtttttttgaagtcaaatgatcgacttgtgcttttgaaacacacatctatcggcgttcttcagctagctaatacgaaaagatgatatggacgacgaagggtatggtattgtactatggttagatggtttagcatcgacaactagatcatgatcgatcatggatcaataattttctttcagtagacgtttgatgtcgcaattctggtatttgtatagtatggggatcgtcggtgctagaatacacgcgagactgaggtaaaagaga

SEQ ID NO: 22853 - DNA, 397 bp, Oryza sativa
ctgccacattactcgagtagcacacgaatctggacatggcgattcgtttcgtctggagatatggtaacgtcgctttggtcggcgagcgtaattaccgcgcgcacaatatgatctatctcgactgccacaaccgcatatccacctcatgcgccgcaagcgggcgaatgggattagtggaagcgtgggcgcgagaaacgaggggcgaaatattgggcgcgagaagcgaggagccgggcacagcgttggcaagagtataaaggcactgaggaagggatttgtttccttcctttcgccattatttcccttgtcttcgccgcttgcgccctaactccttctttcttgtgccctacctttgccacacgcgctcgctcttaatcttctcttccttccggcgcca

SEQ ID NO: 22854 - DNA, 477 bp, Oryza sativa
tgtccctttacgccgtcttgacaaagcctctgaggaacctaagggaacttcggctggggacgcccagagcggataaggctttgtcagatccttcagagacgaaagaccatgtaagatctggtcatgtaagagatctcgccgtgcgtattaaccaagtcgtgtaatcggaaatggattttccaacttcacagctgggggctaggatcagtgcttattcaactaaagcaagtcaaaggtccaagagccttatcctccgagaacgattctccgacgacaaggttgggggatagggagagtgtataactcaacaaactgactgatcgaagtcggtaaaagagtagatgctcatatacaaaacattggtctgtaagtttaattcattttcggttttccatacatattataacatgtcaccctttgagcattcgctcgggggctatttttatctaatattcttttttgagtactgattttagg

SEQ ID NO: 22855 - DNA, 1501 bp, Oryza sativa
aggtgcaagaatgcaagatgatatgtggtccaaaccactggcaaatgagcagaatgatggttgaaaaaagagaatgaattcaaacctgtgcctttcatcccatctcgacaaacttgtcctgcaacaggaaatttgttgcgagctctctctcagcctgccatgttttattggcacatattacatacatataattttagatacgttaggacttaaaaagggccaaagatctcctgggaaacagcagtagagattaccatgttgtccccgatgcctccagggagattaatctgtaagaaacctcatgatcatcatcgatcacatgattcacatcagtgcgctgcggcattggtaatgataaacccaggttgatctccccctcccatcatggactgatcacacactgtcaataggtggatgcatcagcttagagcaagtttaatagtatagccaattgttggctacaaaatttctatagtcaacttaatagtcaattcatacaacaattacctataaacatatattacacaattaataatgtctggtttcacctatcatacacaaatatagttgcagctggctacaaatctttaacccgctgctcttctctctccttttttatttcctcgaattatgtttatagctggcttatagtctgctattgtacttgctcttatatctgcataccatatcatgcatgcgtgaatcccagaaaaattggtctctcgtgtctttgattattagcatggccatcctgctgatagttgcatgcacaataatggctaaactgcagcatgcagataatgcattgcaaaatgacttgcttaattaaaaggcaaactctatggcatcaaggtaggggtaaactgggaccagatgaacacatgcatcagcaaactaatttaatcaggagagtcatctcatctattacacagaagcagtggcggaggacaaaaaaaaatggaggtgtggccatggactaagcatatgacgaagttgaacggcaataacaaatctcggtgcctattcacaagcagaagagtacgcatgccagtggagcattagctgattactcagacaacaatacgagcaacaagttatcttttctgaaagaaaaatatactccctccgtttcgaaatgtttgacgccgttgactttttagcacatgtttgaccgttcgtcttattcaaaaaaaattaagtaattattaatttttttctatcatttgatttattgttaaatatatttttatgtaggcatataattttacatatttcataaaagtttttgaataaaacaaacagtcaaatatgtgctaaaaagtcaacggtgtcaaacattttgaaacggagggagtatttgttttgaaacaagaacacacgcgtgttttctcgatgtgagagaacaaaatcatcaacaaattggccagcaaatataggtttacttaaaagccgtgggaacgccggaagagtaggagtgccacatcatcgatttttgcgaaaa

SEQ ID NO: 22856 - DNA, 448 bp, Oryza sativa
tttcaagatttgatatatcctttggaagattcatgggtccaatcaggtcttggacatgattatggagttagtcaaaccgatataaaaaggtctgttactctacactacaatggtgtcatgaaaccttggcttgatttgggcatacatgattacaagggctactggaggaaatatatgaccaacggggaaaggtttatgacagaatgcaatatacattaataacagactaacagtgacatgagattcactacattctacatttctgggattttggagcaacagaactttcgggaacaaagagggttagagtgagatgaaatctgatgcagcattataatgaattgagtatagtaagggtggcatggtggcactacattaattccaaaatggagataggatgaaatgtttttgtgccagattttaagcaatacttcatagtagctaaaga

SEQ ID NO: 22857 - DNA, 242 bp, Oryza sativa
tagatagttgacatcgtcggactttttctgaatcaaacttttataaatttgatgtcaagaaagacttgataatagggcaccctaagttcgacccatataacgcacttctcaaacaggaattaggagtggcctgctatgtatgcatgctgtagtaagatgtatttaacttctccatgtataagtgcttccttatattttatgatgatgatgccccccacctctctctctctctctctctaaga

SEQ ID NO: 22858 - DNA, 1501 bp, Oryza sativa
cggggcctcagtatattttcaattaacagaagtttaatacttaataatttaaatgacagttcaatattttagccatgacacatggcatccaatgaaagggtcgtccactagaaataaaggtgacagacgatcactgaataggtacacccataccagccacctttctattgtctttgcacttggattgaaaagtggtcacaagggttaaaaccctgaatcattcggaaatgtttttgccacacaaatgagttccaaatacactgagtgacactacgggtcagtcactaaaatttctgaaatgttgttacctactcgtctctttgtccaaaaataaaccaaactcgtacggtgtgaatatatcttcaatgttacctacactgtacaaggttagcttattttgtaacggagggaacatacatctttcgataacattataattgttgtgccgccttggttcagttcaaatttctttttacaaaattccgcttgcatctttgtcccggcgcggcaaaaaaaaaatccacaataaaggtatcatataaaaacaatgatggcagttaatcagtttaggttggtcactatcttaatagatgcaaattaagttgggttgtagcgaaaccaacgaacggcatttgttttgtgctcccacgatacaatcccttaaatcagcacacacgcacaatgcatgcaccacattttagatcgatttcgtagagaatatttcgatcacatagccacaattaatctacattctagaagctccaacaaacttatttaattagttcctgcaaattaacatttacaaatatctcaaactgaagaaataactttaattgcaatgccggcagccaacccggcgtgtatgcttccatttgttcgatgtaaagtgctgtttatccataggaagagatgtaatattaataactactccatccgtttctaaatatttgacgtcattgactttttttaaatatgtttgaatgttcgtcttatttaaaaaaatttaagtaattattaattatttttctatcatttgatttattgttaaatatacttatatgtatacatatagttttacatatttcacaaaagtttttgaatatgacgaaaggttaaacatgtgctaaaaagtcaatggtatcaaatatttagaaacggagggagtatgtttgttgaaaatgttttaccttctctcaatcttaataaatttggtcagggcaggcacagaaaaaaaaaaacaggaagacataacagcaaaacaaaaacagtggaaattaagcattgctaattacaaacttttctgatcattcacaccattttcatgtttgatccagctcaaacttcactacaacagcttagaacactcttagctagcaaaagtcctaatcacagccattataaatagacacaagcaattagcctcatctacacacactcccatcactccaattaaccaaagctaattaagctagctcaagctctaatccacatttagctagaa

SEQ ID NO: 22859 - DNA, 319 bp, Oryza sativa
gtcgtggaatgatctattactacatattaatctatgggtgtgtttagttcacgctaaaattgaaagtttggttgaaattgaaatgatgtgacagaaaagaaaagttagaagtttatatgtaggaaagttttgatacgatgaaaaagttaaaagtttgaagaaaaagtttggaactaaactcggtttatcttgaattttttttataatcgtttcgacgacatgaaagaaattgtatgtgacatgcagagtttaaaatccattcttgtactagaagtcaacttaataaaaaaagttactaaaatacaaagcgaaaccggga

SEQ ID NO: 22860 - DNA, 1501 bp, Oryza sativa
aacaacttgctctcagttgtgtatccgaccaaaaaatgttaaaattaagataagtggcctgtcataattgttagcctagctactgctgctgtatatcctccactatatattactctactatagctattgtatagtagtacttaattagtactagtatatataggtctcctcccaacgttcatctcgatcgatccgcatcggtcaattaatatatgtttgtgctgtagttgcatgcatgcatgcatgtacgtagggcgggtctctagctgaagtaattcttttcgccattgatccccttgatgcttggtcggtcctgcatcgatcgatcatttccatcaatatcgatcacaagcaagctaggttccattttttagtatcgatcgtctctgtcttaatagtactgaacgatcgcgagagaagaagatcgataattatggggagcaccagtcttggatgcatattatttgtacctgtattatttcgccggtgcaatgttaatttcccgctccatattatcactaccacaaaaatactcattggtgccagttataaaggcctcataggtgccggttttgggcccggctccaattggtcggtgctagatctggaaccggcacctatagctttcaacaaataaaaaaaaagaaaaataatcccggcaacccatcgccggccgtcggccacctcgcctggcgtacgcaccagccatctccaccttcgccgccatcaccagatctggaggaaaagggggtagggcggacgaagaggatgagggagggcccccagggagagagagacctgcatcgatccatcatttccatccatatcgatcacaagcaattaaggtcagattgtccatttttgagtatcgatcgtctctgtgtcttaacagtgatcgatcgagagaagaagatcgataagggagcagcagtcttggatggatattatttgtacctgtatatatatatgctgctagtacgtatacaagctagcaatagagtctgtaatgcaacacagttaatgcttgtgctatatatcagattaattaatggccatactattgtcatatatatctgcaaattaaggagcttctttttaatttcactctcaagttctcaatttgttcagtagtacgtggtctgcctatgaatatatgttcagaccggagaccatgatcacatggtgggcgctggctctgtatctaacaatatatgcaagcatgcatgcatgttctatgttccatcgtatcctcataaaccaactcgatagatctaccagagatgactcaaactcaatgctggagatcgagaccatgatagggagtgtttaatttgtatattcggtttattagtcaaacactaatttaacccaaataaaatattagtctgttggtaattttgctgattatcttataatagtttcagtgaatatttaaaaagatgaagcatatggttgaccaacgttaatcacacttgaatttatcgtttagtcactggtaaaa

SEQ ID NO: 22861 - DNA, 337 bp, Oryza sativa
gtgctgccaccgccgctccctctttgcggtgtcaaatatggctcggggaccgtctgattcatcgatcttggcctcccctccagttgaatcggtcgcccggatggagtcaacagggcgccgccgctgccctcttctcctgtccctctctgcctagacggagtcagtaggccgccgccactgccatcttctcctctccctctccatgagagcctcgctcagtgccatgagaagggaagggagagtgtcggcttggccaggaccacgatgaagacagctgcggctccgcgacaatagctgcctagtcgttcctgttctcttttttccttttcgttctagc

SEQ ID NO: 22862 - DNA, 1501 bp, Oryza sativa
gcatagtagggtttcatttgcataaacagcatttaataaacatttcagaatttaataaaatagttaagtagtaattaaacaatattaatccaacgctatacaacataccctgttgcataggcccaaccattctgaacaactatcccggctgcacagttctatctccaaaccaggaatataccattccaaaccaggagctaatcaaattattaccagttatagcatcttttattatggtgagaagtgtgaaactaatcacgaaagacattgttagacccgcccataaccgcgggcacggctattcgaatagttttactctggtcagaggtgtaccactgtacccacaagacacagccccacaacatgtcaccatgcgcctcaataccaccacggtacctcagaaaggagctgtgacagtacccctcgcacaacacaatccaccacagcgcaccattcctggatcataatcacccccttataaacaaggcatggactccccagcgacccccgtgggcttatctccgccacttctcagtctggtgccccgcaatgaaccatgctatacaaaaggtaaagctgttgcccacgctggcttgtggttggcacggttaatatctcacaaccgaaactcatgaaccggtccttaattgtcatgagcacgaccatcaaaaccatgtgctcacaacccaccattatcaggttttagttggcaaattaattaattaaccaatcatgattaaccatcatgagctatcattaagccatcattaaataatagtgagtcataagttatcccaatagtgtgctaatgtttctaagcatggctaagcaatcatatctaatatctagctgaaccaatatataaagcccaactagtcaagttataataacccaaggtatcaaggaataaagtaatcaagaacaaaaaggctataacaaacaataggttaattccacccaacgacattcgaaaataaatgcaatagttgaatagaaacaatagctttaaacgggatcaacatgctcaaagggttgtttgggatctgtgtgacttgccttgctggccttggaactcttcaaaatcttctcctgcaaactcagactctccggaaacgtcggaatctaaagagaaaagagcaaaatcaccaaaacagcacataaacaagcatgaacagtacatgtggatatttttaacatgtagatctcaattttagaaaaaattagagacttgaaccaactaaatccgagctaagatgaattagttatgaatttttatagattaaatcggattaaaacacttatatgggttttaattgaatgatgacgcaataatgaattattttttaaaaggaaaaggaaattattgcgtcagcggttagggttcgcggtggaccgggtgcacggcggcggctcacggaaacgaacggccgagatcgatcctatccacaacgaacggccaagatttaacggtctacgaccggtctacgacggacggcaccga

SEQ ID NO: 22863 - DNA, 1501 bp, Oryza sativa
tcgatcctatccacaacgaacggccaagatttaacggtctacgaccggtctacgacggacggcaccgatgacatcggtgatgacgtcatcaccggcggcggctcgggcgcgcaagctcgccggcgaacgacgacgcgacgccgcgaatggaggacaccaacacgtagagggcgacgtggcgaactcaccggtgaccaaaacagcggcagaagatcaacggacggcgacggcgtcgaggaagaagcggcggcgaccttcggcttgacgacgacggcaacctacggcgacgacggaggggtggacgagatcggcgacggcttggtgaccacgacggtgacctccccgagcagcgacgacgaccggagcgacggccgcgcacggctggagctgcggcggcgacggcagcgcacagctgcacggtgctagggcgctacagacggcggcgggcaatggcgagggtggcgacggatagcggagacaccgggggtccttttataggggcaaggaggcggcggcgaaggcccacggcgaccggcgacgcgatggaaggtttagggttcggaggagagagatcgatccgaatcgaactcgaattcacggatttccaaaccgaattggcgatcgattccaaaaggaaaaaaggtagagaagattccggggagcatttcccctcaaacgatttcaccggatcgggaaagatgcggccgaattggaaaggtggcggcggcgcggcgcggctagggtttcggtgcgaggaggacgacgagtccgacaggtgggacccacctgtcagcgaccgagcgcgcgcgcgcgggcggctgcgggctgactaggccaaagaggagagagagggaaggttttgggccgactttcggcccaaagccaaaagaggacttttaaaatattttccaatttaaattattcatgaaatgcaattccatttattaaaaatacttccttggctcaaataaatcccagaaaactctaggaactatagaatcaagcaaagtatttaatgaaattttatctggccccattttatattggaatttattatttaaaattagatcttctcttctaggcttttaaaatcatttctaataattccaattaaacaacaattcatctccatctctgcatgcaccatggccatcgtgtttatcttccatatgtagccccaaataagtggattggtcatgaacatataaacgcatacattatgaggtagtgtcgtattcttgattagattaatttggcacttgttatgaaacgagaccacctgtgggtatatgatatgatcaatggttatatccgtcgtaggcatggtcacattagatcttcaatatgctgagttgatagaagggaatctaatatgataattatggattgcttcttatatgaaatacagataaaacttgatgaatggatcgatcagtttgttagataataaaataaaatcccgacgtttagtttataaggaagaattaaatttttatatatt

SEQ ID NO: 22864 - DNA, 202 bp, Oryza sativa
agggggggcagcaaatcagcagaaaaattatcatagatggaaaacataccagatggaacatgtggttgctgatttacattccatgccaaggaataaaagggaacatataatttataagtttgtattgtccacttgctatttaaattcagaatatgtagattattttaaagtaatgatattatctgaatatcctttttccaga

SEQ ID NO: 22865 - DNA, 1501 bp, Oryza sativa
ttgcagtgtgcagtgagaactcatacttgtggagagcaccagactcattgaagatgggattcacatgctccattgtggtaacagaagggagagctatctgttcccctgtgatcggattgaccaggtgcatctcggataagtcatcagctgtaatcaaccaaccaagtgaggacccaatcagaaacctactgcgtatgggtggctccgggagagtaatcttgtactccctcttctcgacaagactatagagacacacgacgctatcgccagcagattcagaggtgtatagcaggcacggcgtctgggacagtttatagatacctaggctgcgcaattcgttgtaggccgagagccaggagttacagaccgatcctgcacgcacgaggtcagggatctccaggagggcaaatatctccattaagatgtcctgagacagctctggtaaatttgccacaacactctctgccattgatggctgatcaccatcatctttttgcacttccttcagtaaactactgtgaaggggcgctaggagcttggattgtactactctgaagagtaggttgcacaaattcttgggacatctcgctagatcccctaagttcataatcctggctatagtactacagggcgccattggataattggagcagatcgagcccctcttgcaaggtgaaattcgtcgcctgcttgaatacttgcagagttggaacatgtgatgaagcaagagacgcaaggtatatacctgaagttacccaaggaaaactgaaacggaatttgttgtcctcaaaagagaaatccgactccggatcagacttgttcccgggaatccactctgaatcatactggctcacacggatccatattccgaatcgaggtcagcaaggaaaacatgtggagaactcaccgtcaagcgctgccgccgtgcatggtggggggcgggagtggatttgtgcgcggaggagaagcagccaccgtcaggccgccgtgcggtggagcacaggaaatccggcggtcgattttggccgccgtagcacagccaccgggggccgccacgcgctgccgtatctccgaggacaggacggccggcggttgaagcggcgacgactccgggccagcgtgctcgtcggcggagaggatgcggcttcgcgccgccgttgtcggcgacggcggcgggtgggcagccacgcgagtgtttccttctttctttttttctcaggttttctattttgcaagcgcctgcaaaattttaacaattttgctatatattttgcgataaattttctcaaaaaaattgacatatgtaaattaaagtataatcgtagtgtaattataatataacttgtatgtaacttttaaatatctcttcgtaatctccgtaacatgttatttcggtaaaataaaggtcatgagaacaaatcctctcacatatctctactgtaattttttttctttcttaccagaacaaatcttgtaaaagatctaacgattcaaaattacg

SEQ ID NO: 22866 - DNA, 646 bp, Oryza sativa
cctctccccctccccctcccacccctaccccaccccgggaccctaacctgtagggtcctttatcgaagtctagggtatcaccggcgcgggagaagacgaggaggttgccggagttggaggagaaggcctggagtacgaatctcgaaactcatccggtggcccaaaatctgcaagatttggggatacaatttctatccgcatgaggttagcaattctgtttaataaatactctctccatctacttttgataagcatattaacaaatctgaaaaaattatttttgatagacatatttctatccaacaacctatcctattaataactttctcggatttaatgcgtgactctctattcttccacacaagatttactacatgggcatcgagaaatgtaaatattaataaatcgtttgtttacgaggaataactagtaacatgtttaaatagatgacaagtagaattacttatcctgcaaggatgaaatagagtagatggggaagtacaatgaaaaaaagacaaaattccgatcgtaagggtggcgccgtaaacatgtaatatacgtggttgtttttgcaaaacgtccatccccctcaccaagcccaccggccgcccctccggccccctccctgccgcctcgcacgctcgca

SEQ ID NO: 22867 - DNA, 665 bp, Oryza sativa
atacgtctagttgaaccaatataaacaaagctcaactagtcaaattataataacccaaggtatcaaggaataaagtaatcaagaacaaaaaggctataacaaacaataggttaattccacccaatgacattcgaaaataaatgcaatatttgaatagaaacaatagctttaaataggatcaacatgctcaaagggttgtttgggatctgtgtgacttgccttgctggccttggaactcttcaaactcttctccggcgaaaacggactcttcggaaacgacggaatctaagcaaaaaagagcaaaatcaccaaaacagcacaaaacaagcatgaacagtacatgtggatatttttaatatgtatatctcaattttagaaaaatttagagacttgaaccaactaaatcggagctaagatgaattagttatgaaattttgaagattaaatcggattaaaacacttaaattgattttaattgaattatgacgcaataatgaattatttttgaaaaggaaaagggatttattgcgtcagcgggctagggtttcgcggtggaccgggcgcacggcggcggttcacgggaacggacggccgagatcgacttgatccaaaacggacggccgagatcgatcgggtccacggcggctcacgggaaacggggacga

SEQ ID NO: 22868 - DNA, 1501 bp, Oryza sativa
ctccattaagatgtcctgagacagctctggtaaatttgccacaacactctctgccattgatggctgatcaccatcatctttttgcacttccttcagtaaactactgtgaaggggcgctaggagcttggattgtactactctgaagagtaggttgcacaaattcttgggacatctcgctagatcccctaagttcataatcctggctatagtactacagggcgccattggataattggagcagatcgagcccctcttgcaaggtgaaattcgtcgcctgcttgaatacttgcagagttggaacatgtgatgaagcaagagacgcaaggtatatacctgaagttacccaaggaaaactgaaacggaatttgttgtcctcaaaagagaaatccgactccggatcagacttgttcccgggaatccactctgaatcatactggctcacacggatccatattccgaatcgaggtcagcaaggaaaacatgtggagaactcaccgtcaagcgctgccgccgtgcatggtggggggcgggagtggatttgtgcgcggaggagaagcagccaccgtcaggccgccgtgcggtggagcacaggaaatccggcggtcgattttggccgccgtagcacagccaccgggggccgccacgcgctgccgtatctccgaggacaggacggccggcggttgaagcggcgacgactccgggccagcgtgctcgtcggcggagaggatgcggcttcgcgccgccgttgtcggcgacggcggcgggtgggcagccacgcgagtgtttccttctttctttttttctcaggttttctattttgcaagcgcctgcaaaattttaacaattttgctatatattttgcgataaattttctcaaaaaaattgacatatgtaaattaaagtataatcgtagtgtaattataatataacttgtatgtaacttttaaatatctcttcgtaatctccgtaacatgttatttcggtaaaataaaggtcatgagaacaaatcctctcacatatctctactgtaattttttttctttcttaccagaacaaatcttgtaaaagatctaacgattcaaaattacgtgaaacttatatacaagttacacggtattcacatttaagttataatataattacactacgattatattataattatatctattaaatttttagaagaaaatttgtcgataaaatatacaggtgatcccaaattttaatccatcagtcgattttgtcagccgttggatttgcttggctggtggatgcacattctggtaacttggttgtattttggcaggcccgttaacccgtgggcttgcattgctccacattttgccttctgttaaaatgtgtgtattcagatgcaattcggcataggtttccttgccgaatcgtagttagtctgtcttctcaggtacttgtattacatatggggtgttaggacgctaataaaaaaaaattacagaatccgttagtaaaccgtgagaaaaat

SEQ ID NO: 22869 - DNA, 242 bp, Oryza sativa
gtaagttagttgctagaatccatggctcctttgccgacgctgagtagattttaggtgacgggtggtgacaatgagtccgtgtcgagcgctgattttttcggcctttagagcgagatttatacaatagaatttggcatgagattggattgcttttagtcagcctcttatagcctaaagtctttgagtgactagatgacatatcatgtaagttgctgataggtttccagttttccgctcctagg

SEQ ID NO: 22870 - DNA, 1501 bp, Oryza sativa
aaagtataatggtagattgtgaaaattgtgctaatttggaaaaagaagtttcttatttgaaaagttctttgcaaagattttctgatggtaagaaacagctcaacatgattttggatcaatctaaggtgactagttacaataggggtgttggttttgatgttcataactatttcaccaaaaatcatcccaatgttttgagtgtgactgaacatggtgaaattttgagaaaaccaagtgctaagaaaacagtttttaagtctgctggaattttgccctctctttctagaactttaaaagaaacaaaaacaaatctttcaaaaccatctactttacaaacttgttgtgagaattatatttgttctttttgtggaaaagatgcacatttggttagtttttgttttcgacttgcccgtaaacagaaaaaggaaagagaaattgcttttgcaaaacgacgatggcaaaaatcgggttttggttcgaggagcacggttagaccgacactgactagtcggtcagaccggccagcggtcagatcgcagttgaaccggtggtcagactagatgccaggcccggtcagaccgcagggacaacggtggtcaaaccggcttccgggcgattttgcacgtaattcaaatcggacttttgtgaaacgacaaggtaagttttcaggtaagtttagttctgattttgttagtgcatatgtacctattggttctactggtcgtgtgactcagtgttggattccaaaattttttatttctaaccccaacatggaggcctcgacattttcttgttcgtaggtattttggtggcatactccctatgtgcgttcaacgttgagatggtgagtgcttttcaaggtaatatcaagataattttggattgacataattttgttctactttcttgattattaggttttcatatgctagtgtttgagatagtagtttttgttaatacaagtggatacatgtcaattcatgagaaccttggtgatatcattggcaattggatgtctttttcaaaatctttgatttcttcttgatttttcttcggggagaattagaggttaatttgaggtggagtttatgctttttcgtgcattcatgtttatttttatgcattgcttttaattctgaaaataaataaaaataaaaaaaagaagagctttgttttatacctctagtatattcttgtgcatgctagcaaaataattgaggtatatttgttgcaatgttagcttgtatgcgttttagtctttatataaggcttagatattgcttttaagtgagatgatgcatgatactaattcttttacttgaattaataaaatatgcaatattgatgatagcatatggattgatttataaatgcttatgtatatgctttattgaattgttattcctcaaatagcttttatttgctcattgtgcaagagaataaaaaatatctatgaaagaaaaaaaaagaataccgaatccttggaaatagtcatgacgat

SEQ ID NO: 22871 - DNA, 434 bp, Oryza sativa
ggttgatccctcacgaaaatttcatcgaaacatagaggagataaactaaagaagggagaagtcaacagcaatgttgttgtcagacactgatgaatacaatcctggactcgaatgattgatacgtcgtgtaatctggggttgaaaaattttcaaaattgatgataacacaaacttttggcgaaatgggtttttgattttttttttcatgagcagcagtatatgtatcagtaagcaagacaaacattgggcctggcttgtgctaattattctaaatttgcgaaaagctgatattaagaaactgatcatatcagagtgaggataaatgcataaatcgtgtgctaaaatgatcagatgaaaagtgtggcaagaagttgatagattgctgtggttccaagcctaagtttgccggattttggttgctaattacacgataa

SEQ ID NO: 22872 - DNA, 312 bp, Oryza sativa
tgcaatgctatttatgtcctattgattgacatggttagtggtatgacatgattatttggcctaatgaacatgcttgttatgagacgacattagctgtactagattaacttcttgctaattttctttgccgtagttatgattcgccgtaaatgacactgattttctatggcctcttagttggatgagataaaaagagatgagtatgatgagattaatttcttgcctgtttctgctggatgccaaaattgcaagctttgattcccgatttaatggcggcgatggccgcagataaatcccagcttggtggatccc

SEQ ID NO: 22873 - DNA, 271 bp, Oryza sativa
agacaagtattgtataacttattccgggcttctgagaaaaggttgaactacgaatgtcataactttctcatatgaactgcacctacgatcgcaagttatccagatgtgatagattggagcctaatcatgaaaactatcttccggacaatcattgagttcattgagtacgtaaaagtgattactacctccgtcccaaaataattacagttgtaggtatctgtatacaacgtttaaccgtccgtattatttaaaaaaattatgaaaaaattga

SEQ ID NO: 22874 - DNA, 1501 bp, Oryza sativa
atgaaaaaagccacttgtttgtttaggcttagacttttcggattataagttggcttataaatctaaacaaagagggccttaatagaggaagtatgtgcaggtgtaagaaataaaacaatagcaaattgtgtagatatttagggtgtgttttgaaaggaggtgaaaaagagaatattatgaagatatgcaagataaggtgtaaccattagcggatgattaattgatattaagcattctaaacttgtaaatggatcggtataattatttttaaattaacatttctatgaaaaacgtacgcataaaaaatgagctatatttatcctttgtgcttcaaacggacgcatcctcactcctcagtactaacaactttgttttgtgtcatccttgttgtatgccacattgccatgacctcaccatgcaagaccaaagtgtagtatttatgctttttcctcatttgctcaaagtttttccatctgcccacctccaatcacctcttcttcaacatcttcccctagtcttgagctacatggttcctgatttacgcggcgaacccaactaacctctcgctctcaccgctgactcatatccaatgatcattcaacaaccaaaaaaaaaaactctgagatcacacacaaacttgaaaggaactggtacaagaaaacaagaaggaaaatgaattaaattttccataaccctaaatctaggtaggcagagggtggtttaacttgttcaaaaattttgccgtgcacattgctgtgtaacatttcacggaatttcccctgccgtgtcatgtcactccccccaaatttgggtgcaacaattttgcaaccttttcttcctctccggtgtaactgcgtgcaatctcgttcaactcgttttcccatttttatggtataaatatacatgcaggtgttgtaactagcttttgttcacttttttgttttgaccaggaaagctagcttggccacttcacacggcagcatcctctgcctttgcagatcacgtcttgccactttggtactccggtgcaggttcacagttccgacgaaaaccggtcgaatttcgtgaaatttcgatgtttcaacatggctcgaaattaagttttgatcaaaatttcgaaggttaaacagtaaattcagttaaaatttatcaaaaatcataatactaatagggctcgaaatttagtagaggtaatgtaaaccctcctccggcgacggcgatgtcactggcgatggtggactcctccgccgcagccaccgtgcaagccagccacgtacgtcccgatgctgggccacgtggcaagggcttttcgtgagggagttcagagaagaaaacaaaagcccatgaagctctttttatactccctccgttttacaatgtaagtcattatagcatttcttaatgttaatgaatctagacatatatatctatttagattcattaacatcaatataaatgtgggaaattttagaatgacttacattgtgaaacggaggaagta

SEQ ID NO: 22875 - DNA, 172 bp, Oryza sativa
agtcgaccggagatgctgccatgctaacaactcttgatcgatggatgatgcatgctttgggagataaacaacgcactgatcaatccgcctaagcacccctcaacaacccccccaaataccacacgctgatcctgtcctgcactgatcttcttggtcttctcttctctcaagg

SEQ ID NO: 22876 - DNA, 245 bp, Oryza sativa
aagaacaaaatttttgaaattagaattttgccgaattagtttttaacgcctcacgaaaagcgaagcgttacatgcagtgagggacaaatttcagactcagtggcaaaaatgaggagctgaaagtgaacttatttccattgcacaaaatccaacaataaaaattccgtgccgaaaacgaaaaagcttgtgggattaaagtggaaatttcactgatcggttacgctttagcattctcgcgccccagg

SEQ ID NO: 22877 - DNA, 1501 bp, Oryza sativa
accgttgactcttcctcctcgcaggcaccatcaactactcgtgccagaacgggtcgtcgtcgccgtcgccgtcgccgccaccgccacctcctccgccgccggcgatgccgtcgctgacgaacctctccatctacgaccgtaataatctctcaactactgcactcaaaacccacaagattaatcaccaccatcatgtcgtcaaattaaactgttcttagctttagctgatcatggcgttaattaattctcgccgtcgttgattgttgcctgaatgaatgcagcttgcctcctccagtactgcggcgacggcggcagctgcgagaggtcgtcggagttcggccaccgctgcgcctgccacgacggcttccagaaccttctcaacgacacctcctacccttgctaccggcagtgtaagcatcagctttaatttgcaatacttccttcgttttgggagtagatgatatatatttttgactcacgtttcatcgttcatcttattttaaaaaaatgatgtaaatgtataagatataaatcatgcttaaaataattttaacaataaaacatttcgcaacgaaataaatgctaattgcacaaatatttagtactctcttcgtctctaaatatttaacgccgtttactttttaaacatgtatttaacgccgtttactttttaaacatgtttgattgtttgccttattcaaaaacttttataaatcttatcctgcggccggccggctggatgaatgccgggcctagctcgtcgccggcgactgatgtttttcttcttctccggtggcaggttcgcttgggtcggactgctccggcctggggatcagcatgttcaacgggtcgcagccggggacggcgccgccggcgccgttctcgttcaccgtcaagaagtccggcgccgccgcctcctcccttctgccggccggcggcggcgtgctgctccacctcctcctcgtgctggtctcctccttcatgataggatgaacagcagagcacagctagtagcaataatagagagacaggcagagatttcttttcccatattgaggagacgttttctttttcctatttacacccctttttcagtaggaattttgtttcattcatgtgatcatcagtgtatgttaataatttcatagaaataaaatacttagcagtagaagatcttgtgcacatcagtagataataatgctgcgctaactatcacaccaggcaccagccatactcttcaaaagatctgaccaccatcagcagcagcaagccagtaacagcttcagaagttctgtccacagaccacagtgatgcatcatgcaaagactgattggcaagatgcaagagcaacaagcacaccaacaaaacatgatagatgcttgcttgatcatggcccagattaaatcaagtgatttgtgagaaattaacatctccattgaagtttttcgctccactgattagatctaaaccgatgtagtgcagatcactgcaaacatgtctc

SEQ ID NO: 22878 - DNA, 181 bp, Oryza sativa
ttgttcgatacaggtatctgtttttttgttctttctgtgcatccttacgatttctcgctcttctgacttgagatattgtagctctaagcctgtaatagaatccaatgattgtcttactgcaatactatttcagcatgttatccaatttgaatctacgcatacttactgttggttttacagt

SEQ ID NO: 22879 - DNA, 1438 bp, Oryza sativa
tactaagtacttccttcgtttctaaatatttaacaccgttgactttttaacacatctttaaccattcgtcttttttaaaaaaatttgtgaaatatgtaaaactatatgtatacataaaagtatatttaacaataaatcaaatgatagaaaaataattaacaattacttatttttttaataagacgaacgatcaaacatgtttaaaaaaagtcaacgatgtcaaatatttagaaacaaagagatcagtaatagcagtcgtcaagccgccagacaaactgcatgttacatcgtctgacaaattgcgttacatgcctcccaggaaacaaattcagaattggattgggagagtggtcgagcaacgataatttgtaaagaaagagaagataagtcttagacaaagaacacgtgcatctactagctgatagccatggactgactgctgtgttgtctgattgttacaaatatcagttttgtcttttgagtgaccggcggtacaagtaacaatgaaaaaaaaaattacagttgtacaggagaaaacgcataagagaaaacgaaggaagctgccaagaatgacagtggaacgcagcactggtgacctgcattacccgcatatcttgcgactgaaagaactggacctgaaataaggtgtgactcgctatgacgctatatgcatttgaccgttctcttgcgactgcaaaccacacggttagaaattaattactttaatctataacgtagggatgaactagatctagatgtttatacactcatttttaccattagttaacctcgatcacactgtgtaggcgtgtagcagagcagattattattacacacctaaattggaatctggaggagatcagttcacaatggtgatgccacactaatagagatcatagccagaggagaaaatatgcaaatttcatgacacacccgatgtaccaaataaacatgcagaaacgaagttccgagaaatcagccgatcgatacccttcatgctctggatcttgtgttgaacgtacgtgttacagatatttaaacgactaactgaacgtacgtagagttagagatcgatatacttctactagctagaggagtagttagttttgagtttgtttctaccaaactcgtttgtactttgtactacaaatatcactgatcaaagttattactcaagcggtctttccccaaaaccagagtatgcatagctaatcaccaagtttttcaaaatggtgctgaccaattgaaactttatctgggtagtttcattacaatctgcagcaatatttttttaacaccgtgtaagcgaacatgttggaatctagaaatgctagctagcagccctactgagaacaagtccagtttacaactcaagatcaccgagagttaacaagtccattctgcatgcttactatgtaaacaactagctaggacaagg

SEQ ID NO: 22880 - DNA, 244 bp, Oryza sativa
gggtttcagcgcggcggctggaggtggacgacgagtccgacaggtgggacccacctgtcagcggccgagggcgctcgcgcgggcggctgcgggctgacttgggccgactgggccgagggagagagagagaggttttgggccgactttcggcccaaagccaaaagagaacttttaaaaccttttccaatttaaattattcatgaaatgcaattccatttattaaaaatacttccttggctcaaat

SEQ ID NO: 22881 - DNA, 1501 bp, Oryza sativa
cggtttgtttatatgggctgcgggagctgaaatatgttgggaagtttgttgtaggggattggtgataaaatgcaattgcaaatgatatggttttgaaaaaaaaaggtattgtttcttttttccaactttaagggaaagatgggtccggacaactgacacatctgaatgtatttttttggtgtacttgagactatgcagcctgggcttggtctgtagttggtcatctggttatggcttggtctgtagtcacacttgtggcaactgacaagattccttgttcatcatgcaagtctttattaattttgttagccaaattttagacaagtttagaacataataactacacccaaatgttctgttcggtacactacacacagccgaggccgacatgtgagaaagagaatctaaggaatttatttattttaaaaaaactactaaaccttactatttcccgatctaaatcttttactccctccgtcccacaataaaagtgattttcagtttttgcttgtaacgtttggccactcgtcttatttaattttttttttgcaaatctaaaaaacgaaaagttgtgtttaaagaactgtagataataaagtaagtcacaaataaaataattaataatttcagaaaatattgaataagacgagtgatcaaacgttgtaagtaaaaactcaaaatcccttatatcttatattatgagacggagggagtagcgataacattgttttggttgggtggtaaaataaaactgtcacgtcacaggtggtgttgaagaaaagagtttagattttggaattaggttttgaagggtttgttttcaaaataaaaattaaaatatttcaaaaataaataaaaattcgaagctaagcctcggtgaaaagcccaacactgaaaatactgttttatcatatactcgtacaatcataatacggaaaaaaagatttaaagtttttttagacatgatttagtaggtgcatgaaaaagtccctacacaaaggttgactctaagcttcaagcctttcaaccttcgagaagcaaagaacacacgccacatcattgcaccagcaacagcatcaacagcagccaggtattatatttcagcaagcaccaagccaccaaatgttggtccattcaatgaaccagaaaaagaaaagttcagttatctgtatttctcggtcattatttccacacggaagaaagaaattccaggccggcactggcctggagtgaatgcaaaactagagcaattaataattaatcaagtatggacatcaattgacctaagacagtttcatccatacatttcacacagattattgctcctacgtctccatgttctggaagaaacaagcaaggagaggacgcatatgttgcccaattaattagggtgatgaccattttttttctctgtcaaatctgacggtataacttgaggtgcagtcttcttttttagtcttaatttagttccaagcgccattgcgatcgacatcacgccaaa

SEQ ID NO: 22882 - DNA, 1501 bp, Oryza sativa
aagtgcacaggataacaaaggatggcatagtagggtttcatttgcataaacaacatttaataaacatttcagaatttaataaaatagttaagtagtaattaaacaatattaatccaacgctatacaacataccctgttgcataggcccaaccattctgaacaaccatcccggctgcacagttctatctccaaaccaggaattaaccattccaaaccaggagctaatcaaattattaccagttatagcatcttttattatggtgagaaatgtgaaactaatcacgaaagacattgttagacccacccataaccgcgggcacggctattcgaatagttttactctggccagaggtgtaccactgtacccacaagacacagctccacaacatgtcaccatgcgcctcaataccaccacggtaccttggaaaggaactgtgacaatacccctcgcacaacacagctcaccacagtgcaccgttcctggatcataatcacccccttataaacaaggcatggactccccagcgacccccgtgggcttatctccgccacttctcagtctggtgccccgcaatgaaccatactatacaaaaggtaaagccgttgcccacgctggcttgtggttggcacggtaatgtttcacaaccgaaactcgtgaactggtccttaattgtcatgagcacgaccatcaaaatcatgtgctcacaacccaccattatcaggttttagttggcaaattaattaattaaccaatcatgattaaccatcatgagctatcattaagccatcattaaataataaataatagtgagtcataagttatcccaatagtgtgctaatgtttctaagtatggctaagcaatcctatctaatatctagctgaaccaatatataaagcccaactagtcaagttataataacccaaggtatcaaggaataaagtaatcaagaacaaaaagggctataacaaacaataggttaattacacccaatgacattcgaaaataaatgcaatagttgaatagaaacaatagctttaaacgggatcaacatgctcaaagggttgtttgggatctgtgtgacttgccttgctggccttggaactcttcaaattcttctcctgtaaaaacggactctccggaaacgtcggaatctaaacagaaaggagcaaaatcaccaaaacagcacacaaaaaagcatgaacagtacatgtggatatttttaacatgtagatctcaattttagaaaaatttagagacttgaaccaactaaatccgagctaagatgaattagttatgaatttttaaagattaaatcggattaaaacacttatatgggttttaattgaattatgagcaataaagaatcatttttgaaaaggaaaaaggatttattgtgtcagcgggctcgggttcacggtggacttggtgcacgggaacggtctacggaataaacggctgagatcgattcgatccaccgcggtctacggatgacgcggcgc

SEQ ID NO: 22883 - DNA, 250 bp, Oryza sativa
taccataccagttagtataaaatttagaccaaacaaaagcatgccagtgattgcgttatcatgtataggatgatcccagcatgcttggtcatttttatgtttctcaaaatcaagtgaaggttctaagttgaattgctcatcgccaccctcactttgaatggaatactttgcgcatgaaaaaaaagaaaaaacaggctgcaattccacccaataagttggaacaaatatataattccgtacataattgcaa

SEQ ID NO: 22884 - DNA, 1501 bp, Oryza sativa
ggattatatctccaatttggacttgttccggatacattccacatggattcatagtcatgagtctattttctatgctcaaagactggaccaattattattccccgtaagggctatcaaccgaatacttgcgccagtcgggattcaattattatatatattttggagtatctcataagggataatcactcagatcagaagctattcatatgagctacacctggtctatatcacccggaagatttattactcgagagcatattacatgcgtcatcctttaaagggtgtcgaaggcatattttttggtctaggcctaatatgtctgcagcccatattttcaggtgtggcctgtcacgttcttttagggacttaggcacttttcgcttaggccaaagtgcgcgtgatcaagtgcccaataccttaaaatccttttataccgcagttactcgactttttaggagttggtacaatgcatcttaaaaggtgtcaaacagtaaagctttatatagctgccccgctggcttttttaatatagccatggtgctgtttgggtttttaagcaattgattggatacaatatcattgctttttgccacgtaagtgtgcatttttattgaccaatattatggcttaggctgattatatattatggtcatttttcaggcggttggtaaatcctttatgagtttacttactcggatgttataccatatatgccatatatttccaggtgtggtgaaaccatgtgtcttttagggacttaagcacatctgttaaagcagtgtgcgcatggcgtatgcccaatactttggaaatttctttattcacagcattcaagcttctttataattgttttgctatgtgaactttcaaagatgttgtcaactttaggttgtacgcatcatattttgccaagcagtcggtatatcacttggatcatattattcggggattcacaccgcatatgctatatattggtatcaagtcacttggttgactataattattaaaaaccactcggttaattggataatttattccttgactatatgtttagtttgttcagctaatcacatagttgggggctacacctattaggtgcatctattcgatgcacctgactttatttttcagccctccacagtcttcagatttggtaaaagtactcgggagaccatggcgaagatgattgaagcactcggctttggagtatctagttcgagagaaggttatctttccgactgtgaaggtctcaggggctactgtggagattatgggtaccccatacccacacggcatggttatccgactagttataggggataacttatatctatgtaatatgtaaaagatcatgacttgggtgttacgtttccttgtatattacggaacggcctaaagtcctgatttaggaaaccgataccgtattggttaaggtttctatcttgtaatcctgccccccatcctatataaggtgggcaggaggccctctagggggcatata

SEQ ID NO: 22885 - DNA, 421 bp, Oryza sativa
ctacattgaactgcatcaattagccatattacccaaaaatcaataacttattaattgcatgcaccaactattatgggagaatagccaaaatggtccctaaagtttcactcctggatcattttagttcttaatctttcatattatccaaacaaattctttaaatttgtcacatgggctaatattgtccttggtcccaccaaaatcgctccatggacaagtcatgtcaccctcctatgtaaaatctatataatttgtccaatttacccttacatatatcatagaaaaataaaaggcaaaatgaaaaaagttaaaaaaaagtatggtatatgtaagagcaaaaatatacatcaaagggtgaaaaaaaggaaaagtattttttcctatggttatgtctaattcactcttacattttcatcataga

SEQ ID NO: 22886 - DNA, 1501 bp, Oryza sativa
tgagactctgaatgaatcagctcggccattatatcttagataatctattgctcaaaaccttgaagctttcacatcgatccatcgagagtttacacggaagttcacatatctcagcatcataaatccataagatgccaattagatatgagacagtgacatggcgatggagacccaatggtccatggttaggacaaataacgaaaccaccgagtaattaactgcagttagcctataccactagtacaagagccatgatagatgccggttgggaaccgactataggtgccggttttccaaccgacacctattggttggcaccaataaaaacaaccggcacctataccaaaatagagccggcacctataggtttgcacgagcaaaaaaaaaaaaagagccggctcgaatcaagccggaactcacaatcgtagtcattgcgccatccccaaaccctcacaaatcacagatcgaaacatattcagaaacaaaatcatccacagatcacagaaacatctaaaagaactacaaaatcattcaaaaatccatcgggcgctactggcgccaccgcctccgccggaccgccgcccgaccgtccccgacgtccatcgcctcccttccatccggatccagcggaggggagggcgcggccgccgccagccgctgctgccgcctccgctgaggtccgctgccagccgctgtgccgcctccgtcgcctcctctccggctggatctcgcggaggggagggcgcggccaccgccaccgcctccaccggaccaccgcccggccgtccccaaggtccaccacctcccctccaaccggatccagcggaggggagggcgcgccgccgccagccactgccgcgcttacctcgatggggctgccgcctcccccgggccaccgccgtgcctacctcgacgggccaccgccattgctgcctccatcgggccgccggtgccacagagagagagagagcgatggagggaggcgagagagcaagagcgagagagagacaggagcgaccgagcgactaataaaaggacaggcggatggataaggccggctcgccggctcggctccatataggtgccggttttttatacaaaaccgccattataataaattctaggtggcgattttgaataaaaaactgatacggtgttggtttttctttaaaactgacacctataattactcaaggtgtcggttttatgtgtttttaacttgtagggaagggaaaagtattataggtgccggttttaactgctccggcacctataatgccaatctctgtgagcttttttttttagtgtacacactctgtcttaaaaaataaattgtttcttttttatttttatgtatgaaagttgatatgtccatgttcgtgcataagagttactaccgaagtaatttattttaggatagaggcacatagagtgatagatatatcagattgagtatagggtcaactgcaaatggatgaagaaaaaaaaatattctcttcat

SEQ ID NO: 22887 - DNA, 1501 bp, Oryza sativa
tgtgtccaacgtgaaaacccaaccatattattctcaacacaaaaaccaaaaaatagaacacctaatccaagggccgactcatcgttgataatcgtaataagtatacttaaggttcctcatctttcatcaagtttaaatatcatatccctacacacaatactaaaatcctaaccccaacttacgaaactggactaaattaggtcctatgacactataggtggttggttttactgacgtggcatcctagttagcaaaaataaataaaaaaccatggggcccacgtggcaatgcctgcttcattcttctctcctggaccctggtgatggggaggcggtcgggaagaagcgcaagacgtagggagagcgcattcacgaaggcggcgacagatgaggcggtcaaggtgcgggctgtcgccctgaggggtggctgaaggagtccgaggcgggagaggaatggagaggtggtcggcgagcccatccaagctcaagctcgcccggcctccatgcgagggaggtggacggaggagcgtgagaggtactctaggcgcgagctactaccacgctaggctgccatagagggtagtccagggaggggaaggcggtcagcaagctcgtctgagctcgtgctaccttggcctccgtgcaagagaggtggaaaccagtaagggagggggttgcgcttgcgcgtttaaggagcaatcggacgatggaggtattgtgccagagtgcatgctgaccacggcaaccggttgggtccccgtgggctctgcccccctccccccccttcccccctcctcctatctcgaatcgaccgagcctatgacaatgtcgccggctatctcccacatggcgaagatgagggaacggaagagaagaaaagaggagaggtgaagtagaagacggcgtgtccacttcaagttaccagccctgatccaacggagcacgtcgaagcccagcgcagcacaccagatcagttaccagccaacaaataaggcccattttgacccaagaaataaagcccaattttgcccggcccatgcatgcacccccagcttccacgtagacccatggctgccaccacacccatatccacgtgcatatatgcttgccagctcgtcccttccccggcatccaaatcctcgtacacgccatcccctcgccatggatggcatggccaagaaaccgacgagctccacctactccccccccccaaaaaacgacccgatcggcgtcgcgcccgccgcgtagcagttgcaccgcgcgccgccgctacccgccaactcacacctaccaccctcccccctcccccgcgcgcgacgtgggctcgctgcatgagcccatggcggacacgtcgcctcgccacctcccccccgccgccgccctccgccgagcttaaatgcacccccgcttccgcctcctccaacgccattccccaccaccacctgtcgacggcgtacgactactatctcggtgctttgttgctagcttcttccagctagcca

SEQ ID NO: 22888 - DNA, 1501 bp, Oryza sativa
taacaaaggatggcatagtagggtttcatttgcataaacagcatttaataaacatttcagaatttaataaaatagttaagtagtaattaaacaatattaatccaacgctatacaacataccctgttgcataggcccaaccattctgaacaactatcccggctgcacagttctatctccaaaccaggaatataccattccaaaccaggagctaatcaaattattaccagttatagcatcttttattatggtgagaagtgtgaaactaatcacgaaagacattgttagacccgcccataaccgcgggcacggctattcgaatagttttactctggtcagaggtgtaccactgtacccacaagacacagccccacaacatgtcaccatgcgcctcaataccaccacggtacctcagaaaggagctgtgacagtacccctcgcacaacacaatccaccacagcgcaccattcctggatcataatcacccccttataaacaaggcatggactccccagcgacccccgtgggcttatctccgccacttctcagtctggtgccccgcaatgaaccatgctatacaaaaggtaaagctgttgcccacgctggcttgtggttggcacggttaatatctcacaaccgaaactcatgaaccggtccttaattgtcatgagcacgaccatcaaaaccatgtgctcacaacccaccattatcaggttttagttggcaaattaattaattaaccaatcatgattaaccatcatgagctatcattaagccatcattaaataatagtgagtcataagttatcccaatagtgtgctaatgtttctaagcatggctaagcaatcatatctaatatctagctgaaccaatatataaagcccaactagtcaagttataataacccaaggtatcaaggaataaagtaatcaagaacaaaaaggctataacaaacaataggttaattccaccccatgacattcgaaaataaatgcaatagttgaatagaaacaatagctttaaatgggatcaacatgctcaaaaggttgtttgggatctgtgtgacttgccttgctggccttggaactcttcaaaatcttctcctgcaaactcagactctccaggaacgtcggaatctaaagagaaaagagctaaatcaccaaaacagcacataaacaagcatgaacagtacatgtggatatttttaacatgtagatctcaattttagaaaaatttagagacttgaaccaactaaatccgagctaagatgaattagttatgaattttcaatgattaaatcagattaaatcatttatatggattttaattgaattatgacgcaataatgcattatttttgaaaaggaaaagggtattattgcgtcagcggctagggttcgcggtggatcgggtgcacggcggtggctcacggaaacgaacggccgagatcgatcctatccacaacggacggccaagatctaacggtctacgaccggtctacgac

SEQ ID NO: 22889 - DNA, 415 bp, Oryza sativa
cctactccggcgtgttcagcaagctccgtggtaggggggtcctcccgacagagaaagggtgttctgtggatggatctcgatccgggcttggtatcacttgtttttctttcctaaatcactgcgggcatcgtacatagtactgtgacacaaataaaactcttcccgaaccttcaccatgccatatgagcttagttggaggctaggaaccacagttttaagatcacgcgtagggcatgggctaacagtacttaagccctgctccaacaaaattaaaggtcaacacggcacgttgggtgggtgatgatggtccgctccatgtacggcaccctttggatcctctcggctgcacgcatgcggccacccgcagtgcttgtgcatgattctcccagttcatgaattcccactcccacaacga

SEQ ID NO: 22890 - DNA, 204 bp, Oryza sativa
cgattttcaaagaatttcagaaaggatttgcactaaaaatacaagggacgtcatacaaagtttcttgaacgaatcataattcagaagtgaactagaataccattaccacctgagtacgagatgcccaatttgaagggagcttccgacttttgtgaagaggaggcgtcaatcccgtgcccggagtggactaatccgacgcctcca

SEQ ID NO: 22891 - DNA, 1501 bp, Oryza sativa
gaaggaaatggtaaatacataagtggagctaaccagtaacaacccagcggtcagaacactgcaaatgtatcaaggtgcaattatgattttttactgacatgaatgaatttctaatgtggacttcaagctttaaactaattgggtatgacttccccctgaataactttaggagcagttaaatcaactaactttggtcaatagcaggttgctgactattattcatggtcgggggcctgtagttcattgatgggggaacttcatcaagtccaatttctcgttcaagagtgctcctgaactcccttgaaacatcctatatgcggaaaaaagagacacgttacatatgtatcaaggaatcacatcagacaagtcacaaaccaacctgtagctctctaatggttggctggaaagcacgcaaagtcttccccaaattcctggctacctgcatacaagcaagcaagtgagacctaacagttcgtaatgatagaaaggttggcaggaagtacatgctcattttcattcacagtaaaataaagcagaacaacaacatgacatatttaaagtgaagaaaacaacaacataaaatatttcctgcaaggctttttcttttctgtatgtagtgtgtgctttcaaacctttgcagaaaacctaccacgatctggcagtacatgcaacaggttaagaaactataggcgattagaatatggtgctaatgctgagggtttagtgaagaattagctagaataggaagccggacaacagcaaaaatatgatgtccaggtttgttgggaaagagtttacctctgctagtcctttgggaccaaagactaacagagcaaccactccaatgaccagagcttcgggagctccaactccaaataaagaagcataaacacccgttccacgacttgttcttttgctctctacattgaagaagtcaaagaaacacaaaggctgtgagatgcctaatttggcaaagaattatggaacagcacgatacgaatacaggcatagtaaatatagtaaagggaatatccttcatccagctatataaagcaggaaggtagatgggcagttatagcggcgaagacaaattagatgggtataagaaatcctgatctcttcctttcctagtctttagctttcctgtttttcatacaaagatggtagtgtgttgacgtctaattccagcccaagagaaaatttgtagatgaggttaggaatggtagttatggaaacgaaggaagaagtggcgagcagccaggtgatcccaggcattttcccgagcttatggtgggcagcagctgagcctgagcagcacaaggacaaaaaatgttgaatgccgcccaatttgtgcactgtatagagcttgtgacaagagttgctatttccatccaagatatgatgaatacttttgacggatagtaatacaaagaataaggagtacaactaaaaggtaattagatactactactaaatgaatccaaacaatcaaatcaatcaa

SEQ ID NO: 22892 - DNA, 1501 bp, Oryza sativa
gtgtgatagttttggtgtaaagttacaattaacgatggtactttttttgttaattctgttggccaagcatgattgcaacggttaatcaaagttcttcatcagcgccactagtacatcaacaccttgatctcaaatcactctgcaatgtgtaggctactttttttctctcccatgcttttcgtgccgtttagttaattattttttcttttttcccttaactagcacgaggtaaaatccggagtatatatgtaccacgtgtcacatggacaagggctagatctaattaggatctgtgggatttacttcagttttttttttttgctgtcttctgaaatacacacggaccgttaattattttaatgtattcatttctaatggagagatattactttatacaaaacgatctcgcccttaggccaccctgcaatatttaaattcgaataaattttgactaaattaaaacatattccatgaaatttaaaacttgtgccaaattacgaaatgagaattgaggaaaaaatgaaacaaattgaacaaatattcgtgaaatttaaatttttgtaccttgtctaatttccacatttggaggcggtttttgaattttgaaaataagtttaaattcagcaaatgtatattgatttgtttatatccaaatcttacatgatgcccaaggatagaaccgttgtttgtaaagtttatctcttcattggaaaatatatatactacaataatggttgaagtgtagtactccctccttccctaaatgtttgacgccgttgacttttttaaacatgtttgaccgttcgtctaattcaaaaaattttgtgaaatatgtaaaactatatgtatacataaaagtatatttaacaatgaatcaaatggtaggaaaagaattaataattacttaaattttttgaataagacgaacggtcaacatgtttaaaaaaatcaacagcgtcaaacatttagggatggagggagcacattttagccaacaaccacaaaaatgtcctaagccaaaaccataaaagggtgtcatatgtagcaaacaagtgtgtatccgagcaaattttaccatatgtttgcttatgcttatacttatcagccaaaaattaaattttcaaccttaaatttagaactgattttgagggttttttttatcgaagtttattttttaacctttgcttttaaattgttaagaacacgtatataaagttttattacaaattaattttcgtttgcaaatatgtcgtttcgttttgtggagattatgggtaccccatacccacacggcatggttatccgactagttataggggataacttatatctatgtaatatgtaaaagatcatgacttgggtgttacgtttccttgtatattacggaacggcctaaagtcctgatttaagaaaccgataccgtattggttaaggtttctatcttgtaatcctgccccccatcctatataaggtgggcaggaggccctctagggggcatata

SEQ ID NO: 22893 - DNA, 1501 bp, Oryza sativa
acaatatgcgaagtgtggattaaagttctgatcaatctaatcaaaacctatgatattcaaatatgtgagtaatgactaatttcgcggtaggtcaagtatttaaatgtttccatccactctttggaaggttagctttcaacctttcagacctatcttggatcatgagtatctgttgatgcgaaaacacgatggcctcgaagatttgcttaacttcagtgtaggtccaaagcttcaggttcagggcatgccagttgatttgatcctgcaaccaataagatagactatagcaaacattagaagatgatagccaatcagctgatgttgtatctgtggggacacccgataaagtcatggtgcccccacgaatacgtaaccgcctaggatgttcaattatgcatgaaatgatataaaagcataaacttcgattatacattacttaagtcacttagttcacaacacaacataaatacaaaccattacatatatggcctataaatccttatttctacaaacagataaactactagactccaccacaggaactgcctgatcatagaatgacctagaaaccatagctgtcccatctaacaagtcaacgggatctccacaagcatcttcctcctcatgatctgaacccatttatgaatacaaaaggtactcaacaagacatgcttatgatagcaaatacaataattgcaatataaaacatgccatattaagagcaggaaggtttaaaccctaaccttaacaattatttcatagagcctatcttaattatcatttgatataaacaacactattgaacatttaatcttaaaaataataacgggcataaaaatataaatgttacttataaataacttgaatagaacatcaagtaataaataagttgaccatattaattaatagccatttagtttaacttgtggccacaatctggtatacccatagacacatctccattaactgggagcacgtcgtattcgaatactctacgactctgcagcgtctgcccagctttacccacacgatatccacaggctgaaaagtaacaaggtgtaatattgctccatatatctctcttttctgcttagtaagttaaaggatgctcgggtcgttactcggagtgatccggtccgaggtgtgtaccaacctacctccgcatccacttaccattgttcgttactgggtggacagcccagaacttcatgggcccatagggcagttctaaactctcgggcccatcaagcccacatatataaatcatataaacataaaccatgtcactttgcttcacacttgaaatctaatggccagtacaccgaaaggcctatagaagttcaatcaattggagcaatatacggctaggttcgacaaattgatcgtgtggatgggcgaaactatgtcattcttattgacacaagggggctgattattatatcaattttaaataagaaataaccataaatatatccatatattcaacacgaccataaacagg

SEQ ID NO: 22894 - DNA, 319 bp, Oryza sativa
ccccatttgaacaatttgcttctattttttttcccttttgagttcttccgtttcgactagtttttccaagtgttaatgacggcaaagtctctgtgtgtaactttgtataaatataaggagacttaagccaatttggtaatgccataatgtacaaatttgaatctgattgaaattcgccaaattgaaacccgacggcttaaacccacgcggcccgcggccacacggcccataccccacaaccagaacatgatagcgtcgaggacgcccgtctcgctccacagcctcctcgtcgccggcggccacggaaagcgatgcgtcg

SEQ ID NO: 22895 - DNA, 1501 bp, Oryza sativa
atcccgagtggtttgaaagggttcctcttcctaatcggtttaaaatccctgatttctccaagttctcaggacaagagggcgtgtcgacttatgagcacatcagccgataccttgctcagtgtggtgaagcatcggctgtggacgccttgagagttaggatgttccgattatcattatccgggtcagcttttacttggttttcatctttgccatatgggtcggtcaatagttgggccgatttagagaagcaattccacagctatttctacaacggggtccacgagatgaagttgtctgacttaacggcgatcaagcaaaggtatgatgaacccgtacacgagtatatccagaggttcagagaggtgaggaacaagtgctttagcttgagtttgaccgatgcccagttagccgatctagccttccagggtatgattcctccgatcagggagaaattctcgtccgaagacttcaatagtttgtcgcatctgatacaaaaggtaaccttgcatgagcataggtcggctgacgtcaggagaagctccaggaaggttaatcacgtttgcccgtatacgtatggatcggacgatgaagacgatgattctgagatagctgcagtcgaatgggtgaggagcaaaaaggttataccatgtcaatgggtgaaaagtcctgggaaggaggaaaagtatgacttcgatatcaccaaagccgataagattttcgatttgctactccgagagaagcagattcagctccctcctagccatatgatcccatcggctgaagttattaggcaagaggagatattgtaaatggcataattctgggtctcattctactaatgattgcaaggtctttagatagcaaatccaggtagccatcgaaggggggaagattaagtttgacgattccaagaagccgatgaaggtcgatggaaatccttttcccgacaacatggtacatacagctagtcaagcagccggtggagctaagattattaacaagtatcaaaggaagtatgataagcagcaggcgaggcgttatgaagagaacaacaatggtttcgatcctcattgggattgtgagttctttagattcttctgcaacgaaggaatgaggttgccatctattgaaaactgtcctgggtgcagtgacgtcattgagagctcaagccgaccacataatcagggtgatcggccaagacagacaagacttcctgttcatcaaagattgggtccgatgagtcaagatcatggtcaagaagatgaagggactaggaagaatcaatggtgtccctctggtatttacacaaaaaatcagaaaaggagggtccagagattgaggagcagggaacgttttcaagaggttgaagagggaatcaatcatcggctgaggaaaccaagaccaaggcaggtgtggcgtgttaagaatcaagctcctacagccgatgatgctgcagccgatgaagcgaagaggttggcaaaaggaaagagtgttgttacag

SEQ ID NO: 22896 - DNA, 1501 bp, Oryza sativa
gggtaaaagttttgcttaagcggggaaaacggaagtcacggtgtgagatctcggggataacggttagtatttgaagcactagagtaacaatcgggaaaatgttagagtgcgaaacttgttcggagtcgatacacggcaaatccggaacattaccaaatatcccggacttggggggcatgtgttaacgaccaaatttggtaatatcagtatcggagatgaagatgaaatcgaaggagaatcgaagataggggtttttccgaaaacagagtaagaatcggctggagtccggatcggctatgactgggatcggctaatctgagttggactggttaagtgatacagccgattccgacaatatgacccatgtgcgacattgggtttgagttgatgtgcttcaagatgattgccacgcatagatagagtcctgagaaggcaattgtatctattaattaggatattttatgtaaattccttagagatatgttcgggcaaaagtctgccgcaaagacttacaatatcttagagtttgttagagataagagtcgtgttcaatatggacatatcttgtattcctcggatataaatagaccccgagccctatgtaaaaaaaaacacaacacacatccaatacaattccggcgcatcgccaccttttgctttagttttatttcgacgagttcttgctttcaggttgagctgcaccggtttcgatcttcaacaagaggtaaaactcgtcgtgacgaattatgttcttagggattagtgcttccatcttcatgacactctaatctcgtttatataattcgccgagttatcatatatcttatataatctatagcaatatcgctatctaacccacaatcggctaacatatattaacagacggcaaccgattgggttaaatgttgacattgatctagattatataagatatctaccattctatgaatcttctagtggcttgattgtctagatatcattcttcttttcatacttaatgctgcatcaattgagtttgatctattgagtcgtgcttagaatattgatctccagcctgccacctagttgtcgattagaatagcatcggagtttcagccgatcgtatctgatttaactataattatttcaatttgcttcactgatatgttaaatttgccctttatgccaagatattgctgtatttgaatatattaggcatttgcttgatattctatgcctgttttaatatcctgacataaggtagtatcgaggtatttgctgatacatgctagatctatatgatcggctatgctgtaagcttatatagtcttgttattaatatatatttcggtctaagtgattcatactgtctcggcatggcgaccgatctatcccagtcacttgatttaagtatatatcgatataaggagtatatatcgctaacatctacagctgatcaagtaggtttagttttcttccttatttattcacgattgtcgatcaatgcacagatgacattggc

SEQ ID NO: 22897 - DNA, 1031 bp, Oryza sativa
ctattacagtatttaacatcaagtaaaggacgcttgtgaaagatttattgtgccaacctaattaagaacatgcactaaatatactcatctaatcgtgtacacaaaccgataaatcctttgtgtgaactgtgtagtgcaaactgatcagaaaaacaaaattgatttggctttcagttcttggtacaacaaaacaagagaacaacaatgtaaacatttgtgattgaacaagtaagttctttcacaaatgcataaaaattataagtacttgtcaaataattcgaggtgcagtaaattagactgcaattcttcctattacattgtgatgctgaatacaaaaatctacagtttttgtagcgagacataattattattattactaggtgaaaccccgcgcattgctgtgggaatttagtatgataacagtaaaaaaaataacatgtaagatagctagataacataagattaagtaaattaatgtggtttatgataatttaaatttaaatagtatgtagaatggtgattcaaacgtaaaaagtaaggtggtatgactttatggaagaagaaaagtagggagatagtttggaccatagattaatcatctaaaggctaaaaacaattgatgtgatatgacttaattagaggaaaaaatgagaaagataatttggaccatagattaatcatttaagcactaactaagtgaggatgaactatataaatatataggatatcataaaacataataaagatatatattaaaacattttgtgaattattttggatgataatttaacatgtttgtatttgaaaagctcttaaattataaaaactatattgcatgatgtttaaatgtgatgattgttagtggatgataatgtggcatcttgttaattagtggatgatgatgtggcatcttgttagtggacgatgatgtggcatctttgcatgataagcttaaggagtttgtggggataactttatagtaagatatgattaaaaaggggaataaataagatattcgggggtaattttat

SEQ ID NO: 22898 - DNA, 1501 bp, Oryza sativa
ctctctattgagttgcatgcaccgaccagttcaacccaaaagcttaactaaggtgggcaatccactttatattccaacactatctactcaactctccaagctaaaaatttggcaaatgaaccaaatacactcctccaacagactctccattcaactctccaagccaactgcctctccatccaagcccacccactggccaatattggccagcctcctagtctagctatctctccagctctcctctactcgtgcttctctcctctccctctagctccactgccacgccacatttttgtcgtcagggtcaccgcggcgccgcctctccgtcaacggcatcgttgtgccgtctctccatgttgccatcgtcgcctatgggaggagcgtcatcgtcgtctccttacaccgggaggagcgccgccgtcttccccctccttcctccgcggccgtcatcccccgagccaaggagcgctgatgctatccacatctcgatctgccaccagcctcgcctcatcactccgtccaccaccggcctcgacgagggagaggattggagagaggggaaggaagaagaaagctcgagaaggggaaagaaaacacgcctgtctcgcgtggtcgtcgtcgcgagccgctgccgccaccatcgctagccgccgccgccccgtcgtcgctgcgcacggcaaccgtcgctgcgcccgaagactgctaccccgccgtcgccgcgtgcggccacactgccgcaagcaaaaaggggattggggaagagagggagcaggataatgagaaagaaagtggtatagaggctgacatatgggtcccgctgtcatagactcagaatagagaggatgaatggagaggctgttagagaaaacaatgaatttgacttgctaaattaaatggagagttagctaaatatatatttgaagagactgttggagggcaacatatcctatgcacacaggccctcacgtgtacacacgtgcacaccaactaaaaaatgtcaccaaaaaatctagaaaaaatcatacacatacttttaattgtattacacctagagttaaaatcttaacgtcaaattcattatattttagccgtaacaaaaaaaacaaaaaatctgacaattttaaggttgcaattttgtcagaattttatcttttttgttattctctatgtagaatgaatttgaagatgcgactttgcacgtagatgtaatactattgaaagtacatgtatgaattttcctagaattttttatgataatttttagttggtgtacacgatgtgtacacgcgagggcctgtgtgtataagatacgctcccctgttggagatgctctaattaagatgctagacccatccatgtcgtccttttcccatagatgctttcactagctacttaattatctaacagcaatgcatcatgtacgatgtttgatggtagcatatatatatatatatatatatatatatatatatatatatatatatatatatatatatatata

SEQ ID NO: 22899 - DNA, 1068 bp, Oryza sativa
  unsure (1)..(1068): unsure at all n locations
ttcgccgtcgtcctgctgcttccgccgcatccatcccggtgagcagtcacatcctccgccaccgccgcntgcgccgatcnccatccatccctccagcgagcagggcgggcgccgtcgttcctcctgctgcttccgcccgcatccatcctggtcactggtgagcacatcctccgccaccgccgcntgcgcttgcgccgatcctcatccatagcgcgagcgagcgttcctcctgctgcttccaccgcatccgttacgcacatcctcactttttttctcgaatttgcgttaaccctagcttctgttctagaaatttgcctcaaccttaatactaaaacagtttgatggttcccaaaaagtttcccatgttaagaaagcttggttacgcactaggatttcatgatttgtctatctctttgcaccaccaaaggcaccaagctgatatcctggttgcagcagcaccatgggtggagaagatgagtttcgcagtgttaaaaatgatctagtgatgggggttctgatggcaaaaggatgacttggggcattttggggtgaaggaaggctaggcacaaaccctcttgagaggacagtggtgggttatagctcatgtttaggtttgttctaagggatggtatttatcacacctggacaatacgattttggtaaacctttctagctagatttttggttctagaaagggaataagttgaatgttgtgaggatcattgatgatttggaccacttgtgccgttaactctcctagcgcataaagcttatgtttccctaaatgcaaccgaccagttagatgaagggttgttactatgaattgatatacataacttgtatttgaggtgaacatgttaactcgaacaattacatattgcatggtttctgtgacaaactgtatacatcatcctagtataatgaacaagcttagcacaacttgaatcttgggtcatgttttgccttggttcaaaggtttgcatcatgtcatcaatatgtcatataaagtgtaaaattgtttgtggaatgctagaccttagctattttcttttatattgccagtgaaaa

SEQ ID NO: 22900 - DNA, 1501 bp, Oryza sativa
cttttttgaagccataagacaatctaacacttttaagccaaaagctaggttggagaagcttttttgacttatttgacttaggacaataaatccaccggcataaatcatataagccaataagctgacttaaaagtttaatccaacaaacctataaacctaaacaaagagggcctaagtatagtatatataagtagcattagtcagtggcggattcatgcttaatctatgggatcggttgaccctagcttttccaaaaacaccccaacaaatcatgattctcgtgtataattttttttaaaaaaaatagagaaatgtcatcacttaaatataaaccagtagtaattgatctcacattgtaaaattccctggtactagtactacttattggtatcttgaacaaattattacctttccccaaacaatagaggcgttgtaggtctaaaattcttgatgaatgaattccaggctaaaatgttggctaagcatgtgaaatataagatgaattttgagctaaaatttgtcatgctaatcgtaacttaagatgcattggaaataggtgtaagagcggttcacaagagagcgtacaggttacttcctatgaggattcgctctaataactacataagttattgtagcggatcctctttacttgtggagtaataagtagttggtgatacgtgttagccacgaggcatatattctataataatacagtgtcttgtttcgattgtaaagtgaatttgaacaagcacaatttctaaggtgaatttggataaacacttgttcagatatatcctaaaaggttgatttttttatttcagagaaggagggtataaggatatttattagaggtatttcatcaacaaaattaacccacatacagcacagtaacaattttatattgagtttattattacaaagccaccaaccagcatatatgcccaacgatttcgctatatctcactcgaaagattttttcttatctctcactcaaatttacagtgtgttttcttgtaagttacagtgtaattttttaatcttcacatgtaagttttaaaatttatattggatatggtctttttcttgcagatatggtaatttagtgtctattatggtatttttttaattgcttttatattttactgtatttattagattttaattaaaaattaaaaatctgtgtaggtactccaactccgtgtgcccaaaaatgagcgtgagcccaactcgccacaatcctccaaccacccctagacacgtgtccagagaatctctaaccgatcagtcgaagacgctccattacactgacaaattggccccacatgtcagtgactgggccttgctcgatatatccgcgccatggcttccgctgtgcagttgcttttgcttcgtctacctctcgccgccgttttccccccaaaacccgcgacgacgaaaaccctagccgtcgccggaatgtcgaaggccgaggccgccgccgccggcgacgccgccaagcccg

SEQ ID NO: 22901 - DNA, 182 bp, Oryza sativa
ttgttttgtgtcagaaatgttactatttttttaataaacttggtaaaatttttaaaagtttgacaaaatcagtttagatagttttcggtatccgatcttattttcggaaaatgatatctcaaacgaataatttttatttagtaccagatacggaaatgaatacatattgcttttctcagaaa

SEQ ID NO: 22902 - DNA, 334 bp, Oryza sativa
ccaaattcctgtgctgtttaattctctagcattgcagatctgccttatatatttttggggttacattttgttgttttacaactttatagatattttaaatacaatattaaatatgttatttttttattaatattggttccattcaatttgagactaaatgttagtttcatgcagaaaatgcaaacactgctagaagatgttgaaagatccagaatgaagacttaatactgatgaatcccctaatgatttttatcaaaatcattaagttaaggtagatacacatcttgtcatatgatcaaatggtttcgccaaaaatcataatcagacaacaaaa

SEQ ID NO: 22903 - DNA, 769 bp, Oryza sativa
tgctgtttatcttgaagcttttaccttaataagatgtaaatgctagagattcctatgctaattgtgaaataagaaataacttgaaatcctcacaataatccgaggaatgaagatctgaggcatacaatttctgtttcgcaacatggaacttgtttagctatgtctcccgtactcatgatccaaaaaagtatcgaaaggaacaaacaaaaatttcacttttcaccaaccaatttctcaattggagataacatactgcttggattagtactctacacgagacgaggtctaattattggaggcacaaatcgaagtaaagaagaaataatatgatttaaagagacatacatcaattgactctgaaaatagtcgcgaaataaaataaccaagcaaagcaattgtcatgcatgcagtaatgtgcagtggcacacatcttgaataaacagaaaagatatccggcaaaagttttttgcgaacgcgcaaaaggattgcacgtcaatatattagcaggaaaagagtttttgttacacaaagcaatcagctagactggcttatgcctaaagggggggggggacttgaagctaggaactactacgacggttaaaaacgcaactccaaacagcgggagggggcagagccacgctacactcccaagaaatccccaaaacaagcaacaccggctaaagaccacagctggccctccgagcggaaggactctagaaccactgcgaccgaagcgagcgcagagtcgaaaaccctggagtttcgttcc

SEQ ID NO: 22904 - DNA, 1501 bp, Oryza sativa
gtggtcttacctacgtggcacgccacgtggacgatgacatggtgtttttttttctttctctttttctttttcctcctattcttttatcttcttcctccactagagctacctcgagctcccccgtgtcaaagaggccgaagaagagagaaatgaaagaggaagaagagagaaaaaaaggaataataataataatgtgccatgtcgtcatctacatgtcatgtcaaatggacaagaccacggtcaaatgagactttggaccgggataatataataaatcaagtttagggacctcgatacatgctttgtaagtttgtggatctaaatgaaacctgcttacaagtttaagaaccgcaagtgcaatttactttaaaaaaattaggtacattctattctgtcacttgggacataaaaaggtgctatgtctgaaacatcgatgcctataaaaggagcgttaattgtaaagctaggatagtcgatggtggagaagctaatgacaacgttaagctatgatgagcttttattagctatcagtaggtttttattaatttcagataatggattaattaaaaccacgtgacctctacgtccaaacaaaatgtaacttgacaaaacctagtattatatggacagtttttagtagccgatggccgtggtgtttgcattaaacctaagcgaacacctctgcacaatcgatgttcacgtggttaactattcaaatatgacctaaatcccgaaccaaccgttaccacgaaattcagttaattaaccaaatattttcctggttataatcttcagtgttataacatttttcccctgatataaaacttcgcactatggtgcgggtcgtttcggaaaaaaaataaaagaaactttttttcagcccaataccatcgcacacacaaatcatcaaagagattaattgggaaatcaacaaatataggtaagtaaatcttgagaagagatgaaatgaaattacagttgggtatgacacatgggaggaaggggaactgcaggttgccgaggtggtagcggctccacccggggttgcacctgcacgcgaacccgaacacgtagtcgctcgactcgctgcagctccccatcccgcacctcaccttgctgcacctactcccatctccatctgcaaccaaccatgcaaccaagcagcaattcaaccaccaaaaaattcagacaagaaaaggagagaggaacacccatcgatcatgcactcaattagctagcttgcagtactattcaggcattcagctgctcactttgtgctcctgctccatctggcagcatggcgatcatggcctgcagagaaaccatcacaagaactaatctgactctgctgcacttcatcgtctctaatttcagagagttcagagagagagagagagagagaaggaaggtaagctttgtttgcaggaagataggaggatgtagtggcgacttatatatttttggcgtgatgtcgatcgcaatggcgcttggaactaaatta

SEQ ID NO: 22905 - DNA, 1501 bp, Oryza sativa
aagctctcctatcggagagagccatggccatctatctcctgctcaatttattcctctcccctccctcgcgtacacattcgtgtgtgcacgcgcgcgagcagcacagcactagctctaggtcgatcgaccatggaaaccctagctagctataccctacacccggcgaagcagtatcttaattacgttacctttaattacactgcctggaggatggcttcggcggccaccgtggcccatccatggcggcgctcgtggcagtctcgcatgcaccgctgcctctcgtgccactcgcggtggtgctggcattgcctccggcagtggtcgccgccatggccgccgccgccgccgtggtggttgtcatcgtcgacgacgtcgtcttcctcctggcgcctgtacctgcagtcctgcatgcattgctgcctcttccattggtcgtggtggtgctggcatcgcttgcggcagtgttgctctctctcgccgccgtagttgtggtcttcttcctcgtcgacggcggcctcttcctcctcctggcgccgccactgcctgcagtcttgcatgcattgttgcttcttccattggtcatggtggtgttggcactgcttgcggcattgctgatcgccatggccgtcttcttcctcgacgacgtcgtcttcttggcggtgatggtacctgcaatcttggatgcactgctgcttcttccactggtcatggtggtgctggcactgcttgcggcagcgatcgccgccgtggttgtcgtcttcctcgtcgacgtcgacggcggcgtcttgttggcgctggtggtatctgcactcctccatgcattgttgcttcttccactggtcgtggtggtggcggcactgcttgtagcaggggtctctgccatggtggttgtcgtcgtcggcgtcgacctcctgtcgccggtggcggcagtccatgaggcagcgctgcttctcccaccagtcctgctggtgctcgcactgctcacggcagtccggcctggatccgccatggccgccgccgtggtggtgctgctcgtggcggcgccactcgcactgcctcatgcactcctgcttccgccacggctcgtcgcggtagccacggcactcgcggcggcactccttgccgccgccgccgtgcgtgttctcgtcgtcgtcgtcgtcctcctgctgccgctggagacactgctcctcgcactccctcagctgccgctggtcctgcccggcctcccaccggcactgcttcttgcaccaccggagctcctccttcgggtcccgccgaccctcctcctccgccgccgccgccgccacggccaccaggagcagcccggcggcgagcaggaggagcgcgccaccacctttccacttcacacccatggctagctggaagaagctagcaacaaagcaccgagatagtagtcgtacgccgtcgacaggtggtggtggggaatggcgttggaggaggcggaagcgggggtgcatttaagctcggcggagggcggcgg

SEQ ID NO: 22906 - DNA, 1501 bp, Oryza sativa; identical to SEQ ID NO: 22858

SEQ ID NO: 22907 - DNA, 240 bp, Oryza sativa
cgttgatcaggggaagggggcgatggagttagtggtggacgacggggtggtgaacgccttctgggacggcggcggaggcggcgcaagctcttccccggtgatggccgccgtctcggggtttattgaggagccggacggcggtaattcctccgtcgcagacgcagcgccgccgccggagcacggaggtgcgtctgtcgtcggacgggatggctccgcggcggcgccggcggcggccgcagg

SEQ ID NO: 22908 - DNA, 1501 bp, Oryza sativa
ccgcatgttatgttaggaccaggcctcgatcgccaagctccggctgcaggtccagcatggggccgcgtgcgttagtgtacaaccatatatcaattgtatttatcgacctttaccaaccatatatcaatttttattgggtgtagctatatttatggtgctatattttttataaaaaaatagtcggcatgtatttacattgtaagtccctaaattacatatgtaattttagtgtatttacaatgtaagtcttaaaattacatatgtaatgtaaatttgaaaattacatactaattacatatataagtgaggtgtaaatgaggtgtaactactgcgtaagtggctgaaaaaaagtcgactgtagcatatggcgccatatttctagcaactccgtataatatatagctcatgcatggaacccaatatatcttactactcatctgtgttgacagtacgtatttgccaaagtatcttttgtcggtcctgttttatcatgtgtttactagctgtttaattctttgacgggcacaaaactttaaaaacggaccatttaatatgcacaattaaaattgttttcacccgttgcaacgcacgagcatttatgctagtaatatataaaaatttaattcttccttataaactaaacgtcgggattttattttattatctaacaaactgatcgatccattcatcaagttttatctgtatttcatataagaagcaatccataattatcatattagattcccttctatcaactcagcatattgaagatctaatgtgaccatgcctacgacggatataaccattgatcatatcatatacccacaggtggtctcgtttcataacaagtgccaaattaatctaatcaagaatacgacactacctcataatgtatgcgtttatatgttcatgaccaatccacttatttggggctacatatggaagataaacacgatggccatggtgcatgcagagatggagatgaattgttgtttaattggaattattagaaatgattttaaaagcctagaagagaagatctaattttaaataataaattccaatataaaatggggccagataaaatttcattaaatactttgcttgattctatagttcctagagttttctgggatttatttgagccaaggaagtatttttaataaatggaattgcatttcatgaataatttaaattggaaaatattttaaaagtcctcttttggctttgggccgaaagtcggcccaaaaccttccctctctctcctctttggcctagtcagcccgcagccgcccgcgcgcgcgcgctcggtcgctgacaggtgggtcccacctgtcggactcgtcgtcctcctcgcaccgaaaccctagccgcgccgcgccgccgccacctttccaattcggccgcatctttcccgatccggtgaaatcgtttgaggggaaatgctccccggaatctcctctaccttttttccttttggaatcgatcgccaattcggttt

SEQ ID NO: 22909 - DNA, 186 bp, Oryza sativa
tgtatgcttcttgaatttattcaataacttgagcctcactgggcactacctggtgcaattaagcatatgagtttttcaccaccttcaggccctaggaattcttgtttcctgcttaatttctaacttgcctatagctcagaaagaccgaaactatcccttcaaattcaaaatatgttccattgcagg

SEQ ID NO: 22910 - DNA, 1501 bp, Oryza sativa
atggtaccactagtatgattttaggtagatgcttcgctgtttaattaggtaacattaggtgattttacaactctagactttgggaatattctcatcacctggacacactggaattgttggatttctgtggaattggattcacacctcccctcttttcaaaatccccaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggatggagatggacgaagtcgggggtcgatggacatctctaggacaaatgaaggctacacgagctgcggcccggtagtcgagatgtcatggcacagggccggtgtcctgctgctaggggctcagtcctgcctacctgtcccgggggttccggccgtaggtgggattgggtcggtactcttgtctatggctaggatgggttggaaactatgtcacgtcttccgtctgtataccgtggtggtatgtggcacgtggttacacgtgaggaagatgtgtcttgtgggtaaagatgtacacctctgatcagagtataacctattcgaatagccgcgccctcggttatgggcaagccgagcaatgtacccaagttagtgttttaatcttaaaacctgcttaacaactaaatgtggaattgttggcctgggttggcttgggacgagctgggacccagggtcgggttgccagttcggtctgactcatcgtaggccttgggttaaggcaggttcgtgtgggttcacggccttgataaataatattgtttagttctagaatcgtgtatgcaaaatagccctgagcaactaaatgtctttaaatgctgattcctgcaaccctaaccctcacagtataacctctatgtactaccttgcattaattctgcacttgtgggtgtgtcttgttgagtacggtggttgtactcagtcttgctcaatttttcccaaccccagaagaggagttcctggaagatgaaggcttcggtgtctagctcgtgcctgccgtcaagtgcctgtggtcgtcgccctagtcttccgctgtttctcgttggtctttgtgtgtgtgctgggccttcgctgcccatgtaataattatctatttacgcttccgcttgttaaactctgaattgtatcaacttttggtgtaccttgcctcctgggacaaggattaatgcacgcacgtaaggaatgcccgttgggttatttccggtcgtgacaagttggtatcaaagcccccttgaccctaggacgagccgtagatcccaagccttagcaatattttcgaaataaaaaccccttcttatttgtgaaaaccctctagtctctctctgtcttgctgcttcatttatcgccaaaatctgacctttaaaatgttgcttttctttttgtttttgtttgtaga

SEQ ID NO: 22911 - DNA, 216 bp, Oryza sativa
tcagaaactattttagtttcagttttcttcttctttttctggttacagatcaagtctaataactgttcctacttttggtcaggggttgtagctttcatgtattcatacagtagctgtactagtatactcctactgatgagaaaggcacacaatgcaagcacggtggtttgtttttttgttttgtttcttccctgcgtttttttttactggccaaga

SEQ ID NO: 22912 - DNA, 467 bp, Oryza sativa
atattatgaagaagatgatggtggttttgatcctcattgggaatgtgagttcttcagattttgttggaatgaaggtatgaggctgccatcaattgaggattgtcttggatgcaacaatgattcagggagttcaagccgatccagcaatagaggtaatcggctgagtcagaagagggtagctgttcatcagaggttgggccctgtgaatcaagattatcgccatgatgaagatgaaaataggaatacacagtggtgtcctacaggcattttcaccaagaatcagaagagaaggatgcaaaggatgaggaacagggagcattttcaggaggtgcaacaggagattaatcatcggctgaggaaaacaaagaccaagcaagagtgacgtgttaagagcacggttgcaacagctgatgagatcgaaggtgacaagacaaaaaggttgcttaagggcaaagctggtacatctg

SEQ ID NO: 22913 - DNA, 406 bp, Oryza sativa
gtgtggcacacggtgcactcaccgaatggcaaaaggctcatgagtcacgatcatggcacgcactgtgttaatcctttctttttctcaactcatctctctctctctcttttcatgttcatttgcttttcaaataattaaatggtactactatgttttttcaaaaattctatataagaaagttgctttaaaaaaatcatatttgtacattttcaagttttttttaagttaatacttaggcctgatttagttcccaaacatttttcccaaaaatgttacatcgaatctttagacacatgcatggagtattaaatacaaataaaaataaaaactaatcatacagtttgcatggaaatcgcgaaacgaatcttctgagcctaattagtccatgattagtcataagtgctac

SEQ ID NO: 22914 - DNA, 984 bp, Oryza sativa
cacgcttttctgatggcccactatgacattcctcctaccatgctttctctttcagctttgttccggcactccccttcttctcgggaggttggtgcgcactgtgcaaggtacagtgatacatcacacacaattcaacatgcccatatacatgatacaagagtacaagacggaccaactttttttactgaacatcagccttcacgcacaacaaactgtggtagctgtcgtggcaagcctgtaccgctgtggtgtttcggctaaccgcgagatagtgcaataaattgttacgtgcgtgatgcgtcagcccgccggtgtgatgacaggctgatcaagggagagcaaaaccaagccccctgacaagagctagatgggcgtctgtcatcagccaacttttggctgacagacacaaacacgtacaatgtatgtatgtatgccttggtacatggcattacacattaggccattaactcgcgcatatctctcagattcagaactaaacgaagccacgccgcgccggcatgcaaaacggcactctgcaccacaggcatgcagcggtgcagttgaaccattcgatcctcaacaaccaccccacccgtgaaacccatcgcaatctgagtagcagcgtgcctgccagtctgccagtgaggactgaggatcttctggaatctggagtacgtttagtttgtacgtagggcctcttcaagaatacgactgaataattccgccccaacaaaacgaaaaagaaaacaaaacgagttgataaagcaagagcagccgaacgagttaatttccaatatatggtttggcacgcgattgctccgtgcgcttaataattaactaacacaagtcctcccgcacgtggccgtggatttggatatatacaaaaaccagacaccccgatcgatcggcctttgctatcgtatagctagctaccagcccaaccaactagtgcgcgagtgagcgcgcggctattgcgtgccaaac

SEQ ID NO: 22915 - DNA, 242 bp, Oryza sativa
tcaccacaaatttagtaaccatcatgtaccgactagagcttaacatcatgatttggttaattattacatcaatgtttttgttgtcttttcaaggtgactcacttgtttttcatagctgatgttgccctccgaaatactaatgactagccaatacaccccagtaaataatcgtttccttatggagcttagccttatgcaatttttgcctttgaccaatggaacccattaatctattctgcagg

SEQ ID NO: 22916 - DNA, 174 bp, Oryza sativa
ttaaatttaaaaactttaaaatttggtttttctttggcttattaggccatccgatgggagcctaatttcctctagccccactgcggtgttttcatttcttgtcaggtaaaacagcaccagtacaaagtttaatttcctctagccccactgcggtgttttcattttcttgtcagg

SEQ ID NO: 22917 - DNA, 1501 bp, Oryza sativa
tctttagattacgagatagctatttaacaatatttaagtaaaatcatattaataaatagatatttcctccgtttcacaatataagtcattctagcatttcccatattcatattgatgttaatgaatctaaatagatatatctatttagattcattatatctatctaaattcattaacatcaatatggacgtgggaaatgctaaaatgacttacattatgaaacagagggagtaattttgtatgggtgctagcagcgcaattgcgcgagccacccatctagtttttcttatataaagttagatgcagaatttaattatcttgtaaaaaggtaattatcttgtattatatattactgtaaagaatataatttaattccactacctctatttctaaaaaaaaatcattgtatcttaaaaaagatctgttggtgttcggtctcagcgtctatagcgtgaacaatcgcgcagtgggcttttttcgacttttgggctagcaagatcacacacaacacgcacatcacgaaccggaccaaacctccgccgccgcccgccgccgccgccgccgcctacacaaccccccctcgccccccgccgcgccctcctctccgtacgtggagcgcatgcaaatcccctcgcgctcgattcttcgcctcctccgacgccccatcgtcgcgccttattctgccctgcggcaccgcatctcgatcccctcccgcgatctctcctctcctccatggctacctctggtccggctcgcgggtggctaccggcgcttgcgcgaagaatcgcttcagtcacggggacgcttaaccctcctgccagtcgtgtttctcggtgtgttctcctgctctgatcctaaagtttgggcctttcgtctcttgctaaagttctcgatatagattctgttgaatttagttttttttttgttagaactatttgttcttatatcatgttggtgttttgagtataactagggaaattatttcaatcccgactgatggcacttgaatcggacgcaaagatttacccttttatgctctttgttcatagatttcctggatctcggaacatggccagcggcagtggagtggaaggcgagggattgggtataccatacaggcgccgcttcatcccatttgccaacgatcctatccacacaaccaaagataatatcatttctatggacaagcaccttcccatcacccaaggcaaggacagtgctgcaactaaggagttcatctcttgttatggccattgccgtcctaccacgtatggcgatgaagatgcttctaggacagctgtggaggtcaccggtggtaaacaagatccaaggggggcagttcagaacctaatagatggtgaagtggcagttcaggagctaatagatggtgaagaaattgcaaggaaccaaagggccagtgaggttagtgacaacgatggatatgaagagttcaatgatcgtgctgttaactaccactgtgactgtcatgtttggacgccac

SEQ ID NO: 22918 - DNA, 556 bp, Oryza sativa
tttaaatggaggtgtttaattttattgggtgaatgtattgtattagttaagatgattcaaacaatgaggtgataataattgtttcttagtctttgggtcaaaggtggttgtgctttatattttggcaatagagggagtaaagttttagcacagttaaattttggaaaggttcattatgtcttcatccctagttaaaaaaagcctctttttgttcatagcaagtttaatagtataggtgactattggctattaatccttattataaataacatgtataataggttaactataaggatggcattatttttttctcccatctctctttctctcactataaaattaataatgaaaatgttttagctcttacatgagagtcaacccttctcacttattttttaatttttcttttatataagtttatagttgacttatagtctactgttatccttgctatcgcggtcttttaccctcatggacaactaccggggcggtgggccgggagcccaggtaacaagaacggcccgtgtctgggtgtggctcccttccaatcgcatcc

SEQ ID NO: 22919 - DNA, 1501 bp, Oryza sativa
taaccgcgcggttaccgtgtttaccggccttaccgcggggtacggtaatagaaaaaccgcggtaacctccttaaatttaaataaattttaaaaataatttgaattttagataaattttgtacggtttcgtacggtttttcacggttaccgcgcttatcgcgcggtaaccgtgcttaccgccagggcgcggtaaccccggccccgacggtttaggaaaccctgttgacaacccgttcttttcacataggatgtcagtttagataagaactcccacatgcttatgaatcctgaagtactacatcgtagtgttcatgtctgttttgtagggtacagtacagtaatttgtgtaattaatgttccaacttccaagcgcttgagagcagaagtttcgtacatcttttttaaaaaaaagaaattcaattctcacaaaatttctccattccaaagtggccttgtacctcagctctgctactcttcttgagtgaaaacagctctaggccttgtttgcaatggatcaattttagacaaactttacaggaattaaactaatccctgcgaaaatcttgcaaaattctaacgctacaaatagggattacaacgggcacccaactgaactataaaaagtgatagtttccgatcctaagtctaaccacatgaaattttgataattctaatttctttcagtgcagtaatgcaatctccaccaaatagttaaattggaaagtataaaaataccaaaccatccaaaaattgtttccgtataaatgatacaatttcaggtttgttcagattggtgttattttaaactatgccattgtttggtgaaattgacgaagatatggatgtatttagtttgttactacctctgttttatattataagttgtttttacctttttcctagtaaaactttttttagttttgaccaaattttagaaaaatatagtgatattttgaacataaaacattctaaccagatatattcaattttgctattaatgaaactaatttgatgttgtaagtgtgtcggtgacatggaaccgggagtatcatgactagaggcttgaggcagacacaatcgcccacgtggcctggcaccctcggggggcgtcgggcccgagggtgatgtgttcgccctcctctttgtctccccgagggggtcggaccgctcccgcctcggccccgagggccgaggcgccccgaccccttgtgggttttgcgccgcgtgtatgggttaggtgagcgcagcggggctcacctaaccgcatttattgcggtttgggtgagcacgtcacgccacacgtaatgcagtacagcgcgctcgtttatccggtctgtgactggtcacagaccggtcagattgcgggttaggtggcgacaggcggtctgacgcacgcctcgccccatcccgtcaggacgagagcctccaagcactcgtccctagccggagccggcgtgttagctcctggagatggcacgttggttccggtcagatatatgcc

SEQ ID NO: 22920 - DNA, 205 bp, Oryza sativa
gcttcgctggttaattaggcaacattaggtggtttacaactctagactttgggaatattcatatcacctggacactatggaatggatggattattgtggaattggattcacccctccccctctattcaaaaccctcaaaatggttttaggctgggcttggggtgcatggttttgatagtagcacctcggccatataaggatcggt

SEQ ID NO: 22921 - DNA, 1501 bp, Oryza sativa
  unsure (1)..(1501): unsure at all n locations
ctgaaagagaatgcatggtaggaggaatgtcatagtgggccatcagaaaatcgtgcatatgggctagtttcgctggacctacaaagaaagaagacgcaccaaccaacgggtttggcaaccggaataaggttatttcaaatcccttaactttaccaacgaannnncaggtggtctttgaccacaaaacttgaatcaacgggtctctcatatgttaaaaccggtacaatataagtcccaagatagtatggcaagaggttttattctacgtggtaatttgacccaagtcaacaacactgagtcagcgtaggctccacatgtccgtggctcttcatctctctctctctctctccaatctcaacggattgttggaggacggcgcccgtcgatttagagtgcgaagcaggaggcctagccgaacatatcggtgaagggctacgacatcatcaatgggatcaagacggagctatagaagatgtgcccagaggtggtgtcgtgcacggatatcgaggcgctcagcacgcgagacaccgtgcacctcgctggggtgcccaattacaccatgcgcctgtgcgcaccaatcgccgtctccaaccacgaggatgacgacggcctccctgggcggacatcgttgtgggccatggaggaaaggatggcggctgatgaggcgaagacggctgctacagtgtcacgccccggactagtaccgaccggaactagcccgtgacgctccaaattaacctgttaatcgataccagtcccaggaaatagtgctggtatcacaggaagacggattatcacagcaacagaggtctctttattatagagtagaggtacagtcatgttgggctacggacagatcccgagctcacaactgcattacaaaagggaaacggaagccaggacttggaccaaacaacacaggcgcgacttgggaactaggccgaaaccctaaaactcatcgtagccggcttgctcctggaagaactcctcatcagcaggatccgcttcatcttcttcagcaactggggggggattatttatatagagcaagggtgagtacggaagtactcagcaagccatgggaaataagtgtttaatgcaggcttcaaggaaaggctgttgtttttgcaattgattttatttgaactcttttctgaaaacaactaagtgagtgcttctcaaacgacacggttgagacagtgcatctcgtccggtcggagtatgtgcaatgtatcagtctttttgaattgattcaaggttggcacccggccaacaactttcaaacggccacccgggcctacaatttcaaacggccacccgggctagctgatcccgtcagctgcagattttccaaacatcgaacccctttccacaacagcaatttcacaagcagtagtcaaacaaaactacgctaggaatcacctcacatccgctcatgaccgtgggcacggctgttcgaacagtttgttaacctctgcagagggggtacactttacccaca

SEQ ID NO: 22922 - DNA, 1119 bp, Oryza sativa
atggagggagtaataaggtgacagcattgtcaagttttaatatgaaaggataaatgtgatgttaccaaaatttcttagatattatcaatgtttggtacttcctctatttcatttcctctatttcatattataagttgttttaatttttttttctaatcaaatatttttaaatttgactaagtttacagaaaaatttaataacactttgacggagcgtggggctcctcaccgggagaccgcgcaggcccccctttgccggttcggccgggggccctgggtgagattctaagctcctagtctatgtgtggaaggttcgcgagaatggaaacacacaagacacgggcgatgtatacaggttcgggccgctgagaagcataataccctactcctgtgttttggtggatctatgtatgaagaagctacaaaagagctggagaaccagagagctcttactctctccctctctgatcgttctggatccgaaaaaatctcctttctaagtgggcaaggtcctccttttatacctcaaggggataccacatgcaccatctctctcttttttgtggggacttatcctatcttttcataaacagacggagacttgtatggttgccgtccgaatgaccttctgatgggacggcccatacctacctccacttccgccggaagcaggcgcgacgtgggaacatggctgtctgctgacgacatgaccagtgtcagaccggtcacaaatcggtcattcttgtccaccacgtgtcagtttaacaatctgcatgttcgcccttcttcatacaatatcttgcctgtaatggttaggatgaagcctggcatatatctgaccggaaccaacgtgccatctccaggagctaacacgccggctccggctagggacgagtgcttggaggctctcgtcctgacgggatggggcgaggcgtgcgtcagaccgcctgtcgccacctaacccgcaatctgaccggtctgtgaccagtcacagaccggataaacgagcgcgctgtactgcattacgtgtggcgtgacgtgctcacccaaaccgcaataaatgcggttaggtgagccccgctgcgctcacctaacccatacacgcggcgcaaaacccac

SEQ ID NO: 22923 - DNA, 1501 bp, Oryza sativa
ccttgatgaataatagtgtatagttctagaatcgtgtttacaaaatagctttgagcaactaaatgtctttaaatgctgtttactgcaaccctaaccctttatagtataattcccttgtactcccttgcatttattctgcagttgcgggtgtgtcttgttaagtacggtggttgtactcagtcttgctcaatttttcccaaccccagaagaggagttccttgaagatgaaggctttggtgtctagctcgtgcctgccgtcaagcgcctgtggtcgtcgccctagtcttccgctgtttctcgtttgtctttgtgtgtgctgggccttcgctgcccatgtaataattatctttttccgcttccgcttgttaacctctgaattgtatcaccttttggtgtaccttgcctcctggcacaaggattaatgcacgcacgtaaggaatgaccgttgggttatttccggtcgtgccaaggggagggaaggggggaatcgaaccggcggtccacggctcaccccgggtcgcgggcgacgacggaaacggcgacctgagcggaggaagcggcgggccggctcgggtggacggggtcggcggtgcttccggcggtcggcgagcggaacggaggggtggacgaggtcggcgaggatgcggcgaagccgaagtaggcggcgccaagggggcgggtggtccggggcgacgacgccggcagccggagctcggcgggcgcggcggagagagagagcgacggcgcgagctcgattccggcgaggagagagggcggcgagtggcggaaacggtggagggaggcacggtgagggtttatatagggttgggagtgaaagggggtggccgcaggagggggaaacgggcgcgggagtcccggccgccattaatggcgccggcgaggttaggggaggagtttacaaacgaatccgagggagagagagagggaaaaatggggggaaagggggaggggatcccggggaataattcccccctattgattgcacgcggggcggacgggggcggcgggattcgcggcggcggcggcgctagggcgcgggcgaggcagcgggagcggcgggaggaaggggatgacgggtgggccccacccgtcagcgagggaggcgggcgggcccgctcgtcagcggcgcgcgcgcggggaggagaccgaatgggccgcggggaagaggagagagagggagagagatgggccgaaccggcccaagagggggaggggggaaaaaagactttttagagcttttctttttataaaatcattttaactttgtttatttcttaataattattgtttgtgctctgaaaattccactaaaatttatttacgtattttaggcttttaggaaatatacaaaaatcctccaagccttatttgacttttaactttgcacattttaattgttggaggctttcacacggattttaattattctaggcataatttcgaggatgtattttagagtcgttttgggacgcgacacaga

SEQ ID NO: 22924 - DNA, 1501 bp, Oryza sativa
tgatcaacaacatcttcttccggcgacttcaagacggggaagagcttggggaatccatggggatgcctggcgtgcaagacgcattgcgctgcctcccgtcgctaatccggccgcactgtgccaccgttaaccccgttgcactacactgcctccttccgctaatttcaccgctgaggctgtcacagccgctacctctcggtcttcttccgctaacctcaccgttgaaacccttgccgatttagggatattttaggggatttgggttgaaatacactggtaagggcaagttatgtgcaaggtatatgtggaggggttgagcacaaaaatgttgcctacgtggcattgccatgttgtaatgccatgttggcggtcaaacgtggttaaaggaggattggaccggtggtggtatatcaaaccaagttcacggatctaaacgtgcaattttcaagttcatggatctaagtgacaccacaccacaagtttaaggaccggccatgtatttcactctttgttttactttcacttgttagagcatctccaatagaatggccaaattagactctccaaatacccatagtcacctctccaactgatttggagagccaaacatgttcctcgttccaacagtctctccatctacacactctattttaagtatatgccgttgggacctacatattaacctctacttcttcctcctctttctcccgcaaccatcgccaagttgccctcttggcgacgtcgatgacggcgacagaactgtgtgcacgcgatgtagctgcggtggcgacgagaggtgagaagccgccgacggcaaatccgtgcatgcgcgaggcgcgctcgtgcacgagacggcagatccgtgcgcgcgtgtcgacggtgacagcgagggacaatgaagactacggcggcgacgacagcggtggcgaagagaggggagaagccagcgacaatgaatctgtgcgcaaggagggctcggtgacgacggcaagacgatagtcgctaggatggacctgtgtgcaaggaaggtgatgacggcgctgggcgagttacattgtctaccggttaaaatgccactttggagggttttcgggccaaaaaaaccctaggttggcatgcgaggagagggagagggaggcagtaggcgcatgtcgctggacggttggccatcggtgataatgggatgatggggtggaggaaggaggacaaggcgaattacgggatggtggggacgtggaccgccctctttggctcctcaaaggagcggcgagggcacagtctccagcgttgcccgtcccgcacgcttgtcgcacacagctcgcacgctcattgcacatcgcctctagtgccccccacgttggagggcgagggctagaggcggtggtggaaggaggaacgatagggtggagggaatatgaggatgcgacaacatgcgctcttgggatagggaggactacactctttgacttcttggaggagcggcgagggcacggcctctagc

SEQ ID NO: 22925 - DNA, 1501 bp, Oryza sativa
ctccctcggattcgttcggatttacccccgcgaacttcgacggcgcatcaatggagcccgagatcgccgcgccgatttccttcccttcgggccgccctttctcactcccaaccctatttaaacgctccccgtcctcccatcatccgtttccgccactcgccgctttctctccccgtcggattcgagcccgcgccgtcgttctctctctccgccgtcgccgccgagctccggtccgccgccgtcgtcgccccggacctcctcccgcttcggcatcgcctacttcggcttcgccgtgttctcgtcgacctcgtccactcctccgtttcgcccgccgaccgccggaacgccgctgtcctcgtcgacccgagccgcgccgccgccttcctccgcttcggccgccgtttccgttgtcaccgtcgacccggggtgagccgaggaccgccgtttcacttcccccttctctcctctctctcgggcgccgctccgcgcgccggtggtcgccggcgtcgaccatcggggcgcgggtgcgccgcctcccgtcggccgtgccggcgaggccgccttcgggcgcgcctcgcggctgccaggtggggcccggccgtcagccgcccacgcctcgggggcggctgacgcgtgggacccacggcgccggccagcgtcagccgcgtgcacccggtccaccgtggaccgtgaggctgccgcgtgggccccactcccgtggacccggtccgcgcgccctctcccccggctgacgcaataaatatgttttttaattaaaatttaaatgaagaaattcgcaaatatccatttaaagagcatataaacttcaaatggccataacttggccatttgaactcggaattggaccgttcaagtctctaattttcccataagaagtcaagaacccatttttgtgctttgtttctgcttgttatatggagtttattagagtaaaagccttttcttttccgttggtcgtgtagacgctgcagcttcggaagatccgctcttcgtggaagttgaagccggcgtttgggaaagcgagcaaggcaagtcacatcatctttgaacatattgaatcccagtttataaaattatgttgatttaaattattgcatatccgctttatttaaattcccgcgttatcactgttttatttagccatgcctatttacctttgttatgaccttattattattgtttttgttattatttccttgttcaccctagaataaacaaaaccccaactagtggacactctactcatggtaccactagaatgattttaggtagatgcttcgcttttaattaggtaacattaggcggttttacaactctagactttgggaatattcatatcacctggacactgtggaattgttggagtattgtggaattggattcacatcgccccctctattcaaaatcccctaaaatggttttaggctgggctcggggtgcatggttttgatggtagcacctcggccatataaggaccggt

SEQ ID NO: 22926 - DNA, 372 bp, Oryza sativa
atatgtaattatcatttattttgttatacttttccattaaatttcctacaaacgctctcacgtcaccatgtgtcactctacaaacgcttctacgttgctaagtagcgctataataaattaaataaaataatataaattcttagttaaaataaaacatttaattctcgattttcacttaaagctaagagaccattattttagacaattaaattattatatctataaaaaataatctctccctcctaatatcccgttcaaattattaaatctataaaaaataatctctcgctcccaatatcctattcacatagcctagtggttacaagagcttcagtagcacctgaggtcctgggttcgactccccgtgggagc

SEQ ID NO: 22927 - DNA, 157 bp, Oryza sativa
tattagtaaatgttgtgctgttttcacaaagagttatttgcttttacttatatatgatagtatggcacaatagtagtctagaatctaaatttattctcgatcaccttctggtctttttccggagtagctgaaagtttgtattcttttaatcttttca

SEQ ID NO: 22928 - DNA, 267 bp, Oryza sativa
atatttgagttgaaagtttcaaattttgattaattatatttgaattttgagatcaaagttttaatttttttcatagaagtttttttatttaaaaaaatgagcttgacactttccgtttaaaaaagtcagataaaccgtatagatgaaacctatatatatatggtggttgcatcgcatactgcttcctacatcgacactcgaaatcagcacgtaccatgttccttgagtgggccttatatgggtcaaaaccatgtgttccaacacagc

SEQ ID NO: 22929 - DNA, 263 bp, Oryza sativa
aaaatagaccattgcatactacaagaatagcatacacatgttgcaaacataaatgagacttcagatattgtttactagattttccatgcagctttgtttctttcctttctggtgaaaagattgcaaaatttgaagcggtgtatttggcatatacagactttgacatgtaggcagacagcaaaaaacattacatgccatagacaagaattcttataaacatgattagatgtaattacctctcaagagcttgatttttcctcagt

SEQ ID NO: 22930 - DNA, 1501 bp, Oryza sativa
tcgagatgtcatatggcagagggttggtgccctgctgctaggggctcagttctgcctgcctgtcccgggtattccggccgtaggcgggattgggtcggtactcttgtctatggctaggatgggtcggaaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagtcagtgttttaattcttaaaatttgctcaacaactaaaatgtggaatggttggcctgggttggcttgggacgagctgggacccagggtcgggttgccagttcggtctgaatcatcgtaggccttgggttaaggcaggttcgtgagggttcacggccgtgattaataatactgtatagctctaggatcgtctttataaaatggctttgggcaactaagtgacttttaaatgctgtttactgcaaaacttaacccctatattattatccccttgtacccccttgcattaatcatgcatctgccggtgtggcctgctgagtactgtggttgtactcattcttgctctatctttctccccctcttcagtaagagaagcgttggagaagatgtcttaggtggagtcctggcttataccccagttgagcgcctgtgaagatggagccgtaggcccgctagtccgctgctgtttatttttgattgtcaggccttaagtgcctttgtaataatgtaaatattatcgatataataaagatgtgtcttttatatcatgtttgtgtggtgtaccccggcttttcctgggacggggactaatacactagcgttcgggaaaaggcaattttcccggtcgcgacaagctggtatcagagccatctcgactgtaggataagccaagtggataaaacctaaggacatattttataaataaaactatttgcgaaagttcctctttttctccttcccctaatgctatttgcaaaaggtttactcttttcttccttcttcaaatttcaactagtactagataatcaggtcagtgaagaagaagacatcgtcagttgtttgccgaagctccggaagactgcaggatccgctggcgaagcaaaggaagcagtgaagccagctgtgaaggagtgaagatcttggagaacccgtcgcagaacctaagccaccctctagggtagtgtcgttagtcgtgtgtttcttgcttgtgtgtgtagcgcgtggtttgcatcggtgggttgtgatgtaaccatgctaggttgttagcttaatcaacttgcagaataagtgaaacaaacaacacatcagcaagaagagttagttcctttaaggtcttgtccctagttctggtctattctttccttgtatgcttcccctctcaacctctaccttgtgacagatggataatactagtaacaaaggctatgggaa

SEQ ID NO: 22931 - DNA, 387 bp, Oryza sativa
tcgaaaagcatgtttataaaaaatgatttataataagaacaaaatggtaatcaaaggtcaataagaatacaggtaaagcaggggaaaaaagagatagagtaacaccaacattaagagcaccatataaaaacattacaagctacaggatggacagtcagaggcctgtggttcaagtactgaagcaaagagcaagaaaaccaacctgaaatttaaactacaccaatataatcaagaaaatcccttgcttctgagcttgggaataaaatgagcaagcactttcaataacatcaaaatggagttgaagaaggaaaacgttgaatcaatacatgagtttgatagtcacataaagaaaactagacaatgactaccatatttctaacttgtagg

SEQ ID NO: 22932 - DNA, 1501 bp, Oryza sativa
atctcatgttaaatttcctctaaacttatatggaaggagacatttcgtatgaatttcatatggtccattccttttattcagagggttctatagaaataaagaattataggaacgaaattctacaaaaaaaattcctatgacttttctttgaaccaaatgggacctagttgtggagatcggagatattagagcatctccaatagcattgataaatgactcctcaagttaaattttagccaacacaggaaaaaaaaactccctccaatagtctagctacttggattgccaagtcatatggctggccaaacaagcatctcaactggccaaatttggccggcctcctccagttgccgaacgatgggccccaccgtgggtcccacctatctctttctttgcttctctcttctctcagccgacggctagctcccatgcctttgccgatggcgccaatggccagctcctactgaggtcgatccgtgcagcatggtgaaggtcgagatggccggcgagcggcgcaaggtggccaatggtggcaccaacggtggaggaaggcatgcaatggggcggcggaggggacatggtgacggtgagggagagagggcgcagagacgacggagggagggatgcggcatcgagggaggggggatggggcgcggcgcacgaccgtcgaagaggatgaggccaccatcgtcgttcaccgtcggggccacctcacgcatgcacggatccaccattgtcgactgccgccgaacagggcctctcgtgccatgcactcaccgctgcctcaaatgcgcgagggcacaccgtcgtcgtcgccgtcgccgctcaggtgctgccgccgccgtcaccgtcgtcactcggcttcttcccgccgccgatttccaccgctacctccgcctccgtcagatccgctcgctcacccactgacgacacgagggaatcgacgagaaaactgtggcatcgttgaggtcggcgtcgcgagctgatgtcgtcgtcgtcatcgaggtcgtcgtggcgagccgccgccatcccgccccgagctccgccgccgccgtcgccatcccgctctgagctccgtcgcctcgtcgccgcaaagccggcggcggcctctagatccggcagcccgaggggagctcgacggtgctcggctgtggggagtggtcggcggggagagggagagcacctcggtgagtgccgcctcccgcctccccgcgtcgccgccccactgcgcgccatgcgtcggccgccatcggcatcagtgtggtcgacaggaaggaaggaaggaaaggggaaaagaaggaaagagaaggaagaaggtggggggagaggctgacacgtgggttcatttttattttagagagaattaatagagagtcttgttgtgtttagttcagcgcaaagtttacattttgattaaaattgaagatgatgtgtgataaaaaaggactgaagtttggatccaaactttaaatctaaacacagcctctgttggagtgagttt

SEQ ID NO: 22933 - DNA, 923 bp, Oryza sativa
aggaggaggagcgggcgctggcgccgctcgccgacgcgctcgaggcggcgctcgcgctgctccggctcggccgcgaggggagcaggatctccttggtatgtgcgcgcgtgtgggtttcttgattttgttcgattcgtggtcctggctgcctttttgggaggaactattattattattatggattggtgatttgatattatgacctgttcttaggtaaaaataaagtgcagctttagttattaagtttattattgactttagtctcctaaaaaaaattaagattcttggatgcaaaaatatgattctgattcgtctactgtgtatccgtgcttaatttttgcttttataaatcgtgtggactaatattaatatatattgatgtgcagttgtttgaaacacaaaacaaattgtaggggtcgtgattgttaagtgagttttcttttgttttagcataggggctttaggatgatttagttgctgttgcttattaatcgcaaaaaagagagagagaaaggtttccataattttattctgcagctgtgttgtatttgttcagctagatttcttgttgagctgagattgcttcttgttcaatgcgaccaatatatgttcttcttttgtggtgcaattttggtagggtccataagttgtggtctttgggggcgtctgtaacttggttatttcagatcaaactccttgctatttttttttgtggatctactgcgaaacttgtcatctgtaaatgatccatgcattctcatttctcagggcatccatgagtttgtcatagatttgctgtagaataaatgcttggacggattcctccatcggtttctttacttgttgaaacattcaagaatctacttgcccttgccctacatccttcatggttgtactccacatgttattccccatggtaaaag

SEQ ID NO: 22934 - DNA, 151 bp, Oryza sativa
ccatggaaatatgctaatcccttgttgggcattccttggatgatttccttaatgcagatgcttctttctcaaatgaggaagcatataagattaggaagctgcatgcttcatgctgcattactatataattttccatcatatatttcttaga

SEQ ID NO: 22935 - DNA, 1501 bp, Oryza sativa
cgtgtagggtatcatctagtatgctataaagcaaatgaatttttatcttttgatggatgcatggctccatcaaaagcctttcattgccactgaattttcatccttacacacacacaacacggtatatatactacgcatctcagaaaaaaatcttatatgtatagacgaatatagtacatattgtgtggtcaaattaaaggcgtgtatgcaaaatcacgacatgtttcatgagaaaaatacaataatgtgcaattagtcatgtctaatctgaaaatacatgagcagccagcaaaacactaatttgcttattattgctggagactagctatcaggcaagaataattagactactacctcttctacctttcacatggtcaaagaggggttggttggggtgtcattgtatactccatagtggccactaatcaatccccatcagtgttaagagtacacatgacaaccaagaaagcaaaccgcctagtacactctatccatgtggactatgttcaaagttttcatcaaacccataacttttaacatccgatgatgtttgtgaacatgaagcaggcaaaaataagtaggactatgttaattagggaaaacgagtctatctataattataaattacaccaaaatctaccacaaaacagacatgtgtccttaggcacgtgtgagacaaggtgccgctaaggcctcaacagaatatggggccggcctctaaaattatatgttttaatcgataccaatgtgttttgatatgtttaggatttcttcattctatttttaaaattttctctttatctgctcaatcgaattaggctataacgagattttatttttcctcggatccaacaattgtttgatgatcatagctacctttaatgtgaacatgcgttccaagcaatacgattccatttttacatttaattagtaaaacaaaactgaattgatgcaacggtttttttttctactcagctagatcgacgctactacttgtaggtgggtagccttctttaacatcgctctagttatcgccatcacatataagaactcatttttttttagagtgaagtgcaccagcggtccctaaacttgtgtgggtgtgtcatctagctacctaaactctcaaaatgcatttttagatccccaaacttgttttgggtgtcatatagatccaaatgggtttcgacccgctccatccgctgatgtggcatgccacagtggcgtctacgtgtcgatgaggacccaacatgtcagtcatatttataaaaataagattaaaaaccatattttctggagacacacggacgagcaccttgggtgtgctcgatgccgtgcggccccgaccccgtgcgccctcaactctgacgacgccacctcttcttaacgacttcaccccccctcaagaaaactcgccaccaccccgccattctccaccgcggagccgacggaggcggcgccgcggccgagccctgtgcgaccggcggagtagacggaggca

SEQ ID NO: 22936 - DNA, 342 bp, Oryza sativa
ttttaaaaacatgtcaattttgaaacgagcctttgcttatgtactcctaaaaaacatctcttttcttataataaatatgcaggaatttcacagtttctttaaaaagaacatctcaatttataaacaagcctttgcttaggtactccttgagaatttttgttctttttttggtttaaatatgcaggctaagattcaatttttcacagttctaaaaaagcatctcaatttataaacaagcctttgcttatgtactcattgagaaattctcaaaattcctgtgtgtacacccgaaagctatcaaagtcaatggtaagcttttcaatttgctatgtgctgtttagt

SEQ ID NO: 22937 - DNA, 1501 bp, Oryza sativa
ggagtggagctagcaactattatatcatcaacataaataagaacaaagacattgacatcacccttactatagaagaatagtgacgtgtctgccattgatggtttaaaaccaagtgcttgtagctttgtgcttagcttagaataccaagctcgtggagcctgtttgagaccatatacagctttatccaacttgcatatatgattaggaaatttactattctcataacctgatggttgtttcatatgtacctcttcttctaaaatcccatgaaggaagcattttgcacatctagttgacgaaagctccaacctctagacaccgcaatggaaaggatagttctaattgtagtagccttaactacatgactaaacgtgtcctcatagtctattccatacctttgcttgaagccttttgcaactaacctggccttgtatctgctaggctaccataagcttttctcttgactttgtatacccacttgcagtcaataatatttctcccctgctgcagtggtaccaagtgccatgtttgatttttcatgagggcctgatactctgcatccatagcctccctccagtggttagtagcaaaagcttcatctagagattgaggttcaccagaggaggaaaaacaagaccatttaactgtaccatctgtatataccttttccttgcagatgccgctttgaagtcttgtgtgaggtcgtggaggaaccattgaatcttgatgcactgggtctatttgatagagtacagtggttgtgtcaggagcatcatgagcccctgtgtcaagcgcagcagctgaggtggaggaagcgctgatggttggcgtcgtggcagcaccaggctggttcggtgattgtgccagggagggagccgagggcgcaggggtcggcgtggcaggcagagagccggacgcgtgatgcaacgacgcatgtgaaacggatcccggagactgatgccccgatcctggagactcctgcgacatggatcccaggtcttccaagggggcgtcaccatgtgctgtgtgcaccccatcatgtgtacctgagacatccaaatctcctccattttctgctgaaccagcatcagatatgtcggtgacaagggaccgggagtatcgtgactaaaggcttgggcggccgcgctcacccacgtgccttgaccccctggggggggtcgggcccgagggtgacgtggccacccctccctctgtctccccgaggggtcgggccgctcccgtttcggccccgagggttggggcgccccgaccccctgtggtgttggcaccacgtgtgtgagttaggtgagcacagcagcgctcacctaaccacgtttactgcgggttggacgagcgcgccacgccgcatttaatgcagtgcagcgcgctcacttatccggtccgtgaccggtcgcagtatgtgaccggtcacagaccggtcagatcgcgggttaggtggcaacaggcggcctgtcacgcgcctcgccccgtcccatcggaa

SEQ ID NO: 22938 - DNA, 1501 bp, Oryza sativa
gaagaggagttcctggaagatgaaggctttggtgtctagctcgtgcctgccgtcaagtgcctgtggttgtcgccctagtcttccgctgtttttcgtttgtcttcttgtgtgctgggtcttcgccgcccatgtaataaattaattacgcttccgcttgttaaactctgaattgtatcaacttttggtgaaccttgcctcctgggacaaggaataatgcacgcacgtaaggaacgcccgttgggttatttccggtcgtgacaagttggtatcagagcccccttgaccataggactagccttagatcccaagccttagcaatattttcgaaaaaaaaaatcctttgttatttgtgaaaatcctctagtctctctctgtcctgctgcttcatttatcgccaaaatctgacctttaaaatgttgcatttctttttgtttttgtttgtagatggccggcagcatcaaccgtcgtggtctggacctgactggctttgttttggagctgcggggcatgtgcgttgtcctggggtatgcgcatggagtggactaccagggcaggcagctcccggagcaggagggtgacgatgcagagccccacgctgcttgggaggttactgcagtgatcctcactggctcacccgagaggacttcgttggcagtcaccacgggtggagattctttctccgccgcttgccagaacgccgctctcctcgccatcggcactcttcaccagcgctacccggacgagttgcagcactcgccctaccgctaccaccctcgccgcggaggagcccgcgactacgccaccttccgggatgctagctcggaggatgacgctaccatcatgcacctggcgcgcatggtggaggcgtacgacgcggctcgtatcgacttccatcagatggtgcgccgtgggatggtcgagaacaacatgaagatcctggagctgcgttaggagaatctgcagctgaagaaggacctagacgcagcagaggcgcagctgcatcagctcaagatcgcccagggagaggtctgtcgccccaagcgccgccgcgtctgccgcagccagaagatcaccgcccgcaagagcacctccaggcccgagcttgttcgccagtccttggcatggacctgcttcgtggagacccctcgtgccgagcccgcgcccatggctcctcaggagggggaagcctccggcgttggtagcacggaggatgcgctgctgctcaccttctgtcctggcccgtcgcagcggtagacgagcagttagtaggcttgcgcgtgtgttctttctcgtttgtcttcttgttggagtcgtgtggggcatggttatgccggtgtgtggtataactgtgtcggagcctgtctttattttatttgcctaagcaacttgaactttaatgaaccaatttaatagcagtaataaattcaaaaattatggtagtcgtgggtggctagttttaattgtcagctctctctgtttgctggttctgtgtggggttttc

SEQ ID NO: 22939 - DNA, 1501 bp, Oryza sativa
ggcggattttggatgtggtggaggagagcagtcatcatgttggcctgctgggcgaggatttgggtgagaatggcgttggtgtctggtggtggtggtagaggcggaggaggaggtggaggtggactgccctggttgttgtggttgctgccttcggggtgactgccttcaccgtagcagcacttctcctggtcgtcaccatctgaaaaccccacacagaaccagcaaacagagagagctgacaattaaaactagccacccacgactaccataatttttgaatttattactgctattaaattggttcattaaagttcaagttgcttaggcaaataaaataaagacaggctccgacacagttataccacacaccggcataaccatgccccacacgactccaacaagaagacaaacgagaaagaacacacgcgcaagcctactaactgctcgtctaccgctgcgacgggccaggacagaaggtgagcagcagcgcatcctccgtgctaccaacgccggaggcttccccctcctgaggagccatgggcgcgggctcggcacgaggggtctccacgaagcaggtccatgccaaggactggcgaacaagctcgggcctggaggtgctcttgcgggcggtgatcttctggctgcggcagacgcggcggcgcttggggcgacagacctctccctgggcgatcttgagctgatgcagctgcgcctctgctgcgtctaggtccttcttcagctgcagattctcctaacgcagctccaggatcttcatgttgttctcgaccatcccacggcgcaccatctgatggaagtcgatacgagccgcgtcgtacgcctccaccatgcgcgccaggtgcatgatggtagcgtcatcctccgagctagcatcccggaaggtggcgtagtcgcgggctcctccgcggcgagggtggtagcggtagggcgagtgctgcaactcgtccgggtagcgctggtgaagagtgccgatggcgaggagagcggcgttctggcaagcggcggagaaagaatctccacccgtggtgactgccaacgaagtcctctcgggtgagccagtgaggatcactgcagtaacctcccaagcagcgtggggctctgcatcgtcaccctcctgctccgggagctgcctgccctggtagtccactccatgcgcataccccaggacaacgcacatgccccgcagctccaaaacaaagccagtcaggtccagaccacgacggttgatgctgccggccatctacaaacaaaaacaaaaagaaatgcaacattttaaaggtcagattttggcgataaatgaagcagcaggacagagagagactagaggattttcacaaataacaaaggattttttttttcgaaaatattgctaaggcttgggatctaaggctagtcctatggtcaagggggctctgataccaacttgtcacgaccggaaataacccaacgggcgttccttacgtgcgtgcattattccttgtcc

SEQ ID NO: 22940 - DNA, 1501 bp, Oryza sativa
aaaacttttatattcgtgttcttagtgatttaaaaacaaaggctgaaaaataaacttcgaaaggaaaaccttaaaatcagccaatttaagattgtaaatttaaatttaagctgataagtgaggccctcagagacgatgagtaatcggtagtacccgcagcagccaacgcagccgcaggaaccgcaggagcagcttccaccgcagcaagacatcttcttcttcttctaccttgggactcttcactcttcacctctcaagaacttgtacgcaagaggaaaaatgaggttgatgaaagaggtgcatttgctcctcaagaatggcctccctatttgtaggagtggtgaagcaactgtagtacactacaatgctaatgtgttccaatctgataggtggattagaacacttcaggatgtttcaaacagataatccaaccataattgtttcttccttttttttttccccttggaatccctatgaacgacgggatctcctatggagattgtgacaaaaatgtagaaatctgaaggctctggcaatggcgtatcatcacatccttttctttgaggaaaaaaaaaggggaaatctattgcacatcttgattcttgtactactaaaggttgagacgttgcagtgcgtggttaaccacggtggccgtcgccggcggcagcttatctccggcgggaggtacggccacggcccacggcccaacacgtttcaggtgaccgtaccggcccaataccttgcggcccatcacattccggcccatcccgttcgcggctcaataagttgtgggccgatatgttcgtgggggatcacgtttgggcccagctaatattgggctttcagtttttcacggcggcggcgctcctcgccgtgccggagcatcgccggcatgaacctctgcttctccagctccggccggctcagccgcttcaggttacctcagcagctttcattggctatttatggttacttggaacatcgcttaaattttcaactcttttctcttttccaaaaaaaaaaaaattcaaatctttgaattcctctgaaatttatctattctagcatgagagcagtgacgtgtatacactagtgctcttttctcatgaagattaagattttaccttgattttcattagcacgtttttcaaactactaaacggtgtgtttcgtgcgaaaactttttatatatatgttgctttaaaatatcaaatatatctatttgtcaagtttgtaataattaaaatttaattaatcatgtgctaatatctacctcattttacattctccatttttatctttatctttatgagtttcaaacagtccaaatgttcaatcagattttattctgcgcataatcttgtcattcattttgcctacttaaacttgtatactactttttggtaagtgcaccgttagtcaattttcgggttataagcaggaacggtgagacaatatggttgactgcatcagtaaatggaactgaaagaacatgccatat

SEQ ID NO: 22941 - DNA, 1372 bp, Oryza sativa
gagcgtgatgatgccgccggagagcgtgcggctgtagaagtcctcgttcaccttggggtaggcgtccaggctccggagcttggacaggagcccctccatggccggggcccgggggatctcgccgctcctcgccgacgaggaatgtttccggttcggggtcgagctcgagcttggaggcctttgggggagtttgggaacggaggcttactattacctttttctcttttattttctggtcttttgtttgatcgaaacgggaggagaccatggagttgttgcaggttttcctttccttatgtgcgcgcctcgttggagccggtgctctgcggtttagacttcagaccaaaaaggtaagacggctacaaacgcaagcgatcactataaacccatttcggacgatcagatataaatcaaacactagacaatgcccttcctttcatataatttttcagcttcctgtacaatcttgcacaactcatatcttatccattcaaactcagcacaacaacatattattttttaacgactcacacaagatgatgcgaagttctattgaactcagcacaacagtatattatatggcatgatcgtatatttcatccatatcagtcttgggatagtgatgtgattttatcggtataattagaaggccatgcggtaaattgagcttgatcatactccaatcaagttgtgtgaactatcaaaaccatttatataagataagttatcaatttgtatgcatctcacaagatatattaccactaattaatatattttattctttataaaaacttaattcttgatatcctctatatattttatccttatcagcgatccccttttctatgatcacttgccgtgtgcgcgcatctttttttagtgccgtccttctgtctacctctatatcaattactaataatattatgatactttaagaggtttcacttaactaattaatatatctagccatgggttaaaatcattgaaaccgagatgatattgggagcacatgtaaaatagaacttggctagaagtaacattgactcttttaattttagtttataaaatttgacaattttaaaaatcagagttaatagtataaagttgtagctagcaactgcaagtgaggcggacttcttactaaagcatcatacataattcagaaaatacccatcatatttcatatatgatcaaagttctaatatttataattaataaagtaatagctatgtcacgtggatcggtgtctagtatatataatgttacatttattatgagttagtttattttacgacgaagggatatgcttcagctacgcacccatccctcagaatatttaacaagccaacatattagctctggtcctctagct

SEQ ID NO: 22942 - DNA, 1501 bp, Oryza sativa
tggaaaatgttgacctcatgaaacagggcctagagccaaaaccattcaagcatgagaaacttgtcatagattctatggaatcggctcttagtattgtcaggatcttattcagggatgcatttaactcaggattatttgagcatgagaaacctcccaagcccatctttgaaaacacattggatcgtcaggaggttaagcacaaaagaaagcaggacaagcggaaaaagaaaggaaagaagggaggagggggatcaggagggggaggtggaggtggatcgattggggaagaagtaccaaagggaggaggagttcgagaaagactgaagggagcaagttacaagcatgttagtcttttagtcctcatgggctcattgcatattttatgttttacctcagaaatattcttactggtgacgtgcatattgcattttgatgtattattaatatatatatgatgtgtctgtttgatcctagtgcacctgaagttgacaataacttgacgctgatcagcttttcatctccttagttccagtgtattaaaagcaaaaattgtcagttgttaaagttgcataaatattcctttgttcaacaaaatgattttgcataatttcctgattctcagtgtgacatctatatatttgcagcatgtgacgatgtgaaactagtcaccggtcaatattatgagttgttagatacataaatgaaactttatcctgctgaattatttagcgatcatcctctgatttgagatgtgacatttgattcacccattgtttcatcgaaactgttcatagtgttatgctgttgcgtgctccattgttttccttgtttgcaactcaacatctcgtttacagaattccatttatctttcatatacttaccgtaatagcttttgaaactagtatacaaaagatacgtgttggaataacacccactcttttgtttggtaatcctcacaggccagagacattgacagcaagagtattggccccagcagtaatggctctgatgatgagaaacgtgaactggaaggctctaaaagatgtcatatacaaaggtaatcaaccctacttgaggctttcattgaagattccgttgtgctcatcgcatgataatggatcaggcgaagtggatggttggacctttattactgatttttaagcattggtattcctaaagtatctcagctttgcatagaagatgctcaaaagcaagtggatcttttttctttgctctgttgcagagtgttttattcattctggtttgaagatcttatccattctctctgatgtccgtctgcatccccacgagcggtggaatgtatgtttgtttcacaacctgtaactcaaaaggtccctttggtgacatgtctcaaggtttatcggttcagtaacggttaatgaactgatgatactatttcactgaacagatttgtcagaaggtaggatcgagggctgcaattctgcaaaatcttgtcaaccccattgaggtgttcgtagat

SEQ ID NO: 22943 - DNA, 517 bp, Oryza sativa
attgaaaacagaacaatgtgatttttgtagaaaaacatgataacagaggtttttctttgagtacattttcattctcgaattttaatgatgcttcttttccaattgctggcagattctacattttctttaaaccatatagctgctgaagttctaataaccaatgaacccctttttcttaattatcagttgcattctagcagcagaagtttatttgctgtatatttcaaattatgtgattaatattgaaaagagatggttcattgtatttgtgtctgtatgagagaaccaaatgaaaccttctgtccgtagtttgttctatacttctatatttgagcacagattacatagtgaactcttcttatgacttaacactagtgtctttcactggaggcctggacacagtttgttgtttggtttactggtcaagctttagacacattgggtattttcctgtcaatgtctctccagcattataatttaaaatactatgcttatttttgttatgtactctggtaga

SEQ ID NO: 22944 - DNA, 449 bp, Oryza sativa
tcgagtatgtactcaaaaaactgcatggatcttctagtattatcaggatataacgagcagattaaatatcaggcattatgtaaaccgtaaacaagcatgatttatacagaagaaaatagagcgagcccccagcgttagaccgtagttggcctatcgtcggaagtactcgcacaacggacattgtataaaaaacatgctctaggtaaacataataaattattgatctgacaatactgcatgatctggataggtacgataaattgcatataaaatattgcgtacctgtgtagatatatgccggatatatctacggaattagtagattgattaaattaattaatctactaattaccttaactagccttagtagccattgaattgtcttcggtgcatgtatatgatggcaaaccaatgcatgcctgggcacgtattgagtctgtgcatatgca

SEQ ID NO: 22945 - DNA, 1157 bp, Oryza sativa
gaggtggatgatagtgacattgcagcgacaacgaagtaggcaggagatgaaggaggagcatgggtgggccgtccgcggaggaccgtggttatgggcgtcgttccacgcagagtctgcaacgttgacggtgcagcgtctgcgaagctcggaggtgggccaggcatggcaagatagcgtcaggaggagctctcgccggcgtgggaaggaggagctcaccggtggcgacaaatgaggcgtacggacaacacgtcaggcgacatgtggcttcggagggacgagtggcacggaatgaaacaactcgcgtcctcggtggcatattcagaaagtgtcatgaattaagtggcaaacctagatggtgcgaatccaatgacatattctaaaaattctccacatttcaaatagagggggagaagggatttccttggagagcgagtagattgccacgctggcaagcaacatgtgctattaaaaaagacgtgaatattagggaatgacctaatatcaaataattaggagtgaggttttgaacccaggtcgtctagcgcaccacctcgtggagctagccggaagacccctgtgtgtttcttgcctcatgtgttatttaaaccataaatgcaacagtgctgtggggagttttcaacacttgagctagatgggagcagccaatgttggatttttcaacacttgatttcgattgaaaaagacaagtgaactaggacctactccatgattcaaaagttataaaagagggatatgtattttcatcactcgagatgacattccctcgttatttgtatgccatctaaatagttattaaaaattttgaaaaaaaataataacatagattaatataaaatatatcactccacgaacatacaagaccagattcaacttctacatgctgcaacaaaaagaacaaattaaatggacaatagttgtcgtacattcgcaactatatttgttattttcgttacaacttgtagaagttgaattcaaacttgtatatttgtggagtgatatatttcatatcaatctatgctgccaatttttttcaaaatattttatgactatttagatggcatggacgaaacgaggggatatctcctcgagcgatgaaatcacttttcccagcagatggacaaaagtgcaattacaca

SEQ ID NO: 22946 - DNA, 1501 bp, Oryza sativa
cctgctttcttttgtgcttaacctcctgacgatccaatgtgttttcaaagatgggcttgggaggtttctcatgctcaaataatcctgagttaaatgcatccctgaataagatcctgacaatactaagagccgattccatagaatctatgacaagtttctcatgcttgaatggttttggctctaggccctgtttcatgaggtcaacattttccattatgtgagcagaaattttcttgtacttcttcacatacatggggttggagggatgtttccccaatttgcttaaacccggattctcagaaaggaaagaatctttgatgtagtcatgcaccgggcgtaatcttgctgcctcagatataatcacagcaaatattgcaacatcttctgatatatttatgttttcaccaccagcatgcctccagaagttgtcaaatgcttttctaacaggccatagaccagtgggagtattctcaacacccccgaaaacaagcttgttatagttcaaaccagttttgagtctgatgcactttgggtccagagtgaagttctcatgttggtcatggttaagctcaaaaacacaatcccttgctttccatcctctaaggtacagatttcttccctgtatcaagaatcttatagaccgacccatgtacacgaattccacttccattgagcctccagctcttgtagtgaatacctcatggcactgtccacaaatatctgagatatccaccttaattccatcttcatatgaccaattaattacctcttcaatgccactaagatagcttgctaacgcttccttgtcagttccatcaaggcaaattgtggtcacatgctttgaggtgagccccctattcctgatctgctaaacaaaattacaggtgtgtacattcatatatggaagttaaatgagtaaactagcaacttttcaacaggcagtgctgcttaatggtcagttgtagttcattagggtatatccaaactcccaatcctgtgaaagattccaggcatattaaacttccaagttcagagtaacaatgtggctgatatatagccttgcaagttaactgtaacaatctggctgataaccttgcaagattataagcaacagcagcaaaactatggactgctgaaccatattctgttctcacatttttggatccaatatacagtctaatactctgtcaatagtgttttctatcattctctgacaatactgccgtaccaaatatccatattgaccagggcacagttattggaaatcatatccaagtaaaccaatcaccataattttgtatggcatttccctctcttaatataaaaccagcaagatctaggtttcaaaaaaaaaaaacaatcaccataatacaattaataggaacgactgaaacgaattcaataggttgtcctacctaggaaatttatgcactaattagcaagacaaaatcagttcggcaggtggatcataagttgcacatgctcagggaatcttactagc

SEQ ID NO: 22947 - DNA, 1501 bp, Oryza sativa
ttaatatagtccttataccaaaaaaatggtacatgagtatgccaagtcatcctcgcatgcagcgatatgaatgaaatgactattctacccctatatactatatagaaaagaaataaaagacacaaaaaaaaagctaacctaggcccaacattgttgcggagggtggccgacaaaggaatttatacgattaggctgcagcaatcgtaagtgacaattctaaaatgtccatacatgtgtgaaatatttgttttcttttttatatggtatataagggtagaatgttcatttcattcataccgctgcatgcgaggatgacttgacatgctcacgtggcactttttgtgggtccaaggattatattaacccaaataattaatttgtggcacttttttgggtccaagcactatattaactcaaatgattaatttggaggacttgtttggacgatttaaaacatcaaggactaaactgagcccgaagtgaaacttcagggagcatattagctattcacccaatttaaaataaggaatattagaagtagagtatagaatccatatagaaatacaattaagaaaaaagtagaaatttagaattaaaaaataaggaatattagaagtagagtatagagtccatataggaattcaaaactaactaaaatttggaataaatataataaaattaaaagtagagtttagagtatgtataaaaatacaatttacaaataactaaaattcgaaattcgaaattaagaataacatgggaagaagagtttaaggtcaatataggaatacaaatatagaaatacaatttagaagtaactgaaattcgaaattaaaattaaagaatattgaaagataagtttagagtccacatataaatgcaattagtaataataacaattcaaaaataaaaataaataatattgaaagaagagcaaacagtctatatagaaatacaatttacagaaaattcagaattaaaaaaaagaagtattaaaagacaagtctagagtacatataggagtatatataatttacaaataactaaaatttgacattaaaaataattaataactaacacgtatataaaatataatatgaatattacacattagtagttttgtaaagttattgcaaaatttaaaattatgttttcattttaatatatttgaataatataatgagaaaacatatatgctattatatgagagaaaatataatgatgctagccgcgcaatctgcgcgggccaccatgctagtttaatcttacggtagcatttccaattcccctatccgttttgtctccgtctataagaagcctcattagccagctgaagtagatcatcgtcggtgcacataacatctcaaaaagtgcagataaaggtcgagacagtctgcttcttcaagccttcaacaatggcgcataagctcctctgctttgcggcactcatttccatggcggctttggtacgtgttctacattttctgagtctcgcttatga

SEQ ID NO: 22948 - DNA, 1501 bp, Oryza sativa
cggagctcggagacgaagaggaggagcatgacgacggaggaggcgagcgtgatgatgccgccggagagcgtgcggctgtagaagtcctcgttcaccttggggtaggcgtccaggctccggagcttggacaggagcccctccatggccggggcccgggggatctcgccgctcctcgccgacgaggaatgtttccggttcggggtcgagctcgagcttggaggcctttgggggagtttgggaacggaggcttactattacctttttctcttttattttctggtcttttgtttgatcgaaacgggaggagaccatggagttgttgcaggttttcctttccttatgtgcgcgcctcgttggagccggtgctctgcggtttagacttcagaccaaaaaggtaagacggctacaaacgcaagcgatcactataaacccatttcggacgatcagatataaatcaaacactagacaatgcccttcctttcatataatttttcagcttcctgtacaatcttgcacaactcatatcttatccattcaaactcagcacaacaacatattattttttaacgactcacacaagatgatgcgaagttctattgaactcagcacaacagtatattatatggcatgatcgtatatttcatccatatcagtcttgggatagtgatgtgattttatcggtataattagaaggccatgcggtaaattgagcttgatcatactccaatcaagttgtgtgaactatcaaaaccatttatataagataagttatcaatttgtatgcatctcacaagatatattaccactaattaatatattttattctttataaaaacttaattcttgatatcctctatatattttatccttatcagcgatccccttttctatatattttattctttctaaaaacttaattcttgatatcctctatctattttatccttgatcagcgatccccttttctataatcacttgccgtgttgcgcgcatctttttttagtgccgtccttctgtctacctctatatcaattactaataatattatgatactttaagaggtttcacttaacttaattaatatatctagccatgggttagaatcattgaaaccgagatgatattgggagcacatgtaaaatagaacttgaactagaagtaacattgactcttttaattttagttttataaaatttgacaattttaaaaatcagagttaatagtataaagttgtagctagcaacttgaaagtgaggcggactttcttactaaagcatcatacataattcagaaaatacccatcatatttcatatatgatcaaagttctaatatttataattaagaaagtaatagctatgtcacgtggatcggtgtctagtatatataatgttacattttatcatgagttagtttattttacgacgaagggattatgcttcagctacgcaccatccctcagaatatttaacaagccaacatattagctctggtcctctagct

SEQ ID NO: 22949 - DNA, 524 bp, Oryza sativa
caccaggccccgggtcccagtgtcacctacgtaacaggttgacatgcgcattacgatttacgacccgcggcacagggcaccggcgcgcgcgttggtcacctcggcgcgcgacaaaccggtcgttttctttagctccgcaccctgcaattttttccttccgaagcgatgaccgtggaattggaacccgcgtatcggcgtatgtagtagggagaagcgcacggcacagcgtcttctgtcgagtcacgcacgtaactcgagctgagcatgagcatggaatttttacataggcaaataaaggtaagcttctcttgtgcccatgcagatttcactacagttttgctagtggccgtgatcgatgtgtgtgggtgtatctgtacacggcccatgcacgcgaaggccgcgtgaattttcccttctgaagaccgtagaatcggagttcagcccgtgccgagtttttttcagtttagctcaccgacgagtcacgcacgtaatagcggagccaacacggagttcccacgaagcag

SEQ ID NO: 22950 - DNA, 1501 bp, Oryza sativa
caagagatgaactccttagttgcagcactgtccttgccttgggtgatgggaaggtgcttgtccatagaaatgatattatctttggttgtgtggataggatcgttggcaaatgggatgaagcggcgcctgtatggtatacccaatccctcgccttccactccactgccgctggccatgttccgagatccaggaaatctatgaacaaagagcataaaagggtaaatctttgcgtccgattcaagtgccatcagtcgggattgaaataatttccctagttatactcaaaacaccaacatgatataagaacaaatagttctaacaaaaaaaaaaactaaattcaacagaatctatatcgagaactttagcaagagacgaaaggcccaaactttacgatcagagcaggagaacacaccgagaaacacgactggcaggagggttaagcgtccacgtgactgaagcgattcttcgcgcaagcgccggtagccacccgcgagccggaccagaggtagccatggaggagaggagagatcgcgggaggggatcgagatgcggtgccgcagggcagaataaggcgcgacgatggggcgtcggaggaggcgaagaatcgagcgcgaggggatttgcatgcgctccacgtacggagaggagggcgcggcggggggcgagggggggttgtgtaggcggcggcggcggcggcgggcggcggcggaggtttggtccggttcgtgatgtgcgtgttgtgtgtgatcttgctagcccaaaagtcgaaaaaagcccactgcgcgattgttcacgctatagacgctgagaccgaacaccaacagatcttttttaagatacaatgatttttttttagaaatagaggtagtggaattaaattatattctttacagtaatatataatacaagataattacctttttacaagataattaaattctgcatctaactttatataagaaaaactagatgggtggctcgcgcaattgcgctgctagcacccatacaaaattactccctctgtttcataatgtaagtcattctagcatttcccacgtccatattgatgttaatgaatctagatagatataatgaatctaaatagatatatctatctagattcattaacatcaatatgaatatgggaaatgctagaatgacttatattgtgaaacggaggaaatatctatttattaatatgattttacttaaatattgttaaatagctatctcgtaatctaaagattttgaaaaacaaagccttatcatccccatgtttctaattttataatttttaaaagtcacatcggttgttacctcttactttcttttttgtcacccctcatttaattttatagaaaatcccttgtatacccttgaaattttaactaatcccttctatgcccctgaattttgcttacttccttatatacccctaaaatttgattttgatcccttccatacccctcccgtcagttgattgttagttgaccgtctaatt

SEQ ID NO: 22951 - DNA, 321 bp, Oryza sativa
attcctgcagcccccgtgattagtctcaccctagcttagtctaatggaatcgattagttcaggtggatggttaggcctgtgcaacgtggggtagcgttgaacagtggatggttaatattgatgaattattataactgttttactgcttttaactactgcctttaaatgctcgctttatgcaaatgaaccactctagctatcctttggttatatcctgcatcataccctctattccggtatgacttgctgagtacggtggttgtacttagtcttgctctattttcccccaaaccccagagtttgagtacgtgtcagatggtg

SEQ ID NO: 22952 - DNA, 470 bp, Oryza sativa
ggcatgcaaaacggcactctgcaccacaggcatgcagcggtgcagttgaaccattcgatcctcaacaaccaccccacccgtgaaacccatcgcaatctgagtagcagcgtgcctgccagtctgccagtgaggactgaggatcttctggaatctggagtacgtttagtttgtacgtagggcctcttcaagaatacgactgaataattccgccccaacaaaacgaaaaagaaaacaaaacgagttgataaagcaagagcagccgaacgagttaatttccaatatatggtttggcacgcgattgctccgtgcgcttaataattaactaacacaagtcctcccgcacgtggccgtggatttggatatatacaaaaaccagacaccccgatcgatcggcctttgctatcgtatagctagctaccagcccaaccaactagtgcgcgagtgagcgcgcggctattgcgtgccaaaca

SEQ ID NO: 22953 - DNA, 1130 bp, Oryza sativa
tgacaacaagttgaacgagacaattagcgatgtgagatgcgaaagattattccagaacagatcacaagcaggcctgtgacaatcatgtgacgcacaaggagagagtatgggaagtaaagtcaaacaaacgagtacatgatgagcatttttagacggatttaggacttgacgagtggtctaaaaacctgataaatcaggtacgtttattcaagaaaaacataaaacatttttttgccacctactacattattagtgcgcacattaccagcagccctggcttattatcacaactcaacactttgacagaacaagcacataaactagaggacgtgctcagtgctcagctcagctctcctcctcggcggcggcggtggccgtgctgatcttgccgcagacgctccgctcggcgtagagctggtacggcggcgcgtcggtggcgagccactgctggacgtcgaacgccgccctgttgcacctggcgtggggaccggcgacggtgacctcgacggacttgcagaaccacccgtggtgctcgccggcgccgttggagacgagcttcatgcggcagacgggggctcccaggcatggcccgcggccgctgaagatgtcgacgttgctccgctcgaagtagtcgtggccggccgccatgaggccgccccacgcctgcaggttcctgatgaggatgccgttgccggccgccgtgtagagctccacgccgatcgccgcgtcggtgccggccttccagatcgagcccgtctccacgtagagcgtgtacacgcactggttcgaccccgtcgagcccgggagcagcagcgcgcccgtgtcctcctccgacgttgctccggcggcctgcgcattcaaggttatatatggtgaagctgatcacgagatggactcataagcgagactcagaaaatgtagaacacgtaccaaagccgccatggaaatgagtgccgcaaagcagaggagcttatgcgccattgttgaaggcttgaagaagcagactgtctcgacctttatctgcactttttgagatgttatgtgcaccgacgatgatctacttcagctggctaatgaggcttcttatagacggagacaaaacggataggggaattggaaatgctaccgta

SEQ ID NO: 22954 - DNA, 240 bp, Oryza sativa
attcctgcagccctgtgctccttgatcaacttccatagacaacagagtagcaccgaaataagaattcaattagcatcacgcaaatgtttacaaaagtttatcattgctctagcaagattgcccaagacattagggcagaccaaagtttagcatgccaagagttaaactctatattaatacatggaaatagctcacaaaagttgccacacataacatcttccagtttttactttgcataga

SEQ ID NO: 22955 - DNA, 1501 bp, Oryza sativa
aaattgcaaggaaccaaagggccagtgaggttagtgacaacgatggatatgaagagttcaatgatcgtgctgttaactaccactgtgactgtcatgtttggacgccacttattgcaagcagccaccgtgacggttctatatacgataccaggggcacctttggatctgggtggaaatgggattatcgtattgcagatcgtaacgagagtaagtgatatatatctattttcctgttgttatctattttataattaggacatttgtcaagctataggttcagctaatatattctatgttgaaaggttagtgtgcattatattttgtacttaaaatgataaattaaactactaaaaccgggtcacttcacccctgctttaaattgagattttgtaccataatatgacactccactctatgtcatgaatactttcgcaatttctcatgattatctgcatacattatcacatcccaagggtttgtgtccaggaggaaggtggcagcaatgctgccacttatgcaaccctagggtgccaaccagtcctatggctgctggggcccaccatgtggccatctgacctacatgccctgaacaacaaacaagacgagaaattctgtctattattaagagtctggagtctagtagactaggaagttatcaattaaatagaaatatatctcccatttaagttaagggtggcataatagatgatatttatatcaaaccacagctctaagtatcggaagaactttttatttgccactacagagtgtcctattctgggatacgccattggaaaatatcttatacggtctatggcatccacctcacaaatttcacccttatttgcaattgttgaccagtcaagacatgggaaaggtgtaaaattaggatgcctcatccacctcctaggtgatcattcccatgatggccatgatctaactggtgatgcctcctcgatggcactattgaacagaggcagcattctaccatgaccacaatcgatgaagtgtcacagaataaattgcagactttgtgcttgagggggacaattgtggaccagtggaacagagccccctcaactccaaaccatggtggtttgttcccttgtttgggacctgatgttcttttctttttcccctttttttttattttcttctgtcagtctgaattggttactagaaattacattggacagaaggtgttttttttttttgccttatattgtcccacatgaagtgatctggttttagtaattaggtgggggagtgaaatgagacgggaattatctagacaaccaaaaagctttagtcattagaatggactttctacctttatttttattgtaccatgcatgtattttatctactctttaagtttccgttacaatttggcatgtcatctttgttgtagctcggttggaggcaatgatgttatcacatcccacgaaagattgctacatgagggatggaacttgcatatggcatcctgcaaatggcatgt

SEQ ID NO: 22956 - DNA, 1501 bp, Oryza sativa
ttaccacgggtgttgagagtgctacctaccaaagaggaaaaatgttctctacattaaatgtgtgtgttgtgccttgtcttggaagccatgcgcacaagtgtcgcaacatgggcccatcaaattgaaccgcctaacacgagggacgctcgtgtcattcggcatttaatgggtgaagacttctgggttcccgtttgcaccggaaaacgggagccttgcttactagagtggatgaaccgactccggtcgggatgagaggcttcacgatgtgacggggcaggttagatcgcacgccgcctgacatgtgagtagtgcacaggcgcactactccggttccatcaatcattcaaccggtcacgtgcacagcacgcactctggccgctttaaatgcggttaggtggccgttgggggcgcccacctaactccgcatacgtggcatcatgcggtgggggttggggcagtccaacccccaatcatggagggggcagccgccgccctaccccgggcccgaccctcttcgggggagtgccacgtgggtgctaggagcagcctcctccctcaagttttaataccctcaggcgaagagggggcagccgtcactccacatcgggcccgatccccctcggggaagtgccatgtgggtttcggggtggcctcttccctccaaacatgatacccctggaccatattattgacagtagcccccggcgttagccctaaccgaatgaatatagttcttttcgaaacaacagcaagagtgataattgcatgaaaaagatcactagtgggcctgtttggtagccggggctgctgctgcgccgcagcccatagctaatgtgaacagtgccacactcaatatgtgtagctgcagctgcagccgttgtagccggcctgctgaacaggcccagtaacatcataaacaaatactacaagaacaataattgaaagataagtgcagggctcgtcattaccctcaaccttctcctagagagcagaaaaattatcgcgtccgcgctgtggcacaagaaagcacaaaagcataaaaaattaggcttcttagtcttagccgcgtgtgtattcttctcctacaagcatgtgcggtgcggacgggtgctaccgtacaccaccggtccaccaccaccctactccgcactcagtgagtgcctcgctggtcagtgctcccgtccctactccctacaagtcccttcgggctccaaggcgctgcgtgccacagcaaatccacctaccaagcctagcttcttccacatccttcgatccgcccggaacgtctgcacgtacataagtaagcacgccgcaacctttcccgccacccttccgtgccaccttttccacgagttccgcttcacacagcaagctctcctcatggaaagcctcgcctatccacagaaacagaaacctcctgctctcgagccgctgccacggccaaccgccgccatggacgacaaaggcaaagccaaggctgctgacgccgctgctgctgccg

SEQ ID NO: 22957 - DNA, 1501 bp, Oryza sativa
gatctggaagggcgggacggactcggtgatcggcgtgacgctgctgggcgccgacggctccggggtgcggatccgcgacctggagcggtggggcggcctcatgggcgacggccacgactactacgagcgcggcaacctcgacatcttcagcggccgcggcccctgcatgcgccaggcgccgtgccggatgaacctcacctccgacggcaccggcccgcaccacggctggtactgcaactacctcgaggccaccgtcacgggtccccacctcggctgcgcgcagcagctcttcaccgtcgagcagtggctcgccaccgacgcatcgccctaccgcctctacgccgtcgtcgacaactgcaacaaggccaaggacgccgccgccgccgacgccgacgagccgagggtcaccgtgctgtaaataaatcgtagattctctttggattcccgtgtaattatgtaccttacgcgtatgtggtctactgctcgactgctcgtgctgtcgtgcattgcagtgattgatccttttttttacattgaggggaggatgctaaaataattatacgattttaagagggtaataagatgaaaccagcgttggatcggtcggacgatccggtgctcactccagttggtaacatgtcagcatcactccattcacaccttcaatgtcaccatgactggcttattgatttccatgtatcgtttttgtgtcggcataatctctatatgaaatgtacatgcggcatcgagacctcacggctgtttacacatcagtgtccgacaggcctgtcgttgtgtatacttgtactggagtatacagtatatatgtgaaccatgggtgctctggagtctggagtttgatgttgtttcttcagaagtcagaactcagaacagattttgtttgattgcttctgaagttaggaaaggggcaattctgaaacctgcttccaagattccagaacaagtggacaaatgggacctgccgacggcctcttttctgcctagattgggccgtggcccgtggattcgacgatacggcccagaagtcctagataggcccaagcatggttctgttgaaaagtctgcgggggtaacggcgtgccgggccggagttgatggctgaacgagaatcttcactacagcacggagatgatcatcagaaacatgctaaaacttgtccgcgtctgtggaattcagtgccatagatcgggatcttcgtctcaaacgagtcaaatgcaacgtcgctagtagactggctggccgtgtaactatgtaagcattcacaagaaatgggaggacatacacatactcatgtggcggtggtagtagtacgtactccctccgtcctaaaagagacgatttctggaagggaggattcctccacagaaatcaagaaaacttcaaatctatcgtatcatttgtgggccctggtggacagcgacttcttctctcgttcacattcacaccgcaaaaatcttatcgcctgcccgtctctaccagt

SEQ ID NO: 22958 - DNA, 1501 bp, Oryza sativa
ttacacattagtagttttgtaaagttattgcaaaatttaaaattatgttttcattttaatatatttgaataatataatgagaaaacatatatgctattatatgagagaaaatataatgatgctagccgcgcaatctgcgcgggccaccatgctagtttaatcttacggtagcatttccaattcccctatccgttttgtctccgtctataagaagcctcattagccagctgaagtagatcatcgtcggtgcacataacatctcaaaaagtgcagataaaggtcgagacagtctgcttcttcaagccttcaacaatggcgcataagctcctctgctttgcggcactcatttccatggcggctttggtacgtgttctacattttctgagtctcgcttatgagtccatctcgtgatcagcttcaccatatataaccttgaatgcgcaggccgccggagcaacgtcggaggaggacacgggcgcgctgctgctcccgggctcgacggggtcgaaccagtgcgtgtacacgctctacgtggagacgggctcgatctggaaggccggcaccgacgcggcgatcggcgtggagctctacacggcggccggcaacggcatcctcatcaggaacctgcaggcgtggggcggcctcatggcggccggccacgactacttcgagcggagcaacgtcgacatcttcagcggccgcgggccatgcctgggagcccccgtctgccgcatgaagctcgtctccaacggcgccggcgagcaccacgggtggttctgcaagtccgtcgaggtcaccgtcgccggtccccacgccaggtgcaacagggcggcgttcgacgtccagcagtggctcgccaccgacgcgccgccgtaccagctctacgccgagcggagcgtctgcggcaagatcagcacggccaccgccgccgccgaggaggagagctgagctgagcactgagcacgtcctctagtttatgtgcttgttctgtcaaagtgttgagttgtgataataagccagggctgctggtaatgtgcgcactaataatgtagtaggtggcaaaaaaatgttttatgtttttcttgaataaacgtacctgatttatcaggtttttagaccactcgtcaagtcctaaatccgtctaaaaatgctcatcatgtactcgtttgtttgactttacttcccatactctctccttgtgcgtcacatgattgtcacaggcctgcttgtgatctgttctggaataatctttcgcatctcacatcgctaattgtctcgttcaacttgttgtcacctaatccaagcataaaaaatgttggaagatgcattcaatatagagtggcatacacctgcacgaactgttctctctataagaaaatctaacaagtcactgttagatctggcactgcctatatatcaacctcttcagcttagctcacagcagcgcgcatccaatccaaaaattccaaatagagggagttcttcaagcctttgacaatgg

SEQ ID NO: 22959 - DNA, 456 bp, Oryza sativa
tacgtgtttacacaagataaccagggaaacaaaaaaaacaactagcttaagacaaattctctcagttgacagtagtatcctcattatgaggcaccaattacaaacgtatctctagaagttaaatattctaacaagaaagaggcagcatatcttccttctaatattcaagatttattacagaaaatagggaaatagatgtgtaatattattaaatgaaggattttgaataaaaaccatatatgctgtgcactaggattagtttgtttcctcctgcaaataaatatacccaaatcttgcagtgccagaaaataggagtaaatgataatcttaaaaaatacaagagctggactcgtgagtccaaagaacagcataacactagccagccaacaattgaataaaattgctagcatgagtggcaagaaagagtggacaattctggttgaaaactgagcttac

SEQ ID NO: 22960 - DNA, 621 bp, Oryza sativa
cctatgtaagattcgatcgaagtggaaggtactgagatatgctggtagccgacactgacaattaatggtttgcaaagcaaaggcattcgatccttgacgttctatgtctctcttgatcgagttaattcgataaatttcaaatcttttttttcccttttgtatgcgggccttgtaatcatcgtatgaatatttttcaattgtttggaatcaaacgatggatggatggagagtatatgtacttctagctagccctttattttagttttccccttaatttcgcaaaaaaaaaaaaggcagagaagaggaagaagaacaagtatatattccatttgtctaaatatttaacgttacgaggaacatataataaaacttccagaactttgacatcaataattctcaaatattcaagttctttttaaaaagtgatatatgtatatttggcttaatattttaaacatattatattttataaagttaataataaaaagtaatagttggagcaattgaatcttattttaaattatatatatttataatcaaatcatatcttatactaaacgtcaaatgttagttaaatactgcatgcaattaatccgtgcgtatatgcataagttagctcat

SEQ ID NO: 22961 - DNA, 443 bp, Oryza sativa
ttcctgcagcccagtactaggctactagccacttgccaacgagcaaggtagtatggttgtctgggccgacggtccatggtttggatcttgttggaatgggctgtatgatatgccacggaactgcaagtctggaactactacttccccattcggtttcacttccctccgggtgaatgtgttgtgctgttgagttctttacgtcttggaaaatgtctatgcttttctttttggcctcactggtaccttttgctactttgcaaactgcaatatgacgctactcgtttatgtaaaagtacaaaacatgcagcattcgtggtagtgtatatatttttatcctgcgtgggactgaggcaggggagcaggaagcatctttctgcgttgcatttctctgtctcgccggccaactttcacatccttttctcccgacaactttctctcgcagg

SEQ ID NO: 22962 - DNA, 372 bp, Oryza sativa
aaattctaccgaatcgagatggtctcatgcttcgttgggtatcttctgttatgtgatgcgtttctagggtgaaattgtgtagggggtaggtctcagcgtagccttgaggtgaattaggtagtggactgctaaacctagttagttctgaagcttgggcgaacacctccgttgttgtgctgataggcctctagttgtgctcatggagctttgacatgcgactataattttttttctagtatctcattctaggaagttttgtgattgctaaagtattgtgatgtcttaggtgtaggtttgtttaggttcatttgaattataaaatcgtgatactgcttactgtcttaatatatttatatatgggacacaggtttg

SEQ ID NO: 22963 - DNA, 1501 bp, Oryza sativa
tttctctagtcataaatattagggactatctaaaattctagcaacagattttttagaaaaatctttcaaatgtaatcagtgtaagttatatgtaattactgtttaactaatgtgtaatttttatttcagttcaaatttgaataactgctcacttggttaaggcgtgatgcgtgcgaccagttggtcctacgatcgaatccccgatcttgcagtttgctgtgtttttttatctctggcaaccagcacggatctaatcacgaaatcaatggaccagaaatcgaaagatatccataaaaaaaaaatctgtcgacagatttgtaccctttccgtaaatagtaaacgtttagcacaaagtttggtcaaaagtttaacgctttgatataggagaagtttgtaaaacctaataagcttatgatattataattaatattacttttctagacaaagccacacaaactatatattttattcgtttttacctaagcatttcaaaagttacttacagtctaagtatcaatacaaagtatcaacagtgctatcaaatcttgttataaatgccacatatttatgaccagagggagtaggttttttaacttggctgagtgaactaggtcaaatttcgggtctaaagaccaatattgctgcagcgttgatgctgaaacccattggattggaatgtttggaaaatgggttaggagaggtgggattaaaaaatagaaatgaatggagggatatgatgaaatgggtgagaagaatggatggctaagattaaagcttaccctttgaaggggtggaaaatcatattccaaacccattttgcaaacacagccaaaaagtgtactatactgagggtgtgtttagttcacgctaaaattaaaagtttggttcaaattggaatgatgtaacaaaaaaagttaaaattttatgtgtgtaggaaagttttgatatgataaaaaaattgaaagtttgaaaaaaaaaactttgtatctaaactcggccttagtcctacggtcctaccaggcctgagaacagaggtcggagtattaatgtaccggattggacttcagtacgctgctatcattttcttttcaaaagaaaaaaaagaaaagatgagtagtactcgtaggacgaaaatgtaaagggctcacacctttaaatacttgtctaccaggccagggtgctacgttgctgccaaaaaccaggaaaaccacgcagagccggagaagaaaaggaccctagaaaaaggttcatcaggaccaccattttgcgcaataataaagctcacgcagacttgctaaatggcgagctgctctttttctgccttgcatgttcttattacatagtagtcctataagattttataacattaatggaaatatatgtgcttgatcgcatctctgcaaaacattagatggaaaacttctgctgtctgcaaaaacattagatgaaaaacttctgccctgatgctgcagtagtacaagcgctattgcaaatcgtcagc

SEQ ID NO: 22964 - DNA, 1501 bp, Oryza sativa
aaattttggtctcgccatggtccctgccttcccggtgtggcagatgtactgcaaccatgtcaaaaaggttttgttttattaaaaaacaaagtgaattttcttaaattaccttcgaaagttcaaaaaaaataaaaatgtttttcctaactgtttctcgctgaagttcaattatacagatatgatgtaaaacatacgatttcatacatttcaacggttcaaccaagttatatggtacagttagagattgtatacacgctggattttggtgtcttgtaagggaaatgccatatttttagtagcatacgaggaaactcaagaatttgagtgccacgtaagctatttccaaaaaaaaatatgttgcttgaagaatgtattgtttatgaaattctatcttttgcaagggatggcggtagtgatctcttttaaggttgtggacttgaagaagacgtagtggcaaagcttttgccaaaggttgccgtcaggcttcaacaagggtgaaattgttggctatggtggtgaaggcatatcaatacccttaaggaaacggtagcatcgatcttcaacggggatggcttgctttagtaggggacagtgtgtcattgggtgtgagtgtgtcattgggtgtgagggataatatttagatggcataaggagggtaaaatctattcagtgtgctctctctctctatttggtcttaactagagaccctttcgtaagtcgtccgatgatggctaagatatatataaacacatgaatgttatattgaccaagaaacagataaacgagaccacttgctagaaaaagaggaccacatactatctactagttgtcatgtcaattcacgtgcatactactgaggctaacataccgttacaaaagtatattttcctttggtataggatctttgatgagttatattttttagaagtatattattcatatattatttgtaagatccgtttgaaccatcatactccacttaaaatatgtgacaaaatgagtctaatagggcgtgtttggttgcctggaccgcacctggcccgcatctggcgtgcaacctgcaggttgtttggttgcttggacgggggactcagccaggcctaggagatgcaaaaaggcccgtcgagccaggctgaggggaaacggccaatttgagctttgctgggcggcctggctcgtggcgtgcagcgacagggcacgaggctgcacccgcgtgtgcaggcagaaagagatggggtcaccgcgcgttgcctcaactcctcgagcgcttctccctcttcctcattttttcacaacgaaaaaaagctagggtttgggctgctcgccaggaacctcactgcgcccatcctccatcgccaggcgggcgtgagcgccggctccctccttcgcaggctgcttgtctccgttcgtcggcagctgctcgtttcccccgtcgccggctgctcctcttcccccgtcaccagctgctcctcccccccgtcgccagctgcttgtctcccac

SEQ ID NO: 22965 - DNA, 202 bp, Oryza sativa
tactctgtctggactgatagtatagtgtattctgatggttgtcctgcatgacaggaagcacaagatttcagatgatgcgtattctctgctccatgcttctgggactatcggtcaagtatagtagatatagccataattcttggattcgctgttttctcaatgtacaaaacaaagcttcaatagacatttattctactgcagg

SEQ ID NO: 22966 - DNA, 1501 bp, Oryza sativa
tgggaaataagtgtttaatgcaggcttcaaagaaagggctgttgtttttgcaattgattttatttgaactcttttctgaaaacaactaagtgagtgcttctcaaacgacacggatgagacagtgcgtctcgtccggtcggagtatgtgcaatgtatcagtctttaaaattgatcaagattggcacccggccaacaactttcaaacggccacccgggccaacaactttcaaacggccacccgggcctagccgatcccatcagctgcagattttccaaacaacgatccccttttcacaacagcaatttcacaaggcagtagtcaaacaaaactacgctaggaatcacctcacatccgcccatgaccgtgggcacggctgttcgaacagtttgttaacctctgcagagggggtacactttacccacacgacattactaacccggatcacccagcccgtggggatcagccacgtcgggagacctccaagctttcatgacaaggcatttccaaagccgacacagatttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctaattacttagccaggggtgtcccattccacccatgtggtcgtacttgtcttatgttcggatgaaattccaaggaaacggtccttaagtgcaagagcgggaaaccgtacacccggtacgttccccggtccgcggttttgaaaattcatttagttcgcaagcaccgacccaggtgtcgggttttccaagccttttgtaaaacccaagttttacccaagaagttttttcagattttaagtttgaaggcgaccgtcgatactcgcacagggtgcacgaatatcgaggcgcaactagatggttacaaggggacatgatataacaattaacaaaggaaggatcaaatgcaacaaattaggtaggtccgtcaatctgccttgcagacgggacaaacagattaagtgcgatcctatcaatgcataatatttttcaagcaacataattaaattcaaatataggctcaagatgttcaaaggtggcttgccttgctcgagatctggagcttgatcctcgaaatcctcgcactgcgggtcttcgggctccgaaactatacgcaaaacgggacaactcaacaaacggcgaaaataaagccctattaatgacctctaagcgtgccattagatagatctagagatttgaggaattttggaagttgaacagagtcaaacggacttacggttgggaagatattgaatttctaagattattggatttttggtctaaaggaaaaggatttaattaaacccttttggaaaaagaaaaggaagagggaggggaaataaacttccctcgggcggctagggcgcgacccgagagaaaaggggcggctcggccgagctaaa

SEQ ID NO: 22967 - DNA, 1501 bp, Oryza sativa
ggagattctccttttaagggtttaagtacccctgattctaatcaggttcagggcaaatgattatacgtactactgtacaatccctgcagaaaattacgcacaaagaccaaatatcaaggtttgctatggactgaatatatcttttgtttgcgcctggacgtcggtagctaccccagatattaattaattatttgaattagtgattttgtaccaaatgatcgaaccagctcatgcttagcatgaagctaataaattctcccgtttattgcagtactcgaatacaaatagtaggtgtactactcgccatggagtctgctctaattcgttctcaaaagcttctggagacgaaggattggtttggtcgctttctcggttgctgctcggctcgcgtgtcgcatatgacgctttacttaatgctgctagtagtactcataatttccattaattaagactcatttaattagtaatgcaccaaatccttaaatccagccagatcagatcaaagtcatcctagggtaaaacactctgatctgatggatcactagccactaaattaatccggtgattgatcatgtgtggaagcaagttttggctcgttacaaggtactattacataacactacgctgtcctgtatagctatctcatctatctcttcccatgcatttttcacctactagctagtactccatccgttttaaaatgtttgacaccgttgactttttagcacatgtttgaccgttcgtcttattcaaaaatttttgtgaaatatgtaaaactatatgtgtacatgaaagtatatttaacaataaatcgaatgatatgaaaagaataaataactacttaaattttttgaataagacgaatggttaaacacgtactaaaaagtcaacggtgtcaaacattttgaaatggagggagtagtaacctgtgatgagtttccttcatcacccacgtctctttctactaaaaagaccatcatgtagctcgcctctagtatttaaggggcaccaccacccctcccactttatttcctctatacaacgatttcctcttgtcaccctgaatctacttctgctgcaaaaggtaattagcatatcctaactatttatcacctcatccctcaagtgtgttcttctactttcttagatgtactttttaaacttttctgtgcataaacatctcatgtgctgattctttttgtgtgttctatgtgcttgcataccatgtccgtttggttcgattcgattttttaagcatccgtgtggtttgtttttgttctagcttagctagctagctagcaaagaggtgtcatggatacataccagctttaatttgatttggtttgctctacctttaaaagtgtgtgaatcatctccggtcctagtttatgcatatctgtgtgcatatgtacaaatgtttcaggacaggagttggcataacagctaacaaatcttacatatatagcagcaataagcaaggagcagttagccaggtaaagct

SEQ ID NO: 22968 - DNA, 313 bp, Oryza sativa
tatttatttcttttatggtagtatagtttttagaagaaaaaataaattagaagtacgattcactttattcgtcttattcgtcttgcttgcatcccgacgcctgttcttgtaccccacttatgaggtcagcaagttgatgaaacctttgtttggtgtaacaagctagctcagtcaaagttttttgttcaagtcgaagtcaaccggccagttcgtttgatacacattctcagagatagacgcctcagctcgcaaaatagagacgggaagaacagagtaatgatgcaatctgcttgactctcgggtgttccatagg

SEQ ID NO: 22969 - DNA, 399 bp, Oryza sativa
ttatttaattaaaaaaacttatatataacttttttaaaatactatttagtacgtagtatgacaaaaggatagcagcttaaaaaaaggtaagtaggagacatccttatattagggggtgtgtttgattctcaaccatattttgcatgtgactgttaaatatgtgtttggtttttttaataacttaaacaactttattatgcaatacagggtttagtacatcgcaaaaggatacaaagtatacgtgtttggtccactgttatcattatgacagcatattttttcaatacatgttccatgtatcgtagattaagtcttttatcaattttatcatactttatagccaataataatttattcgtcacacttttgttactctcaccatttacgtaaccttaatta

SEQ ID NO: 22970 - DNA, 1501 bp, Oryza sativa
atccacaccaaatcccaatccgctaaaataatttggtatccattcgagtatccgaatccatactgttttcaacccttaggctatattcgattaatccccacaaacccctccaatcctcttcaacactctttaaaccgagcaaggccttaaggggactgagtgcaaatacatggggacctttctgaaaaaaaagtacaaaaataggggctatttggaaagagggggctctgtcaaaaacagcatcgtgtggcctgtttaattgggctgagatggtctgggccgtatgcccgtacacctctcccatccggccatcccccacgataccgtcagtccgtcacgccccagaattggtgtgaggtttcaaatcatctcgcttcacggtggtcgctcgcaagccacacacgcacgcacccccaccactcctcccattcgagaccccgcggggctctggattgcttgctcggaacctgggatgcactgcctcgcctgcgccgctccggccgcgcgcgccccgggcagtcgcgtcggcggcggcggccgccggaggatggctatcgagtgcgccgcctcctcccccttcacccgcgacggcgaggaaacggccccgaggtatgcccgccccttgcccctgcgccagaaattttgttctaaccgggtggttttcatcggtacaatctggtggttctggataactgtattgcgtagttagtgtaggatggcccaatttgggtacctttcgcttgctgaatctcggttgcttctagcgggagattattgattattccagttgtgttccgtttgatatctagtagagtagtagttgatgaatttttaggggaaaattcgatgtgcgagaacattcgtgttagttaactcaccatcaagcagcgtccacattttctcatgttctgttagtagtatttgtcttttgcacggcgctcactctgtgactatgtgcacctgcattaggtattcatagttggttgaccgttttcctattcactctatctgtttatgtttatctgaaattatattccaggtcaatgatggaaacatatggtgaaatgtcaagtaaacctgtattgcttgcgtcaaggaggaagcttgttgcattatcatcgttttgcttttgcttacattcttcaaggtacttctcaggttcggactaagtggcatgataatttaggtgttaatagaaattaactcgatccttgtcagttgtcacctacccaaatgattgcttttgtagtatttaatttactctataagtgttcatgctttgtaacttacaactccttaaatacagcacttgctttgggtgatccatctgttaaaattgatgatgtcactccaaagatttttccatctggtccactgtttccaactgaggtcagtacttagttgaacccactttatcctattttacttcttccaaaaatatatttacatttctttggatatttcttcttttatggcttgcatggcagaaacggatcgcaga

SEQ ID NO: 22971 - DNA, 1501 bp, Oryza sativa
acaaaatatagttgtccttactccttaccaatttaccatcctcaacaagtaaagactaaagagaacactttatgttataggctcatgaaatagacaaggtttgctctaattttgccatcacacagattcatataatagctgtggtcgtttacaggagatgttcttgggtccaataaaacacttccacagatgcattgcagtagctccttaaaatactaattttgttgatataagaagacaaatctgatatcttgagctattgcatttaaaaagtaccatatgttcgagaactatatgaaagaaaaaaaatgtatgtaattttgctgaatcagcatatctgtgaaacatatgggttggaagctgtacctcatgaacggttttatacgtgatattgacctttcataaccatcttctgaatcattctttgcattatcatctgatgcctgctccacatcgttgtcttcttcattttctcgtcttggttttgcttgttgtcttgatgtaggcttccagcttgctttggcaagtgacttagcaagtaaatctgcaatatttattgacatttcctcagctttctgcacatgaggaaaatgatcttcctcaaaatggtgtgacaaccacaagtacattgacaggacctgatgttttgtctcaaggtccagaagctcagtgtcgttctttgcagaaccctttggcattcccattgcaatgctaacacgacggctttggctatagtttgtagcaaatctcagaagatggtacatggcttttggatcccttatattcactggagcaaaacaaaaattgtagcgatccttgagggagagaccctggatcctctcaagcatattagcaaccttcttgatactttcctggtgacacatgaagtatgtactgtcgacgcggcaattttcacggaacttatccagcagttcattgaaggtaaggtcaggaaactggatggcaaaactttccacctgctcaaagcaagggaatagaccaactttcttcgcttcctcaaatggctgctgaaggcactggatcaaataatccaaatcatccaacaagaaggtggttgtcagcccatctgggtaaatactgcctctccgaccagctcgcccagcaatctgttttacctgtgaagcagcaacaggtaccatcctgtccccattgtacttggccaaactatagaataccactctcctaatgttgaggttcaatcccataccaacagcatcacttgctacaagcacatcatactcattatcctgctcattaaacagctttgcttgctgccgccgtgtctctggtggaagagctccatatataacgcaacacttgtgcttcgtaaacttctcgattgccagtttcacctcaaatatctctctgcgtgaaaacgcgacaatgcagtcaccagagcgcacattcttgaggtctccaagcagtgtctttgcttcaacaacaagcggtttgaagcgctcatattgatgcacctccaaat

SEQ ID NO: 22972 - DNA, 684 bp, Oryza sativa
atgaagcgagaggaggctgggataccgaggaaacaatggaagaggagagggagtcttaatgaaggagagaaaaaaagggaggggtaccgggtaccgaggagagggtagcggcatgcgcgcggctcggcagttcatttttgtcccggtttgtataaacaaccagaactaaaaatagatctttagtcccggttgtaattggagcctgactcgacccaccaacttctttgaaccgggactaaaaatgatctttagtcccggttggtagataaaattttttttaaccgggactaaaaatgatctttagtcccggtttttattgcatccgggactattgtggaatttggtcgaccgaccaaagatggtttctccaccagtgaacccctccaaaaactttatggggcatttgcaaatttgccaccggttttttcaatattgcaaggatgccactcgaatgacagttctaatggtatttttgcaattttctagtggcagttttgcaataacgatttaaagtagtggtaaatttgcaattgccccaaactttatttgtaaaactgtacggttgagtgagctatctcaatctaactcaaactaatttgaccacggttttgccaagccaattagaacaacgtagcgagggttttgtcacgacagatagactagaatgacaggagaacagtgaca

SEQ ID NO: 22973 - DNA, 1501 bp, Oryza sativa
acaattgtactatcaaaatattttactcacttgacccacggataccagtttccactgtaaaactggcaagcattttagataatcttttgagtgatccataaattgaaacaaaagaatatatcagtttaactgatttcacatcggacaccttgacgattgggtgttgtttgaatttgacaaaagacgtgaagaattctcatcaataaaaggtagttcatgaccactcgctctccaggaacaggagtccaggtcgaactaaaaaggagactgcacggtgttctttcctaaacgttaacaatgacattgcaaacataaacataatctcaccaatatagtaattgcaagttgaacagtacacacagctcaccttgttacagcttccggtacccagcagcacagctcgcgctgtcacctaacatcaggcaaggggctcgtcacgtatagggtgtgtttacttcatgaaaaaagttataagtttaaagaaagttaggagtttgtaaaaaaagttaaaattttatatgtgtagaaaagtttttatgtaatatgatgtgatacaaagttaggaatagggggcaaactaaacacggccatattactccaatttagttgcagctttcagtaccagcagcacaggttgcacagctcacttctgtcaccctaccatcatgcaaatcgcaaaggttctgatttctcaaggtttaccaacctgccatctcccatgagctgttttccgacgagtacggaagtacgggctgccgcgggctgcgacgtgcacccgttagatgggctcgacgtgcccatgtatcccccggctcgcgacgccgccgcggcccacccacgattcgcaggggcggaaatccacacggaaaaccccgtcaaaataggcccatccgccgagacgatcatgcaggcgaggcgacgaccaccccccacccccacgccgctgccgcgtgccgccgcgctttttatacgagttccagctccgccgcgagtccgcgactgctgctgctactgctactaccctagcctagtagtagtactactactgctacttcttccccggtcgcggccgcctgcctgcctgacatcgcttcgcgtgccaaagccgacgcgcgcaaaagcaaccaaaagcgaaagcaagaccaccgcctgcttgctgctcggtctctcactctcacggtctcacctcctcctcctcctcaaagccagccattcgtctcctcgtctcgtttcgtttcgcttcatctcgtcatcgatgcgctcccctagaatgagagaaacctaggactagtactgcgtcaccatagaaggcgaatcactactctgccccggatcgaccacccacgccgccgtgattgggagaggagacggacgcgcatgccgccgcagcagggggagtgctgccgccacggctggctcggcgtgggggaggccgcggtgggcggcggcggggaggaccgttctacgtgccgtgccaagcggctgtcggtggacggcaagg

SEQ ID NO: 22974 - DNA, 1273 bp, Oryza sativa
cgtaaggtaaaatattgatgctacaatactatggttgtgtttagttcacaccaaaattgaaattttagttgaaattggaacaatgtgacgaaaaatttggaagtttatgtgtgtaggaaaattgtgatctgatggaaaagttgaaagtttgaagaattattttggaactaaacacgacctatattgatttgatttttcatcttactgcccaagtactactataaaacaccgtggaaccttgctttagcatttcaaaatgcagaggatccggatccagtaaatttggcagaaccgaaactcggtgttaaagcataaagcgtctgcaatttcaaggtgaaaaatcgtccgctatgtgcatatctgccccgcatgtatacgactaactacgctcatacgctaacacgtaatgaaataccattgggttgtttcactttggcaagaacacgcaggcacgtgcccaaacaccccgagtccccgacgaccggactgttccagctcaaactcactatagtagagagtactccctccgtccaaaaaaataataatctaggattagatgtcacgtatcctaggagagtgaatctagataaatatatgttcagattcgttattagagcaagtttaatagtatagcccactattaatatatggtcccacctgtcatacatacattgcgtcttggagtccgtgttgcagctggctacagatatataacccgctgctcttctctctcatcttttatcttattaaaatatgtttatagctgactaataatctgctattatacatgctcttagaagatgtcacatctgacgcttaagttaattttttttataggatccagggatagagtagaagaagagcgcacgccaacaccgcagccattccgggccgcccggacccaagaaaaaacgcacgaaaagcgcaaaaagccgcggctgcggtgccgcgccaagctcgcgcgtggggccgatctgtccgcggttgcgagcgcgcgcgcgcaccagaaaagatgcgggtcaatgcgacagcgccatccgatctccccctctccgccccccacccacccaaaaaatactcgcaaaacctcagcgccaaagctagtgggcgaaacggagaaaaaaaataaaaatctgcagcttgccgtcttcccttctcttctctcctcttctcccccaaacccaaagccaagccaagaggagtctcgctcgcttggcacttatcacgaaccatccttcccctctctctctcgtccatgagctgaggccgacga

SEQ ID NO: 22975 - DNA, 714 bp, Oryza sativa
atgtaatcttacccaattttttccctttttagtgaataaaggggtccattagaaacaaattatcttacaattatggccctattattttcatagtttcccccaaatttttgccacagattattgttctacacttctactaatacaatgtctaaaaaaattcttctaccatattcatcggaccatatattctaacgtagtatttgcgaagtttaattatatctcaaaaatattaatttatcatgctaatcaagacaatctgtgtgactgcgtcaacaatttggtggaaaaacaatctcaaacagggccgtgttcttttaaaatttttgtgtcaattattcattccaaggggccctagctaattgatcaattttcaaagttctagagggaatgagcattgtaagtgatcagttaatcaattcaatgccctcgcactaactaacagattttcaaaggttgccacaatcatataagtgtgttgttaagcctccgtcccaaaataagtacaaccgtggatatccgtgtccaacgtttaaccgtcagtcttatttgaaaaatttgcgaaaaatttgaaaatatttagtcacacataaagtactatttatgttttatcatctaatagcaattaaaatactaataataaaaaaatttaaataagacgaacggtcaaacgttgaacgtaaatagtgcaaaactgcacttattttaggatggagg

SEQ ID NO: 22976 - DNA, 335 bp, Oryza sativa
aatcgctccatgttttgataatatgttgctacagtaaacatttgctaatgacggattaattaggcttaataaattcgtcttgcggtttactgacggattctgtaattagttttttattagtgccaaacaccccatgcgacatcctatataatattcgatgtgacacgctaaaactttacacctctggatctaaacatcccaacatgtactgtcatatagacagtcccaaacattaggggcccttggaggcctctataataagcttagtcgcgcgtccgtgcaatggatgatgtttgcctataatatttgttcatgtgcatagtccatatatggaa

SEQ ID NO: 22977 - DNA, 201 bp, Oryza sativa
ccggtctgtgaccagtcacagaccggtcaaatcgcgggttaggtggtgacaggcggtctgacgcacgcttcgccccatcccgtcaagacgagagcttctaggcactcgtccccggctggagctagcgtgttacatcccagagatgacacgttagccccgatcgatatatgccaggcttcatcctaaccattacaagcaaga

SEQ ID NO: 22978 - DNA, 512 bp, Oryza sativa
attcctgcagccctatttcttgctgtgccaaaatggctttacaagaattgtttcttttggccctcagaagcaacttccataatacaaagtttttctttttagcaaagcattgttgtaggcaaaattccagcaatagattgaaggttggttaattgcgacatgcttaaacaagtggcttacaacaagaacaggtatggttccagtaagtaaaagtacctaggcaacagaagatttagtacaaacatgtggattcagtaattagcaaacaaataatagttgaggcctgccactaacatactgatgtatgcaactattgcataagcacaactcatttgccattgttatgctttgtggataacaaaaaactggcatactagacatcttaactcgattgaaggtgtactacagttatggatatggagcacctgaacaacctattgaaagagagagagcagaagagagcattttgtgtgtcaacccgcgcgcgcgcgtatgtgtgtgagagagaaaga

SEQ ID NO: 22979 - DNA, 1501 bp, Oryza sativa
aacgaacagaacctaagagcaggtacaataacaggctataagccagctataaacatattttaaggagataggagaggagagaggagagcagcgggctacagatttgtagccaactgcagcacagactccaagacacaatacgtgtatgacaggtgggatcagatattaaagtgtagtatatgtttgtaggtaaatattgtatgaattggctattaaattgactataggtgattccgaggtagtagttggctatactattaaaggtgctctaagggcatgttcgctttaatgcaaaaaaaaccttaccaaattttggtaattaccaaaattttggcaacttgccaaaattttggcagtatttcttatatagttaccaaaatttgacagcaaactaaatgtaatcacttttttggcaaatttaccaaaatttggtaaggttgaaaatggcatcaaagtgaacaggccctaaggcagctatttcagctgagctactcaattttcggtagcataattttcaaactgttaaacggtatattttacgtgaaaactatttatatatatgttgtttaaaaaatataataaatttattcataaaatttttatatattaatatttaattaattatatgctaattaagtttattgttttatactatgctaattacgtttctcgttttacgtgtgactaattagctatttcaagcatttaaaaagaatgcaacctaagtacgtttcgattccatgattcccaaacagaacttaggtcaggtttagtgcccaacattttattcaaactttcaacttttttatcatatcaaaactttcctacgcgcacaaacttctaacttttctgtcacatcgttttaatttcaaacttctaattttgacgtgaactaaacacacccttagaagaacgtggatttcacgtaagagaaaagttgaattttgactcatcatttgacccacccatagtagattaatgcgtgaaagataaacagaaacaactgaaggtaatttatgaataaaacttttacttatgtctcgtttgcggtttaaaagccattgtaaaaaaaaatagactacgatgaaataactctaaaaagaaaatctaaaattaagttctcaaaattcaaattttggctagcgtgtgtgccccagggttcaccataccgccggtaaccgcgcggttaccgcggttaccggccttaccgcggggatacggtaatgtaaataccgcggtaacctccttaaattcaaataaatttaaaaaataatttgaatttttgatggattttacacggtttttcacggttaccgcggtaaccgtgcttaccgctggggcgcggtaacctcggccccggcggtttgggaaaccctggtgtgccctgctttgtccattgtgacaaaaagtatggacaaaaatacaaaaaagaaatggttacgggagtatatatgtgacacaggcacagtgacacctcggcaagcagttctaccaactgcaa

SEQ ID NO: 22980 - DNA, 508 bp, Oryza sativa
ataaaaagaattcattgcatgcaattttttctcttatacacatatgcaatgcaacgaattctttttatagataatgcatagcaatttatgtaaaacgaaaataaattatatacttgcaagtgtatacgatagccattagactcaagtttcatatacacatattgaaataacggaaagtacatatgcaatgttgtttattcattttgggtttcttttttctagtgtatagttggatacaaattaagggcaaaagggacattttctaaccaaattgttgactagaaatagccatatggcatatttagtgagtccaatgatgattttaagccaaaacaaatactaaatacttagaacagctatatggataaaatgaaacttacaggatcaaactgagtctttggtgaaacttaagggactaaattagttattcacccaaagaaaaacctcagcaagaaacgaatccacccaagatccccccaaagaaacccccaccacttggcaccgcaga

SEQ ID NO: 22981 - DNA, 1501 bp, Oryza sativa
ttgaataaaatgttgggcactaaacctgacctaagttctgtttgggaatcatggaatcgaaacgtacttaggttgcattctttttaaatgcttgaaatagctaattagtcacacgtaaaacgagaaacgtaattagcatagtataaaacaataaacttaattagcatataattaattaaatattaatatataaaaattttatgaataaatttattatattttttaaacaacatatatataaatagttttcacgtaaaatataccgtttaacagtttgaaaattatgctaccgaaaattgagtagctcagctgaaatagctgccttagggcctgttcactttgatgccattttcaaccttaccaaattttggtaaatttgccaaaaaagtgattacatttagtttgctgtcaaattttggtaactatataagaaatactgccaaaattttggcaagttgccaaaattttggtaattaccaaaatttggtaaggttttttttgcattaaagcgaacatgcccttagagcacctttaatagtatagccaactactacctcggaatcacctatagtcaatttaatagccaattcatacaatatttacctacaaacatatactacactttaatatctgatcccacctgtcatacacgtattgtgtcttggagtctgtgctgcagttggctacaaatctgtagcccgctgctctcctctctcctctcctatctccttaaaatatgtttatagctggcttatagcctgttattgtacctgctcttaggttctgttcgttgctggaggttcccaaccagaacagtgtgcacgcaaaacggagtgatccattagcgtgtgattaattaagtattagctatttttttttcaaaaatggattaatatgatttttaagcaactttcatatagaaacatttaaaaaaaacactttttagcggtttgagaagcgtgcgtgcggaaaacgaggcaaatggagctgggaacgagcacttacgaacagagagcatctgtcggtgctggaaacttcttttgaaaagaaaaaaaaaaactcaaaccgaaactaattcccaactcatcctaaccgtccgatcgtaacgccccgagatggaatccaacttgctttggggcgaagcaaacctccctcgcgactttctccctcccctccccacggacaaagaacccagctccacccagaaacaaacacggacctccggacccaccccatccaccgtacacgtgtccacatctacggcccagatccctccaaaagtggagcaggttcgggctaaggctacgcgtcgccgccgcggccgcctccacctcatcatctcccacctctcgccgtcgccgccgctgctatttagatcgaatcgaatcgaatcccacgcggcgcggagccctccacttgcgctgctgctgctgcgagagatcgatcgagaaggcgcgaaccattctcccccctctcggatcggcgggtcgaattggggcgg

SEQ ID NO: 22982 - DNA, 1501 bp, Oryza sativa
gaatgtgaatagtgataatcaaattcgccaacttttctttggtggcatcgaaaataggtattcctaccaccttgtataatctctttgatgtctgcttgatttgtatatactttatgccaggatatctttttgaatgcatgtcatttagaaaccactgtaaaaggatatcattaatatgtgttaaaaccaataattgcttgctgttcttatatgcattggtctatgcatggtttaaactgggtagcaattgttcttgtgtgtccaacactccaagacatgaataattcttcatatcaacaagtggtggaaaacgagggaatctatctttgcattctatttgtgctaggtatttcctttatgtaatttcaaagaaaaagtagtaactgtgagttattgcttgtgcgtatttcctgtaaaaatgattgttttctttacatttacctgcttatcattgcttatgtataattcttgtcagcttcacaatctttgtcgtagaaataagcctggtgaaacttggccacaaagtaaagcttttaaagtgccaaatgatgaaggcatagctacagagggcaagaagactccaaagtctcgcacaatcaaacttttcactattgtggaagatcttaaacttttcactacagagggcaagaagactacaaagactggctggcttaaagtccggggggaggttttatggagtttggctggtaaaatacccacagatcatatatataaaattgatgatgatggccaagagtttgatgaagatgggagcagtgtggaacttcctgagcaggatatagaagacacttccccatatggaactgcatatgaagcgtttggtggaggaaagaagggaagggaagcatgtcatgccattgctgctctatgtgaagtcttttctattgacaaattgatatccggcttcattgttccattgcaggtgagccaggatcttagtcatgctgattgaagttgccattcttaagacatcactcattgcatgtacttataaatgataatgcaaatcaatttgtgctggtgttatgtgtcctgagtcctgacagctccaatgttctttcacctcacgctcttgaaactttggggcttcagcatgcaccataaatgtggtgatttggtcagcatgcaatttttgtagggagagcatggaattcagttaaatgcattgtcagtccatcaagtttgaaatttggttctttcgattagtgctgtttgatatcttaatttgataatttaatactttgtttataccatgatcacttggtctgttttgattatatattttgaggcttaatggtgctactactgtagtcttggtgctgatccaacttgtgttgtttgtgtgagggacaactatggtgtatacttggtgcatgataccaatagtctcagctaactgcacttaacttctaagttgcacctactgtttgagtcttgactgctctttatccatgatagggagatcgtatatcatgcaagg

SEQ ID NO: 22983 - DNA, 287 bp, Oryza sativa
gactgaagcacactgaaatttttaagttgatgctgtaattagtattacgggcatgcccatttgcacctagctaagaagcaagatttagaagtggggttttcatgataattaagcttatgtagaattgcattcattttgtcaacatttatactatcactttctctgacttttcttttgtatatgtttattgcccagaactactaatattgaaaggatatcctaattcttgtgccacctctttttgctgagtgctaattcaccatgtcttctcttgttgtttccgcagg

SEQ ID NO: 22984 - DNA, 1501 bp, Oryza sativa
ccatgtggcgattttggtgggaccaaggactatattagcccacatgacaaatttaaaggacttgtttggacaatataaaatattaagaactaaaatgacccaggagcgaaactttagtgaccatattagctattctccctattttaaacatgaaaaatagatttatttgatattttaaagcaaagacaattttcaacgaaacataccatttgataggtaagtttaataatttggaaaaacgtgctaacaagtcgagataaaatctttctgactttctcttactcctcttcagccatacgctcaagctttaactgaagtccatagaaagcaagcggcagcgtgcaatgcgtgtccagtgcagcggcgcatgcgcgtgagcgcgtcaatgtcgttaagaaacagttacatgtacctgtcagtggcacaattgggagctcaatagcagctgagattttcagcgaggcaaaagacatacagaagtagaagagatggtgagccaatcaaagcacaaaccaacgcgtagtagctgacggatttgaattgtccgcacatgagctctcccagccactaaatcggggagcccaaaggaaaaaaattctctcaattattgctgcgtgatccactgcattattgtccgatcactcaaacagtggtccatcgaagctttcggctgctcgatcgatcagttgccattgccgtttgccaatctcacctgcatgctgtatccattccgactgaactggggtctgaactgaactgttcagatcagagagaagaatataaaaaaacattcagtgacactagtgttaatgcttgtacattttaccagtgcggatgaggtcccgaattgtcgataggttacagctgctgcacacagatgcatggaccaacttcactggcaagtgtagcgacttccttgactgctcaggaagaagggaatcacatagaccaatctgtaacaaaaaaaaaatgaaatattttaatcaagagaatagtgttgttgtaggaaaaattgccacgagtccttttcggagtaccaaaaatccctggattggcttgttccacagccacaaaatatgctaactaaggtaccatcagcatcattgttgtgcgaactgaacgtactcctcttgctacaaatatagaccaaacacttgggactctaaaaagtacacaccaccaatgttgattgtttcatcctacatattaagctcagagcatcctcacattgggcagcgttacacaagtaccaacaatattagaaacctaccaaatatgccattgaaacacactatgggttgccaactccaataccaccttctataagcccaaaaaatttgttgaagaatgcatccaccaagtttagtgctagataccttgaagcgtatcaaactatacatagccatgaagctcctgttaccgaattcggaggtgcctcggatctattgggagaaagctcagcatctctgtgggttcctgtccatgaagctcatttccagag

SEQ ID NO: 22985 - DNA, 1501 bp, Oryza sativa
tagttaaattcattagaagacagggtttggaggagatactaacatgacgactgcaaatagcaacagagttgatggagaaagtgttgatatatcaaggatagattcaccggcttgtcttgtattaacactctggaataataatcctaccaatttctgtaaccaattcattccctctaagctctctgagttccactcaaacgagcaaataaacattacttgcagtagaatcagtccagtaacactcagaacaatgtaaacagaatttctcctcacatgcaaatgtttgtagccagtctccccaggatgctgaaggatgtaagcatactctgcttttccactgaccttccccaaaacccatacgcatagccgcaagagtggtgaaaacaaggtgttgcctgctagaatctgcgggatcactaggagcaaaaggacccagttctttctgaagggttgcatgttactatttagtggcgtgaagccacagtttgcgaacgaggacactgctgtgaagatgcaaaaggtatacatattgatctccttacttttcagtacatttcttgcatctgaatcaatccaaaagtaaataataatgatgacagaactggaaatgacagtagctacgaaataacctgtcactatgcgaaccaacacagcgcaaggattatatgttatgcttttgttttgctgtacctggttttgcgacatagtttcttctgattggccacattccgtaattttgtgatccccattgtttgcaggactgttgaattcaatgtccaagctgattgaaggtaaacttctctggctgttctcatttctgttggcattggcattgttgaagtagagccctagcattgatgtgaacacctctcctcccattagcatcagaaggatcagaacccagagttgcctgtcagataagtcttccatctctactgttgccatgctcgagacagtaagtgtagacacagaggtgaacaataggtccaaatcctttggacctggcttaccctggggcttgagattcttcagagcaaggaaaccagcaaatgagattatcacaaagtaaacgagctgaactaccaaagggttacttttgcaaaccagaaaactataagattgtttgacagaacttgccacacatctggctctggaaatgagcttcatggacaggaacccacagagatgctgagctttctcccaatagatccgaggcacctccgaattcggtaacaggagcttcatggctatgtatagtttgatacgcttcaaggtatctagcactaaacttggtggatgcattcttcaacaaattttttgggcttatagaaggtggtattggagttggcaacccatagtgtgtttcaatggcatatttggtaggtttctaatattgttggtacttgtgtaacgctgcccaatgtgaggatgctctgagcttaatatgtaggatgaaacaatcaacattggtggtgtgtactttttagagtcccaagtgttt

SEQ ID NO: 22986 - DNA, 1501 bp, Oryza sativa
gagaacggcgtgatggctagtagttgagagcttctacttccgattgataacatcgtaagctgctgctgcttttgctacttcctttgcatgtatggtcgttgtgttgtgagaggagtaggttgccatgcaccaaaggtgcagagcatgtcgagcatgcgggcccgtgatgcgaacagtgtagagttgcactgttgcagagcactttgagccggaaagttgatcgaggcgacgaccgaagcgtgagacccaacgtcaaaaacgtgctccatccgaccaatttggtgtacctgatccctcctacccacctgtacacatggcgtgctgtctacgttcataaaatcaaaatggagaggcaaaaagtttatcgtttctatcgctctgccttatgtagaaaaactaaaatggagagatagaaacgagtatgttcaccggtaatcaatcgctagcatttcttcatgaaacagtgggatttcacgctatgatgctaatgtaatgcaagccaacgcccccactcacacggaaatctctgattagcgttcatgggatatagggctgttttggtttgatgctaaaacttgcccaaccaaatagttggcaatttaaatagtagtttgtagatgtttggattgatgtcaatatttgccatagctaatacaattcatatagtctaaatctaccaaaacattgatagtgtcaaaacataactaagatttagcactaccaatgatttgatagggcatcaaatcaaatcagcctatatttccacaacggttaaactacttataatacaaaattgaaggactatattgatagaaacatcacattgcttggggcgttgttcacttaaaaaaacacaagcggccgaaaatggtacacatgttaatttaacatagtgttgatatattatactatttaattaagtctactatgtaaaaaaaacatgaatgagctaataacatcaatttgttacgagaaaaggacaagaagtattttcaaaagaaaaaaaaagaggaatgctgtaagttaaaaagggggaaaatcagtgtataggagcaagtttaagtttaatagtatagccaactactagctctaatttatctatagtcaatctaatagctcattcatacaatagtaaaatagtacactattaatacctggtctcacctgtcatacacaccttgcgtcttggagtccgtgctgcagctagctataaatctgtagcgcgctgttattctttctctttatttatctccttaaaatatgtttacagctggtttatagcatatgctattatacctgctctaatgaccaagtggttatttaccggcagtaggccccgttcaacgacgaccgagccaccaccgaggtccgacccccaaacgccacacacacgaaaacacatcccacgcggcggcgtgacacgcgcgaatcgccggagacctcgccggaggtggcgagctcgggtgccggcgatctcctccccgcgggcggcgtccgtcca

SEQ ID NO: 22987 - DNA, 1501 bp, Oryza sativa
gattttgcaaggcacaaatttcctgaagagatcgactcatatgccgactatttctactgggacattgatatttctgacctcaagcaggtaaattctttttcctgtatgcagcaaatgcttatctcgtatatgcatttggctgtaattcataatgccagatatgtcattctgggtgctaaattggtattcctgtagttaaaatctgtgcaatcaacaatactacaagtatatgagactagaaatctagtatgagggattccctgcttaatctccatagttttgatccatccaaacatacgaaaattcatccaatggtccctgttggggtttgtatgataacagccaacgataaatttggaaaaatatttcccaattttcataagctacttactctttgttactaagaagtttggcaagtttgatattaagaagtttgtctgaaaactactattgtgctcggaaatattatccaagtagagaaccaatagataaggactaaatacagtgatcattttggtgattcttctttctttgtacattgttcagattttcagcaatatggacagagctgttgttgattcaaacatggtacaccactacaaaaagaagtattgcgcagatgagagattctgcttcttccagggttgctgtgtctacttctatcatgcacccttggtgtaagttttatttgcggtcaatatcatctttcatgtaatgtgattctttattcattgatgctcttcttttctggaggaatgcggactacaatgtaatatctgatcttgcactcaagagagtgaagcaggaccttaccatgcatggtggtcaagtgtgcagcattcttgctcccgctactcatttgattatagtttcagttctacaagcctacaattttgacatgctgtacaagaggttatttattaatttttttttggtctgttctatgatagaagaatttctttcttcaaacactgacagctggaaatttgaaaacttatgaaaatactggtttatgcagcctccctcctgccgagaggcgttatctacatgacaaaagattgcaggttgtcagtaacaagtggttggaagattcagtggaaaaacaaacaaggctgcctgaaaccacttacagccttaaaccggatacactagaagaaatagaaattgaacgaaggtagatgcgggatggttgtatttcagcattcgcaatatctgcattttttattgttatcgatcttttattttttactgaagtttctgttttgttttcagtgaggaaactgttcagccttgtaatgacaagcttgaggaaaatgagaaggctgatacatctcatgttaagcatgcaccaaggaaaaggggaaggccatccagtagtgcctcaagaactgcaaagcctgctcctagaccagtccgaagaacaagagctagaagaggaaatcaacatgcaaaaatagatgatgttgagcctgaagaaagtgaccatggtgaaacaggtcta

SEQ ID NO: 22988 - DNA, 1430 bp, Oryza sativa
tgcaagtagttcatcaacaaggtaatattcctggagctttgaagccatcaatagtggagaactaaatcataactgcgatatctttattcaacagaaaatcgttgaatctgaactgcaagatattttcctgtacaacccaatatctgccatccgtatattcatttgcatttactagcactagactgagctgttcaacaagcagcatttaagacaacctcgcaaataccctactccctccggttccattttaattgacgttttggacaatgacacggtctacaagatacatctttaatcttacttttctattataatatatataataaataaatgcatgtttatttttattatagtactttaaaagacaaatctatatatgttgttctagttcttttaaaccaaatatttttaaagttattaatggttaaagttataaaagtttgacctcaaccttgtccaaaacgtcaattaatatggaaccggagggagtaccttgcactttcacaagtataatttaaagccattcatctgtagcacttcagaatgaacaattcaagatggtgacgaggcacctttcagatagcataccttacatttgtacttttaagttctaaattctacaaggaactcaaacaataagagtgaacagaggaatatcaaaagtatatgcatactccaggagataagatatgagttgactcaaactgaaataaaacatgccaacagcccaacagacccatgtgattttcaaacagaccaactaatccatgttttcttatggtttacagaagagctagattgacttgataaatccaaaggatgaaaattgatcaaaatatacattcatgactcatgtgtggtatccttcaaattagctgattacttacaagcctcaatgaacaagtgggaaaaaacaacctaaccttaatttcatcttgtcaaacttaaattgacataacaccaactacatctctgacatttgttttctcctcaaaatacataacactataggaatttgtgatgatatcctcctctaaaataatcacaaaacagaaatttttagattttttagactacaccaatctcagtgagtatgctgtaaactaacacatcaaagagcataaaataacccagttctccaaatctacaccttctattagtcctaaaacatagaaacgtaaaactttacttccacctgaaataaataggaatagttcagaccttcccatttacttaatttaacgagaaatcgagactacgaaaatctcactgtaccaagagtggccgagtacctccactaatccttaaactaacactgaaagagttcgaacattttaaccgaattatcatcacagctgagctaaccagaatgcactccatgtggttgatttgcaaacttccagattctcgtcccaccagtaatccacaga

SEQ ID NO: 22989 - DNA, 262 bp, Oryza sativa
gtcgaggaggagaggtgtgtacatactcttatcttgaattacacagtttatctattgttccagtttcgacattagggctatgctgcaagggtgctatatatcctaccatgttttctaagacttttttgcatgtatctgtcctaaccactcaaggacaaaaaactgcatttttcttgttttactgggagcatatattggtgatattcttattttcaagaagaatgctataaaaaagtgctgaccattcttaacctgttatagg

SEQ ID NO: 22990 - DNA, 1501 bp, Oryza sativa
cagctgaacactacagtatatcccgattgcgtacttatagtacttacatggtccaacttctgagtaagctcaagcaaacttttctctgcttcactagcgcgggcttctagtgattcccctttcttaacttggtcctctaaatcactacccagcctcagaacctgacagttgtatgtcagttttgtaaccatttttgtcaggcttaattaataccattgttttgaaatcatgattatcttacctgtttctcaagcatctcattatgggcgtttgccttcagcactgattcatcgtcagcaacattaggcacctgattcaacagcataaaaagaaaaaagtcgagataacatttataggaataagagttccgaaaaaaaagattagtctaagctgaggttatactatatgattatgacaagtgccagtttgccacttctgttagtcactgataatgagcggtcctattcaagaagtgatcatgttaactatgactcgaaactcattgttctaaaattcaagttaattactccctccgtcccaaaatataaaacttttggatggatgggagcctatccagattcatagtactacaatacgtctcatccacacctaaattgttatattttaggacggagggactactaagtaatgttgcacagtcaaccagtaaccaacagtttctaaacgggagagttcaactagcagtcatgtattttatgccgttattgtcagttaattattacagtttccaaaccaaaaaagttaatatagcatacggagttaaaattcaagagagtaattcatagaatttcatacaataaggtgaaaaaacagaataaaattcacctgcagaacttctagctcgctcaccaatgccgcaatctgtgctgacttctccctgacaacattctccagctgcaaggtctcctccttcctcccactgatctcatcctctaaacccaaagaacgtaattctttcacccagtaaacaacaatgaatcaggtaaatttccattgcacagtgttaatccggttaatggaacaaccaaactatcatcttgtcctataacgactcttattaacgagttgaactttttggtagctccaagttattatatggtatcaaagcaacaaaaccatggtgatctatcatatcttttgcgatattcaacaatgcaaacagaataaattttcaaaatacgagtatataaataaacaagaacaggactcacctaacgacgcgactttggctctcagcatctgaagctcttgcgcctgctccggcgacgacggagaaacggcggcggcgaccacatcgcaccgggccacctgaacgaagcacaagcagaaaacgaggacggccgcgatcacagctcggtggttcgccatggcgcgctcgctcgctcgctcgccgccggcggccgcgtatgggcggctatcgacttctcgctgtcctcgccgtagaatcgatctgctgctgtatctaatcttcgtcaggttt

SEQ ID NO: 22991 - DNA, 841 bp, Oryza sativa
  unsure (1)..(841): unsure at all n locations
aatgttttttcggagaagttcgtccgcgagggagaggagcagacttcatatccttgataggtaactgccacaattggtgtgccttcatctattaaatcttcactgtgaaggcttgactcccattaccctaagattttaccagcttttcctgcaattcagagctagaattgaggggggacacctcttgctactatcagttcttctgcaaaatgaataaaaggtgctattgtgaaaatgttgttcccatgttacaaaaagatgggagatactttgtctggtttttctccatcttttgtgtcttattaatatttaccgatgaaagctagttacagtttggttcagaattgttgacacaacagtaaaggggcatcagattacatgagttttggtattcaacagacgataacctcttttttttttgctccactcaatggtgttggaacattaagaagcttgtttgacgaatgtaccacttaaacagcagtaaaaaaaaaaggatctttgtggtccaacatggaaagcatgggtgctagtagatcataacaagaaacataacaagaacgacaaggtatgacgaatgcatcacttaaacagcaaaaaaataaaaaataaaaaaatcgatctttatgatccaacacggaagaaggcatgcgctatctatcataacaagaagataagctntagccaaaaaacaacacactattaaggagcggacctgacatgggaaatttacaaattgctagtattagtgctgcaccacgtacaggaaaatcgggaacagaaggttaataattggaaggagggggcaaaaaaataaacccaatctcaatccaagcccaga

SEQ ID NO: 22992 - DNA, 560 bp, Oryza sativa
tgtagatatgctgtccaaaatcaggaggcaaacttgcacttgcagatgtgatttagcttttcaacccttcaaggaattgccaccagttcgtgatcctgattatctaaaggactagtttgtaatacatgcatgtagataagcaaaaggttcgatcgaaatgacaaaggggagaaattaaagtaccaaaaagggaaagcctggagaatttgtcctgcacaagcagcaaaaacagctccctggtaacaacaagcacatacagttacaatttacatgatgatgcacaccggacagaacttgtttggaggctattgcatcataggatgcaaatggtaacattaaacttcacatgatgcaaacagaaataaactccatgtggttgaacaatctattattagtaaagcgttacatgatgtgcttcggagcttgtttggaggacacgtagcactgtaatatccccttgttttgtgcttattaaaattccatttcttacctccttcaatgcaatagttagagctcctaccccttttggcatttttgctgaaaaaatatcatcatcaaaa

SEQ ID NO: 22993 - DNA, 1501 bp, Oryza sativa
gctcctcgacgcggagctcgagctcacctccgccgctgactcggcctccgccggagacacctccgccgtcaacaacgactatgaggaagacccctcccaaccttccctccttcctcctcgagctccctcatgccggcgccggcgcctgcagggatgggaagccgacagtgctggccgttgtggtcagctcgcttgccgcggcaacgctggtcccggcgctaaccggctgatgcgtctgcggatcgatgccctggctcatgagcttgcgcttgatgtgcgtgttccacctgcagaaccaatcaatcagcaccaagaacacaagaagagctaaccggagcagatgacaacacgttgaaatttgttttgcttacttgttgccgagaagggcgtggaggttgatggtgagctcgtcgtcgtcgtcggtgaagttgctgcacttgaggtcggggctgaggtagttcatccagtggaggcagcagctctttcggcagcggagcaaccccatcgccttggggagggagagagggtcgacggggagagcgcgtcgctcgcccggcgggcggcgacggggcccgtggtcgagcacccggcacgttcgaacatctccgacgcagagctcgccgtcgcgccggcctccacctctcctcctctcccgccgccgccgtcgcgtcgaccgcctctctctccctctcccgccgccgccatctccgctccgccaccggccacctttctccccctcggtcgccgtgcctgctcgagactcgagagatttcggagagaagagaagagaaaaagaaaaaaaacagagaaatgtgggacccacaccattgtctcacttacatgtgggccacacatattaaatttttttttgctgactaggatgccacgtcagcaaaaccactcgtatatactgcctagggaccttgagtgaacggttttgtatagtttaggggtggagatttctagatttgtggttaagggatctcaaaaaatctcggtgtaaagttgagggacggcggtgaacttattccatattatttcatggtttcggaagctacgtattgttgggccatagcccaaactgctgatgttcacactcaaatttcgcatcaaatctcttgtaatttaggaaaattcggaaatctaatggcaaagttttgcggcggtgctcccgaagcttttcgtacacgccacagcaggttactgtagtagcagctatcacatcgttctctgacgtgtcgtcagctctgcacgccgcgaaggccacgtgtacgcgcccggatcgacacgtgtacagccacgcactagaccatctcgaactcccaaagtcccaagctctacgcaaaacgcaaaagcatggacgaatcaaaaaaaatccaaactcttaaaactcgcgtcgaattcaacctggtccagcaaaaacaaagtctcgatcgaactctgatgaagaaaataggaatgtctctggacaaatcgtgacgcgacccagcactcgcatttg

SEQ ID NO: 22994 - DNA, 250 bp, Oryza sativa
gccaacttttgttttttgaacttttaacttttaaaggaataatcctcaagatttccttttttttatggaagttccttaaatatctttggttcaaagccatttcaacttgagcaaaatagttaccgttttgatgttttatctttgccaaaaaaaaaagtggtttgtgcctatattttcttttattttgttttgccaataattgttgtcacatgaaagaatgcatttgaacaactgttctaaatatttcagt

SEQ ID NO: 22995 - DNA, 1501 bp, Oryza sativa
gcacttccaattttccatctgttcaagtgcgcaacatgacgccaatgcaactcaattctagtggctagtggtgatacttctgtcctttgattatagtccatgccctgcaaaaaaatgacccctagtgaatagttgatatcagaattaacaggactatccgctgatagatatgcatgaacatgattactcacagatagatcatgtgttacatcgatctatcttatttggaatgttccatggttgtacctgcctaacgccatttggtgcgtagattacccagcactaaagagtggccccattggaattatcaaagcatattcggtgatggatggagaggctcattgctcacctgtagagctgctccattagaactatcaaggcaacttgatgattcaaaaccattgaggatagtctaattgttgcatctgcacgctctcgcacttgtagcccaaaaccatacggtccaccaatacaaaatgtgagccttgacgacccctaaaacgtttgaagaacacacattactgaaacatggtatccctcaaaatttccagcaggtttgaacttttaacacaaatatgtataaaaatttatgaatcaaggtacagagcgtaccgtgttcccagcatccccgaccagatcagctacctgctcagacgtgacatccttcccgttttcatccagcacaaccacctaaatatgcacatcaatgtcaaaccactaatacacagataacgaaaactacaagatgaactacatatgatctctagaatataaggaggtactgaaacatacgaagtcttcaggcttgagctgcagcatcattgccatgtcttctgcctccacttgcaccttaacatcactgaaaggaaaaagaagaacagaggtcagcatcagtgatcaacttcttaacaaaaaataactactccctccagtaaaatatatttgactttgagagaactaaactcaattctaccaacgtcaatggaatgatgtgtaaagctaccaatcaaaaccctttctactaatatctaggactatacaatataaacagcgtttgggaatgaatatgaatcgactatagagtatcctaccttgtgagttttgggttggatttgataagtgtgtcctcaatatcacagtagtaaccaagcttctccttgtattcttcaacaatgagctgtgcccctcgagacctcttctttccaactgttagcacacgcataggcattgctctcttcaaacatgaccacaagagatatcaaacaccaaacattattagacattcatccgttgcttttgctatgcaattcatatggagaatatattacgaaaactatgtatttggcagaaggtttcaaccccttcagatttctctaattcatttaattgatgggaaaattagttctgtgacatggaaagcactttcagaaaaaatgttcagatatagtgctgaatctactgatacaaaatccttgtttcagaagcagtttcctgttgttct

SEQ ID NO: 22996 - DNA, 1501 bp, Oryza sativa
gtgcatatggcaattttacttaagtcatatcacaaatgcacaacaattggagtataggacaaggagaaagtagtgatagtaagcattttcttggagaatgtgaaacaacttacccctgctaaagtgatgcaaacaaattagctttcctcttcatcagtttgagtagcaacttttcttgaactctccactggatgagaaaatttccctttaaacagaagtaattaatctgattaggaagtattcaacataatgctacgtgtagagaaaaatcatttaggttccaatactaaaggttcacaatgtacacacatggagaagatataaactgaaaacctgaaatctacccaacccagccataggtaaactcagcccatatacacaaaactccccaagcatgaggcccacccaacaactgctggttcaagacaatctgaaacacataatgttagcaactcagtatttctatctattctagaccatgcacaattagggcatgaacactcaatatttgcaagaaaacgaatcatatagggcatgaacaattgaacccaaactatatatgtagcaacccagtcataaattctaaaatcagttcaacctaaacttaccaacacaatgttctttaggctcattttaactcgtcagtcatcgcgtacagccgtacaaactattagaaagtgcctgttataagttcagttctgccaaaacaacaagctgagtgctcctgttactgaggtaattacagaatctacatttggaaggaagaaattctgatgcctcatgatatggttatgtataactgacattgagattagttagtaactctcacaaacaaatattaatgcagagaaatccaggtttagcatctgcatgaatcaagtggatggaagatttactggaacctctgtctaaattgttttgaattaactagtactaaaatagttgtggatcaaatttgcgaagccaaactaggtgtagagttttcttcctgtcaagctcatgaaggaaaaggagtactagtaagatgaaccaaaaactattagaaccatggttcatacatgacactccaaagccaaaataaactactaaaataccgtaatactctaatttcaacctgcaaatgaggggaaggtaatccatgtacagttgtttcatacttcaactattcactatactctcaacctaaacaatcatgaatccccaatgcttcaccaatcaaacaaacacccgcggtttgctcctaaccaaggctacttacagaaaaacaacgcaacaacttccatttcgcaatccaaacaaaatgctaaatacctttacaacttccatttcgcaatccagaaatgctaattgcctaattcgatcgaactcaactcaccttcgacgaagtaagcctccgacggccacccgcgcatggtggtgaggcacatcatctcctcctccgtcatcgcctccgcgttccaggcggcgccaatcgcgctgcggacggcggtgcccacgaggt

SEQ ID NO: 22997 - DNA, 1501 bp, Oryza sativa
gtgagaaaacgatggctctacggatacagctgccaggtgcaatattcaatctgtttcgctatcccctaacaaacgaacagagtctccctccggcacatgcggcccaaagggggagaaaaaagattggagaaaagacagataagacacacgagttagttgactggggatgaactcattatgtattagtatgagtgttatatatatgcattggaaacagggacttttcaccgaatgtgcaggcataaacacatatacaaatattcaaattttgtagtgaaagatagcccattggatttggatatgccaagttgccagctctgtgaagttcgtagtctccaatagaaaaaaatgtactagtagcatctatcgatctattgggggatgtgaagttgtgaacactgaacaaaaacccaaagaacgcaatgagaacgttgggcaaatggtagtgcaatgcactcaatcgtatggcccatggataatagaactatatgtgcatgtctctttccattgcctgaacttcttttcaaatctttttgcttttgtatttcacattccaaaacggttcaaattaaaacgtgaaggttccatgattggatcagccaacaaccactaaagagaaaaagggaggggcatcggtactgtgagcgaacatggcgccagcttccatagctctcttatgggaagcccaatgatgcatgcatcatgcatgagctattccaaaggagaaatgctggagagactagcagatggatgacactgttgtttctcataattacacaactacacgagatccgattgatatccaagcaacaattgacatggatgtaacaccacaatgctggtaatgtgagagttagcaaggacatatgatgtatttttgttcatacggcaccgtcatactacgtatttgatggtatttcagcgccgaccggccttggcaccaaccgcgacgtttacacctgacgaacgaacccacattcgattagttgacggttcacgatcccggtgagctctgcaagaatcagtacaggtcttcgagtggagcagctgggtgttggagttgggagctagcgtcattttcttcagtggaacgtggcgtcagaactctgaatgcaagatgctgtttcattaagaggtgatcgaacttcctcttgacgattgcgtcttaactcttaacccaccattcagcaatctacatcactactaagctctaccatttccgggccaagtagcatgtacgtgtcacgagttatgccatttcttcaaggaaaatagatgtgccatttcttacatgaaaaagtccatacatactttttttttcctcactaacactacatgtatgatgtgaatacatcttgcttaacttccatctagttaaatcaaacagctcatatcattgtttgtaaagagttatgttaaaaagaaagttagtacgtatagcagtgctcttcttacatattagcatttccaggggcaattgttatcagaagaagcagcatta

SEQ ID NO: 22998 - DNA, 1501 bp, Oryza sativa
tatcttacaccaaaaaaattcggatttttgtataaatcctggagaatattccttattattggtttccaattacttacctttttccttctgtcattttcagtttcttgtatatatatattttttatttatcagactcgtgcaagtaaacctccgtcagcaattcatcatgttaatttgatgtcttaattgccttaacatgatatcaacaggtgaagggaactgaccgtggagttttgctgcccaaagatgggcatcaggaagttgctgatgtcgcactacagcttgccaagtactgcatagacgatcctgtcaagtctccactaatatttggaggtattgaaagagtgaaattgccccaattctccaaataatatctccaaaattgattgtgtcactgactgacaaccagtaaagtaacaacgagcattacattgaggtttgggttgtattacaacactgtaaacctcatgccatcctgactaattttcttgcttattgcacttgacctgacctaccagagtgggaggttgtgtactgctcagtaccgacatcaccgggagggctctaccggactcctctcggccgcctgatattcaaaaccgatgagatggctcaggtggtgcaagcgcctgatgttgtaaaaaacaaggtgtccttctctgtctttggtttcgatggtgcggtatctctgaaaggtaaaaaacagacaccatctgtcaactcattctctattcagactgggcgtgacaaatctgcacagcaatactgaatgtgatctcatgaagttcttgttatgttgggcatgacaggcaagctgaatgtgctggatggtaagtggattcaggtcatattcgagccaccagaagtgaaggtaggctccctggggtttcagtatggtggcgagagcgaagttaagctggagatcacctatgtcgacgagaagatcaggctgggaaaaggatcaagaggctcgctcttcgtcttcatgagacgatgatatgagggcagcaggcaatgtttgtaccatcatgtcctttgagaccacaagagggtagcaccatagcactgatgctacgacaatatgtttgtgtgtacaatactgtattctgttgtaaaattcagaggtcatgttggctagtagtgttcttcagacctccgaattagagattgtattgtcatttccaatcaaaatgacaaaatgtttgtagtttttgtgattaatgtgatggttaaattgtccagactaatgagcatggttatggatttttggtgaaccctgcaatgaaattgctgctcctagtatatactgtatttgccagaaggtttcaacatttttgtaggcaactattggtaacggaacacttttggatctacgagcaccgtcagatctcaattaagaggtcaagattgttccaaacttccaagtgcatcagtatagcggatatgccgcctccggcctgcagtaacgtactctatggagacagaacctgtacagtcgaaa

SEQ ID NO: 22999 - DNA, 1501 bp, Oryza sativa
aatttcctttccttgtaatcgcatatttaagcaatacaagagtcgggaaaaagctgcctagttagcagcaccaaacaagatggtgttcattcctatgttcgcgggagttttgtgtgtgtgttcttgccggcgacgtgagttttgtgtgtgtgttcaccgtgagcccttcgccttgacggccggaggtgttctcaacggcagacgcggcgccgacttttccaatggacgctccgacatcagccgctgccgcttccgccttggagacgagctcctcctcggcggtgccgagcttgtcgttctcgacgcggtcatctggggccgtcagctgcacacttctcttctccacgctggcggtcgccgtggggaaaatttcaccggtgcggagatggagatggagagagaggcggcgtcggacgaaacgatcaaagtggataagacagaatcagccatgcgaaaatacagaaatacccttccacctccacatcctaatacagtgccactacaaggacgagttggtacctcgcggtacctagcgatgacagccgttggatcctatccactcaacggtgacgatttgataccgctttggcctgctgtacggtaaaaaaaactctattatatatgctttattagtagtgtgcggctctaaacaagctagttacctagctattatgagagatcttaaaaaacacaagcacaccggccgattgatgattgtctccaccaccttacatgttggaaagcctagcattgtgcaaaatcttcagtccttcaaagctcacaaacaactcactttgtcagtttatttgtcttaaccaagaagccaaagataaactttacaaatctctctctctctctctctccaagatatactacattactacaggacatacacatgtacatacatccctgtgatgatcttttgatgcaaatgaggcatgcagctaattaacaaatacccctaaaacacacatcccatcaaacagcatgcagcgagccagtgtcagtctgtcagagcatgtatgtgttgcatggggctactctaattaactagctagggctacccagttagcaaattaattagttgatgaataataatagtagatgatgccaaattaggtggcaccaaccaggcaatgcatgcatgagatgagagaggggccctactaaaacactagcagctcagttcagctcagctcccctaaccatgtgggctttgagctcactaatcaccctgtatcatcatatcatgaccgtttggggatgaagaggaaagaacaacaacccaccctgtagcatcacgtgtacacgtaccgtatttctggcggtcgacaggagccgaccgttggttaccagcacgcataattctcctccctctacctcttaatcatctcatctgcaatttggtgtcctcttaacacttgatctccatcgatcgatgatcatgtcgttggcaaccatacatccgttcttcagagatttgcatgatcagggcgggctc

SEQ ID NO: 23000 - DNA, 1375 bp, Oryza sativa
agtattggatatgacataatctattactacaaatttgaacatacctctattcaaattcattatactagaatatgccacatctagtactaacttcgttttttgtgggctgggaggggtatgtgaggatttaggccccctttgattcaaaggaaatacatagaaattttaaaggatttcattcctataggaatttttcctatatggcactttgaatcaaaggaatgaatcctacgaaattctatgaaattcctatggaatgcctaaagacatgcaagttttggaggaaatttagcatgaggttctatctcatggaaactttcttatgaatcttcatttctcctctaattcctgtgtttttctgcggtccaatcaaacggccattcctgtgtcttaactgtgtttttgcaatcctctattttacacttgcactcgtatcaaaatcctacgtttttcctatttctacgttttttcaatcctgtgattcaaagggcccttatcatattcagtgttacggaagagcacccgatgagggttacgacagattggtttaggttttctcgattaagatgtaaattttttaaactgtgaaatattatgtttttaaaataaaacttttttaactatcaaataaatctatcttttaaatttataataattataactcaattaattacacacggttggttttctcgttttgcatgctctgacttcatttttaatctatctcacatagcaccatagagaatgagaagcgagtgcagtgatcaacactatgtcaaagcatgggtggaaccttgacatagcacgatgtaaagatacgcaacattggacagtatttggaaggaaggcaacattttggtcattcgttttcttgattccttattttagtatagagttaagtaaatttcataaaattatatttattttatcaaaatatctatttgcaaattgcccagatattttaagaaggtagtggaataatgacgagacgaacaaagaatgttaacatgattgtgggaggagaccactagatacattaatacttgtcaccgtattatctccgtctcttctcattatccctcaaggaagaaatggttggataatgcaaaagtatcaaaattatctaaagatgcaccatcagatcagatgggttgtcaaactatcagttaactatctattagcttccagttttttagataacagaataaatatcccagtaataatgataaattatagggcatgttcactttgatgtcattttcaaccttaccaaattttggtaaggctgccaaaaaagtggctaaatttagtttgctgccaaattttggtaactatataagaaatcttgccaaaattttggcaacttgccaaaatg

SEQ ID NO: 23001 - DNA, 585 bp, Oryza sativa
tgggcgtgatggagcggggcgggccctgcgacggcctctgtcgcttccggattcacctaggcacgagaggggactgcccgtcgcccgctggggacgggggtgaaacctgaggtgtggtgtgcttggctagagggggttatgcgaagggtcctgtcacggcctctttccggtatgtcgtggtggcatgtcggcacacggaaacgtgtcgtggggctgtgtcttgtgggtacagttgtacacctctgatcagagtaaaactattcgaatagccgtgcccgcggttatgggcggtcaaccagattcaccgtgattagtctcaccctagtgtaatctgttgaacttggatagtttaggtggatggttgggcctgttgcaacgtgggttagcgttggacagcggatgtttaatactgcttaattattacaactgttttcgcattaaattcctgtttataaatgccagtatttatgcaaatgaaccactctagctcttctttgttaattccctgcatcatacccctattccggtatgacttgctgagtacagtgggtagtactcagtcttgctctacttttcccaacccca

SEQ ID NO: 23002 - DNA, 1422 bp, Oryza sativa
tgggcgtgatggagcggggcgggccctgcgacggcctctgtcgcttccggattcacctaggcacgagaggggactgcccgtcgcccgctggggacgggggtgaaacctgaggtgtggtgtgcttggctagagggggttatgcgaagggtcctgtcacggcctctttccggtatgtcgtggtggcatgtcggcacacggaaacgtgtcgtggggctgtgtcttgtgggtacagttgtacacctctgatcagagtaaaactattcgaatagccgtgcccgcggttatgggcggtcaaccagattcaccgtgattagtctcaccctagtgtaatctgttgaacttggatagtttaggtggatggttgggcctgttgcaacgtgggttagcgttggacagcggatgtttaatactgcttaattattacaactgttttcgcattaaattcctgtttataaatgccagtatttatgcaaatgaaccactctagctcttctttgttaattccctgcatcatacccctattccggtatgacttgctgagtacagtgggtagtactcagtcttgctctacttttcccaaccccagaggtcgggtatgtgtcagatgaaggtttccccgaggagtaggcttcgtccgtgccatcgaggatgcctgtggagtggtgttcccgctgcagtttagtcaaggcttagctccagttatctttcgttttccgctgcatttatgtaagattttacaatgtttgtaagacgtggatctgtatgtcaacattgtcgtttgtgtaccccggctggtcctggacggggattttaatgcacattctgcttggaattctattcgggaatttctgagcgtgacaagttggtatcagagccaggttgaccgtaggacaagccaaatggaaagacctaagagccctctgaatccttttcattgcatatgttctttgcaattggattttgttccgggaaaatggggatctgttcttgtggttcaagggaaaaatcttggtcgctcgtttaaagtgagtttttcaaaacgagtcagtctagggttttagtaaaattattgggatttattcgtcagtcagttgggatttgatgggtgaaatgcattcggtcctagctcggtatcatgggttgcaaggtatttatgctttgttcgttactattattatgtatctaatttcccattattttatcgttatgtgagtctgtcttacttattcgctctcatgcaaaatgatctatgcataaaatttcgcttctattcgattctcttatttgagtcttttattgctttatttaaatttggatttgagcatgcattgatcctactcctttgtcttctctagatggccggtcacccacccaaccaccgcggagaaggcatgatcgactttgtggcagagctggcacgta

SEQ ID NO: 23003 - DNA, 1501 bp, Oryza sativa
gggaaaaatcttggtcgctcgtttaaagtgagtttttcaaaacgagtcagtctagggttttagtaaaattattgggatttattcgtcagtcagttgggatttgatgggtgaaatgcattcggtcctagctcggtatcatgggttgcaaggtatttatgctttgttcgttactattattatgtatctaatttcccattattttatcgttatgtgagtctgtcttacttattcgctctcatgcaaaatgatctatgcataaaatttcgcttctattcgattctcttatttgagtcttttattgctttatttaaatttggatttgagcatgcattgatcctactcctttgtcttctctagatggccggtcacccacccaaccaccgcggagaaggcatgatcgactttgtggcagagctggcacgtatgacactggtggtgggctaccccgacgcaccggagtacacgaccattccaccgctcagtggcgagcttcctcaccgtgtccgcttggaggtccatggctacgtggggacttgcctcgctaacatggcgggttgaggcatctggaggcacagcagatcacgcctgtcaggaggcagcctacttgatgatggccagactacgggagcgccacaactacatcttccacgacacggcgtaccgctaccaccccagtcgagccaacggtgatggcgtcagctccttccgtccgacagctggcgagaacgacaccacctttggtcacatgtgtgctgtgatgagaggattggataggatgcactcggacctgcacaaggcgaccaaggccttgaatgatgggaagctcatgaggatcgtcgctctgaaggacgagatagcgcgcctgaagaaggagaacgctcagctaaagggtctcccagcaccaggaggagtccggatccgcactacgccccgtaagaggacgactgcacccgtgcgcatccagcttgcgcccaggaacccacctccaccagcagctcccgcagctccggcagttcccgcagttcctccagctccagctccagctccagctcccgcgttcactctctccttcgctccagcatcagccgccagaggtccagccagtggtaccggaggttggttgtccgctactcccagtggcagcgacgagactgatctgtcaggctccaggagccgctcagagggaccaggtgacgagcaggaggacgctttcgactccaccgaccgcaggagccgttccgagcattaggctcgttttcccattagtttatcgattgtttagtttctgcttgttagtttgtgtgtttaggttgcttgtttggggtcagtcgacggtcgatatcatgtgcctatgatatggctgtcttaataaggatttttgcttgcctttttaagtgttttaattcagatcagaacaattgcagttttaattcctatataataaagcttagttcttgagcatctgtttttcttcttttccccgcctgctcttccctccaga

SEQ ID NO: 23004 - DNA, 1501 bp, Oryza sativa
acggcggcgacaccgactgcacggtgaagaaccaccggaacagccgaagagatgggcgcaccccaatgaacatctcgcacaggtgcgcgaagatggccaatgtcatcactgcattgggggtgaggtgcgccatctggagatcgtagaaatccagaacatccataaagaaagaagaaaatggcggaaccagccctgccattgcgaaggggaggaagaagacggaccgccccgggtagtctggtgccgggcgtccctcgcccagcatcactatctcccggtcggtggcagattccggcataaagcggcgcggcagcccggcatgcctctcgctcacgatgcgagaaggcggaagtacgcttccgtcgagcagagcggaaccccgagccatggcgccggagaaagggatgattgagagcgagcgcgtgtggcgaaggtagggcgcagcagagaaagagttagggctcaagcggcgaaggcaagaggaataatggcgaaaggaagggagcaaaacttttcctcggtatttttatacccttgccatagctgggcccggctcctcgtttctcgcgcccactatctcgctccctcgtttctcactatctcgctccctcgtttctcgtgcccacgcttccactaatcccattcgcccgcttgcggcgcatgaggtggatatgcgattgtggcagtcgagataggtcgtatcgtgcgcgcattaattacgctcgccggccgaagcgacgttaccatatctccaggcgaagcaaatcagctcacccagattcgtgcgctgcttaggtgatgtggcaagtcttaaagagaccgcccattatggacagccaagttaccattaccgatgtgcatggtttgagaccgttaggtttctgcgcaaccatgaaaaccggtcccacctgtcaccaggctttaggagtggcgttacgcccgaccgcttcccttgagaagggcgatcgccctggcataacgccgggggctactgtcggtgatatgggaccgggagtatcgtgaccagaggcttgaggcagacacaatcgcccacgtggcctggcaccttcggggacgtcgggcccgagggtgaggtgtccgccctcctcctgatttccccgaggggggggtcgggtgactcctgccccggccccgagggccgaggcgccccgaccccttgtggagttagcgccacatgaatgggttgggtgaacacggtgagcctcacctaaccacatttattgcggtctggtcgaacgtgtcacgctgcatgcagcgcagtgcagcgcgttcctttatccggtctgtgaccggtcacagaccggtcagatcacgggttaggtggcgactggcggtctgacgcacgccttgccccatcccgtcaagacgaaagcctctaggcactcgtctcaagccggagctagcgtgtaatctcttagagatggcacgttagccctggttagatttataccaggcttcatcccaaccattacagcctata

SEQ ID NO: 23005 - DNA, 412 bp, Oryza sativa
tggaccggtaaatcttgagattaacgaagtcaccacgaccgtctcgctgtcgacggatacgtcacctaccattaaaataataattagttctaaatatgaacaattaagctaaacaggcacgtggtgaacaaattgatcgaccagtgtataataaaaggttacaacacataagatgccgaaaaatggacgaactaataaaaaataatttataagtttttgtatttgtgttattagtattttaaaagtaaatgctagaaaatagctagaatacagcgaaaagactctaaaattaaattaagttttaaaatttaaatttgtgtctgatatgctaataagtacagtaagggacttaatttgtatattcaaatgcagtctcattttctttttcttgttccttcttcgaaatttcagc

SEQ ID NO: 23006 - DNA, 534 bp, Oryza sativa
ttttattaaaacataaaacatagtgcgaacaataatgtttatatatacatgtgcacgctttaatgctttatctctataatcatgtctgagagattaagtcgacgacacatagattatcacatgtgtttcattattgacgggtagttgcctactatttaaaaaataattagccgtaaatatgagcatatgtttaagtctggtacttgaacttgggttccactagaatctaactagagctacgccagtttgcaaactaaatcatgttatcacttgatcattagagtatcagactataatgatttcctgtgtggttgatcttagcctctagtaaacaggaccgatttgtttacagaagtcacaatatacagtttgaatgctttgtatcgtcgtcatcatcagtgaaggctacacgcctccaaacacaaaaacatggccacacacagagagacagagtgagacctcgcactcacactcacactcacactcacgacgaggcaggcagaaacagacgatgacctgagctagtgagagtga

SEQ ID NO: 23007 - DNA, 1023 bp, Oryza sativa
ttttattaaaacataaaacatagtgcgaacaataatgtttatatatacatgtgcacgctttaatgctttatctctataatcatgtctgagagattaagtcgacgacacatagattatcacatgtgtttcattattgacgggtagttgcctactatttaaaaaataattagccgtaaatatgagcatatgtttaagtctggtacttgaacttgggttccactagaatctaactagagctacgccagtttgcaaactaaatcatgttatcacttgatcattagagtatcagactataatgatttcctgtgtggttgatcttagcctctagtaaacaggaccgatttgtttacagaagtcacaatatacagtttgaatgctttgtatcgtcgtcatcatcagtgaaggctacacgcctccaaacacaaaaacatggccacacacagagagacagagtgagacctcgcactcacactcacactcacactcacgacgaggcaggcagaaacagacgatgacctgagctagtgagagtgatgggtggggcccacacgggggagaaaaagaataggaatctagtcagccgtggggcccacgagaacgatggccacccattagagcacccacaatggtaaagtaaagtgctctctataaaacatgtacatctcagcaatatactagattaatagtaaaccatctcaatagtatgtctacatgggtatgtatagctctctaatggattgcctcgtttttctctagactatttccaggttagtgttagatcttatcatatcttatcattctctgtatggatatgcacggatgcatgttggttcggatagatagaggataggactctaatcccttgtaattaggatcaccgaaccaacacatctgcacgcatatatatctgtaaactcagcgcgtttttgcatatagtgaatcaacacgaaaccctgcgtccaccgtgacgctttcctgcatacacctgagttttatatggtatcagagcctcaaagtccggcg

SEQ ID NO: 23008 - DNA, 219 bp, Oryza sativa
ctacaattcttaacatagtaaaggcatataaaaatatattgctgtaaatatatactattattgtatgccattctcataaatttattgtataatgcgctcccagagcggaacgttgataaccaaatattgaatcatactcatgcatttatatttttataaatccacccatataaccattgatcacatttatcaatggacgtgtctctcgtcaactctagt

SEQ ID NO: 23009 - DNA, 268 bp, Oryza sativa
ctgtgtttagatctaaagtttggatccaaatttcagtcctttttcatcatatcaacttgtcatacacacaacttttcagtcacatcatctccaatttcaaccaaaatccaaactttttacttttatgataagtaatttttcactctttgctgacatgcatggcatgccagcctgcactcccacggtggacaagacgtgtgaaatgtttatcttacccctcgtgaaccctacaagtcagctgtatctctttgttctctatcagtataga

SEQ ID NO: 23010 - DNA, 449 bp, Oryza sativa
ttagagttgccaataaaaatgaatctccagtttttgatttttaggtgcaaacaaaataaaaaatcatttcgaattttagttcgcatttgtatatacacattcatacgattaggcatcaaaatatagtagcctagtactagctggtgtctaatcaagtatcccgttactatattttgaaacagatggagtataaccttttcctcccttatttcagtctgcttgacaaacttgactgtaatgcaccagtaaatttgagttatccaaaagtaccagtgaaatatatattcccctacagtcgaactgtttgggagaagaataagtaaggttcattgctgatccaacagatgagtatgaacatgcatcaaaacaaagcgtcaacttggagccacagaatttgatgaaacaatatagaattcaagtcgaatcacattgttcatcaaaatttcaga

SEQ ID NO: 23011 - DNA, 487 bp, Oryza sativa
caaacatttacatcgtctcgtttgacatttaaagttggttttgatttttttcaaaagaatgtgaaaaaattgtgaatctgaagtcggcgaggcgcctccccgtgaaccaaccaccggtgctccacggcggcctttgccgtcagcctcttcctgtcgccatctcatcaaaggcaagcagccgaaggttaacacaccgccgccgagtctgcacccctcgggccgccctccctccgtggaaggcaaaggaaatcacacatgaagatgcatggaggcggcgtgtcacgcccagaaattcccgaatagaatttcaagcagaatgtacattaaaaccctgttcaggaccggccagggtacacaaacgacaaagttgatatacagatccacgttttacaaacattataaaagtcttacataaatgcagcggaaaataaaagataactggagctaagccttgacttggtttgcagcgggaacaccactccacagg

SEQ ID NO: 23012 - DNA, 851 bp, Oryza sativa
caaaaagttgccaaattgtggaagaagttaatgtcaactggccataccagagttattaaaaaaatgtgaaaggtcttactgtggaatttgttctactatttcatatgcatatgtctactgctggtagccatgcatgtcactgttaaacagttgaactagaaatgttcatgaaatcaggatgcatgtataactgactggagatcaatgtgtaagacataaaactcttgacaaattccaaattataggacaataactagcatgggggatttttttgctgttcaattttttggttacattttctggattagatgattttgtttttcattcattttaactaaaactaaaaaattattaaaaagaacttatataagagatactagtctaggaaaatccataggtgcgcgtactgtacatatatttcatgaattattcatcttaggttggttcgctcttaaaactgaactgagggggaaaccaatggggggtacgacagacaggcaagacttgttagtcaaatagttataagggtaataatatgattgaagtatgtacttggcaactcatcagtttaactctcaatttaaaaaaattcaatttatattagtatacatgtttttttatcattctctatgtttcagccatagcttataaataaaagttaattaagcaccaaattattttggttgcttttgggcacgtagcacgttttgtaagccgcaaccaagcacattctaagaattaaaagatactaccagcaactagattacttatgatggccaaaaatcactaggataaagcaaaaaaacgtctcgaaaattattcgtgacgtatcaacatcaggaaaattccgt

SEQ ID NO: 23013 - DNA, 650 bp, Oryza sativa
ttcctgctttgtcaattaatctcaaatgttcaaaatctttatctgtcagtactttgtgctggacatgtgtactaagtgcatatatacatgcagacaataaattacctttaaatttgcatgtgttaagcgatcatatattcaaagatccaatccaataacaatccaatgcatttgcaaagtatatactgcagatacgatgtacggctcattgtagtactcctgatcaattaatcatctctcagactcagtttacaagaagttaattaagacgcagtgcgattattgtacttattgctgttaagatttcacatgcatgcataaataaagcggtgcgtggatcctacgtataccaaccgatggatagatcattattttctcgtagctgggctgcagagaggattggacgtacgtgatcaaatcattcagtttggacggccttaattcgcccatctgcaaattcggcgccaaattggccctttttgctcatagctagctggtcgatccatcgattgatggatcaataatgcaagcaagctgtgtttgtattcatcgatgcctatataaaccgcgcgtttgcctcacctttcacttcatccatctctacacatcagcaatatttagctacacagagctagctaggattagctcag

SEQ ID NO: 23014 - DNA, 1501 bp, Oryza sativa
  unsure (1)..(1501): unsure at all n locations
taattaatttagaaatatcttaatgtaaaatgtagtttgtgcgctgctgcctttaattgtccatgagaagacgcgttccaggcacgaacgtgaccggaacacacgacgctcacgctgcaaacatgcagacgtgctcatgcaaaaaatcgaaaatagacgagctacagtacagtacaatacatcacaggacgctggttacaactttaagcaagaacacatgaaatgaaaaggcataggcatgcaggagaggcgcgcgcgttctagctgtacgtagtgtgtcaggctgctagctagtgctgcaggtagacgtggatctcgacgacgccgccggcggcgaggctgtagtcgtagctgctgctggccatgtacccgcgcgcgagccggaaccggccggtgccgccgacgaccaccgactcgcgcacgccgacgccgacgtcgatccggcccttgatcgccaccgagctgccgcggtgctcgccggcctccatcaccaggtgcatgctcaggtccgtcaccaacccgccctccgacacccgcaccccgaacccctgcgccgtgcccacgcgcgcgctgccggcgtccggcccctccgtcagcgcgttgttcagcaccacgatgtccccgaactgccgcggcggcgacgagccgtcgacgatgtcggtggtggactgcagcaaggagcggccggagacgacgcgcatggcggtgggagccgggccggtgtaggcgtcgtgcatgtagaagtggaggtgggtggtggtggtggtggtggcgncggcgctgtcatggcggcgaaggaggacggcggccgcgatgaggaaggagcagccgaggaggagggaaggagacagggaggatgacgccgccatgatcgacgttatcgagcttgctttgtgtgtggttgctactggcaggcagccctcatatatacacacactatgtacgtactggtttatgatttgttagaatctagttttaaacttaaccaaattgatatttttttctccttgttttaaacgtgggtttatttattaagatactgactagaccacctttcttttgtttcgctttgttccagttgctttcgatccagtactacctccgtttcatttcaggttataaaactttctagcattgcccatatttatatagatgttaatgaatctagacacatatatatgtatgtgtagattcattaacacacacacacacacatatatatatatatatatatatatatatatatatatatatatatatatatatatatatatatatatatggataatagtagaatatcttataatattaaacagaggaagtattagctaagtgcaaggaaatatagggtctgtttggggagcttaagattctgcgaagtagctggtcggtagccagcttatgagaatctggaaaagctgggtttcccagcttatagcttctaggctgtgtttagttcacactaaaattgaaagtttggatgaaattgtaacaatgtgat

SEQ ID NO: 23015 - DNA, 373 bp, Oryza sativa
acgcaatagtggatagatgcacgttctggttgttagcttgcatgtaggtgtacatgcagccttgcatagagggttagtttgttagtgcatggcgtgagtcccggtcaagagaattggctggttgttatcctttgcatgtaatttgagtctatatataatgagaaaaatgatgaggccgtgggtggttgaatcaacagaaacttgcatcttgtgctgcttgtgtgtgtctacctgagaagcctttgtggcaaaaatacggtagagagagagagagagaggaagtgatttcccaccagagagacaaaagtgtttgtgattaacacttgtagctgtgagtgagcaatcccaacacaagggagggggagagaagcga

SEQ ID NO: 23016 - DNA, 1501 bp, Oryza sativa
gtaatttccgaagcaaagcgcggggaatttcctagtatctatatcatccagtaccttattatctctgtctctctcgtctcatacttattcgcttgtttctataggctgtctctctcgtctcatacttattcgcttgtttctataggcccgttagaacgttgaaaattcatatggtcccctcatctcctaattataggaggttgttgggcatactcttatcccttctttatatgcggctcccaagagtattgaaaattcgtcgaacacggtacaatcatacgtaccatatttgtcctgacagtcacttgaattcattttatatgagagctgatatatatatatatatatatatatatatatatatatatatatatatatatatatatattatatttatttattttagggtgtgtttagttccacgctaaaattggaagtttgactaaaattgaaagtttgaagaaaaaagttaaaagcttatgtgtgtacaaagttttgatgtgatggaaaagttgaaagtttgaagaaaaagttagtaacttgttatatacgatgttcgtgtgacgtaacggctctctcctagaatcacgacgcaaaagcgaagaaagaacatgacatttaccgtccgtttcccagctaaccatgcatggtggcgttcaccatacgttcccaatcgcactaggaccgtcgtataagtctataagaagaaatcgttcacatagcattttttatctctatagcgcatgtacagcaacggccggaatatttgattatttcgttgtctctcaaattgtcaattgtcttctgcttacctcgctatatacccggaccgcgaaaaaaggtcttgtatgtacactgatctaattaatgcttctttgacaaactgcaatcatttcatcacaactattcacttatttaattaccaatacccacggagcgcaaggcggctatatcatgatcatttcacttcctatggagaattttcaaatacaggaaagtttccaaaccatcagtagattggcatagcagaaaaatacacatcaacaacagaaaaatagacgggaggtggggcctcatgcttattctccctccgaaattcatctacaatagtctatttcgttagaattttaaaggggattggttaaaaattagtcctttcttcaatgggctctatagaattatttttcatatgacacaaatgctctaatatttttatgttttgcttataaagtgcaagctgctagttgctttcacaggattagtgaagcaagagtataagttttgagcaattgagatgactgtgaaatttagtgttatagctcgagtccccaagacaagtatcctgcttggtcattgccttcgagtggtttaacatgcttaggttgaagttaataactggctaactattctatcaaaggtttctcctttgcttattacttggtgttgtggttattatattgaaagatgccaatcgtggacatggacacattcagagtgagtg

SEQ ID NO: 23017 - DNA, 1501 bp, Oryza sativa
cgccggcctccagcaccatgtgcaggctcaggtccgacaccacgctgtcgaaaaaagatttcggcaataataaaatgggtggctatcaagctagaaaagtggatgggtttggagacgaagaattttataaaggttcgggccttcttattcaagaagtaataccctactcctgtccggggatgattccgccgagtgtgttattgattgtataaattgggaaaaagaatcgcgtcccaagaggcacacggaccctccttatataggggaaggagtccgctttacaaaatacaatccatatcctaacggaatatgggattatagataaaatacaaacgtaaccgactaagatcccgggtatttccttgacatacaagtttagaacctaacccgagtcttcatagagatattccatctatatttggtaccgtatatccgactaaattacaactgtcatgtagatatggggtatctataatctccacagtagcccccgagacgttcgcagttgacaaaatagccttctcgaaacaaaaaacagtagtccgagtgcttcaattcaacttgctccagcttgccgagtgctaaagatcaaaaactgtgaagggcgaaaataaaacatggtgcatcgagtagatgtacctaattaggtgtagcccccgactatgtgattagttgaaaaactaaacatatagtcaagaaccgagtggttttatagcgaagcacgcatggtacttagtaagatacccagccgactgcttctcaacttgaacataccaaggacaaaaaatacaagaagggccgagtgataaacactcaaaggtccaaaaatagacatgtttgataggaatccgagtaaaaatctcataaaatgacccaccaaacatgatagaaaatcatggtaattaataagtctaatagcctaggctgtgacccttaccataaccaaaataagcatataacatgctaaaagaatgattattaataaaccagtcatctcaaatcaacccaaacagcttttgcagcctaataaagcttacaaaaaatggtataacacctttctgtcgggcacctttttatatgcatcataataattccaaagaattattgaatcgcgttaaaaaggattttaacagcattgggccacaccattgtgaacacaaattgccaaagcaaaaattgactaagtccctagggatcacaacaggccacgctgattatagtattgggctgaagtactgtacaggcccaggcccattagtactcccgataccccaataataccgaagtgaaaaacgtctcttcgtcttccccgccgagactctcgccactttccccatttcctgctacagtgcaaaactgcgccgggcaaactagggttcatcaatccgctccaatccaccctcaaaaacttcacgaaatttctcctcgcatccaccgctccgattccccatccctttccagccgtatctcgaactaaatcagaccatccagttcacattca

SEQ ID NO: 23018 - DNA, 292 bp, Oryza sativa
gagtaagactatcaatccatgaaatagattgccatctttaaaataactcccgtagacacatagcagtcaatacaacttaaggggccttttatgcaacaacatacgaaaatcgattttcacatacagcctcttaaggatccgcccaaagtctgagttacctcctcatttctctcctcaacacttcaaaatttttcatccctatcctttctcacttcctctcctcattatttcaaccttatactctcctctcttctcactctcacctcctctcctctctaactcactggcaagc

SEQ ID NO: 23019 - DNA, 264 bp, Oryza sativa
tattgagtccactagttgatcatgccgggtagagggaagtgatccttgtggcaccccttattgaggtcaatgaaatccacacaccttctctacttgtcattggccttgggaaacattactggatttgtgagccactctggatggagaacttctcgatgaaactgttgacgaaaaatccgtgcttggccaacggtgcccgatctgtgttggccgcgaacttaaatcgacgaacacaacgacctaggagatctgctttactccagt

SEQ ID NO: 23020 - DNA, 1501 bp, Oryza sativa
cgagcaaagagctaagtgtggggagtttgttggcggctattaaatgccaaatttatgccgtcaatacctgcataaacagaaagaataaagtatccaacatagtgattaggtttatttctaacatattccacgagtgttggtgcatatgtgcctgcaggtaataaaccgccgaagttgggatgaaaatcagacttaagtggaggtgaaatcctatccatacaacgagtgggccaataactacacaaaacatcaacaaatggtccttccactcgaagaaatagatatgggaggctgaggaggagcaacaggccgaaaagtgggcctattgggccatacatgggttcggccgaaccactcccacagctgtctgatatgcggcttggcagggacagtccagatgactccctaatggcggttggagggtagaatggacatttcacatcttcacttcactcacacactccaagcttgagctgaattataagaggctctattgtactttattgtatactagattagagagagagtagagtacaagaagtcagaggagttccggaattgtcggtaatcctcttcttatttcttttgctttgtttaactactctgattataatagaaatatctttcgagtaatttagttttgcttggtgagaattatctcttggttagttcctaatcagcgtacgagatcatcgttcactataatccagcaaaatatagtgattgctttagtgtgtacctaacattaaagtaagttattaattgcttagacgctgtgtctaggtagttattaatcgctccgtatcccacagtaggtgtggggtgggtgtagaggtggtgacagccctcaagatcactgaagtcctccctaactaggtacgtagtagagcgatatctgggagtagtaagctggccagtgcccgaagtatcgtattaggattaaagttaagctttccatagacactgtttctcaccggtgaatccactctatcctttgcttatccttagctttatgtacttggacgtacctggtgaagagccgacacagacgttccctgtggaaatcgatacctgagaatactcctgggtgaagtgttacatcggtatatctctataaggttaagaaataccaacatggacccagtcatgttccctgaagcagattactaggttggacagatacgatctacaatagccaatctaaacaattccttcttggagacaattggaccaacaacctagcgtccttcttgttccccatctcaaggagaagagcaacatggagttgggaatgtcaatgttgaagatgtccctagcgaacacctgagtttagacccaggccgtaatccccataatgcattgccaagaagaccaagttggaaaaccccacttgccgaggtaatcgtgatctttgcgaccacttgaacaggcggagacgggaatgacgagaacaagacggacgtcggccatcaccaacgttgttctccacaacgataacaga

SEQ ID NO: 23021 - DNA, 1501 bp, Oryza sativa
tttcctgcaaatttgattatcagtattattgccacaatgggtgcgcatcaatgcaagagagatcgttatgtaagttgcacctagaagacttcctgatctttggcacagggcgactggatgttttcttccttggtgtagcctgttttgatagtttcttggttgtctctcggtctccaggcctcctggcggtatcatcggcttcgtcgtcacttaaaaccagcttcctctttcgagaatctggctggctgattggatcagaagcacttggttgagttcagaccgaattcgtggtcctccgctcccttgcccagtttggtggcggggagatcggcgttgagcgattgggggatccgacttcatcaaagcaaattcctgggtgtaatatccttcattgttaactaattcaacaagaaaataagatcatattttgagaaaggttgaagtgtatgaatacgtaccggtggaggaggattgaatgcattgaacggtacgactggcagcaagtgtgagtagctgacaacgatggcgtttgagaagatcttatacatcctttccttcatgaccttgaagtcaagagaatctggatcttcacggtttgggtcatgcttgccgtcaaattcgaaggctgtgcgagatctttctttgattggagctaactgacacttgataaagtgccgggtgatctgttctccttgaaggccctgttctttcagctttatcattctctccatcagttctactgcttgtgcagcttcatctcccattggcagtgagttccaagtatcccgataaactggaggaaggcaggagtactcgggaagaacaggctcggggttttgaacataaaaccaatttgcgtgccagcctttatttgaggtcttgaagggcatggagaagtatttttggcttagtgttcccctgagttggaaaccagcacccccaacgacgcatggtttgctcttatttagctggggcttgaggaagaagatgcggcggaacaaggcgaaatgaggcctaatgcccagaaaagcttcgcaggcatgaataaaattggcaatatgcactatagagtttggattcagatgatgcaagctaatcccgtagaagttcagaattccccggaaaaatcttgaggttggaagagaaaatccgccatagaagaaatgagcaaataccacgatttcgtgtgtatcgggggtcgggaatgcctcaccaaatgccggtcgccacccgatgatctcttttgctggaagaacgccgtgcgccaccatctccttcagattgtcttccgtcacatcggagggcgcccactgactctcgaagctttctctttcttccgccatgaatgtgaactggatggtctgatttagttcgagatacggctggaaagggatggggaatcggagcggtggatgcgaggagaaatttcgtgaagtttttgagggtggattggagcggattgatgaaccctagtttgcccggcgcagttttgcactgtagc

SEQ ID NO: 23022 - DNA, 1501 bp, Oryza sativa
tagaatgacttacattgtgaaacggagaaagtagtaaaggctcaagatccggatgcccctatgatagattcaccctaaagttgtgtgtatagtttccttgtggaatgaaaatccatctcctatatatgcatatagttcaaagtgtcgagaagtagtaactacactactatatattgtccagttgatgtattgtatcgagaagattaagtaacattaattatatatttatttatggtttatgtagcccttgatagttgtttgctttaaatataataatttttgaatctgaaattaataaataagaagatgcatatgtattggcattgtctttatggtataggtgatatgagctcacgctatcagctgaatatttgaacatgcactcagtaatatttagacaagtgcttggatcggtacgatatttagcttaaaaatccgacacccacctcagcatccatcacacatgcaggtgcaccacacaaagcctcaaaaaccttgcatagccatgtagcactggtggagaaaccatctttcgtcggtcggccgatttccacaatagtcccggatgcaataaaaaccggggctaaagatgatctttagtcccggttcaaaagggtaacgggcatatttgatctttagtcccggtttgtgttaccaaccgggactaaagatcatctttagtcccggttcgaatgctgtcaggacctgtcaggcccccccgggatctttagtcccggttggtagcaccaaccgggactaaagatcttaactttagtcccggttggtaataccaaccgggactaaagatcccggtgatctttagccccggttggtgctactaaccgagactaaagatcttaactttagtcccggttggtaataccaaccgggactaatgatcccggtgatctttagccccggttggtgctaccaaccgggactaaagtcccacccctatatatatgtcttcttcctcctccagctgcccgagcaagcttcaaaatttcttcaaaaaagaggggaggtcatgccaaaatttctattgaatttattttggtgattacatacaaatcggaggtgcctaaaaggtttgcaacttcatcctccaatgttttttttttgtcatactacatttgcacctatgttttgcacactttttttgtctccaaaatttagttgtaagttgatgagagagaaaatgtgtgtggggaagaaagaatatatagaaatttagttcatttgctaaacaaggttttataaaatagttgagaaggaaaactctagtgaaagttaatattaaataatagaaaacaaactaaaataaaaattaaaagaagtaaaacacattaaaattagtttaaaactttacaaatagtttttaagaattatttggtgtaatattttatgatttttgtatgaataaagatatcttataattattgtatgactgtcattattgtaagaataattatttgtgtgcggtttttttgactcatgtaga

SEQ ID NO: 23023 - DNA, 216 bp, Oryza sativa
tgaatgtagacttaccccttgtttagatcctacctcaaaattttttaccctgtcatatcgaacgtttgaacacttggatgaagtattaaatataggcttaaaaaataactaattacacagattgcgattaatttgcgagacgaatcttttaagcctaattgctccatgatttgacaatgtggtgctacagtaaacatttgctaatgacggattagg

SEQ ID NO: 23024 - DNA, 333 bp, Oryza sativa
aagtattaaatataggcttaaaaaataactaattacacagattgcgattaatttgcgagacgaatcttttaagcctaattgctccatgatttgacaatgtggtgctacagtaaacatttgctaatgacggattagttaggcttaataaattcatcttgcagtttattgacggattctgtaattagtttttttattagtgcttgaacgctacatacgacaccctatataatattcgttgtgacacaccaaaattttacacgcatggatctaaacaacccccttagctacactggtggagaaaccctttgtagtcccggttcgtaaccccccttt

SEQ ID NO: 23025 - DNA, 858 bp, Oryza sativa
ggaaattaaatatttaccatttttaaaatgtgccatttaataatttatcactcatatctacttattataaaaattgaatatgtttttgccaatactttgatacgccatccgtgtattagttagtttttaagttcatttgattttggaaatgcatattcatgtttgagtcgggttctaagtttgtcctttttggaaatatgcaacgaggcgcgcaagatatctctttaaaaactcacatactaacttgagatgatcggattcctagttgcaactcatgattttctatatatatatatccaagcaaattcctatagtgaatttcaccttaactaaatcgtataacaataataaaattaaaataatcttcaccaattgcaacgtacgtgcattttttctaagtattatgtgacatatgtgtcttcatgtatatatgatatttgggttaagtgatgccacatgtaaaagtgacagatagttaaatatctcatacttgtagccaggtgtcgaaaacaagatttatttgtgctttttttttccctatacctctgttcaatactccatctttccatcttaagatcacattttccgaacttgtaaaccgtgcatattacctattatttttaaaaaagtttataggaatttgcttttaaaaattatattaatctacctttcaatatttttagctattaattaattaattatgtgttaatgagtcgctttatttgacatacatctagggggagaaatcccatattctctagactaacacagctttaattggaaaaaaaaacacatatactccatctttgaaagaatgtacttttgaacttaatttttgtctcgcaaataccatatttt

SEQ ID NO: 23026 - DNA, 1251 bp, Oryza sativa
tggtacacagtaatttatagctgggataccaaatgctcatacacgagagtctactagaaattagtgcaacataagcccgcaggcattatcttaaatcatcggaccgagcggtccggaatacaaccaaaagcagagtttagataaggcagcggaatttaggcagcggcatgccattgcacaggcaacgaccgtactaagacctattgggcaccatcgtcttcttctccctcctggtagtaggcataggggttctccgaagcttcatctcccgcttctgattaattttatatttgcaagggtgagtaccaaccgtactcaacaagccgccacatcaacaatacatatgataggggtatttcaaaggatggctttggttcttttgtgcaaagcaagttttataattcttttcacaaacttaagacctagcattgactgatcaaattttagtaccagtgtttgtatttaaacaacgacggttctgtccaccatccattgtgatcccaaggatagcttcccgccattgagtcgttatggttttctgaggacgtccactttcccctatctcaagaagtgactccgcagcatagaaatttcatcatgcaataacatatcccacacaagttaagaattcagagactagccaagtgtaatacatgtcccggtgctcaataaccgcgagcacggctattcgaatagttttggtttactcacactgcagtggatgtacactttacccacactccatgactgcccaacacatgagccttgtctcaacacatgagacgcgtcacggcaaagcctttcgataacctcgcattggcagtacccgctccatgaacttttcatcctcatgcactctaggcgtacacggtttctagcaatgagaggagttctggcgcacccgggaagggaagttttacacccatgtaattaagttataactaggctcaactcaacacacgacagtcctagcaatggcgacaccattgtagagcccctgccatacacatgagaaaccactatgcatggatactgcctccgctcggctatttactccgctaggtctaaccccattcgagaaatgtggttgtacgaggtcgtttcatgcttaacttcatggctcggtccttaattgaccggggacggtactagcctttcccggataccacccaaatccaccatccgccccggtctaaaacataggtttttaattcctttcttgtcaccattatcatggcaatgtggtgctca

SEQ ID NO: 23027 - DNA, 1501 bp, Oryza sativa
attagttttgtaagtagtctatatttaatactctaaattagtgtctaaatatagagactaaagttaaatctatggattcaaacaccacctaatatggtactaggttgtggaatagcaaggacagagagatttgttctagatagatattgggtacacatgacaagattgattgctgcaaggaagagcaagtggctagactacttatttgatgaagaaatgtaatgtgtggagcagcggagaacagcactgatggtgacgagtcccatgaggcatgaggagcggaggagacaagtgcacgtcgcctgcctctctgtctgtatctctactatgtatgtaggagtaaatgtatcagtatcacggtcgtttttatcctttccatgccatgcctgagagaaatgaattggcttcggcttcggattggatatgcttcttcctccaccacacaaccagagcacaagccaaggcaaacctcactgttgcttcccttcccttcgccctgtaccaatagaagttcggattgggtttcgttcttttcttcttcttttttttttcccttgtaccattagaacatggccatgccacatattgccatcgctccatcgctaacatttccacgacggccggcagcctctctcctattaccaaatttcaaaagcttctatacaaactagtgtcaaactagtgtagtactctattcgttttttaatatatatggtactgttgattttttaagatatatttaattattcatcttattaaaaaaataatgtatttatttattttattatgacttgatttatcgtcaaatgctcttaaaattttttatatttgcacaaaaaattttaaataaaataaatgattaaatatttataaaaaaatcaactgcatcatcatgtatttaaaaatcaactgcctcccaacaacatctatcaccggtgaaagcaagaaaaatagttagttcagggatatcatatgctgcctgtaatgtattggatccatctgtactccattatcacgcacgcctctccaagaaatcataagctcattagcggtcaacacgatgcgataccgccataatcgactacagtctacaaatttaggccaatttcaaaatttgtgtggagtataaattacaacgaattttctgcatttgctcttgtttgttcgtacggatagatactactagtccgtcaattgccaataggcagggagaaaggaaaaaaaaaacaaaaaaggaaaaaagagctttgagttgactgacatggccgtgctctcctcttcctcccatggcctcctccacccaccgctccgtctcctcgccgccgcctccgccagtagcggcagcagctactcgattccccatgcgcgcctccgcctcgccgtcactactccgtcgaggctaccttcccccatctcatcctcgcccgacccaccgcccgacgtcgcccacgacgaagacgaacaggaaggtcagcaccacaaggaggagcgggacgagcgg

SEQ ID NO: 23028 - DNA, 1501 bp, Oryza sativa
ccagtagcggcagcagctactcgattccccatgcgcgcctccgcctcgccgtcactactccgtcgaggctaccttcccccatctcatcctcgcccgacccaccgcccgacgtcgcccacgacgaagacgaacaggaaggtcagcaccacaaggaggagcgggacgagcggtacgggttcgagatccaggtgcgcaagctgcccaagcgcaaccgccgcctcgtccgcgcccgggtccgcgtcgacgccccgctcgacgccgtctgggccacgctcaccgactacgagggcctcgccggcttcatccccggcctctccgagtgccgcctcctcgaccagtccgactgcttcgcccgcctctaccaggtacccccaattcctcctccaccaccaatcaatttaggttgaccttatctgtgctttcatccgcaggtgggtgagcaggatctcgcgctgggtttcaagttcaacgccaggggcaccatcgactgctacgagggcgaattgcagctgctgcccgccggagcgcggaggagggagatcgccttcaacatgatcgacggcgacttcaaggtcttcgagggcaactggtccgtccaggaggaggtgtgagatgctattccaaatccatgttgccgaatcatactaccacatttcattccatgccatgatcccaacagcatgattttttctttctttctttttgaagaagaagaagagagatagtagtgcatagtaagcatgaattgagaaaaggaatcaacccccattcatcccaaacatacgacatactgcattgatttttttagataatggatagaaatccagcctctatacatgtcgcattgatggtggttcagatttaagatttttcactttttcatacaatcagctgctcattgcattaaccatcggtacttattctcgattaaatctgattccagctggtctggattctagaagcaagatgctatgaatttcattttctgaatcttaatctcgagactagggttagataatatgatgatttgggtgtgctgttcaggttgatggtggggaaatatcagcggatcaggaatttcagactatactttcttatgtggtggaactggagccgaagctctgggttccagtgaggctactggaagggaggatttgtaatgagatcaagaccaaccttttttcaatcagagaagaagctcagaggatccagagattgcaagataaggtaaactgtaaacaagggtgttgctcaattgctgttccaacatgctcgagtcaattagtagtaatttctgaacattcttcagtagtactggaaatacaacattagcctgtggaaattatggcaatggtacatttgggagtcatatcttttcttgttatataactccattttgttcattccactgttatcatactgtaccttcttaattctacagagaaatccatgctgaagtttggcagtatgttttcagtgattggtcatctcttaaggcttc

SEQ ID NO: 23029 - DNA, 1501 bp, Oryza sativa
tgttgctcaattgctgttccaacatgctcgagtcaattagtagtaatttctgaacattcttcagtagtactggaaatacaacattagcctgtggaaattatggcaatggtacatttgggagtcatatcttttcttgttatataactccattttgttcattccactgttatcatactgtaccttcttaattctacagagaaatccatgctgaagtttggcagtatgttttcagtgattggtcatctcttaaggcttcatcccaatattacacgtccttgattctcaagaatacacttcagaaaggtaggtatttagcactccttagttttttttttcttttttgaaactttagcacttgttagttagttggacaactgccatgaacctaatgagtctcagtcttgcagggggaaaatgggcgaagaaagatgatgacgcgcttcatgatgttagtggaacacccaaaattatgacttaggtcactgggcatgtcttgtgacaattggattggttgatctttctcaatagaagagaggaaaaggcaaatggattatttggaattcggacagctttggacgtgcctgacaggcaaatggatagagggtcccaaaacctaatcttgcttgtatatctaggattacctttttgccactcaatggagaaatgattaacgtttcgtgattaactacacgatgttgacatatattgcaattttatttgtaaccaatcctaggcagaaagctgctgaattggtactcacttagtcacttgcctcttgtgttgaagcggaggggaggggatattttgggcttgattgggggtgcttttaacttctgtagcttctccgagaatcagaaacttctctaaacagttcagcttttgtctggattctaaaaaactgtagttataaaatctagaaaatgaattaaaagctagaaggtaggaaacctacttttccagatcatcataagctagctaccaaccagttgcttcttagaatctcataaacatgccttttgtcatcttctgttagcttacttgtactgtggaatcatcatctaaatcaaacttgtttgttcataattaatcaaacttgtttgttcaaaatgatgagaaaattgcaatattaggactgtaaacattggggtttcgcacttttgacacaagtgggtgacaaataggcccatttgtgtctataaaatgtgggtcctgtgtcattatagcaaatgttaatatttgcaacgtcataattgcaaatcccccgaaaatgagtcgttcaccatctttgccactttctcgcgaggtagcatagcagtgctcactgctcagtgggagggagcatctcgccgtttcaatcggatcgggctccacaaatccaatcccgaattgaatgatgaaatgcgcggcttcctccgccacgccgagtcgcgaaccccgcgggccttcgtccaactcctcgccgcccagccgccgcgcccctccgccgccgaccagtgccatg

SEQ ID NO: 23030 - DNA, 716 bp, Oryza sativa
atctggacatgatgatattcagattcgttatactagactatgtaactgtaaaattaaaggtgtttttgattgttattctgtgatgaacaattggcatcggagattattggttttgatatttacaatttattcaccaagtggtttaggagatgattggatttcacaggtaaatctacaggtactgctggaataggtccggtcagaccaggcatgtgctaccggtcagaccggcgtgtatcgcgcagtcagaccggtgcagcccgcggtctgaccggcggactctgtgtcggtttcggtttcgggttgtttgtttggatatccgtgattgtttcatgattatggcttctagatggatactatacgtatgtaatactgttgtttgctactaatgagtcaaggttggagatagcttggtctcggaatatgatttctttgtttgttctatgtgtaggtgactcggatggcaggagagtatttgcggtgatggactaagagtcggcttggggataagacgacgtccgtggtggtcagagatcatacgggatactacggctagagttcaatacacatggttggtgaagattccatatggtatacgatggaggtattgtgtgtgtatggaatgcggagtcgaatttgaaaggagtccaaatttggtatgagtggttatgtaaagtttgtttcttgtactagagggtttcctaagttgtatagga

SEQ ID NO: 23031 - DNA, 1501 bp, Oryza sativa
cacaaattcgtaaaaataaaaaacgaagaacgaactcgaccaaactagcctctctctctctctcttaaaatctttcgatcatctcagttctggtcttattatagtttgcttttcagtttctgttagtttcccatctttagaaagccgaaaaatcaaccttcttcccacatcgatccccatgttatatcgtcttcactgttgcttttaaaaaaaatatagaatgtgaaaatgtctggttacgataaaaaggaaaacacccggatacgattattgaaccatgtcgatattagctagagagataacaactgagtagagcataataaagcaattagatcgccatatccaacaaaatatggatggccatatcctatccatgcatgaccgtgaaccaaacacactctaagttatgtatgttatccaagaagacaaaaaaaaaagatataaatatagctgaatgagagatactccatccgtccctaaaatataagagattttggttggaagtgacacatcctagtccaacgaatttggacatgcttctgtccagattcattgtaataagatatatcacatcccaccaaaatctcttatatttagggacgtggggagtagttcataattatagagttagtggcacatgatgggaagcaagtgagagttgcataggatttgggcagacttggcaggttggcttccgtcccataatatagcaatctaggatgggatggaatctattataggacaatgtatctagacatgactcgtaatatagcaacctaggatgggatgagatccatcctaggactagatatattatgggacggagggagtagtttatactttgggtaaaaacataaaccagtaggaaaaaagaagcaattatttttgcacatttttctcttttacgtgaataagttttggtggtcgttcagaaagagaatttgaatttccaaaagactgtataaaccgtgtagtataactgtaaaccaattggccaccactacttctgttggacagaaaagcatgaagtacagtagtaccgtatttgtacaacatacagatacagggagggagggcccacacaccagactagtctagtcgcatacggatcggatccacagactagctggctagctgctacggttgttggtgtggagtacacagaaaagaaaaaaaaaaggaaccatgtggttggggtcggtgagacaagcgcccttacccaccaaccaaactgactatgactggtgggcccttcgacctactcccactatacaactctactgctcctcaatcctctcctcctcctcctcctcctcattcgcgatctctctctctctctttctttcgtcgttggatccaaagctcctcctcctcctcgcctcgcgctcctcgtcccttctctcgtcccatctctcatctcatctcttggtagttgccagttgggacttgggagagagaggagcaggaggcaggagcaagaggagggcaagatcgatcaaga

SEQ ID NO: 23032 - DNA, 368 bp, Oryza sativa
cgggtatgaaacaattaatcaacaatgttctctcttcaatagctaaaaaaacacaaatgctttgctatagataaaagaaaatatattatagtatgtaataaatattataaaaattatcgaacatattagtaccacttgtttatttgtttgaactgaatatttgggctattccataataacaaaagatatcaccagtcaatttttaaaaacagcagtgggtgtttgattcactgccaccatcactagagactttataggagtataggttaatggaatttaattgtagtagtaaattgtttgtaattacttcttaatttgccattttcttcttgtcctgacttgaaattaatggtgattaatcggtcagg

SEQ ID NO: 23033 - DNA, 407 bp, Oryza sativa
atcatcttggggtcatttattaaaatgatttaggcttgggagaagaacttcagggtgtgacacggcgataccctgaaccctctgatggctattgcggctgctgctgctgttggtaccatatatacactttgatttttttcctatgttaaacttctttaattttaatcaaatttataatgaaatatagcaacacctacaataccaaattgcttttattaaatctagaattgaatataattggttttattaaattggtttattttgtgttgaaaatgttactatatttttctatagatttgatcaaatatatagaagtttaacttagaaaaaagtcaaaacattagaggtagtataatgctagtgccaccaataatgatcatcggactccaaccgtcgaacgccactca

SEQ ID NO: 23034 - DNA, 1501 bp, Oryza sativa
gtgtctgttagggttggagtcaccatcaccactacggaattttaaagcagtagagattattgcagcctagttcaatttctctgtatatctctctctcctgtttctctttctcttcgatctctcgtttctaacgatctctttcctctgtacacaggccaaagccagcccagcccaacccaagccgccatcctccccactccccactgcccacgcacggggacaccgcttctgcttcgtcttcaatcctcggacgtttttcctccatgaaagcagcaacgtatccactaattcccatcacccatcctatcatctccctcatcaatcttactgtttaatgccaaaaatgaaactacctcgatgagctgaatccgtttctcaaacttctggtgacctctctaccttcctcctccacacacaccactgagtatgaatggccgtttttttttcttccaatctactcactaatcccttcctctcctgaatcaattttgtcgaagcaagatttcggcaataataaaaggggtggctatcaagataggaaagtggatgggtttggagaccaggaattttatacaggttcagggccttcttattcaaaaagtaataccctactcctgtcgggggattgatccgccgagtatattattgatcgtatgatctgggtgaaattcgtgcccctagaggcacccggacccctccttatataggggaaggggtccgtattacaaaatacagtccatatccctaacggaatatgtagttacagataaaatacaatcgtaaccgactaggatctcagatattttcttgacatacaagtttacattttaacctgagtccttctaaagatattctatctacacatggcaccccatacccagtcggactatacatgccgtgtaggtatggggtatccataatctccacaactaggttgtttacctaggaatagatgtcacctcctttcagccatatttctatctaggtggcagcctagtccgattacttggcctctacatagtggctactgcttacttgcttagcattttctagaatactgaatagaatttagaaataatatcatgtcttagccaacaatatgatagtgtcaaagtaagggtatggaaactggtggcattcgatattggaccgaatgagcctgaatagtttaattttgaattagaatgttattgatttcttatagatgtatttattctgcctggttactgactagtaataggtccggctaccggtcactggccggtaaacattatttggattcaaatatttccagtaagttctggtaaccagcaataaccaaccaactaccagcgttgcaaaggagacctgcatttttgtattgggttttaaaacctcggttcaagcgaaaactcaattacttggagatggaaccatagcttgttagtgtttgagttttgtcaatttattctaaattttacttggaaactatgtgtagcaggaatagtaaatggtctcattt

SEQ ID NO: 23035 - DNA, 934 bp, Oryza sativa
tctagaattccaataactgcataagaaggttgttagccattcattattgacaatcggaaacaaaatcataaattgtgtaaaaaaacacgccaaacagggacatttggtggtctcaagaaaatgttaagatatctaaatatattcttgaaatcagacagaactagctaacaaaaggaatgtaactagagtatcatgtattcagatttagtgatcaagttcaatactccctccgtcccaaaaaattgaggcgtataatttttttgcagtgtcttcaatgtaaaactttgaccattaatttcatacatatatcatcaaaaactacacaaattaacatcatatgaaaaatatttttatgaatctaatgatgtcacatgcatgacactaaacattatattattagtacactttaactgttagtcaaagtttgcaaatgttgattttcctaaaattgtgggtgcattatatgttgggatggagggagcagcatagagcattgcattttcagagtctcggtttcactgctaaaacaacatggaacaaaatgctttgcaaggaatagtggtggccaaaaatactttctgaaacatcagccacgagtccctgacatccctgagaaccactcaatgtaaattaaatggggaaattgtgttcttcccctattttcaaacacaattgtgattttacccctctttttttactttatgattttgccatcacttttgtaaccgaagctcccgtttgcccctggtttggatgtttgttaggtgtgccaagaattagggagttaaagaaaagaaaaagggaatgaaaaatgatttacagaataaaaggattgttatacccccaaatacaacatcaattagccacacagcccttacatgtgtgttaccccattctccataccaaaccctggctctctcgtcatggcaacagc

SEQ ID NO: 23036 - DNA, 298 bp, Oryza sativa
aacttcataaatattcaagcaaaagtcattgagcaacatgacttcaattgttccacttgcaacaacaaattcatcagttctattttctcttgcatgtatagactccaaatcacatgagtagcaacatcattcttcatatcagatgacaagtgattagccaactgggacatgttcaaccaaaaactctgtttctcttcttcctctgaaacaacggccatgaaccttactggtttttaagctgctatttcgacaaccagatctgccaactgccaaacaagctcattcatctagttttctg

SEQ ID NO: 23037 - DNA, 217 bp, Oryza sativa
cctccccctttgattgcttctccccttcatgccagcccggcgactctagagtagaggatccccatgatagatagatagatatgcaagtgtgctacatcatcatctactagtaattattatatagattattttaaatatcatataaatatgacatatcatttataatattgttgtatttttagaacttaatatatatgtaatcaatgtcgaaccatta

SEQ ID NO: 23038 - DNA, 209 bp, Oryza sativa
ggcagaggtatgacacactactatagggcgaattcgagctcggtaccctggacttgttttgttatatattttgagtgaagtacgatcgttcaaatatgtagatgtttaaaataatattggcgatgttttaggtcacaactacatggtaaggggattgtcggtaccaaagtttatgcaagattgaggtaaaagagatagagacaaggatt

SEQ ID NO: 23039 - DNA, 508 bp, Oryza sativa
atttatatagagagcaagggtgagtacttacgtactcagcaagccaggggaacttaggtggttaatgcaagtttcaaagaataggttgttatttttcaatcagttttgttttcaaggttttcaacaatctaagtgtgtgctttccacaaccagagcgagacaagtctcagctcagtcggggtgagaagtaacaaatttatttatcaagattttcacaactcccagagttggcctcaaagctggttttcccaaaccaaaccatttttccaaacttcccaataatagtggtccccaaacgaccaatcacttccagggacttccggtcccactgtcccccggacagctaattgcttcccaagcattaggtttcccaaaccttaacaccttttcataaaacagggtaaaacaaaaactacgctaaggaatcacctcacattcgcccatgaccgtgggcacggctgttcgaacagtttaataacctctgtagagggggtacactatacccaca

SEQ ID NO: 23040 - DNA, 1501 bp, Oryza sativa
accagattactccaaagccgagtgcttcaatcatctttgtcatggtctcccgagtacttttaccaaatctgaagactgtggagggctggaaaataaagtcaggtgcaccgactagatgcacctaataggtgtagcccccgacaatgtggttaattgaacaaaccaagcatatagtcaaggaataaataatccaaccaaccgagtggttttgataattgtaatcaaccaagtgacttgatatcaatatatagcatatgcggtgtgaatcctccaaataacatgatccaagtgatataccgactgctttgtaaaatatgatgagtgtaacctaaagttggctacattattgaaaattcacatagcaaaacagctataaagaagcttgtatgttgtgaataaataaatttccaaagtattgggcatacgccatgcgcacactgctttaacagacgtgctttagtccctaaaagacacatggtttcaccacacctggaaatatatggcatatgtggtataaaatccgagtaaataaactcataaggatttatcaatcgtctggaaaatgaccaaaatatataatcagcctaagccataatattggtcaataaaaatgcacacttacgtggcaaaaagcaatgatgttgtattcaatcaattgcttgataaacccaaacagcgccatgactatataaaaagtcagcggggcagctatataaagctttactgtttgacaccttttaagatgcattgtaccaactcctaaaaagttgagtaactgcggtataaaaggattttaaggtattgggcactagatcacgcgcactttggcctaagcaaaaagtgcctaagtccctaaaagaacgtgacaggccacacctgaaaatatgggctgcagacatattaggcctaggccaaaaaatatgccttcgacaccctttaaaggatgacgcatataacatgctcccgagtaataaatcttccgggtaatatagaccaagcgtagctcatatgaatagcttctaatctgagtgattatcccttatgggatactccaaaatagatgtaacaattgattcccgactggcgcaagtattcagttgataacccttacggggaataataaatagtccagtctttgagcatataaaatagacctatgatcatgaattcatgttgcatgtatccggagcaagtccaaattgaagatataatacttgtaattgagctagtaagcccctgagcacgtagtcacgattgttcattgatggtagctgacgcagttggcatagagacaagacgaccaatatagagataatattgcccaacagaggtggcaaaaatattggtggtagtgaagatagtgataccaatcaaaagtgatgaagttgcacagccgtggaggcgaagcaaccagtcggcaacagtcaggtcagccatcaatgaagatgaaggtgcccagcgataaagttgtatagccatggcagcgaaataatcagtcggt

SEQ ID NO: 23041 - DNA, 419 bp, Oryza sativa
ggtatgctgaaaaggtgttttttttattgtagtatactgctgctagaactgcataacttagatatggttaaaatatttattgactgcagttgcaaataggaaagccagtggtagttcatcccagacagataaggattacattcaatctttaaagggtttgtatttttctaataaaagcaaatcattttacatttattaaggaaaaaaactgacataatcaaatatgtatgttacagcatcatacccagaacgatcgtactactgacctccgacatatgaatgcccattttgtggtgccatcttttggtatcaagagagagttaaaaccctctctgctgtctcgaaaagaaaaatagtttacaacctatgttgcaaaagtggcaaaattgaattgcctcctttatgtcctctacctgaac

SEQ ID NO: 23042 - DNA, 1501 bp, Oryza sativa
gggtcataattttatttattttatttaaaaccctgctattattttctggatccgtatctcatctagagtcagcttgcatagcatatacacgcatggggtttgttggccttagcgagctggaccattcctgcttcctagctacatatatatattgttgggtggtgcgtgcaaaacagtagtccggagtagtgttacaagtaaagacagtatagtagacataatagccaactagatcgatcgatcgatataattaatgtacagtacatacacatagggtcaacgcatgcatcacaacgttagtactctcttcctagtaaaaagtacccctctctctctctctctaagcaataaaaagtacttggcatttgacattttttatggtcttcgagttatgaatgtaatcagtattatttgatattgaaaaacaagtttataagattatgacggatatgattttccaaaaactattatgagggattctaagagataatgataactgaggtttcaaatattcccaaaatggagtatatataattcaaaacgtaataatgtcttaccagatcgatggagggggcgcataatgttgtaccgtggattgaaataagttcactttagatctctcatcttgacatcgaatttgaatcgtgtcattgaaccataatactagatatagtgtgtcccttcgatttgcaatatcggagtacctaaggtcgcatgactgtattgtgcctagttttagcaacccggcaaaatcaacgtgggccccacacattaacaacctagtcttcttccacctatcaaccattccctcttttctctctctctcagcaggatgtcgggtggtacgaagaatggcgatggttgctaggagaggaattggatggcggtgttgtcactgcgagcacgagcagccgcctcgactcctctctattctaactggcactttattgggagagaggagtcgaggtgaccgctcgagagctccgtgccgtcgtcgcccatctcctctcccgttggctggcgcttgctacccttttccccattagccattgccttaggtttggtgaaatatgggaaagagatggaagaagggagagaggaagagaagaagactaagccgctaacatgagggtcccgcattgattaagccggttgaccacatttaactcgtgacttaagccaaaacctggtataatagtaccattgagacatcggatgctccgatattgcaagttgggggacgtgtggatatgggtaccccatacccacatggcatggttatccgactagttatagaggataacttaaatctattagataaggtaacagatcatgacttgggtattacgtttccttgtatattacggaacggcctaaagtcctggtttgataatattgtagagtagatttaggaaaccaatacggtattggttgaggtttctattttgtaaccctgccccccaacctatataaggctggcagggagccccctctaggggca

SEQ ID NO: 23043 - DNA, 442 bp, Oryza sativa
gttgggtaccttttatttgcatcgtagtaattctaaagaattatctaatcgcattaaaaaggattttagcagcatcgggtcacatcattgtgagcacaaattgctaaagcaaaaagtgcctaagttcctaaggatcacaatgggccacgcctggtaataatattggcctgaagtactggacaggcctaggcctgttagcactcccgataccctaacaaagtaccaaagtccaagcggcgcttcgttttccccgccgagactctcgccatttccccactccttgctacagtatcaaaccgcaccgtcaaagctagggttcatcaatccgccccaatccattctcaaaaaatcccacgaaacctctccgcatgtccaccgcattgattcctcattcccctccacctatatcttggaccaaatcaatccattcaacttgcatcca

SEQ ID NO: 23044 - DNA, 677 bp, Oryza sativa
tcccttatattataagacggagggagtaggaagcaatgggatccaaccctacctggcctacatatatggatgtctccttttccattgatcgagatcgtcctctctgcaaattttctgttcctatcgcctgcactacactgctgatagtgatagccctcctcccccacaccaacattttccttccttttctttagtttccccctgcatgcaaatgtctcacaaagcttgtcacttgctacatattaaccatactgctctcccatctaatctaatcctcgaaaaaaaatacattatcacgccgatcgatcggtcgactctctatagctagctcaataatgtatatatatagtaggagtttgattcttttttttttactatagtgtcagttgcttaataatgttgacccatgcaggatgtgacatataccagatcaaaagtgcatgcatgagctcggctatgcattttcaatctttaatttttccccctcctttctgcaaattaatactgtgaaaagaattatttgccacattgatgcatgtatatattcctgcactcatccatgtgaatgtggcacttgcattttgattgaaactagagaggcgccaaagggcaataaaagtaaaaaaagaaaagaaaagaaaggctttagcttgggaatgacaggagtacgtacgtca

SEQ ID NO: 23045 - DNA, 601 bp, Oryza sativa
cttgatgtcaaggtaacatgatatgaattgatcactttgcattatgaacaccaataacttggagttgttcttctccttagcattgttgcctctgttcttgcaactgagaactgtatgcccttgtttcgatcagtggtttaatgtactatggtccctagcttagatagtcatgtatgaatttgcgactaaggaatcatgcatacgataaaacttggtggaaataaacttgaagtttaaaccagaatgtgaccactagtgttcacaagtgatgaacatgaagattaagtacgggcacgcaaaacgagaaaaccattagcacataactaattgagttttaattattttaaacttagaaaattaattaatctaatattgtagataagagcaacttctatatagaaagtttttgcatgtaatacaccgtttagtagtttgaaaagcgtgctaacggaaactgaggtaaaatttgtatcttcatttgctgacaaggccgtagattgaaaagcatgcaccagtggtatgtcaaattcttgtgcaaatttggtcgcagctcatacatcatattgttcaacatttctctttaagttgcatacaaattcag

SEQ ID NO: 23046 - DNA, 1501 bp, Oryza sativa
gttgcctctgttcttgcaactgagaactgtatgcccttgtttcgatcagtggtttaatgtactatggtccctagcttagatagtcatgtatgaatttgcgactaaggaatcatgcatacgataaaacttggtggaaataaacttgaagtttaaaccagaatgtgaccactagtgttcacaagtgatgaacatgaagattaagtacgggcacgcaaaacgagaaaaccattagcacataactaattgagttttaattattttaaacttagaaaattaattaatctaatattgtagataagagcaacttctatatagaaagtttttgcatgtaatacaccgtttagtagtttgaaaagcgtgctaacggaaactgaggtaaaatttgtatcttcatttgctgacaaggccgtagattgaaaagcatgcaccagtggtatgtcaaattcttgtgcaaatttggtcgcagctcatacatcatattgttcaacatttctctttaagttgcatacaaattcagggctagagaaatcaacatgctatccaatgaagagacagtaaagctgcacatcatattcctaggtcgttcaattatttttctgtgcatgattacttacatccatgttcaaatgatagtttatttgagatttatacctgaaccgaagtttatttgagatttatacctgaactgaagcccgtgttattgtgccgtggagccggagaggaaacttatgcaacctgtgcagaactaactataggcctaaatgcatgtgttgagaatacactgctaatagcttgcggagcagtctagagatcaaggccgtagtgcaaaatgttatgaattctagctgcggtattattagcagtcctctaattgatgctgtaagcttcaagtgaaattggtggtcaatgcaatgaaatactctgggatccagttctgtgagggtaaccaatggtttttgccttctttaaaagttctgtctttgtatccattagattgtgtattgtctgtttcccatcggcctagacccatatatagggtgcctcgtctttggcttggtcccacactaattagattagagatcacatggtattaaccaaaacaatgaaaattaacatagaaatgaaaacgttgcatatgcacagcgcctccgacttccttgcctctgtacgtcacctctatgctgccaacttgatcatgtgatcttccatccagcatcacagcatattaattttgttctcaagctttatcttccatagaaaatgtactgctgctacgccaggagccaggaggcaaagtaaaactggaattaaaccatacatgcatgcatcacattcaggagaagcacttgcccatatattctctgataataacctgattaaccattgaacaaccgaattcaattaagtagaagaataaaaacattcggcaagacctcgtccaaataaaataaccgaataaaaatcatcggctgtcaatttttgatatcaacacacacacata

SEQ ID NO: 23047 - DNA, 579 bp, Oryza sativa
aataaggggcgtcgtgtgaaagaaggtggggattcaggaggaaattggagtgcagttttggcaggcaaaaaatgatcagtggaggagcgggcaattcacatgtgagttagaaagtgattagtagtgcggttgttacagaacaggcccaggtgaacagtgctccgactgctacagtaccagcccagatgaacagaaccgcaatcacagccgtgcctgccgaaatgaacagttcttccgctgcagtgccagcagctgattgtggtggtggttcatgtggagaaaatgtgtctatgcagcccggcaaaggtaaacagctccaatggtgccctccagatattggacacactcggaagcggaggctgcaaagattacgcgcacaagagttgagacagtctaaggctgagaagatgagagaagaaattttcaatgatatcaatcctgaacccatggtacgtgttcgcagggaatggagggcgaaacaagttgcagcttcagttcaagaaaacagtgatgaagagcatgatctgttagaatgtggttccccggtaattagagatggctctccgcttccagaaagaa

SEQ ID NO: 23048 - DNA, 1501 bp, Oryza sativa
catgcttagatatacgatgagcccacagtgcctcagacaaaacctcgtgccatcttttaggatgttcctctattttcttttttatcagcctaattaaagttttattgcttgactcggtctgtccattggcctgagcatagtatggtgatgaacaaagcaacttaattttaaagattccgtaaattcacgaacttgatgtgacataaatgatgatccttgatcagttgtcaaggtttgtggtatgccgaatctatgaataatatgctctaaaataaaatcaatcacttctttatgggtcatattttttagaggaacagcctctgtccactttgtaaaataatctgtagctactaaaacaaatcgatgacctttggaagaacaaggatttatcggggcggatgaaatctaaagcccatccacgaaacggccatggtttaataataggatgtaacatagcagcagacggctaattggatatcaccaaatttttgacatgactcacaccctttataatatgtaaagcaatcttctaacatagtgggccaataaaaaccagctctccttaataaccatttcattttatgagccgactgatgtgtaccacatataccttcatgtacttcacccatagcaaccttgcttggtctaaacttagacattttaaaagcaacccatctacagatcggcggatacaaatctccattaagtaatatatattttagggcttgacgccgaagttttctttcgacagtctgactagggttctcaggtaactggttaaaggttttctccaatcatcaggatggaccacataaatcttaacatgctctagcatcggtctttcaatcataaacaatttacctctactgactcgataacgggatgcttgttgcgctagattattagctagaacattctcttccctagaaatgtgtttaataacaaaatcatctaaatttgctatgatctccaaacatttctccaaatacatattcagtgatccatcaaagcattgataattcctagaaacttgttgcacaactaataaggaatcaccataggcctctatattctttacatccagggattctaaaatttgcaatcctcgcaaaagaggtcgtactgggcttgattattggtgcaaaaatattctaaatggacggatgtctcaaaaatattgcgtttggtgaaattaaaacaacaccaacaccgtgttcctctctacaagctgagccatcaaagtaaagtttccatgggcatacagacgagtaactaaccctcttcatatcatcattaatcctatgatcaacaataaaatcaacaacaatctggcctttcatggattttaaagattcgtaagccaaatcatactctactaaagcataagcccattttcccattctaccacttagaatcggcttttgcaacatatattttatgacatcggtctgacaagccacaacacaagtactagatagtaaataatgccttagcttggtgc

SEQ ID NO: 23049 - DNA, 188 bp, Oryza sativa
cagaggaagtattagctaagtgcaaggaaatatagggtctgtttgggaagcttaagattctgcgaagtagctggtcggtagccagcttatgagaatctggaaaagctgggtttcccagcttatagcttctaggctgtgtttagttcacactaaaattgaaagtttggatgaaattgtaacaatgtgat

SEQ ID NO: 23050 - DNA, 606 bp, Oryza sativa
catacggtgcttcgcttgtctatatcatttatttggcatcttaaacttctcaagcttaacttgtgcatacaatattgttaggttttagtgttctatgcctatgaaagtgcaaaaggccaataactgatggatgaaatttgtgaatcatgtgatgttattttgcgcaccaaattgcattgcatcgcattgccttttttccccatatctttagctcaagtagtgtgggccaggaggttgatttgaaaactcaatgcatcgaatcttgcttgtagctgcttatttcctattttggtggttgcctacttcccttcctagtaatccatcacaatattttggaactttaaagctgtgctcaaaattatttctgaatatgtatgtcattcaacatacactccttacactgtaatcatacagaaaccatgcacacattatctcatttagttactaccatttgcatgttcagttgtgtacaaatgtatttgtcttcatcggacaatgttgcttccttgtgtcccaattagacttaatttcttcgtgttatgtatttatctttgccaaaggtgcaaagtagcacttagtttgtatcatgtacaatttggtcatctg

SEQ ID NO: 23051 - DNA, 775 bp, Oryza sativa
caaaataataataagaataattatgaatagaaacagaccctgacactgctgcatgtgttacgtttttaaagctatccatccaactaccgaatagagatatgtactcctatgcatcatgtgtctcgaagaaaagaagaagaaaaatatagatatgcatcaagttgctcacgccagaccaaacagacacgtactacatcctgcagcaagccagcaagcgctctagctgttgactttagcctccggcacataaaacaaaagctcgtattattacaataataactatttttttaaaaaaaatatatattaatataattttttaaaataatttttatatagaaagtttttacataatcacaccatttagcagcttgaaaaacgcgcgagaaaataagagatgtggtttgggaaaataggggaagaacacagcactagattcccttcccttccactgacacgtgggtcccaccactcctgtacatacagagccaccgcagtactcggacgaggtcttcacgtaatcacgccttcccgaccctatccgtactgcacttccggccaaccccacgtcgcgtagcctcactgacaggtggggcccacgcccgcacgtgccagtgttactccacctgtcagtggccgtagagcacagaatcccgatggcctgggaggcgatggggagactgacaggtgggccagagttttgctgccctttcgcttttaaatatacgtggtgaagttggcttgcgacgtgagaagagctcaaatcctccaaactttt

SEQ ID NO: 23052 - DNA, 907 bp, Oryza sativa
agtattctctagctagctagctagtcgatctagtacttacaagatatatataggtatgtatgcgtactgtacgtacgtagctagtgcagcacgtattactactatagttgttgcttttgttaatttccagctgatccaccatgcatcgtatcgaaaggtacacgttgtatctactactatatgtatgtatcttcatcagagtatagtatatagaagtagtatatgtagatccatcctatgctatgtcatatggaaatctagctataagatgctctcgccggccggctggcttaaatattggcgatgcaataataattaatataatctctatatttgtatcaatcatatattgatgagatattgcacgagttaaatcgcccggactgtcaatattttctgcggctaataaaaaaatcacattgctcatccaatgcctctatcacattctttcttgttcacatttcctcttctcggtggtaatataatagtagcatctgaaagaaaagaaaagtactatatgtttgggcctagtatcatgttggcccaacacatcatacacgtaagatctggccggcccaaaacaaatgcgaatccatgggcttggtttttccacgggcctttaaagaaagaaagcgaggaaggaaatgctaatgggccggcccgcatggcagagagagtacaacggctactcgggtggggggcccacagtcagagggagacagctcgtgctagaaaaagtaggcgacttgcccactccaaccaaagtgaccgttgcaacctcatctccgctcctcttcctcctcctcgtcgtcgttgtcgtcgtcggcggcgcatccagcctcgacgtgccggcggcggtgggtggcggggcagcagacgagcaagaaagagatccctagtctctctc

SEQ ID NO: 23053 - DNA, 1501 bp, Oryza sativa
ccacagcggcggaggcggcgcggcggaggcggcgcggcgaggcgagaaacggtagctacggcacggcgaggcgagaaacggcagcgacggcgtggctgaggtgaggaacggcggcacaacgaaaagaggagacggggagtggacagaagggaagaacggcggcgtcacgggttgtttctctcacgcgtgcaaagaaccacgtagcaatggtcaaacattggtacggaaagatagggtttgtcttttttttgggacggaggggagggagtatgtagtctgtaaataaccagtactctctgagtgcaaagcatcatataagcaatcgaagagcacaatatcaagcatgcatggcgacgggagggaggagaggccgcgctgtgccgctgtccaagagcttctcgaggaggctaaggcacggccgcacgggttttggaggaagcggacacgcgagggggatgatgcagctccatgtggcgtccgcgccatccagatgtatggcgacggcggcggcagttctcgcctctcaactctcgaacaacaggacaaggcggcgcactggggctcaatgaatggcgacggcggcggcagatagatgcatggcgacggcgccggccggcggcatatcgatgtatggccacgtcggcggcagctctcgtctcgcctctttctcgactctcgaacaggaggaggcggcgcacggggttgggagtggatggggtcacgggattggaacttggaagtgggctctaggactttgactgggctagggcgcgtccgcgcgtgggccaaaattttgggaggctgtggaccgggaaaagaaaaagtacaccaaaggtccctcaacttgccatcgggatacaaaagcgtcctcgaatcgcaaaaccagatatatggggtcccttaattatacaaaactggtcaaaatagatccctcggcggccctcggcggttttgatgcaggttttgccctacgtgtctgcttagacccacgtgggccccacatgtcagcctatccagtcagcctctctttctttcccctcttctctcccttccccttctctctctcactcttctctctgggggctctgggcaggccggcgctgctggccgacaggtggggaagagaccgatggtgcgaggtgggagaggaggtccggcggccggcgatatggcggcagtgatgacggagacgacgcgggagcaggggagcaaggcggcggcggcggcggcgagatgtccatggtgaggtactggaggcggagctccgtcggggcggggagcgggtcgacggcggtggatggcgggcacgggatagcgtcgcggcccaacgccggcgccagcgccggcatcgcccgcccgcgcgcgatctcccccaccgccgtcatgaactgcaacgcgccgagggccgagggccaatgcggcggcgacggcgtcaccgatggctgccatcgaggcggttcgggagaggcagcagaggaaggggagatcgaggatgacggcg

SEQ ID NO: 23054 - DNA, 1501 bp, Oryza sativa
ttacatggaacatggtcttgggctgcatcaatagtgtggggcggctgcaccttaggaagcccatcggctcctaacaacccgttcccttaatttttggcttgtctccaagccaatgcaataaactcctagatcccatggcacctttagttctgagaattcttcgggatgtccaaaatacaaaaaaacattcaccattgttcctctagcttgcagttgctgagatgaactttggaaatcaaaaaggcagcttgagtacataaattgatactttccattagataattgttggttactgagtaggccaaactcccatgagctagaaatgtgttcagcttgttatcatgctcagcccctgtttgactgagcttgaatataacaccttacgaattttgcacagaagaaacaaccatctcggtagtccctctagttggaattgcataactattaaccttccatgtagcagtaagcaagagaagaagcactttatcaaaatccattgcttcatcagcccatttgagagaaccaacaagccaacaaatcaccatgcagatgtagtacatgattgagaacttgtgagctcttctctttaggatgttgaaccgtgccaaacagcagaaaagtagcatcaacaacatggtgttctttggcagtgacgatctcacaatcacatgatttagtgcattcttccctcatctaggtattaaattgataatctgaaccatctgagcatctagatcccacactaactgcactaattgggcttgcatgagttccattgggtccataattgtgaatgccttgccttgaagaaaatatttcctatttgcaaagtgaatcattgacttggtgccatgtaaagtaagtagcattctacacatgtattgtttagagttcaaatcaagcataccactagaaaaccaattattgtgcataaataggatgtgctgaacatagcacttctgaccaatgcaagcataagaatgtaagatcaatgtgtgtattgattcttattctgtgatgaacaattggcatctgtgattattggttttgatatttggagattatcgttgaagtggttttggagataatcaattttcaggtgatgatcggattcactgttattttatgtatccggtccgaccgagcagaggttgccggtcagaccggtgctatgtgtgcggtcagaccggccggcccgtggtttgaccggccgatgctgtgtcggtttcggtttcgggttgtttctttggatatccgtgattgtttcatggttatggcttctagatggatactatacgtatgtaatactgttgtttgctaataatgagtcaagttggggatagcttggtctcggaatatggtttctttgtttgtttcatgtgtaagtgactcgatgcctcgagacagtatatgcggtgatagaccgggagtcggcttggagataagacgatgtccgtggtggtcagatatcatgcgggatatatactaaggctagagttga

SEQ ID NO: 23055 - DNA, 744 bp, Oryza sativa
ctcgaggttaactaaaaaggtattcagttatgatcttcgagttacctcttccagcagatctagcctgtatcccatcctatactaactcgttgactcagaaaaaaatatattagcaaaagcaacataataaataaataaataaataaatataatattagcatggactagccaccatgatttgaatcttgacaccactatatattacgcagatatagatgcacgtttaaaagaattttagagagctagggattttggtgttggtctttatatgtgttgagagtacattcaggtgcatcgatattgcattacgctattaaaatattcattcatttgtgcacgcatgtagatggttgggtaccatgattattgcaattcaccccggtcttctttcgcataagaacatgttgtgcaggaagaaaaataaggtcaaaattttaaaaactctgtgtaatacaaagtcatccgataatttctccatatatttaaatcttaatgagaaaagtattggaaacggcggaataagcaatacaaccaatgaagtaacagctcggttctacaggagcgacaacaacagtagcccgtcattgtgtgccttttttcagtcaattaggccgcaggatggttgcatgccataggaggattcaaaaagcagtgttaggaatgccaagcaaatcaatcgatgctgtatgtataagtacgcacaactactgtttgcaggtatcttcttttcgcttcaaatcagga

SEQ ID NO: 23056 - DNA, 1501 bp, Oryza sativa
agaaaattattgagatgcaaattgcgtgtgggtgtgcgaataatggaatggcctatatgtttgatttccataccttcatcacttgccgtgtagatctgatctttgccattgtacttctcacgggttgctaacttctctagttcacccgtgatgtgatccgttgcaccggtatcaatataccagttcggatcaacatggtaggaggctgctgctgccatctttggatcagggacgaacgagtcgtcgaacctgtgcctgcaatcggtgacgacgtgtccaatcttgccacagagttggcacaccggacggggtttggagttgtagcagccgccggtgttgttgccatcgcgtccgcgtccactgaagccgccgcgttcgccacggccattgttgttcctggggccaccgcgacccccgccgcctccaccgcgactgaagtcgccgcctttgccgccgcgcttggcggcatttgcagaggagtatccgtgattagccgtcatctggcgaagttttcccctggactcaaaactcagaagctgtgagtagacttcagagattgaaaccggctcacttttgcctaccaaactggagacaaccggttcatagttgtcgtcgaggccggcaagcacgtagcccatcagttcctcgtcgtccatgggcttgccggcggcggtcatctcgtccgccagcatcttcatcttgttgatgtagtcggacacgctcaagtcacctttgcgcgtcatggagagcgcgagtcgtgtgttgagacactgcgaccgcgaccgagtggagatcatctctgtgatccccttccatacctgcgccgccatctccatggtgacgacttgcgtcagaatttccttcgaaaaggaggagaggagatagccgagaacctgttggtccgcggcgagccatgcctcatacgcggggttcacggtttaggtgggtctgccaccttccttctccggcacaaccgtgattgtctccgaaggagctttggttgcaccggtgagatagccttccatgcgcgccccccggatcacggcgagaacttgcgctttccatagcaagaaattgctgcgggtgagcttgtcaggggtggattggccggataggggggttgctggaggtggagctagaggatgccatcgctagatgcaatccagtcgatgcgattttcgctctgataccatgtagaaaatacggaagcgttgtcacctctctcgaggccgcgtacgtgtgttaatatgagttgggaacagcccccaacgtggcttacaatagatgagatcaatctcagttgattcggatagaagaaagaaacaaactctgaaacaaactaaccgaaccaaccttatcctattatctcatgcattatcacatgtaacaacacatgtaacaggaacaacctttctaacaccgcctactccaccaccgcagcaatcaccgaacttatctactttgccacctcgccggcaccgacgacatcaaagaaccaggc

SEQ ID NO: 23057 - DNA, 241 bp, Oryza sativa
tactctagttatggtgattgttttgatctgctagttgttttggctgttgattctagatctctctttatgcttggggttgatgccgtttgtgtctggtactctggtcctctgttactaggaatgggggcaagtggatgttttgcttcagtttgctgtcatatatctcatcttcaccatcagatactatctgggctgtaattcatgagtatgttgcagacaattgatgattctatttcttgct

SEQ ID NO: 23058 - DNA, 1501 bp, Oryza sativa
ctctcgcgttcaaacaggcggatttgcccccgcaaatctcgccggcgccattgatggcagccgacctcccgcgccggtttcctcccttccccggccgccctctctcgccccggctctatttaaacccttcccgcacctcctccgtccgtttccgcctctcgccgcccttcctcctcgccggaatcgagcccgcgtcgtcactatctctcttcgccgtcgccgccgagctccggtccgccgccgtcgtcgccccggaccacttcccacctcggcgccacctccttaggcttcgccgcatcctcgccgacctcgtccacccctccgtttcgctcccgaccgccggaacgccgtcgaccccgtcgacccgagccgcgccgccgccttcctccgctccggctgccttttcgtcatcgccgtcgacctagggtgagccgtggaccgtcgcctcgtttccccctttccttcccttctctcggccgccgctccgccgtgcctatggccgccgccggcgaccataggggcacgggcacgccgcctcccgccggccgcgccgccgtggctgccttcgggcgcaccaagcggctaccgtgtggggcccggccgtcagccgcccgcgctctcgggtgcgactgacgcgtgggacccacggcgccggccggtgcgagccgggtgcacccggtccaccgtggaccatgaggctgccgcgtgggccccactcccgtggacccggtccgcgcgccccctcccctcggctgacgcaataaacccttttaaaattaaaatttaaatgaagaaattcgcaaatattcatttaaagagcatataaacttcaaatggccataacttggccatttgaactcggaattggaccgttcaagtctctaatttttccttaagaagtcaagaacccatttttgtgctttgttccaccttgttatatggagtttattagagtaaaatccttttcttttccgttggtcgtgtagacgctgcagcttcggaagatccgctcttcgtggaagttgaagccaacgtttgggaaagcaagcaaggcaagtcacatcatccttgaacatattgaatcccagtttataaaattattttgatttaaattattgcattatcgctttatttaaattcccgcgttatcactgttttatctagccatgcctatgtatctttcttatgaccttattattgttatcgttattatttccttgttcaccctagaataaacaaaaccccaactagtggacactctactcatggtaccactagtatgattttaggaagatgcttcgctggttaattaggcaacattaggtggttttacaactctagactttgggaatattcatatcacctggacactatggaatggttggattattgtggaattggattcacacctccccctctattcaaaatcctcaaaatggttttaggctgggctcggggtgcatggttttgatagtagcacctcagccatataaggaccggt

SEQ ID NO: 23059 - DNA, 1501 bp, Oryza sativa
gagcaaagtcttgcttcagatcacttaatagagcatcagtagcattctgtgtagaactagccacaataatatcatcaacatatatcaaaacaaatacagtaactcctcctttactatagaagaacaacgaagtatcagccttggataacttaaaaccaatatcacaaagcttactactaagcctggagtaccatgctctaggtgcttgtttcaaaccatacaacaatgctttatcaagcttgcaaacatggttgggttttcgtttatcttcataacctggaggttgtgccatatagacctcttcctcaagatggccatgaagaaaagcattctgaacatcaagttggcgaaaggaccaccctctagatacagcaatagatagaatagtcctaataatagctgccttaacaacaggactaaaagtatctacatagtcaataccatatctttgcttaaatccctttgccactaagcgagccttataccgatccaaagttccatcagatttacgctttatctcatagacccacttacagccaattatattgtgacctttacaaggcggtactaaatgccaagttttattattcatcagggcattatattctaaatccattgcatttttccagttatgattagagagagcttcatctaaatcatgtggttctccactggtagtaaggaaattatatctgagtgtatcatcagtgtaaactttctccttgcgaatgcctctgggcactagtgacagggcgagactgttgttgcgactgctgccgttgcacatcggctgccatgctgtccccctgcatgctgtccccctgcgatgtgctgtcggctgcaccaggctgcaccgggctgctgtcacctcctgaatggctggcagcgcttgcagaggaggcgtcagaggcagagccagcgtctgcaccagcgccagatggatgtggcgatcccgaggacgccgagggagcgggagaaaggacggcatcatccggatcttctgtgctcactccgggagactgtatttcattattttgtgctgaacctgtgttgacggtcgttatcaatcagtttcgaccgtcaatattactaaaatagaggagaactagtgatgcttgcaatgcatatgtttgttagaataataatatttcactagtattaggtatactaaccttttatagagaatgacaataaagtggaggagaatcgacatcaacttagacgataaatcaatcggacgatgtcgagaaccagacttatgtatgaatagaccaagaactcagaattgacacgatgaattgggccaaatttcacaagtctgcggagaagagaagtccaggatgccagcagccaaattgtgggctggttgggccggccccaggttcggccgaacccatctctccattgttggatgtggggtttggcagggacgctccagatcttctcctgatggcggttgcggggtacttcggacaattccccttccacaaccgtcataact

SEQ ID NO: 23060 - DNA, 1501 bp, Oryza sativa
tgctagcccctgcagtgaagtctcgttggtgcatgattggatcagctgtatctcgatctttttcctattttcgatctttcttcatcgcatgcagtaccttaactttgattaatgaatttgatggggtaccacccctatgttatgtaatctcactctttaatttctatcttaacaacaatttggccggccggcaaccttagtgtggcccgctcggcaaaaatgcttgtgtgaccatgcattcatcatctatataatatcctattgtactattaatttgtaccttcttaattcaatcatggttcctcactactgtacgtgtagtgtgtacgtacgttatgagaaatactccatatatgttgtgcagctagctagctatacgtggtgcatgtgtatcttggcaatcatatatgtatactactccctccgttacgaaatgtttgactctgttgactttttagcacatgtttgaccgttcgtcttattcaaaaacttttgtgaaatatgtaaaattatatgcctatataaaaatatatttaacaatgaatcaaatgataggaaaaaaattaataattacttaaatttttttaataagacgaacggtcaaacatgtttaaaaaagtcaacggtgtcaaacatttcgaaacggagggagtactacttaattacttctgtagtcgtacagcacattctattttgccaatctcaatattcttagagagagagagagagagaggtggggggcatcatcatcataaaatataaggaagcacttatacatggagaagttaaatacatcttactacagcatgcatacatagcaggccactcctaattcctgtttgagaagtgcgttatatgggtcgaacttagggtgccctattatcaagtctttcttgacatcaaatttataaaagtttgattcagaaaaagtccgacgatgtcaactatctatgacaaacgatagtaaattattatacgatgaaggaaataatacgttcataaaaatcagcactacttgaaaacttgaccaataaatgaactaaaaatatccgtgcttagtcttatgcatgtagtattattatattttgatcctaaaatattttctcatgatgtggatttctttgtcctttataatattatgaaagaaatcaacaatcaaaatataatgttaaagaccatataggaacaataatactacatatatttttagacttaccaaaattgtttgaaatatattttacatatgcatgtaaaacacgcatccttcccatttttacgctagccagagtatttcaccgcactgtcctcgcactgagcaggactggagctaagtgacgagggagactttgcgaaccctcatcaaagcctcataaaaacacttggcttttactaattaagtctcttttacttagaccctatgatttggagaaaaaagtagaaatcctatgaaagcttttgagacaaaaggattgaatcctatcaatccttttatacgaaaaaa

SEQ ID NO: 23061 - DNA, 1087 bp, Oryza sativa
gccatttccaactcttgtaggttctgcaaattttcattgccaaatttcagattaggttatactcacggttgcttatgtggatttgtagtttattactcaaagttgtgtcaatttgtgatgtatattacttgtgtggatgtgctatagtatagttgtagcgcaagtataatgtaattacactatagttgtattgtaactacagtgtaactacactgcgatttctatatacgttatatataaatttttattttggccgtcaacaaaaataatttttgaagtagtgaccgacaggatgcagccatgcttcatcttttaaatatttttaccagtgactaaacgataaattcaagtgtgattaacgttggtcaaccatatgcttcatctttttaaatattcactgaaactattataagataatcagcaaaattaccaacagactaatattttatttgggttaaattagtgtttgactaataaaccgaatatacaaattaaacactccctatcatggtctcgatctccagcattgagtttgagtcatctctggtagatctatcgagttggtttatgaggatacgatggaacatagaacatgcatgcatgcttgcatatattgttagatacagagccagcgcccaccatgtgatcatggtctccggtctgaacatatattcataggcagaccacgtactactgaacaaattgagaacttgagagtgaaattaaaaagaagctccttaatttgcagatatatatgacaatagtatggccattaattaatctgatatatagcacaagcattaactgtgttgcattacagactctattgctagcttgtatacgtactagcagcatatatatatacaggtacaaataatatccatccaagactgctgctcccttatcgatcttcttctctcgatcgatcactgttaagacacagagacgatcgatactcaaaaatggacaatctgaccttaattgcttgtgatcgatatggatggaaatgatggatcgatgcaggtctctctctccctgggggccctccctcatcctcttcgtccgccctacccccttttcctccaga

SEQ ID NO: 23062 - DNA, 1501 bp, Oryza sativa
gtaattaagtagtactccctccgtttcgaaatgtttgacaccgttgacttttttaaacatgtttgaccgttcgtcttattaaaaaaatttaagtaattattaatttttttcctatcatttgattcattgttaaatatatttttatataggcatataattttacatatttcacaaaagtttttgaataagacgaacggtcaaacatgtgctaaaaagtcaacagagtcaaacatttcgtaacggagggagtagtatacatatatgattgccaagatacacatgcaccacgtatagctagctagctgcacaacatatatggagtatttctcataacgtacgtacacactacacgtacagtagtgaggaaccatgattgaattaagaaggtacaaattaatagtacaataggatattatatagatgatgaatgcatggtcacacaagcatttttgccgagcgggccacactaaggttgccggccggccaaattgttgttaagatagaaattaaagagtgagattacataacataggggtggtaccccatcaaattcattaatcaaagttaaggtactgcatgcgatgaagaaagatcgaaaataggaaaaagatcgagatacagctgatccaatcatgcaccaacgagacttcactgcaggggctagcatgagatgcaacttatataattaaggagctagctagcaatataagcagtatagcagtaatagatgatgcatatatggatcgatggaggggagctagtagagaccaggcttgtagttgagagcgttgggcagccactgggtgccgtggatgaagcggtcgacggtgtactcctcagctttgctagcgtcgaccacggagaagccctcccagttgacgcggcggctggtgtccgatccgggtcccgtattgttgaacttcatgtacgacacggtcttggtcgtctccaagacgtgcttgctcttgtcccactccacccagcccttcgggtgcacgatgccgtcgaggaacgactgcatgaagatgacgtgcgagtggttcttccacgggcggccgaggaatgtctcgacgcccgtcaggttctcgttgggcttggccatgatgctgcagttctggaagctgaagccggtgtcgtcgccgggcttgtcgcggccctgcgccgtgatgatgttgtgcgcaccttcccttccgcggcgcacgaggagatggcatctctggaacaccgccttggcgttgccgaagacgaagtccaccgtgcctgaaatcacgctgtcgaggtacaactgcagtccgttctcagcgtacaaggtgtcctgaaagctctccagctcgcaccggtacagtacagtgtggttggaactagagcgaagagccaacgactggttcccctccggtcccgccgtgttctgtatcgtcaggtctcgggccatgaaaccgcggcctgaggcagctgcatacagtatatatacgtacatacactgatcaaaataaaatttcat

SEQ ID NO: 23063 - DNA, 1501 bp, Oryza sativa
tttcgtcagatggtgaaacaacatcgtggagtacaagaccgaatgtctcatcttgtaaatcgaagcggaggaaaccctgtggaggaggagggcttccctcctggaggagttccttgcaaatgtgccaatacaaggaacccttgaaatacatagggtctgccgtaaccgggtatggtggatcctccgctatggtcctccaacacgaatcacggttgccgatagtgaacacctccatcccggcagcatcgtgagcccactgattgaaatcgatggatcggtcgaaggaccgaacaatcttgtaagtgttggtgccaagatcaaggcctaggcctgcagtctggaacctgctcttttggccatcaggcagcttgaggacatcacctgtagtaaggggttgcaatttcagaacgaaaatctcaatttcaccctcccaccgacaagcacatatctcacccaaaattttcaaaaatgttttcgaacctccgtgaatttggttaaaatttattcaaatccattcaaaatttatcaaactttcaaaagtaccggaattccaaaaaatttcagttgccaccgaaatttgctggaaaacgaaagtgtaaacccttgcctgtagctgggttgaagacgtacaacctggtattggtggggaatataacaagcccatcatagtgcgacatgccgtaaaccgacctgaattccccatgtaggttggtcgcacgcacaaggtgcgcatcgtcctgctcggtctcctgccaacggtagaaggtgattatgttggagaatgtggttggccagggctcttcgtcgtcgatcatgctgtcaagggtgtgcggggtgatgaggaaggacggcttctgctcgtgtctggagacggcagactgctgctgctgcttgagatgcgtggtgatgaaggacgggttggagatggtggcgcgccacgccctgcacacggatttcgaccgggaaagggttttgacggggaggcggagcaggatctcgtagacgagctcgttagggagggatgatgcgccggggtggcagtggtgctgcaccctcctcctcttcctcctcttgtacgtcttgatcaacgtcgtcgtcggctcttgtgggttgcgatctatagctttcttattattcttcgtggcaattacgtccatggtacctaaattaaacacaccaaaaaaagaagactggactcgtgaatgaataatatgggtggaaaactatgagcagaggatgcgcgatgtacttatatttatgaaaagatagagtgacagcaaacatgaaaacgagtcggaatcgccaatctcggatgaatttcgagaccacgcggccgacctgtccgcatccatctcataatcgaatttgccatggaaaatggaaatccaaaatcgactgctgagtagatagataggttcttcttttttttttaagaactcataaatttatttatataatgaggattacagacggagttcaaagaaaatggcatcccagtaca

SEQ ID NO: 23064 - DNA, 286 bp, Oryza sativa
aaaaaaaatccccgcgacaatgtctccgcccaatctttcctcctcctcctagagccggagaatccacccgccatcaccatcgtgctcgcaatcgcatcggtaagagcagcttggatctggtctagggtttgtggggggttcgcgatatcgtcgcgattcccgtccctttttcttttttagttttgattcgtgatgagctggttgtttgttgtgctaattttgtgatccggtgggtggtgggtggtggtgcagcctgtggcgggatcgccggcggcggcggcggaga

SEQ ID NO: 23065 - DNA, 523 bp, Oryza sativa
gggagcgagcggcacgtggggaagcggaagtgggtggacggcttgtgggcccgaagggacggcgcactagcgtgggttacgttacgggctgcttggcccggtgggaagggggtggttgtttggtttgaccattttgattattattataattgtatttatttatataataaaaataaatgaatatgtgaaaaaaaagatatacttctcacgtcaaaactgtagagggaaaatatttggttgatcatttagtattccctctttgttataaatatttgacacctagaataagatttggtcaaaatttttagattcacatcatcaattttattttatgttatactactaagtttataaaatatgtaaataaatactccatccttttcatactgtacggtgacttgtttctaagtcaaatatttttagtttgataaaatttatagaaaaatatagtaaaattttcaacacaaataaaaatgatattaaaatatattcaatgtgtcaacggggttacccatatgccgaa

SEQ ID NO: 23066 - DNA, 1501 bp, Oryza sativa
atgaggcagataaatgtgtgtactatcgccatggtgggggtgagggagttattctgtgcttgtatgttgacgacatactgatatttgggacaaaccttgaggtgataaatgaggttaaatcattcttgtctcaaaattttgatatgaaggatttgggagtagctgatgttatcttaaacattaagctaattagaggtgagaatgggattacactcttgcagtcccattatgtggagaagatcttgaatcgctttggctacattgatagtaagccttctccaacaccttatgatcctagcttgttgcttcgcaagaacaaaagaattgctaagaatcaactggaatactcccaaatcattggctcgctgatgtacctggctagtgcaataaggcctaatatctcctttgttgtgagcaagttgagccggtttacctctaatccgggagatgatcactggcgtgcacttgagcgagtaatgcgctatctgaaaggtactatggaattggggcttcactatactgggtatcctgcggtattggagggttatagtgattctaactggatctctgatgtggatgagatcaaagccactagtggatatgtcttgacattgggtggtggtgctgtttcgtggaggtcttgcaaacagaccattttgacgaggtcaaccatggaagcagaactgacggcactggatactgctactgttgaggcagaatggctgcgtgatctattaatggatctgcctattgttgaaaaaccgatgccggctatcctaatgaactgtgacaatcaaacggtaattgtcaaagtgaatagttctaaggataatatgaaatcatctagacatgtgaaaagacgattgaagtctgtcaggaaattgagaaactccggagttataacgttggattacatccaaacagctagaaacctggcagatcccttcacgaagggactatcacgaaatgtgatagataatgcatcgaaggagatgggtttgagacccatgtgagttatactatggtggtaacccaatctatgtgatcggagatcccatgaattagaacctgggaagaacaaaccattagtaaactagaggagagtaccaatttataccctctctaagtgaagatgcatgtactctcgtgagctgcaaggcaggttggctatgtcttaatgagttctgttggctttaattagcgaagatgctgtcctgcagagcattcttgaaagaactcacctttgtaagcttgactgttggtcgcagtctatggagattttgggtgaatcttctaggaagtttactaaagacctaggagtatgacttatacgctccacccgaggggtagtctacagacggtctagtaccagataagactctgagtgaaacttgcttacacaagacttgcaattcaaggcgtagtccattgttcaagttgtgagtaagtgtagcttggagttctaggtggatgttcaaccttaatcgctctccattgaacc

SEQ ID NO: 23067 - DNA, 523 bp, Oryza sativa
ccaccatcaaagacttccccctcatcttgaaggagaagaaagaaactagtcacctaataaagagattagtgttaacacatcttttattactttaaatcatatactattactaaatcttttaccttggaccagtagtctacatgtcagcgagaaagtctctctctgctgcttcatgaactcctcaatcccatcttcatctcgataacagttccatctctctctgctacttcatgagctcctcaattccatcttcatctagatagcaactctagtgacatgggttggctgatggtgattgggagaaggtgggcttgaaagctcgagtggcatgccagctcaaggggagatcgagctcaagcttgtgagtgaggatggcccatgcccacatgcttgtgctacagatgacaacaccgtttcatcacccaaccctgtgccacggtgtctcatcttttgcagtttgcacctatgcaaccacgcttgtgtccttctagcacgtgaaatggtggcagattgcatccctcca

SEQ ID NO: 23068 - DNA, 1501 bp, Oryza sativa
cacacaaccatggacaaaatggagatcaatctcgacgtgcttgatgtgctggtgctgaactgcagtgatgttgtcacaatagaccaaagtggttcgagtgggatgtgaatgcagctcgtgcaaaagttggtgaagccagcatgttccaacaacaacattgcaaatgctctatactcggctttagtgctggagtaggagacgatgttctgacgtttggaggacaatttcgttacacagcaggtgtactttcatccataatcaactacatacaaatatttaccaacacttgtggaattggttagtaacaaaccctaccactacgtccagtgtttcatttggtatttaaggaccgccaacacctggcccagcatgctgagagcatggcctgatatttgaatggtatcggcacagggattgtaaggggtgtgctacggcgtgacttggtgttgggactagttgccactctcccgcagcctgttggcctgagtgggtggcttggatgccgccgccaccttgttcggaggcctgagcagtgccaccgttgccgctatctccattgccacacccatggcagtgattgcagttgttgccaccgttcccggaggtggagttggtggtgctggatgcagcagtgacgacagacccagctccaccggaaccgttgttggtggaggcgacgaaggcaatggcggttctggtggtctgttgtcccttgttgatttccgcaagaagcagctgagagcatgcctcgaggaaggtggggaagcgacgctataagggcaatacagtttgcagattattgtactttttattcaaacctcgtgaaagtgcgaggactagcgtgcactcggtgataggttcgccgaggtcggccatcgcatcatccatgctccggaagtggcgacagtattcggtggccgacttgtcaccttggatctcctcaggttataagaaaaaaaaagatttcaaaggaacatctctcgatcctaaataagcctctaaaaattcacttggcacaagtatgtcatgcttattattccaaacccagggagaatgtgtcattgtccattggatgacaaatctcccgaggcatgtgtcctaccctaaacacaagtcaaaatacgcttcaaaatacatttgctaaaactcaaactggacccttttgtccatatatatttgcttggataaattttaagctattccaaaacattatattggataatgtcttttcaattaaacaatgtgagtaaattaatttctagtaaaatagatggatcgtaaaattaattctagtaaaatatcatgaatagactatactacaccttcctcccaacaatatttttcttattttgagaggatgttttcctggttaagtacacaaacaaaaatcattgttcaaacccagatcatttgaacagacgaaagtaggggcacatttgtcacccagttgcatatttgtgtgttagttcgaaataggaactgtctatttgtgacaaacaat

SEQ ID NO: 23069 - DNA, 398 bp, Oryza sativa
ctactgagcctagatgtatattcagtccatgagcttgttattcagttaaggtcatgtagtagctactctatttttgttattgaattagaatgtactagctcctccatcccaaaataatatcatctttgcctcctcttgtttgtcccaaaataagttaatctttcaagcaatcattgtattggagtttgtcatagtgaggaacaaatgcattgtgactaaacaaagtggaagacaattgcattgggatttgatgaagtggagggcattgcagttttttgcttttgtattgatatgtgtgggatgggtgaaaaacgaagttattttaggacgaagggaatagtagctttctttatttttgttattagtgtataacaacgttttgtgttgtcttattcaga

SEQ ID NO: 23070 - DNA, 1501 bp, Oryza sativa
ctaactttgagctctaaactctaacttcagtgatagctagctcctattagagatgaaaatttgttgaaaaatgtttggctacgttttagctctagatctggaaaaaaaaaagaaaaaaaacagccgtcggccccaggcgcgccgccaacccgccggccgcttgccgtccccaggcacgccgcccgtcgtctccgcgcgtgctcgcgtcgatccgccggccgcgcgacatccccaggtgcacgccgcccgccgccgccgccacccccgcagctcggttgggatcaggaggaagatggggaggagagagaacaggagaggagtgaagggtagttgagtggtatttttgtgtaaatagacttaaaagattaaagggtagtgggtcttttgggatggagtgaagcaatggagcagcaaaactccaactccacccctgtagttcattttctaggggtagctctgctagatctactccaaaagacgaggatctgtaccgtttggcaattggcacagctctggctcgaagtaagttagagttgggagctcgaaacgggcaacggtggatacagtggtcccgggaccacctgaaaaaagggcgatcgactcactattaaaaaaaatagcgactattgaaaagaaaaaaaagcgatataatcccccttcccgactcccgacgccctaactatggctcacaggtcccacacgtgagtcgcgacgtgcgtgtatcgaatcgatcgacacaactctctctgtctctctcctcatcgccctagcccgtagccccgggccatagcccatagcgaggacgccgcgacgcgagcagccgatcacggaggcagagccacaccgccgccagccgcccagcccatgcgcgacccggagcccgcgcccccacgctcgcgccgccgcaaacggggcctatatgttataaaactaacaactagttcaaacacaagttacctaagaaacgttgatatccaaaatttttaaagaaatcatacttttgaaaacatggcataaataatccgcacaaaaatctacatatgtaatctaaaacgacagtgcttgattatttatatactacttcaaaaaagatagtgatgatgttagtaaatctgtctccccacttactataattgtagtttagaaaattatcccttaatttcttaatattaaaaaattcaaatctaaatagataatgacatataaaatcaaatcaaatcaaatcaaattaaatattccttataacaaaagatggctaacatatttaattaaaagtatatttttgtttatttctggtaatattataataatattttcttttattccaagcaaagtatgtaaggtcattcctaattaagctataaagagttgctaaggtcattctggtcattcgtaagtataaattgagctaagagggttggccgtgcacatacagaccgccgatgctgtcgtccactattagtctattactccacaagtagtatctctacgtgtgccccga

SEQ ID NO: 23071 - DNA, 289 bp, Oryza sativa
aatggaaaagaaaagataaaagcaatggatttgtatataaaattagtgaacattataagattctattgggcaaaccccacctctatgatcttacaattctaagaggagggaaaataaatttgaaaagaaccaacatgtttaagaggaggagaaatgagaagattgaaaagatacctaaagcgaggcttgccattaattgagtattaattatttaaaaatccaaaaaatagatcaatgtaacttttaagcaatttaaatttaaattcatcgttaaattgtttggaaagca

SEQ ID NO: 23072 - DNA, 1501 bp, Oryza sativa
cgtatgcaaattcaggagaaatcatattaaattgagttgaaaccagtgactacctcgactcgactgagacagctttgttgatgattatagtgatttaatatgcagaaaattggcaatgtaaatagcaaggactactcatgctgctcatcagactgcattattttgtagtcactaatcttatttcgaacaaactttttgtcgagatgaccgaagaagatcatccaaatattataaagatagagggaaaaaaaggttagaagaaggttttttatcgaagcacaccaaacgttttgtcgagaaatgatgtgcaccaaagcgcatgccccttgactacttgttgaatgaaaacaaaagtgcatgactgactggagaacacaaaatgattatatattttgcaagtggcctgctttgattaaaaagacaggaaattatttgccaaaagctgtctggtaggaactgggcagtttcagtactaccgcatgcatccatagttccatacgttagatcaactgattgcattgaccctccagtggactggaagtagcaatgaaatgaccggtcgccgacatattcctgatgtggacacaagtagcacatatatacattctattctcgccgtatttagtttctaagtttttcttcaaacttccaacttttttatcacattgaaactttcttacacacacaaactttcaactttttctgtcacatcgttccaatttcaaccaaacttccaattttggtatgaactaaatacatcctctttgtttgctggggatcagaagaataactcaaggtttttctatatataaagaaccctttaatatatgcaaatgcattcttgcagccacttgtcatcctcaagtcgatcagcacaagagcaaggtgggaagacagggtagtcggcttgcatgcctgcatgtcgacaattcaggtccccacaggaaatcttctagagaaaggcagcccaacacaaagtattctactcacttcgttccattttaagcatagctataagttttttcgtgtctaactttgatcgttcgacttatttaaattttttttataattaatatattattgttattagatgaaaaaacataaatagtatttatgcatgacatatgtttttaatttttttttaaaaaaaataaagaagacagacgatcaaagctagaaactaaacaagcgagtggagtcagccagtatctattggctagcccactatcagcaagggggagagagacctaatggcgttgtgctatataaggtgggcaggtgtcagagacaaggggcggactgatttgtaatgaaacaactattccttcctataattccaatctctccctgctttcattccaacctactctgttctatcttcttcttcctcaattcttactctgctctatctctttctcccaaaatcctccccaaattcctcaccgtttgcggtgcgattcctgtcaacaccactggcttgatcatcatggcaagagcaaca

SEQ ID NO: 23073 - DNA, 174 bp, Oryza sativa
cctactacaaaataacaatttcctcacagcaatttgcagtcctagtcgtcccataaccctgcaaaatattaggaaacatgaccgcataatttgtaagaaacaacaaaatgttgtgaccaaacatgatctaggggcaacaaggcaaaattttgttaccttagtcaatgacctcca

SEQ ID NO: 23074 - DNA, 1501 bp, Oryza sativa
atgttattcttaacatcaaactacaaagaggagatgagggtgggattacacttgtgcaatcccactatgtggacaaggttttgagtcgctttggatatagtgactgcaagccagctcctactccttatgatcccagcgtgctattaaggaaaaaccgaagaatagcaagggatcaactgagatactctcaaatcattggttcattgatgtacttggctagcgcaacgaggcctgacatcttatttgctgtaagcaagctgaaccggtttgtctcaaatccgggagatgagcattgacaggctctggaaagagtaatgcgctatctaaagggcactatgagctatggaattcactaataccgggtatccaaaagtactagaagggtatagtgactcaaactggatatctgatgctgatgagataaaagccacaagtggatatgcgttcacacttggaggtggcgctgtttcctggaagtcttgcaagcagaccatcttaacgaggtcaacaatggaagcagaacttacagcactagatactgcgacagttgaggccgagtggcttcgtgaactcctgatggatttgccggtggttgaaaaaccagtgccagctatcctaatgaactgcgataatcaaacagtgattattaaagtgaacagttcaaaggacaacatgaagtcatctagacacatcaagagaagactgaaatctttcagaaagcagaaaaactccggagtgatagcattggactatgtccaaacggctagaaatctggcagatcagtttaccaaggggctaccacgtaatgtgatagacagtgcatcgagggaaatgggcttgatacccacctaaggttgcataatagtggaaacctgtccattgtgatcggagatcccgtgaatttggatggtgaaacaaactattgtgtgactgaaagaagagacccttgaaaagggctcattttcatgatgtgcttctcttctttcctgcatggtagaatggcttatgtcttaatgtgaaccgagtggcttttccaaacagagatgttgacctgcagaacattctcagaaggaacacacctatatgagttcgactgctagtcacagtctataaggtttgggcaatctctagatactcatgaaaggcctggagtttgacttatatgctccaaacagaggggatgcgaacgacagcccagtcccagtcaaggttttgagtgaaacctgatcacacaaaacttacaattcaaggcatagtccattgttcagttgtggtctgatgaagctcatttcctaggtggaagttcaacttgacagtctccaccaaaaccctggtatatcaaacaggcacaacattgggaacatttcttatgagccttgaaatttggtggggattgttaaaataattgggctaggcccaatttataatattaaatctcaaaggcccataataaatgttgaggataataataccacctcaggatttaagcgagaaatatctc

SEQ ID NO: 23075 - DNA, 1501 bp, Oryza sativa
aagaaaattagccgatgtttccaaaagagaaaaggaagaggagatctcaaggatcatttgccctcaaacaattcggccggagaaggaaaggcgcggccgaatttggaaggagaaggcggcggcggcgcgctagggtttgcgggcggcggcggccgaaggagaacgacgaacctgacaagcggggcccacctgtcagcggcagagagagagtggagagcggcggctcggcggactgggccggctgggccgagggaaagagagagagaagggttttgggccggctttcggcccaaagccaaaagaagacttttaaaacctttttttcaatttaaattatttcttaaatgcaattccatttattaaaaatacttccttagctcaaataaatcccagaaaaatctaggaattatagaattaagcaaagtatttaacaaaattttatctagcccaattttatgttgagatttagcaaattaaaattagatcttctcttttaagcttttaaaatcatttctaataattccttttaaacaacaatttataatttaaggattttaaacaagaaaagctcttaacaaatataattagatcatcaatgatcaaataattactgaactgttctttgtattatttaagaattgagctctgaaaaatccgagaaaatttcagagagttgacttaaccatggagaatttaataaaaattaaatccatccatgctttatatttaggaaattttatttcccacatttaacttcacttgtaacttaaagaacatttaatataaattctattaataatttattaaataatttataaatcctgaaacaaaaaatcaggatgtgacaaggagagcagctatgttccaccaagctacattgcccactatggaagaggccatttcagcaatggtgcaggaagagatgagattgaggttgatgagaggtacaaattctataagatcagcatacattgcagctgataatagggaatgctacaattgtgggcaagtgggtcatgtgagctacaattgtcccacttcccggaacattggtggtaggggatcgattcgaggagggcatggtggaactcgtggtggatttggaggagaccgtggtggttttgggggaaatcgtggtggtagaggaggtgatcgtggaggtcgtgttggaggtcgtggtaggggcagaggtgttcctcaggccaatgcagctacggaggatgggaaagctgttaccctaataggtgaacaagtgacacaatgggaggaatggtagaagaacaagaccaatgagagctctaacaccaccactcactttggtaacttcgccaactacgcccaagtgggcgaaggtactcaggcacaggcacttgcatctacatagacatcctatagattggatcatagactcaggagcatcaaagcatgtcacaggattgcataatactttcacatcatacactccttatatccactctgaaactatccaaatcgctgatgg

SEQ ID NO: 23076 - DNA, 1501 bp, Oryza sativa
ctactgttttgaaatgccggctttatgcaaaagaacctttagcctcccttggatatatcttgcatcatacctcctcttccggtatgacttgctgagtacagtgggtagtactcagtcttgctctcttttcccccacaccagagttgaagtccttctcagttgaagatgtctcgaagaggttggtttcgtcgctgccgtcaaggatgcctgtggaatggagtcgcccgctgcaggagtcaagccttcaggcttagctcgcttttatctttttccgttgcatttgtaatcttttatatttttgtaagacgtggatctgtatgtcaacaattgtcgtttgtgtaccctggctggtcctggacaggggtttaatacacattcagcttagaaattctggttcgtgaatttctgggcgtgacactgtctgctgacgacatgaccagtgtcagaccggtcacaaatcggtcattcttgtccaccacgcgtcagtttatcaatctgcatgttcgcccttcttcatacaatatcttgcctgtaatggttaggatgaagcctggcatatatctgaccggaaccaacgtgccatctccaggagctaacatgccggttccggctagggacgagtgcttggaggctctcgtcctgacgggatggggcgaggcgtgcgtcagaccgcctgtcgccacctaacccacgatctgaccggtctgtgaccggtcacagaccggataaacgagcgcgctgcactgcgttacatgcggcgtgacgcgctcgtccaaaccgcaataaatgtggttaagtgagccccgctatgctcacctaccccatatacgcggcgcaaaacccacaaggggtcggggcacctcggccctcggggccgaggcggtagcggtccgacccctcggggagacaaagagaagggcggccgtatcaccctcgggcccgacccccccgagggggttaggccacgtgggtgatcgtgtctgcctcaagtctctaagtcatgatactcccggtcccatgtcactgacagtagcccccggcgttatgccaaggcgatcgctctcctcgagggaagcggtcgggcgtgacgccacttcctaaggcctggtgacaggtggggccggtctaaaaatcgggacaagccggttcgtttttcctggagatatgatgatggcgcttcggtcggcgagcgtaattaacgcgcgcacgagatgttccatctcaactgccacagccgcatatccacttcatgcaccgcaaacgggcgaatgggattagtggaagcgtgggcgcgagaaacgagggagcgagatagtggacgcgagaagcgaggagccgggcgcagcgttggcaagggtataaagacgccgaggaagagatttgcttccttcctctcgccattattccccttgtcttcgccgcttgcgccctaactccttgtttcctgtgccctaccttcgccacacgcgctcgctcttaaacttctcttcctccggcgtca

SEQ ID NO: 23077 - DNA, 422 bp, Oryza sativa
taaagatattttgagcatgctacttatttgataatgatccttttgttggataaatgggtaccctggttcccatttcaccgacaccgtgctttgctatgataaaataaattagatgtgtactaatattgcttggaacaaattagttgtgatgtttgggacaaattcgtccttatatgtgtctttgcataataaacttgtgttttagaaatgaaataagataagagtcatatgtaggactattttgtaatattaaagcacatgaaagaagagtaggtacaaccatggagtaataggtaaataatgctctacacaatcgagttggtgaggtggcagatttactggcaccaccattgccttgttttaaaagaagtacagatacctgtaggggagttttttttttctttttttacctttaccgcaga

SEQ ID NO: 23078 - DNA, 639 bp, Oryza sativa
gtcctcagcaaaaggggcgtagaaacctgcaagacctatatcttaagagaacgagctaagatccactttgggcctggcatagtcttgggcccccgggctcaccttagccagcgcaagtcgtgctactcgataaagaggagtgtcgagacataccaaatataaaggtgtaaactgaggtttgcctctagcctagccttgtttcgggtcacagtttcaccttggtccttgtataactcacgtccctctgcctagaggggcactgaaacgtacaagacacgtaatcttggaataatttttcatcaacgacatcttcgagaagctcatctgagaataaccaaactacttctttaaacgcgggagggcgcgacctcagaacttgccgggaagatgggcgtgctccacagccagctgtgaggcagcatgccccgccataaatgaaacaggtttatggggaatccccagccagtctggagttgaaaggacgtggacaagacaccagcgctaagtcacttaggacggtggcgcctgggacacacgtcgcacatgccccgcgccacctaatttagccaaacgggcagagaagcaaccgtgatgctgtttttggcaggtcaggccttgtcaggcccaccacgcaccaca

SEQ ID NO: 23079 - DNA, 1501 bp, Oryza sativa
gcaactgcactaggaattcatctggatttttttggttggttgtgataactgcagcaaaacatctcaagaggataaaccttcactgtcattgaaataaaaaatacacttattaattgaataacgtatttttaatccattctgaacagtgcagaactttctgaattatctatcggtgtttagcggttgattgttgttttattgaggggtattattaaatatcaaagtagatagatgcagataaagaatcaagttttatgacttggttttagttatacatatttttcttcaaagtgcaaaaataaaaattgtactccctccgtcccatgatataagggattttgagtttttgcttgcactgtttgaccactcgtcttatttaaaaaaattgtgatggtgactcatacatatattgtcattactaaatatcaccatagcattagcacgggcacaataatgttttatagtcaattaatgacttgtttctttttagtatcgctaagcagctcacctaaaaaagttagaacaaaaccatacacaggggccaaaaaaagcagggtgagtggcggccaaggatcaaagtgtcaagggggcatttgcccccgctcactgcaaaattgagtggtgttgatgaaaaacacgaggcctgggagatctgcttaactccagtgcaggtccaaaactcgccttcgggtatgctagcgtaccataccaaatttggtcgttaacaggtgggggcaaaggtccccacttgtaatactctagatctgcacatgaccatacatccctagctccctgccaaatctatgctccctgtagttggtcggcttgtagtagacttgtgacgtacaagtgtaaagaaaaatctatgcactccatcgttataaaaggaaacgctctctcactcccttctcatcacttcgctcactcactctcactcatttcctcccattagtcttcccactcacgtctcactcctctcactcacttctcactcgaatgagtcagcagccaccctgttgtgggcacgcatcctaaggggctgccaaggcaaccagggcgggaagggtagtcggggtcagctaggatgaaaaggagaaccaggtggcgacggtggcttgagcgtacacggtggcgcaagcggcgacggtggtggtctaggttaccatggcgctagaggaggatgaggacaagatagcagaaatggtggccgcgggtcaacggcagtgggcgcataaggtctagggcgaggtggtaagccatgatgcggttatgatcgttaggttggtttagtcattctttttacaacttgcctcgatccttactgcaaatggcaaattcatgcaagaaagagtgtagctaataggtggaggataactagtgcaggtgaagacaaacatgctcagtgcggaattatctggcaagtacttgcagctaacttcaaggtttattggcaacaggttacagacatttgtccaagctgagccaatcttgtgtcctgtag

SEQ ID NO: 23080 - DNA, 1501 bp, Oryza sativa
tagacatgcttaaagtacttttgattattagtattttttaaatttacttaacaaagtaactaataaataggaaaaaattctatatgtcccaaaaacattggatagaagttcattgaacaccctaaactttaaaattaaacatccaaccaccgaacattgtcataccattcatatattacagacattggttttttatattttaaagtttaaacgaggggttttgacaaaaataatataacatatgcttacataaaatccatcatccgttattagtttgtacagtaatgttatattaagttcgcactcatcccttctttctataaagctaatgcccactaaacacctagagctcaacatgtaagtgttgtatttattagtactcctaaaacctagatgcaagcatgccacatcaacccattaagcacacaaatctcaatatgcaagcatatagtaattatatctacaatttatttcattctaaaactaaacatacacatgctaaaccatcattctcaaattattttcatattatttcaatccaaattatttcattaattctccaatatctaatatatatcccgtggcaaagcgtgggatatcttttagtttatataggagtacaagtgaaagaaataagggggtaaagaagagaatcaagtgaagatttaacatatacatccaagacatatgtcacatattcaaactcatccattgtatatacaaattatatagtaatcatttttttaaaccatcatatgggctgcatagatggtattataaactacataggattaaacgtctggttttaaagtttagggtgttagatggactatcatctaaagtttacggggtatatggaatttcttccccaataaatattattcaaagtttaaggaaaaaaatctacatcatatattagaaatggagaggtatatacgtgggtttagactgatggtgtgatattatctttcacgttatattttaataaacacggatgacctataacatgtttattttttttcctccgaggaatggccctcgtaaccatgttgtctattcagatctgcacaatatttttataattaatgatttctaatatagtatacatgacaggctatcatcttactataatagagcgtatggccccatcatttggcttattacggaataagccaaacgacatatttgcaaatgaaaaataatttgtaaataaaacttttttatatgtgtttttagtgatctaaaagcaaaggctaaaaagaaaacttcggtgaaaatccctaaaatcatgataagtataagcataagcgaaaaatgaggcttgtttctcccttgttttctcatgatttcacatcatcatagcatactccctcatactataaaattgttcatgcgcaagctactccctcacctagtcgattaattatattggccgcgtggtcactagcatgcatcatttcgttaattaattaattgctcttacgtacccttccattttcgg

SEQ ID NO: 23081 - DNA, 644 bp, Oryza sativa
cctccttatataaggggaggagtcggtgttacaagatacagcccatattcctaacggaatatgcaagtaaagataaattacaatcttaacagactaggatcctcgggcgtttgcttgagacacaagttaataaaacaaccgagtcctttacttaagacattctatctgtatatggtacccctatacctagtcggatatacataccgtgtgggtatggggtatccataatctacacagtagtcccagagaccttcacagtcgatgaaataatctcctctgaaaccattgaacgaaaatctgagtacttcgactatctctgtcttgttattccgagtgcttgaactgaaggctatggagggctaaaaaataaaaaatcaggtgcatcgactagatgcacctaattaggtgtagcccctaactatgtgattagttaaacaaaactaaatatatagtcaaggtatagttcaataaccagccgagtggttttatagataatattaccgaagtaatcaaatagcaaaacatatgcgatttttatccaaagattcagccgactgctttaacctaataagctcaccataaagatatataaagatcagaatggaaaaacgatctatgatctattttggagcttaaaatagctt

SEQ ID NO: 23082 - DNA, 262 bp, Oryza sativa
atctgggaaatgctttggtacgggtataatgtttgcttatgcaattacactatgtcatgacgatgatattagagtagtatttggtagtttaacgtggtgtctagattacgggatatcattatttggggttatatgctgcggatgagaggtgggccgctgatggtgacagctcagtacgggtattcctccgtgcctgtatatagtcctaagttaattccctagggagggtattcctccgtatttagccccggttgtatggtca

SEQ ID NO: 23083 - DNA, 362 bp, Oryza sativa
ccgccgcctttgcgccgccgtcatccgccgtcggttcccgcgcctccggttgccgtcgccggcgaccgtgcgtgcgcggcaccgccctcgccataaccggtcggccggtttgaagccgagccggaccgaccgggcgcctcgccgctttccccccccccttgtgacgctgcccggtgggtcccgcttgccagccgccccctctccctctctcctgtgcctctgacccgcgggtcccgcgtgtcggcgccacccctccttgtgctgacgtcagccctgggatgaattattgcgcaataaattgattaagggtttttcttttatagtaataaacacatataatcttctaaaaatcataactaatt

SEQ ID NO: 23084 - DNA, 1501 bp, Oryza sativa
tttccaggatacgaattggcatctccacgtaggtcaaatcttcttggatgtcaatgtgctctgagctagcttgttcctcaggtaccctcaaacacttcttcagttgagacacatgaaacacatcgtggataccaaccatattaggtggaagctctagctggtaagcgacttcacctctgcgttccaagatcctgtatggtcccacaaagcgtggtgccaacttgcctttggtttggaagcggtgtactccccgaagcggagtgacacgaaggtacacataatcccctgcttcaaaagtaagctctcttcggcggttatcagcataactcttttgccgagactgggcgattcgcagtctttccctgacggtcctgactttctcctctgcttcggttaacacttctgttccgaacagttgacgttcgcctgtctgatcccagaagagaggtgtgcggcacttccggccgtataaagcttcaaacggtgccatctgtagactggcctggtagctgttgttgtacgagaattccgcatatggcaagcttttgtcccaagctccaccaaaatcaagagcgcaagctctcaacatatcttccaagatttgatttactcgctcggtctgaccatctgtttgcggatgataagccgtgctgaaattcaaacgagtccccaattcttcttgcagtttctgccaaaattttgaagtgaactgactccctcgatcagatacaatctttttgggtaccccatgtagacacatgattctcgagaggtagagctccgccaaccttttgcccgtatacgtggtatgtactggtatgaagtgagcaaccttagtgagtcgatccacgactacccagattgaatcgtgacccgatgatgtccggggcagtcctgttataaagtccattccaatctcctcccatttccattccgggatttgaagaggttggagtaaacctgctggtctttggtgctctgccttcacccgttggcaaacatcgcagagtgcgacgaattcagctatttctctcctcatgctgacccaccagaatttctctttgaggtcctggtacattttagtactgccgggatgaattgaatactgagtttgatgagcttctgtgagtatgagatccttcagttctttgtcgtcaggcacacacaatctttctcccaaccagattgtgccatgctcatcctcatggaaatctcgggcttttccgaccctcatattctttttcagctcagctatttcaggatcatttacttgagctgctctgacttgatccacgagcgtaggccgtgcctctagggcagctacgtacccgtgttctacgatgcccaaatttaggtgctcaagatcttgctgcaatttgtcacacatgccttcggtacatactgcattgcaatagctctttctgctcagagcatctgctaccacatttgctttgcctggatgatagtgtatccccatgtcataatctttaattaactctag

SEQ ID NO: 23085 - DNA, 506 bp, Oryza sativa
ttaatatcaactttgtggtgctttcatgagaatagtataggtttacttctccttgggaaaaaagataattcaaatgaaatgccttagcatgaccttaaggtggaggaggagcaatggcaaaatgcaactatatcacagaaggaggcagcaaacagattatacaaatacaaaacaagatttaaaattacaaatatgatgtgttctaaatctaaataaaagttttcacagaaactgtaattgttgtactccctttatctttaaataaatgatgttgtagacagtcatcaggattaatttgtagttcaaaattaccatgctagccctaatagtttatcttattaccatgttatatattattctcaaaatgtagagcaataacaacgtacatttttgaactacaatatctgggatgaaatcgaaactttgaattgaaggaatatgatagagttgcaaaaatactgtacagaaagcatgctaacctcattgcgtgcctcaatcccttcagg

SEQ ID NO: 23086 - DNA, 1501 bp, Oryza sativa
tcttattaaaaagattgcataattaatatttgttttgttgttacttaggttatcactaaaggtattttaaacacaaatttacatatttacacagaaattttaaaataagacaaatagtgaatattatgtggtgctcatgaaaaaaaacagtgacatcatctattaaaaccagagagagtaatttctcctcatgttaattccgattctatatatttatgcaactttcagacatgcctcttgctatactatatatattgcaaaatttgtcccatgtacattaaccatccgctttaagatgtatcaagcattttttttaaataaacaagagaaataaataaatgcctcgaagccgatgccctgctttttcacgtggcaaaccgaaagcaagaacaaaagggaccgacaagtgggtcctacttaccaatgactattcatcatattattattatattaaaaaaatccagccgagaatgaaaacagaaggattaatgaattaaccacgtgcgcaaaatcacacgttggaacctgtggcgaaggaagcatccaagagagttcctgtgtgaagccgcaaagcgatcctagtgtgaaaccaaatggcggctggctgtaactgttggatttggatctaactgttcaactgtcctaacctagctaagctagccatttgtttgtcactgatttgattagtataactagccaattgatctaattgcgtgccttaatcaccatgtaatcctactcatcagtcacacccgtacgtgcgtgtgttcttaattaaatcattcagatgcagaaagacccctgcttttcaggcaatgatgccaagaaagaagtctcagttggacagcaggcttgcatttgccaagcttacaaaattcagttatctcagactaattaagtagtagttaatcctcctccaaactcatgatagtccctaggtagtgactaattgaaatttagtagtatatgatatgatgtgagctatccctgaatagtccaaaggagcatcacctagtggggatcaaatgtggaaaaagaatgcacctaggtgtacatgtcattgtgtgtttgtggttggttggccaataatgaattgaaacacatgcacatatatattgatagatcatctatacatagatttatcatgaggtgagatatgatctgatcatcctggtctgacgagcatatccatctatcctacaattaacaaattaatgtggtgagggcctgcaggcttctgttcttcttccttttgcagcagtttaagtaccccctcttattagcttctcttcagccctcacttcacttcactcttcattgctattcttgcaccgacagaaataatcgaacctcatataggtatctatatatgtttaattacagtgctaattacttcatcattttcttgttcttgaaggtcgaattaacagtctactgattcttcttgcagcattattgagttaatcgtcattaattcatatagttgaggattttggataga

SEQ ID NO: 23087 - DNA, 1501 bp, Oryza sativa
ggccatatcttggcgagtaccagacttggcttgggtcaaaccaatggcaattgaagagcacaagtgtgagaggtttggtgccatcaaagctgatttctattatttctttaatgtaaccacagtactcagtcatttcaccactttctccatgtcctatagtcatttctattattttaaccccgtgcctggaggttgaagcttttaccatatgtaatatgtcattccataggaatttcataggatttggaaagcttcaatcatttgaatcaaagggccaaatagaaaaattttctatagaatttgaatcctatgaaattcctatataaatcttttgattcaaatgagctcttaatatgagtaggacggaagagcactggaattatcattaattcagtgatactagctaccttcgccgtcctaaaaattttagttactccaaaataatacaaaatcaataagactacaataccccactttatcaaatcctaatgtaattatttttcactgaacacgcttctaatgcatttactttccaatttcattaactccgattcaataattgtttaaaaataattttctttttggacaaactgacttagtaaaaattgatcttattgtgagatgggggagtatttcgtggtctacacaatcatggatcatgttgtcttcctgttctacactttagtatatttcacttaggatatatttgccgtgtttagttccaaagtttttaaacaaacttccaacattttcatcacgtcaaaaatttcctacacacacaaacttctaactttttcgtcacatcgtttcaatttcaaccaaacttttaattttggtgaactaaatacagccattgagaaccctatatttgcgtgataaaataatggggcatagtcatgtcgtaatactaataagtagcatgtcaaatcctagacccatatttccttttgatatttacctatgggataaaacaaatattttgctttgagacgagattaagttattcctcctaaatctaataaaatcgataagcgtccctgtgctgttccggccaaaaatcaagattaaaggtaagagcaagtttaatagtatagccaaatgatatctataaatcatctacttcctccgtttcacagtgtaagtcattctaacattttccacattcatattgatgttaatgaatctagatatatatgtctagattcattaatatcaatataaatatgagaaatgctcgaatgacttacattgtgaaacagagggagtataactaatctaataacctatttatataatagttacgaataaaaatatactaatctattaatacccggtcacacctctcatatacacacaacgtcttcaagtctgtattgccactggcaacaaatctacagttcgtttttttctctcttctttaatattcttgatatgtggttctagcttgctctaacatgcatattttccttgcacaaaaataagcgtattcttctatgccttt

SEQ ID NO: 23088 - DNA, 1501 bp, Oryza sativa
gaattaacatcgatttatgatgcaattattaaatattttctcaaagaaaaggctgttgctgacgtcatcaaaggggccggcgcagacaggcgggcctcacacgtcagtgggtcaaggggagcggtccaccgtggaccagaaccacgaggtggtccaccgccggtccacgggaaccgacggcccaaatcggccaaaaccgatcgggcggccatagagtggcgcggccagggcacaggcgcggctcaaagctggcccggctgagccatggcgcgacggcggcgctcggccaccggcggcgcaagatggcggcggggatgagagaggggtgctcaccaagtgcccgaggcaaggaagcgacgcggggagctcaacgatgagagacggcagtggtgcttgcgggttggagtcggggacgacgctccattgactcccaaccgcggcggaggcgtggccgagaaccggcggaacctagggaacaagggggaagggttagaggagggggaggcggcgtcaatcgccggccagaagaggagggaatgatggagctcacctttcgcgaggaggcaaccactccggagcggttggggcaaaacagaagggcggccaaggcactcctcgatgaggtgaagcaaacggcagtgacggcgcgacttgaggtggctaggagcggcggtggtggccgaccgaagtgcagaacggcagcggcactggggattcacagtggagatggtgtttcgtgggtggaaggtagaagtggagtgggtgctggggtgcggagcggcatggcgaagccggtggcgccagcggcaggatgcggcgacggcgggagcggcggtggcgcgttgttggagagggagaggagcggaaatgagagagggagctccggggatcgtttttatgggctcgggggattgggatcgtggtcgggcgaggcggtagagggcggcaactgccggcgatgtggggggagacagagagatgagggaggcggtggcatggcaggattttgcgaggagagtagaggaaacggtgcggaaatgggcggcgaccacgcccacgcacgcacgggagagggaaccatgcgatgaaagcgacgacgtgggtggatttggcagccatggcggttgcttgcggggtggctgaaggaaggaggaggagctgacatgtggggcctcgggtcccacatgtcggctagagagagaggggagaccgggaggagggcaaagtagattttcacgagggcgggctgaaggagagggaaaatgagtagacggcccaagagaggagaggggaggccggccgagagagggaggagggaaaggagggcttgggctgaaaaaagggcccaaggggaggaagggaagtttattttgttctctttttattttaattgattaaatgaattttatgcttttaaaattatttcttgagctccgaaaattcacgggaaatttcagagagtacattagggcacagagaatattacaaattatttccgacc

SEQ ID NO: 23089 - DNA, 688 bp, Oryza sativa
cccaaatttaaatcccggttcctcccctcccaaacgcgaatgcaccaaaatccccatcactttataggtttagaagttatactatcacgagcaggcattttaacgatagtgtacactttctacagttggccttcagcgatgcatcgaaagcactactactatatgtaaaatgaatactttttaaataatgacacctgaacatgtaaaatgtcctgcattggtaatgtgcctaaactgatttttttttactactatacattgttatattacactattgagaacatggttctataggtgctaatattgtcggcagaatcagtttcaaacgtagggatttttctttttaccttggaggatttgagaaattcaggcaccaatatctttttcaagcgcttattcccttggactgaatttcttgattaaacttcctgattctgtttaacagggattctcacactgtcatctcttgatttccctttatcgtagacgttctcccaaaaaatacaatcacaaaggtagacatctcattcaattcagagaaatatatttttgtatatgtgtgtcgaaacatgaattcggcaataataaaacggggtagcgcacgagacctaaaagtggatggatgtggagacaaatgatttagacaggttcaggccctctcaatgagaggtaataccctactcctgtt

SEQ ID NO: 23090 - DNA, 1501 bp, Oryza sativa
tctcaccaataatcaaacacaacacaaggtggcaactagcaaaacatttttgcagcaaagtggacctgccatgaaggggtaaaactaacaagggcaacgggtgcacaatgaatggctttatgttaaggtgtgcaacttccacagaattttcattggacattaggctttgaaaaatcaaccgataccaattttttccttgacacaaagggaaattatatgagcgttcaaagtgtacgcataatacattcattggctagctgtctagggaggtatgtgttgcataaatgatccccttgcttgggttcatgggaagaagtgcgatgagaaaacgatatagtcatacttaaaaataatcttattttgccaatagtattttgtccgtaatctcgattgttggtcaaatcaacagttcaccagaagccatgtgcttctaacagtgattcacacagcatatttgtagttacgatgtcttactatattaggatttgtatagttgcacgaatctggctacatctgcccttgtttcatttctgtgtgcctacacaatagtatgaacttacacccttcttgctgaaatacttctagagttacgtgtagcttcagaaaagaataccagaacacttgacgctgacatttgcgatagccctctaaatttatttaaacataagtaatatgcaattttgcaccatctgttcatgtaaaaccgcagcttgtgacatttaacacattaaaatatcatcttccaccatgtaatttggacaaattgagcactcttccaccatgtaaaagcatgtttattgttacaggtttgcctcattccgacaatgagatggaaatggtgcattgagacctctgtgggcacatccacgaaatggctcatatatccatgtgaacaaagacccaggtgtgtccaacatgacctgtgatgtcaggagctaaccaaatggagggtgagaatcggcttgaccgttctgttatgccattgcaaaacaaggaattcactttcacctcctgtgtgggtgaataagccagctcagacatgcccccaaagaaatcaccttcagtatggcacagcatcctaacaggacaatgaatggcctctggccattgctacaccagcatttgggtgcatcccacctcacataatgttcatgaaccactgaacctggttcagagagcccaatttctgtgaacttagaaggtggaagtggtgtgttaacttacaaatagtgcaagctgctgtgtttacaatcagatggtgggcaatgcaacttactctttaaacaaaattgatttttaacccacaaagggcactgatatacatctttgaataaaaattacaagaacggtagaggaagcacgacatatatagaaagccttcccttattgatttccataataaattttgcaaagactgctcatagtaagctaaccagtcagcagaaaaatgtttaaagtacttcattccacaccatgcaatatggaacagattatacgtgct

SEQ ID NO: 23091 - DNA, 1501 bp, Oryza sativa
gcaaatataatctatagcggaagatttcaaaaataaatcatatttgaacaaaagaaaatacatcataatttctaaagaaaatagaagtaccttgccgcataatttggattacatgttccttctttggtttttttgtgttctgatgcacagatgttttttatctactcaattctttgataagtgatgtttgagtcattgacctgctctggtatctctgtattggctaaaatctcagttggttctttcccggtctcagcagagtccatctatgtcaattaacaatttcagccttaaacaatttcttcttaacaaatgctaaatatccaccatccttgttttctcttaacaagaaacagaaaaaaaaatcaagtatcatgctctatcattgcgttccagaaattgaaattgtatattttttttatcattcattcaagtaaaatcacagtttacatgacttacaatttgcctccaatttacagttttactccaattctcaagaacccaaattgaaacctactggactcctaatcctacaatatgaaaaataacatccaattagttttgtctataaccagtgaagttgattgaaaaataaatagatgaagcattatttgttaccttgatggacttattcgtggctgatattgtgaaagtttggccggatgctggctgttgcccctggactggacgatcagcgacgggttggccggcagccagtgagtgcggcgtccctagccgtgacccactgccgttctccaagcgagggggaaggcgacggcgagatgttctcgggagacacggcgtatggaaaccaaagagacgtggaagagtagcggcgtacgggatgagccgagaaaagatcgaggcattccacttctcctcttcctgatgggctgacgggctgctatttgggccaaggggcgccggcggtggaggtgtagcggggcgcggtgaaaaagtgggaggcgcggcgtcgccagttggatcgcggcgctgctatacgtacgactaatttgttacgacggttgtacgatgaaacgtttctcttctaggctcataacgctgattaacgttgcaagttctggtcccacactggacctcttctaacgctgagccggcccatatccaaaaccccaagctcatcacatcatcgtcctgacatcttataattaaagcctcctggcacagctaaccagagtaatttatttttcctaatcaatcttatatactcgtactgtcgctcaacacttatcatgtaacctagcttaagttaagtaaattattttgacatgaacctagttttacaaatactccatccgtcctataatataatggattttgactttttcttacaatgtttgatcactcgttttattcaaaaaatttgtgcaaatataaaaaactaaaagttgtgtttaaagtactttagaataaataataattctaattttttttaaataagacgaatggtcaaacagtgcaagcaaaaagtcaaaatgtc

SEQ ID NO: 23092 - DNA, 612 bp, Oryza sativa
tttaaagccttaccaaatcaaatatttgagagtagaaacttatggaattatcaaaatgtgatagagtagcaattgcaaataacatgtttgatttcttgtcatcctaaaagttgctaatactaaaattcgatagagttaaaaatggtaacagtttatattaaccacgtataaatatgaatacattattgaagcatgatgtatataaggtatattaaaaataaccatataatttataattaagaacaagaaaatacgataatttaaaattcatgaatggtcaaaactgagataacaccgatcaaaagcgataaataaaatagtactccctccgtttcacaatataagactttctagcattgcccacaatataagacacatatatatatatgtctagattcattaacatgtaaataaatatgggcaaatgctagaaagtctttcacattttggtccttttaaaaaacttatttcgcaaatagacccctagaaaaacttatcccaaaaatggtcctttttggggcgccagagtggacgacggcgctagccactctggcgccgtccccctgccgacgtggcggggcgatgctgaggtggctagggagtgcgccagag

SEQ ID NO: 23093 - DNA, 1501 bp, Oryza sativa
agatttgaggaggtgagagagagagagagagtcatctctcttctttgtatcccccgtcgccaacttctcctaccaacttctctctctctttttttctcctcctcctcttcttcttggtggccgctcgccgccgccgacgccgacgccgccggcgggtctcgtcgtcggtacgtgttactacgggggccggtctgtggcccctaccctccgtcgccgtcgtcttttcttgttcgcgtgtgcgtttatttctcggccagaggttggcggcttccggcggttcttggattccggcaggattgatcggcgtggtgtttcttggcccccccgcgaattccggcggcattctgatggcgtgcttcttctctcttctttttttctcttgctggttgttttgttgagttcgtgtggggtggtaggattggaaggtggcggtggttggggggtctttgggtggtgagggaagggggtgaattctctgtgttcttgggggttgttgttgttatcatctgagcctcttaggattggttgggtggcggaaggttggttgttgccacctgccctgttcgtgtttgcgattgatttgtactacacagtgggtgcttctcctatgtgcaaatcagataattccgcggtaacaaagtcagcgtaggattatgttggtgatgatgatgactagtgtgcctgaaaattccatctttgcagtagtccttggcttgataatacagatagattctttgcagagttcgtgcacttcactgtcacaacaaagaaatcttttttcctcaagagttaaattctagtaggattcgttggattctgtaggccctggagtgtgcttgctaggtctgtgctaactgttagtggtgactggtgacaagtacatcaccttgatttcttcttttttttttcactcactatttttagggcgtttatttggttactcctttcgccgagtttcagttaaagctgacctgtgcctccacgtgacgttagtggggcttttgtcagatgatacagctctgttgaggatcgtgctggacattgctgcactgtcagcatccttgttcctttgctgtctatttgagccctcaatttccagtgcctgtagtactcttcactgtctccatggaagttgtaggcctgttgaatgttgatgtcttattgtcaacagttttgttcccagagattgataactcacatgagtttatcagtttttgtagtacgattggctcctttagattccattttattgattagtaacttaatgctaataagtaaaaagatatgagtgtgatcttccacatttgtttgttagtgcattaacccgccactaggtttgccagtcgcatctatgtgctactatcacaaaacattttttttttgtctattgatgtgaagaacaaatagtcaatattattctgtatatatttggcaatatggttaagattaccattcatagggaagaaatagatatggccaataagagaagtgtaacgtaatt
